United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 22

SEQ ID NO: 825253 - RNA, 13 nt, Mycobacterium avium subsp. paratuberculosis
gccaccuggccgg

SEQ ID NO: 825254 - RNA, 19 nt, Mycobacterium avium subsp. paratuberculosis
gccaccucgaucagcggca

SEQ ID NO: 825255 - RNA, 19 nt, Mycobacterium avium subsp. paratuberculosis
gccaccucggcggcaccgc

SEQ ID NO: 825256 - RNA, 22 nt, Mycobacterium avium subsp. paratuberculosis
gccaccucggagaugauggccg

SEQ ID NO: 825257 - RNA, 15 nt, Mycobacterium avium subsp. paratuberculosis
gccaccucgucggcg

SEQ ID NO: 825258 - RNA, 18 nt, Mycobacterium avium subsp. paratuberculosis
gccacgcucucgccgguc

SEQ ID NO: 825259 - RNA, 17 nt, Mycobacterium avium subsp. paratuberculosis
gccacgcuggcguccag

SEQ ID NO: 825260 - RNA, 19 nt, Mycobacterium avium subsp. paratuberculosis
gccacgcuggcguccaggu

SEQ ID NO: 825261 - RNA, 20 nt, Mycobacterium avium subsp. paratuberculosis
gccacgcuggcguccagguc

SEQ ID NO: 825262 - RNA, 22 nt, Mycobacterium avium subsp. paratuberculosis
gccacgcuggcgugacgcucgg

SEQ ID NO: 825263 - RNA, 16 nt, Mycobacterium avium subsp. paratuberculosis
gccacgccgauggccu

SEQ ID NO: 825264 - RNA, 12 nt, Mycobacterium avium subsp. paratuberculosis
gccacgccgccc

SEQ ID NO: 825265 - RNA, 21 nt, Mycobacterium avium subsp. paratuberculosis
gccacgcucgggccggcgccg

SEQ ID NO: 825266 - RNA, 22 nt, Mycobacterium avium subsp. paratuberculosis
gccacgcucgggccggcgccga

SEQ ID NO: 825267 - RNA, 16 nt, Mycobacterium avium subsp. paratuberculosis
gccacgcccuggccgc

SEQ ID NO: 825268 - RNA, 21 nt, Mycobacterium avium subsp. paratuberculosis
gccacgcccuggccgccggcc

SEQ ID NO: 825269 - RNA, 13 nt, Mycobacterium avium subsp. paratuberculosis
gccacgccgacca

SEQ ID NO: 825270 - RNA, 21 nt, Mycobacterium avium subsp. paratuberculosis
gccacgccgaccagguccggu

SEQ ID NO: 825271 - RNA, 17 nt, Mycobacterium avium subsp. paratuberculosis
gccacgccgacuagcgc

SEQ ID NO: 825272 - RNA, 17 nt, Mycobacterium avium subsp. paratuberculosis
gccacgcccgcagcgca

SEQ ID NO: 825273 - RNA, 20 nt, Mycobacterium avium subsp. paratuberculosis
gccacgccccauugccgcgc

SEQ ID NO: 825274 - RNA, 21 nt, Mycobacterium avium subsp. paratuberculosis
gccacgccccauugccgcgcc

SEQ ID NO: 825275 - RNA, 22 nt, Mycobacterium avium subsp. paratuberculosis
gccacgccccauugccgcgccg

SEQ ID NO: 825276 - RNA, 15 nt, Mycobacterium avium subsp. paratuberculosis
gccacgccccggcgc

SEQ ID NO: 825277 - RNA, 17 nt, Mycobacterium avium subsp. paratuberculosis
gccacgccccggcgccg

SEQ ID NO: 825278 - RNA, 20 nt, Mycobacterium avium subsp. paratuberculosis
gccacgccccggcgccgucg

SEQ ID NO: 825279 - RNA, 22 nt, Mycobacterium avium subsp. paratuberculosis
gccacgccccggcgccgucguu

SEQ ID NO: 825280 - RNA, 13 nt, Mycobacterium avium subsp. paratuberculosis
gccacgcccaggg

SEQ ID NO: 825281 - RNA, 16 nt, Mycobacterium avium subsp. paratuberculosis
gccacgcccagggcgc

SEQ ID NO: 825282 - RNA, 18 nt, Mycobacterium avium subsp. paratuberculosis
gccacgcccagggcgcca

SEQ ID NO: 825283 - RNA, 21 nt, Mycobacterium avium subsp. paratuberculosis
gccacgcccagggcgccagau

SEQ ID NO: 825284 - RNA, 12 nt, Mycobacterium avium subsp. paratuberculosis
gccacgcccagg

SEQ ID NO: 825285 - RNA, 17 nt, Mycobacterium avium subsp. paratuberculosis
gccacuucuccacgccg

SEQ ID NO: 825286 - RNA, 19 nt, Mycobacterium avium subsp. paratuberculosis
gccacuucuccacgccgac

SEQ ID NO: 825287 - RNA, 20 nt, Mycobacterium avium subsp. paratuberculosis
gccacuucuccacgccgacg

SEQ ID NO: 825288 - RNA, 21 nt, Mycobacterium avium subsp. paratuberculosis
gccacuucuccacgccgacga

SEQ ID NO: 825289 - RNA, 14 nt, Mycobacterium avium subsp. paratuberculosis
gccagcaccagcag

SEQ ID NO: 825290 - RNA, 16 nt, Mycobacterium avium subsp. paratuberculosis
gccagcaccagcagcc

SEQ ID NO: 825291 - RNA, 14 nt, Mycobacterium avium subsp. paratuberculosis
gccagcaccagcgc

SEQ ID NO: 825292 - RNA, 16 nt, Mycobacterium avium subsp. paratuberculosis
gccagcaccagcgcgc

SEQ ID NO: 825293 - RNA, 17 nt, Mycobacterium avium subsp. paratuberculosis
gccagcaccagcgcgcg

SEQ ID NO: 825294 - RNA, 15 nt, Mycobacterium avium subsp. paratuberculosis
gccagcaaccccgcg

SEQ ID NO: 825295 - RNA, 18 nt, Mycobacterium avium subsp. paratuberculosis
gccagcaaccccgcggug

SEQ ID NO: 825296 - RNA, 22 nt, Mycobacterium avium subsp. paratuberculosis
gccagcaaccccgcggugcacg

SEQ ID NO: 825297 - RNA, 16 nt, Mycobacterium avium subsp. paratuberculosis
gccagcaaccgccgug

SEQ ID NO: 825298 - RNA, 17 nt, Mycobacterium avium subsp. paratuberculosis
gccagcaacgacccggc

SEQ ID NO: 825299 - RNA, 21 nt, Mycobacterium avium subsp. paratuberculosis
gccagcaacgacccggccacc

SEQ ID NO: 825300 - RNA, 13 nt, Mycobacterium avium subsp. paratuberculosis
gccagcaacacca

SEQ ID NO: 825301 - RNA, 23 nt, Mycobacterium avium subsp. paratuberculosis
gccagcaacaccagcuggauggc

SEQ ID NO: 825302 - RNA, 17 nt, Mycobacterium avium subsp. paratuberculosis
gccagcaacacccagcc

SEQ ID NO: 825303 - RNA, 20 nt, Mycobacterium avium subsp. paratuberculosis
gccagcaacacccagccgcu

SEQ ID NO: 825304 - RNA, 14 nt, Mycobacterium avium subsp. paratuberculosis
gccagcaacagcag

SEQ ID NO: 825305 - RNA, 15 nt, Mycobacterium avium subsp. paratuberculosis
gccagcaacagcagc

SEQ ID NO: 825306 - RNA, 16 nt, Mycobacterium avium subsp. paratuberculosis
gccagcaacagcagcg

SEQ ID NO: 825307 - RNA, 18 nt, Mycobacterium avium subsp. paratuberculosis
gccagcaacagcagcggc

SEQ ID NO: 825308 - RNA, 19 nt, Mycobacterium avium subsp. paratuberculosis
gccagcaacagcagcggca

SEQ ID NO: 825309 - RNA, 15 nt, Mycobacterium avium subsp. paratuberculosis
gccagauagggcagc

SEQ ID NO: 825310 - RNA, 22 nt, Mycobacterium avium subsp. paratuberculosis
gccagauagaugagccgcagcc

SEQ ID NO: 825311 - RNA, 16 nt, Mycobacterium avium subsp. paratuberculosis
gccagcacccgcucgc

SEQ ID NO: 825312 - RNA, 18 nt, Mycobacterium avium subsp. paratuberculosis
gccagcacccgcucgcgg

SEQ ID NO: 825313 - RNA, 23 nt, Mycobacterium avium subsp. paratuberculosis
gccagcacccgcugauccagcag

SEQ ID NO: 825314 - RNA, 12 nt, Mycobacterium avium subsp. paratuberculosis
gccagcacccgg

SEQ ID NO: 825315 - RNA, 14 nt, Mycobacterium avium subsp. paratuberculosis
gccagcaccggcgc

SEQ ID NO: 825316 - RNA, 15 nt, Mycobacterium avium subsp. paratuberculosis
gccagcaccggcgcg

SEQ ID NO: 825317 - RNA, 18 nt, Mycobacterium avium subsp. paratuberculosis
gccagcaccggcgcgccg

SEQ ID NO: 825318 - RNA, 14 nt, Mycobacterium avium subsp. paratuberculosis
gccagcaccgggcc

SEQ ID NO: 825319 - RNA, 23 nt, Mycobacterium avium subsp. paratuberculosis
gccagcaccgggcccagcucggu

SEQ ID NO: 825320 - RNA, 19 nt, Mycobacterium avium subsp. paratuberculosis
gccagcaccgucagccagg

SEQ ID NO: 825321 - RNA, 12 nt, Mycobacterium avium subsp. paratuberculosis
gccagcaccgug

SEQ ID NO: 825322 - RNA, 21 nt, Mycobacterium avium subsp. paratuberculosis
gccagcaccgugcugauccac

SEQ ID NO: 825323 - RNA, 19 nt, Mycobacterium avium subsp. paratuberculosis
gccagcaccgacagcuuga

SEQ ID NO: 825324 - RNA, 21 nt, Mycobacterium avium subsp. paratuberculosis
gccagcaccgacagucccacc

SEQ ID NO: 825325 - RNA, 17 nt, Mycobacterium avium subsp. paratuberculosis
gccagcaccgacgcgcc

SEQ ID NO: 825326 - RNA, 13 nt, Mycobacterium avium subsp. paratuberculosis
gccagcaccgcca

SEQ ID NO: 825327 - RNA, 14 nt, Mycobacterium avium subsp. paratuberculosis
gccagcaccgccac

SEQ ID NO: 825328 - RNA, 16 nt, Mycobacterium avium subsp. paratuberculosis
gccagcaccgccaccg

SEQ ID NO: 825329 - RNA, 21 nt, Mycobacterium avium subsp. paratuberculosis
gccagcaccgccaccggcccg

SEQ ID NO: 825330 - RNA, 23 nt, Mycobacterium avium subsp. paratuberculosis
gccagcaccgccaccggcccggc

SEQ ID NO: 825331 - RNA, 12 nt, Mycobacterium avium subsp. paratuberculosis
gccagcaccgcg

SEQ ID NO: 825332 - RNA, 18 nt, Mycobacterium avium subsp. paratuberculosis
gccagcaccgcggccguc

SEQ ID NO: 825333 - RNA, 21 nt, Mycobacterium avium subsp. paratuberculosis
gccagcaccgcggccgucgcg

SEQ ID NO: 825334 - RNA, 15 nt, Mycobacterium avium subsp. paratuberculosis
gccagcaccgcggcg

SEQ ID NO: 825335 - RNA, 16 nt, Mycobacterium avium subsp. paratuberculosis
gccagcaccgcggcga

SEQ ID NO: 825336 - RNA, 17 nt, Mycobacterium avium subsp. paratuberculosis
gccagcaccgcggcgau

SEQ ID NO: 825337 - RNA, 18 nt, Mycobacterium avium subsp. paratuberculosis
gccagcaccgcggcgauc

SEQ ID NO: 825338 - RNA, 17 nt, Mycobacterium avium subsp. paratuberculosis
gccagcaccgcgggggc

SEQ ID NO: 825339 - RNA, 18 nt, Mycobacterium avium subsp. paratuberculosis
gccagcaccgcgggggcg

SEQ ID NO: 825340 - RNA, 13 nt, Mycobacterium avium subsp. paratuberculosis
gccagcaccgcgu

SEQ ID NO: 825341 - RNA, 15 nt, Mycobacterium avium subsp. paratuberculosis
gccagcaccgcgucg

SEQ ID NO: 825342 - RNA, 16 nt, Mycobacterium avium subsp. paratuberculosis
gccagcaccgcgucga

SEQ ID NO: 825343 - RNA, 12 nt, Mycobacterium avium subsp. paratuberculosis
gccagcaccggc

SEQ ID NO: 825344 - RNA, 15 nt, Mycobacterium avium subsp. paratuberculosis
gccagcacggccagc

SEQ ID NO: 825345 - RNA, 15 nt, Mycobacterium avium subsp. paratuberculosis
gccagcacgccgguc

SEQ ID NO: 825346 - RNA, 18 nt, Mycobacterium avium subsp. paratuberculosis
gccagcacgccggucagc

SEQ ID NO: 825347 - RNA, 20 nt, Mycobacterium avium subsp. paratuberculosis
gccagcacgccggucagcac

SEQ ID NO: 825348 - RNA, 15 nt, Mycobacterium avium subsp. paratuberculosis
gccagcacgccgucc

SEQ ID NO: 825349 - RNA, 16 nt, Mycobacterium avium subsp. paratuberculosis
gccagcacgcugcgga

SEQ ID NO: 825350 - RNA, 21 nt, Mycobacterium avium subsp. paratuberculosis
gccagcacgcccccgcuggcc

SEQ ID NO: 825351 - RNA, 18 nt, Mycobacterium avium subsp. paratuberculosis
gccagcacgaccccgccc

SEQ ID NO: 825352 - RNA, 14 nt, Mycobacterium avium subsp. paratuberculosis
gccagcaccuggcg

SEQ ID NO: 825353 - RNA, 20 nt, Mycobacterium avium subsp. paratuberculosis
gccagcaccuggcgcaccgc

SEQ ID NO: 825354 - RNA, 21 nt, Mycobacterium avium subsp. paratuberculosis
gccagcaccuggcgcaccgcc

SEQ ID NO: 825355 - RNA, 17 nt, Mycobacterium avium subsp. paratuberculosis
gccagcaccuucagcgg

SEQ ID NO: 825356 - RNA, 18 nt, Mycobacterium avium subsp. paratuberculosis
gccagcaccuucgggccg

SEQ ID NO: 825357 - RNA, 19 nt, Mycobacterium avium subsp. paratuberculosis
gccagcaccuucgggccga

SEQ ID NO: 825358 - RNA, 17 nt, Mycobacterium avium subsp. paratuberculosis
gccagcaccucgaacgc

SEQ ID NO: 825359 - RNA, 19 nt, Mycobacterium avium subsp. paratuberculosis
gccagcaccucgaacgccg

SEQ ID NO: 825360 - RNA, 19 nt, Mycobacterium avium subsp. paratuberculosis
gccagcaccaguucgcgua

SEQ ID NO: 825361 - RNA, 15 nt, Mycobacterium avium subsp. paratuberculosis
gccagcaccucgcgg

SEQ ID NO: 825362 - RNA, 15 nt, Mycobacterium avium subsp. paratuberculosis
gccagcaccucggcg

SEQ ID NO: 825363 - RNA, 22 nt, Mycobacterium avium subsp. paratuberculosis
gccagcaccucggcgaccacgu

SEQ ID NO: 825364 - RNA, 21 nt, Mycobacterium avium subsp. paratuberculosis
gccagcagauacuccucgcgg

SEQ ID NO: 825365 - RNA, 21 nt, Mycobacterium avium subsp. paratuberculosis
gccagcacgguguugcgcacc

SEQ ID NO: 825366 - RNA, 18 nt, Mycobacterium avium subsp. paratuberculosis
gccagcacgugaugcagc

SEQ ID NO: 825367 - RNA, 22 nt, Mycobacterium avium subsp. paratuberculosis
gccagcacguggccgggcucga

SEQ ID NO: 825368 - RNA, 22 nt, Mycobacterium avium subsp. paratuberculosis
gccagcacggccagccagccgc

SEQ ID NO: 825369 - RNA, 17 nt, Mycobacterium avium subsp. paratuberculosis
gccagcacgcaggcgug

SEQ ID NO: 825370 - RNA, 16 nt, Mycobacterium avium subsp. paratuberculosis
gccagcacggcggcgu

SEQ ID NO: 825371 - RNA, 17 nt, Mycobacterium avium subsp. paratuberculosis
gccagcacggucagcgg

SEQ ID NO: 825372 - RNA, 18 nt, Mycobacterium avium subsp. paratuberculosis
gccagcacggucagcggc

SEQ ID NO: 825373 - RNA, 19 nt, Mycobacterium avium subsp. paratuberculosis
gccagcacggucagcggcc

SEQ ID NO: 825374 - RNA, 23 nt, Mycobacterium avium subsp. paratuberculosis
gccagcacggucagcggccagcc

SEQ ID NO: 825375 - RNA, 16 nt, Mycobacterium avium subsp. paratuberculosis
gccagcagcagcgcgg

SEQ ID NO: 825376 - RNA, 18 nt, Mycobacterium avium subsp. paratuberculosis
gccagcagcagcgcggca

SEQ ID NO: 825377 - RNA, 18 nt, Mycobacterium avium subsp. paratuberculosis
gccagcagcaacgcggug

SEQ ID NO: 825378 - RNA, 12 nt, Mycobacterium avium subsp. paratuberculosis
gccagcagcacc

SEQ ID NO: 825379 - RNA, 13 nt, Mycobacterium avium subsp. paratuberculosis
gccagcagcacca

SEQ ID NO: 825380 - RNA, 15 nt, Mycobacterium avium subsp. paratuberculosis
gccagcagcaccagg

SEQ ID NO: 825381 - RNA, 20 nt, Mycobacterium avium subsp. paratuberculosis
gccagcagcaccagggcgug

SEQ ID NO: 825382 - RNA, 13 nt, Mycobacterium avium subsp. paratuberculosis
gccagcagcaccu

SEQ ID NO: 825383 - RNA, 13 nt, Mycobacterium avium subsp. paratuberculosis
gccagcagcacgg

SEQ ID NO: 825384 - RNA, 14 nt, Mycobacterium avium subsp. paratuberculosis
gccagcagcacggc

SEQ ID NO: 825385 - RNA, 21 nt, Mycobacterium avium subsp. paratuberculosis
gccagcagcagcaggucgucg

SEQ ID NO: 825386 - RNA, 15 nt, Mycobacterium avium subsp. paratuberculosis
gccagcagcagcccg

SEQ ID NO: 825387 - RNA, 21 nt, Mycobacterium avium subsp. paratuberculosis
gccagcagcagcccgccgaug

SEQ ID NO: 825388 - RNA, 16 nt, Mycobacterium avium subsp. paratuberculosis
gccagcagcagccgcg

SEQ ID NO: 825389 - RNA, 17 nt, Mycobacterium avium subsp. paratuberculosis
gccagcagcagccgcgc

SEQ ID NO: 825390 - RNA, 18 nt, Mycobacterium avium subsp. paratuberculosis
gccagcagcagccgcgcc

SEQ ID NO: 825391 - RNA, 21 nt, Mycobacterium avium subsp. paratuberculosis
gccagcagcagccgcgccgcc

SEQ ID NO: 825392 - RNA, 22 nt, Mycobacterium avium subsp. paratuberculosis
gccagcagcagccgcgccgccg

SEQ ID NO: 825393 - RNA, 13 nt, Mycobacterium avium subsp. paratuberculosis
gccagcagcagcg

SEQ ID NO: 825394 - RNA, 21 nt, Mycobacterium avium subsp. paratuberculosis
gccagcgcgcgggcguccucg

SEQ ID NO: 825395 - RNA, 20 nt, Mycobacterium avium subsp. paratuberculosis
gccagcgcgcgaucagcgcc

SEQ ID NO: 825396 - RNA, 21 nt, Mycobacterium avium subsp. paratuberculosis
gccagcgcgcgaucagcgccg

SEQ ID NO: 825397 - RNA, 15 nt, Mycobacterium avium subsp. paratuberculosis
gccagcgcgccgccg

SEQ ID NO: 825398 - RNA, 16 nt, Mycobacterium avium subsp. paratuberculosis
gccagcgcgccgccga

SEQ ID NO: 825399 - RNA, 18 nt, Mycobacterium avium subsp. paratuberculosis
gccagcgcgccgccgaug

SEQ ID NO: 825400 - RNA, 15 nt, Mycobacterium avium subsp. paratuberculosis
gccagcgcgccgcac

SEQ ID NO: 825401 - RNA, 21 nt, Mycobacterium avium subsp. paratuberculosis
gccagcgcgccgcacagccgg

SEQ ID NO: 825402 - RNA, 13 nt, Mycobacterium avium subsp. paratuberculosis
gccagcgcgccga

SEQ ID NO: 825403 - RNA, 11 nt, Mycobacterium avium subsp. paratuberculosis
gccagcgcgcc

SEQ ID NO: 825404 - RNA, 18 nt, Mycobacterium avium subsp. paratuberculosis
gccagcgcgacggccucg

SEQ ID NO: 825405 - RNA, 12 nt, Mycobacterium avium subsp. paratuberculosis
gccagcgcgauc

SEQ ID NO: 825406 - RNA, 16 nt, Mycobacterium avium subsp. paratuberculosis
gccagcgcgaucgccg

SEQ ID NO: 825407 - RNA, 18 nt, Mycobacterium avium subsp. paratuberculosis
gccagcgcgaucgccggg

SEQ ID NO: 825408 - RNA, 20 nt, Mycobacterium avium subsp. paratuberculosis
gccagcgcgaucgccgggau

SEQ ID NO: 825409 - RNA, 22 nt, Mycobacterium avium subsp. paratuberculosis
gccagcgcgaucgccgggaugg

SEQ ID NO: 825410 - RNA, 12 nt, Mycobacterium avium subsp. paratuberculosis
gccagcgccgcg

SEQ ID NO: 825411 - RNA, 13 nt, Mycobacterium avium subsp. paratuberculosis
gccagcgccgcgc

SEQ ID NO: 825412 - RNA, 14 nt, Mycobacterium avium subsp. paratuberculosis
gccagcgcgacggc

SEQ ID NO: 825413 - RNA, 18 nt, Mycobacterium avium subsp. paratuberculosis
gccagcgccgcccgggcg

SEQ ID NO: 825414 - RNA, 20 nt, Mycobacterium avium subsp. paratuberculosis
gccagcgccgcccgggcggc

SEQ ID NO: 825415 - RNA, 22 nt, Mycobacterium avium subsp. paratuberculosis
gccagcgccgcccgggcggccc

SEQ ID NO: 825416 - RNA, 19 nt, Mycobacterium avium subsp. paratuberculosis
gccagcgccgccagccgca

SEQ ID NO: 825417 - RNA, 21 nt, Mycobacterium avium subsp. paratuberculosis
gccagcgccgccagccgcagc

SEQ ID NO: 825418 - RNA, 12 nt, Mycobacterium avium subsp. paratuberculosis
gccagcgccgca

SEQ ID NO: 825419 - RNA, 14 nt, Mycobacterium avium subsp. paratuberculosis
gccagcgccgcacu

SEQ ID NO: 825420 - RNA, 13 nt, Mycobacterium avium subsp. paratuberculosis
gccagcgccgaga

SEQ ID NO: 825421 - RNA, 14 nt, Mycobacterium avium subsp. paratuberculosis
gccagcgccgagau

SEQ ID NO: 825422 - RNA, 19 nt, Mycobacterium avium subsp. paratuberculosis
gccagcgccgagaucgcgg

SEQ ID NO: 825423 - RNA, 13 nt, Mycobacterium avium subsp. paratuberculosis
gccagcgccgagc

SEQ ID NO: 825424 - RNA, 21 nt, Mycobacterium avium subsp. paratuberculosis
gccagcgggauacccaugauc

SEQ ID NO: 825425 - RNA, 12 nt, Mycobacterium avium subsp. paratuberculosis
gccagcgggccg

SEQ ID NO: 825426 - RNA, 17 nt, Mycobacterium avium subsp. paratuberculosis
gccagcgggccgaccug

SEQ ID NO: 825427 - RNA, 21 nt, Mycobacterium avium subsp. paratuberculosis
gccagcgggccgaccuggcgg

SEQ ID NO: 825428 - RNA, 15 nt, Mycobacterium avium subsp. paratuberculosis
gccagcgggccgugc

SEQ ID NO: 825429 - RNA, 18 nt, Mycobacterium avium subsp. paratuberculosis
gccagcgggccgugccgc

SEQ ID NO: 825430 - RNA, 21 nt, Mycobacterium avium subsp. paratuberculosis
gccagcgggccgugccgccau

SEQ ID NO: 825431 - RNA, 16 nt, Mycobacterium avium subsp. paratuberculosis
gccagcgggccguugc

SEQ ID NO: 825432 - RNA, 12 nt, Mycobacterium avium subsp. paratuberculosis
gccagcgcggcc

SEQ ID NO: 825433 - RNA, 17 nt, Mycobacterium avium subsp. paratuberculosis
gccagcgcggccgggcg

SEQ ID NO: 825434 - RNA, 18 nt, Mycobacterium avium subsp. paratuberculosis
gccagcgcggccgggcgc

SEQ ID NO: 825435 - RNA, 13 nt, Mycobacterium avium subsp. paratuberculosis
gccagcgcggccg

SEQ ID NO: 825436 - RNA, 16 nt, Mycobacterium avium subsp. paratuberculosis
gccagcgcgccgaucg

SEQ ID NO: 825437 - RNA, 13 nt, Mycobacterium avium subsp. paratuberculosis
gccagcgcgcggc

SEQ ID NO: 825438 - RNA, 15 nt, Mycobacterium avium subsp. paratuberculosis
gccagcggucacgga

SEQ ID NO: 825439 - RNA, 15 nt, Mycobacterium avium subsp. paratuberculosis
gccagcgguccagcg

SEQ ID NO: 825440 - RNA, 22 nt, Mycobacterium avium subsp. paratuberculosis
gccagcgggugauggccgccgc

SEQ ID NO: 825441 - RNA, 15 nt, Mycobacterium avium subsp. paratuberculosis
gccagcgggucgugc

SEQ ID NO: 825442 - RNA, 20 nt, Mycobacterium avium subsp. paratuberculosis
gccagcgggucgugcaucgg

SEQ ID NO: 825443 - RNA, 15 nt, Mycobacterium avium subsp. paratuberculosis
gccagcgggcggccc

SEQ ID NO: 825444 - RNA, 22 nt, Mycobacterium avium subsp. paratuberculosis
gccagcgggcggccccgggcgc

SEQ ID NO: 825445 - RNA, 14 nt, Mycobacterium avium subsp. paratuberculosis
gccagcuccagcag

SEQ ID NO: 825446 - RNA, 15 nt, Mycobacterium avium subsp. paratuberculosis
gccagcuccagcagc

SEQ ID NO: 825447 - RNA, 16 nt, Mycobacterium avium subsp. paratuberculosis
gccagcuccagcagcc

SEQ ID NO: 825448 - RNA, 18 nt, Mycobacterium avium subsp. paratuberculosis
gccagcuccagcagcccg

SEQ ID NO: 825449 - RNA, 22 nt, Mycobacterium avium subsp. paratuberculosis
gccagcuccagcagcccgggcu

SEQ ID NO: 825450 - RNA, 23 nt, Mycobacterium avium subsp. paratuberculosis
gccagcuccagcagcccgggcug

SEQ ID NO: 825451 - RNA, 13 nt, Mycobacterium avium subsp. paratuberculosis
gccagcuccagca

SEQ ID NO: 825452 - RNA, 18 nt, Mycobacterium avium subsp. paratuberculosis
gccagcguuuccagcgcc

SEQ ID NO: 825453 - RNA, 19 nt, Mycobacterium avium subsp. paratuberculosis
gccagcguuuccagcgccg

SEQ ID NO: 825454 - RNA, 21 nt, Mycobacterium avium subsp. paratuberculosis
gccagcguuuccagcgccggc

SEQ ID NO: 825455 - RNA, 21 nt, Mycobacterium avium subsp. paratuberculosis
gccagcguuuggccugcggca

SEQ ID NO: 825456 - RNA, 15 nt, Mycobacterium avium subsp. paratuberculosis
gccagcucccgggcg

SEQ ID NO: 825457 - RNA, 16 nt, Mycobacterium avium subsp. paratuberculosis
gccagcucccgggcgg

SEQ ID NO: 825458 - RNA, 22 nt, Mycobacterium avium subsp. paratuberculosis
gccagcucccgggcggcgccga

SEQ ID NO: 825459 - RNA, 15 nt, Mycobacterium avium subsp. paratuberculosis
gccagcuccgggucg

SEQ ID NO: 825460 - RNA, 16 nt, Mycobacterium avium subsp. paratuberculosis
gccagcuccgggucga

SEQ ID NO: 825461 - RNA, 20 nt, Mycobacterium avium subsp. paratuberculosis
gccagcuccgggucgaccgc

SEQ ID NO: 825462 - RNA, 16 nt, Mycobacterium avium subsp. paratuberculosis
gccagcuccgccaccc

SEQ ID NO: 825463 - RNA, 18 nt, Mycobacterium avium subsp. paratuberculosis
gccagcugcccgccgacg

SEQ ID NO: 825464 - RNA, 13 nt, Mycobacterium avium subsp. paratuberculosis
gccagcugccgcg

SEQ ID NO: 825465 - RNA, 16 nt, Mycobacterium avium subsp. paratuberculosis
gccagcugccgcgacu

SEQ ID NO: 825466 - RNA, 18 nt, Mycobacterium avium subsp. paratuberculosis
gccagcugcgacagcacg

SEQ ID NO: 825467 - RNA, 19 nt, Mycobacterium avium subsp. paratuberculosis
gccagcugcgacagcacgg

SEQ ID NO: 825468 - RNA, 23 nt, Mycobacterium avium subsp. paratuberculosis
gccagcugcgacagcacgggcgg

SEQ ID NO: 825469 - RNA, 22 nt, Mycobacterium avium subsp. paratuberculosis
gccagcugaacacgaacccggc

SEQ ID NO: 825470 - RNA, 15 nt, Mycobacterium avium subsp. paratuberculosis
gccagcugauagccg

SEQ ID NO: 825471 - RNA, 15 nt, Mycobacterium avium subsp. paratuberculosis
gccagcugcaccggg

SEQ ID NO: 825472 - RNA, 16 nt, Mycobacterium avium subsp. paratuberculosis
gccagcugcaccgggg

SEQ ID NO: 825473 - RNA, 19 nt, Mycobacterium avium subsp. paratuberculosis
gccagcugcaccggggccg

SEQ ID NO: 825474 - RNA, 22 nt, Mycobacterium avium subsp. paratuberculosis
gccagcuggguggucaccagcg

SEQ ID NO: 825475 - RNA, 23 nt, Mycobacterium avium subsp. paratuberculosis
gccagcuggguggucaccagcgc

SEQ ID NO: 825476 - RNA, 17 nt, Mycobacterium avium subsp. paratuberculosis
gccagcuggucguagcg

SEQ ID NO: 825477 - RNA, 18 nt, Mycobacterium avium subsp. paratuberculosis
gccagcugggcagccaga

SEQ ID NO: 825478 - RNA, 18 nt, Mycobacterium avium subsp. paratuberculosis
gccagcuucaccggucgg

SEQ ID NO: 825479 - RNA, 21 nt, Mycobacterium avium subsp. paratuberculosis
gccagcuucaccggucgggcc

SEQ ID NO: 825480 - RNA, 14 nt, Mycobacterium avium subsp. paratuberculosis
gccagcugggcagc

SEQ ID NO: 825481 - RNA, 17 nt, Mycobacterium avium subsp. paratuberculosis
gccagcugggcagccag

SEQ ID NO: 825482 - RNA, 12 nt, Mycobacterium avium subsp. paratuberculosis
gccagcugcggg

SEQ ID NO: 825483 - RNA, 23 nt, Mycobacterium avium subsp. paratuberculosis
gccagcugcggguugcgggccag

SEQ ID NO: 825484 - RNA, 19 nt, Mycobacterium avium subsp. paratuberculosis
gccagcugcgcgucggccg

SEQ ID NO: 825485 - RNA, 12 nt, Mycobacterium avium subsp. paratuberculosis
gccagcugcgga

SEQ ID NO: 825486 - RNA, 17 nt, Mycobacterium avium subsp. paratuberculosis
gccagcugcggaucggg

SEQ ID NO: 825487 - RNA, 21 nt, Mycobacterium avium subsp. paratuberculosis
gccagcugcggaucgggcgug

SEQ ID NO: 825488 - RNA, 21 nt, Mycobacterium avium subsp. paratuberculosis
gccagcuugcagcuguccugc

SEQ ID NO: 825489 - RNA, 17 nt, Mycobacterium avium subsp. paratuberculosis
gccagcuucgggcgcgc

SEQ ID NO: 825490 - RNA, 18 nt, Mycobacterium avium subsp. paratuberculosis
gccaggaaccacaccccg

SEQ ID NO: 825491 - RNA, 20 nt, Mycobacterium avium subsp. paratuberculosis
gccaggaaccacaccccggc

SEQ ID NO: 825492 - RNA, 15 nt, Mycobacterium avium subsp. paratuberculosis
gccagcgccaccccc

SEQ ID NO: 825493 - RNA, 17 nt, Mycobacterium avium subsp. paratuberculosis
gccagcgccacccccca

SEQ ID NO: 825494 - RNA, 16 nt, Mycobacterium avium subsp. paratuberculosis
gccagcgccaugccgc

SEQ ID NO: 825495 - RNA, 17 nt, Mycobacterium avium subsp. paratuberculosis
gccagcgcccgcgcgug

SEQ ID NO: 825496 - RNA, 14 nt, Mycobacterium avium subsp. paratuberculosis
gccagcgcccgcgg

SEQ ID NO: 825497 - RNA, 18 nt, Mycobacterium avium subsp. paratuberculosis
gccagcgcccgcgggugc

SEQ ID NO: 825498 - RNA, 16 nt, Mycobacterium avium subsp. paratuberculosis
gccagcgcccgcugcg

SEQ ID NO: 825499 - RNA, 19 nt, Mycobacterium avium subsp. paratuberculosis
gccagcgcccgcugcgcgg

SEQ ID NO: 825500 - RNA, 14 nt, Mycobacterium avium subsp. paratuberculosis
gccagcgcccggcg

SEQ ID NO: 825501 - RNA, 15 nt, Mycobacterium avium subsp. paratuberculosis
gccagcgcccggcga

SEQ ID NO: 825502 - RNA, 15 nt, Mycobacterium avium subsp. paratuberculosis
gccagccgucccgcc

SEQ ID NO: 825503 - RNA, 17 nt, Mycobacterium avium subsp. paratuberculosis
gccagccgucccgccgu

SEQ ID NO: 825504 - RNA, 15 nt, Mycobacterium avium subsp. paratuberculosis
gccagcgcaccgggc

SEQ ID NO: 825505 - RNA, 13 nt, Mycobacterium avium subsp. paratuberculosis
gccagcgcagcac

SEQ ID NO: 825506 - RNA, 15 nt, Mycobacterium avium subsp. paratuberculosis
gccagcgcagcacug

SEQ ID NO: 825507 - RNA, 18 nt, Mycobacterium avium subsp. paratuberculosis
gccagcgcaguucaccga

SEQ ID NO: 825508 - RNA, 21 nt, Mycobacterium avium subsp. paratuberculosis
gccagcgcaucggucaccagc

SEQ ID NO: 825509 - RNA, 15 nt, Mycobacterium avium subsp. paratuberculosis
gccagccgugcggcg

SEQ ID NO: 825510 - RNA, 16 nt, Mycobacterium avium subsp. paratuberculosis
gccagccgugcggcgg

SEQ ID NO: 825511 - RNA, 17 nt, Mycobacterium avium subsp. paratuberculosis
gccagccgugcggcggc

SEQ ID NO: 825512 - RNA, 22 nt, Mycobacterium avium subsp. paratuberculosis
gccagccguucccggcagaacg

SEQ ID NO: 825513 - RNA, 22 nt, Mycobacterium avium subsp. paratuberculosis
gccagccgguacggaucgccgg

SEQ ID NO: 825514 - RNA, 16 nt, Mycobacterium avium subsp. paratuberculosis
gccagccggucgucgg

SEQ ID NO: 825515 - RNA, 18 nt, Mycobacterium avium subsp. paratuberculosis
gccagccggucgucgggg

SEQ ID NO: 825516 - RNA, 21 nt, Mycobacterium avium subsp. paratuberculosis
gccagccggugcggucggcgu

SEQ ID NO: 825517 - RNA, 23 nt, Mycobacterium avium subsp. paratuberculosis
gccagccggugcggucggcgucg

SEQ ID NO: 825518 - RNA, 20 nt, Mycobacterium avium subsp. paratuberculosis
gccagccggugcugacccgg

SEQ ID NO: 825519 - RNA, 18 nt, Mycobacterium avium subsp. paratuberculosis
gccagccgguggcggcca

SEQ ID NO: 825520 - RNA, 20 nt, Mycobacterium avium subsp. paratuberculosis
gccagccgguggcggccacg

SEQ ID NO: 825521 - RNA, 16 nt, Mycobacterium avium subsp. paratuberculosis
gccagccggguggccc

SEQ ID NO: 825522 - RNA, 16 nt, Mycobacterium avium subsp. paratuberculosis
gccagccgggcggcca

SEQ ID NO: 825523 - RNA, 23 nt, Mycobacterium avium subsp. paratuberculosis
gccagccggcucuuggcgaccuc

SEQ ID NO: 825524 - RNA, 12 nt, Mycobacterium avium subsp. paratuberculosis
gccagccgggcc

SEQ ID NO: 825525 - RNA, 17 nt, Mycobacterium avium subsp. paratuberculosis
gccagccgggccgagcg

SEQ ID NO: 825526 - RNA, 20 nt, Mycobacterium avium subsp. paratuberculosis
gccagccgggccgagcgcgc

SEQ ID NO: 825527 - RNA, 19 nt, Mycobacterium avium subsp. paratuberculosis
gccagccgaugcgcccgcg

SEQ ID NO: 825528 - RNA, 22 nt, Mycobacterium avium subsp. paratuberculosis
gccagccgaugcgcccgcgcca

SEQ ID NO: 825529 - RNA, 14 nt, Mycobacterium avium subsp. paratuberculosis
gccagccgcaccgc

SEQ ID NO: 825530 - RNA, 14 nt, Mycobacterium avium subsp. paratuberculosis
gccagccgcagcag

SEQ ID NO: 825531 - RNA, 15 nt, Mycobacterium avium subsp. paratuberculosis
gccagcagcggcuug

SEQ ID NO: 825532 - RNA, 21 nt, Mycobacterium avium subsp. paratuberculosis
gccagcagcgugggauccgag

SEQ ID NO: 825533 - RNA, 13 nt, Mycobacterium avium subsp. paratuberculosis
gccagcagcgcgu

SEQ ID NO: 825534 - RNA, 16 nt, Mycobacterium avium subsp. paratuberculosis
gccagcagcgcgucgc

SEQ ID NO: 825535 - RNA, 21 nt, Mycobacterium avium subsp. paratuberculosis
gccagcagcgcgucgcgggcc

SEQ ID NO: 825536 - RNA, 13 nt, Mycobacterium avium subsp. paratuberculosis
gccagcagcgcgc

SEQ ID NO: 825537 - RNA, 17 nt, Mycobacterium avium subsp. paratuberculosis
gccagcagcgcgccgcg

SEQ ID NO: 825538 - RNA, 18 nt, Mycobacterium avium subsp. paratuberculosis
gccagcagcgcgccgcgc

SEQ ID NO: 825539 - RNA, 14 nt, Mycobacterium avium subsp. paratuberculosis
gccagcagcgcggc

SEQ ID NO: 825540 - RNA, 12 nt, Mycobacterium avium subsp. paratuberculosis
gccagcagcgcg

SEQ ID NO: 825541 - RNA, 13 nt, Mycobacterium avium subsp. paratuberculosis
gccagcagcgccg

SEQ ID NO: 825542 - RNA, 13 nt, Mycobacterium avium subsp. paratuberculosis
gccagcagcgcaa

SEQ ID NO: 825543 - RNA, 13 nt, Mycobacterium avium subsp. paratuberculosis
gccagcagccgca

SEQ ID NO: 825544 - RNA, 13 nt, Mycobacterium avium subsp. paratuberculosis
gccagcagccgcg

SEQ ID NO: 825545 - RNA, 14 nt, Mycobacterium avium subsp. paratuberculosis
gccagcagccgcgc

SEQ ID NO: 825546 - RNA, 15 nt, Mycobacterium avium subsp. paratuberculosis
gccagcagccgcgcg

SEQ ID NO: 825547 - RNA, 16 nt, Mycobacterium avium subsp. paratuberculosis
gccagcagccgcgcga

SEQ ID NO: 825548 - RNA, 12 nt, Mycobacterium avium subsp. paratuberculosis
gccagcagccgg

SEQ ID NO: 825549 - RNA, 21 nt, Mycobacterium avium subsp. paratuberculosis
gccagcagccgggucaguucg

SEQ ID NO: 825550 - RNA, 19 nt, Mycobacterium avium subsp. paratuberculosis
gccagcagccgguacagcg

SEQ ID NO: 825551 - RNA, 21 nt, Mycobacterium avium subsp. paratuberculosis
gccagccccgggaaccagccc

SEQ ID NO: 825552 - RNA, 12 nt, Mycobacterium avium subsp. paratuberculosis
gccagcccgccc

SEQ ID NO: 825553 - RNA, 15 nt, Mycobacterium avium subsp. paratuberculosis
gccagcccgcggcag

SEQ ID NO: 825554 - RNA, 14 nt, Mycobacterium avium subsp. paratuberculosis
gccagcccgcgucg

SEQ ID NO: 825555 - RNA, 15 nt, Mycobacterium avium subsp. paratuberculosis
gccagcccgcgucgu

SEQ ID NO: 825556 - RNA, 15 nt, Mycobacterium avium subsp. paratuberculosis
gccagcccgcccagc

SEQ ID NO: 825557 - RNA, 18 nt, Mycobacterium avium subsp. paratuberculosis
gccagcccgcccagcgcc

SEQ ID NO: 825558 - RNA, 14 nt, Mycobacterium avium subsp. paratuberculosis
gccagcccggcgug

SEQ ID NO: 825559 - RNA, 15 nt, Mycobacterium avium subsp. paratuberculosis
gccagcccggcgugc

SEQ ID NO: 825560 - RNA, 18 nt, Mycobacterium avium subsp. paratuberculosis
gccagcccgggaaagcgg

SEQ ID NO: 825561 - RNA, 21 nt, Mycobacterium avium subsp. paratuberculosis
gccagcccgggaaagcgggug

SEQ ID NO: 825562 - RNA, 23 nt, Mycobacterium avium subsp. paratuberculosis
gccagcccggugaucgccgccca

SEQ ID NO: 825563 - RNA, 12 nt, Mycobacterium avium subsp. paratuberculosis
gccagcccgucg

SEQ ID NO: 825564 - RNA, 14 nt, Mycobacterium avium subsp. paratuberculosis
gccagcccgucggg

SEQ ID NO: 825565 - RNA, 21 nt, Mycobacterium avium subsp. paratuberculosis
gccagcccguggccagcgcca

SEQ ID NO: 825566 - RNA, 23 nt, Mycobacterium avium subsp. paratuberculosis
gccagcccguuguggcggccagc

SEQ ID NO: 825567 - RNA, 20 nt, Mycobacterium avium subsp. paratuberculosis
gccagcagcuugacgucggu

SEQ ID NO: 825568 - RNA, 14 nt, Mycobacterium avium subsp. paratuberculosis
gccauaaaccggcc

SEQ ID NO: 825569 - RNA, 15 nt, Mycobacterium avium subsp. paratuberculosis
gccauaaaccggccg

SEQ ID NO: 825570 - RNA, 19 nt, Mycobacterium avium subsp. paratuberculosis
gccauaaaccggccggcgc

SEQ ID NO: 825571 - RNA, 15 nt, Mycobacterium avium subsp. paratuberculosis
gccauccgccacccg

SEQ ID NO: 825572 - RNA, 11 nt, Mycobacterium avium subsp. paratuberculosis
gccaucccggu

SEQ ID NO: 825573 - RNA, 14 nt, Mycobacterium avium subsp. paratuberculosis
gccaucccggugcc

SEQ ID NO: 825574 - RNA, 16 nt, Mycobacterium avium subsp. paratuberculosis
gccauccgcugcgcgu

SEQ ID NO: 825575 - RNA, 18 nt, Mycobacterium avium subsp. paratuberculosis
gccauccgcgccgaacgc

SEQ ID NO: 825576 - RNA, 20 nt, Mycobacterium avium subsp. paratuberculosis
gccauaccuugucggcgucu

SEQ ID NO: 825577 - RNA, 14 nt, Mycobacterium avium subsp. paratuberculosis
gccauccgggcggc

SEQ ID NO: 825578 - RNA, 13 nt, Mycobacterium avium subsp. paratuberculosis
gccauccggccgg

SEQ ID NO: 825579 - RNA, 14 nt, Mycobacterium avium subsp. paratuberculosis
gccauccggccggc

SEQ ID NO: 825580 - RNA, 15 nt, Mycobacterium avium subsp. paratuberculosis
gccauccggccggcg

SEQ ID NO: 825581 - RNA, 17 nt, Mycobacterium avium subsp. paratuberculosis
gccaucgacuccagcac

SEQ ID NO: 825582 - RNA, 22 nt, Mycobacterium avium subsp. paratuberculosis
gccaucgacuccagcaccggcg

SEQ ID NO: 825583 - RNA, 23 nt, Mycobacterium avium subsp. paratuberculosis
gccaugaucgaaaggacgggcgu

SEQ ID NO: 825584 - RNA, 23 nt, Mycobacterium avium subsp. paratuberculosis
gccaucucgugcccgggcccgua

SEQ ID NO: 825585 - RNA, 20 nt, Mycobacterium avium subsp. paratuberculosis
gccaucuccugcacgcgcgg

SEQ ID NO: 825586 - RNA, 17 nt, Mycobacterium avium subsp. paratuberculosis
gccaucgugggcgccgu

SEQ ID NO: 825587 - RNA, 20 nt, Mycobacterium avium subsp. paratuberculosis
gccaucgugggcgccgucgc

SEQ ID NO: 825588 - RNA, 21 nt, Mycobacterium avium subsp. paratuberculosis
gccaucucagcguucacgucg

SEQ ID NO: 825589 - RNA, 20 nt, Mycobacterium avium subsp. paratuberculosis
gccaucgucacuucgccggg

SEQ ID NO: 825590 - RNA, 21 nt, Mycobacterium avium subsp. paratuberculosis
gccaucgucacuucgccgggc

SEQ ID NO: 825591 - RNA, 22 nt, Mycobacterium avium subsp. paratuberculosis
gccaucgucacuucgccgggcu

SEQ ID NO: 825592 - RNA, 23 nt, Mycobacterium avium subsp. paratuberculosis
gccaucgucacuucgccgggcug

SEQ ID NO: 825593 - RNA, 23 nt, Mycobacterium avium subsp. paratuberculosis
gccaucgaucgggcgucgcagau

SEQ ID NO: 825594 - RNA, 16 nt, Mycobacterium avium subsp. paratuberculosis
gccaucgcaccgcgag

SEQ ID NO: 825595 - RNA, 17 nt, Mycobacterium avium subsp. paratuberculosis
gccaucgcaccgcgagc

SEQ ID NO: 825596 - RNA, 18 nt, Mycobacterium avium subsp. paratuberculosis
gccaugcagaccagcccg

SEQ ID NO: 825597 - RNA, 19 nt, Mycobacterium avium subsp. paratuberculosis
gccaugcagaccagcccgu

SEQ ID NO: 825598 - RNA, 18 nt, Mycobacterium avium subsp. paratuberculosis
gccaugccgccgaccgcc

SEQ ID NO: 825599 - RNA, 20 nt, Mycobacterium avium subsp. paratuberculosis
gccaugccgccgaccgccga

SEQ ID NO: 825600 - RNA, 12 nt, Mycobacterium avium subsp. paratuberculosis
gccaugccgggg

SEQ ID NO: 825601 - RNA, 23 nt, Mycobacterium avium subsp. paratuberculosis
gccaugccucuucggcgcgccgg

SEQ ID NO: 825602 - RNA, 16 nt, Mycobacterium avium subsp. paratuberculosis
gccaugccgucgcgca

SEQ ID NO: 825603 - RNA, 13 nt, Mycobacterium avium subsp. paratuberculosis
gccaugccggccu

SEQ ID NO: 825604 - RNA, 15 nt, Mycobacterium avium subsp. paratuberculosis
gccaugccggccuga

SEQ ID NO: 825605 - RNA, 17 nt, Mycobacterium avium subsp. paratuberculosis
gccaguuugccgucggg

SEQ ID NO: 825606 - RNA, 22 nt, Mycobacterium avium subsp. paratuberculosis
gccaguugaaguccggcggucg

SEQ ID NO: 825607 - RNA, 23 nt, Mycobacterium avium subsp. paratuberculosis
gccaguugaaguccggcggucgc

SEQ ID NO: 825608 - RNA, 14 nt, Mycobacterium avium subsp. paratuberculosis
gccaguugaucagc

SEQ ID NO: 825609 - RNA, 17 nt, Mycobacterium avium subsp. paratuberculosis
gccaguugaucagcccg

SEQ ID NO: 825610 - RNA, 19 nt, Mycobacterium avium subsp. paratuberculosis
gccaguugcacuuucggca

SEQ ID NO: 825611 - RNA, 22 nt, Mycobacterium avium subsp. paratuberculosis
gccaguugcacuuucggcagcu

SEQ ID NO: 825612 - RNA, 12 nt, Mycobacterium avium subsp. paratuberculosis
gccaguucgcca

SEQ ID NO: 825613 - RNA, 15 nt, Mycobacterium avium subsp. paratuberculosis
gccaguucgccagca

SEQ ID NO: 825614 - RNA, 13 nt, Mycobacterium avium subsp. paratuberculosis
gccaguucgccgg

SEQ ID NO: 825615 - RNA, 16 nt, Mycobacterium avium subsp. paratuberculosis
gccaguucgccgguga

SEQ ID NO: 825616 - RNA, 14 nt, Mycobacterium avium subsp. paratuberculosis
gccaguucgacgau

SEQ ID NO: 825617 - RNA, 15 nt, Mycobacterium avium subsp. paratuberculosis
gccaguucgucgcgc

SEQ ID NO: 825618 - RNA, 15 nt, Mycobacterium avium subsp. paratuberculosis
gccaguucgucggcc

SEQ ID NO: 825619 - RNA, 19 nt, Mycobacterium avium subsp. paratuberculosis
gccaguucgucggccgucg

SEQ ID NO: 825620 - RNA, 21 nt, Mycobacterium avium subsp. paratuberculosis
gccaguucgucggccgucggc

SEQ ID NO: 825621 - RNA, 18 nt, Mycobacterium avium subsp. paratuberculosis
gccaguguggccgcggcg

SEQ ID NO: 825622 - RNA, 19 nt, Mycobacterium avium subsp. paratuberculosis
gccaguguggccgcggcgg

SEQ ID NO: 825623 - RNA, 15 nt, Mycobacterium avium subsp. paratuberculosis
gccaguggcugcacg

SEQ ID NO: 825624 - RNA, 16 nt, Mycobacterium avium subsp. paratuberculosis
gccaguggcugcacgu

SEQ ID NO: 825625 - RNA, 22 nt, Mycobacterium avium subsp. paratuberculosis
gccagucguacucccaggccgc

SEQ ID NO: 825626 - RNA, 23 nt, Mycobacterium avium subsp. paratuberculosis
gccagucguacucccaggccgcg

SEQ ID NO: 825627 - RNA, 14 nt, Mycobacterium avium subsp. paratuberculosis
gccagugccgcgcg

SEQ ID NO: 825628 - RNA, 15 nt, Mycobacterium avium subsp. paratuberculosis
gccagguuggcggcg

SEQ ID NO: 825629 - RNA, 18 nt, Mycobacterium avium subsp. paratuberculosis
gccagguuggucagcagc

SEQ ID NO: 825630 - RNA, 17 nt, Mycobacterium avium subsp. paratuberculosis
gccagguugcgccgucc

SEQ ID NO: 825631 - RNA, 19 nt, Mycobacterium avium subsp. paratuberculosis
gccagguugcgccguccgg

SEQ ID NO: 825632 - RNA, 20 nt, Mycobacterium avium subsp. paratuberculosis
gccagguugcgccguccggc

SEQ ID NO: 825633 - RNA, 16 nt, Mycobacterium avium subsp. paratuberculosis
gccaguaccagcggcc

SEQ ID NO: 825634 - RNA, 20 nt, Mycobacterium avium subsp. paratuberculosis
gccaguaccagcggccgucg

SEQ ID NO: 825635 - RNA, 13 nt, Mycobacterium avium subsp. paratuberculosis
gccagucgcggcg

SEQ ID NO: 825636 - RNA, 16 nt, Mycobacterium avium subsp. paratuberculosis
gccagucgcggcgaac

SEQ ID NO: 825637 - RNA, 21 nt, Mycobacterium avium subsp. paratuberculosis
gccagucgcggcgaaccagca

SEQ ID NO: 825638 - RNA, 12 nt, Mycobacterium avium subsp. paratuberculosis
gccagucgccgg

SEQ ID NO: 825639 - RNA, 14 nt, Mycobacterium avium subsp. paratuberculosis
gccagucgccggcc

SEQ ID NO: 825640 - RNA, 16 nt, Mycobacterium avium subsp. paratuberculosis
gccaggaauaacgccg

SEQ ID NO: 825641 - RNA, 18 nt, Mycobacterium avium subsp. paratuberculosis
gccaggaacggcgccauc

SEQ ID NO: 825642 - RNA, 13 nt, Mycobacterium avium subsp. paratuberculosis
gccaggacagcgu

SEQ ID NO: 825643 - RNA, 19 nt, Mycobacterium avium subsp. paratuberculosis
gccaggaagaacuccgcga

SEQ ID NO: 825644 - RNA, 23 nt, Mycobacterium avium subsp. paratuberculosis
gccaggaagacguaggcggccag

SEQ ID NO: 825645 - RNA, 16 nt, Mycobacterium avium subsp. paratuberculosis
gccaggaagccggcga

SEQ ID NO: 825646 - RNA, 19 nt, Mycobacterium avium subsp. paratuberculosis
gccaggaagccggcgacga

SEQ ID NO: 825647 - RNA, 19 nt, Mycobacterium avium subsp. paratuberculosis
gccaggaccgggacgacgg

SEQ ID NO: 825648 - RNA, 14 nt, Mycobacterium avium subsp. paratuberculosis
gccaggaccagcgg

SEQ ID NO: 825649 - RNA, 16 nt, Mycobacterium avium subsp. paratuberculosis
gccagguucgcgccga

SEQ ID NO: 825650 - RNA, 19 nt, Mycobacterium avium subsp. paratuberculosis
gcccacugguaaccgcccg

SEQ ID NO: 825651 - RNA, 20 nt, Mycobacterium avium subsp. paratuberculosis
gcccacugccugacccggcc

SEQ ID NO: 825652 - RNA, 23 nt, Mycobacterium avium subsp. paratuberculosis
gcccacugccugacccggccgug

SEQ ID NO: 825653 - RNA, 18 nt, Mycobacterium avium subsp. paratuberculosis
gcccagacaggccggccg

SEQ ID NO: 825654 - RNA, 19 nt, Mycobacterium avium subsp. paratuberculosis
gcccagacgaugucgucgc

SEQ ID NO: 825655 - RNA, 21 nt, Mycobacterium avium subsp. paratuberculosis
gcccagacgcgggcgcccagc

SEQ ID NO: 825656 - RNA, 23 nt, Mycobacterium avium subsp. paratuberculosis
gcccagacgcgggcgcccagcaa

SEQ ID NO: 825657 - RNA, 21 nt, Mycobacterium avium subsp. paratuberculosis
gcccagacgguuccaccgguc

SEQ ID NO: 825658 - RNA, 17 nt, Mycobacterium avium subsp. paratuberculosis
gcccagaacgacgcgcu

SEQ ID NO: 825659 - RNA, 20 nt, Mycobacterium avium subsp. paratuberculosis
gcccagaacgacgcgcucag

SEQ ID NO: 825660 - RNA, 21 nt, Mycobacterium avium subsp. paratuberculosis
gcccagaacgacgcgcucagc

SEQ ID NO: 825661 - RNA, 21 nt, Mycobacterium avium subsp. paratuberculosis
gcccagaacugggccgccguc

SEQ ID NO: 825662 - RNA, 24 nt, Mycobacterium avium subsp. paratuberculosis
gcccagaacugggccgccgucgcc

SEQ ID NO: 825663 - RNA, 20 nt, Mycobacterium avium subsp. paratuberculosis
gcccacguaggggcccgggu

SEQ ID NO: 825664 - RNA, 14 nt, Mycobacterium avium subsp. paratuberculosis
gcccacgucgcgcc

SEQ ID NO: 825665 - RNA, 17 nt, Mycobacterium avium subsp. paratuberculosis
gcccacgucgcgccgau

SEQ ID NO: 825666 - RNA, 15 nt, Mycobacterium avium subsp. paratuberculosis
gcccacgugccaucg

SEQ ID NO: 825667 - RNA, 15 nt, Mycobacterium avium subsp. paratuberculosis
gcccacggugauucc

SEQ ID NO: 825668 - RNA, 15 nt, Mycobacterium avium subsp. paratuberculosis
gcccacgggucgccg

SEQ ID NO: 825669 - RNA, 18 nt, Mycobacterium avium subsp. paratuberculosis
gcccacgggucgccgauc

SEQ ID NO: 825670 - RNA, 18 nt, Mycobacterium avium subsp. paratuberculosis
gcccacgggaugcggcac

SEQ ID NO: 825671 - RNA, 22 nt, Mycobacterium avium subsp. paratuberculosis
gcccacgggaugcggcacgcgu

SEQ ID NO: 825672 - RNA, 23 nt, Mycobacterium avium subsp. paratuberculosis
gcccacgggaugcggcacgcguc

SEQ ID NO: 825673 - RNA, 22 nt, Mycobacterium avium subsp. paratuberculosis
gcccagcacgacgccgcugggc

SEQ ID NO: 825674 - RNA, 13 nt, Mycobacterium avium subsp. paratuberculosis
gcccagcaccgcg

SEQ ID NO: 825675 - RNA, 12 nt, Mycobacterium avium subsp. paratuberculosis
gcccagcaccgc

SEQ ID NO: 825676 - RNA, 13 nt, Mycobacterium avium subsp. paratuberculosis
gcccagcaccacu

SEQ ID NO: 825677 - RNA, 13 nt, Mycobacterium avium subsp. paratuberculosis
gcccagcacccgc

SEQ ID NO: 825678 - RNA, 17 nt, Mycobacterium avium subsp. paratuberculosis
gcccagcacccgcucgc

SEQ ID NO: 825679 - RNA, 19 nt, Mycobacterium avium subsp. paratuberculosis
gcccagcacccgcucgccg

SEQ ID NO: 825680 - RNA, 22 nt, Mycobacterium avium subsp. paratuberculosis
gcccagcacccgcucgccgaug

SEQ ID NO: 825681 - RNA, 14 nt, Mycobacterium avium subsp. paratuberculosis
gcccagcacccggu

SEQ ID NO: 825682 - RNA, 22 nt, Mycobacterium avium subsp. paratuberculosis
gcccagcacccgguuccaccgg

SEQ ID NO: 825683 - RNA, 14 nt, Mycobacterium avium subsp. paratuberculosis
gcccagcaccacca

SEQ ID NO: 825684 - RNA, 23 nt, Mycobacterium avium subsp. paratuberculosis
gcccagcaccaccuugucaccga

SEQ ID NO: 825685 - RNA, 17 nt, Mycobacterium avium subsp. paratuberculosis
gcccagauugcggcccu

SEQ ID NO: 825686 - RNA, 17 nt, Mycobacterium avium subsp. paratuberculosis
gcccagcaaacccagca

SEQ ID NO: 825687 - RNA, 20 nt, Mycobacterium avium subsp. paratuberculosis
gcccagcaaacccagcacca

SEQ ID NO: 825688 - RNA, 14 nt, Mycobacterium avium subsp. paratuberculosis
gcccagauacgccg

SEQ ID NO: 825689 - RNA, 16 nt, Mycobacterium avium subsp. paratuberculosis
gcccagauacgccgcg

SEQ ID NO: 825690 - RNA, 17 nt, Mycobacterium avium subsp. paratuberculosis
gcccagauacgccgcga

SEQ ID NO: 825691 - RNA, 18 nt, Mycobacterium avium subsp. paratuberculosis
gcccagaucgacgccgac

SEQ ID NO: 825692 - RNA, 22 nt, Mycobacterium avium subsp. paratuberculosis
gcccagaucgacgccgaccgcg

SEQ ID NO: 825693 - RNA, 16 nt, Mycobacterium avium subsp. paratuberculosis
gcccagaucgccgacc

SEQ ID NO: 825694 - RNA, 18 nt, Mycobacterium avium subsp. paratuberculosis
gcccagaucgccgacccg

SEQ ID NO: 825695 - RNA, 17 nt, Mycobacterium avium subsp. paratuberculosis
gcccagaucggccagcc

SEQ ID NO: 825696 - RNA, 14 nt, Mycobacterium avium subsp. paratuberculosis
gcccagaugccgcc

SEQ ID NO: 825697 - RNA, 17 nt, Mycobacterium avium subsp. paratuberculosis
gcccagaugccgccgcc

SEQ ID NO: 825698 - RNA, 22 nt, Mycobacterium avium subsp. paratuberculosis
gcccagaugccgccgccagcgc

SEQ ID NO: 825699 - RNA, 18 nt, Mycobacterium avium subsp. paratuberculosis
gcccagaugccggcguag

SEQ ID NO: 825700 - RNA, 13 nt, Mycobacterium avium subsp. paratuberculosis
gcccagccgcuga

SEQ ID NO: 825701 - RNA, 15 nt, Mycobacterium avium subsp. paratuberculosis
gcccagccgccagcc

SEQ ID NO: 825702 - RNA, 14 nt, Mycobacterium avium subsp. paratuberculosis
gcccagccgcaggu

SEQ ID NO: 825703 - RNA, 23 nt, Mycobacterium avium subsp. paratuberculosis
gcccagccgcaggugcagcuccu

SEQ ID NO: 825704 - RNA, 13 nt, Mycobacterium avium subsp. paratuberculosis
gcccagcccggcc

SEQ ID NO: 825705 - RNA, 15 nt, Mycobacterium avium subsp. paratuberculosis
gcccagcccggccag

SEQ ID NO: 825706 - RNA, 16 nt, Mycobacterium avium subsp. paratuberculosis
gcccagcccggccagc

SEQ ID NO: 825707 - RNA, 19 nt, Mycobacterium avium subsp. paratuberculosis
gcccagcccggccagcacc

SEQ ID NO: 825708 - RNA, 22 nt, Mycobacterium avium subsp. paratuberculosis
gcccagcccggccagcacccgc

SEQ ID NO: 825709 - RNA, 14 nt, Mycobacterium avium subsp. paratuberculosis
gcccagcccggccc

SEQ ID NO: 825710 - RNA, 17 nt, Mycobacterium avium subsp. paratuberculosis
gcccagccgagccgggc

SEQ ID NO: 825711 - RNA, 22 nt, Mycobacterium avium subsp. paratuberculosis
gcccagccgagccgggccaggu

SEQ ID NO: 825712 - RNA, 17 nt, Mycobacterium avium subsp. paratuberculosis
gcccagccccucgacgu

SEQ ID NO: 825713 - RNA, 16 nt, Mycobacterium avium subsp. paratuberculosis
gcccagccagcgacaa

SEQ ID NO: 825714 - RNA, 15 nt, Mycobacterium avium subsp. paratuberculosis
gcccagcccgagcac

SEQ ID NO: 825715 - RNA, 21 nt, Mycobacterium avium subsp. paratuberculosis
gcccagcccgagcaccagcgg

SEQ ID NO: 825716 - RNA, 15 nt, Mycobacterium avium subsp. paratuberculosis
gcccagcccgccgcg

SEQ ID NO: 825717 - RNA, 16 nt, Mycobacterium avium subsp. paratuberculosis
gcccagcccgccgcgu

SEQ ID NO: 825718 - RNA, 17 nt, Mycobacterium avium subsp. paratuberculosis
gcccagcccgccgcguc

SEQ ID NO: 825719 - RNA, 21 nt, Mycobacterium avium subsp. paratuberculosis
gcccagcccgccgcguccggg

SEQ ID NO: 825720 - RNA, 13 nt, Mycobacterium avium subsp. paratuberculosis
gcccagcccgcgc

SEQ ID NO: 825721 - RNA, 18 nt, Mycobacterium avium subsp. paratuberculosis
gcccagcccgcgccgagc

SEQ ID NO: 825722 - RNA, 15 nt, Mycobacterium avium subsp. paratuberculosis
gcccagcccgcgcga

SEQ ID NO: 825723 - RNA, 17 nt, Mycobacterium avium subsp. paratuberculosis
gcccagcccgcgcgagc

SEQ ID NO: 825724 - RNA, 18 nt, Mycobacterium avium subsp. paratuberculosis
gcccagcccgcgcgagcg

SEQ ID NO: 825725 - RNA, 12 nt, Mycobacterium avium subsp. paratuberculosis
gcccagcccggc

SEQ ID NO: 825726 - RNA, 20 nt, Mycobacterium avium subsp. paratuberculosis
gcccagccaguccgccgccg

SEQ ID NO: 825727 - RNA, 23 nt, Mycobacterium avium subsp. paratuberculosis
gcccagccauaccuugucggcgu

SEQ ID NO: 825728 - RNA, 15 nt, Mycobacterium avium subsp. paratuberculosis
gcccagccccagcac

SEQ ID NO: 825729 - RNA, 16 nt, Mycobacterium avium subsp. paratuberculosis
gcccagccccagcacg

SEQ ID NO: 825730 - RNA, 18 nt, Mycobacterium avium subsp. paratuberculosis
gcccagccaggccgccgg

SEQ ID NO: 825731 - RNA, 22 nt, Mycobacterium avium subsp. paratuberculosis
gcccagccaggccgccgggccg

SEQ ID NO: 825732 - RNA, 14 nt, Mycobacterium avium subsp. paratuberculosis
gcccagccacgcca

SEQ ID NO: 825733 - RNA, 16 nt, Mycobacterium avium subsp. paratuberculosis
gcccagccacgccaac

SEQ ID NO: 825734 - RNA, 13 nt, Mycobacterium avium subsp. paratuberculosis
gcccagccagccg

SEQ ID NO: 825735 - RNA, 17 nt, Mycobacterium avium subsp. paratuberculosis
gcccagccagccggugg

SEQ ID NO: 825736 - RNA, 19 nt, Mycobacterium avium subsp. paratuberculosis
gcccagccagccgguggcg

SEQ ID NO: 825737 - RNA, 18 nt, Mycobacterium avium subsp. paratuberculosis
gcccagcaguccggcggu

SEQ ID NO: 825738 - RNA, 19 nt, Mycobacterium avium subsp. paratuberculosis
gcccagcaguccggcgguc

SEQ ID NO: 825739 - RNA, 18 nt, Mycobacterium avium subsp. paratuberculosis
gcccagcauaggugcgcc

SEQ ID NO: 825740 - RNA, 16 nt, Mycobacterium avium subsp. paratuberculosis
gcccagcaucgccgcg

SEQ ID NO: 825741 - RNA, 17 nt, Mycobacterium avium subsp. paratuberculosis
gcccagcaucgccgcga

SEQ ID NO: 825742 - RNA, 18 nt, Mycobacterium avium subsp. paratuberculosis
gcccagcagcgcaccggc

SEQ ID NO: 825743 - RNA, 22 nt, Mycobacterium avium subsp. paratuberculosis
gcccagcagcgcaccggcgaug

SEQ ID NO: 825744 - RNA, 23 nt, Mycobacterium avium subsp. paratuberculosis
gcccagcagcgcaccggcgaugc

SEQ ID NO: 825745 - RNA, 12 nt, Mycobacterium avium subsp. paratuberculosis
gcccagcagcgu

SEQ ID NO: 825746 - RNA, 16 nt, Mycobacterium avium subsp. paratuberculosis
gcccagcagcgucacg

SEQ ID NO: 825747 - RNA, 22 nt, Mycobacterium avium subsp. paratuberculosis
gcccagcagcgucacgucgacg

SEQ ID NO: 825748 - RNA, 22 nt, Mycobacterium avium subsp. paratuberculosis
gcccagcagcugcgcgucgaag

SEQ ID NO: 825749 - RNA, 16 nt, Mycobacterium avium subsp. paratuberculosis
gcccagcagcccggcc

SEQ ID NO: 825750 - RNA, 18 nt, Mycobacterium avium subsp. paratuberculosis
gcccagcagcccggccag

SEQ ID NO: 825751 - RNA, 18 nt, Mycobacterium avium subsp. paratuberculosis
gcccagcagccgcgccga

SEQ ID NO: 825752 - RNA, 19 nt, Mycobacterium avium subsp. paratuberculosis
gcccagcagccgcgccgac

SEQ ID NO: 825753 - RNA, 14 nt, Mycobacterium avium subsp. paratuberculosis
gcccagcagccugc

SEQ ID NO: 825754 - RNA, 15 nt, Mycobacterium avium subsp. paratuberculosis
gcccagcagcaccgc

SEQ ID NO: 825755 - RNA, 17 nt, Mycobacterium avium subsp. paratuberculosis
gcccagcagcaccgcga

SEQ ID NO: 825756 - RNA, 20 nt, Mycobacterium avium subsp. paratuberculosis
gcccagcagcaccgcgaccg

SEQ ID NO: 825757 - RNA, 23 nt, Mycobacterium avium subsp. paratuberculosis
gcccaccgucuuggucucgccga

SEQ ID NO: 825758 - RNA, 20 nt, Mycobacterium avium subsp. paratuberculosis
gcccaccuucccaaccccgg

SEQ ID NO: 825759 - RNA, 15 nt, Mycobacterium avium subsp. paratuberculosis
gcccacgcagccguc

SEQ ID NO: 825760 - RNA, 17 nt, Mycobacterium avium subsp. paratuberculosis
gcccaccuuggcgucga

SEQ ID NO: 825761 - RNA, 18 nt, Mycobacterium avium subsp. paratuberculosis
gcccaccuuggcgucgau

SEQ ID NO: 825762 - RNA, 13 nt, Mycobacterium avium subsp. paratuberculosis
gcccacgaaccgg

SEQ ID NO: 825763 - RNA, 22 nt, Mycobacterium avium subsp. paratuberculosis
gcccacgaagaugaucagcgcg

SEQ ID NO: 825764 - RNA, 23 nt, Mycobacterium avium subsp. paratuberculosis
gcccacgaagaugaucagcgcgc

SEQ ID NO: 825765 - RNA, 16 nt, Mycobacterium avium subsp. paratuberculosis
gcccacgaucacgucg

SEQ ID NO: 825766 - RNA, 18 nt, Mycobacterium avium subsp. paratuberculosis
gcccacgaucacgucggu

SEQ ID NO: 825767 - RNA, 21 nt, Mycobacterium avium subsp. paratuberculosis
gcccacgaucacgucggugac

SEQ ID NO: 825768 - RNA, 18 nt, Mycobacterium avium subsp. paratuberculosis
gcccaccucgagcacgcc

SEQ ID NO: 825769 - RNA, 20 nt, Mycobacterium avium subsp. paratuberculosis
gcccaccugguuggcccgca

SEQ ID NO: 825770 - RNA, 21 nt, Mycobacterium avium subsp. paratuberculosis
gcccaccugguuggcccgcac

SEQ ID NO: 825771 - RNA, 23 nt, Mycobacterium avium subsp. paratuberculosis
gcccaccugguuggcccgcacca

SEQ ID NO: 825772 - RNA, 14 nt, Mycobacterium avium subsp. paratuberculosis
gcccaccgccacca

SEQ ID NO: 825773 - RNA, 20 nt, Mycobacterium avium subsp. paratuberculosis
gcccaccgggcagccgcaca

SEQ ID NO: 825774 - RNA, 22 nt, Mycobacterium avium subsp. paratuberculosis
gcccaccgguggccgggagugc

SEQ ID NO: 825775 - RNA, 18 nt, Mycobacterium avium subsp. paratuberculosis
gcccaccgucgccacgau

SEQ ID NO: 825776 - RNA, 22 nt, Mycobacterium avium subsp. paratuberculosis
gcccaccgucgccacgaucacc

SEQ ID NO: 825777 - RNA, 19 nt, Mycobacterium avium subsp. paratuberculosis
gcccacgcucgacgcgucg

SEQ ID NO: 825778 - RNA, 20 nt, Mycobacterium avium subsp. paratuberculosis
gcccacgcucgacgcgucga

SEQ ID NO: 825779 - RNA, 22 nt, Mycobacterium avium subsp. paratuberculosis
gcccacgcucgacgcgucgaca

SEQ ID NO: 825780 - RNA, 21 nt, Mycobacterium avium subsp. paratuberculosis
gcccacgccgagggugccggc

SEQ ID NO: 825781 - RNA, 12 nt, Mycobacterium avium subsp. paratuberculosis
gcccacgccgcc

SEQ ID NO: 825782 - RNA, 15 nt, Mycobacterium avium subsp. paratuberculosis
gcccacgccgcccag

SEQ ID NO: 825783 - RNA, 12 nt, Mycobacterium avium subsp. paratuberculosis
gcccacgccggu

SEQ ID NO: 825784 - RNA, 21 nt, Mycobacterium avium subsp. paratuberculosis
gcccacgccgguggggucggu

SEQ ID NO: 825785 - RNA, 17 nt, Mycobacterium avium subsp. paratuberculosis
gcccacgccgucgucgu

SEQ ID NO: 825786 - RNA, 13 nt, Mycobacterium avium subsp. paratuberculosis
gcccacgccgugc

SEQ ID NO: 825787 - RNA, 13 nt, Mycobacterium avium subsp. paratuberculosis
gcccaccggcccg

SEQ ID NO: 825788 - RNA, 16 nt, Mycobacterium avium subsp. paratuberculosis
gcccaccggcccggcg

SEQ ID NO: 825789 - RNA, 17 nt, Mycobacterium avium subsp. paratuberculosis
gcccaccggcccggcgg

SEQ ID NO: 825790 - RNA, 16 nt, Mycobacterium avium subsp. paratuberculosis
gcccaccgaucgcgag

SEQ ID NO: 825791 - RNA, 19 nt, Mycobacterium avium subsp. paratuberculosis
gcccaccgaucgcgagggc

SEQ ID NO: 825792 - RNA, 12 nt, Mycobacterium avium subsp. paratuberculosis
gcccaccgccgu

SEQ ID NO: 825793 - RNA, 15 nt, Mycobacterium avium subsp. paratuberculosis
gcccaccgccguucc

SEQ ID NO: 825794 - RNA, 14 nt, Mycobacterium avium subsp. paratuberculosis
gcccaccgcgccca

SEQ ID NO: 825795 - RNA, 16 nt, Mycobacterium avium subsp. paratuberculosis
gcccaccgcgcccagc

SEQ ID NO: 825796 - RNA, 19 nt, Mycobacterium avium subsp. paratuberculosis
gcccaccgcgcgcugcagc

SEQ ID NO: 825797 - RNA, 13 nt, Mycobacterium avium subsp. paratuberculosis
gcccaccgcggcg

SEQ ID NO: 825798 - RNA, 15 nt, Mycobacterium avium subsp. paratuberculosis
gcccaccgcggcgcg

SEQ ID NO: 825799 - RNA, 19 nt, Mycobacterium avium subsp. paratuberculosis
gcccaccgcggcgcgcggc

SEQ ID NO: 825800 - RNA, 22 nt, Mycobacterium avium subsp. paratuberculosis
gcccaccgcggcgcgcggccgc

SEQ ID NO: 825801 - RNA, 24 nt, Mycobacterium avium subsp. paratuberculosis
gcccaccgcggcgcgcggccgcga

SEQ ID NO: 825802 - RNA, 13 nt, Mycobacterium avium subsp. paratuberculosis
gcccaccgcggug

SEQ ID NO: 825803 - RNA, 19 nt, Mycobacterium avium subsp. paratuberculosis
gcccaccgcggugaccgcc

SEQ ID NO: 825804 - RNA, 12 nt, Mycobacterium avium subsp. paratuberculosis
gcccaccgcguc

SEQ ID NO: 825805 - RNA, 13 nt, Mycobacterium avium subsp. paratuberculosis
gcccaccgcgucg

SEQ ID NO: 825806 - RNA, 20 nt, Mycobacterium avium subsp. paratuberculosis
gcccaccgcgucgcagugcc

SEQ ID NO: 825807 - RNA, 14 nt, Mycobacterium avium subsp. paratuberculosis
gcccaccgacgcgg

SEQ ID NO: 825808 - RNA, 16 nt, Mycobacterium avium subsp. paratuberculosis
gcccaccgacgcggcg

SEQ ID NO: 825809 - RNA, 19 nt, Mycobacterium avium subsp. paratuberculosis
gcccaccgacgcggcggcc

SEQ ID NO: 825810 - RNA, 21 nt, Mycobacterium avium subsp. paratuberculosis
gcccaccgacgcggcggccga

SEQ ID NO: 825811 - RNA, 14 nt, Mycobacterium avium subsp. paratuberculosis
gcccacccggggcc

SEQ ID NO: 825812 - RNA, 18 nt, Mycobacterium avium subsp. paratuberculosis
gcccacccggggccgucc

SEQ ID NO: 825813 - RNA, 14 nt, Mycobacterium avium subsp. paratuberculosis
gcccacccguuggc

SEQ ID NO: 825814 - RNA, 23 nt, Mycobacterium avium subsp. paratuberculosis
gcccacccguuggcaggcccggu

SEQ ID NO: 825815 - RNA, 14 nt, Mycobacterium avium subsp. paratuberculosis
gcccacccgcgccg

SEQ ID NO: 825816 - RNA, 18 nt, Mycobacterium avium subsp. paratuberculosis
gcccacccggaugucgug

SEQ ID NO: 825817 - RNA, 19 nt, Mycobacterium avium subsp. paratuberculosis
gcccacccggaugucgugc

SEQ ID NO: 825818 - RNA, 20 nt, Mycobacterium avium subsp. paratuberculosis
gcccacccggaugucgugcg

SEQ ID NO: 825819 - RNA, 14 nt, Mycobacterium avium subsp. paratuberculosis
gcccaccccggcgu

SEQ ID NO: 825820 - RNA, 19 nt, Mycobacterium avium subsp. paratuberculosis
gcccaccccggcguccacg

SEQ ID NO: 825821 - RNA, 20 nt, Mycobacterium avium subsp. paratuberculosis
gcccacccgaugaccggccc

SEQ ID NO: 825822 - RNA, 21 nt, Mycobacterium avium subsp. paratuberculosis
gcccacccgaugaccggcccg

SEQ ID NO: 825823 - RNA, 14 nt, Mycobacterium avium subsp. paratuberculosis
gcccacccgcacgc

SEQ ID NO: 825824 - RNA, 14 nt, Mycobacterium avium subsp. paratuberculosis
gcccacccgccagc

SEQ ID NO: 825825 - RNA, 17 nt, Mycobacterium avium subsp. paratuberculosis
gcccacccgccagcccg

SEQ ID NO: 825826 - RNA, 13 nt, Mycobacterium avium subsp. paratuberculosis
gcccacccgcgcc

SEQ ID NO: 825827 - RNA, 20 nt, Mycobacterium avium subsp. paratuberculosis
gccaugcuuucgaucaucga

SEQ ID NO: 825828 - RNA, 17 nt, Mycobacterium avium subsp. paratuberculosis
gccauggaaaccggcgg

SEQ ID NO: 825829 - RNA, 14 nt, Mycobacterium avium subsp. paratuberculosis
gccaugcgaccacg

SEQ ID NO: 825830 - RNA, 14 nt, Mycobacterium avium subsp. paratuberculosis
gccaugcgccgcgc

SEQ ID NO: 825831 - RNA, 14 nt, Mycobacterium avium subsp. paratuberculosis
gccauggcgcaccg

SEQ ID NO: 825832 - RNA, 15 nt, Mycobacterium avium subsp. paratuberculosis
gccauggcgcaccgc

SEQ ID NO: 825833 - RNA, 17 nt, Mycobacterium avium subsp. paratuberculosis
gccauggcgcaccgcgg

SEQ ID NO: 825834 - RNA, 18 nt, Mycobacterium avium subsp. paratuberculosis
gcccacacgcgauagacc

SEQ ID NO: 825835 - RNA, 17 nt, Mycobacterium avium subsp. paratuberculosis
gcccacauacaccggga

SEQ ID NO: 825836 - RNA, 19 nt, Mycobacterium avium subsp. paratuberculosis
gcccaccaccacgaggacc

SEQ ID NO: 825837 - RNA, 20 nt, Mycobacterium avium subsp. paratuberculosis
gcccacagguccagcguccg

SEQ ID NO: 825838 - RNA, 13 nt, Mycobacterium avium subsp. paratuberculosis
gcccacagccagg

SEQ ID NO: 825839 - RNA, 14 nt, Mycobacterium avium subsp. paratuberculosis
gcccacagccaggu

SEQ ID NO: 825840 - RNA, 14 nt, Mycobacterium avium subsp. paratuberculosis
gcccacagcgccag

SEQ ID NO: 825841 - RNA, 15 nt, Mycobacterium avium subsp. paratuberculosis
gcccacagcgccagc

SEQ ID NO: 825842 - RNA, 17 nt, Mycobacterium avium subsp. paratuberculosis
gcccacagcgccagcac

SEQ ID NO: 825843 - RNA, 20 nt, Mycobacterium avium subsp. paratuberculosis
gcccacagcgccagcacggc

SEQ ID NO: 825844 - RNA, 15 nt, Mycobacterium avium subsp. paratuberculosis
gcccacagcugacgg

SEQ ID NO: 825845 - RNA, 23 nt, Mycobacterium avium subsp. paratuberculosis
gcccacagcuugccggagcccag

SEQ ID NO: 825846 - RNA, 23 nt, Mycobacterium avium subsp. paratuberculosis
gcccacaggacguugaggcggcg

SEQ ID NO: 825847 - RNA, 20 nt, Mycobacterium avium subsp. paratuberculosis
gcccgauggugaagccgugc

SEQ ID NO: 825848 - RNA, 21 nt, Mycobacterium avium subsp. paratuberculosis
gcccgauggugaagccgugca

SEQ ID NO: 825849 - RNA, 19 nt, Mycobacterium avium subsp. paratuberculosis
gcccgauucagccggcggu

SEQ ID NO: 825850 - RNA, 18 nt, Mycobacterium avium subsp. paratuberculosis
gcccgaucgccagcgccc

SEQ ID NO: 825851 - RNA, 15 nt, Mycobacterium avium subsp. paratuberculosis
gcccgauggcggccu

SEQ ID NO: 825852 - RNA, 17 nt, Mycobacterium avium subsp. paratuberculosis
gcccgauggcggccugc

SEQ ID NO: 825853 - RNA, 22 nt, Mycobacterium avium subsp. paratuberculosis
gcccgcagcgcaucggugagac

SEQ ID NO: 825854 - RNA, 13 nt, Mycobacterium avium subsp. paratuberculosis
gcccgcagcgccu

SEQ ID NO: 825855 - RNA, 17 nt, Mycobacterium avium subsp. paratuberculosis
gcccgcagcgccucggc

SEQ ID NO: 825856 - RNA, 18 nt, Mycobacterium avium subsp. paratuberculosis
gcccgcagcgccucggcg

SEQ ID NO: 825857 - RNA, 12 nt, Mycobacterium avium subsp. paratuberculosis
gcccgcagcucg

SEQ ID NO: 825858 - RNA, 13 nt, Mycobacterium avium subsp. paratuberculosis
gcccgcagcucgg

SEQ ID NO: 825859 - RNA, 15 nt, Mycobacterium avium subsp. paratuberculosis
gcccgcagcucggag

SEQ ID NO: 825860 - RNA, 15 nt, Mycobacterium avium subsp. paratuberculosis
gcccgcaggaucgag

SEQ ID NO: 825861 - RNA, 17 nt, Mycobacterium avium subsp. paratuberculosis
gcccgcaggaucgagcc

SEQ ID NO: 825862 - RNA, 22 nt, Mycobacterium avium subsp. paratuberculosis
gcccgcaggaucgagccggccg

SEQ ID NO: 825863 - RNA, 23 nt, Mycobacterium avium subsp. paratuberculosis
gcccgcaacuccacaaccagcga

SEQ ID NO: 825864 - RNA, 19 nt, Mycobacterium avium subsp. paratuberculosis
gcccgcaacuguucgcggc

SEQ ID NO: 825865 - RNA, 22 nt, Mycobacterium avium subsp. paratuberculosis
gcccgcaacuguucgcggcugg

SEQ ID NO: 825866 - RNA, 23 nt, Mycobacterium avium subsp. paratuberculosis
gcccgauucgcggccaccaccgg

SEQ ID NO: 825867 - RNA, 23 nt, Mycobacterium avium subsp. paratuberculosis
gcccgauuggaagagggccaucc

SEQ ID NO: 825868 - RNA, 20 nt, Mycobacterium avium subsp. paratuberculosis
gcccgcaaaucagccgagcc

SEQ ID NO: 825869 - RNA, 21 nt, Mycobacterium avium subsp. paratuberculosis
gcccgcaaaucagccgagccg

SEQ ID NO: 825870 - RNA, 15 nt, Mycobacterium avium subsp. paratuberculosis
gcccgcagcggcggu

SEQ ID NO: 825871 - RNA, 13 nt, Mycobacterium avium subsp. paratuberculosis
gcccgcaggccgc

SEQ ID NO: 825872 - RNA, 15 nt, Mycobacterium avium subsp. paratuberculosis
gcccgcaggccgcga

SEQ ID NO: 825873 - RNA, 19 nt, Mycobacterium avium subsp. paratuberculosis
gcccgcaguucggccgccg

SEQ ID NO: 825874 - RNA, 20 nt, Mycobacterium avium subsp. paratuberculosis
gcccgcaguucggccgccgu

SEQ ID NO: 825875 - RNA, 21 nt, Mycobacterium avium subsp. paratuberculosis
gcccgcaguucggccgccgug

SEQ ID NO: 825876 - RNA, 23 nt, Mycobacterium avium subsp. paratuberculosis
gcccgcaguucggccgccgugcu

SEQ ID NO: 825877 - RNA, 13 nt, Mycobacterium avium subsp. paratuberculosis
gcccgcaucgaau

SEQ ID NO: 825878 - RNA, 20 nt, Mycobacterium avium subsp. paratuberculosis
gcccgcaucgaauccacgaa

SEQ ID NO: 825879 - RNA, 13 nt, Mycobacterium avium subsp. paratuberculosis
gcccgcaucgacg

SEQ ID NO: 825880 - RNA, 15 nt, Mycobacterium avium subsp. paratuberculosis
gcccgcaucgcacag

SEQ ID NO: 825881 - RNA, 22 nt, Mycobacterium avium subsp. paratuberculosis
gcccgcaucgcacagauacgcg

SEQ ID NO: 825882 - RNA, 19 nt, Mycobacterium avium subsp. paratuberculosis
gcccgcaucgccgaaccgg

SEQ ID NO: 825883 - RNA, 22 nt, Mycobacterium avium subsp. paratuberculosis
gcccgcaucgccgaaccgggcg

SEQ ID NO: 825884 - RNA, 21 nt, Mycobacterium avium subsp. paratuberculosis
gcccgcccacauacaccggga

SEQ ID NO: 825885 - RNA, 20 nt, Mycobacterium avium subsp. paratuberculosis
gcccgccaucgcccggugcg

SEQ ID NO: 825886 - RNA, 22 nt, Mycobacterium avium subsp. paratuberculosis
gcccgccaggaauaacgccggc

SEQ ID NO: 825887 - RNA, 23 nt, Mycobacterium avium subsp. paratuberculosis
gcccgccaggaauaacgccggcc

SEQ ID NO: 825888 - RNA, 15 nt, Mycobacterium avium subsp. paratuberculosis
gcccgccagcauggu

SEQ ID NO: 825889 - RNA, 14 nt, Mycobacterium avium subsp. paratuberculosis
gcccgccgccacca

SEQ ID NO: 825890 - RNA, 13 nt, Mycobacterium avium subsp. paratuberculosis
gcccgccgcgacc

SEQ ID NO: 825891 - RNA, 22 nt, Mycobacterium avium subsp. paratuberculosis
gcccgccgaucgaucagccgcg

SEQ ID NO: 825892 - RNA, 16 nt, Mycobacterium avium subsp. paratuberculosis
gcccgccccgacgugc

SEQ ID NO: 825893 - RNA, 14 nt, Mycobacterium avium subsp. paratuberculosis
gcccgcccaccacg

SEQ ID NO: 825894 - RNA, 22 nt, Mycobacterium avium subsp. paratuberculosis
gcccgcccaccacgaacgcgcc

SEQ ID NO: 825895 - RNA, 19 nt, Mycobacterium avium subsp. paratuberculosis
gcccgcaucgcggcgaugg

SEQ ID NO: 825896 - RNA, 17 nt, Mycobacterium avium subsp. paratuberculosis
gcccgcccacgggucgc

SEQ ID NO: 825897 - RNA, 20 nt, Mycobacterium avium subsp. paratuberculosis
gcccgcccacgggucgccga

SEQ ID NO: 825898 - RNA, 17 nt, Mycobacterium avium subsp. paratuberculosis
gcccgcccagcgcagca

SEQ ID NO: 825899 - RNA, 13 nt, Mycobacterium avium subsp. paratuberculosis
gcccgcccagcug

SEQ ID NO: 825900 - RNA, 17 nt, Mycobacterium avium subsp. paratuberculosis
gcccgcccagcugcacc

SEQ ID NO: 825901 - RNA, 15 nt, Mycobacterium avium subsp. paratuberculosis
gcccgcccaggccgc

SEQ ID NO: 825902 - RNA, 17 nt, Mycobacterium avium subsp. paratuberculosis
gcccgcccaggccgcca

SEQ ID NO: 825903 - RNA, 18 nt, Mycobacterium avium subsp. paratuberculosis
gcccgcccaggccgccag

SEQ ID NO: 825904 - RNA, 19 nt, Mycobacterium avium subsp. paratuberculosis
gcccgcccaggccgccagc

SEQ ID NO: 825905 - RNA, 23 nt, Mycobacterium avium subsp. paratuberculosis
gcccgcccaggccgccagcucgu

SEQ ID NO: 825906 - RNA, 15 nt, Mycobacterium avium subsp. paratuberculosis
gcccgccgcgacggg

SEQ ID NO: 825907 - RNA, 12 nt, Mycobacterium avium subsp. paratuberculosis
gcccgccgcgag

SEQ ID NO: 825908 - RNA, 16 nt, Mycobacterium avium subsp. paratuberculosis
gcccgccgcgagccgc

SEQ ID NO: 825909 - RNA, 17 nt, Mycobacterium avium subsp. paratuberculosis
gcccgccgcgagccgcc

SEQ ID NO: 825910 - RNA, 16 nt, Mycobacterium avium subsp. paratuberculosis
gcccgccgcgcccggc

SEQ ID NO: 825911 - RNA, 17 nt, Mycobacterium avium subsp. paratuberculosis
gcccgccgcgcccggcu

SEQ ID NO: 825912 - RNA, 14 nt, Mycobacterium avium subsp. paratuberculosis
gcccgccgccggcg

SEQ ID NO: 825913 - RNA, 16 nt, Mycobacterium avium subsp. paratuberculosis
gcccgccgccggcgcu

SEQ ID NO: 825914 - RNA, 15 nt, Mycobacterium avium subsp. paratuberculosis
gcccgccgcgaccgc

SEQ ID NO: 825915 - RNA, 21 nt, Mycobacterium avium subsp. paratuberculosis
gcccgccgcgaccgcgaucag

SEQ ID NO: 825916 - RNA, 13 nt, Mycobacterium avium subsp. paratuberculosis
gcccgccgcggcg

SEQ ID NO: 825917 - RNA, 14 nt, Mycobacterium avium subsp. paratuberculosis
gcccgccgcggcga

SEQ ID NO: 825918 - RNA, 23 nt, Mycobacterium avium subsp. paratuberculosis
gcccgccgcggcgaccggggcgg

SEQ ID NO: 825919 - RNA, 18 nt, Mycobacterium avium subsp. paratuberculosis
gcccgccgcggcgagccg

SEQ ID NO: 825920 - RNA, 20 nt, Mycobacterium avium subsp. paratuberculosis
gcccgccgcggcgagccggc

SEQ ID NO: 825921 - RNA, 21 nt, Mycobacterium avium subsp. paratuberculosis
gcccgccgcggcgagccggcc

SEQ ID NO: 825922 - RNA, 14 nt, Mycobacterium avium subsp. paratuberculosis
gcccgccgcggcuc

SEQ ID NO: 825923 - RNA, 12 nt, Mycobacterium avium subsp. paratuberculosis
gcccgccgcggu

SEQ ID NO: 825924 - RNA, 13 nt, Mycobacterium avium subsp. paratuberculosis
gcccgccgcggug

SEQ ID NO: 825925 - RNA, 16 nt, Mycobacterium avium subsp. paratuberculosis
gcccgccgcggugcug

SEQ ID NO: 825926 - RNA, 11 nt, Mycobacterium avium subsp. paratuberculosis
gcccgccgcgu

SEQ ID NO: 825927 - RNA, 16 nt, Mycobacterium avium subsp. paratuberculosis
gcccgccgcguacagc

SEQ ID NO: 825928 - RNA, 12 nt, Mycobacterium avium subsp. paratuberculosis
gcccgccgugcg

SEQ ID NO: 825929 - RNA, 18 nt, Mycobacterium avium subsp. paratuberculosis
gcccgccgugcgccccgc

SEQ ID NO: 825930 - RNA, 14 nt, Mycobacterium avium subsp. paratuberculosis
gcccgccgucgacc

SEQ ID NO: 825931 - RNA, 17 nt, Mycobacterium avium subsp. paratuberculosis
gcccgccgucgaccacg

SEQ ID NO: 825932 - RNA, 13 nt, Mycobacterium avium subsp. paratuberculosis
gcccgccgucggc

SEQ ID NO: 825933 - RNA, 15 nt, Mycobacterium avium subsp. paratuberculosis
gcccgccgguggccg

SEQ ID NO: 825934 - RNA, 17 nt, Mycobacterium avium subsp. paratuberculosis
gcccgccgguggccgcg

SEQ ID NO: 825935 - RNA, 18 nt, Mycobacterium avium subsp. paratuberculosis
gcccgccgguggccgcga

SEQ ID NO: 825936 - RNA, 22 nt, Mycobacterium avium subsp. paratuberculosis
gcccgccgucacgccguauucg

SEQ ID NO: 825937 - RNA, 15 nt, Mycobacterium avium subsp. paratuberculosis
gcccgccggcggcga

SEQ ID NO: 825938 - RNA, 19 nt, Mycobacterium avium subsp. paratuberculosis
gcccgccggcggcgaugau

SEQ ID NO: 825939 - RNA, 20 nt, Mycobacterium avium subsp. paratuberculosis
gcccgccggcggcgaugauc

SEQ ID NO: 825940 - RNA, 13 nt, Mycobacterium avium subsp. paratuberculosis
gcccgccggcggg

SEQ ID NO: 825941 - RNA, 12 nt, Mycobacterium avium subsp. paratuberculosis
gcccgccggcgu

SEQ ID NO: 825942 - RNA, 17 nt, Mycobacterium avium subsp. paratuberculosis
gcccgccgggaugcgcc

SEQ ID NO: 825943 - RNA, 22 nt, Mycobacterium avium subsp. paratuberculosis
gcccgccgggaugcgccaccga

SEQ ID NO: 825944 - RNA, 16 nt, Mycobacterium avium subsp. paratuberculosis
gcccgccgggcacccg

SEQ ID NO: 825945 - RNA, 14 nt, Mycobacterium avium subsp. paratuberculosis
gcccgccgggccgg

SEQ ID NO: 825946 - RNA, 23 nt, Mycobacterium avium subsp. paratuberculosis
gcccgccgggccggaucgcgcag

SEQ ID NO: 825947 - RNA, 16 nt, Mycobacterium avium subsp. paratuberculosis
gcccgccgggcgccac

SEQ ID NO: 825948 - RNA, 17 nt, Mycobacterium avium subsp. paratuberculosis
gcccgccgggcgccacg

SEQ ID NO: 825949 - RNA, 20 nt, Mycobacterium avium subsp. paratuberculosis
gcccgccgggcgccacgcug

SEQ ID NO: 825950 - RNA, 13 nt, Mycobacterium avium subsp. paratuberculosis
gcccgccgggcug

SEQ ID NO: 825951 - RNA, 17 nt, Mycobacterium avium subsp. paratuberculosis
gcccgccgggcugaccg

SEQ ID NO: 825952 - RNA, 22 nt, Mycobacterium avium subsp. paratuberculosis
gcccgccgggcugaccgucgac

SEQ ID NO: 825953 - RNA, 15 nt, Mycobacterium avium subsp. paratuberculosis
gcccgccgcucaccg

SEQ ID NO: 825954 - RNA, 21 nt, Mycobacterium avium subsp. paratuberculosis
gcccgccgcucaccgccgagc

SEQ ID NO: 825955 - RNA, 22 nt, Mycobacterium avium subsp. paratuberculosis
gcccgccgcucaccgccgagcc

SEQ ID NO: 825956 - RNA, 19 nt, Mycobacterium avium subsp. paratuberculosis
gcccgccgcugacgcggcg

SEQ ID NO: 825957 - RNA, 12 nt, Mycobacterium avium subsp. paratuberculosis
gcccgccgcugc

SEQ ID NO: 825958 - RNA, 13 nt, Mycobacterium avium subsp. paratuberculosis
gcccgccgcugca

SEQ ID NO: 825959 - RNA, 15 nt, Mycobacterium avium subsp. paratuberculosis
gcccgccgcugcagc

SEQ ID NO: 825960 - RNA, 13 nt, Mycobacterium avium subsp. paratuberculosis
gcccgacgagucg

SEQ ID NO: 825961 - RNA, 19 nt, Mycobacterium avium subsp. paratuberculosis
gcccgacgagucgccguug

SEQ ID NO: 825962 - RNA, 21 nt, Mycobacterium avium subsp. paratuberculosis
gcccgacgaugcggggcggcg

SEQ ID NO: 825963 - RNA, 14 nt, Mycobacterium avium subsp. paratuberculosis
gcccgacggcagca

SEQ ID NO: 825964 - RNA, 18 nt, Mycobacterium avium subsp. paratuberculosis
gcccgacggcagcaccgc

SEQ ID NO: 825965 - RNA, 20 nt, Mycobacterium avium subsp. paratuberculosis
gcccgacggcagcaccgccg

SEQ ID NO: 825966 - RNA, 21 nt, Mycobacterium avium subsp. paratuberculosis
gcccgacggcagcaccgccga

SEQ ID NO: 825967 - RNA, 13 nt, Mycobacterium avium subsp. paratuberculosis
gcccgacggcgcg

SEQ ID NO: 825968 - RNA, 13 nt, Mycobacterium avium subsp. paratuberculosis
gcccgacgccgga

SEQ ID NO: 825969 - RNA, 14 nt, Mycobacterium avium subsp. paratuberculosis
gcccgacgggcgug

SEQ ID NO: 825970 - RNA, 16 nt, Mycobacterium avium subsp. paratuberculosis
gcccgacgggcgugcc

SEQ ID NO: 825971 - RNA, 18 nt, Mycobacterium avium subsp. paratuberculosis
gcccgacggguucgcgca

SEQ ID NO: 825972 - RNA, 20 nt, Mycobacterium avium subsp. paratuberculosis
gcccgacggguucgcgcagc

SEQ ID NO: 825973 - RNA, 21 nt, Mycobacterium avium subsp. paratuberculosis
gcccgacggguucgcgcagcc

SEQ ID NO: 825974 - RNA, 14 nt, Mycobacterium avium subsp. paratuberculosis
gcccgacggucgcc

SEQ ID NO: 825975 - RNA, 17 nt, Mycobacterium avium subsp. paratuberculosis
gcccgacggucgccacc

SEQ ID NO: 825976 - RNA, 20 nt, Mycobacterium avium subsp. paratuberculosis
gcccgacggucgccaccacc

SEQ ID NO: 825977 - RNA, 16 nt, Mycobacterium avium subsp. paratuberculosis
gcccgacgacgacguc

SEQ ID NO: 825978 - RNA, 22 nt, Mycobacterium avium subsp. paratuberculosis
gcccgacgacgacgucgacgac

SEQ ID NO: 825979 - RNA, 13 nt, Mycobacterium avium subsp. paratuberculosis
gcccgacgacgau

SEQ ID NO: 825980 - RNA, 15 nt, Mycobacterium avium subsp. paratuberculosis
gcccgacgacgccgu

SEQ ID NO: 825981 - RNA, 18 nt, Mycobacterium avium subsp. paratuberculosis
gcccgaccuucugcugca

SEQ ID NO: 825982 - RNA, 15 nt, Mycobacterium avium subsp. paratuberculosis
gcccgaccgcgccga

SEQ ID NO: 825983 - RNA, 17 nt, Mycobacterium avium subsp. paratuberculosis
gcccgaccgcgccgaac

SEQ ID NO: 825984 - RNA, 18 nt, Mycobacterium avium subsp. paratuberculosis
gcccgaccgcgccgaaca

SEQ ID NO: 825985 - RNA, 17 nt, Mycobacterium avium subsp. paratuberculosis
gccccuggcgucgggcu

SEQ ID NO: 825986 - RNA, 15 nt, Mycobacterium avium subsp. paratuberculosis
gcccgacccggucag

SEQ ID NO: 825987 - RNA, 16 nt, Mycobacterium avium subsp. paratuberculosis
gcccgacccguccagc

SEQ ID NO: 825988 - RNA, 20 nt, Mycobacterium avium subsp. paratuberculosis
gcccgacccguccagcagca

SEQ ID NO: 825989 - RNA, 15 nt, Mycobacterium avium subsp. paratuberculosis
gcccgauaggccgac

SEQ ID NO: 825990 - RNA, 15 nt, Mycobacterium avium subsp. paratuberculosis
gcccgaucagccggg

SEQ ID NO: 825991 - RNA, 18 nt, Mycobacterium avium subsp. paratuberculosis
gcccgaucaucucaccga

SEQ ID NO: 825992 - RNA, 19 nt, Mycobacterium avium subsp. paratuberculosis
gcccgaucaucucaccgac

SEQ ID NO: 825993 - RNA, 13 nt, Mycobacterium avium subsp. paratuberculosis
gcccgaucccggg

SEQ ID NO: 825994 - RNA, 16 nt, Mycobacterium avium subsp. paratuberculosis
gcccgaucccgucguc

SEQ ID NO: 825995 - RNA, 17 nt, Mycobacterium avium subsp. paratuberculosis
gcccgaucccgucgucg

SEQ ID NO: 825996 - RNA, 19 nt, Mycobacterium avium subsp. paratuberculosis
gcccgaucccgucgucggc

SEQ ID NO: 825997 - RNA, 20 nt, Mycobacterium avium subsp. paratuberculosis
gcccgaucccgucgucggcg

SEQ ID NO: 825998 - RNA, 23 nt, Mycobacterium avium subsp. paratuberculosis
gcccgaucccgucgucggcgccg

SEQ ID NO: 825999 - RNA, 21 nt, Mycobacterium avium subsp. paratuberculosis
gcccgagcaacugggugagca

SEQ ID NO: 826000 - RNA, 14 nt, Mycobacterium avium subsp. paratuberculosis
gcccgagcaccagc

SEQ ID NO: 826001 - RNA, 15 nt, Mycobacterium avium subsp. paratuberculosis
gcccgagcaccagcg

SEQ ID NO: 826002 - RNA, 21 nt, Mycobacterium avium subsp. paratuberculosis
gcccgagcaccagcggacccu

SEQ ID NO: 826003 - RNA, 17 nt, Mycobacterium avium subsp. paratuberculosis
gcccgagaucaccggcu

SEQ ID NO: 826004 - RNA, 23 nt, Mycobacterium avium subsp. paratuberculosis
gcccgagaucaccggcuuggcgg

SEQ ID NO: 826005 - RNA, 23 nt, Mycobacterium avium subsp. paratuberculosis
gcccgagcaccugaacggccgcg

SEQ ID NO: 826006 - RNA, 18 nt, Mycobacterium avium subsp. paratuberculosis
gcccgagcacguugugcu

SEQ ID NO: 826007 - RNA, 19 nt, Mycobacterium avium subsp. paratuberculosis
gcccgagcauuucgcgcac

SEQ ID NO: 826008 - RNA, 22 nt, Mycobacterium avium subsp. paratuberculosis
gcccgagcauuucgcgcacguc

SEQ ID NO: 826009 - RNA, 12 nt, Mycobacterium avium subsp. paratuberculosis
gcccgagcccga

SEQ ID NO: 826010 - RNA, 16 nt, Mycobacterium avium subsp. paratuberculosis
gcccgagcccugcgcc

SEQ ID NO: 826011 - RNA, 17 nt, Mycobacterium avium subsp. paratuberculosis
gcccgagcccugcgcca

SEQ ID NO: 826012 - RNA, 18 nt, Mycobacterium avium subsp. paratuberculosis
gcccgagcccugcgccag

SEQ ID NO: 826013 - RNA, 14 nt, Mycobacterium avium subsp. paratuberculosis
gccccugcggggug

SEQ ID NO: 826014 - RNA, 19 nt, Mycobacterium avium subsp. paratuberculosis
gccccugcggggugucgac

SEQ ID NO: 826015 - RNA, 22 nt, Mycobacterium avium subsp. paratuberculosis
gccccugcggggugucgaccca

SEQ ID NO: 826016 - RNA, 14 nt, Mycobacterium avium subsp. paratuberculosis
gccccugcaccacg

SEQ ID NO: 826017 - RNA, 21 nt, Mycobacterium avium subsp. paratuberculosis
gccccugcuggguuccgcgag

SEQ ID NO: 826018 - RNA, 15 nt, Mycobacterium avium subsp. paratuberculosis
gccccucggggcugc

SEQ ID NO: 826019 - RNA, 21 nt, Mycobacterium avium subsp. paratuberculosis
gccccucggggcugcgcggcu

SEQ ID NO: 826020 - RNA, 12 nt, Mycobacterium avium subsp. paratuberculosis
gccccguucggu

SEQ ID NO: 826021 - RNA, 17 nt, Mycobacterium avium subsp. paratuberculosis
gccccguucgguggcca

SEQ ID NO: 826022 - RNA, 23 nt, Mycobacterium avium subsp. paratuberculosis
gccccguucgguggccaccgcga

SEQ ID NO: 826023 - RNA, 20 nt, Mycobacterium avium subsp. paratuberculosis
gccccugagggugucggcga

SEQ ID NO: 826024 - RNA, 16 nt, Mycobacterium avium subsp. paratuberculosis
gccccgucggucccga

SEQ ID NO: 826025 - RNA, 19 nt, Mycobacterium avium subsp. paratuberculosis
gccccgucggucccgacgc

SEQ ID NO: 826026 - RNA, 22 nt, Mycobacterium avium subsp. paratuberculosis
gccccgucggucccgacgcggc

SEQ ID NO: 826027 - RNA, 20 nt, Mycobacterium avium subsp. paratuberculosis
gccccguggaucaucccgac

SEQ ID NO: 826028 - RNA, 18 nt, Mycobacterium avium subsp. paratuberculosis
gccccguccggcgccagc

SEQ ID NO: 826029 - RNA, 20 nt, Mycobacterium avium subsp. paratuberculosis
gccccguauugccgucggcg

SEQ ID NO: 826030 - RNA, 21 nt, Mycobacterium avium subsp. paratuberculosis
gccccguauugccgucggcgu

SEQ ID NO: 826031 - RNA, 20 nt, Mycobacterium avium subsp. paratuberculosis
gccccgguuccaaccaccgu

SEQ ID NO: 826032 - RNA, 23 nt, Mycobacterium avium subsp. paratuberculosis
gccccgguuuucgccucggucug

SEQ ID NO: 826033 - RNA, 16 nt, Mycobacterium avium subsp. paratuberculosis
gccccggucccgccgg

SEQ ID NO: 826034 - RNA, 17 nt, Mycobacterium avium subsp. paratuberculosis
gccccggucccgccggu

SEQ ID NO: 826035 - RNA, 15 nt, Mycobacterium avium subsp. paratuberculosis
gccccggucccgggg

SEQ ID NO: 826036 - RNA, 14 nt, Mycobacterium avium subsp. paratuberculosis
gccccgguccggcu

SEQ ID NO: 826037 - RNA, 23 nt, Mycobacterium avium subsp. paratuberculosis
gccccgguccggcugaacgccag

SEQ ID NO: 826038 - RNA, 23 nt, Mycobacterium avium subsp. paratuberculosis
gccccgcccgaucccgucgucgg

SEQ ID NO: 826039 - RNA, 20 nt, Mycobacterium avium subsp. paratuberculosis
gccccgguagccagcaccgc

SEQ ID NO: 826040 - RNA, 21 nt, Mycobacterium avium subsp. paratuberculosis
gccccgguagccagcaccgcc

SEQ ID NO: 826041 - RNA, 16 nt, Mycobacterium avium subsp. paratuberculosis
gccccggucaccccgg

SEQ ID NO: 826042 - RNA, 17 nt, Mycobacterium avium subsp. paratuberculosis
gccccggucaccccggc

SEQ ID NO: 826043 - RNA, 17 nt, Mycobacterium avium subsp. paratuberculosis
gccccgccaggcggcga

SEQ ID NO: 826044 - RNA, 18 nt, Mycobacterium avium subsp. paratuberculosis
gccccgccaggcggcgac

SEQ ID NO: 826045 - RNA, 14 nt, Mycobacterium avium subsp. paratuberculosis
gccccgcccggcgc

SEQ ID NO: 826046 - RNA, 18 nt, Mycobacterium avium subsp. paratuberculosis
gccccgcccggcgcgcag

SEQ ID NO: 826047 - RNA, 15 nt, Mycobacterium avium subsp. paratuberculosis
gccccgcccggcggc

SEQ ID NO: 826048 - RNA, 17 nt, Mycobacterium avium subsp. paratuberculosis
gccccgcccggcggcca

SEQ ID NO: 826049 - RNA, 19 nt, Mycobacterium avium subsp. paratuberculosis
gccccgcccggcggccacc

SEQ ID NO: 826050 - RNA, 16 nt, Mycobacterium avium subsp. paratuberculosis
gccccgcccggggcgg

SEQ ID NO: 826051 - RNA, 23 nt, Mycobacterium avium subsp. paratuberculosis
gccccgcccuugaacggcaccag

SEQ ID NO: 826052 - RNA, 21 nt, Mycobacterium avium subsp. paratuberculosis
gccccgacgaucgcgccggcc

SEQ ID NO: 826053 - RNA, 23 nt, Mycobacterium avium subsp. paratuberculosis
gccccgccagauagggcagcguc

SEQ ID NO: 826054 - RNA, 23 nt, Mycobacterium avium subsp. paratuberculosis
gccccgccagcagaugccgccca

SEQ ID NO: 826055 - RNA, 23 nt, Mycobacterium avium subsp. paratuberculosis
gccccaguucgaucagcagcucg

SEQ ID NO: 826056 - RNA, 21 nt, Mycobacterium avium subsp. paratuberculosis
gccccagugcaggcaggcccc

SEQ ID NO: 826057 - RNA, 13 nt, Mycobacterium avium subsp. paratuberculosis
gccccagugggug

SEQ ID NO: 826058 - RNA, 16 nt, Mycobacterium avium subsp. paratuberculosis
gccccaguuggcgucg

SEQ ID NO: 826059 - RNA, 20 nt, Mycobacterium avium subsp. paratuberculosis
gccccaguuggcgucgucgg

SEQ ID NO: 826060 - RNA, 21 nt, Mycobacterium avium subsp. paratuberculosis
gccccaguuggcgucgucggc

SEQ ID NO: 826061 - RNA, 20 nt, Mycobacterium avium subsp. paratuberculosis
gccccaggucggggugggcg

SEQ ID NO: 826062 - RNA, 22 nt, Mycobacterium avium subsp. paratuberculosis
gccccaggucggggugggcgac

SEQ ID NO: 826063 - RNA, 14 nt, Mycobacterium avium subsp. paratuberculosis
gccccagguuccgg

SEQ ID NO: 826064 - RNA, 23 nt, Mycobacterium avium subsp. paratuberculosis
gccccagggaccagugguggccg

SEQ ID NO: 826065 - RNA, 18 nt, Mycobacterium avium subsp. paratuberculosis
gccccagggugcgccgcu

SEQ ID NO: 826066 - RNA, 23 nt, Mycobacterium avium subsp. paratuberculosis
gccccagguagauucccaugucg

SEQ ID NO: 826067 - RNA, 12 nt, Mycobacterium avium subsp. paratuberculosis
gcccccgccgcg

SEQ ID NO: 826068 - RNA, 14 nt, Mycobacterium avium subsp. paratuberculosis
gcccccgccgcgag

SEQ ID NO: 826069 - RNA, 15 nt, Mycobacterium avium subsp. paratuberculosis
gcccccgccucgccg

SEQ ID NO: 826070 - RNA, 16 nt, Mycobacterium avium subsp. paratuberculosis
gcccccgccucgccgg

SEQ ID NO: 826071 - RNA, 17 nt, Mycobacterium avium subsp. paratuberculosis
gcccccgccucgccggu

SEQ ID NO: 826072 - RNA, 18 nt, Mycobacterium avium subsp. paratuberculosis
gccccccuugagccgguc

SEQ ID NO: 826073 - RNA, 23 nt, Mycobacterium avium subsp. paratuberculosis
gcccccgaaaugcaucagcguga

SEQ ID NO: 826074 - RNA, 13 nt, Mycobacterium avium subsp. paratuberculosis
gccccccugcucg

SEQ ID NO: 826075 - RNA, 18 nt, Mycobacterium avium subsp. paratuberculosis
gccccccgggcaccagcg

SEQ ID NO: 826076 - RNA, 13 nt, Mycobacterium avium subsp. paratuberculosis
gcccccgacaggc

SEQ ID NO: 826077 - RNA, 20 nt, Mycobacterium avium subsp. paratuberculosis
gcccccgaggagacgucggc

SEQ ID NO: 826078 - RNA, 17 nt, Mycobacterium avium subsp. paratuberculosis
gcccccgauagccccgc

SEQ ID NO: 826079 - RNA, 13 nt, Mycobacterium avium subsp. paratuberculosis
gcccccgaugaac

SEQ ID NO: 826080 - RNA, 22 nt, Mycobacterium avium subsp. paratuberculosis
gccccgcagugaaauucgcgcc

SEQ ID NO: 826081 - RNA, 21 nt, Mycobacterium avium subsp. paratuberculosis
gccccgaugguauccgaucgc

SEQ ID NO: 826082 - RNA, 15 nt, Mycobacterium avium subsp. paratuberculosis
gccccgcaccgagcc

SEQ ID NO: 826083 - RNA, 16 nt, Mycobacterium avium subsp. paratuberculosis
gccccgcaccgagccu

SEQ ID NO: 826084 - RNA, 13 nt, Mycobacterium avium subsp. paratuberculosis
gccccgcaccgcc

SEQ ID NO: 826085 - RNA, 14 nt, Mycobacterium avium subsp. paratuberculosis
gccccgcaccgcca

SEQ ID NO: 826086 - RNA, 15 nt, Mycobacterium avium subsp. paratuberculosis
gccccgcaccgccag

SEQ ID NO: 826087 - RNA, 17 nt, Mycobacterium avium subsp. paratuberculosis
gccccgcaccgccaggc

SEQ ID NO: 826088 - RNA, 18 nt, Mycobacterium avium subsp. paratuberculosis
gccccgaucggauccgcc

SEQ ID NO: 826089 - RNA, 22 nt, Mycobacterium avium subsp. paratuberculosis
gcccccgcgggucgucgacguc

SEQ ID NO: 826090 - RNA, 18 nt, Mycobacterium avium subsp. paratuberculosis
gccccgaguccacgacgu

SEQ ID NO: 826091 - RNA, 19 nt, Mycobacterium avium subsp. paratuberculosis
gccccgaguccacgacguc

SEQ ID NO: 826092 - RNA, 19 nt, Mycobacterium avium subsp. paratuberculosis
gccccgaguuccagcuccg

SEQ ID NO: 826093 - RNA, 14 nt, Mycobacterium avium subsp. paratuberculosis
gcccccgcggcggc

SEQ ID NO: 826094 - RNA, 14 nt, Mycobacterium avium subsp. paratuberculosis
gcccccgcccggcc

SEQ ID NO: 826095 - RNA, 15 nt, Mycobacterium avium subsp. paratuberculosis
gcccccgcccggccg

SEQ ID NO: 826096 - RNA, 14 nt, Mycobacterium avium subsp. paratuberculosis
gcccccgcgacguc

SEQ ID NO: 826097 - RNA, 18 nt, Mycobacterium avium subsp. paratuberculosis
gccccgagaucccagcgg

SEQ ID NO: 826098 - RNA, 14 nt, Mycobacterium avium subsp. paratuberculosis
gccccgagcagcgg

SEQ ID NO: 826099 - RNA, 15 nt, Mycobacterium avium subsp. paratuberculosis
gccccgagccgacga

SEQ ID NO: 826100 - RNA, 12 nt, Mycobacterium avium subsp. paratuberculosis
gccccgagccgc

SEQ ID NO: 826101 - RNA, 14 nt, Mycobacterium avium subsp. paratuberculosis
gccccgagccgcgg

SEQ ID NO: 826102 - RNA, 15 nt, Mycobacterium avium subsp. paratuberculosis
gccccgagccgcgga

SEQ ID NO: 826103 - RNA, 19 nt, Mycobacterium avium subsp. paratuberculosis
gccccgacgugcagcgcca

SEQ ID NO: 826104 - RNA, 22 nt, Mycobacterium avium subsp. paratuberculosis
gccccgacgugcagcgccagca

SEQ ID NO: 826105 - RNA, 14 nt, Mycobacterium avium subsp. paratuberculosis
gccccgagcgucac

SEQ ID NO: 826106 - RNA, 18 nt, Mycobacterium avium subsp. paratuberculosis
gccccgagcgucacgcca

SEQ ID NO: 826107 - RNA, 21 nt, Mycobacterium avium subsp. paratuberculosis
gccccgagcgucacgccagcg

SEQ ID NO: 826108 - RNA, 23 nt, Mycobacterium avium subsp. paratuberculosis
gcccaucugcacagcuucggcgc

SEQ ID NO: 826109 - RNA, 14 nt, Mycobacterium avium subsp. paratuberculosis
gcccaugccgaugc

SEQ ID NO: 826110 - RNA, 15 nt, Mycobacterium avium subsp. paratuberculosis
gcccaugccgaugcc

SEQ ID NO: 826111 - RNA, 17 nt, Mycobacterium avium subsp. paratuberculosis
gcccaugaucacaccgc

SEQ ID NO: 826112 - RNA, 20 nt, Mycobacterium avium subsp. paratuberculosis
gcccaugaucacaccgcugu

SEQ ID NO: 826113 - RNA, 20 nt, Mycobacterium avium subsp. paratuberculosis
gcccaugaacgcgucgccgu

SEQ ID NO: 826114 - RNA, 23 nt, Mycobacterium avium subsp. paratuberculosis
gcccaugaacgcgucgccgugcc

SEQ ID NO: 826115 - RNA, 18 nt, Mycobacterium avium subsp. paratuberculosis
gcccaucggcagcccgga

SEQ ID NO: 826116 - RNA, 18 nt, Mycobacterium avium subsp. paratuberculosis
gccccagaaccgcucggc

SEQ ID NO: 826117 - RNA, 19 nt, Mycobacterium avium subsp. paratuberculosis
gccccagaaccgcucggcg

SEQ ID NO: 826118 - RNA, 21 nt, Mycobacterium avium subsp. paratuberculosis
gccccagaaccgcucggcggc

SEQ ID NO: 826119 - RNA, 22 nt, Mycobacterium avium subsp. paratuberculosis
gccccagaaccgcucggcggcg

SEQ ID NO: 826120 - RNA, 12 nt, Mycobacterium avium subsp. paratuberculosis
gccccacgccag

SEQ ID NO: 826121 - RNA, 21 nt, Mycobacterium avium subsp. paratuberculosis
gccccacggucuuugccggcc

SEQ ID NO: 826122 - RNA, 18 nt, Mycobacterium avium subsp. paratuberculosis
gccccacggcgcgugcug

SEQ ID NO: 826123 - RNA, 20 nt, Mycobacterium avium subsp. paratuberculosis
gccccacgcgcucagcgcgg

SEQ ID NO: 826124 - RNA, 22 nt, Mycobacterium avium subsp. paratuberculosis
gccccacgcgcucagcgcggcc

SEQ ID NO: 826125 - RNA, 13 nt, Mycobacterium avium subsp. paratuberculosis
gccccacggcccg

SEQ ID NO: 826126 - RNA, 23 nt, Mycobacterium avium subsp. paratuberculosis
gccccaggcgaacauggcggcca

SEQ ID NO: 826127 - RNA, 24 nt, Mycobacterium avium subsp. paratuberculosis
gccccaggcgaacauggcggccag

SEQ ID NO: 826128 - RNA, 22 nt, Mycobacterium avium subsp. paratuberculosis
gccccagacguuuccguccggc

SEQ ID NO: 826129 - RNA, 23 nt, Mycobacterium avium subsp. paratuberculosis
gccccagacguuuccguccggcg

SEQ ID NO: 826130 - RNA, 17 nt, Mycobacterium avium subsp. paratuberculosis
gccccagacgaaguaga

SEQ ID NO: 826131 - RNA, 23 nt, Mycobacterium avium subsp. paratuberculosis
gccccagcacgaucccgccgccc

SEQ ID NO: 826132 - RNA, 17 nt, Mycobacterium avium subsp. paratuberculosis
gcccaucaccagcagac

SEQ ID NO: 826133 - RNA, 22 nt, Mycobacterium avium subsp. paratuberculosis
gcccaucaccagcagacccgac

SEQ ID NO: 826134 - RNA, 19 nt, Mycobacterium avium subsp. paratuberculosis
gcccaucaccgcaccgacg

SEQ ID NO: 826135 - RNA, 13 nt, Mycobacterium avium subsp. paratuberculosis
gcccaucaccgga

SEQ ID NO: 826136 - RNA, 14 nt, Mycobacterium avium subsp. paratuberculosis
gcccaucaccggac

SEQ ID NO: 826137 - RNA, 15 nt, Mycobacterium avium subsp. paratuberculosis
gcccaucacgcccca

SEQ ID NO: 826138 - RNA, 18 nt, Mycobacterium avium subsp. paratuberculosis
gcccaucacgucggggcc

SEQ ID NO: 826139 - RNA, 22 nt, Mycobacterium avium subsp. paratuberculosis
gcccaucccgauccgcgccgcc

SEQ ID NO: 826140 - RNA, 23 nt, Mycobacterium avium subsp. paratuberculosis
gcccaucccgauccgcgccgccg

SEQ ID NO: 826141 - RNA, 17 nt, Mycobacterium avium subsp. paratuberculosis
gcccauccggcgccgcg

SEQ ID NO: 826142 - RNA, 18 nt, Mycobacterium avium subsp. paratuberculosis
gcccauccggcgccgcgc

SEQ ID NO: 826143 - RNA, 13 nt, Mycobacterium avium subsp. paratuberculosis
gcccaucgacccg

SEQ ID NO: 826144 - RNA, 14 nt, Mycobacterium avium subsp. paratuberculosis
gcccaucgaccgga

SEQ ID NO: 826145 - RNA, 13 nt, Mycobacterium avium subsp. paratuberculosis
gcccaucgccacg

SEQ ID NO: 826146 - RNA, 17 nt, Mycobacterium avium subsp. paratuberculosis
gcccaucgccacgccgu

SEQ ID NO: 826147 - RNA, 21 nt, Mycobacterium avium subsp. paratuberculosis
gcccaucgccacgccguggcc

SEQ ID NO: 826148 - RNA, 20 nt, Mycobacterium avium subsp. paratuberculosis
gcccaguugcacgguguaga

SEQ ID NO: 826149 - RNA, 18 nt, Mycobacterium avium subsp. paratuberculosis
gcccagguucuccggccc

SEQ ID NO: 826150 - RNA, 20 nt, Mycobacterium avium subsp. paratuberculosis
gcccagguucuccggcccgc

SEQ ID NO: 826151 - RNA, 21 nt, Mycobacterium avium subsp. paratuberculosis
gcccagguucuccggcccgcu

SEQ ID NO: 826152 - RNA, 14 nt, Mycobacterium avium subsp. paratuberculosis
gcccaggugcaccc

SEQ ID NO: 826153 - RNA, 20 nt, Mycobacterium avium subsp. paratuberculosis
gcccaggugcagaccggaca

SEQ ID NO: 826154 - RNA, 13 nt, Mycobacterium avium subsp. paratuberculosis
gcccagguccacc

SEQ ID NO: 826155 - RNA, 19 nt, Mycobacterium avium subsp. paratuberculosis
gcccagguaguagcgccac

SEQ ID NO: 826156 - RNA, 13 nt, Mycobacterium avium subsp. paratuberculosis
gcccaggucguga

SEQ ID NO: 826157 - RNA, 13 nt, Mycobacterium avium subsp. paratuberculosis
gcccagccggccg

SEQ ID NO: 826158 - RNA, 14 nt, Mycobacterium avium subsp. paratuberculosis
gcccagccggccga

SEQ ID NO: 826159 - RNA, 21 nt, Mycobacterium avium subsp. paratuberculosis
gcccagccggccgacgcggcc

SEQ ID NO: 826160 - RNA, 14 nt, Mycobacterium avium subsp. paratuberculosis
gcccagccggcgga

SEQ ID NO: 826161 - RNA, 20 nt, Mycobacterium avium subsp. paratuberculosis
gcccagccggucgccgggcc

SEQ ID NO: 826162 - RNA, 13 nt, Mycobacterium avium subsp. paratuberculosis
gcccagccgcguc

SEQ ID NO: 826163 - RNA, 16 nt, Mycobacterium avium subsp. paratuberculosis
gcccagccgcgucacg

SEQ ID NO: 826164 - RNA, 12 nt, Mycobacterium avium subsp. paratuberculosis
gcccagccggcc

SEQ ID NO: 826165 - RNA, 15 nt, Mycobacterium avium subsp. paratuberculosis
gcccagccggugcga

SEQ ID NO: 826166 - RNA, 20 nt, Mycobacterium avium subsp. paratuberculosis
gcccagcgagcugccggcgg

SEQ ID NO: 826167 - RNA, 21 nt, Mycobacterium avium subsp. paratuberculosis
gcccagcggcuugagccggau

SEQ ID NO: 826168 - RNA, 20 nt, Mycobacterium avium subsp. paratuberculosis
gcccagcggggcgaccuugc

SEQ ID NO: 826169 - RNA, 18 nt, Mycobacterium avium subsp. paratuberculosis
gcccagcgacucggccag

SEQ ID NO: 826170 - RNA, 20 nt, Mycobacterium avium subsp. paratuberculosis
gcccagcgucaacucgucgg

SEQ ID NO: 826171 - RNA, 18 nt, Mycobacterium avium subsp. paratuberculosis
gcccagcucguugccggc

SEQ ID NO: 826172 - RNA, 20 nt, Mycobacterium avium subsp. paratuberculosis
gcccagcucguugccggcgg

SEQ ID NO: 826173 - RNA, 22 nt, Mycobacterium avium subsp. paratuberculosis
gcccagcucguugccggcggcc

SEQ ID NO: 826174 - RNA, 12 nt, Mycobacterium avium subsp. paratuberculosis
gcccagcucggu

SEQ ID NO: 826175 - RNA, 14 nt, Mycobacterium avium subsp. paratuberculosis
gcccagcucgguga

SEQ ID NO: 826176 - RNA, 15 nt, Mycobacterium avium subsp. paratuberculosis
gcccagcucggugau

SEQ ID NO: 826177 - RNA, 22 nt, Mycobacterium avium subsp. paratuberculosis
gcccagcucggugaucugcacc

SEQ ID NO: 826178 - RNA, 21 nt, Mycobacterium avium subsp. paratuberculosis
gcccagcucggugaugaucgc

SEQ ID NO: 826179 - RNA, 21 nt, Mycobacterium avium subsp. paratuberculosis
gcccagcuccaaugcggccga

SEQ ID NO: 826180 - RNA, 22 nt, Mycobacterium avium subsp. paratuberculosis
gcccagcuccaaugcggccgac

SEQ ID NO: 826181 - RNA, 22 nt, Mycobacterium avium subsp. paratuberculosis
gcccagcuccacgcguagccga

SEQ ID NO: 826182 - RNA, 17 nt, Mycobacterium avium subsp. paratuberculosis
gcccagcgugucggcga

SEQ ID NO: 826183 - RNA, 20 nt, Mycobacterium avium subsp. paratuberculosis
gcccagcgugucggcgaucg

SEQ ID NO: 826184 - RNA, 14 nt, Mycobacterium avium subsp. paratuberculosis
gcccagcgugguca

SEQ ID NO: 826185 - RNA, 18 nt, Mycobacterium avium subsp. paratuberculosis
gcccagcgucucggcggc

SEQ ID NO: 826186 - RNA, 20 nt, Mycobacterium avium subsp. paratuberculosis
gcccagcgucucggcggccg

SEQ ID NO: 826187 - RNA, 13 nt, Mycobacterium avium subsp. paratuberculosis
gcccaggccggcg

SEQ ID NO: 826188 - RNA, 15 nt, Mycobacterium avium subsp. paratuberculosis
gcccaggccggcgag

SEQ ID NO: 826189 - RNA, 22 nt, Mycobacterium avium subsp. paratuberculosis
gcccaggccggcgagcucgcgg

SEQ ID NO: 826190 - RNA, 14 nt, Mycobacterium avium subsp. paratuberculosis
gcccaggccggcgg

SEQ ID NO: 826191 - RNA, 16 nt, Mycobacterium avium subsp. paratuberculosis
gcccaggccggcggug

SEQ ID NO: 826192 - RNA, 15 nt, Mycobacterium avium subsp. paratuberculosis
gcccaggccgcgguc

SEQ ID NO: 826193 - RNA, 16 nt, Mycobacterium avium subsp. paratuberculosis
gcccaggccgcggucg

SEQ ID NO: 826194 - RNA, 21 nt, Mycobacterium avium subsp. paratuberculosis
gcccaggccccggccgagcgc

SEQ ID NO: 826195 - RNA, 14 nt, Mycobacterium avium subsp. paratuberculosis
gcccaggccgaugg

SEQ ID NO: 826196 - RNA, 23 nt, Mycobacterium avium subsp. paratuberculosis
gcccaggccgauggugguaccga

SEQ ID NO: 826197 - RNA, 13 nt, Mycobacterium avium subsp. paratuberculosis
gcccaggccgcca

SEQ ID NO: 826198 - RNA, 14 nt, Mycobacterium avium subsp. paratuberculosis
gcccaggccgccag

SEQ ID NO: 826199 - RNA, 15 nt, Mycobacterium avium subsp. paratuberculosis
gcccaggccgccagc

SEQ ID NO: 826200 - RNA, 16 nt, Mycobacterium avium subsp. paratuberculosis
gcccaggccgccagcu

SEQ ID NO: 826201 - RNA, 18 nt, Mycobacterium avium subsp. paratuberculosis
gcccaggccgccagcucg

SEQ ID NO: 826202 - RNA, 22 nt, Mycobacterium avium subsp. paratuberculosis
gcccaggccgacgccggccacc

SEQ ID NO: 826203 - RNA, 23 nt, Mycobacterium avium subsp. paratuberculosis
gcccaggccgacgccggccacca

SEQ ID NO: 826204 - RNA, 19 nt, Mycobacterium avium subsp. paratuberculosis
gcccaggcccagcagcacc

SEQ ID NO: 826205 - RNA, 22 nt, Mycobacterium avium subsp. paratuberculosis
gcccaggcccagcagcaccgcg

SEQ ID NO: 826206 - RNA, 16 nt, Mycobacterium avium subsp. paratuberculosis
gcccagcugcacccac

SEQ ID NO: 826207 - RNA, 20 nt, Mycobacterium avium subsp. paratuberculosis
gcccagcugcacccaccggc

SEQ ID NO: 826208 - RNA, 21 nt, Mycobacterium avium subsp. paratuberculosis
gcccagcugcauggacagcga

SEQ ID NO: 826209 - RNA, 13 nt, Mycobacterium avium subsp. paratuberculosis
gcccagcugcugg

SEQ ID NO: 826210 - RNA, 21 nt, Mycobacterium avium subsp. paratuberculosis
gcccuuggcggccacgacggc

SEQ ID NO: 826211 - RNA, 15 nt, Mycobacterium avium subsp. paratuberculosis
gcccuuggcgcccag

SEQ ID NO: 826212 - RNA, 18 nt, Mycobacterium avium subsp. paratuberculosis
gcccuuggcgcccagcgu

SEQ ID NO: 826213 - RNA, 23 nt, Mycobacterium avium subsp. paratuberculosis
gcccuuggcgcccagcgugguca

SEQ ID NO: 826214 - RNA, 13 nt, Mycobacterium avium subsp. paratuberculosis
gcccuugcucgcg

SEQ ID NO: 826215 - RNA, 14 nt, Mycobacterium avium subsp. paratuberculosis
gcccuugcucgcgg

SEQ ID NO: 826216 - RNA, 20 nt, Mycobacterium avium subsp. paratuberculosis
gcccuugcucgcggcguagg

SEQ ID NO: 826217 - RNA, 23 nt, Mycobacterium avium subsp. paratuberculosis
gcccuugccccaccaccgccggc

SEQ ID NO: 826218 - RNA, 12 nt, Mycobacterium avium subsp. paratuberculosis
gcccuugccgau

SEQ ID NO: 826219 - RNA, 19 nt, Mycobacterium avium subsp. paratuberculosis
gcccuugcagcacaccggc

SEQ ID NO: 826220 - RNA, 21 nt, Mycobacterium avium subsp. paratuberculosis
gcccuugaucgucuugccgaa

SEQ ID NO: 826221 - RNA, 14 nt, Mycobacterium avium subsp. paratuberculosis
gcccuugaccgccu

SEQ ID NO: 826222 - RNA, 20 nt, Mycobacterium avium subsp. paratuberculosis
gcccuugaacggcaccagcg

SEQ ID NO: 826223 - RNA, 16 nt, Mycobacterium avium subsp. paratuberculosis
gcccuucgaccucgag

SEQ ID NO: 826224 - RNA, 17 nt, Mycobacterium avium subsp. paratuberculosis
gcccugugaggcguugg

SEQ ID NO: 826225 - RNA, 16 nt, Mycobacterium avium subsp. paratuberculosis
gcccuguucgccgucg

SEQ ID NO: 826226 - RNA, 23 nt, Mycobacterium avium subsp. paratuberculosis
gcccuguucgccgucgcgggugg

SEQ ID NO: 826227 - RNA, 15 nt, Mycobacterium avium subsp. paratuberculosis
gcccuucaccucggc

SEQ ID NO: 826228 - RNA, 16 nt, Mycobacterium avium subsp. paratuberculosis
gcccuuccccggcggc

SEQ ID NO: 826229 - RNA, 19 nt, Mycobacterium avium subsp. paratuberculosis
gcccugguacgcgccgucg

SEQ ID NO: 826230 - RNA, 23 nt, Mycobacterium avium subsp. paratuberculosis
gcccugguacgcgccgucgucgu

SEQ ID NO: 826231 - RNA, 15 nt, Mycobacterium avium subsp. paratuberculosis
gcccuggucggccag

SEQ ID NO: 826232 - RNA, 18 nt, Mycobacterium avium subsp. paratuberculosis
gcccuggugcaacaccga

SEQ ID NO: 826233 - RNA, 20 nt, Mycobacterium avium subsp. paratuberculosis
gcccugguugagcaccgcga

SEQ ID NO: 826234 - RNA, 20 nt, Mycobacterium avium subsp. paratuberculosis
gcccugguugauccagcggc

SEQ ID NO: 826235 - RNA, 17 nt, Mycobacterium avium subsp. paratuberculosis
gcccugggggucgguga

SEQ ID NO: 826236 - RNA, 17 nt, Mycobacterium avium subsp. paratuberculosis
gcccugcugggagcggc

SEQ ID NO: 826237 - RNA, 21 nt, Mycobacterium avium subsp. paratuberculosis
gcccugggaggaagugcacgc

SEQ ID NO: 826238 - RNA, 18 nt, Mycobacterium avium subsp. paratuberculosis
gcccuggcuguagcgguc

SEQ ID NO: 826239 - RNA, 15 nt, Mycobacterium avium subsp. paratuberculosis
gcccuggcgggcggc

SEQ ID NO: 826240 - RNA, 16 nt, Mycobacterium avium subsp. paratuberculosis
gcccuggcgggcggcc

SEQ ID NO: 826241 - RNA, 17 nt, Mycobacterium avium subsp. paratuberculosis
gcccuggcgggcggccc

SEQ ID NO: 826242 - RNA, 18 nt, Mycobacterium avium subsp. paratuberculosis
gcccuggcgggcggcccg

SEQ ID NO: 826243 - RNA, 20 nt, Mycobacterium avium subsp. paratuberculosis
gcccuggccgccggccgcgc

SEQ ID NO: 826244 - RNA, 21 nt, Mycobacterium avium subsp. paratuberculosis
gcccuggcaggugagccgggu

SEQ ID NO: 826245 - RNA, 20 nt, Mycobacterium avium subsp. paratuberculosis
gcccuggcauccgucggccu

SEQ ID NO: 826246 - RNA, 14 nt, Mycobacterium avium subsp. paratuberculosis
gcccuggccgccgg

SEQ ID NO: 826247 - RNA, 22 nt, Mycobacterium avium subsp. paratuberculosis
gcccuggacgaguggucggccg

SEQ ID NO: 826248 - RNA, 15 nt, Mycobacterium avium subsp. paratuberculosis
gccgaacaggcgcaa

SEQ ID NO: 826249 - RNA, 14 nt, Mycobacterium avium subsp. paratuberculosis
gccgaacagcagcg

SEQ ID NO: 826250 - RNA, 21 nt, Mycobacterium avium subsp. paratuberculosis
gccgaacagcagcgaacccgc

SEQ ID NO: 826251 - RNA, 23 nt, Mycobacterium avium subsp. paratuberculosis
gccgaacagcagcgaacccgcca

SEQ ID NO: 826252 - RNA, 14 nt, Mycobacterium avium subsp. paratuberculosis
gccgaacagcgacg

SEQ ID NO: 826253 - RNA, 18 nt, Mycobacterium avium subsp. paratuberculosis
gccgaacagcgacgucug

SEQ ID NO: 826254 - RNA, 22 nt, Mycobacterium avium subsp. paratuberculosis
gccgaacagcgacgucugcggc

SEQ ID NO: 826255 - RNA, 19 nt, Mycobacterium avium subsp. paratuberculosis
gccgaaccgcuccccgagc

SEQ ID NO: 826256 - RNA, 13 nt, Mycobacterium avium subsp. paratuberculosis
gccgaaccgcugc

SEQ ID NO: 826257 - RNA, 19 nt, Mycobacterium avium subsp. paratuberculosis
gccgaaccgaucaccggca

SEQ ID NO: 826258 - RNA, 21 nt, Mycobacterium avium subsp. paratuberculosis
gccgaaccgaucaccggcagc

SEQ ID NO: 826259 - RNA, 22 nt, Mycobacterium avium subsp. paratuberculosis
gccgaaccgaucaccggcagca

SEQ ID NO: 826260 - RNA, 16 nt, Mycobacterium avium subsp. paratuberculosis
gccgaaccgcugcgga

SEQ ID NO: 826261 - RNA, 19 nt, Mycobacterium avium subsp. paratuberculosis
gccgaaccgggcgcgcaga

SEQ ID NO: 826262 - RNA, 14 nt, Mycobacterium avium subsp. paratuberculosis
gccgaaccggggcc

SEQ ID NO: 826263 - RNA, 15 nt, Mycobacterium avium subsp. paratuberculosis
gccgaaccggggccg

SEQ ID NO: 826264 - RNA, 17 nt, Mycobacterium avium subsp. paratuberculosis
gccgaaccgucccacac

SEQ ID NO: 826265 - RNA, 17 nt, Mycobacterium avium subsp. paratuberculosis
gccgaaccccagcuccg

SEQ ID NO: 826266 - RNA, 23 nt, Mycobacterium avium subsp. paratuberculosis
gccgaacccgcccucgccccgga

SEQ ID NO: 826267 - RNA, 13 nt, Mycobacterium avium subsp. paratuberculosis
gccgaaccagauc

SEQ ID NO: 826268 - RNA, 13 nt, Mycobacterium avium subsp. paratuberculosis
gccgaacaucagc

SEQ ID NO: 826269 - RNA, 20 nt, Mycobacterium avium subsp. paratuberculosis
gccgaaacggugcccgcagc

SEQ ID NO: 826270 - RNA, 19 nt, Mycobacterium avium subsp. paratuberculosis
gccgaaacgcccggcucaa

SEQ ID NO: 826271 - RNA, 14 nt, Mycobacterium avium subsp. paratuberculosis
gccgaaaucaacgc

SEQ ID NO: 826272 - RNA, 19 nt, Mycobacterium avium subsp. paratuberculosis
gccgaaagccuccgcgauc

SEQ ID NO: 826273 - RNA, 20 nt, Mycobacterium avium subsp. paratuberculosis
gccgaaagguuuucccggcc

SEQ ID NO: 826274 - RNA, 23 nt, Mycobacterium avium subsp. paratuberculosis
gccgaaagguuuucccggccgcc

SEQ ID NO: 826275 - RNA, 16 nt, Mycobacterium avium subsp. paratuberculosis
gccgaaaaacgcgacg

SEQ ID NO: 826276 - RNA, 14 nt, Mycobacterium avium subsp. paratuberculosis
gccgaaacaccggc

SEQ ID NO: 826277 - RNA, 22 nt, Mycobacterium avium subsp. paratuberculosis
gccgaaacaccggcuucgggau

SEQ ID NO: 826278 - RNA, 19 nt, Mycobacterium avium subsp. paratuberculosis
gccgaacaccugcggcggc

SEQ ID NO: 826279 - RNA, 22 nt, Mycobacterium avium subsp. paratuberculosis
gccgaacaccugcggcggcagu

SEQ ID NO: 826280 - RNA, 18 nt, Mycobacterium avium subsp. paratuberculosis
gccgaacagaugccugcc

SEQ ID NO: 826281 - RNA, 15 nt, Mycobacterium avium subsp. paratuberculosis
gccgaacacggccgc

SEQ ID NO: 826282 - RNA, 16 nt, Mycobacterium avium subsp. paratuberculosis
gccgaacacggccgcc

SEQ ID NO: 826283 - RNA, 17 nt, Mycobacterium avium subsp. paratuberculosis
gccgaacacggccgccu

SEQ ID NO: 826284 - RNA, 20 nt, Mycobacterium avium subsp. paratuberculosis
gccgaacacguacagcggcg

SEQ ID NO: 826285 - RNA, 21 nt, Mycobacterium avium subsp. paratuberculosis
gccgaacacguacagcggcgg

SEQ ID NO: 826286 - RNA, 23 nt, Mycobacterium avium subsp. paratuberculosis
gccgaacacguacagcggcggcc

SEQ ID NO: 826287 - RNA, 19 nt, Mycobacterium avium subsp. paratuberculosis
gccgaacaccacgccgagc

SEQ ID NO: 826288 - RNA, 13 nt, Mycobacterium avium subsp. paratuberculosis
gccgaacaccggc

SEQ ID NO: 826289 - RNA, 20 nt, Mycobacterium avium subsp. paratuberculosis
gccgaacaccggcagcgcca

SEQ ID NO: 826290 - RNA, 21 nt, Mycobacterium avium subsp. paratuberculosis
gccgaacaacagggccgcgcg

SEQ ID NO: 826291 - RNA, 23 nt, Mycobacterium avium subsp. paratuberculosis
gccgaacaacggcggaccggcgg

SEQ ID NO: 826292 - RNA, 15 nt, Mycobacterium avium subsp. paratuberculosis
gccgaaaugccgugc

SEQ ID NO: 826293 - RNA, 16 nt, Mycobacterium avium subsp. paratuberculosis
gccgaagauggccagc

SEQ ID NO: 826294 - RNA, 23 nt, Mycobacterium avium subsp. paratuberculosis
gccgaagauggccagcgcggcgu

SEQ ID NO: 826295 - RNA, 17 nt, Mycobacterium avium subsp. paratuberculosis
gccgaagaugucggugc

SEQ ID NO: 826296 - RNA, 18 nt, Mycobacterium avium subsp. paratuberculosis
gccgaagaugucggugcc

SEQ ID NO: 826297 - RNA, 19 nt, Mycobacterium avium subsp. paratuberculosis
gccgaagaugucggugccg

SEQ ID NO: 826298 - RNA, 16 nt, Mycobacterium avium subsp. paratuberculosis
gccgaagaucaccgcg

SEQ ID NO: 826299 - RNA, 18 nt, Mycobacterium avium subsp. paratuberculosis
gccgaagaucaccgcguc

SEQ ID NO: 826300 - RNA, 21 nt, Mycobacterium avium subsp. paratuberculosis
gccgaagaucaccgcgucggc

SEQ ID NO: 826301 - RNA, 20 nt, Mycobacterium avium subsp. paratuberculosis
gccgaagaucagcgcgucca

SEQ ID NO: 826302 - RNA, 15 nt, Mycobacterium avium subsp. paratuberculosis
gccgaagaccgccga

SEQ ID NO: 826303 - RNA, 17 nt, Mycobacterium avium subsp. paratuberculosis
gccgaagaccgccgaaa

SEQ ID NO: 826304 - RNA, 13 nt, Mycobacterium avium subsp. paratuberculosis
gccgaagaccggg

SEQ ID NO: 826305 - RNA, 15 nt, Mycobacterium avium subsp. paratuberculosis
gccgaagaccgggcc

SEQ ID NO: 826306 - RNA, 21 nt, Mycobacterium avium subsp. paratuberculosis
gccgaagaagauguugcggcg

SEQ ID NO: 826307 - RNA, 22 nt, Mycobacterium avium subsp. paratuberculosis
gccgaagaagauguugcggcgg

SEQ ID NO: 826308 - RNA, 24 nt, Mycobacterium avium subsp. paratuberculosis
gccgaagaagauguugcggcggcc

SEQ ID NO: 826309 - RNA, 23 nt, Mycobacterium avium subsp. paratuberculosis
gccgaagcggcgcacgcagugcc

SEQ ID NO: 826310 - RNA, 20 nt, Mycobacterium avium subsp. paratuberculosis
gccgaagcgggucggggagc

SEQ ID NO: 826311 - RNA, 15 nt, Mycobacterium avium subsp. paratuberculosis
gccgaagcguuccgc

SEQ ID NO: 826312 - RNA, 17 nt, Mycobacterium avium subsp. paratuberculosis
gccgaagcguuccgccg

SEQ ID NO: 826313 - RNA, 20 nt, Mycobacterium avium subsp. paratuberculosis
gccgaagcguuccgccgucc

SEQ ID NO: 826314 - RNA, 21 nt, Mycobacterium avium subsp. paratuberculosis
gccgaagcguuccgccguccu

SEQ ID NO: 826315 - RNA, 15 nt, Mycobacterium avium subsp. paratuberculosis
gccgaagcgccgcau

SEQ ID NO: 826316 - RNA, 16 nt, Mycobacterium avium subsp. paratuberculosis
gccgaagccggcucga

SEQ ID NO: 826317 - RNA, 16 nt, Mycobacterium avium subsp. paratuberculosis
gccgaagccgucgacc

SEQ ID NO: 826318 - RNA, 23 nt, Mycobacterium avium subsp. paratuberculosis
gccgaagccgucgaccccgccgg

SEQ ID NO: 826319 - RNA, 22 nt, Mycobacterium avium subsp. paratuberculosis
gccgaagcccgacaucugccgg

SEQ ID NO: 826320 - RNA, 16 nt, Mycobacterium avium subsp. paratuberculosis
gccgaagcccgcagcg

SEQ ID NO: 826321 - RNA, 21 nt, Mycobacterium avium subsp. paratuberculosis
gccgaagcccgcagcgaacgc

SEQ ID NO: 826322 - RNA, 22 nt, Mycobacterium avium subsp. paratuberculosis
gccgaagcccgcagcgaacgcg

SEQ ID NO: 826323 - RNA, 14 nt, Mycobacterium avium subsp. paratuberculosis
gccgaagccgacac

SEQ ID NO: 826324 - RNA, 14 nt, Mycobacterium avium subsp. paratuberculosis
gccgaagccgccgu

SEQ ID NO: 826325 - RNA, 16 nt, Mycobacterium avium subsp. paratuberculosis
gccgaagccgccgucc

SEQ ID NO: 826326 - RNA, 13 nt, Mycobacterium avium subsp. paratuberculosis
gccgaacugccga

SEQ ID NO: 826327 - RNA, 18 nt, Mycobacterium avium subsp. paratuberculosis
gccgaacugccgaugcug

SEQ ID NO: 826328 - RNA, 16 nt, Mycobacterium avium subsp. paratuberculosis
gccgaacugccggacc

SEQ ID NO: 826329 - RNA, 15 nt, Mycobacterium avium subsp. paratuberculosis
gccgaacucggcgcc

SEQ ID NO: 826330 - RNA, 19 nt, Mycobacterium avium subsp. paratuberculosis
gccgaacucggcgccgccg

SEQ ID NO: 826331 - RNA, 17 nt, Mycobacterium avium subsp. paratuberculosis
gccgaacgugcgcggcg

SEQ ID NO: 826332 - RNA, 23 nt, Mycobacterium avium subsp. paratuberculosis
gccgaacgugcgcggcgcgcgaa

SEQ ID NO: 826333 - RNA, 15 nt, Mycobacterium avium subsp. paratuberculosis
gccgaacuccgccga

SEQ ID NO: 826334 - RNA, 20 nt, Mycobacterium avium subsp. paratuberculosis
gccgaacuccgccgaaccga

SEQ ID NO: 826335 - RNA, 17 nt, Mycobacterium avium subsp. paratuberculosis
gccgaacgggucggcga

SEQ ID NO: 826336 - RNA, 17 nt, Mycobacterium avium subsp. paratuberculosis
gccgaacgucaccaaca

SEQ ID NO: 826337 - RNA, 17 nt, Mycobacterium avium subsp. paratuberculosis
gccgaacgucgagcgcg

SEQ ID NO: 826338 - RNA, 22 nt, Mycobacterium avium subsp. paratuberculosis
gccgaacgucgagcgcggcccg

SEQ ID NO: 826339 - RNA, 16 nt, Mycobacterium avium subsp. paratuberculosis
gccgaacgugauggcg

SEQ ID NO: 826340 - RNA, 18 nt, Mycobacterium avium subsp. paratuberculosis
gccgaacgugauggcgaa

SEQ ID NO: 826341 - RNA, 19 nt, Mycobacterium avium subsp. paratuberculosis
gccgaacgggucggcgacc

SEQ ID NO: 826342 - RNA, 13 nt, Mycobacterium avium subsp. paratuberculosis
gccgaacgcgcug

SEQ ID NO: 826343 - RNA, 14 nt, Mycobacterium avium subsp. paratuberculosis
gccgaacgcgcugu

SEQ ID NO: 826344 - RNA, 18 nt, Mycobacterium avium subsp. paratuberculosis
gccgaacgcgcugucgcc

SEQ ID NO: 826345 - RNA, 20 nt, Mycobacterium avium subsp. paratuberculosis
gccgaacgcgcugucgcccu

SEQ ID NO: 826346 - RNA, 18 nt, Mycobacterium avium subsp. paratuberculosis
gccgaacgccuccgccgc

SEQ ID NO: 826347 - RNA, 24 nt, Mycobacterium avium subsp. paratuberculosis
gccgaacgccuccgccgccccguc

SEQ ID NO: 826348 - RNA, 17 nt, Mycobacterium avium subsp. paratuberculosis
gccgaacgacagcagga

SEQ ID NO: 826349 - RNA, 18 nt, Mycobacterium avium subsp. paratuberculosis
gccgaacgcaccaccgcg

SEQ ID NO: 826350 - RNA, 19 nt, Mycobacterium avium subsp. paratuberculosis
gccgaacgcaccaccgcgg

SEQ ID NO: 826351 - RNA, 14 nt, Mycobacterium avium subsp. paratuberculosis
gcccugcacuucgg

SEQ ID NO: 826352 - RNA, 17 nt, Mycobacterium avium subsp. paratuberculosis
gcccugcacgaucucgg

SEQ ID NO: 826353 - RNA, 16 nt, Mycobacterium avium subsp. paratuberculosis
gcccugcacccagccg

SEQ ID NO: 826354 - RNA, 19 nt, Mycobacterium avium subsp. paratuberculosis
gcccugcacccagccgugc

SEQ ID NO: 826355 - RNA, 18 nt, Mycobacterium avium subsp. paratuberculosis
gcccugccacagcgacag

SEQ ID NO: 826356 - RNA, 17 nt, Mycobacterium avium subsp. paratuberculosis
gcccugccagcgcccgc

SEQ ID NO: 826357 - RNA, 13 nt, Mycobacterium avium subsp. paratuberculosis
gcccugcgcggcc

SEQ ID NO: 826358 - RNA, 18 nt, Mycobacterium avium subsp. paratuberculosis
gcccugcucggccagcgg

SEQ ID NO: 826359 - RNA, 14 nt, Mycobacterium avium subsp. paratuberculosis
gcccugcucgguga

SEQ ID NO: 826360 - RNA, 16 nt, Mycobacterium avium subsp. paratuberculosis
gcccugcucggugaug

SEQ ID NO: 826361 - RNA, 15 nt, Mycobacterium avium subsp. paratuberculosis
gcccugccugcugcc

SEQ ID NO: 826362 - RNA, 17 nt, Mycobacterium avium subsp. paratuberculosis
gcccugcgccagcagca

SEQ ID NO: 826363 - RNA, 15 nt, Mycobacterium avium subsp. paratuberculosis
gcccugcccgucggg

SEQ ID NO: 826364 - RNA, 20 nt, Mycobacterium avium subsp. paratuberculosis
gcccugcccgucgggcgcgg

SEQ ID NO: 826365 - RNA, 13 nt, Mycobacterium avium subsp. paratuberculosis
gcccugcggccag

SEQ ID NO: 826366 - RNA, 14 nt, Mycobacterium avium subsp. paratuberculosis
gcccugcucuucgc

SEQ ID NO: 826367 - RNA, 17 nt, Mycobacterium avium subsp. paratuberculosis
gcccugcucuucgcgcg

SEQ ID NO: 826368 - RNA, 21 nt, Mycobacterium avium subsp. paratuberculosis
gcccugcucuucgcgcgcggc

SEQ ID NO: 826369 - RNA, 23 nt, Mycobacterium avium subsp. paratuberculosis
gcccugcucuucgcgcgcggcgu

SEQ ID NO: 826370 - RNA, 14 nt, Mycobacterium avium subsp. paratuberculosis
gcccugcucgucgu

SEQ ID NO: 826371 - RNA, 17 nt, Mycobacterium avium subsp. paratuberculosis
gcccugcugcagcgcga

SEQ ID NO: 826372 - RNA, 17 nt, Mycobacterium avium subsp. paratuberculosis
gcccugcuugaccgcga

SEQ ID NO: 826373 - RNA, 20 nt, Mycobacterium avium subsp. paratuberculosis
gcccugaagcugggcgccca

SEQ ID NO: 826374 - RNA, 19 nt, Mycobacterium avium subsp. paratuberculosis
gcccucuucuucgaggucg

SEQ ID NO: 826375 - RNA, 17 nt, Mycobacterium avium subsp. paratuberculosis
gcccucuuccucgcugu

SEQ ID NO: 826376 - RNA, 13 nt, Mycobacterium avium subsp. paratuberculosis
gcccugaccccgg

SEQ ID NO: 826377 - RNA, 20 nt, Mycobacterium avium subsp. paratuberculosis
gcccugacacagcaccggcg

SEQ ID NO: 826378 - RNA, 13 nt, Mycobacterium avium subsp. paratuberculosis
gcccucgucgaug

SEQ ID NO: 826379 - RNA, 16 nt, Mycobacterium avium subsp. paratuberculosis
gcccucgucgaugacg

SEQ ID NO: 826380 - RNA, 20 nt, Mycobacterium avium subsp. paratuberculosis
gcccucgucgaugacgucca

SEQ ID NO: 826381 - RNA, 14 nt, Mycobacterium avium subsp. paratuberculosis
gcccucgucggcga

SEQ ID NO: 826382 - RNA, 15 nt, Mycobacterium avium subsp. paratuberculosis
gcccucgucggcgag

SEQ ID NO: 826383 - RNA, 17 nt, Mycobacterium avium subsp. paratuberculosis
gcccucgucggcgagca

SEQ ID NO: 826384 - RNA, 23 nt, Mycobacterium avium subsp. paratuberculosis
gcccucgucuuccgcggcggccg

SEQ ID NO: 826385 - RNA, 15 nt, Mycobacterium avium subsp. paratuberculosis
gcccucgugcguagc

SEQ ID NO: 826386 - RNA, 16 nt, Mycobacterium avium subsp. paratuberculosis
gcccucgugcguagcg

SEQ ID NO: 826387 - RNA, 18 nt, Mycobacterium avium subsp. paratuberculosis
gcccucgugcguagcggc

SEQ ID NO: 826388 - RNA, 22 nt, Mycobacterium avium subsp. paratuberculosis
gcccucgugguggacggucagc

SEQ ID NO: 826389 - RNA, 20 nt, Mycobacterium avium subsp. paratuberculosis
gcccucgguguucgggucgg

SEQ ID NO: 826390 - RNA, 23 nt, Mycobacterium avium subsp. paratuberculosis
gcccucgguguucgggucggugg

SEQ ID NO: 826391 - RNA, 14 nt, Mycobacterium avium subsp. paratuberculosis
gcccucguagcggc

SEQ ID NO: 826392 - RNA, 18 nt, Mycobacterium avium subsp. paratuberculosis
gcccucguagcggccgca

SEQ ID NO: 826393 - RNA, 17 nt, Mycobacterium avium subsp. paratuberculosis
gcccucguccgacagcg

SEQ ID NO: 826394 - RNA, 15 nt, Mycobacterium avium subsp. paratuberculosis
gcccucgucgaagcc

SEQ ID NO: 826395 - RNA, 17 nt, Mycobacterium avium subsp. paratuberculosis
gcccucgucgaagccga

SEQ ID NO: 826396 - RNA, 20 nt, Mycobacterium avium subsp. paratuberculosis
gcccucgccgcggucaucga

SEQ ID NO: 826397 - RNA, 15 nt, Mycobacterium avium subsp. paratuberculosis
gcccucgccggucag

SEQ ID NO: 826398 - RNA, 12 nt, Mycobacterium avium subsp. paratuberculosis
gcccuccucgcc

SEQ ID NO: 826399 - RNA, 21 nt, Mycobacterium avium subsp. paratuberculosis
gcccucgauaauggcggccgc

SEQ ID NO: 826400 - RNA, 23 nt, Mycobacterium avium subsp. paratuberculosis
gcccucgauaauggcggccgccg

SEQ ID NO: 826401 - RNA, 23 nt, Mycobacterium avium subsp. paratuberculosis
gcccucgaucgaggagauguuga

SEQ ID NO: 826402 - RNA, 14 nt, Mycobacterium avium subsp. paratuberculosis
gcccucgaucgcga

SEQ ID NO: 826403 - RNA, 15 nt, Mycobacterium avium subsp. paratuberculosis
gcccucgaucgcgac

SEQ ID NO: 826404 - RNA, 16 nt, Mycobacterium avium subsp. paratuberculosis
gcccucgaucgcgacc

SEQ ID NO: 826405 - RNA, 16 nt, Mycobacterium avium subsp. paratuberculosis
gcccucgcgcagggcc

SEQ ID NO: 826406 - RNA, 17 nt, Mycobacterium avium subsp. paratuberculosis
gcccucgcgcagggcca

SEQ ID NO: 826407 - RNA, 20 nt, Mycobacterium avium subsp. paratuberculosis
gcccucgcgcagggccagcg

SEQ ID NO: 826408 - RNA, 18 nt, Mycobacterium avium subsp. paratuberculosis
gcccucggugacgaacuc

SEQ ID NO: 826409 - RNA, 15 nt, Mycobacterium avium subsp. paratuberculosis
gcccucggucgccga

SEQ ID NO: 826410 - RNA, 19 nt, Mycobacterium avium subsp. paratuberculosis
gcccucgggguacucggcg

SEQ ID NO: 826411 - RNA, 21 nt, Mycobacterium avium subsp. paratuberculosis
gcccucgggguacucggcggc

SEQ ID NO: 826412 - RNA, 17 nt, Mycobacterium avium subsp. paratuberculosis
gcccucggaggugccgc

SEQ ID NO: 826413 - RNA, 20 nt, Mycobacterium avium subsp. paratuberculosis
gcccucggaggugccgcgcg

SEQ ID NO: 826414 - RNA, 21 nt, Mycobacterium avium subsp. paratuberculosis
gcccucggaggugccgcgcgg

SEQ ID NO: 826415 - RNA, 22 nt, Mycobacterium avium subsp. paratuberculosis
gcccucggaggugccgcgcggc

SEQ ID NO: 826416 - RNA, 23 nt, Mycobacterium avium subsp. paratuberculosis
gcccucggaggugccgcgcggca

SEQ ID NO: 826417 - RNA, 16 nt, Mycobacterium avium subsp. paratuberculosis
gcccucggccagccag

SEQ ID NO: 826418 - RNA, 18 nt, Mycobacterium avium subsp. paratuberculosis
gcccucggccagccaggc

SEQ ID NO: 826419 - RNA, 21 nt, Mycobacterium avium subsp. paratuberculosis
gcccucggccagccaggccgu

SEQ ID NO: 826420 - RNA, 23 nt, Mycobacterium avium subsp. paratuberculosis
gcccucgccccggaugaccaggg

SEQ ID NO: 826421 - RNA, 20 nt, Mycobacterium avium subsp. paratuberculosis
gcccucgccgaaccggggcc

SEQ ID NO: 826422 - RNA, 21 nt, Mycobacterium avium subsp. paratuberculosis
gcccucgccgaaccggggccg

SEQ ID NO: 826423 - RNA, 23 nt, Mycobacterium avium subsp. paratuberculosis
gcccucgcugaucuucuggauca

SEQ ID NO: 826424 - RNA, 15 nt, Mycobacterium avium subsp. paratuberculosis
gcccucgcugccgcc

SEQ ID NO: 826425 - RNA, 20 nt, Mycobacterium avium subsp. paratuberculosis
gcccucgcugccgcccccgc

SEQ ID NO: 826426 - RNA, 21 nt, Mycobacterium avium subsp. paratuberculosis
gcccucggccguaccggcgua

SEQ ID NO: 826427 - RNA, 24 nt, Mycobacterium avium subsp. paratuberculosis
gcccucggccguaccggcguacga

SEQ ID NO: 826428 - RNA, 23 nt, Mycobacterium avium subsp. paratuberculosis
gcccgugcauguagguggcgacc

SEQ ID NO: 826429 - RNA, 14 nt, Mycobacterium avium subsp. paratuberculosis
gcccgugccgaugc

SEQ ID NO: 826430 - RNA, 19 nt, Mycobacterium avium subsp. paratuberculosis
gcccgugccgaugccggcc

SEQ ID NO: 826431 - RNA, 20 nt, Mycobacterium avium subsp. paratuberculosis
gcccgugccgaugccggccu

SEQ ID NO: 826432 - RNA, 16 nt, Mycobacterium avium subsp. paratuberculosis
gcccgugccgcaccug

SEQ ID NO: 826433 - RNA, 15 nt, Mycobacterium avium subsp. paratuberculosis
gcccguggccagcgc

SEQ ID NO: 826434 - RNA, 17 nt, Mycobacterium avium subsp. paratuberculosis
gcccguggccagcgcca

SEQ ID NO: 826435 - RNA, 15 nt, Mycobacterium avium subsp. paratuberculosis
gcccguggcccacgg

SEQ ID NO: 826436 - RNA, 14 nt, Mycobacterium avium subsp. paratuberculosis
gcccgugcgacggc

SEQ ID NO: 826437 - RNA, 20 nt, Mycobacterium avium subsp. paratuberculosis
gcccgugcggcggggccucg

SEQ ID NO: 826438 - RNA, 14 nt, Mycobacterium avium subsp. paratuberculosis
gcccgugucgcggc

SEQ ID NO: 826439 - RNA, 17 nt, Mycobacterium avium subsp. paratuberculosis
gcccgugucgcggccuc

SEQ ID NO: 826440 - RNA, 17 nt, Mycobacterium avium subsp. paratuberculosis
gcccguucgagcgccgg

SEQ ID NO: 826441 - RNA, 24 nt, Mycobacterium avium subsp. paratuberculosis
gcccguucgaugaugggcgaucga

SEQ ID NO: 826442 - RNA, 16 nt, Mycobacterium avium subsp. paratuberculosis
gcccucaucgucgacc

SEQ ID NO: 826443 - RNA, 20 nt, Mycobacterium avium subsp. paratuberculosis
gcccucaucgucgacccggc

SEQ ID NO: 826444 - RNA, 20 nt, Mycobacterium avium subsp. paratuberculosis
gcccguugucgagcaccgcg

SEQ ID NO: 826445 - RNA, 23 nt, Mycobacterium avium subsp. paratuberculosis
gcccuccacggugcgcaccgaca

SEQ ID NO: 826446 - RNA, 16 nt, Mycobacterium avium subsp. paratuberculosis
gcccuccagcaccguc

SEQ ID NO: 826447 - RNA, 20 nt, Mycobacterium avium subsp. paratuberculosis
gcccuccagcugguugagug

SEQ ID NO: 826448 - RNA, 22 nt, Mycobacterium avium subsp. paratuberculosis
gcccuccaggaagaacccggcg

SEQ ID NO: 826449 - RNA, 16 nt, Mycobacterium avium subsp. paratuberculosis
gcccguugcccgauca

SEQ ID NO: 826450 - RNA, 21 nt, Mycobacterium avium subsp. paratuberculosis
gcccguugagcaccgcgaaga

SEQ ID NO: 826451 - RNA, 19 nt, Mycobacterium avium subsp. paratuberculosis
gcccguugcugcguucggc

SEQ ID NO: 826452 - RNA, 13 nt, Mycobacterium avium subsp. paratuberculosis
gcccuccuggcgg

SEQ ID NO: 826453 - RNA, 23 nt, Mycobacterium avium subsp. paratuberculosis
gcccuccuggcggguggcgauga

SEQ ID NO: 826454 - RNA, 16 nt, Mycobacterium avium subsp. paratuberculosis
gcccuccugggugagu

SEQ ID NO: 826455 - RNA, 13 nt, Mycobacterium avium subsp. paratuberculosis
gcccucgacaccg

SEQ ID NO: 826456 - RNA, 18 nt, Mycobacterium avium subsp. paratuberculosis
gcccucgacaccgguggc

SEQ ID NO: 826457 - RNA, 19 nt, Mycobacterium avium subsp. paratuberculosis
gcccucgacaccgguggcg

SEQ ID NO: 826458 - RNA, 17 nt, Mycobacterium avium subsp. paratuberculosis
gcccucccccgagucgg

SEQ ID NO: 826459 - RNA, 17 nt, Mycobacterium avium subsp. paratuberculosis
gcccuccccggccagca

SEQ ID NO: 826460 - RNA, 13 nt, Mycobacterium avium subsp. paratuberculosis
gcccuccgcggcg

SEQ ID NO: 826461 - RNA, 14 nt, Mycobacterium avium subsp. paratuberculosis
gcccuccgcggcgc

SEQ ID NO: 826462 - RNA, 16 nt, Mycobacterium avium subsp. paratuberculosis
gcccuccgcggcgccg

SEQ ID NO: 826463 - RNA, 21 nt, Mycobacterium avium subsp. paratuberculosis
gcccuccgcggcgccguaggu

SEQ ID NO: 826464 - RNA, 20 nt, Mycobacterium avium subsp. paratuberculosis
gcccgguuccgcgacaucgg

SEQ ID NO: 826465 - RNA, 22 nt, Mycobacterium avium subsp. paratuberculosis
gcccguagaacaguucgacgua

SEQ ID NO: 826466 - RNA, 20 nt, Mycobacterium avium subsp. paratuberculosis
gcccguagacccacagcugc

SEQ ID NO: 826467 - RNA, 21 nt, Mycobacterium avium subsp. paratuberculosis
gcccguagaugcggcccagcc

SEQ ID NO: 826468 - RNA, 23 nt, Mycobacterium avium subsp. paratuberculosis
gcccguagaugcggcccagcccg

SEQ ID NO: 826469 - RNA, 19 nt, Mycobacterium avium subsp. paratuberculosis
gcccgguugagugcgccgu

SEQ ID NO: 826470 - RNA, 18 nt, Mycobacterium avium subsp. paratuberculosis
gcccgguguccacgucgc

SEQ ID NO: 826471 - RNA, 17 nt, Mycobacterium avium subsp. paratuberculosis
gcccggugaucgccgcc

SEQ ID NO: 826472 - RNA, 22 nt, Mycobacterium avium subsp. paratuberculosis
gcccgguuuccaguccggcgcc

SEQ ID NO: 826473 - RNA, 15 nt, Mycobacterium avium subsp. paratuberculosis
gcccguagucggcgg

SEQ ID NO: 826474 - RNA, 21 nt, Mycobacterium avium subsp. paratuberculosis
gcccguagcggcggaacucga

SEQ ID NO: 826475 - RNA, 17 nt, Mycobacterium avium subsp. paratuberculosis
gcccguagcggugggcg

SEQ ID NO: 826476 - RNA, 20 nt, Mycobacterium avium subsp. paratuberculosis
gcccguagcggugggcgcgu

SEQ ID NO: 826477 - RNA, 15 nt, Mycobacterium avium subsp. paratuberculosis
gcccguagcucgcgc

SEQ ID NO: 826478 - RNA, 18 nt, Mycobacterium avium subsp. paratuberculosis
gcccguagcucgcgccga

SEQ ID NO: 826479 - RNA, 19 nt, Mycobacterium avium subsp. paratuberculosis
gcccguagcucgcgccgac

SEQ ID NO: 826480 - RNA, 21 nt, Mycobacterium avium subsp. paratuberculosis
gcccguagcucgcgccgaccc

SEQ ID NO: 826481 - RNA, 16 nt, Mycobacterium avium subsp. paratuberculosis
gcccgucucggcgugc

SEQ ID NO: 826482 - RNA, 21 nt, Mycobacterium avium subsp. paratuberculosis
gcccgucucggcgugcucggc

SEQ ID NO: 826483 - RNA, 14 nt, Mycobacterium avium subsp. paratuberculosis
gcccgugaucgcca

SEQ ID NO: 826484 - RNA, 16 nt, Mycobacterium avium subsp. paratuberculosis
gcccgugaucgccacg

SEQ ID NO: 826485 - RNA, 19 nt, Mycobacterium avium subsp. paratuberculosis
gcccgugaucgccacggcg

SEQ ID NO: 826486 - RNA, 19 nt, Mycobacterium avium subsp. paratuberculosis
gcccggugccacgaugaug

SEQ ID NO: 826487 - RNA, 21 nt, Mycobacterium avium subsp. paratuberculosis
gcccggugcgacgccgcgcag

SEQ ID NO: 826488 - RNA, 16 nt, Mycobacterium avium subsp. paratuberculosis
gcccggugcgccagcg

SEQ ID NO: 826489 - RNA, 17 nt, Mycobacterium avium subsp. paratuberculosis
gcccggugcgccagcgu

SEQ ID NO: 826490 - RNA, 18 nt, Mycobacterium avium subsp. paratuberculosis
gcccggugcgccagcgug

SEQ ID NO: 826491 - RNA, 19 nt, Mycobacterium avium subsp. paratuberculosis
gcccggucugcggccgcga

SEQ ID NO: 826492 - RNA, 12 nt, Mycobacterium avium subsp. paratuberculosis
gcccggugacga

SEQ ID NO: 826493 - RNA, 21 nt, Mycobacterium avium subsp. paratuberculosis
gcccggugacgaacaucgacg

SEQ ID NO: 826494 - RNA, 22 nt, Mycobacterium avium subsp. paratuberculosis
gcccggugagccucagggcgcg

SEQ ID NO: 826495 - RNA, 20 nt, Mycobacterium avium subsp. paratuberculosis
gcccggucggaguccagcac

SEQ ID NO: 826496 - RNA, 15 nt, Mycobacterium avium subsp. paratuberculosis
gcccggucgucgccg

SEQ ID NO: 826497 - RNA, 23 nt, Mycobacterium avium subsp. paratuberculosis
gcccgccucagugucguggcgac

SEQ ID NO: 826498 - RNA, 16 nt, Mycobacterium avium subsp. paratuberculosis
gcccgccucgcagcga

SEQ ID NO: 826499 - RNA, 18 nt, Mycobacterium avium subsp. paratuberculosis
gcccgccucgcagcgaca

SEQ ID NO: 826500 - RNA, 13 nt, Mycobacterium avium subsp. paratuberculosis
gcccgccucggcg

SEQ ID NO: 826501 - RNA, 15 nt, Mycobacterium avium subsp. paratuberculosis
gcccgccucggcggc

SEQ ID NO: 826502 - RNA, 16 nt, Mycobacterium avium subsp. paratuberculosis
gcccgccucggcggcc

SEQ ID NO: 826503 - RNA, 19 nt, Mycobacterium avium subsp. paratuberculosis
gcccggucaguucgucggu

SEQ ID NO: 826504 - RNA, 21 nt, Mycobacterium avium subsp. paratuberculosis
gcccggucaguucgucgguca

SEQ ID NO: 826505 - RNA, 23 nt, Mycobacterium avium subsp. paratuberculosis
gcccggucaguucgucggucacg

SEQ ID NO: 826506 - RNA, 20 nt, Mycobacterium avium subsp. paratuberculosis
gcccggucccgcgucacauc

SEQ ID NO: 826507 - RNA, 22 nt, Mycobacterium avium subsp. paratuberculosis
gcccgguccgcugugcggcccg

SEQ ID NO: 826508 - RNA, 12 nt, Mycobacterium avium subsp. paratuberculosis
gcccggucgaug

SEQ ID NO: 826509 - RNA, 15 nt, Mycobacterium avium subsp. paratuberculosis
gcccggucgaugauc

SEQ ID NO: 826510 - RNA, 20 nt, Mycobacterium avium subsp. paratuberculosis
gcccggucgaugaucuggcg

SEQ ID NO: 826511 - RNA, 21 nt, Mycobacterium avium subsp. paratuberculosis
gcccggucgaugaucuggcgg

SEQ ID NO: 826512 - RNA, 22 nt, Mycobacterium avium subsp. paratuberculosis
gcccggucgaugaucuggcggu

SEQ ID NO: 826513 - RNA, 18 nt, Mycobacterium avium subsp. paratuberculosis
gccgcacgaaccgcucga

SEQ ID NO: 826514 - RNA, 20 nt, Mycobacterium avium subsp. paratuberculosis
gccgcacgaccaugucggcg

SEQ ID NO: 826515 - RNA, 21 nt, Mycobacterium avium subsp. paratuberculosis
gccgcacgaccaugucggcga

SEQ ID NO: 826516 - RNA, 14 nt, Mycobacterium avium subsp. paratuberculosis
gccgcaccugaucg

SEQ ID NO: 826517 - RNA, 23 nt, Mycobacterium avium subsp. paratuberculosis
gccgcaccugaucgaugccgugg

SEQ ID NO: 826518 - RNA, 16 nt, Mycobacterium avium subsp. paratuberculosis
gccgcaccgucgugcc

SEQ ID NO: 826519 - RNA, 14 nt, Mycobacterium avium subsp. paratuberculosis
gccgcaccucgccg

SEQ ID NO: 826520 - RNA, 15 nt, Mycobacterium avium subsp. paratuberculosis
gccgcaccucgccga

SEQ ID NO: 826521 - RNA, 16 nt, Mycobacterium avium subsp. paratuberculosis
gccgcaccucgccgau

SEQ ID NO: 826522 - RNA, 17 nt, Mycobacterium avium subsp. paratuberculosis
gccgcaccucgccggcc

SEQ ID NO: 826523 - RNA, 18 nt, Mycobacterium avium subsp. paratuberculosis
gccgcaccucgccggccg

SEQ ID NO: 826524 - RNA, 21 nt, Mycobacterium avium subsp. paratuberculosis
gccgcaccucgccggccgccg

SEQ ID NO: 826525 - RNA, 12 nt, Mycobacterium avium subsp. paratuberculosis
gccgcaccucgg

SEQ ID NO: 826526 - RNA, 15 nt, Mycobacterium avium subsp. paratuberculosis
gccgcacaccgcgca

SEQ ID NO: 826527 - RNA, 14 nt, Mycobacterium avium subsp. paratuberculosis
gccgcacaccgcgg

SEQ ID NO: 826528 - RNA, 17 nt, Mycobacterium avium subsp. paratuberculosis
gccgcacaccgcggcgg

SEQ ID NO: 826529 - RNA, 18 nt, Mycobacterium avium subsp. paratuberculosis
gccgcacaccgcggcggc

SEQ ID NO: 826530 - RNA, 19 nt, Mycobacterium avium subsp. paratuberculosis
gccgcacaccgcggcggcg

SEQ ID NO: 826531 - RNA, 13 nt, Mycobacterium avium subsp. paratuberculosis
gccgcacaccguc

SEQ ID NO: 826532 - RNA, 16 nt, Mycobacterium avium subsp. paratuberculosis
gccgcacaccugcauc

SEQ ID NO: 826533 - RNA, 14 nt, Mycobacterium avium subsp. paratuberculosis
gccgcaccgcgacc

SEQ ID NO: 826534 - RNA, 13 nt, Mycobacterium avium subsp. paratuberculosis
gccgcaccggccg

SEQ ID NO: 826535 - RNA, 15 nt, Mycobacterium avium subsp. paratuberculosis
gccgcaccggccggc

SEQ ID NO: 826536 - RNA, 13 nt, Mycobacterium avium subsp. paratuberculosis
gccgcaccggcgc

SEQ ID NO: 826537 - RNA, 14 nt, Mycobacterium avium subsp. paratuberculosis
gccgcaccggcgcc

SEQ ID NO: 826538 - RNA, 15 nt, Mycobacterium avium subsp. paratuberculosis
gccgcaccggcgccg

SEQ ID NO: 826539 - RNA, 14 nt, Mycobacterium avium subsp. paratuberculosis
gccgcacggugcag

SEQ ID NO: 826540 - RNA, 15 nt, Mycobacterium avium subsp. paratuberculosis
gccgcacggugcagc

SEQ ID NO: 826541 - RNA, 16 nt, Mycobacterium avium subsp. paratuberculosis
gccgcacgcgaccgcg

SEQ ID NO: 826542 - RNA, 20 nt, Mycobacterium avium subsp. paratuberculosis
gccgcacgcgaccgcgucga

SEQ ID NO: 826543 - RNA, 12 nt, Mycobacterium avium subsp. paratuberculosis
gccgcagcacgc

SEQ ID NO: 826544 - RNA, 13 nt, Mycobacterium avium subsp. paratuberculosis
gccgcagcacggc

SEQ ID NO: 826545 - RNA, 12 nt, Mycobacterium avium subsp. paratuberculosis
gccgcagcagcc

SEQ ID NO: 826546 - RNA, 16 nt, Mycobacterium avium subsp. paratuberculosis
gccgcagcagccgcgc

SEQ ID NO: 826547 - RNA, 17 nt, Mycobacterium avium subsp. paratuberculosis
gccgcagcagccgcgcc

SEQ ID NO: 826548 - RNA, 21 nt, Mycobacterium avium subsp. paratuberculosis
gccgcagcagccgcgccaccg

SEQ ID NO: 826549 - RNA, 13 nt, Mycobacterium avium subsp. paratuberculosis
gccgcagcagcga

SEQ ID NO: 826550 - RNA, 23 nt, Mycobacterium avium subsp. paratuberculosis
gccgcagcagcgaggccucgccg

SEQ ID NO: 826551 - RNA, 14 nt, Mycobacterium avium subsp. paratuberculosis
gccgcacaacagac

SEQ ID NO: 826552 - RNA, 22 nt, Mycobacterium avium subsp. paratuberculosis
gccgcacaacaugauucguucg

SEQ ID NO: 826553 - RNA, 14 nt, Mycobacterium avium subsp. paratuberculosis
gccgcacaccacca

SEQ ID NO: 826554 - RNA, 17 nt, Mycobacterium avium subsp. paratuberculosis
gccgcacaccaccacgu

SEQ ID NO: 826555 - RNA, 18 nt, Mycobacterium avium subsp. paratuberculosis
gccgcaaucggcgccggc

SEQ ID NO: 826556 - RNA, 16 nt, Mycobacterium avium subsp. paratuberculosis
gccgcaauacaccgcg

SEQ ID NO: 826557 - RNA, 23 nt, Mycobacterium avium subsp. paratuberculosis
gccgcaaggugauucgcgcggcg

SEQ ID NO: 826558 - RNA, 19 nt, Mycobacterium avium subsp. paratuberculosis
gccgaugucgucgaacgcg

SEQ ID NO: 826559 - RNA, 20 nt, Mycobacterium avium subsp. paratuberculosis
gccgaugucgucgaacgcgg

SEQ ID NO: 826560 - RNA, 16 nt, Mycobacterium avium subsp. paratuberculosis
gccgaugugaucggcg

SEQ ID NO: 826561 - RNA, 22 nt, Mycobacterium avium subsp. paratuberculosis
gccgaugugaucggcggccacc

SEQ ID NO: 826562 - RNA, 14 nt, Mycobacterium avium subsp. paratuberculosis
gccgaugucggccg

SEQ ID NO: 826563 - RNA, 14 nt, Mycobacterium avium subsp. paratuberculosis
gccgaugucggcgu

SEQ ID NO: 826564 - RNA, 16 nt, Mycobacterium avium subsp. paratuberculosis
gccgaugucggcguug

SEQ ID NO: 826565 - RNA, 16 nt, Mycobacterium avium subsp. paratuberculosis
gccgauggugaccucg

SEQ ID NO: 826566 - RNA, 17 nt, Mycobacterium avium subsp. paratuberculosis
gccgauggugaccucgg

SEQ ID NO: 826567 - RNA, 23 nt, Mycobacterium avium subsp. paratuberculosis
gccgauggugacgauccggucga

SEQ ID NO: 826568 - RNA, 18 nt, Mycobacterium avium subsp. paratuberculosis
gccgauggugacggugcc

SEQ ID NO: 826569 - RNA, 20 nt, Mycobacterium avium subsp. paratuberculosis
gccgauggugacggugccgc

SEQ ID NO: 826570 - RNA, 24 nt, Mycobacterium avium subsp. paratuberculosis
gccgaugguguggaucgcuucggc

SEQ ID NO: 826571 - RNA, 19 nt, Mycobacterium avium subsp. paratuberculosis
gccgaugagccucagcgcg

SEQ ID NO: 826572 - RNA, 20 nt, Mycobacterium avium subsp. paratuberculosis
gccgaugagccucagcgcgc

SEQ ID NO: 826573 - RNA, 13 nt, Mycobacterium avium subsp. paratuberculosis
gccgaugcgcccg

SEQ ID NO: 826574 - RNA, 14 nt, Mycobacterium avium subsp. paratuberculosis
gccgaugcgcccgc

SEQ ID NO: 826575 - RNA, 16 nt, Mycobacterium avium subsp. paratuberculosis
gccgaugcgcccgcgc

SEQ ID NO: 826576 - RNA, 21 nt, Mycobacterium avium subsp. paratuberculosis
gccgaugcgcccgcgccaccc

SEQ ID NO: 826577 - RNA, 19 nt, Mycobacterium avium subsp. paratuberculosis
gccgaugcgcccgcugcgg

SEQ ID NO: 826578 - RNA, 13 nt, Mycobacterium avium subsp. paratuberculosis
gccgaugaccgcg

SEQ ID NO: 826579 - RNA, 14 nt, Mycobacterium avium subsp. paratuberculosis
gccgaugaccgcgg

SEQ ID NO: 826580 - RNA, 15 nt, Mycobacterium avium subsp. paratuberculosis
gccgaugaccgcggc

SEQ ID NO: 826581 - RNA, 18 nt, Mycobacterium avium subsp. paratuberculosis
gccgaugaccgcggcggg

SEQ ID NO: 826582 - RNA, 22 nt, Mycobacterium avium subsp. paratuberculosis
gccgaugaccgcggcgggcagg

SEQ ID NO: 826583 - RNA, 16 nt, Mycobacterium avium subsp. paratuberculosis
gccgaucuugucgacc

SEQ ID NO: 826584 - RNA, 16 nt, Mycobacterium avium subsp. paratuberculosis
gccgaucugguccagc

SEQ ID NO: 826585 - RNA, 17 nt, Mycobacterium avium subsp. paratuberculosis
gccgaucugucgcgcuc

SEQ ID NO: 826586 - RNA, 14 nt, Mycobacterium avium subsp. paratuberculosis
gccgaucgcgcgca

SEQ ID NO: 826587 - RNA, 13 nt, Mycobacterium avium subsp. paratuberculosis
gccgaucgcggcg

SEQ ID NO: 826588 - RNA, 16 nt, Mycobacterium avium subsp. paratuberculosis
gccgaucgcggcgauc

SEQ ID NO: 826589 - RNA, 17 nt, Mycobacterium avium subsp. paratuberculosis
gccgaucgcggcgauca

SEQ ID NO: 826590 - RNA, 22 nt, Mycobacterium avium subsp. paratuberculosis
gccgaucgcggcgaucagcccg

SEQ ID NO: 826591 - RNA, 14 nt, Mycobacterium avium subsp. paratuberculosis
gccgaucgccgcgg

SEQ ID NO: 826592 - RNA, 15 nt, Mycobacterium avium subsp. paratuberculosis
gccgaucgccgcggc

SEQ ID NO: 826593 - RNA, 16 nt, Mycobacterium avium subsp. paratuberculosis
gccgaucgccgcggcg

SEQ ID NO: 826594 - RNA, 17 nt, Mycobacterium avium subsp. paratuberculosis
gccgaucgccgcggcga

SEQ ID NO: 826595 - RNA, 18 nt, Mycobacterium avium subsp. paratuberculosis
gccgaucgccgcggcgau

SEQ ID NO: 826596 - RNA, 22 nt, Mycobacterium avium subsp. paratuberculosis
gccgaucgccuccgucagcgcc

SEQ ID NO: 826597 - RNA, 23 nt, Mycobacterium avium subsp. paratuberculosis
gccgaucgccuccgucagcgccg

SEQ ID NO: 826598 - RNA, 16 nt, Mycobacterium avium subsp. paratuberculosis
gccgaucuggcgcagc

SEQ ID NO: 826599 - RNA, 15 nt, Mycobacterium avium subsp. paratuberculosis
gccgaucuggcgggc

SEQ ID NO: 826600 - RNA, 22 nt, Mycobacterium avium subsp. paratuberculosis
gccgaucuggcgggcgguccag

SEQ ID NO: 826601 - RNA, 17 nt, Mycobacterium avium subsp. paratuberculosis
gccgauggucagcugcc

SEQ ID NO: 826602 - RNA, 18 nt, Mycobacterium avium subsp. paratuberculosis
gccgauggucagcugccg

SEQ ID NO: 826603 - RNA, 21 nt, Mycobacterium avium subsp. paratuberculosis
gccgauggucagcugccgcac

SEQ ID NO: 826604 - RNA, 21 nt, Mycobacterium avium subsp. paratuberculosis
gccgauggcguucaucgucca

SEQ ID NO: 826605 - RNA, 19 nt, Mycobacterium avium subsp. paratuberculosis
gccgauggcgcccagcguc

SEQ ID NO: 826606 - RNA, 13 nt, Mycobacterium avium subsp. paratuberculosis
gccgauggcgguc

SEQ ID NO: 826607 - RNA, 17 nt, Mycobacterium avium subsp. paratuberculosis
gccgauggccugguggc

SEQ ID NO: 826608 - RNA, 18 nt, Mycobacterium avium subsp. paratuberculosis
gccgauggccugguggcc

SEQ ID NO: 826609 - RNA, 20 nt, Mycobacterium avium subsp. paratuberculosis
gccgauggccugguggccca

SEQ ID NO: 826610 - RNA, 22 nt, Mycobacterium avium subsp. paratuberculosis
gccgauggccugguggcccagg

SEQ ID NO: 826611 - RNA, 16 nt, Mycobacterium avium subsp. paratuberculosis
gccgauggccaccggg

SEQ ID NO: 826612 - RNA, 18 nt, Mycobacterium avium subsp. paratuberculosis
gccgauggccaccgggcg

SEQ ID NO: 826613 - RNA, 15 nt, Mycobacterium avium subsp. paratuberculosis
gccgauggcccaggc

SEQ ID NO: 826614 - RNA, 22 nt, Mycobacterium avium subsp. paratuberculosis
gccgauggcccaggccgcgguc

SEQ ID NO: 826615 - RNA, 23 nt, Mycobacterium avium subsp. paratuberculosis
gccgauggcccaggccgcggucg

SEQ ID NO: 826616 - RNA, 16 nt, Mycobacterium avium subsp. paratuberculosis
gccgaugcugagcggg

SEQ ID NO: 826617 - RNA, 18 nt, Mycobacterium avium subsp. paratuberculosis
gccgaugcugagcggguc

SEQ ID NO: 826618 - RNA, 22 nt, Mycobacterium avium subsp. paratuberculosis
gccgaugcugagcgggucggcc

SEQ ID NO: 826619 - RNA, 23 nt, Mycobacterium avium subsp. paratuberculosis
gccgaugcugagcgggucggccg

SEQ ID NO: 826620 - RNA, 14 nt, Mycobacterium avium subsp. paratuberculosis
gccgaugcgguuga

SEQ ID NO: 826621 - RNA, 14 nt, Mycobacterium avium subsp. paratuberculosis
gccgaugcgccgca

SEQ ID NO: 826622 - RNA, 17 nt, Mycobacterium avium subsp. paratuberculosis
gccgauagucgcgggug

SEQ ID NO: 826623 - RNA, 19 nt, Mycobacterium avium subsp. paratuberculosis
gccgaucaacaggcccagc

SEQ ID NO: 826624 - RNA, 22 nt, Mycobacterium avium subsp. paratuberculosis
gccgaucaacaggcccagcagc

SEQ ID NO: 826625 - RNA, 23 nt, Mycobacterium avium subsp. paratuberculosis
gccgaguccgggccgccggccgc

SEQ ID NO: 826626 - RNA, 18 nt, Mycobacterium avium subsp. paratuberculosis
gccgagucgcgccgcguc

SEQ ID NO: 826627 - RNA, 20 nt, Mycobacterium avium subsp. paratuberculosis
gccgagucgcgccgcgucgc

SEQ ID NO: 826628 - RNA, 21 nt, Mycobacterium avium subsp. paratuberculosis
gccgaucagcugcucggccac

SEQ ID NO: 826629 - RNA, 17 nt, Mycobacterium avium subsp. paratuberculosis
gccgaucagcuggcuga

SEQ ID NO: 826630 - RNA, 23 nt, Mycobacterium avium subsp. paratuberculosis
gccgaucaggcuggacaccacgu

SEQ ID NO: 826631 - RNA, 13 nt, Mycobacterium avium subsp. paratuberculosis
gccgaucgccgcg

SEQ ID NO: 826632 - RNA, 12 nt, Mycobacterium avium subsp. paratuberculosis
gccgaucgacga

SEQ ID NO: 826633 - RNA, 22 nt, Mycobacterium avium subsp. paratuberculosis
gccgaucgacgaauagccuucg

SEQ ID NO: 826634 - RNA, 14 nt, Mycobacterium avium subsp. paratuberculosis
gccgaucgagacca

SEQ ID NO: 826635 - RNA, 19 nt, Mycobacterium avium subsp. paratuberculosis
gccgaucgaucagccgcga

SEQ ID NO: 826636 - RNA, 23 nt, Mycobacterium avium subsp. paratuberculosis
gccgaucgaucagccgcgacagc

SEQ ID NO: 826637 - RNA, 14 nt, Mycobacterium avium subsp. paratuberculosis
gccgaucgcccagu

SEQ ID NO: 826638 - RNA, 18 nt, Mycobacterium avium subsp. paratuberculosis
gccgaucgcccagugcgc

SEQ ID NO: 826639 - RNA, 22 nt, Mycobacterium avium subsp. paratuberculosis
gccgaucgcccagugcgcgccg

SEQ ID NO: 826640 - RNA, 19 nt, Mycobacterium avium subsp. paratuberculosis
gccgaucgcccgguaggcc

SEQ ID NO: 826641 - RNA, 15 nt, Mycobacterium avium subsp. paratuberculosis
gccgauccgcugcgg

SEQ ID NO: 826642 - RNA, 15 nt, Mycobacterium avium subsp. paratuberculosis
gccgauccggcgccg

SEQ ID NO: 826643 - RNA, 18 nt, Mycobacterium avium subsp. paratuberculosis
gccgauccggcgccgcgg

SEQ ID NO: 826644 - RNA, 19 nt, Mycobacterium avium subsp. paratuberculosis
gccgauccggcgccgcggg

SEQ ID NO: 826645 - RNA, 20 nt, Mycobacterium avium subsp. paratuberculosis
gccgauccggcgccgcgggc

SEQ ID NO: 826646 - RNA, 18 nt, Mycobacterium avium subsp. paratuberculosis
gccgauccgcaccggacg

SEQ ID NO: 826647 - RNA, 14 nt, Mycobacterium avium subsp. paratuberculosis
gccgauccgcagcc

SEQ ID NO: 826648 - RNA, 12 nt, Mycobacterium avium subsp. paratuberculosis
gccgaucccggc

SEQ ID NO: 826649 - RNA, 14 nt, Mycobacterium avium subsp. paratuberculosis
gccgaucccggcca

SEQ ID NO: 826650 - RNA, 16 nt, Mycobacterium avium subsp. paratuberculosis
gccgaucccggccagc

SEQ ID NO: 826651 - RNA, 18 nt, Mycobacterium avium subsp. paratuberculosis
gccgaucccggccagcac

SEQ ID NO: 826652 - RNA, 19 nt, Mycobacterium avium subsp. paratuberculosis
gccgaucccggccagcacc

SEQ ID NO: 826653 - RNA, 14 nt, Mycobacterium avium subsp. paratuberculosis
gccgauccagccgu

SEQ ID NO: 826654 - RNA, 18 nt, Mycobacterium avium subsp. paratuberculosis
gccgaucagugccgcgcc

SEQ ID NO: 826655 - RNA, 19 nt, Mycobacterium avium subsp. paratuberculosis
gccgaucagugccgcgcca

SEQ ID NO: 826656 - RNA, 21 nt, Mycobacterium avium subsp. paratuberculosis
gccgaucagugccgcgccaac

SEQ ID NO: 826657 - RNA, 20 nt, Mycobacterium avium subsp. paratuberculosis
gccgaucauggucggcgacg

SEQ ID NO: 826658 - RNA, 21 nt, Mycobacterium avium subsp. paratuberculosis
gccgaucauggucggcgacgc

SEQ ID NO: 826659 - RNA, 19 nt, Mycobacterium avium subsp. paratuberculosis
gccgagcucggccaccagc

SEQ ID NO: 826660 - RNA, 23 nt, Mycobacterium avium subsp. paratuberculosis
gccgagcucggccaccagcgccc

SEQ ID NO: 826661 - RNA, 13 nt, Mycobacterium avium subsp. paratuberculosis
gccgagcguucgg

SEQ ID NO: 826662 - RNA, 14 nt, Mycobacterium avium subsp. paratuberculosis
gccgagcguucggc

SEQ ID NO: 826663 - RNA, 21 nt, Mycobacterium avium subsp. paratuberculosis
gccgagcguucggcgcggauc

SEQ ID NO: 826664 - RNA, 23 nt, Mycobacterium avium subsp. paratuberculosis
gccgagcucgugaugguccagca

SEQ ID NO: 826665 - RNA, 20 nt, Mycobacterium avium subsp. paratuberculosis
gccgaggcacagcagcacgu

SEQ ID NO: 826666 - RNA, 16 nt, Mycobacterium avium subsp. paratuberculosis
gccgaggccgauggcg

SEQ ID NO: 826667 - RNA, 18 nt, Mycobacterium avium subsp. paratuberculosis
gccgaggcaguuccaugu

SEQ ID NO: 826668 - RNA, 18 nt, Mycobacterium avium subsp. paratuberculosis
gccgaggccaacucgcga

SEQ ID NO: 826669 - RNA, 21 nt, Mycobacterium avium subsp. paratuberculosis
gccgaggccagcacgccgguc

SEQ ID NO: 826670 - RNA, 15 nt, Mycobacterium avium subsp. paratuberculosis
gccgaggccuccagg

SEQ ID NO: 826671 - RNA, 23 nt, Mycobacterium avium subsp. paratuberculosis
gccgaggugcaacacucgagcgc

SEQ ID NO: 826672 - RNA, 16 nt, Mycobacterium avium subsp. paratuberculosis
gccgaguaacucggcc

SEQ ID NO: 826673 - RNA, 17 nt, Mycobacterium avium subsp. paratuberculosis
gccgaguaccgacgaga

SEQ ID NO: 826674 - RNA, 19 nt, Mycobacterium avium subsp. paratuberculosis
gccgagucgacgugcucgg

SEQ ID NO: 826675 - RNA, 14 nt, Mycobacterium avium subsp. paratuberculosis
gccgagucgaucgc

SEQ ID NO: 826676 - RNA, 16 nt, Mycobacterium avium subsp. paratuberculosis
gccgagucgaucgcca

SEQ ID NO: 826677 - RNA, 19 nt, Mycobacterium avium subsp. paratuberculosis
gccgagucgaucgccagcg

SEQ ID NO: 826678 - RNA, 21 nt, Mycobacterium avium subsp. paratuberculosis
gccgagucgaucgccagcgcg

SEQ ID NO: 826679 - RNA, 19 nt, Mycobacterium avium subsp. paratuberculosis
gccgagguggcccgccacg

SEQ ID NO: 826680 - RNA, 17 nt, Mycobacterium avium subsp. paratuberculosis
gccgaggugcugucguc

SEQ ID NO: 826681 - RNA, 22 nt, Mycobacterium avium subsp. paratuberculosis
gccgaggugcugucgucgcccu

SEQ ID NO: 826682 - RNA, 20 nt, Mycobacterium avium subsp. paratuberculosis
gccgaggucuuucaucgccc

SEQ ID NO: 826683 - RNA, 23 nt, Mycobacterium avium subsp. paratuberculosis
gccgaggucuuucaucgccccgg

SEQ ID NO: 826684 - RNA, 24 nt, Mycobacterium avium subsp. paratuberculosis
gccgaggucuuucaucgccccggc

SEQ ID NO: 826685 - RNA, 17 nt, Mycobacterium avium subsp. paratuberculosis
gccgaggcugucggagg

SEQ ID NO: 826686 - RNA, 19 nt, Mycobacterium avium subsp. paratuberculosis
gccgaggcugucggaggcc

SEQ ID NO: 826687 - RNA, 22 nt, Mycobacterium avium subsp. paratuberculosis
gccgaggcugucggaggccucc

SEQ ID NO: 826688 - RNA, 18 nt, Mycobacterium avium subsp. paratuberculosis
gccgaggucggucgcggc

SEQ ID NO: 826689 - RNA, 18 nt, Mycobacterium avium subsp. paratuberculosis
gccgaggcgugccgcugg

SEQ ID NO: 826690 - RNA, 15 nt, Mycobacterium avium subsp. paratuberculosis
gccgaggcgcucggc

SEQ ID NO: 826691 - RNA, 18 nt, Mycobacterium avium subsp. paratuberculosis
gccgaggcgagugaggac

SEQ ID NO: 826692 - RNA, 18 nt, Mycobacterium avium subsp. paratuberculosis
gccgaggcgaugccgugc

SEQ ID NO: 826693 - RNA, 17 nt, Mycobacterium avium subsp. paratuberculosis
gccgaggcgcaacaccg

SEQ ID NO: 826694 - RNA, 19 nt, Mycobacterium avium subsp. paratuberculosis
gccgacgcccacagcgcca

SEQ ID NO: 826695 - RNA, 13 nt, Mycobacterium avium subsp. paratuberculosis
gccgacggccagc

SEQ ID NO: 826696 - RNA, 17 nt, Mycobacterium avium subsp. paratuberculosis
gccgacggcugcccggc

SEQ ID NO: 826697 - RNA, 18 nt, Mycobacterium avium subsp. paratuberculosis
gccgacggcugcccggcc

SEQ ID NO: 826698 - RNA, 16 nt, Mycobacterium avium subsp. paratuberculosis
gccgacggcgccggug

SEQ ID NO: 826699 - RNA, 18 nt, Mycobacterium avium subsp. paratuberculosis
gccgacggcgccggugcc

SEQ ID NO: 826700 - RNA, 13 nt, Mycobacterium avium subsp. paratuberculosis
gccgacggugucc

SEQ ID NO: 826701 - RNA, 14 nt, Mycobacterium avium subsp. paratuberculosis
gccgacgguguccg

SEQ ID NO: 826702 - RNA, 17 nt, Mycobacterium avium subsp. paratuberculosis
gccgacgguguccgcgg

SEQ ID NO: 826703 - RNA, 14 nt, Mycobacterium avium subsp. paratuberculosis
gccgacuagcgcgg

SEQ ID NO: 826704 - RNA, 15 nt, Mycobacterium avium subsp. paratuberculosis
gccgacuagcgcggc

SEQ ID NO: 826705 - RNA, 16 nt, Mycobacterium avium subsp. paratuberculosis
gccgacuagcgcggcg

SEQ ID NO: 826706 - RNA, 19 nt, Mycobacterium avium subsp. paratuberculosis
gccgacuagcgcggcggcc

SEQ ID NO: 826707 - RNA, 12 nt, Mycobacterium avium subsp. paratuberculosis
gccgacggcgcc

SEQ ID NO: 826708 - RNA, 22 nt, Mycobacterium avium subsp. paratuberculosis
gccgacgggauccggauugccg

SEQ ID NO: 826709 - RNA, 18 nt, Mycobacterium avium subsp. paratuberculosis
gccgacgggcccgcgccu

SEQ ID NO: 826710 - RNA, 17 nt, Mycobacterium avium subsp. paratuberculosis
gccgacggugagcaccg

SEQ ID NO: 826711 - RNA, 18 nt, Mycobacterium avium subsp. paratuberculosis
gccgacggugagcaccgc

SEQ ID NO: 826712 - RNA, 20 nt, Mycobacterium avium subsp. paratuberculosis
gccgacggugagcaccgccg

SEQ ID NO: 826713 - RNA, 22 nt, Mycobacterium avium subsp. paratuberculosis
gccgacggugagcaccgccguc

SEQ ID NO: 826714 - RNA, 12 nt, Mycobacterium avium subsp. paratuberculosis
gccgacgguggc

SEQ ID NO: 826715 - RNA, 14 nt, Mycobacterium avium subsp. paratuberculosis
gccgacgguggccc

SEQ ID NO: 826716 - RNA, 22 nt, Mycobacterium avium subsp. paratuberculosis
gccgacgguggcccccaccacg

SEQ ID NO: 826717 - RNA, 21 nt, Mycobacterium avium subsp. paratuberculosis
gccgacgguggcgaagcacga

SEQ ID NO: 826718 - RNA, 16 nt, Mycobacterium avium subsp. paratuberculosis
gccgacgaugucggcu

SEQ ID NO: 826719 - RNA, 20 nt, Mycobacterium avium subsp. paratuberculosis
gccgacgaugucggcuucgu

SEQ ID NO: 826720 - RNA, 20 nt, Mycobacterium avium subsp. paratuberculosis
gccgacgaugagggccagca

SEQ ID NO: 826721 - RNA, 12 nt, Mycobacterium avium subsp. paratuberculosis
gccgacgcaugu

SEQ ID NO: 826722 - RNA, 17 nt, Mycobacterium avium subsp. paratuberculosis
gccgacgcauguccgcc

SEQ ID NO: 826723 - RNA, 21 nt, Mycobacterium avium subsp. paratuberculosis
gccgacgcauguccgccguca

SEQ ID NO: 826724 - RNA, 19 nt, Mycobacterium avium subsp. paratuberculosis
gccgacgcauuucccgagu

SEQ ID NO: 826725 - RNA, 14 nt, Mycobacterium avium subsp. paratuberculosis
gccgacgccagcac

SEQ ID NO: 826726 - RNA, 16 nt, Mycobacterium avium subsp. paratuberculosis
gccgacgccagcacgu

SEQ ID NO: 826727 - RNA, 21 nt, Mycobacterium avium subsp. paratuberculosis
gccgacgccagcacguggccg

SEQ ID NO: 826728 - RNA, 13 nt, Mycobacterium avium subsp. paratuberculosis
gccgacgcccagc

SEQ ID NO: 826729 - RNA, 17 nt, Mycobacterium avium subsp. paratuberculosis
gccgacgcccagcgcgg

SEQ ID NO: 826730 - RNA, 18 nt, Mycobacterium avium subsp. paratuberculosis
gccgacgcccagcgcggc

SEQ ID NO: 826731 - RNA, 20 nt, Mycobacterium avium subsp. paratuberculosis
gccgacgcccagcgcggcga

SEQ ID NO: 826732 - RNA, 15 nt, Mycobacterium avium subsp. paratuberculosis
gccgacgcccaggcu

SEQ ID NO: 826733 - RNA, 23 nt, Mycobacterium avium subsp. paratuberculosis
gccgacgaugucgaaacccagga

SEQ ID NO: 826734 - RNA, 21 nt, Mycobacterium avium subsp. paratuberculosis
gccgacgaugaacagucggcc

SEQ ID NO: 826735 - RNA, 23 nt, Mycobacterium avium subsp. paratuberculosis
gccgacgauacgugcucccgccg

SEQ ID NO: 826736 - RNA, 15 nt, Mycobacterium avium subsp. paratuberculosis
gccgacgauccgggc

SEQ ID NO: 826737 - RNA, 17 nt, Mycobacterium avium subsp. paratuberculosis
gccgacgauccgggcgc

SEQ ID NO: 826738 - RNA, 18 nt, Mycobacterium avium subsp. paratuberculosis
gccgacgauccgggcgcc

SEQ ID NO: 826739 - RNA, 20 nt, Mycobacterium avium subsp. paratuberculosis
gccgacgaccucgucgucga

SEQ ID NO: 826740 - RNA, 21 nt, Mycobacterium avium subsp. paratuberculosis
gccgacgacggcgaacgucga

SEQ ID NO: 826741 - RNA, 13 nt, Mycobacterium avium subsp. paratuberculosis
gccgacgacgucg

SEQ ID NO: 826742 - RNA, 17 nt, Mycobacterium avium subsp. paratuberculosis
gccgacgacgucgcgca

SEQ ID NO: 826743 - RNA, 17 nt, Mycobacterium avium subsp. paratuberculosis
gccgacgacgucguaga

SEQ ID NO: 826744 - RNA, 14 nt, Mycobacterium avium subsp. paratuberculosis
gccgacgauccgcg

SEQ ID NO: 826745 - RNA, 17 nt, Mycobacterium avium subsp. paratuberculosis
gccgacgauccgcgccc

SEQ ID NO: 826746 - RNA, 18 nt, Mycobacterium avium subsp. paratuberculosis
gccgacgauccgcgccgc

SEQ ID NO: 826747 - RNA, 19 nt, Mycobacterium avium subsp. paratuberculosis
gccgacgauccgcgccgcg

SEQ ID NO: 826748 - RNA, 20 nt, Mycobacterium avium subsp. paratuberculosis
gccgacgauccgcgccgcga

SEQ ID NO: 826749 - RNA, 23 nt, Mycobacterium avium subsp. paratuberculosis
gccgagauuggacgacaccacgg

SEQ ID NO: 826750 - RNA, 17 nt, Mycobacterium avium subsp. paratuberculosis
gccgagauggcaacacg

SEQ ID NO: 826751 - RNA, 15 nt, Mycobacterium avium subsp. paratuberculosis
gccgagcaaccggga

SEQ ID NO: 826752 - RNA, 14 nt, Mycobacterium avium subsp. paratuberculosis
gccgagcacaccgu

SEQ ID NO: 826753 - RNA, 15 nt, Mycobacterium avium subsp. paratuberculosis
gccgagcacaccguc

SEQ ID NO: 826754 - RNA, 16 nt, Mycobacterium avium subsp. paratuberculosis
gccgagcacaccgucg

SEQ ID NO: 826755 - RNA, 19 nt, Mycobacterium avium subsp. paratuberculosis
gccgagcacaccgucgccc

SEQ ID NO: 826756 - RNA, 13 nt, Mycobacterium avium subsp. paratuberculosis
gccgacugugcga

SEQ ID NO: 826757 - RNA, 13 nt, Mycobacterium avium subsp. paratuberculosis
gccgagaucgacc

SEQ ID NO: 826758 - RNA, 17 nt, Mycobacterium avium subsp. paratuberculosis
gccgagaucgcgguggc

SEQ ID NO: 826759 - RNA, 18 nt, Mycobacterium avium subsp. paratuberculosis
gccgagaucgcgguggcg

SEQ ID NO: 826760 - RNA, 15 nt, Mycobacterium avium subsp. paratuberculosis
gccgacuugaucgcg

SEQ ID NO: 826761 - RNA, 16 nt, Mycobacterium avium subsp. paratuberculosis
gccgacuugaucgcgg

SEQ ID NO: 826762 - RNA, 19 nt, Mycobacterium avium subsp. paratuberculosis
gccgacuugaucgcggcgu

SEQ ID NO: 826763 - RNA, 18 nt, Mycobacterium avium subsp. paratuberculosis
gccgacuuggucagcccg

SEQ ID NO: 826764 - RNA, 20 nt, Mycobacterium avium subsp. paratuberculosis
gccgagauccaccgcgcggc

SEQ ID NO: 826765 - RNA, 23 nt, Mycobacterium avium subsp. paratuberculosis
gccgagauccaccgcgcggccag

SEQ ID NO: 826766 - RNA, 15 nt, Mycobacterium avium subsp. paratuberculosis
gccgacuccccgccc

SEQ ID NO: 826767 - RNA, 17 nt, Mycobacterium avium subsp. paratuberculosis
gccgacuccccgcccgg

SEQ ID NO: 826768 - RNA, 21 nt, Mycobacterium avium subsp. paratuberculosis
gccgacuccccgcccggcaac

SEQ ID NO: 826769 - RNA, 18 nt, Mycobacterium avium subsp. paratuberculosis
gccgacugauccaccauc

SEQ ID NO: 826770 - RNA, 17 nt, Mycobacterium avium subsp. paratuberculosis
gccgagcgggucgucgu

SEQ ID NO: 826771 - RNA, 17 nt, Mycobacterium avium subsp. paratuberculosis
gccgagcgucacgcugg

SEQ ID NO: 826772 - RNA, 19 nt, Mycobacterium avium subsp. paratuberculosis
gccgagcgucacgcuggcg

SEQ ID NO: 826773 - RNA, 20 nt, Mycobacterium avium subsp. paratuberculosis
gccgagcgucacgcuggcgu

SEQ ID NO: 826774 - RNA, 14 nt, Mycobacterium avium subsp. paratuberculosis
gccgagccgggcca

SEQ ID NO: 826775 - RNA, 15 nt, Mycobacterium avium subsp. paratuberculosis
gccgagccgggccag

SEQ ID NO: 826776 - RNA, 21 nt, Mycobacterium avium subsp. paratuberculosis
gccgagccgggccagguccca

SEQ ID NO: 826777 - RNA, 13 nt, Mycobacterium avium subsp. paratuberculosis
gccgagccgggcg

SEQ ID NO: 826778 - RNA, 16 nt, Mycobacterium avium subsp. paratuberculosis
gccgagccgggcggcc

SEQ ID NO: 826779 - RNA, 14 nt, Mycobacterium avium subsp. paratuberculosis
gccgagccggguca

SEQ ID NO: 826780 - RNA, 15 nt, Mycobacterium avium subsp. paratuberculosis
gccgagccgguccga

SEQ ID NO: 826781 - RNA, 16 nt, Mycobacterium avium subsp. paratuberculosis
gccgagccgguccgac

SEQ ID NO: 826782 - RNA, 22 nt, Mycobacterium avium subsp. paratuberculosis
gccgagccgguccgaccagcgg

SEQ ID NO: 826783 - RNA, 15 nt, Mycobacterium avium subsp. paratuberculosis
gccgagcaccaggcg

SEQ ID NO: 826784 - RNA, 16 nt, Mycobacterium avium subsp. paratuberculosis
gccgagcaccaggcgc

SEQ ID NO: 826785 - RNA, 20 nt, Mycobacterium avium subsp. paratuberculosis
gccgagcaccaggcgcacca

SEQ ID NO: 826786 - RNA, 22 nt, Mycobacterium avium subsp. paratuberculosis
gccgagcaccaggcgcaccagc

SEQ ID NO: 826787 - RNA, 23 nt, Mycobacterium avium subsp. paratuberculosis
gccgagcaccaggcgcaccagcu

SEQ ID NO: 826788 - RNA, 12 nt, Mycobacterium avium subsp. paratuberculosis
gccgagcaccgg

SEQ ID NO: 826789 - RNA, 23 nt, Mycobacterium avium subsp. paratuberculosis
gccgagcaacagcccgaccgucg

SEQ ID NO: 826790 - RNA, 16 nt, Mycobacterium avium subsp. paratuberculosis
gccgagcaccggcagc

SEQ ID NO: 826791 - RNA, 18 nt, Mycobacterium avium subsp. paratuberculosis
gccgagcaccggcagcac

SEQ ID NO: 826792 - RNA, 13 nt, Mycobacterium avium subsp. paratuberculosis
gccgagcaccggg

SEQ ID NO: 826793 - RNA, 19 nt, Mycobacterium avium subsp. paratuberculosis
gccgagcaccuccgacauc

SEQ ID NO: 826794 - RNA, 17 nt, Mycobacterium avium subsp. paratuberculosis
gccgagcaccucgucgc

SEQ ID NO: 826795 - RNA, 18 nt, Mycobacterium avium subsp. paratuberculosis
gccgagccgaugcccagc

SEQ ID NO: 826796 - RNA, 19 nt, Mycobacterium avium subsp. paratuberculosis
gccgagccgaugcccagca

SEQ ID NO: 826797 - RNA, 22 nt, Mycobacterium avium subsp. paratuberculosis
gccgagccgaugcccagcagcg

SEQ ID NO: 826798 - RNA, 17 nt, Mycobacterium avium subsp. paratuberculosis
gccgagccgcaccgccu

SEQ ID NO: 826799 - RNA, 23 nt, Mycobacterium avium subsp. paratuberculosis
gccgagccgcaccgccucaugcc

SEQ ID NO: 826800 - RNA, 13 nt, Mycobacterium avium subsp. paratuberculosis
gccgagccgcgcc

SEQ ID NO: 826801 - RNA, 16 nt, Mycobacterium avium subsp. paratuberculosis
gccgagccgcgccacg

SEQ ID NO: 826802 - RNA, 18 nt, Mycobacterium avium subsp. paratuberculosis
gccgagccgcgccacgcg

SEQ ID NO: 826803 - RNA, 15 nt, Mycobacterium avium subsp. paratuberculosis
gccgagccgcgggug

SEQ ID NO: 826804 - RNA, 19 nt, Mycobacterium avium subsp. paratuberculosis
gccgagccgcuccaccgcg

SEQ ID NO: 826805 - RNA, 23 nt, Mycobacterium avium subsp. paratuberculosis
gccgagccgcuugguggcgccgg

SEQ ID NO: 826806 - RNA, 13 nt, Mycobacterium avium subsp. paratuberculosis
gccgagccggcac

SEQ ID NO: 826807 - RNA, 14 nt, Mycobacterium avium subsp. paratuberculosis
gccgagccggcacg

SEQ ID NO: 826808 - RNA, 16 nt, Mycobacterium avium subsp. paratuberculosis
gccgagccggcacggc

SEQ ID NO: 826809 - RNA, 19 nt, Mycobacterium avium subsp. paratuberculosis
gccgagccggcacggccgg

SEQ ID NO: 826810 - RNA, 23 nt, Mycobacterium avium subsp. paratuberculosis
gccgagccggcacggccggccgg

SEQ ID NO: 826811 - RNA, 14 nt, Mycobacterium avium subsp. paratuberculosis
gccgagccggccga

SEQ ID NO: 826812 - RNA, 21 nt, Mycobacterium avium subsp. paratuberculosis
gccgagccggcguacccgccc

SEQ ID NO: 826813 - RNA, 16 nt, Mycobacterium avium subsp. paratuberculosis
gccgaccacggcccca

SEQ ID NO: 826814 - RNA, 21 nt, Mycobacterium avium subsp. paratuberculosis
gccgaccacggccccagccgc

SEQ ID NO: 826815 - RNA, 17 nt, Mycobacterium avium subsp. paratuberculosis
gccgaccacaugccguu

SEQ ID NO: 826816 - RNA, 19 nt, Mycobacterium avium subsp. paratuberculosis
gccgaccacccccagcccg

SEQ ID NO: 826817 - RNA, 23 nt, Mycobacterium avium subsp. paratuberculosis
gccgaccacccccagcccgccgg

SEQ ID NO: 826818 - RNA, 18 nt, Mycobacterium avium subsp. paratuberculosis
gccgacccccgccgcguc

SEQ ID NO: 826819 - RNA, 16 nt, Mycobacterium avium subsp. paratuberculosis
gccgacccugcguccg

SEQ ID NO: 826820 - RNA, 22 nt, Mycobacterium avium subsp. paratuberculosis
gccgacccgggcuagacgcgca

SEQ ID NO: 826821 - RNA, 16 nt, Mycobacterium avium subsp. paratuberculosis
gccgacccgcugcagc

SEQ ID NO: 826822 - RNA, 12 nt, Mycobacterium avium subsp. paratuberculosis
gccgacccggcc

SEQ ID NO: 826823 - RNA, 14 nt, Mycobacterium avium subsp. paratuberculosis
gccgacccggccga

SEQ ID NO: 826824 - RNA, 15 nt, Mycobacterium avium subsp. paratuberculosis
gccgacccgcccgcc

SEQ ID NO: 826825 - RNA, 16 nt, Mycobacterium avium subsp. paratuberculosis
gccgacccgcccgccg

SEQ ID NO: 826826 - RNA, 17 nt, Mycobacterium avium subsp. paratuberculosis
gccgacccgcccgccgg

SEQ ID NO: 826827 - RNA, 14 nt, Mycobacterium avium subsp. paratuberculosis
gccgaccucggcca

SEQ ID NO: 826828 - RNA, 15 nt, Mycobacterium avium subsp. paratuberculosis
gccgaccucggccag

SEQ ID NO: 826829 - RNA, 18 nt, Mycobacterium avium subsp. paratuberculosis
gccgaccucggccagcgu

SEQ ID NO: 826830 - RNA, 19 nt, Mycobacterium avium subsp. paratuberculosis
gccgaccucgauggcgacg

SEQ ID NO: 826831 - RNA, 14 nt, Mycobacterium avium subsp. paratuberculosis
gccgaccucgucgg

SEQ ID NO: 826832 - RNA, 16 nt, Mycobacterium avium subsp. paratuberculosis
gccgaccucgucggcg

SEQ ID NO: 826833 - RNA, 19 nt, Mycobacterium avium subsp. paratuberculosis
gccgaccucgucggcggug

SEQ ID NO: 826834 - RNA, 20 nt, Mycobacterium avium subsp. paratuberculosis
gccgaccucgucggcggugc

SEQ ID NO: 826835 - RNA, 22 nt, Mycobacterium avium subsp. paratuberculosis
gccgacgaagaugcgcccgguc

SEQ ID NO: 826836 - RNA, 17 nt, Mycobacterium avium subsp. paratuberculosis
gccgacgaccaguucgc

SEQ ID NO: 826837 - RNA, 13 nt, Mycobacterium avium subsp. paratuberculosis
gccgaccgguccg

SEQ ID NO: 826838 - RNA, 23 nt, Mycobacterium avium subsp. paratuberculosis
gccgaccgguccgccgccggcgg

SEQ ID NO: 826839 - RNA, 23 nt, Mycobacterium avium subsp. paratuberculosis
gccgaccggucucgaccgcggcg

SEQ ID NO: 826840 - RNA, 20 nt, Mycobacterium avium subsp. paratuberculosis
gccgaccgacagccgcacca

SEQ ID NO: 826841 - RNA, 12 nt, Mycobacterium avium subsp. paratuberculosis
gccgaccggccg

SEQ ID NO: 826842 - RNA, 13 nt, Mycobacterium avium subsp. paratuberculosis
gccgaccggccgg

SEQ ID NO: 826843 - RNA, 13 nt, Mycobacterium avium subsp. paratuberculosis
gccgacaccaccg

SEQ ID NO: 826844 - RNA, 19 nt, Mycobacterium avium subsp. paratuberculosis
gccgacaacgacagcaccc

SEQ ID NO: 826845 - RNA, 21 nt, Mycobacterium avium subsp. paratuberculosis
gccgacaacgacagcacccag

SEQ ID NO: 826846 - RNA, 14 nt, Mycobacterium avium subsp. paratuberculosis
gccgacaccagcgc

SEQ ID NO: 826847 - RNA, 18 nt, Mycobacterium avium subsp. paratuberculosis
gccgacaccagcgcgcac

SEQ ID NO: 826848 - RNA, 18 nt, Mycobacterium avium subsp. paratuberculosis
gccgacaccccacaccgu

SEQ ID NO: 826849 - RNA, 20 nt, Mycobacterium avium subsp. paratuberculosis
gccgacaccccacaccgucc

SEQ ID NO: 826850 - RNA, 22 nt, Mycobacterium avium subsp. paratuberculosis
gccgacaccccacaccguccga

SEQ ID NO: 826851 - RNA, 23 nt, Mycobacterium avium subsp. paratuberculosis
gccgacaccccacaccguccgac

SEQ ID NO: 826852 - RNA, 17 nt, Mycobacterium avium subsp. paratuberculosis
gccgacaccaccgcgcg

SEQ ID NO: 826853 - RNA, 18 nt, Mycobacterium avium subsp. paratuberculosis
gccgacaccaccgcgcgc

SEQ ID NO: 826854 - RNA, 21 nt, Mycobacterium avium subsp. paratuberculosis
gccgacaccgcauuugccgac

SEQ ID NO: 826855 - RNA, 19 nt, Mycobacterium avium subsp. paratuberculosis
gccgaccaacacccccgcg

SEQ ID NO: 826856 - RNA, 22 nt, Mycobacterium avium subsp. paratuberculosis
gccgaccaacacccccgcgcug

SEQ ID NO: 826857 - RNA, 16 nt, Mycobacterium avium subsp. paratuberculosis
gccgacauggacgcgg

SEQ ID NO: 826858 - RNA, 19 nt, Mycobacterium avium subsp. paratuberculosis
gccgacauggacgcggccu

SEQ ID NO: 826859 - RNA, 21 nt, Mycobacterium avium subsp. paratuberculosis
gccgacauggacgcggccuca

SEQ ID NO: 826860 - RNA, 16 nt, Mycobacterium avium subsp. paratuberculosis
gccgaagggcaaccgc

SEQ ID NO: 826861 - RNA, 13 nt, Mycobacterium avium subsp. paratuberculosis
gccgacaucgucg

SEQ ID NO: 826862 - RNA, 15 nt, Mycobacterium avium subsp. paratuberculosis
gccgacaucgucggc

SEQ ID NO: 826863 - RNA, 19 nt, Mycobacterium avium subsp. paratuberculosis
gccgacaucgucggcucgu

SEQ ID NO: 826864 - RNA, 20 nt, Mycobacterium avium subsp. paratuberculosis
gccgacaccgggucccccgc

SEQ ID NO: 826865 - RNA, 23 nt, Mycobacterium avium subsp. paratuberculosis
gccgacaccgggucccccgccga

SEQ ID NO: 826866 - RNA, 15 nt, Mycobacterium avium subsp. paratuberculosis
gccgacaccgucgcc

SEQ ID NO: 826867 - RNA, 16 nt, Mycobacterium avium subsp. paratuberculosis
gccgacaucgcccggu

SEQ ID NO: 826868 - RNA, 17 nt, Mycobacterium avium subsp. paratuberculosis
gccgacaucgcccgguc

SEQ ID NO: 826869 - RNA, 16 nt, Mycobacterium avium subsp. paratuberculosis
gccgacaucgcggcga

SEQ ID NO: 826870 - RNA, 18 nt, Mycobacterium avium subsp. paratuberculosis
gccgacaucgcggcgauc

SEQ ID NO: 826871 - RNA, 17 nt, Mycobacterium avium subsp. paratuberculosis
gccgaaguuccagccga

SEQ ID NO: 826872 - RNA, 19 nt, Mycobacterium avium subsp. paratuberculosis
gccgaaguuccagccgauc

SEQ ID NO: 826873 - RNA, 22 nt, Mycobacterium avium subsp. paratuberculosis
gccgaaguuccagccgaucgcg

SEQ ID NO: 826874 - RNA, 16 nt, Mycobacterium avium subsp. paratuberculosis
gccgaaguuggcgucg

SEQ ID NO: 826875 - RNA, 17 nt, Mycobacterium avium subsp. paratuberculosis
gccgaaguuggcgucgg

SEQ ID NO: 826876 - RNA, 18 nt, Mycobacterium avium subsp. paratuberculosis
gccgaaguuggcgucggg

SEQ ID NO: 826877 - RNA, 20 nt, Mycobacterium avium subsp. paratuberculosis
gccgaagugcucgaacgcgc

SEQ ID NO: 826878 - RNA, 14 nt, Mycobacterium avium subsp. paratuberculosis
gccgaagucgcuga

SEQ ID NO: 826879 - RNA, 17 nt, Mycobacterium avium subsp. paratuberculosis
gccgaagucgcugaggc

SEQ ID NO: 826880 - RNA, 19 nt, Mycobacterium avium subsp. paratuberculosis
gccgaaguauccggucagc

SEQ ID NO: 826881 - RNA, 23 nt, Mycobacterium avium subsp. paratuberculosis
gccgaaguauccggucagcgcca

SEQ ID NO: 826882 - RNA, 14 nt, Mycobacterium avium subsp. paratuberculosis
gccgaaggcggcgc

SEQ ID NO: 826883 - RNA, 13 nt, Mycobacterium avium subsp. paratuberculosis
gccgaaggcggcg

SEQ ID NO: 826884 - RNA, 16 nt, Mycobacterium avium subsp. paratuberculosis
gccgaaggcggcgccg

SEQ ID NO: 826885 - RNA, 18 nt, Mycobacterium avium subsp. paratuberculosis
gccgaaggcggcgccggc

SEQ ID NO: 826886 - RNA, 19 nt, Mycobacterium avium subsp. paratuberculosis
gccgaaggcggcgccggcc

SEQ ID NO: 826887 - RNA, 19 nt, Mycobacterium avium subsp. paratuberculosis
gccggaucgagcacccggc

SEQ ID NO: 826888 - RNA, 14 nt, Mycobacterium avium subsp. paratuberculosis
gccggaucgccgag

SEQ ID NO: 826889 - RNA, 15 nt, Mycobacterium avium subsp. paratuberculosis
gccggaucgcgcagu

SEQ ID NO: 826890 - RNA, 19 nt, Mycobacterium avium subsp. paratuberculosis
gccggaucggcagcgcguu

SEQ ID NO: 826891 - RNA, 17 nt, Mycobacterium avium subsp. paratuberculosis
gccggaucgaauccggc

SEQ ID NO: 826892 - RNA, 20 nt, Mycobacterium avium subsp. paratuberculosis
gccggaucgaauccggcggc

SEQ ID NO: 826893 - RNA, 21 nt, Mycobacterium avium subsp. paratuberculosis
gccggaucgaauccggcggcg

SEQ ID NO: 826894 - RNA, 22 nt, Mycobacterium avium subsp. paratuberculosis
gccggaucgaauccggcggcgc

SEQ ID NO: 826895 - RNA, 19 nt, Mycobacterium avium subsp. paratuberculosis
gccggaucgugucccggcg

SEQ ID NO: 826896 - RNA, 20 nt, Mycobacterium avium subsp. paratuberculosis
gccggaucgugucccggcgc

SEQ ID NO: 826897 - RNA, 22 nt, Mycobacterium avium subsp. paratuberculosis
gccggaucgugucccggcgccc

SEQ ID NO: 826898 - RNA, 14 nt, Mycobacterium avium subsp. paratuberculosis
gccggaugccagca

SEQ ID NO: 826899 - RNA, 18 nt, Mycobacterium avium subsp. paratuberculosis
gccggaugccagcagguc

SEQ ID NO: 826900 - RNA, 15 nt, Mycobacterium avium subsp. paratuberculosis
gccggcaacgacccg

SEQ ID NO: 826901 - RNA, 20 nt, Mycobacterium avium subsp. paratuberculosis
gccggaugcggucgaugagc

SEQ ID NO: 826902 - RNA, 15 nt, Mycobacterium avium subsp. paratuberculosis
gccggcaaccgcugc

SEQ ID NO: 826903 - RNA, 14 nt, Mycobacterium avium subsp. paratuberculosis
gccggaugcggccg

SEQ ID NO: 826904 - RNA, 14 nt, Mycobacterium avium subsp. paratuberculosis
gccggaucggggug

SEQ ID NO: 826905 - RNA, 17 nt, Mycobacterium avium subsp. paratuberculosis
gccggaugccgcgcggc

SEQ ID NO: 826906 - RNA, 18 nt, Mycobacterium avium subsp. paratuberculosis
gccggaugccgcgcggcg

SEQ ID NO: 826907 - RNA, 21 nt, Mycobacterium avium subsp. paratuberculosis
gccggcagauugguucggccg

SEQ ID NO: 826908 - RNA, 18 nt, Mycobacterium avium subsp. paratuberculosis
gccggcagcaaccggcgg

SEQ ID NO: 826909 - RNA, 22 nt, Mycobacterium avium subsp. paratuberculosis
gccggcagcaaccggcggcugg

SEQ ID NO: 826910 - RNA, 19 nt, Mycobacterium avium subsp. paratuberculosis
gccggcagacgaauucgga

SEQ ID NO: 826911 - RNA, 14 nt, Mycobacterium avium subsp. paratuberculosis
gccggcagcaucgg

SEQ ID NO: 826912 - RNA, 17 nt, Mycobacterium avium subsp. paratuberculosis
gccggcagcauucgccg

SEQ ID NO: 826913 - RNA, 21 nt, Mycobacterium avium subsp. paratuberculosis
gccggcagcauucgccggggu

SEQ ID NO: 826914 - RNA, 16 nt, Mycobacterium avium subsp. paratuberculosis
gccggcacucgccucg

SEQ ID NO: 826915 - RNA, 20 nt, Mycobacterium avium subsp. paratuberculosis
gccggcacucgccucggagg

SEQ ID NO: 826916 - RNA, 17 nt, Mycobacterium avium subsp. paratuberculosis
gccggcacucgucgugg

SEQ ID NO: 826917 - RNA, 20 nt, Mycobacterium avium subsp. paratuberculosis
gccggcacucgucguggcgg

SEQ ID NO: 826918 - RNA, 21 nt, Mycobacterium avium subsp. paratuberculosis
gccggcacucgucguggcggu

SEQ ID NO: 826919 - RNA, 22 nt, Mycobacterium avium subsp. paratuberculosis
gccggcacucgucguggcggug

SEQ ID NO: 826920 - RNA, 22 nt, Mycobacterium avium subsp. paratuberculosis
gccggcacugcugcccgcgacg

SEQ ID NO: 826921 - RNA, 15 nt, Mycobacterium avium subsp. paratuberculosis
gccggcacccgggcc

SEQ ID NO: 826922 - RNA, 21 nt, Mycobacterium avium subsp. paratuberculosis
gccggcacccgggccuugacg

SEQ ID NO: 826923 - RNA, 16 nt, Mycobacterium avium subsp. paratuberculosis
gccggcaccagcagcc

SEQ ID NO: 826924 - RNA, 19 nt, Mycobacterium avium subsp. paratuberculosis
gccggcacaccgagcgagc

SEQ ID NO: 826925 - RNA, 17 nt, Mycobacterium avium subsp. paratuberculosis
gccggcaacucccgauc

SEQ ID NO: 826926 - RNA, 14 nt, Mycobacterium avium subsp. paratuberculosis
gccggcccagcgcg

SEQ ID NO: 826927 - RNA, 15 nt, Mycobacterium avium subsp. paratuberculosis
gccggcccagcgcgc

SEQ ID NO: 826928 - RNA, 15 nt, Mycobacterium avium subsp. paratuberculosis
gccggcccagcucca

SEQ ID NO: 826929 - RNA, 23 nt, Mycobacterium avium subsp. paratuberculosis
gccggcccagcuccacgcguagc

SEQ ID NO: 826930 - RNA, 19 nt, Mycobacterium avium subsp. paratuberculosis
gccggccagcgucgcgccg

SEQ ID NO: 826931 - RNA, 20 nt, Mycobacterium avium subsp. paratuberculosis
gccggccagcgucgcgccgc

SEQ ID NO: 826932 - RNA, 21 nt, Mycobacterium avium subsp. paratuberculosis
gccggccagcgucgcgccgcc

SEQ ID NO: 826933 - RNA, 17 nt, Mycobacterium avium subsp. paratuberculosis
gccggccagcuccgcca

SEQ ID NO: 826934 - RNA, 19 nt, Mycobacterium avium subsp. paratuberculosis
gccggccagcuccgccacc

SEQ ID NO: 826935 - RNA, 23 nt, Mycobacterium avium subsp. paratuberculosis
gccggccagcuccgccacccugc

SEQ ID NO: 826936 - RNA, 17 nt, Mycobacterium avium subsp. paratuberculosis
gccggccagcucgagca

SEQ ID NO: 826937 - RNA, 17 nt, Mycobacterium avium subsp. paratuberculosis
gccggccagcgcgcggc

SEQ ID NO: 826938 - RNA, 20 nt, Mycobacterium avium subsp. paratuberculosis
gccggccagcgcgcggccca

SEQ ID NO: 826939 - RNA, 15 nt, Mycobacterium avium subsp. paratuberculosis
gccggccagcggguc

SEQ ID NO: 826940 - RNA, 16 nt, Mycobacterium avium subsp. paratuberculosis
gccggccagcgggucg

SEQ ID NO: 826941 - RNA, 12 nt, Mycobacterium avium subsp. paratuberculosis
gccggccagcgu

SEQ ID NO: 826942 - RNA, 13 nt, Mycobacterium avium subsp. paratuberculosis
gccggccagcgcg

SEQ ID NO: 826943 - RNA, 14 nt, Mycobacterium avium subsp. paratuberculosis
gccggccagcgcgc

SEQ ID NO: 826944 - RNA, 14 nt, Mycobacterium avium subsp. paratuberculosis
gccggccagccgcg

SEQ ID NO: 826945 - RNA, 15 nt, Mycobacterium avium subsp. paratuberculosis
gccggccagccgcgc

SEQ ID NO: 826946 - RNA, 16 nt, Mycobacterium avium subsp. paratuberculosis
gccggccagccgcgcg

SEQ ID NO: 826947 - RNA, 13 nt, Mycobacterium avium subsp. paratuberculosis
gccggccagccgg

SEQ ID NO: 826948 - RNA, 14 nt, Mycobacterium avium subsp. paratuberculosis
gccggccagccggc

SEQ ID NO: 826949 - RNA, 16 nt, Mycobacterium avium subsp. paratuberculosis
gccggccagcagcggc

SEQ ID NO: 826950 - RNA, 13 nt, Mycobacterium avium subsp. paratuberculosis
gccggccagaccg

SEQ ID NO: 826951 - RNA, 22 nt, Mycobacterium avium subsp. paratuberculosis
gccggccagaucgacgccgcgg

SEQ ID NO: 826952 - RNA, 13 nt, Mycobacterium avium subsp. paratuberculosis
gccggccagcaca

SEQ ID NO: 826953 - RNA, 13 nt, Mycobacterium avium subsp. paratuberculosis
gccggccagcacc

SEQ ID NO: 826954 - RNA, 14 nt, Mycobacterium avium subsp. paratuberculosis
gccggccagcacca

SEQ ID NO: 826955 - RNA, 17 nt, Mycobacterium avium subsp. paratuberculosis
gccggccagcaccacgg

SEQ ID NO: 826956 - RNA, 15 nt, Mycobacterium avium subsp. paratuberculosis
gccggccagcacgcc

SEQ ID NO: 826957 - RNA, 19 nt, Mycobacterium avium subsp. paratuberculosis
gccggccagcacgccgucc

SEQ ID NO: 826958 - RNA, 14 nt, Mycobacterium avium subsp. paratuberculosis
gccggccagcacgg

SEQ ID NO: 826959 - RNA, 20 nt, Mycobacterium avium subsp. paratuberculosis
gccggccagcacggccagcc

SEQ ID NO: 826960 - RNA, 21 nt, Mycobacterium avium subsp. paratuberculosis
gccggccagcacggccagcca

SEQ ID NO: 826961 - RNA, 18 nt, Mycobacterium avium subsp. paratuberculosis
gccggccagcagcaggua

SEQ ID NO: 826962 - RNA, 14 nt, Mycobacterium avium subsp. paratuberculosis
gccggccagcagcc

SEQ ID NO: 826963 - RNA, 21 nt, Mycobacterium avium subsp. paratuberculosis
gccggccagcagccgguacag

SEQ ID NO: 826964 - RNA, 23 nt, Mycobacterium avium subsp. paratuberculosis
gccggccaacagcagcgccgcgg

SEQ ID NO: 826965 - RNA, 21 nt, Mycobacterium avium subsp. paratuberculosis
gccggcagcggccgcaaucgg

SEQ ID NO: 826966 - RNA, 16 nt, Mycobacterium avium subsp. paratuberculosis
gccggcaucagcgaga

SEQ ID NO: 826967 - RNA, 15 nt, Mycobacterium avium subsp. paratuberculosis
gccggcauccagcac

SEQ ID NO: 826968 - RNA, 20 nt, Mycobacterium avium subsp. paratuberculosis
gccggcauccagcacggccg

SEQ ID NO: 826969 - RNA, 21 nt, Mycobacterium avium subsp. paratuberculosis
gccggcauccagcacggccgc

SEQ ID NO: 826970 - RNA, 13 nt, Mycobacterium avium subsp. paratuberculosis
gccggcauccucg

SEQ ID NO: 826971 - RNA, 16 nt, Mycobacterium avium subsp. paratuberculosis
gccggcauccucggcg

SEQ ID NO: 826972 - RNA, 17 nt, Mycobacterium avium subsp. paratuberculosis
gccggcauccucggcgc

SEQ ID NO: 826973 - RNA, 22 nt, Mycobacterium avium subsp. paratuberculosis
gccggcauccucggcgcgucgg

SEQ ID NO: 826974 - RNA, 18 nt, Mycobacterium avium subsp. paratuberculosis
gccggcaucgaccgcccg

SEQ ID NO: 826975 - RNA, 12 nt, Mycobacterium avium subsp. paratuberculosis
gccggcagcccg

SEQ ID NO: 826976 - RNA, 13 nt, Mycobacterium avium subsp. paratuberculosis
gccggcagcccgg

SEQ ID NO: 826977 - RNA, 14 nt, Mycobacterium avium subsp. paratuberculosis
gccggcagcccgga

SEQ ID NO: 826978 - RNA, 15 nt, Mycobacterium avium subsp. paratuberculosis
gccggcagcccggag

SEQ ID NO: 826979 - RNA, 12 nt, Mycobacterium avium subsp. paratuberculosis
gccggcagccgg

SEQ ID NO: 826980 - RNA, 13 nt, Mycobacterium avium subsp. paratuberculosis
gccggcagccggc

SEQ ID NO: 826981 - RNA, 15 nt, Mycobacterium avium subsp. paratuberculosis
gccggcagccggcca

SEQ ID NO: 826982 - RNA, 20 nt, Mycobacterium avium subsp. paratuberculosis
gccggcagccggccaccucg

SEQ ID NO: 826983 - RNA, 14 nt, Mycobacterium avium subsp. paratuberculosis
gccggcagccggcg

SEQ ID NO: 826984 - RNA, 16 nt, Mycobacterium avium subsp. paratuberculosis
gccggcagccggcgcg

SEQ ID NO: 826985 - RNA, 17 nt, Mycobacterium avium subsp. paratuberculosis
gccggcagccggcgcgg

SEQ ID NO: 826986 - RNA, 16 nt, Mycobacterium avium subsp. paratuberculosis
gccggacucgaucgcc

SEQ ID NO: 826987 - RNA, 19 nt, Mycobacterium avium subsp. paratuberculosis
gccggacucgaucgccacc

SEQ ID NO: 826988 - RNA, 18 nt, Mycobacterium avium subsp. paratuberculosis
gccggacuauacacgccu

SEQ ID NO: 826989 - RNA, 20 nt, Mycobacterium avium subsp. paratuberculosis
gccggacuauacacgccugg

SEQ ID NO: 826990 - RNA, 23 nt, Mycobacterium avium subsp. paratuberculosis
gccggacuauacacgccuggaca

SEQ ID NO: 826991 - RNA, 20 nt, Mycobacterium avium subsp. paratuberculosis
gccggacgggaucggcgcgu

SEQ ID NO: 826992 - RNA, 20 nt, Mycobacterium avium subsp. paratuberculosis
gccggacgggucgaccgccg

SEQ ID NO: 826993 - RNA, 21 nt, Mycobacterium avium subsp. paratuberculosis
gccggacgggucgaccgccgc

SEQ ID NO: 826994 - RNA, 19 nt, Mycobacterium avium subsp. paratuberculosis
gccggacggugacgccgga

SEQ ID NO: 826995 - RNA, 17 nt, Mycobacterium avium subsp. paratuberculosis
gccggagaaggcgaacg

SEQ ID NO: 826996 - RNA, 22 nt, Mycobacterium avium subsp. paratuberculosis
gccggacuugaugcugcccggc

SEQ ID NO: 826997 - RNA, 23 nt, Mycobacterium avium subsp. paratuberculosis
gccggacuugaugcugcccggcg

SEQ ID NO: 826998 - RNA, 13 nt, Mycobacterium avium subsp. paratuberculosis
gccggaggcggcg

SEQ ID NO: 826999 - RNA, 17 nt, Mycobacterium avium subsp. paratuberculosis
gccggaggccagcucga

SEQ ID NO: 827000 - RNA, 19 nt, Mycobacterium avium subsp. paratuberculosis
gccggaggccagcucgacc

SEQ ID NO: 827001 - RNA, 20 nt, Mycobacterium avium subsp. paratuberculosis
gccggaggccagcucgaccg

SEQ ID NO: 827002 - RNA, 21 nt, Mycobacterium avium subsp. paratuberculosis
gccggaggccagcucgaccgc

SEQ ID NO: 827003 - RNA, 14 nt, Mycobacterium avium subsp. paratuberculosis
gccggaggcggcgu

SEQ ID NO: 827004 - RNA, 15 nt, Mycobacterium avium subsp. paratuberculosis
gccggaggcggcgua

SEQ ID NO: 827005 - RNA, 21 nt, Mycobacterium avium subsp. paratuberculosis
gccggaggggcgacgggccga

SEQ ID NO: 827006 - RNA, 23 nt, Mycobacterium avium subsp. paratuberculosis
gccggaggggcgacgggccgauc

SEQ ID NO: 827007 - RNA, 18 nt, Mycobacterium avium subsp. paratuberculosis
gccggaccgauccggcgc

SEQ ID NO: 827008 - RNA, 19 nt, Mycobacterium avium subsp. paratuberculosis
gccggaccgauccggcgcc

SEQ ID NO: 827009 - RNA, 20 nt, Mycobacterium avium subsp. paratuberculosis
gccggaccgauccggcgccc

SEQ ID NO: 827010 - RNA, 18 nt, Mycobacterium avium subsp. paratuberculosis
gccggaccgcgcgggcca

SEQ ID NO: 827011 - RNA, 13 nt, Mycobacterium avium subsp. paratuberculosis
gccggaccucgac

SEQ ID NO: 827012 - RNA, 14 nt, Mycobacterium avium subsp. paratuberculosis
gccggaccucgacc

SEQ ID NO: 827013 - RNA, 18 nt, Mycobacterium avium subsp. paratuberculosis
gccggaccucgaccagcc

SEQ ID NO: 827014 - RNA, 19 nt, Mycobacterium avium subsp. paratuberculosis
gccggaccucgaccagccg

SEQ ID NO: 827015 - RNA, 22 nt, Mycobacterium avium subsp. paratuberculosis
gccggaccucgaccagccggug

SEQ ID NO: 827016 - RNA, 18 nt, Mycobacterium avium subsp. paratuberculosis
gccggacaucucccgcac

SEQ ID NO: 827017 - RNA, 20 nt, Mycobacterium avium subsp. paratuberculosis
gccggacaucucccgcaccc

SEQ ID NO: 827018 - RNA, 19 nt, Mycobacterium avium subsp. paratuberculosis
gccggacccauucgucggc

SEQ ID NO: 827019 - RNA, 20 nt, Mycobacterium avium subsp. paratuberculosis
gccggacccauucgucggcg

SEQ ID NO: 827020 - RNA, 21 nt, Mycobacterium avium subsp. paratuberculosis
gccggacccauucgucggcgg

SEQ ID NO: 827021 - RNA, 22 nt, Mycobacterium avium subsp. paratuberculosis
gccggacccauucgucggcggu

SEQ ID NO: 827022 - RNA, 23 nt, Mycobacterium avium subsp. paratuberculosis
gccggacccauucgucggcgguc

SEQ ID NO: 827023 - RNA, 20 nt, Mycobacterium avium subsp. paratuberculosis
gccggaccccacagcgcgcc

SEQ ID NO: 827024 - RNA, 16 nt, Mycobacterium avium subsp. paratuberculosis
gccgcuuuccaccccg

SEQ ID NO: 827025 - RNA, 17 nt, Mycobacterium avium subsp. paratuberculosis
gccgcuuuccaccccgg

SEQ ID NO: 827026 - RNA, 18 nt, Mycobacterium avium subsp. paratuberculosis
gccgcuuuccaccccggc

SEQ ID NO: 827027 - RNA, 20 nt, Mycobacterium avium subsp. paratuberculosis
gccgcuuuccaccccggcgg

SEQ ID NO: 827028 - RNA, 21 nt, Mycobacterium avium subsp. paratuberculosis
gccgcuuuccaccccggcggu

SEQ ID NO: 827029 - RNA, 12 nt, Mycobacterium avium subsp. paratuberculosis
gccggacagccg

SEQ ID NO: 827030 - RNA, 14 nt, Mycobacterium avium subsp. paratuberculosis
gccggacagcggcc

SEQ ID NO: 827031 - RNA, 16 nt, Mycobacterium avium subsp. paratuberculosis
gccggacagcgggccg

SEQ ID NO: 827032 - RNA, 14 nt, Mycobacterium avium subsp. paratuberculosis
gccggacagcgggu

SEQ ID NO: 827033 - RNA, 20 nt, Mycobacterium avium subsp. paratuberculosis
gccggacagcuggcggucgc

SEQ ID NO: 827034 - RNA, 14 nt, Mycobacterium avium subsp. paratuberculosis
gccgcuugccaugu

SEQ ID NO: 827035 - RNA, 13 nt, Mycobacterium avium subsp. paratuberculosis
gccgcuuggcgcg

SEQ ID NO: 827036 - RNA, 15 nt, Mycobacterium avium subsp. paratuberculosis
gccgcuuggcgcgcc

SEQ ID NO: 827037 - RNA, 17 nt, Mycobacterium avium subsp. paratuberculosis
gccgcuuggcgcgccgc

SEQ ID NO: 827038 - RNA, 18 nt, Mycobacterium avium subsp. paratuberculosis
gccgcuuggcgcgccgca

SEQ ID NO: 827039 - RNA, 20 nt, Mycobacterium avium subsp. paratuberculosis
gccggacaccggcacgucgg

SEQ ID NO: 827040 - RNA, 21 nt, Mycobacterium avium subsp. paratuberculosis
gccggacaccggcacgucggc

SEQ ID NO: 827041 - RNA, 23 nt, Mycobacterium avium subsp. paratuberculosis
gccggacaccggcacgucggcca

SEQ ID NO: 827042 - RNA, 18 nt, Mycobacterium avium subsp. paratuberculosis
gccggacacggcugcacc

SEQ ID NO: 827043 - RNA, 20 nt, Mycobacterium avium subsp. paratuberculosis
gccgcuuguucgggcccaca

SEQ ID NO: 827044 - RNA, 21 nt, Mycobacterium avium subsp. paratuberculosis
gccgcuuguucgggcccacac

SEQ ID NO: 827045 - RNA, 13 nt, Mycobacterium avium subsp. paratuberculosis
gccgcuuggccgg

SEQ ID NO: 827046 - RNA, 15 nt, Mycobacterium avium subsp. paratuberculosis
gccgcuuggccgggc

SEQ ID NO: 827047 - RNA, 18 nt, Mycobacterium avium subsp. paratuberculosis
gccgcuuggccgggcgga

SEQ ID NO: 827048 - RNA, 14 nt, Mycobacterium avium subsp. paratuberculosis
gccgcuugguggcg

SEQ ID NO: 827049 - RNA, 14 nt, Mycobacterium avium subsp. paratuberculosis
gccgcugucgucga

SEQ ID NO: 827050 - RNA, 20 nt, Mycobacterium avium subsp. paratuberculosis
gccgcugucgucgaagagcu

SEQ ID NO: 827051 - RNA, 16 nt, Mycobacterium avium subsp. paratuberculosis
gccgcuguccucgucg

SEQ ID NO: 827052 - RNA, 17 nt, Mycobacterium avium subsp. paratuberculosis
gccgcuguccucgucgg

SEQ ID NO: 827053 - RNA, 14 nt, Mycobacterium avium subsp. paratuberculosis
gccgcuucgucgcc

SEQ ID NO: 827054 - RNA, 16 nt, Mycobacterium avium subsp. paratuberculosis
gccgcuucgucgccgg

SEQ ID NO: 827055 - RNA, 20 nt, Mycobacterium avium subsp. paratuberculosis
gccgcuucgucgccggccgc

SEQ ID NO: 827056 - RNA, 16 nt, Mycobacterium avium subsp. paratuberculosis
gccgcugggcguggug

SEQ ID NO: 827057 - RNA, 17 nt, Mycobacterium avium subsp. paratuberculosis
gccgcugggcguggugc

SEQ ID NO: 827058 - RNA, 21 nt, Mycobacterium avium subsp. paratuberculosis
gccgcugguaggcggcgcagc

SEQ ID NO: 827059 - RNA, 12 nt, Mycobacterium avium subsp. paratuberculosis
gccgcuggucag

SEQ ID NO: 827060 - RNA, 21 nt, Mycobacterium avium subsp. paratuberculosis
gccgcuggucaggccgaauga

SEQ ID NO: 827061 - RNA, 22 nt, Mycobacterium avium subsp. paratuberculosis
gccgcuggugaggucgcgcagg

SEQ ID NO: 827062 - RNA, 14 nt, Mycobacterium avium subsp. paratuberculosis
gccgcuggcguaga

SEQ ID NO: 827063 - RNA, 18 nt, Mycobacterium avium subsp. paratuberculosis
gccgcuggcgucgaucgc

SEQ ID NO: 827064 - RNA, 14 nt, Mycobacterium avium subsp. paratuberculosis
gccgcuggcguuga

SEQ ID NO: 827065 - RNA, 15 nt, Mycobacterium avium subsp. paratuberculosis
gccgcugggagcacg

SEQ ID NO: 827066 - RNA, 13 nt, Mycobacterium avium subsp. paratuberculosis
gccgcuggccgcc

SEQ ID NO: 827067 - RNA, 17 nt, Mycobacterium avium subsp. paratuberculosis
gccgcuggccgccccga

SEQ ID NO: 827068 - RNA, 15 nt, Mycobacterium avium subsp. paratuberculosis
gccgcuggccgcgcc

SEQ ID NO: 827069 - RNA, 16 nt, Mycobacterium avium subsp. paratuberculosis
gccgcuggccgcgcca

SEQ ID NO: 827070 - RNA, 17 nt, Mycobacterium avium subsp. paratuberculosis
gccgcuggccgcgccac

SEQ ID NO: 827071 - RNA, 23 nt, Mycobacterium avium subsp. paratuberculosis
gccgcuggauguccaggccgucg

SEQ ID NO: 827072 - RNA, 18 nt, Mycobacterium avium subsp. paratuberculosis
gccgcuggauuccaccgu

SEQ ID NO: 827073 - RNA, 19 nt, Mycobacterium avium subsp. paratuberculosis
gccgcuggauuccaccgug

SEQ ID NO: 827074 - RNA, 16 nt, Mycobacterium avium subsp. paratuberculosis
gccgcgucggucagcg

SEQ ID NO: 827075 - RNA, 18 nt, Mycobacterium avium subsp. paratuberculosis
gccgcgucggucagcgcc

SEQ ID NO: 827076 - RNA, 19 nt, Mycobacterium avium subsp. paratuberculosis
gccgcgucggucagcgcca

SEQ ID NO: 827077 - RNA, 13 nt, Mycobacterium avium subsp. paratuberculosis
gccgcgucguuga

SEQ ID NO: 827078 - RNA, 13 nt, Mycobacterium avium subsp. paratuberculosis
gccgcgucggcgg

SEQ ID NO: 827079 - RNA, 21 nt, Mycobacterium avium subsp. paratuberculosis
gccgcgucggcggcggcggcc

SEQ ID NO: 827080 - RNA, 22 nt, Mycobacterium avium subsp. paratuberculosis
gccgcgucggcggcggcggccg

SEQ ID NO: 827081 - RNA, 15 nt, Mycobacterium avium subsp. paratuberculosis
gccgcgucggcgguc

SEQ ID NO: 827082 - RNA, 17 nt, Mycobacterium avium subsp. paratuberculosis
gccgcgucggcggucgc

SEQ ID NO: 827083 - RNA, 19 nt, Mycobacterium avium subsp. paratuberculosis
gccgcgucggcggucgcca

SEQ ID NO: 827084 - RNA, 20 nt, Mycobacterium avium subsp. paratuberculosis
gccgcgucggcggucgccag

SEQ ID NO: 827085 - RNA, 16 nt, Mycobacterium avium subsp. paratuberculosis
gccgcgugacaggggc

SEQ ID NO: 827086 - RNA, 15 nt, Mycobacterium avium subsp. paratuberculosis
gccgcguacaccggc

SEQ ID NO: 827087 - RNA, 18 nt, Mycobacterium avium subsp. paratuberculosis
gccgcguacaccggcuga

SEQ ID NO: 827088 - RNA, 22 nt, Mycobacterium avium subsp. paratuberculosis
gccgcguacagcagcugcccga

SEQ ID NO: 827089 - RNA, 17 nt, Mycobacterium avium subsp. paratuberculosis
gccgcguaccagcgcca

SEQ ID NO: 827090 - RNA, 19 nt, Mycobacterium avium subsp. paratuberculosis
gccgcguacuucgcgcccu

SEQ ID NO: 827091 - RNA, 18 nt, Mycobacterium avium subsp. paratuberculosis
gccgcguagcucgccgcg

SEQ ID NO: 827092 - RNA, 19 nt, Mycobacterium avium subsp. paratuberculosis
gccgcguagcucgccgcgg

SEQ ID NO: 827093 - RNA, 16 nt, Mycobacterium avium subsp. paratuberculosis
gccgcguaggccagga

SEQ ID NO: 827094 - RNA, 15 nt, Mycobacterium avium subsp. paratuberculosis
gccgcgucgccgacc

SEQ ID NO: 827095 - RNA, 16 nt, Mycobacterium avium subsp. paratuberculosis
gccgcgucgccgacca

SEQ ID NO: 827096 - RNA, 17 nt, Mycobacterium avium subsp. paratuberculosis
gccgcgucgccgaccag

SEQ ID NO: 827097 - RNA, 14 nt, Mycobacterium avium subsp. paratuberculosis
gccgcgucgccgau

SEQ ID NO: 827098 - RNA, 16 nt, Mycobacterium avium subsp. paratuberculosis
gccgcgucgccgaucg

SEQ ID NO: 827099 - RNA, 13 nt, Mycobacterium avium subsp. paratuberculosis
gccgcgucgccgc

SEQ ID NO: 827100 - RNA, 19 nt, Mycobacterium avium subsp. paratuberculosis
gccgcgucgccgccgggcg

SEQ ID NO: 827101 - RNA, 20 nt, Mycobacterium avium subsp. paratuberculosis
gccgcgucgccgccgggcgc

SEQ ID NO: 827102 - RNA, 14 nt, Mycobacterium avium subsp. paratuberculosis
gccgcgucgcgccg

SEQ ID NO: 827103 - RNA, 17 nt, Mycobacterium avium subsp. paratuberculosis
gccgcgucgcgccgccg

SEQ ID NO: 827104 - RNA, 15 nt, Mycobacterium avium subsp. paratuberculosis
gccgcgucggacccc

SEQ ID NO: 827105 - RNA, 17 nt, Mycobacterium avium subsp. paratuberculosis
gccgcgucggaccccga

SEQ ID NO: 827106 - RNA, 18 nt, Mycobacterium avium subsp. paratuberculosis
gccgcgucggaccccgau

SEQ ID NO: 827107 - RNA, 12 nt, Mycobacterium avium subsp. paratuberculosis
gccgcgucggcc

SEQ ID NO: 827108 - RNA, 13 nt, Mycobacterium avium subsp. paratuberculosis
gccgcgucggcca

SEQ ID NO: 827109 - RNA, 14 nt, Mycobacterium avium subsp. paratuberculosis
gccgcguucacccg

SEQ ID NO: 827110 - RNA, 15 nt, Mycobacterium avium subsp. paratuberculosis
gccgcguucacccgc

SEQ ID NO: 827111 - RNA, 23 nt, Mycobacterium avium subsp. paratuberculosis
gccgcguggccucccgguagauc

SEQ ID NO: 827112 - RNA, 18 nt, Mycobacterium avium subsp. paratuberculosis
gccgcgugggagagcggg

SEQ ID NO: 827113 - RNA, 22 nt, Mycobacterium avium subsp. paratuberculosis
gccgcuagguuuggccagcacc

SEQ ID NO: 827114 - RNA, 18 nt, Mycobacterium avium subsp. paratuberculosis
gccgcuagucgcccagca

SEQ ID NO: 827115 - RNA, 20 nt, Mycobacterium avium subsp. paratuberculosis
gccgcuagucgcccagcagc

SEQ ID NO: 827116 - RNA, 22 nt, Mycobacterium avium subsp. paratuberculosis
gccgcuagucgcccagcagccc

SEQ ID NO: 827117 - RNA, 15 nt, Mycobacterium avium subsp. paratuberculosis
gccgcguuccccggc

SEQ ID NO: 827118 - RNA, 16 nt, Mycobacterium avium subsp. paratuberculosis
gccgcguuccccggcg

SEQ ID NO: 827119 - RNA, 18 nt, Mycobacterium avium subsp. paratuberculosis
gccgcguuccccggcgug

SEQ ID NO: 827120 - RNA, 16 nt, Mycobacterium avium subsp. paratuberculosis
gccgcguucggcggcg

SEQ ID NO: 827121 - RNA, 17 nt, Mycobacterium avium subsp. paratuberculosis
gccgcguucggcggcgc

SEQ ID NO: 827122 - RNA, 21 nt, Mycobacterium avium subsp. paratuberculosis
gccgcucagcgauugcggccg

SEQ ID NO: 827123 - RNA, 23 nt, Mycobacterium avium subsp. paratuberculosis
gccgcucagcgauugcggccgcc

SEQ ID NO: 827124 - RNA, 13 nt, Mycobacterium avium subsp. paratuberculosis
gccgcucaccgcc

SEQ ID NO: 827125 - RNA, 17 nt, Mycobacterium avium subsp. paratuberculosis
gccgcucaccgccgagc

SEQ ID NO: 827126 - RNA, 20 nt, Mycobacterium avium subsp. paratuberculosis
gccgcucaccgccgagccgc

SEQ ID NO: 827127 - RNA, 16 nt, Mycobacterium avium subsp. paratuberculosis
gccgcucgcccagcgc

SEQ ID NO: 827128 - RNA, 17 nt, Mycobacterium avium subsp. paratuberculosis
gccgcucgcccagcgcg

SEQ ID NO: 827129 - RNA, 18 nt, Mycobacterium avium subsp. paratuberculosis
gccgcucgcccagcgcgg

SEQ ID NO: 827130 - RNA, 19 nt, Mycobacterium avium subsp. paratuberculosis
gccgcucgcccagcgcggc

SEQ ID NO: 827131 - RNA, 23 nt, Mycobacterium avium subsp. paratuberculosis
gccgcucgcccagcgcggcggcc

SEQ ID NO: 827132 - RNA, 14 nt, Mycobacterium avium subsp. paratuberculosis
gccgcucgccgggg

SEQ ID NO: 827133 - RNA, 23 nt, Mycobacterium avium subsp. paratuberculosis
gccgcucgccggggacgacggcg

SEQ ID NO: 827134 - RNA, 14 nt, Mycobacterium avium subsp. paratuberculosis
gccgcucagcgggc

SEQ ID NO: 827135 - RNA, 18 nt, Mycobacterium avium subsp. paratuberculosis
gccgcucagcgggcggcc

SEQ ID NO: 827136 - RNA, 19 nt, Mycobacterium avium subsp. paratuberculosis
gccgcucagcgggcggcca

SEQ ID NO: 827137 - RNA, 20 nt, Mycobacterium avium subsp. paratuberculosis
gccgcucagcgggcggccag

SEQ ID NO: 827138 - RNA, 20 nt, Mycobacterium avium subsp. paratuberculosis
gccgcucaaguccucggugg

SEQ ID NO: 827139 - RNA, 15 nt, Mycobacterium avium subsp. paratuberculosis
gccgcucacacagcc

SEQ ID NO: 827140 - RNA, 16 nt, Mycobacterium avium subsp. paratuberculosis
gccgcucacacagccg

SEQ ID NO: 827141 - RNA, 13 nt, Mycobacterium avium subsp. paratuberculosis
gccgcucgcgcac

SEQ ID NO: 827142 - RNA, 19 nt, Mycobacterium avium subsp. paratuberculosis
gccgcucgggugucgccga

SEQ ID NO: 827143 - RNA, 21 nt, Mycobacterium avium subsp. paratuberculosis
gccgcucgggugucgccgagc

SEQ ID NO: 827144 - RNA, 22 nt, Mycobacterium avium subsp. paratuberculosis
gccgcucguaacgccacggcgg

SEQ ID NO: 827145 - RNA, 20 nt, Mycobacterium avium subsp. paratuberculosis
gccgcucguaguuggggccg

SEQ ID NO: 827146 - RNA, 22 nt, Mycobacterium avium subsp. paratuberculosis
gccgcucguaguuggggccggc

SEQ ID NO: 827147 - RNA, 15 nt, Mycobacterium avium subsp. paratuberculosis
gccgcucggccagca

SEQ ID NO: 827148 - RNA, 19 nt, Mycobacterium avium subsp. paratuberculosis
gccgcucggccagcagcac

SEQ ID NO: 827149 - RNA, 22 nt, Mycobacterium avium subsp. paratuberculosis
gccgcucgcuauaucgcaccgg

SEQ ID NO: 827150 - RNA, 23 nt, Mycobacterium avium subsp. paratuberculosis
gccgcucgcuauaucgcaccggc

SEQ ID NO: 827151 - RNA, 23 nt, Mycobacterium avium subsp. paratuberculosis
gccgcucggaguucgcccgcagc

SEQ ID NO: 827152 - RNA, 18 nt, Mycobacterium avium subsp. paratuberculosis
gccgcugcugggugccgc

SEQ ID NO: 827153 - RNA, 22 nt, Mycobacterium avium subsp. paratuberculosis
gccgcugcuuugucucacgccu

SEQ ID NO: 827154 - RNA, 14 nt, Mycobacterium avium subsp. paratuberculosis
gccgcugccggggu

SEQ ID NO: 827155 - RNA, 15 nt, Mycobacterium avium subsp. paratuberculosis
gccgcugccggggug

SEQ ID NO: 827156 - RNA, 19 nt, Mycobacterium avium subsp. paratuberculosis
gccgcugccggggugcagc

SEQ ID NO: 827157 - RNA, 14 nt, Mycobacterium avium subsp. paratuberculosis
gccgcugcccgccg

SEQ ID NO: 827158 - RNA, 15 nt, Mycobacterium avium subsp. paratuberculosis
gccgcugcccgccgc

SEQ ID NO: 827159 - RNA, 16 nt, Mycobacterium avium subsp. paratuberculosis
gccgcugcccgccgcg

SEQ ID NO: 827160 - RNA, 13 nt, Mycobacterium avium subsp. paratuberculosis
gccgcugcccggc

SEQ ID NO: 827161 - RNA, 21 nt, Mycobacterium avium subsp. paratuberculosis
gccgcugcccgggcaucccgc

SEQ ID NO: 827162 - RNA, 15 nt, Mycobacterium avium subsp. paratuberculosis
gccgcugccgcaccc

SEQ ID NO: 827163 - RNA, 20 nt, Mycobacterium avium subsp. paratuberculosis
gccgcugccgcaccccgugg

SEQ ID NO: 827164 - RNA, 19 nt, Mycobacterium avium subsp. paratuberculosis
gccgcugcauccgcagcac

SEQ ID NO: 827165 - RNA, 21 nt, Mycobacterium avium subsp. paratuberculosis
gccgcugcauccgcagcacca

SEQ ID NO: 827166 - RNA, 16 nt, Mycobacterium avium subsp. paratuberculosis
gccgcugcagcugcuc

SEQ ID NO: 827167 - RNA, 23 nt, Mycobacterium avium subsp. paratuberculosis
gccgcugcagcugcucguccugg

SEQ ID NO: 827168 - RNA, 17 nt, Mycobacterium avium subsp. paratuberculosis
gccgcugcagcgccgcc

SEQ ID NO: 827169 - RNA, 20 nt, Mycobacterium avium subsp. paratuberculosis
gccgcugcagcgccgcccgc

SEQ ID NO: 827170 - RNA, 12 nt, Mycobacterium avium subsp. paratuberculosis
gccgcucgucgg

SEQ ID NO: 827171 - RNA, 14 nt, Mycobacterium avium subsp. paratuberculosis
gccgcucgucggcc

SEQ ID NO: 827172 - RNA, 17 nt, Mycobacterium avium subsp. paratuberculosis
gccgcucgucggccagc

SEQ ID NO: 827173 - RNA, 18 nt, Mycobacterium avium subsp. paratuberculosis
gccgcucgucggccagcg

SEQ ID NO: 827174 - RNA, 19 nt, Mycobacterium avium subsp. paratuberculosis
gccgcucgucggccagcga

SEQ ID NO: 827175 - RNA, 14 nt, Mycobacterium avium subsp. paratuberculosis
gccgcucgucgggc

SEQ ID NO: 827176 - RNA, 18 nt, Mycobacterium avium subsp. paratuberculosis
gccgcgguggcgguguuc

SEQ ID NO: 827177 - RNA, 19 nt, Mycobacterium avium subsp. paratuberculosis
gccgcgguggguccgccgg

SEQ ID NO: 827178 - RNA, 22 nt, Mycobacterium avium subsp. paratuberculosis
gccgcgguggguccgccgggcg

SEQ ID NO: 827179 - RNA, 11 nt, Mycobacterium avium subsp. paratuberculosis
gccgcgguggu

SEQ ID NO: 827180 - RNA, 19 nt, Mycobacterium avium subsp. paratuberculosis
gccgcgguggccgggaugc

SEQ ID NO: 827181 - RNA, 20 nt, Mycobacterium avium subsp. paratuberculosis
gccgcgguggcgccgcgggc

SEQ ID NO: 827182 - RNA, 22 nt, Mycobacterium avium subsp. paratuberculosis
gccgcgguggcgccgcgggcgg

SEQ ID NO: 827183 - RNA, 20 nt, Mycobacterium avium subsp. paratuberculosis
gccgcgguucuuguccucga

SEQ ID NO: 827184 - RNA, 14 nt, Mycobacterium avium subsp. paratuberculosis
gccgcgguugaaca

SEQ ID NO: 827185 - RNA, 23 nt, Mycobacterium avium subsp. paratuberculosis
gccgcgguugaacaggcugcccu

SEQ ID NO: 827186 - RNA, 15 nt, Mycobacterium avium subsp. paratuberculosis
gccgcgguuggucac

SEQ ID NO: 827187 - RNA, 17 nt, Mycobacterium avium subsp. paratuberculosis
gccgcgguuggucacca

SEQ ID NO: 827188 - RNA, 20 nt, Mycobacterium avium subsp. paratuberculosis
gccgcgguuggucaccaggu

SEQ ID NO: 827189 - RNA, 23 nt, Mycobacterium avium subsp. paratuberculosis
gccgcgguuggucaccaggucgc

SEQ ID NO: 827190 - RNA, 14 nt, Mycobacterium avium subsp. paratuberculosis
gccgcggugguggg

SEQ ID NO: 827191 - RNA, 16 nt, Mycobacterium avium subsp. paratuberculosis
gccgcgguggugggcg

SEQ ID NO: 827192 - RNA, 20 nt, Mycobacterium avium subsp. paratuberculosis
gccgcgguggugggcgcggu

SEQ ID NO: 827193 - RNA, 21 nt, Mycobacterium avium subsp. paratuberculosis
gccgcgguggugggcgcggug

SEQ ID NO: 827194 - RNA, 14 nt, Mycobacterium avium subsp. paratuberculosis
gccgcgggucggcg

SEQ ID NO: 827195 - RNA, 15 nt, Mycobacterium avium subsp. paratuberculosis
gccgcgggucggcga

SEQ ID NO: 827196 - RNA, 22 nt, Mycobacterium avium subsp. paratuberculosis
gccgcgggucggcgacggcgcu

SEQ ID NO: 827197 - RNA, 15 nt, Mycobacterium avium subsp. paratuberculosis
gccgcggugcguuug

SEQ ID NO: 827198 - RNA, 13 nt, Mycobacterium avium subsp. paratuberculosis
gccgcggugcuga

SEQ ID NO: 827199 - RNA, 20 nt, Mycobacterium avium subsp. paratuberculosis
gccgcgggcccaccgccacc

SEQ ID NO: 827200 - RNA, 12 nt, Mycobacterium avium subsp. paratuberculosis
gccgcggggccg

SEQ ID NO: 827201 - RNA, 14 nt, Mycobacterium avium subsp. paratuberculosis
gccgcggggccggc

SEQ ID NO: 827202 - RNA, 21 nt, Mycobacterium avium subsp. paratuberculosis
gccgcgggcggucgcgcagcc

SEQ ID NO: 827203 - RNA, 19 nt, Mycobacterium avium subsp. paratuberculosis
gccgcgggcguucaucacc

SEQ ID NO: 827204 - RNA, 12 nt, Mycobacterium avium subsp. paratuberculosis
gccgcgggccag

SEQ ID NO: 827205 - RNA, 16 nt, Mycobacterium avium subsp. paratuberculosis
gccgcgggccagcagc

SEQ ID NO: 827206 - RNA, 18 nt, Mycobacterium avium subsp. paratuberculosis
gccgcgggccagcagccg

SEQ ID NO: 827207 - RNA, 21 nt, Mycobacterium avium subsp. paratuberculosis
gccgcgggccagcagccgggu

SEQ ID NO: 827208 - RNA, 14 nt, Mycobacterium avium subsp. paratuberculosis
gccgcgggccagcc

SEQ ID NO: 827209 - RNA, 16 nt, Mycobacterium avium subsp. paratuberculosis
gccgcgggccagccag

SEQ ID NO: 827210 - RNA, 16 nt, Mycobacterium avium subsp. paratuberculosis
gccgcgggaggcccag

SEQ ID NO: 827211 - RNA, 18 nt, Mycobacterium avium subsp. paratuberculosis
gccgcgggaggcccagua

SEQ ID NO: 827212 - RNA, 15 nt, Mycobacterium avium subsp. paratuberculosis
gccgcggccggcggc

SEQ ID NO: 827213 - RNA, 16 nt, Mycobacterium avium subsp. paratuberculosis
gccgcggccggugcca

SEQ ID NO: 827214 - RNA, 15 nt, Mycobacterium avium subsp. paratuberculosis
gccgcggccggcacu

SEQ ID NO: 827215 - RNA, 23 nt, Mycobacterium avium subsp. paratuberculosis
gccgcggccgaaccgcugcaacc

SEQ ID NO: 827216 - RNA, 21 nt, Mycobacterium avium subsp. paratuberculosis
gccgcggccgccgcgacggcc

SEQ ID NO: 827217 - RNA, 12 nt, Mycobacterium avium subsp. paratuberculosis
gccgcggccgcg

SEQ ID NO: 827218 - RNA, 13 nt, Mycobacterium avium subsp. paratuberculosis
gccgcggccgcga

SEQ ID NO: 827219 - RNA, 16 nt, Mycobacterium avium subsp. paratuberculosis
gccgcggccgcggcgg

SEQ ID NO: 827220 - RNA, 17 nt, Mycobacterium avium subsp. paratuberculosis
gccgcggccgcggcggg

SEQ ID NO: 827221 - RNA, 17 nt, Mycobacterium avium subsp. paratuberculosis
gccgcggccgcguuguc

SEQ ID NO: 827222 - RNA, 14 nt, Mycobacterium avium subsp. paratuberculosis
gccgcggccggaga

SEQ ID NO: 827223 - RNA, 12 nt, Mycobacterium avium subsp. paratuberculosis
gccgcggccggc

SEQ ID NO: 827224 - RNA, 16 nt, Mycobacterium avium subsp. paratuberculosis
gccgcggcccgcuucc

SEQ ID NO: 827225 - RNA, 13 nt, Mycobacterium avium subsp. paratuberculosis
gccgcggcccggc

SEQ ID NO: 827226 - RNA, 18 nt, Mycobacterium avium subsp. paratuberculosis
gccgcggcccggccacca

SEQ ID NO: 827227 - RNA, 17 nt, Mycobacterium avium subsp. paratuberculosis
gccgcggcccugcagcg

SEQ ID NO: 827228 - RNA, 19 nt, Mycobacterium avium subsp. paratuberculosis
gccgcggcccugcagcgcc

SEQ ID NO: 827229 - RNA, 14 nt, Mycobacterium avium subsp. paratuberculosis
gccgcggccagccg

SEQ ID NO: 827230 - RNA, 14 nt, Mycobacterium avium subsp. paratuberculosis
gccgcggccagcgc

SEQ ID NO: 827231 - RNA, 16 nt, Mycobacterium avium subsp. paratuberculosis
gccgcggccagcgccc

SEQ ID NO: 827232 - RNA, 19 nt, Mycobacterium avium subsp. paratuberculosis
gccgcggccagcugcccgc

SEQ ID NO: 827233 - RNA, 22 nt, Mycobacterium avium subsp. paratuberculosis
gccgcggccagcugcccgccga

SEQ ID NO: 827234 - RNA, 12 nt, Mycobacterium avium subsp. paratuberculosis
gccgcggccagg

SEQ ID NO: 827235 - RNA, 13 nt, Mycobacterium avium subsp. paratuberculosis
gccgcggccagcc

SEQ ID NO: 827236 - RNA, 14 nt, Mycobacterium avium subsp. paratuberculosis
gccgcggccaccgg

SEQ ID NO: 827237 - RNA, 18 nt, Mycobacterium avium subsp. paratuberculosis
gccgcggccaccgggucg

SEQ ID NO: 827238 - RNA, 12 nt, Mycobacterium avium subsp. paratuberculosis
gccgcggccacc

SEQ ID NO: 827239 - RNA, 15 nt, Mycobacterium avium subsp. paratuberculosis
gccgcggcaacgcca

SEQ ID NO: 827240 - RNA, 20 nt, Mycobacterium avium subsp. paratuberculosis
gccgcggcaacgccagccag

SEQ ID NO: 827241 - RNA, 21 nt, Mycobacterium avium subsp. paratuberculosis
gccgcggcaacgccagccaga

SEQ ID NO: 827242 - RNA, 20 nt, Mycobacterium avium subsp. paratuberculosis
gccgcggauggccucggcga

SEQ ID NO: 827243 - RNA, 22 nt, Mycobacterium avium subsp. paratuberculosis
gccgcggauggugacggccgug

SEQ ID NO: 827244 - RNA, 23 nt, Mycobacterium avium subsp. paratuberculosis
gccgcggauguggaggcgagcaa

SEQ ID NO: 827245 - RNA, 20 nt, Mycobacterium avium subsp. paratuberculosis
gccgcggaugaccaggucgc

SEQ ID NO: 827246 - RNA, 22 nt, Mycobacterium avium subsp. paratuberculosis
gccgcggaugaccaggucgccg

SEQ ID NO: 827247 - RNA, 20 nt, Mycobacterium avium subsp. paratuberculosis
gccgcgcuugacggccgggc

SEQ ID NO: 827248 - RNA, 17 nt, Mycobacterium avium subsp. paratuberculosis
gccgcgcuugcgaccgc

SEQ ID NO: 827249 - RNA, 19 nt, Mycobacterium avium subsp. paratuberculosis
gccgcgcuugcgaccgccg

SEQ ID NO: 827250 - RNA, 20 nt, Mycobacterium avium subsp. paratuberculosis
gccgcgcuugcgaccgccgc

SEQ ID NO: 827251 - RNA, 15 nt, Mycobacterium avium subsp. paratuberculosis
gccgcgcuggcgcag

SEQ ID NO: 827252 - RNA, 21 nt, Mycobacterium avium subsp. paratuberculosis
gccgcgcuguccacguccugc

SEQ ID NO: 827253 - RNA, 16 nt, Mycobacterium avium subsp. paratuberculosis
gccgcgcuggccagcg

SEQ ID NO: 827254 - RNA, 17 nt, Mycobacterium avium subsp. paratuberculosis
gccgcgcuggccagcgu

SEQ ID NO: 827255 - RNA, 19 nt, Mycobacterium avium subsp. paratuberculosis
gccgcgcuggccagcguca

SEQ ID NO: 827256 - RNA, 21 nt, Mycobacterium avium subsp. paratuberculosis
gccgcgcuggccagcgucagg

SEQ ID NO: 827257 - RNA, 14 nt, Mycobacterium avium subsp. paratuberculosis
gccgcgcuggccga

SEQ ID NO: 827258 - RNA, 22 nt, Mycobacterium avium subsp. paratuberculosis
gccgcgcuggccggguuccggu

SEQ ID NO: 827259 - RNA, 15 nt, Mycobacterium avium subsp. paratuberculosis
gccgcgcugcgccgg

SEQ ID NO: 827260 - RNA, 16 nt, Mycobacterium avium subsp. paratuberculosis
gccgcgcugcgccggg

SEQ ID NO: 827261 - RNA, 18 nt, Mycobacterium avium subsp. paratuberculosis
gccgcgcugaacgcggug

SEQ ID NO: 827262 - RNA, 13 nt, Mycobacterium avium subsp. paratuberculosis
gccgcgcgcccgc

SEQ ID NO: 827263 - RNA, 14 nt, Mycobacterium avium subsp. paratuberculosis
gccgcgcgccgaga

SEQ ID NO: 827264 - RNA, 15 nt, Mycobacterium avium subsp. paratuberculosis
gccgcgcgcccgcgg

SEQ ID NO: 827265 - RNA, 14 nt, Mycobacterium avium subsp. paratuberculosis
gccgcgcgcccguc

SEQ ID NO: 827266 - RNA, 14 nt, Mycobacterium avium subsp. paratuberculosis
gccgcgcgccgaca

SEQ ID NO: 827267 - RNA, 22 nt, Mycobacterium avium subsp. paratuberculosis
gccgcgcgcaucucgaaugcgg

SEQ ID NO: 827268 - RNA, 14 nt, Mycobacterium avium subsp. paratuberculosis
gccgcgcgcagcac

SEQ ID NO: 827269 - RNA, 18 nt, Mycobacterium avium subsp. paratuberculosis
gccgcgcgccagcgcgug

SEQ ID NO: 827270 - RNA, 20 nt, Mycobacterium avium subsp. paratuberculosis
gccgcgcgccagcgcgugcg

SEQ ID NO: 827271 - RNA, 12 nt, Mycobacterium avium subsp. paratuberculosis
gccgcgcgcagg

SEQ ID NO: 827272 - RNA, 12 nt, Mycobacterium avium subsp. paratuberculosis
gccgcgcgcauc

SEQ ID NO: 827273 - RNA, 13 nt, Mycobacterium avium subsp. paratuberculosis
gccgcccagcagc

SEQ ID NO: 827274 - RNA, 12 nt, Mycobacterium avium subsp. paratuberculosis
gccgcccagcag

SEQ ID NO: 827275 - RNA, 21 nt, Mycobacterium avium subsp. paratuberculosis
gccgcccacgccgugcagaac

SEQ ID NO: 827276 - RNA, 13 nt, Mycobacterium avium subsp. paratuberculosis
gccgcccagcccg

SEQ ID NO: 827277 - RNA, 14 nt, Mycobacterium avium subsp. paratuberculosis
gccgcccagcccgc

SEQ ID NO: 827278 - RNA, 19 nt, Mycobacterium avium subsp. paratuberculosis
gccgcccagcccgcgccga

SEQ ID NO: 827279 - RNA, 16 nt, Mycobacterium avium subsp. paratuberculosis
gccgcccacguucagc

SEQ ID NO: 827280 - RNA, 15 nt, Mycobacterium avium subsp. paratuberculosis
gccgcccacgccgcc

SEQ ID NO: 827281 - RNA, 18 nt, Mycobacterium avium subsp. paratuberculosis
gccgcccacgccgcccag

SEQ ID NO: 827282 - RNA, 17 nt, Mycobacterium avium subsp. paratuberculosis
gccgcccaccaccggcu

SEQ ID NO: 827283 - RNA, 13 nt, Mycobacterium avium subsp. paratuberculosis
gccgcccaccagc

SEQ ID NO: 827284 - RNA, 18 nt, Mycobacterium avium subsp. paratuberculosis
gccgcccagucgccgccg

SEQ ID NO: 827285 - RNA, 19 nt, Mycobacterium avium subsp. paratuberculosis
gccgcccaggccgagcgca

SEQ ID NO: 827286 - RNA, 14 nt, Mycobacterium avium subsp. paratuberculosis
gccgcccaggcggg

SEQ ID NO: 827287 - RNA, 16 nt, Mycobacterium avium subsp. paratuberculosis
gccgcccaggcgggcc

SEQ ID NO: 827288 - RNA, 14 nt, Mycobacterium avium subsp. paratuberculosis
gccgcccagcggug

SEQ ID NO: 827289 - RNA, 12 nt, Mycobacterium avium subsp. paratuberculosis
gccgcccggacc

SEQ ID NO: 827290 - RNA, 14 nt, Mycobacterium avium subsp. paratuberculosis
gccgcccggaccgc

SEQ ID NO: 827291 - RNA, 16 nt, Mycobacterium avium subsp. paratuberculosis
gccgcccggaccgcgg

SEQ ID NO: 827292 - RNA, 21 nt, Mycobacterium avium subsp. paratuberculosis
gccgcccggagguucgccgga

SEQ ID NO: 827293 - RNA, 22 nt, Mycobacterium avium subsp. paratuberculosis
gccgcccgcuccugcaggccga

SEQ ID NO: 827294 - RNA, 13 nt, Mycobacterium avium subsp. paratuberculosis
gccgcccggccca

SEQ ID NO: 827295 - RNA, 21 nt, Mycobacterium avium subsp. paratuberculosis
gccgcccggcccaagacccgc

SEQ ID NO: 827296 - RNA, 15 nt, Mycobacterium avium subsp. paratuberculosis
gccgccgaagccggc

SEQ ID NO: 827297 - RNA, 19 nt, Mycobacterium avium subsp. paratuberculosis
gccgccgaagcggcgcacg

SEQ ID NO: 827298 - RNA, 16 nt, Mycobacterium avium subsp. paratuberculosis
gccgccgaagcccgac

SEQ ID NO: 827299 - RNA, 17 nt, Mycobacterium avium subsp. paratuberculosis
gccgccgaagcccgaca

SEQ ID NO: 827300 - RNA, 19 nt, Mycobacterium avium subsp. paratuberculosis
gccgccgaagcccgacauc

SEQ ID NO: 827301 - RNA, 16 nt, Mycobacterium avium subsp. paratuberculosis
gccgcccguccgggcc

SEQ ID NO: 827302 - RNA, 15 nt, Mycobacterium avium subsp. paratuberculosis
gccgcccgucagccc

SEQ ID NO: 827303 - RNA, 16 nt, Mycobacterium avium subsp. paratuberculosis
gccgcccgucagcccc

SEQ ID NO: 827304 - RNA, 17 nt, Mycobacterium avium subsp. paratuberculosis
gccgcccguccagcgca

SEQ ID NO: 827305 - RNA, 22 nt, Mycobacterium avium subsp. paratuberculosis
gccgcccguccagcgcaugcca

SEQ ID NO: 827306 - RNA, 16 nt, Mycobacterium avium subsp. paratuberculosis
gccgccgaacagcagc

SEQ ID NO: 827307 - RNA, 17 nt, Mycobacterium avium subsp. paratuberculosis
gccgccgaacagccggg

SEQ ID NO: 827308 - RNA, 18 nt, Mycobacterium avium subsp. paratuberculosis
gccgccgaacagccgggu

SEQ ID NO: 827309 - RNA, 12 nt, Mycobacterium avium subsp. paratuberculosis
gccgcccgggcg

SEQ ID NO: 827310 - RNA, 18 nt, Mycobacterium avium subsp. paratuberculosis
gccgcccgggcggcccgg

SEQ ID NO: 827311 - RNA, 12 nt, Mycobacterium avium subsp. paratuberculosis
gccgcccgggcc

SEQ ID NO: 827312 - RNA, 13 nt, Mycobacterium avium subsp. paratuberculosis
gccgcccgggccc

SEQ ID NO: 827313 - RNA, 14 nt, Mycobacterium avium subsp. paratuberculosis
gccgcccgggccgc

SEQ ID NO: 827314 - RNA, 17 nt, Mycobacterium avium subsp. paratuberculosis
gccgcccgggccgcgcc

SEQ ID NO: 827315 - RNA, 18 nt, Mycobacterium avium subsp. paratuberculosis
gccgcccgggccgcgccc

SEQ ID NO: 827316 - RNA, 19 nt, Mycobacterium avium subsp. paratuberculosis
gccgcccgggccgcgccca

SEQ ID NO: 827317 - RNA, 17 nt, Mycobacterium avium subsp. paratuberculosis
gccgcccggcgagcagc

SEQ ID NO: 827318 - RNA, 19 nt, Mycobacterium avium subsp. paratuberculosis
gccgcccggcgagcagccc

SEQ ID NO: 827319 - RNA, 22 nt, Mycobacterium avium subsp. paratuberculosis
gccgcccggcgagcagcccggc

SEQ ID NO: 827320 - RNA, 13 nt, Mycobacterium avium subsp. paratuberculosis
gccgcccggcgau

SEQ ID NO: 827321 - RNA, 16 nt, Mycobacterium avium subsp. paratuberculosis
gccgcccggcgccccg

SEQ ID NO: 827322 - RNA, 21 nt, Mycobacterium avium subsp. paratuberculosis
gccgcccggcgcgccgcagga

SEQ ID NO: 827323 - RNA, 17 nt, Mycobacterium avium subsp. paratuberculosis
gccgccaucgaucgggc

SEQ ID NO: 827324 - RNA, 17 nt, Mycobacterium avium subsp. paratuberculosis
gccgccauccguucggc

SEQ ID NO: 827325 - RNA, 19 nt, Mycobacterium avium subsp. paratuberculosis
gccgccauccguucggcuc

SEQ ID NO: 827326 - RNA, 20 nt, Mycobacterium avium subsp. paratuberculosis
gccgccauccguucggcucu

SEQ ID NO: 827327 - RNA, 16 nt, Mycobacterium avium subsp. paratuberculosis
gccgccaucgccucgu

SEQ ID NO: 827328 - RNA, 17 nt, Mycobacterium avium subsp. paratuberculosis
gccgccaucgccucguc

SEQ ID NO: 827329 - RNA, 16 nt, Mycobacterium avium subsp. paratuberculosis
gccgccauccgcgccg

SEQ ID NO: 827330 - RNA, 17 nt, Mycobacterium avium subsp. paratuberculosis
gccgccauccgcgccga

SEQ ID NO: 827331 - RNA, 20 nt, Mycobacterium avium subsp. paratuberculosis
gccgccauccgcgccgaacg

SEQ ID NO: 827332 - RNA, 16 nt, Mycobacterium avium subsp. paratuberculosis
gccgccaucaccgcgc

SEQ ID NO: 827333 - RNA, 12 nt, Mycobacterium avium subsp. paratuberculosis
gccgccagcgcc

SEQ ID NO: 827334 - RNA, 21 nt, Mycobacterium avium subsp. paratuberculosis
gccgccagcgccaccccccag

SEQ ID NO: 827335 - RNA, 21 nt, Mycobacterium avium subsp. paratuberculosis
gccgccaggaucugcucggcg

SEQ ID NO: 827336 - RNA, 17 nt, Mycobacterium avium subsp. paratuberculosis
gccgccagcgcgggguc

SEQ ID NO: 827337 - RNA, 22 nt, Mycobacterium avium subsp. paratuberculosis
gccgccagcgcggggucggcca

SEQ ID NO: 827338 - RNA, 22 nt, Mycobacterium avium subsp. paratuberculosis
gccgccagcgucccguccuggg

SEQ ID NO: 827339 - RNA, 13 nt, Mycobacterium avium subsp. paratuberculosis
gccgccagcucgu

SEQ ID NO: 827340 - RNA, 14 nt, Mycobacterium avium subsp. paratuberculosis
gccgccagcucguc

SEQ ID NO: 827341 - RNA, 14 nt, Mycobacterium avium subsp. paratuberculosis
gccgcagccgcgcg

SEQ ID NO: 827342 - RNA, 15 nt, Mycobacterium avium subsp. paratuberculosis
gccgcagccgcgcgg

SEQ ID NO: 827343 - RNA, 16 nt, Mycobacterium avium subsp. paratuberculosis
gccgcagccgcgcggc

SEQ ID NO: 827344 - RNA, 19 nt, Mycobacterium avium subsp. paratuberculosis
gccgcagccgcgcggccgg

SEQ ID NO: 827345 - RNA, 14 nt, Mycobacterium avium subsp. paratuberculosis
gccgcagcccaggc

SEQ ID NO: 827346 - RNA, 13 nt, Mycobacterium avium subsp. paratuberculosis
gccgcagccgggu

SEQ ID NO: 827347 - RNA, 15 nt, Mycobacterium avium subsp. paratuberculosis
gccgcagccgggugg

SEQ ID NO: 827348 - RNA, 22 nt, Mycobacterium avium subsp. paratuberculosis
gccgcagccuucuuggcgggcg

SEQ ID NO: 827349 - RNA, 24 nt, Mycobacterium avium subsp. paratuberculosis
gccgcagccuucuuggcgggcgcc

SEQ ID NO: 827350 - RNA, 16 nt, Mycobacterium avium subsp. paratuberculosis
gccgcagcaggugcgc

SEQ ID NO: 827351 - RNA, 18 nt, Mycobacterium avium subsp. paratuberculosis
gccgcagcaggugcgcca

SEQ ID NO: 827352 - RNA, 21 nt, Mycobacterium avium subsp. paratuberculosis
gccgcagcaggugcgccagau

SEQ ID NO: 827353 - RNA, 17 nt, Mycobacterium avium subsp. paratuberculosis
gccgccagcgcggcgau

SEQ ID NO: 827354 - RNA, 19 nt, Mycobacterium avium subsp. paratuberculosis
gccgccagcgcggcgauca

SEQ ID NO: 827355 - RNA, 21 nt, Mycobacterium avium subsp. paratuberculosis
gccgccagcgcggcgaucagc

SEQ ID NO: 827356 - RNA, 15 nt, Mycobacterium avium subsp. paratuberculosis
gccgccagcgcccgc

SEQ ID NO: 827357 - RNA, 18 nt, Mycobacterium avium subsp. paratuberculosis
gccgccagcgcccgcgcg

SEQ ID NO: 827358 - RNA, 22 nt, Mycobacterium avium subsp. paratuberculosis
gccgccagcgcccgcgcguggg

SEQ ID NO: 827359 - RNA, 13 nt, Mycobacterium avium subsp. paratuberculosis
gccgccagcgcca

SEQ ID NO: 827360 - RNA, 14 nt, Mycobacterium avium subsp. paratuberculosis
gccgccagccgguc

SEQ ID NO: 827361 - RNA, 15 nt, Mycobacterium avium subsp. paratuberculosis
gccgccagccgguca

SEQ ID NO: 827362 - RNA, 14 nt, Mycobacterium avium subsp. paratuberculosis
gccgccgggccacg

SEQ ID NO: 827363 - RNA, 15 nt, Mycobacterium avium subsp. paratuberculosis
gccgccgggccacgc

SEQ ID NO: 827364 - RNA, 17 nt, Mycobacterium avium subsp. paratuberculosis
gccgccgggccacgccg

SEQ ID NO: 827365 - RNA, 18 nt, Mycobacterium avium subsp. paratuberculosis
gccgccgggccacgccga

SEQ ID NO: 827366 - RNA, 20 nt, Mycobacterium avium subsp. paratuberculosis
gccgccgggccacgccgacu

SEQ ID NO: 827367 - RNA, 22 nt, Mycobacterium avium subsp. paratuberculosis
gccgccgggccacgccgacuag

SEQ ID NO: 827368 - RNA, 15 nt, Mycobacterium avium subsp. paratuberculosis
gccgccgggccaggu

SEQ ID NO: 827369 - RNA, 13 nt, Mycobacterium avium subsp. paratuberculosis
gccgccgggccgc

SEQ ID NO: 827370 - RNA, 16 nt, Mycobacterium avium subsp. paratuberculosis
gccgccgggccgccga

SEQ ID NO: 827371 - RNA, 13 nt, Mycobacterium avium subsp. paratuberculosis
gccgccgggcacc

SEQ ID NO: 827372 - RNA, 15 nt, Mycobacterium avium subsp. paratuberculosis
gccgccgggcaccuc

SEQ ID NO: 827373 - RNA, 21 nt, Mycobacterium avium subsp. paratuberculosis
gccgccgggcaccucggcguc

SEQ ID NO: 827374 - RNA, 12 nt, Mycobacterium avium subsp. paratuberculosis
gccgccggcgca

SEQ ID NO: 827375 - RNA, 13 nt, Mycobacterium avium subsp. paratuberculosis
gccgccggcgcag

SEQ ID NO: 827376 - RNA, 23 nt, Mycobacterium avium subsp. paratuberculosis
gccgccggcgcaucaucucggcg

SEQ ID NO: 827377 - RNA, 16 nt, Mycobacterium avium subsp. paratuberculosis
gccgccggccgcgcag

SEQ ID NO: 827378 - RNA, 17 nt, Mycobacterium avium subsp. paratuberculosis
gccgccggccucggggu

SEQ ID NO: 827379 - RNA, 12 nt, Mycobacterium avium subsp. paratuberculosis
gccgccggccgc

SEQ ID NO: 827380 - RNA, 13 nt, Mycobacterium avium subsp. paratuberculosis
gccgccggccgcg

SEQ ID NO: 827381 - RNA, 13 nt, Mycobacterium avium subsp. paratuberculosis
gccgccgcuggag

SEQ ID NO: 827382 - RNA, 14 nt, Mycobacterium avium subsp. paratuberculosis
gccgccggccagcu

SEQ ID NO: 827383 - RNA, 15 nt, Mycobacterium avium subsp. paratuberculosis
gccgccggccagcuc

SEQ ID NO: 827384 - RNA, 12 nt, Mycobacterium avium subsp. paratuberculosis
gccgccgcgugg

SEQ ID NO: 827385 - RNA, 14 nt, Mycobacterium avium subsp. paratuberculosis
gccgccgcguggcc

SEQ ID NO: 827386 - RNA, 18 nt, Mycobacterium avium subsp. paratuberculosis
gccgccgcuagucgccca

SEQ ID NO: 827387 - RNA, 21 nt, Mycobacterium avium subsp. paratuberculosis
gccgccgcguaggccaggacc

SEQ ID NO: 827388 - RNA, 16 nt, Mycobacterium avium subsp. paratuberculosis
gccgccgcgucgccgc

SEQ ID NO: 827389 - RNA, 18 nt, Mycobacterium avium subsp. paratuberculosis
gccgccgcgucgccgccg

SEQ ID NO: 827390 - RNA, 13 nt, Mycobacterium avium subsp. paratuberculosis
gccgccgcgucgu

SEQ ID NO: 827391 - RNA, 14 nt, Mycobacterium avium subsp. paratuberculosis
gccgccgcgucguc

SEQ ID NO: 827392 - RNA, 15 nt, Mycobacterium avium subsp. paratuberculosis
gccgccgcggccaca

SEQ ID NO: 827393 - RNA, 18 nt, Mycobacterium avium subsp. paratuberculosis
gccgccgcgucgugccga

SEQ ID NO: 827394 - RNA, 18 nt, Mycobacterium avium subsp. paratuberculosis
gccgccgcgggucggcga

SEQ ID NO: 827395 - RNA, 23 nt, Mycobacterium avium subsp. paratuberculosis
gccgccgcgggucggcgacggcg

SEQ ID NO: 827396 - RNA, 13 nt, Mycobacterium avium subsp. paratuberculosis
gccgccgcgggug

SEQ ID NO: 827397 - RNA, 14 nt, Mycobacterium avium subsp. paratuberculosis
gccgccgcgggugg

SEQ ID NO: 827398 - RNA, 16 nt, Mycobacterium avium subsp. paratuberculosis
gccgccgcggguggcc

SEQ ID NO: 827399 - RNA, 17 nt, Mycobacterium avium subsp. paratuberculosis
gccgccgcggguggcca

SEQ ID NO: 827400 - RNA, 19 nt, Mycobacterium avium subsp. paratuberculosis
gccgccgcggguggccagc

SEQ ID NO: 827401 - RNA, 12 nt, Mycobacterium avium subsp. paratuberculosis
gccgccgcggcg

SEQ ID NO: 827402 - RNA, 13 nt, Mycobacterium avium subsp. paratuberculosis
gccgccgccggga

SEQ ID NO: 827403 - RNA, 14 nt, Mycobacterium avium subsp. paratuberculosis
gccgccgccgggau

SEQ ID NO: 827404 - RNA, 14 nt, Mycobacterium avium subsp. paratuberculosis
gccgccgccggcgg

SEQ ID NO: 827405 - RNA, 16 nt, Mycobacterium avium subsp. paratuberculosis
gccgccgccggcggug

SEQ ID NO: 827406 - RNA, 15 nt, Mycobacterium avium subsp. paratuberculosis
gccgccgccggcguc

SEQ ID NO: 827407 - RNA, 17 nt, Mycobacterium avium subsp. paratuberculosis
gccgccgccggcgucgc

SEQ ID NO: 827408 - RNA, 12 nt, Mycobacterium avium subsp. paratuberculosis
gccgccgccggg

SEQ ID NO: 827409 - RNA, 14 nt, Mycobacterium avium subsp. paratuberculosis
gccgccgccgccca

SEQ ID NO: 827410 - RNA, 21 nt, Mycobacterium avium subsp. paratuberculosis
gccgccgcccgcgcggcggcc

SEQ ID NO: 827411 - RNA, 15 nt, Mycobacterium avium subsp. paratuberculosis
gccgccgccgaccac

SEQ ID NO: 827412 - RNA, 12 nt, Mycobacterium avium subsp. paratuberculosis
gccgccgcccgc

SEQ ID NO: 827413 - RNA, 17 nt, Mycobacterium avium subsp. paratuberculosis
gccgccgccgagcucgg

SEQ ID NO: 827414 - RNA, 17 nt, Mycobacterium avium subsp. paratuberculosis
gccgccgcccacgccgc

SEQ ID NO: 827415 - RNA, 23 nt, Mycobacterium avium subsp. paratuberculosis
gccgccgcccacgccgcccaggc

SEQ ID NO: 827416 - RNA, 13 nt, Mycobacterium avium subsp. paratuberculosis
gccgccgcccacg

SEQ ID NO: 827417 - RNA, 14 nt, Mycobacterium avium subsp. paratuberculosis
gccgccgagccggc

SEQ ID NO: 827418 - RNA, 16 nt, Mycobacterium avium subsp. paratuberculosis
gccgccgagccggcac

SEQ ID NO: 827419 - RNA, 20 nt, Mycobacterium avium subsp. paratuberculosis
gccgccgagggccagcagcc

SEQ ID NO: 827420 - RNA, 15 nt, Mycobacterium avium subsp. paratuberculosis
gccgccgagcagauc

SEQ ID NO: 827421 - RNA, 13 nt, Mycobacterium avium subsp. paratuberculosis
gccgccgaucaac

SEQ ID NO: 827422 - RNA, 19 nt, Mycobacterium avium subsp. paratuberculosis
gccgccgaucaacaggccc

SEQ ID NO: 827423 - RNA, 21 nt, Mycobacterium avium subsp. paratuberculosis
gccgccgaucaacaggcccag

SEQ ID NO: 827424 - RNA, 23 nt, Mycobacterium avium subsp. paratuberculosis
gccgccgaucaacaggcccagca

SEQ ID NO: 827425 - RNA, 22 nt, Mycobacterium avium subsp. paratuberculosis
gccgccgaucuugagccggaug

SEQ ID NO: 827426 - RNA, 15 nt, Mycobacterium avium subsp. paratuberculosis
gccgccgaugacggc

SEQ ID NO: 827427 - RNA, 17 nt, Mycobacterium avium subsp. paratuberculosis
gccgccgaugacggcgc

SEQ ID NO: 827428 - RNA, 16 nt, Mycobacterium avium subsp. paratuberculosis
gccgccgagcaacagc

SEQ ID NO: 827429 - RNA, 15 nt, Mycobacterium avium subsp. paratuberculosis
gccgccgagcgucac

SEQ ID NO: 827430 - RNA, 18 nt, Mycobacterium avium subsp. paratuberculosis
gccgccgagcgucacgcu

SEQ ID NO: 827431 - RNA, 22 nt, Mycobacterium avium subsp. paratuberculosis
gccgccgagcgucacgcuagcg

SEQ ID NO: 827432 - RNA, 15 nt, Mycobacterium avium subsp. paratuberculosis
gccgccgagcucggc

SEQ ID NO: 827433 - RNA, 14 nt, Mycobacterium avium subsp. paratuberculosis
gccgccgacgucgu

SEQ ID NO: 827434 - RNA, 14 nt, Mycobacterium avium subsp. paratuberculosis
gccgccgacggugg

SEQ ID NO: 827435 - RNA, 16 nt, Mycobacterium avium subsp. paratuberculosis
gccgccgacgguggcc

SEQ ID NO: 827436 - RNA, 23 nt, Mycobacterium avium subsp. paratuberculosis
gccgccgacgguggcccccacca

SEQ ID NO: 827437 - RNA, 19 nt, Mycobacterium avium subsp. paratuberculosis
gccgccgacuccccgcccg

SEQ ID NO: 827438 - RNA, 21 nt, Mycobacterium avium subsp. paratuberculosis
gccgccgacuccccgcccggc

SEQ ID NO: 827439 - RNA, 20 nt, Mycobacterium avium subsp. paratuberculosis
gccgccgacgaagaugcgcc

SEQ ID NO: 827440 - RNA, 24 nt, Mycobacterium avium subsp. paratuberculosis
gccgccgacgaagaugcgcccggu

SEQ ID NO: 827441 - RNA, 15 nt, Mycobacterium avium subsp. paratuberculosis
gccgccgacgacggc

SEQ ID NO: 827442 - RNA, 17 nt, Mycobacterium avium subsp. paratuberculosis
gccgccgacgacggcga

SEQ ID NO: 827443 - RNA, 22 nt, Mycobacterium avium subsp. paratuberculosis
gccgccgacgacggcgaacguc

SEQ ID NO: 827444 - RNA, 16 nt, Mycobacterium avium subsp. paratuberculosis
gccgccgaccgcccgc

SEQ ID NO: 827445 - RNA, 17 nt, Mycobacterium avium subsp. paratuberculosis
gccgccgaccgcccgcu

SEQ ID NO: 827446 - RNA, 14 nt, Mycobacterium avium subsp. paratuberculosis
gccgccgaccgccg

SEQ ID NO: 827447 - RNA, 15 nt, Mycobacterium avium subsp. paratuberculosis
gccgccgaccgccga

SEQ ID NO: 827448 - RNA, 20 nt, Mycobacterium avium subsp. paratuberculosis
gccgccgaccgccgagcggg

SEQ ID NO: 827449 - RNA, 16 nt, Mycobacterium avium subsp. paratuberculosis
gccgccgacaccacca

SEQ ID NO: 827450 - RNA, 20 nt, Mycobacterium avium subsp. paratuberculosis
gccgccgacagcaccucgcc

SEQ ID NO: 827451 - RNA, 22 nt, Mycobacterium avium subsp. paratuberculosis
gccgccgaccacaugccguugc

SEQ ID NO: 827452 - RNA, 14 nt, Mycobacterium avium subsp. paratuberculosis
gccgccgaccacgc

SEQ ID NO: 827453 - RNA, 18 nt, Mycobacterium avium subsp. paratuberculosis
gccgccgaccacgccgcg

SEQ ID NO: 827454 - RNA, 16 nt, Mycobacterium avium subsp. paratuberculosis
gccgcgcaucaggggc

SEQ ID NO: 827455 - RNA, 18 nt, Mycobacterium avium subsp. paratuberculosis
gccgcgcaucaucgccca

SEQ ID NO: 827456 - RNA, 20 nt, Mycobacterium avium subsp. paratuberculosis
gccgcgcaucaucgcccagc

SEQ ID NO: 827457 - RNA, 13 nt, Mycobacterium avium subsp. paratuberculosis
gccgcgcauccgc

SEQ ID NO: 827458 - RNA, 17 nt, Mycobacterium avium subsp. paratuberculosis
gccgcgcauucaccagc

SEQ ID NO: 827459 - RNA, 18 nt, Mycobacterium avium subsp. paratuberculosis
gccgcgcauucaccagcu

SEQ ID NO: 827460 - RNA, 14 nt, Mycobacterium avium subsp. paratuberculosis
gccgcgccacagcg

SEQ ID NO: 827461 - RNA, 22 nt, Mycobacterium avium subsp. paratuberculosis
gccgcgccacagcgucucgacc

SEQ ID NO: 827462 - RNA, 23 nt, Mycobacterium avium subsp. paratuberculosis
gccgcgccacagcgucucgaccg

SEQ ID NO: 827463 - RNA, 17 nt, Mycobacterium avium subsp. paratuberculosis
gccgcgccaccgaggcc

SEQ ID NO: 827464 - RNA, 13 nt, Mycobacterium avium subsp. paratuberculosis
gccgcgccaccgc

SEQ ID NO: 827465 - RNA, 15 nt, Mycobacterium avium subsp. paratuberculosis
gccgcgccaccgcgg

SEQ ID NO: 827466 - RNA, 14 nt, Mycobacterium avium subsp. paratuberculosis
gccgcgccacgcgc

SEQ ID NO: 827467 - RNA, 15 nt, Mycobacterium avium subsp. paratuberculosis
gccgcgccacgcgca

SEQ ID NO: 827468 - RNA, 17 nt, Mycobacterium avium subsp. paratuberculosis
gccgcgccacgcgcagg

SEQ ID NO: 827469 - RNA, 13 nt, Mycobacterium avium subsp. paratuberculosis
gccgcgcaggccg

SEQ ID NO: 827470 - RNA, 20 nt, Mycobacterium avium subsp. paratuberculosis
gccgcgcaggccgccgacga

SEQ ID NO: 827471 - RNA, 21 nt, Mycobacterium avium subsp. paratuberculosis
gccgcgcaggccgccgacgac

SEQ ID NO: 827472 - RNA, 16 nt, Mycobacterium avium subsp. paratuberculosis
gccgcgcaggccgucc

SEQ ID NO: 827473 - RNA, 20 nt, Mycobacterium avium subsp. paratuberculosis
gccgcgcaggccguccagca

SEQ ID NO: 827474 - RNA, 20 nt, Mycobacterium avium subsp. paratuberculosis
gccgcgcagcggggcgcgca

SEQ ID NO: 827475 - RNA, 16 nt, Mycobacterium avium subsp. paratuberculosis
gccgcgcagcgugucg

SEQ ID NO: 827476 - RNA, 21 nt, Mycobacterium avium subsp. paratuberculosis
gccgcgcagcgugucgggguc

SEQ ID NO: 827477 - RNA, 14 nt, Mycobacterium avium subsp. paratuberculosis
gccgcgcagcucga

SEQ ID NO: 827478 - RNA, 17 nt, Mycobacterium avium subsp. paratuberculosis
gccgcgcagcucgacga

SEQ ID NO: 827479 - RNA, 22 nt, Mycobacterium avium subsp. paratuberculosis
gccgcgcagcucggggucggcg

SEQ ID NO: 827480 - RNA, 16 nt, Mycobacterium avium subsp. paratuberculosis
gccgcgcacuggagug

SEQ ID NO: 827481 - RNA, 19 nt, Mycobacterium avium subsp. paratuberculosis
gccgcgcagaucgccagca

SEQ ID NO: 827482 - RNA, 21 nt, Mycobacterium avium subsp. paratuberculosis
gccgcgcagaucgccagcacc

SEQ ID NO: 827483 - RNA, 12 nt, Mycobacterium avium subsp. paratuberculosis
gccgcgcagcac

SEQ ID NO: 827484 - RNA, 13 nt, Mycobacterium avium subsp. paratuberculosis
gccgcgcagcacc

SEQ ID NO: 827485 - RNA, 23 nt, Mycobacterium avium subsp. paratuberculosis
gccgcgauguagcggacgggccg

SEQ ID NO: 827486 - RNA, 21 nt, Mycobacterium avium subsp. paratuberculosis
gccgcgcagcaccgcgucggc

SEQ ID NO: 827487 - RNA, 17 nt, Mycobacterium avium subsp. paratuberculosis
gccgcgcccgccggccc

SEQ ID NO: 827488 - RNA, 19 nt, Mycobacterium avium subsp. paratuberculosis
gccgcgcccgccggcccag

SEQ ID NO: 827489 - RNA, 13 nt, Mycobacterium avium subsp. paratuberculosis
gccgcgcccgccg

SEQ ID NO: 827490 - RNA, 17 nt, Mycobacterium avium subsp. paratuberculosis
gccgcgcccaucgcggc

SEQ ID NO: 827491 - RNA, 13 nt, Mycobacterium avium subsp. paratuberculosis
gccgcgccccgag

SEQ ID NO: 827492 - RNA, 17 nt, Mycobacterium avium subsp. paratuberculosis
gccgcgccccgagcagc

SEQ ID NO: 827493 - RNA, 22 nt, Mycobacterium avium subsp. paratuberculosis
gccgcgccccgagcagcggguc

SEQ ID NO: 827494 - RNA, 19 nt, Mycobacterium avium subsp. paratuberculosis
gccgcgccccggcgcgccu

SEQ ID NO: 827495 - RNA, 13 nt, Mycobacterium avium subsp. paratuberculosis
gccgcgcccagca

SEQ ID NO: 827496 - RNA, 15 nt, Mycobacterium avium subsp. paratuberculosis
gccgcgcccagcacg

SEQ ID NO: 827497 - RNA, 14 nt, Mycobacterium avium subsp. paratuberculosis
gccgcgcccacccg

SEQ ID NO: 827498 - RNA, 20 nt, Mycobacterium avium subsp. paratuberculosis
gccgcgcccacccgcgcacg

SEQ ID NO: 827499 - RNA, 12 nt, Mycobacterium avium subsp. paratuberculosis
gccgcgccagca

SEQ ID NO: 827500 - RNA, 12 nt, Mycobacterium avium subsp. paratuberculosis
gccgcgccagcc

SEQ ID NO: 827501 - RNA, 18 nt, Mycobacterium avium subsp. paratuberculosis
gccgcgccagccgccgcc

SEQ ID NO: 827502 - RNA, 21 nt, Mycobacterium avium subsp. paratuberculosis
gccgcgccagccgccgccgac

SEQ ID NO: 827503 - RNA, 22 nt, Mycobacterium avium subsp. paratuberculosis
gccgcgccagccgccgccgacc

SEQ ID NO: 827504 - RNA, 24 nt, Mycobacterium avium subsp. paratuberculosis
gccgcgcccuucuucgcgggugcc

SEQ ID NO: 827505 - RNA, 19 nt, Mycobacterium avium subsp. paratuberculosis
gccgcgccgaacaccacgc

SEQ ID NO: 827506 - RNA, 20 nt, Mycobacterium avium subsp. paratuberculosis
gccgcgccgaacaccacgcc

SEQ ID NO: 827507 - RNA, 12 nt, Mycobacterium avium subsp. paratuberculosis
gccgcgccgaca

SEQ ID NO: 827508 - RNA, 19 nt, Mycobacterium avium subsp. paratuberculosis
gccgcgcccggcuucgccg

SEQ ID NO: 827509 - RNA, 12 nt, Mycobacterium avium subsp. paratuberculosis
gccgcgcccguc

SEQ ID NO: 827510 - RNA, 13 nt, Mycobacterium avium subsp. paratuberculosis
gccgcgcccgucg

SEQ ID NO: 827511 - RNA, 18 nt, Mycobacterium avium subsp. paratuberculosis
gccgcgccgaccucgucg

SEQ ID NO: 827512 - RNA, 20 nt, Mycobacterium avium subsp. paratuberculosis
gccgcgccgaccucgucggc

SEQ ID NO: 827513 - RNA, 21 nt, Mycobacterium avium subsp. paratuberculosis
gccgcgccgaccucgucggcg

SEQ ID NO: 827514 - RNA, 13 nt, Mycobacterium avium subsp. paratuberculosis
gccgcgccgacgc

SEQ ID NO: 827515 - RNA, 16 nt, Mycobacterium avium subsp. paratuberculosis
gccgcgccgacgccca

SEQ ID NO: 827516 - RNA, 10 nt, Mycobacterium avium subsp. paratuberculosis
gccgcgccgc

SEQ ID NO: 827517 - RNA, 13 nt, Mycobacterium avium subsp. paratuberculosis
gccgcgccgauca

SEQ ID NO: 827518 - RNA, 14 nt, Mycobacterium avium subsp. paratuberculosis
gccgcgccgccgcg

SEQ ID NO: 827519 - RNA, 14 nt, Mycobacterium avium subsp. paratuberculosis
gccgcgccgccggu

SEQ ID NO: 827520 - RNA, 11 nt, Mycobacterium avium subsp. paratuberculosis
gccgcgccgcg

SEQ ID NO: 827521 - RNA, 13 nt, Mycobacterium avium subsp. paratuberculosis
gccgcgccgcgcc

SEQ ID NO: 827522 - RNA, 16 nt, Mycobacterium avium subsp. paratuberculosis
gccgcgccgcgccgcc

SEQ ID NO: 827523 - RNA, 13 nt, Mycobacterium avium subsp. paratuberculosis
gccgcgccgccgc

SEQ ID NO: 827524 - RNA, 14 nt, Mycobacterium avium subsp. paratuberculosis
gccgcgccgccgac

SEQ ID NO: 827525 - RNA, 15 nt, Mycobacterium avium subsp. paratuberculosis
gccgcgccgcccggc

SEQ ID NO: 827526 - RNA, 13 nt, Mycobacterium avium subsp. paratuberculosis
gccgcgccgcccg

SEQ ID NO: 827527 - RNA, 15 nt, Mycobacterium avium subsp. paratuberculosis
gccgcgccgccacac

SEQ ID NO: 827528 - RNA, 20 nt, Mycobacterium avium subsp. paratuberculosis
gccgcgccgccacaccucgg

SEQ ID NO: 827529 - RNA, 19 nt, Mycobacterium avium subsp. paratuberculosis
gccgcgccguagcggccca

SEQ ID NO: 827530 - RNA, 13 nt, Mycobacterium avium subsp. paratuberculosis
gccgcgccgugcg

SEQ ID NO: 827531 - RNA, 14 nt, Mycobacterium avium subsp. paratuberculosis
gccgcgccgugcgc

SEQ ID NO: 827532 - RNA, 15 nt, Mycobacterium avium subsp. paratuberculosis
gccgcgccgugcgcc

SEQ ID NO: 827533 - RNA, 19 nt, Mycobacterium avium subsp. paratuberculosis
gccgcgccguugaccgcgg

SEQ ID NO: 827534 - RNA, 20 nt, Mycobacterium avium subsp. paratuberculosis
gccgcgccguugaccgcggc

SEQ ID NO: 827535 - RNA, 13 nt, Mycobacterium avium subsp. paratuberculosis
gccgcgccggggu

SEQ ID NO: 827536 - RNA, 14 nt, Mycobacterium avium subsp. paratuberculosis
gccgcgccggggug

SEQ ID NO: 827537 - RNA, 15 nt, Mycobacterium avium subsp. paratuberculosis
gccgcgccggggugu

SEQ ID NO: 827538 - RNA, 14 nt, Mycobacterium avium subsp. paratuberculosis
gccgcgccgggcgg

SEQ ID NO: 827539 - RNA, 21 nt, Mycobacterium avium subsp. paratuberculosis
gccgcgccgggcggaugucgg

SEQ ID NO: 827540 - RNA, 15 nt, Mycobacterium avium subsp. paratuberculosis
gccgcgccgggcgcc

SEQ ID NO: 827541 - RNA, 17 nt, Mycobacterium avium subsp. paratuberculosis
gccgcgccgggcgcccg

SEQ ID NO: 827542 - RNA, 13 nt, Mycobacterium avium subsp. paratuberculosis
gccgcgccggccu

SEQ ID NO: 827543 - RNA, 18 nt, Mycobacterium avium subsp. paratuberculosis
gccgcgccggaugguccg

SEQ ID NO: 827544 - RNA, 13 nt, Mycobacterium avium subsp. paratuberculosis
gccgcgccgcggu

SEQ ID NO: 827545 - RNA, 18 nt, Mycobacterium avium subsp. paratuberculosis
gccgcgaacgacgaccuc

SEQ ID NO: 827546 - RNA, 17 nt, Mycobacterium avium subsp. paratuberculosis
gccgcgaacgccucggc

SEQ ID NO: 827547 - RNA, 18 nt, Mycobacterium avium subsp. paratuberculosis
gccgcgaacgccucggcg

SEQ ID NO: 827548 - RNA, 19 nt, Mycobacterium avium subsp. paratuberculosis
gccgcgaacgccucggcga

SEQ ID NO: 827549 - RNA, 18 nt, Mycobacterium avium subsp. paratuberculosis
gccgcgaaaauaccgccg

SEQ ID NO: 827550 - RNA, 20 nt, Mycobacterium avium subsp. paratuberculosis
gccgcgaaaauaccgccggc

SEQ ID NO: 827551 - RNA, 15 nt, Mycobacterium avium subsp. paratuberculosis
gccgcgaacggcccg

SEQ ID NO: 827552 - RNA, 17 nt, Mycobacterium avium subsp. paratuberculosis
gccgcgaacucaggcgc

SEQ ID NO: 827553 - RNA, 18 nt, Mycobacterium avium subsp. paratuberculosis
gccgcgaacucaggcgcg

SEQ ID NO: 827554 - RNA, 20 nt, Mycobacterium avium subsp. paratuberculosis
gccgcgaacucaggcgcgca

SEQ ID NO: 827555 - RNA, 16 nt, Mycobacterium avium subsp. paratuberculosis
gccgcgaagaugucgc

SEQ ID NO: 827556 - RNA, 19 nt, Mycobacterium avium subsp. paratuberculosis
gccgcgaagaugucgccgu

SEQ ID NO: 827557 - RNA, 18 nt, Mycobacterium avium subsp. paratuberculosis
gccgcgaaggcggcgucg

SEQ ID NO: 827558 - RNA, 14 nt, Mycobacterium avium subsp. paratuberculosis
gccgcgacacccgc

SEQ ID NO: 827559 - RNA, 18 nt, Mycobacterium avium subsp. paratuberculosis
gccgcgacacccgcgacg

SEQ ID NO: 827560 - RNA, 19 nt, Mycobacterium avium subsp. paratuberculosis
gccgcgacacccgcgacga

SEQ ID NO: 827561 - RNA, 21 nt, Mycobacterium avium subsp. paratuberculosis
gccgcgacacccgcgacgaca

SEQ ID NO: 827562 - RNA, 15 nt, Mycobacterium avium subsp. paratuberculosis
gccgcgacacgugca

SEQ ID NO: 827563 - RNA, 13 nt, Mycobacterium avium subsp. paratuberculosis
gccgcgacagccg

SEQ ID NO: 827564 - RNA, 16 nt, Mycobacterium avium subsp. paratuberculosis
gccgcgacagccgccc

SEQ ID NO: 827565 - RNA, 17 nt, Mycobacterium avium subsp. paratuberculosis
gccgcgacagccgcccg

SEQ ID NO: 827566 - RNA, 19 nt, Mycobacterium avium subsp. paratuberculosis
gccgcgacagccgcccggc

SEQ ID NO: 827567 - RNA, 15 nt, Mycobacterium avium subsp. paratuberculosis
gccgcgacagccggg

SEQ ID NO: 827568 - RNA, 22 nt, Mycobacterium avium subsp. paratuberculosis
gccgcgauccgggcauggucac

SEQ ID NO: 827569 - RNA, 15 nt, Mycobacterium avium subsp. paratuberculosis
gccgcgaucucggcg

SEQ ID NO: 827570 - RNA, 16 nt, Mycobacterium avium subsp. paratuberculosis
gccgcgaucucggcgg

SEQ ID NO: 827571 - RNA, 21 nt, Mycobacterium avium subsp. paratuberculosis
gccgcgaucucggcggacucg

SEQ ID NO: 827572 - RNA, 21 nt, Mycobacterium avium subsp. paratuberculosis
gccgcgaucuugccgccgcgg

SEQ ID NO: 827573 - RNA, 15 nt, Mycobacterium avium subsp. paratuberculosis
gccgcgaucgccaac

SEQ ID NO: 827574 - RNA, 13 nt, Mycobacterium avium subsp. paratuberculosis
gccgcgaucggcg

SEQ ID NO: 827575 - RNA, 14 nt, Mycobacterium avium subsp. paratuberculosis
gccgcgaucggcgu

SEQ ID NO: 827576 - RNA, 15 nt, Mycobacterium avium subsp. paratuberculosis
gccgcgaucggcgug

SEQ ID NO: 827577 - RNA, 14 nt, Mycobacterium avium subsp. paratuberculosis
gccgcgacccgggc

SEQ ID NO: 827578 - RNA, 22 nt, Mycobacterium avium subsp. paratuberculosis
gccgcgaugucggugggccgca

SEQ ID NO: 827579 - RNA, 16 nt, Mycobacterium avium subsp. paratuberculosis
gccgcgaugcccgccg

SEQ ID NO: 827580 - RNA, 18 nt, Mycobacterium avium subsp. paratuberculosis
gccgcgaugcccgccggc

SEQ ID NO: 827581 - RNA, 15 nt, Mycobacterium avium subsp. paratuberculosis
gccgcgaugaggcuc

SEQ ID NO: 827582 - RNA, 21 nt, Mycobacterium avium subsp. paratuberculosis
gccgcgaugaggcucaggccg

SEQ ID NO: 827583 - RNA, 16 nt, Mycobacterium avium subsp. paratuberculosis
gccgcgaugaucacac

SEQ ID NO: 827584 - RNA, 19 nt, Mycobacterium avium subsp. paratuberculosis
gccgcgaugcaacaccgaa

SEQ ID NO: 827585 - RNA, 15 nt, Mycobacterium avium subsp. paratuberculosis
gccgcgcacgacgug

SEQ ID NO: 827586 - RNA, 22 nt, Mycobacterium avium subsp. paratuberculosis
gccgcgcacgacguggagucga

SEQ ID NO: 827587 - RNA, 12 nt, Mycobacterium avium subsp. paratuberculosis
gccgcgcaccgc

SEQ ID NO: 827588 - RNA, 17 nt, Mycobacterium avium subsp. paratuberculosis
gccgcgcaccgccccgc

SEQ ID NO: 827589 - RNA, 15 nt, Mycobacterium avium subsp. paratuberculosis
gccgcgcaccgcgcg

SEQ ID NO: 827590 - RNA, 22 nt, Mycobacterium avium subsp. paratuberculosis
gccgcgcaccccgaaccgcccg

SEQ ID NO: 827591 - RNA, 13 nt, Mycobacterium avium subsp. paratuberculosis
gccgcgcacccgg

SEQ ID NO: 827592 - RNA, 17 nt, Mycobacterium avium subsp. paratuberculosis
gccgcgcacccggccac

SEQ ID NO: 827593 - RNA, 18 nt, Mycobacterium avium subsp. paratuberculosis
gccgcgcacccggccacg

SEQ ID NO: 827594 - RNA, 19 nt, Mycobacterium avium subsp. paratuberculosis
gccgcgcacccggccacgc

SEQ ID NO: 827595 - RNA, 13 nt, Mycobacterium avium subsp. paratuberculosis
gccgcgcaccacc

SEQ ID NO: 827596 - RNA, 14 nt, Mycobacterium avium subsp. paratuberculosis
gccgcgcaccaccu

SEQ ID NO: 827597 - RNA, 18 nt, Mycobacterium avium subsp. paratuberculosis
gccgcgcaccaccucuuc

SEQ ID NO: 827598 - RNA, 20 nt, Mycobacterium avium subsp. paratuberculosis
gccgcgcaccacgguggcgc

SEQ ID NO: 827599 - RNA, 21 nt, Mycobacterium avium subsp. paratuberculosis
gccgcgcaccacgguggcgcc

SEQ ID NO: 827600 - RNA, 22 nt, Mycobacterium avium subsp. paratuberculosis
gccgcgcaccacgguggcgccg

SEQ ID NO: 827601 - RNA, 12 nt, Mycobacterium avium subsp. paratuberculosis
gccgccugcgcg

SEQ ID NO: 827602 - RNA, 16 nt, Mycobacterium avium subsp. paratuberculosis
gccgccugcccgggcg

SEQ ID NO: 827603 - RNA, 18 nt, Mycobacterium avium subsp. paratuberculosis
gccgccugcccgggcgcc

SEQ ID NO: 827604 - RNA, 12 nt, Mycobacterium avium subsp. paratuberculosis
gccgccugagcc

SEQ ID NO: 827605 - RNA, 15 nt, Mycobacterium avium subsp. paratuberculosis
gccgccugcgcgccg

SEQ ID NO: 827606 - RNA, 18 nt, Mycobacterium avium subsp. paratuberculosis
gccgccuggacgacgucg

SEQ ID NO: 827607 - RNA, 14 nt, Mycobacterium avium subsp. paratuberculosis
gccgccugcggguu

SEQ ID NO: 827608 - RNA, 15 nt, Mycobacterium avium subsp. paratuberculosis
gccgccggggugcac

SEQ ID NO: 827609 - RNA, 21 nt, Mycobacterium avium subsp. paratuberculosis
gccgccggggugcaccguggu

SEQ ID NO: 827610 - RNA, 17 nt, Mycobacterium avium subsp. paratuberculosis
gccgccgggccggcggc

SEQ ID NO: 827611 - RNA, 13 nt, Mycobacterium avium subsp. paratuberculosis
gccgccgggccug

SEQ ID NO: 827612 - RNA, 13 nt, Mycobacterium avium subsp. paratuberculosis
gccgccggggcgc

SEQ ID NO: 827613 - RNA, 17 nt, Mycobacterium avium subsp. paratuberculosis
gccgccggggcgccgcc

SEQ ID NO: 827614 - RNA, 18 nt, Mycobacterium avium subsp. paratuberculosis
gccgccggggcgccgccg

SEQ ID NO: 827615 - RNA, 15 nt, Mycobacterium avium subsp. paratuberculosis
gccgccggggcgggc

SEQ ID NO: 827616 - RNA, 16 nt, Mycobacterium avium subsp. paratuberculosis
gccgccggggcgggca

SEQ ID NO: 827617 - RNA, 18 nt, Mycobacterium avium subsp. paratuberculosis
gccgccggggcgggcagc

SEQ ID NO: 827618 - RNA, 21 nt, Mycobacterium avium subsp. paratuberculosis
gccgccggggcgggcagcacc

SEQ ID NO: 827619 - RNA, 20 nt, Mycobacterium avium subsp. paratuberculosis
gccgccggggcgucggacgc

SEQ ID NO: 827620 - RNA, 16 nt, Mycobacterium avium subsp. paratuberculosis
gccgccgggcgccacc

SEQ ID NO: 827621 - RNA, 19 nt, Mycobacterium avium subsp. paratuberculosis
gccgccgggcgccacccgc

SEQ ID NO: 827622 - RNA, 12 nt, Mycobacterium avium subsp. paratuberculosis
gccgccgggcgu

SEQ ID NO: 827623 - RNA, 13 nt, Mycobacterium avium subsp. paratuberculosis
gccgccgggcgua

SEQ ID NO: 827624 - RNA, 22 nt, Mycobacterium avium subsp. paratuberculosis
gccgccgggcguagucgauggc

SEQ ID NO: 827625 - RNA, 15 nt, Mycobacterium avium subsp. paratuberculosis
gccgccggggacccg

SEQ ID NO: 827626 - RNA, 17 nt, Mycobacterium avium subsp. paratuberculosis
gccgccggggacccgca

SEQ ID NO: 827627 - RNA, 18 nt, Mycobacterium avium subsp. paratuberculosis
gccgccggggacccgcac

SEQ ID NO: 827628 - RNA, 22 nt, Mycobacterium avium subsp. paratuberculosis
gccgccggggacccgcaccgga

SEQ ID NO: 827629 - RNA, 23 nt, Mycobacterium avium subsp. paratuberculosis
gccgccggggacccgcaccggaa

SEQ ID NO: 827630 - RNA, 20 nt, Mycobacterium avium subsp. paratuberculosis
gccgccuucacgaccggcag

SEQ ID NO: 827631 - RNA, 14 nt, Mycobacterium avium subsp. paratuberculosis
gccgccuugacgcc

SEQ ID NO: 827632 - RNA, 17 nt, Mycobacterium avium subsp. paratuberculosis
gccgccuugacgccggg

SEQ ID NO: 827633 - RNA, 19 nt, Mycobacterium avium subsp. paratuberculosis
gccgccuugacgccgggca

SEQ ID NO: 827634 - RNA, 14 nt, Mycobacterium avium subsp. paratuberculosis
gccgccuugggccg

SEQ ID NO: 827635 - RNA, 22 nt, Mycobacterium avium subsp. paratuberculosis
gccgccuuggugauccggggca

SEQ ID NO: 827636 - RNA, 16 nt, Mycobacterium avium subsp. paratuberculosis
gcaaugguugcggcgg

SEQ ID NO: 827637 - RNA, 19 nt, Mycobacterium avium subsp. paratuberculosis
gcacaacagccaugccggu

SEQ ID NO: 827638 - RNA, 22 nt, Mycobacterium avium subsp. paratuberculosis
gcacaacagccaugccggugga

SEQ ID NO: 827639 - RNA, 22 nt, Mycobacterium avium subsp. paratuberculosis
gcacaaaagggcccaugccgcc

SEQ ID NO: 827640 - RNA, 16 nt, Mycobacterium avium subsp. paratuberculosis
gcaaucggggccgacc

SEQ ID NO: 827641 - RNA, 17 nt, Mycobacterium avium subsp. paratuberculosis
gcaaugcgucgcggcgg

SEQ ID NO: 827642 - RNA, 20 nt, Mycobacterium avium subsp. paratuberculosis
gcaaugcgucgcggcggcgc

SEQ ID NO: 827643 - RNA, 20 nt, Mycobacterium avium subsp. paratuberculosis
gcaauccuguuccccggcgg

SEQ ID NO: 827644 - RNA, 19 nt, Mycobacterium avium subsp. paratuberculosis
gcaaucgagcgggcgggcu

SEQ ID NO: 827645 - RNA, 15 nt, Mycobacterium avium subsp. paratuberculosis
gcaaucggcgccggc

SEQ ID NO: 827646 - RNA, 16 nt, Mycobacterium avium subsp. paratuberculosis
gcaaucggcgccggcu

SEQ ID NO: 827647 - RNA, 18 nt, Mycobacterium avium subsp. paratuberculosis
gcaaucggacccagcccg

SEQ ID NO: 827648 - RNA, 17 nt, Mycobacterium avium subsp. paratuberculosis
gcaaucgcugcgcccgc

SEQ ID NO: 827649 - RNA, 21 nt, Mycobacterium avium subsp. paratuberculosis
gcaaucgcugcgcccgccgcc

SEQ ID NO: 827650 - RNA, 20 nt, Mycobacterium avium subsp. paratuberculosis
gcaauacccgaccagcaccg

SEQ ID NO: 827651 - RNA, 23 nt, Mycobacterium avium subsp. paratuberculosis
gcaaacgaaucgagccgccugcg

SEQ ID NO: 827652 - RNA, 19 nt, Mycobacterium avium subsp. paratuberculosis
gcaauaccggcagcaggug

SEQ ID NO: 827653 - RNA, 22 nt, Mycobacterium avium subsp. paratuberculosis
gcaauacggugcccgccgcgac

SEQ ID NO: 827654 - RNA, 23 nt, Mycobacterium avium subsp. paratuberculosis
gcaauacggugcccgccgcgacc

SEQ ID NO: 827655 - RNA, 19 nt, Mycobacterium avium subsp. paratuberculosis
gcacacggccucgcccagc

SEQ ID NO: 827656 - RNA, 22 nt, Mycobacterium avium subsp. paratuberculosis
gcacacggccucgcccagcgcc

SEQ ID NO: 827657 - RNA, 23 nt, Mycobacterium avium subsp. paratuberculosis
gcacacggccucgcccagcgccg

SEQ ID NO: 827658 - RNA, 22 nt, Mycobacterium avium subsp. paratuberculosis
gcacacggccuugccgaucagc

SEQ ID NO: 827659 - RNA, 17 nt, Mycobacterium avium subsp. paratuberculosis
gcacacgaucucguagg

SEQ ID NO: 827660 - RNA, 20 nt, Mycobacterium avium subsp. paratuberculosis
gcacacgaucucguaggugg

SEQ ID NO: 827661 - RNA, 19 nt, Mycobacterium avium subsp. paratuberculosis
gcacaacccggacagcgcg

SEQ ID NO: 827662 - RNA, 18 nt, Mycobacterium avium subsp. paratuberculosis
gcacaaccgggccaacgg

SEQ ID NO: 827663 - RNA, 15 nt, Mycobacterium avium subsp. paratuberculosis
gcacaccgucgucca

SEQ ID NO: 827664 - RNA, 17 nt, Mycobacterium avium subsp. paratuberculosis
gcacaccgucucccacg

SEQ ID NO: 827665 - RNA, 23 nt, Mycobacterium avium subsp. paratuberculosis
gcacaccuuccaccaccgcggcg

SEQ ID NO: 827666 - RNA, 16 nt, Mycobacterium avium subsp. paratuberculosis
gcacacgaacaccggc

SEQ ID NO: 827667 - RNA, 19 nt, Mycobacterium avium subsp. paratuberculosis
gcacacgaacaccggcgga

SEQ ID NO: 827668 - RNA, 16 nt, Mycobacterium avium subsp. paratuberculosis
gcacaacgccuccgaa

SEQ ID NO: 827669 - RNA, 22 nt, Mycobacterium avium subsp. paratuberculosis
gcacagcauguccucggggugg

SEQ ID NO: 827670 - RNA, 18 nt, Mycobacterium avium subsp. paratuberculosis
gcacagcagggcaccgac

SEQ ID NO: 827671 - RNA, 21 nt, Mycobacterium avium subsp. paratuberculosis
gcacagcagggcaccgacggc

SEQ ID NO: 827672 - RNA, 15 nt, Mycobacterium avium subsp. paratuberculosis
gcacagccagcgccc

SEQ ID NO: 827673 - RNA, 19 nt, Mycobacterium avium subsp. paratuberculosis
gcacagccagcgcccggcg

SEQ ID NO: 827674 - RNA, 16 nt, Mycobacterium avium subsp. paratuberculosis
gcacagauacgcgacg

SEQ ID NO: 827675 - RNA, 22 nt, Mycobacterium avium subsp. paratuberculosis
gcacagaucgucucggccagcc

SEQ ID NO: 827676 - RNA, 22 nt, Mycobacterium avium subsp. paratuberculosis
gcacagcaccaguugcaccggc

SEQ ID NO: 827677 - RNA, 16 nt, Mycobacterium avium subsp. paratuberculosis
gcacagcacggcaucg

SEQ ID NO: 827678 - RNA, 15 nt, Mycobacterium avium subsp. paratuberculosis
gcacacuuccgggaa

SEQ ID NO: 827679 - RNA, 23 nt, Mycobacterium avium subsp. paratuberculosis
gcacacuuccgggaagucgucgu

SEQ ID NO: 827680 - RNA, 22 nt, Mycobacterium avium subsp. paratuberculosis
gcacauagcucaggugcgacgc

SEQ ID NO: 827681 - RNA, 14 nt, Mycobacterium avium subsp. paratuberculosis
gcacagccggcggc

SEQ ID NO: 827682 - RNA, 16 nt, Mycobacterium avium subsp. paratuberculosis
gcacagccgcagcagc

SEQ ID NO: 827683 - RNA, 18 nt, Mycobacterium avium subsp. paratuberculosis
gcacagccgcagcagccg

SEQ ID NO: 827684 - RNA, 11 nt, Mycobacterium avium subsp. paratuberculosis
gcacagccguc

SEQ ID NO: 827685 - RNA, 19 nt, Mycobacterium avium subsp. paratuberculosis
gcacagcgaaagcgcuugg

SEQ ID NO: 827686 - RNA, 21 nt, Mycobacterium avium subsp. paratuberculosis
gcacagcgaaagcgcuuggcg

SEQ ID NO: 827687 - RNA, 19 nt, Mycobacterium avium subsp. paratuberculosis
gcacagcuaggucguggcg

SEQ ID NO: 827688 - RNA, 20 nt, Mycobacterium avium subsp. paratuberculosis
gcacagcuaggucguggcgc

SEQ ID NO: 827689 - RNA, 20 nt, Mycobacterium avium subsp. paratuberculosis
gcacagcgaggcgacgucga

SEQ ID NO: 827690 - RNA, 13 nt, Mycobacterium avium subsp. paratuberculosis
gcacagcgccaca

SEQ ID NO: 827691 - RNA, 23 nt, Mycobacterium avium subsp. paratuberculosis
gcacagcgccgcguugucggcgu

SEQ ID NO: 827692 - RNA, 15 nt, Mycobacterium avium subsp. paratuberculosis
gcacagcggcggaug

SEQ ID NO: 827693 - RNA, 18 nt, Mycobacterium avium subsp. paratuberculosis
gcacagcuuucgggcggc

SEQ ID NO: 827694 - RNA, 20 nt, Mycobacterium avium subsp. paratuberculosis
gcacagcuuucgggcggccu

SEQ ID NO: 827695 - RNA, 21 nt, Mycobacterium avium subsp. paratuberculosis
gcacagcuuucgggcggccug

SEQ ID NO: 827696 - RNA, 22 nt, Mycobacterium avium subsp. paratuberculosis
gcacagcuuucgggcggccugc

SEQ ID NO: 827697 - RNA, 16 nt, Mycobacterium avium subsp. paratuberculosis
gcacaggaacgcgacg

SEQ ID NO: 827698 - RNA, 18 nt, Mycobacterium avium subsp. paratuberculosis
gcacaggaacgcgacggu

SEQ ID NO: 827699 - RNA, 17 nt, Mycobacterium avium subsp. paratuberculosis
gcacaggaacgcgucga

SEQ ID NO: 827700 - RNA, 12 nt, Mycobacterium avium subsp. paratuberculosis
gcacaggccgcc

SEQ ID NO: 827701 - RNA, 14 nt, Mycobacterium avium subsp. paratuberculosis
gcacaggccgccgc

SEQ ID NO: 827702 - RNA, 14 nt, Mycobacterium avium subsp. paratuberculosis
gcaccacuuccagc

SEQ ID NO: 827703 - RNA, 16 nt, Mycobacterium avium subsp. paratuberculosis
gcaccacuuccagcac

SEQ ID NO: 827704 - RNA, 18 nt, Mycobacterium avium subsp. paratuberculosis
gcaccacuuccagcaccg

SEQ ID NO: 827705 - RNA, 20 nt, Mycobacterium avium subsp. paratuberculosis
gcaccacuuccagcaccggc

SEQ ID NO: 827706 - RNA, 14 nt, Mycobacterium avium subsp. paratuberculosis
gcaccagagcgccg

SEQ ID NO: 827707 - RNA, 16 nt, Mycobacterium avium subsp. paratuberculosis
gcaccagagcgccgga

SEQ ID NO: 827708 - RNA, 17 nt, Mycobacterium avium subsp. paratuberculosis
gcaccagagcgccggac

SEQ ID NO: 827709 - RNA, 13 nt, Mycobacterium avium subsp. paratuberculosis
gcaccagcaccac

SEQ ID NO: 827710 - RNA, 14 nt, Mycobacterium avium subsp. paratuberculosis
gcaccagcaccacc

SEQ ID NO: 827711 - RNA, 16 nt, Mycobacterium avium subsp. paratuberculosis
gcaccagcaccaccgu

SEQ ID NO: 827712 - RNA, 22 nt, Mycobacterium avium subsp. paratuberculosis
gcaccagcaccccgccgcagcc

SEQ ID NO: 827713 - RNA, 12 nt, Mycobacterium avium subsp. paratuberculosis
gcaccagcaccg

SEQ ID NO: 827714 - RNA, 15 nt, Mycobacterium avium subsp. paratuberculosis
gcaccagcaccgaga

SEQ ID NO: 827715 - RNA, 19 nt, Mycobacterium avium subsp. paratuberculosis
gcaccagaugcaccucgcc

SEQ ID NO: 827716 - RNA, 17 nt, Mycobacterium avium subsp. paratuberculosis
gcaccagauucaccagc

SEQ ID NO: 827717 - RNA, 15 nt, Mycobacterium avium subsp. paratuberculosis
gcaccagcacgacac

SEQ ID NO: 827718 - RNA, 20 nt, Mycobacterium avium subsp. paratuberculosis
gcaccagcacgacaccgacg

SEQ ID NO: 827719 - RNA, 16 nt, Mycobacterium avium subsp. paratuberculosis
gcaccacggcggcaug

SEQ ID NO: 827720 - RNA, 20 nt, Mycobacterium avium subsp. paratuberculosis
gcaccacggcggcauguucg

SEQ ID NO: 827721 - RNA, 21 nt, Mycobacterium avium subsp. paratuberculosis
gcaccacggcggcauguucga

SEQ ID NO: 827722 - RNA, 21 nt, Mycobacterium avium subsp. paratuberculosis
gcaccacguccgcggugagca

SEQ ID NO: 827723 - RNA, 22 nt, Mycobacterium avium subsp. paratuberculosis
gcaccacguccgcggugagcac

SEQ ID NO: 827724 - RNA, 12 nt, Mycobacterium avium subsp. paratuberculosis
gcaccacgucgg

SEQ ID NO: 827725 - RNA, 20 nt, Mycobacterium avium subsp. paratuberculosis
gcaccacguugcgcccggcc

SEQ ID NO: 827726 - RNA, 21 nt, Mycobacterium avium subsp. paratuberculosis
gcaccacggugaucucgccga

SEQ ID NO: 827727 - RNA, 14 nt, Mycobacterium avium subsp. paratuberculosis
gcaccacgguggcg

SEQ ID NO: 827728 - RNA, 17 nt, Mycobacterium avium subsp. paratuberculosis
gcaccacgguggcgccg

SEQ ID NO: 827729 - RNA, 23 nt, Mycobacterium avium subsp. paratuberculosis
gcaccacgguggcgccgcgcagc

SEQ ID NO: 827730 - RNA, 24 nt, Mycobacterium avium subsp. paratuberculosis
gcaccacgguggcgccgcgcagcc

SEQ ID NO: 827731 - RNA, 13 nt, Mycobacterium avium subsp. paratuberculosis
gcaccacggcccg

SEQ ID NO: 827732 - RNA, 14 nt, Mycobacterium avium subsp. paratuberculosis
gcaccacggcccgc

SEQ ID NO: 827733 - RNA, 22 nt, Mycobacterium avium subsp. paratuberculosis
gcaccacggcccgcgccccggc

SEQ ID NO: 827734 - RNA, 22 nt, Mycobacterium avium subsp. paratuberculosis
gcaccacgcugugcucgacgaa

SEQ ID NO: 827735 - RNA, 14 nt, Mycobacterium avium subsp. paratuberculosis
gcaccaccgugccg

SEQ ID NO: 827736 - RNA, 17 nt, Mycobacterium avium subsp. paratuberculosis
gcaccacgaucaccaga

SEQ ID NO: 827737 - RNA, 23 nt, Mycobacterium avium subsp. paratuberculosis
gcaccacgaugaagccgugcccg

SEQ ID NO: 827738 - RNA, 14 nt, Mycobacterium avium subsp. paratuberculosis
gcaccaccgcguug

SEQ ID NO: 827739 - RNA, 18 nt, Mycobacterium avium subsp. paratuberculosis
gcaccaccgucaccgccg

SEQ ID NO: 827740 - RNA, 20 nt, Mycobacterium avium subsp. paratuberculosis
gcaccaccgucaccgccgca

SEQ ID NO: 827741 - RNA, 14 nt, Mycobacterium avium subsp. paratuberculosis
gcaccaccucgcgc

SEQ ID NO: 827742 - RNA, 15 nt, Mycobacterium avium subsp. paratuberculosis
gcaccaccucgcgcg

SEQ ID NO: 827743 - RNA, 17 nt, Mycobacterium avium subsp. paratuberculosis
gcaccaccucgcgcggg

SEQ ID NO: 827744 - RNA, 21 nt, Mycobacterium avium subsp. paratuberculosis
gcaccaccucgugcacaugcc

SEQ ID NO: 827745 - RNA, 18 nt, Mycobacterium avium subsp. paratuberculosis
gcaccaccuugucaccga

SEQ ID NO: 827746 - RNA, 18 nt, Mycobacterium avium subsp. paratuberculosis
gcaccacgaagcgggcgg

SEQ ID NO: 827747 - RNA, 14 nt, Mycobacterium avium subsp. paratuberculosis
gcaccacgacgucg

SEQ ID NO: 827748 - RNA, 19 nt, Mycobacterium avium subsp. paratuberculosis
gcaccacgacgucgagcca

SEQ ID NO: 827749 - RNA, 15 nt, Mycobacterium avium subsp. paratuberculosis
gcaccacgagcagcc

SEQ ID NO: 827750 - RNA, 18 nt, Mycobacterium avium subsp. paratuberculosis
gcaccacccgcaccucgc

SEQ ID NO: 827751 - RNA, 15 nt, Mycobacterium avium subsp. paratuberculosis
gcaccacccgcggcc

SEQ ID NO: 827752 - RNA, 19 nt, Mycobacterium avium subsp. paratuberculosis
gcaccacccgcggccggcc

SEQ ID NO: 827753 - RNA, 15 nt, Mycobacterium avium subsp. paratuberculosis
gcaccaccgcccgga

SEQ ID NO: 827754 - RNA, 18 nt, Mycobacterium avium subsp. paratuberculosis
gcaccaccgcccggaccg

SEQ ID NO: 827755 - RNA, 19 nt, Mycobacterium avium subsp. paratuberculosis
gcaccaccgcccggaccgg

SEQ ID NO: 827756 - RNA, 20 nt, Mycobacterium avium subsp. paratuberculosis
gcaccaccaccgacaccccg

SEQ ID NO: 827757 - RNA, 14 nt, Mycobacterium avium subsp. paratuberculosis
gcaccaccgcgagc

SEQ ID NO: 827758 - RNA, 16 nt, Mycobacterium avium subsp. paratuberculosis
gcaccaccgcgagcgg

SEQ ID NO: 827759 - RNA, 15 nt, Mycobacterium avium subsp. paratuberculosis
gcaccaccgcgguga

SEQ ID NO: 827760 - RNA, 22 nt, Mycobacterium avium subsp. paratuberculosis
gcaccaccgcggugagcggccg

SEQ ID NO: 827761 - RNA, 16 nt, Mycobacterium avium subsp. paratuberculosis
gcaccaacccgaucgg

SEQ ID NO: 827762 - RNA, 17 nt, Mycobacterium avium subsp. paratuberculosis
gcaccaacccgaucggc

SEQ ID NO: 827763 - RNA, 16 nt, Mycobacterium avium subsp. paratuberculosis
gcaccaaccggccccg

SEQ ID NO: 827764 - RNA, 22 nt, Mycobacterium avium subsp. paratuberculosis
gcaccaccacgguggcgccggc

SEQ ID NO: 827765 - RNA, 21 nt, Mycobacterium avium subsp. paratuberculosis
gcaccaccacguugcgcggcc

SEQ ID NO: 827766 - RNA, 16 nt, Mycobacterium avium subsp. paratuberculosis
gcaccaccacacccag

SEQ ID NO: 827767 - RNA, 17 nt, Mycobacterium avium subsp. paratuberculosis
gcaccaccacacccagc

SEQ ID NO: 827768 - RNA, 21 nt, Mycobacterium avium subsp. paratuberculosis
gcaccaccacacccagcgcca

SEQ ID NO: 827769 - RNA, 22 nt, Mycobacterium avium subsp. paratuberculosis
gcaccaccagcucgucgccgac

SEQ ID NO: 827770 - RNA, 22 nt, Mycobacterium avium subsp. paratuberculosis
gcaccaccaggucuccgucggc

SEQ ID NO: 827771 - RNA, 16 nt, Mycobacterium avium subsp. paratuberculosis
gcaccacccaggccac

SEQ ID NO: 827772 - RNA, 21 nt, Mycobacterium avium subsp. paratuberculosis
gcaccacccaggccacccggg

SEQ ID NO: 827773 - RNA, 12 nt, Mycobacterium avium subsp. paratuberculosis
gcaccacaucgg

SEQ ID NO: 827774 - RNA, 22 nt, Mycobacterium avium subsp. paratuberculosis
gcaccacaucggauucgucggu

SEQ ID NO: 827775 - RNA, 18 nt, Mycobacterium avium subsp. paratuberculosis
gcaccaccaacagcagcg

SEQ ID NO: 827776 - RNA, 14 nt, Mycobacterium avium subsp. paratuberculosis
gcaccaccaacggc

SEQ ID NO: 827777 - RNA, 17 nt, Mycobacterium avium subsp. paratuberculosis
gcacaucguggcgacga

SEQ ID NO: 827778 - RNA, 21 nt, Mycobacterium avium subsp. paratuberculosis
gcacaucguggcgacgacgcc

SEQ ID NO: 827779 - RNA, 17 nt, Mycobacterium avium subsp. paratuberculosis
gcacaugcccgucgggc

SEQ ID NO: 827780 - RNA, 16 nt, Mycobacterium avium subsp. paratuberculosis
gcaccaacacgucgag

SEQ ID NO: 827781 - RNA, 18 nt, Mycobacterium avium subsp. paratuberculosis
gcaccaacacgucgaguu

SEQ ID NO: 827782 - RNA, 19 nt, Mycobacterium avium subsp. paratuberculosis
gcaccaacagcggcccgau

SEQ ID NO: 827783 - RNA, 15 nt, Mycobacterium avium subsp. paratuberculosis
gcaccagcccgaugc

SEQ ID NO: 827784 - RNA, 21 nt, Mycobacterium avium subsp. paratuberculosis
gcaccagcccgaugccgccga

SEQ ID NO: 827785 - RNA, 16 nt, Mycobacterium avium subsp. paratuberculosis
gcaccagcccgccguc

SEQ ID NO: 827786 - RNA, 17 nt, Mycobacterium avium subsp. paratuberculosis
gcaccagcccgccgucg

SEQ ID NO: 827787 - RNA, 19 nt, Mycobacterium avium subsp. paratuberculosis
gcaccagcccgccgucggc

SEQ ID NO: 827788 - RNA, 13 nt, Mycobacterium avium subsp. paratuberculosis
gcaccagcccggc

SEQ ID NO: 827789 - RNA, 16 nt, Mycobacterium avium subsp. paratuberculosis
gcaccagcccggccag

SEQ ID NO: 827790 - RNA, 19 nt, Mycobacterium avium subsp. paratuberculosis
gcaccagcccggccagcgg

SEQ ID NO: 827791 - RNA, 18 nt, Mycobacterium avium subsp. paratuberculosis
gcaccagcccgucggccu

SEQ ID NO: 827792 - RNA, 14 nt, Mycobacterium avium subsp. paratuberculosis
gcaccagcgacagc

SEQ ID NO: 827793 - RNA, 17 nt, Mycobacterium avium subsp. paratuberculosis
gcaccagcgacagcacc

SEQ ID NO: 827794 - RNA, 20 nt, Mycobacterium avium subsp. paratuberculosis
gcaccagcgacagcacccgc

SEQ ID NO: 827795 - RNA, 21 nt, Mycobacterium avium subsp. paratuberculosis
gcaccagcgacagcacccgcu

SEQ ID NO: 827796 - RNA, 16 nt, Mycobacterium avium subsp. paratuberculosis
gcaccagcgccgcgau

SEQ ID NO: 827797 - RNA, 17 nt, Mycobacterium avium subsp. paratuberculosis
gcaccagcgccgcgaug

SEQ ID NO: 827798 - RNA, 19 nt, Mycobacterium avium subsp. paratuberculosis
gcaccagcgccgcgaugau

SEQ ID NO: 827799 - RNA, 12 nt, Mycobacterium avium subsp. paratuberculosis
gcaccagcgcga

SEQ ID NO: 827800 - RNA, 15 nt, Mycobacterium avium subsp. paratuberculosis
gcaccagcgcgacgg

SEQ ID NO: 827801 - RNA, 17 nt, Mycobacterium avium subsp. paratuberculosis
gcaccagcgcgacggug

SEQ ID NO: 827802 - RNA, 18 nt, Mycobacterium avium subsp. paratuberculosis
gcaccagcgauccggcgc

SEQ ID NO: 827803 - RNA, 13 nt, Mycobacterium avium subsp. paratuberculosis
gcaccagcagguc

SEQ ID NO: 827804 - RNA, 15 nt, Mycobacterium avium subsp. paratuberculosis
gcaccagcagccgca

SEQ ID NO: 827805 - RNA, 17 nt, Mycobacterium avium subsp. paratuberculosis
gcaccagcagccgcagc

SEQ ID NO: 827806 - RNA, 22 nt, Mycobacterium avium subsp. paratuberculosis
gcaccagcagccggucgagguc

SEQ ID NO: 827807 - RNA, 14 nt, Mycobacterium avium subsp. paratuberculosis
gcaccagcagcgcg

SEQ ID NO: 827808 - RNA, 16 nt, Mycobacterium avium subsp. paratuberculosis
gcaccagcagcgcgac

SEQ ID NO: 827809 - RNA, 20 nt, Mycobacterium avium subsp. paratuberculosis
gcaccagcagcgcgacgccg

SEQ ID NO: 827810 - RNA, 17 nt, Mycobacterium avium subsp. paratuberculosis
gcaccagcacggcgacc

SEQ ID NO: 827811 - RNA, 21 nt, Mycobacterium avium subsp. paratuberculosis
gcaccagcacggcgaccagcg

SEQ ID NO: 827812 - RNA, 12 nt, Mycobacterium avium subsp. paratuberculosis
gcaccagcagcc

SEQ ID NO: 827813 - RNA, 13 nt, Mycobacterium avium subsp. paratuberculosis
gcaccagcagcca

SEQ ID NO: 827814 - RNA, 16 nt, Mycobacterium avium subsp. paratuberculosis
gcaccagcagccagcc

SEQ ID NO: 827815 - RNA, 21 nt, Mycobacterium avium subsp. paratuberculosis
gcaccagcaggccccguucgg

SEQ ID NO: 827816 - RNA, 15 nt, Mycobacterium avium subsp. paratuberculosis
gcaccaggccgacgc

SEQ ID NO: 827817 - RNA, 16 nt, Mycobacterium avium subsp. paratuberculosis
gcaccaggccgacgcu

SEQ ID NO: 827818 - RNA, 19 nt, Mycobacterium avium subsp. paratuberculosis
gcaccaggccgacgcuggc

SEQ ID NO: 827819 - RNA, 16 nt, Mycobacterium avium subsp. paratuberculosis
gcaccaggacgcgacc

SEQ ID NO: 827820 - RNA, 19 nt, Mycobacterium avium subsp. paratuberculosis
gcaccaggacgcgaccggc

SEQ ID NO: 827821 - RNA, 20 nt, Mycobacterium avium subsp. paratuberculosis
gcaccaggacgcgaccggcc

SEQ ID NO: 827822 - RNA, 13 nt, Mycobacterium avium subsp. paratuberculosis
gcaccagcguggu

SEQ ID NO: 827823 - RNA, 22 nt, Mycobacterium avium subsp. paratuberculosis
gcaccagcucgaggccgcgggc

SEQ ID NO: 827824 - RNA, 14 nt, Mycobacterium avium subsp. paratuberculosis
gcaccagcucggcg

SEQ ID NO: 827825 - RNA, 15 nt, Mycobacterium avium subsp. paratuberculosis
gcaccagcggcaucg

SEQ ID NO: 827826 - RNA, 21 nt, Mycobacterium avium subsp. paratuberculosis
gcaccagcggcaucgccgcca

SEQ ID NO: 827827 - RNA, 16 nt, Mycobacterium avium subsp. paratuberculosis
gcaccagcggcgccca

SEQ ID NO: 827828 - RNA, 17 nt, Mycobacterium avium subsp. paratuberculosis
gcaccagcggcgcccac

SEQ ID NO: 827829 - RNA, 15 nt, Mycobacterium avium subsp. paratuberculosis
gcaccagcggaucgg

SEQ ID NO: 827830 - RNA, 20 nt, Mycobacterium avium subsp. paratuberculosis
gcaccagcggaucggcgguc

SEQ ID NO: 827831 - RNA, 13 nt, Mycobacterium avium subsp. paratuberculosis
gcaccagcggcac

SEQ ID NO: 827832 - RNA, 15 nt, Mycobacterium avium subsp. paratuberculosis
gcaccagcggacccu

SEQ ID NO: 827833 - RNA, 20 nt, Mycobacterium avium subsp. paratuberculosis
gcaccagcgucgacgcggug

SEQ ID NO: 827834 - RNA, 14 nt, Mycobacterium avium subsp. paratuberculosis
gcaccagcgcgcgg

SEQ ID NO: 827835 - RNA, 12 nt, Mycobacterium avium subsp. paratuberculosis
gcaccagcgcgg

SEQ ID NO: 827836 - RNA, 20 nt, Mycobacterium avium subsp. paratuberculosis
gcaccagcgcuuucgcgcac

SEQ ID NO: 827837 - RNA, 24 nt, Mycobacterium avium subsp. paratuberculosis
gcaccagcgcuuucgcgcacgcca

SEQ ID NO: 827838 - RNA, 18 nt, Mycobacterium avium subsp. paratuberculosis
gcacccaaaacaucggcg

SEQ ID NO: 827839 - RNA, 12 nt, Mycobacterium avium subsp. paratuberculosis
gcacccaccggc

SEQ ID NO: 827840 - RNA, 13 nt, Mycobacterium avium subsp. paratuberculosis
gcacccaccggcc

SEQ ID NO: 827841 - RNA, 14 nt, Mycobacterium avium subsp. paratuberculosis
gcacccaccggcgc

SEQ ID NO: 827842 - RNA, 15 nt, Mycobacterium avium subsp. paratuberculosis
gcacccaccggcgca

SEQ ID NO: 827843 - RNA, 16 nt, Mycobacterium avium subsp. paratuberculosis
gcacccaccggcgcag

SEQ ID NO: 827844 - RNA, 17 nt, Mycobacterium avium subsp. paratuberculosis
gcacccaccggcgcagc

SEQ ID NO: 827845 - RNA, 18 nt, Mycobacterium avium subsp. paratuberculosis
gcacccaccggcgcagcg

SEQ ID NO: 827846 - RNA, 21 nt, Mycobacterium avium subsp. paratuberculosis
gcacccaccggcgcagcgcgu

SEQ ID NO: 827847 - RNA, 17 nt, Mycobacterium avium subsp. paratuberculosis
gcacccacgccagccgg

SEQ ID NO: 827848 - RNA, 18 nt, Mycobacterium avium subsp. paratuberculosis
gcacccacgccagccggg

SEQ ID NO: 827849 - RNA, 18 nt, Mycobacterium avium subsp. paratuberculosis
gcaccaugaucaggcccc

SEQ ID NO: 827850 - RNA, 23 nt, Mycobacterium avium subsp. paratuberculosis
gcaccaugaucaggccccacccg

SEQ ID NO: 827851 - RNA, 18 nt, Mycobacterium avium subsp. paratuberculosis
gcaccauccgcgacgcca

SEQ ID NO: 827852 - RNA, 23 nt, Mycobacterium avium subsp. paratuberculosis
gcaccauccgcgcgagcgcgcug

SEQ ID NO: 827853 - RNA, 23 nt, Mycobacterium avium subsp. paratuberculosis
gcaccaguuccugcaugccgggc

SEQ ID NO: 827854 - RNA, 22 nt, Mycobacterium avium subsp. paratuberculosis
gcaccaguucgcguacccgcgc

SEQ ID NO: 827855 - RNA, 17 nt, Mycobacterium avium subsp. paratuberculosis
gcaccaguugcaccggc

SEQ ID NO: 827856 - RNA, 15 nt, Mycobacterium avium subsp. paratuberculosis
gcaccagucgcgcag

SEQ ID NO: 827857 - RNA, 16 nt, Mycobacterium avium subsp. paratuberculosis
gcaccagucgcgcagc

SEQ ID NO: 827858 - RNA, 22 nt, Mycobacterium avium subsp. paratuberculosis
gcaccagucggccaucagcacc

SEQ ID NO: 827859 - RNA, 23 nt, Mycobacterium avium subsp. paratuberculosis
gcaccagucggccaucagcaccg

SEQ ID NO: 827860 - RNA, 19 nt, Mycobacterium avium subsp. paratuberculosis
gcaccagguugucgccgcg

SEQ ID NO: 827861 - RNA, 21 nt, Mycobacterium avium subsp. paratuberculosis
gcaccagguugucgccgcgcc

SEQ ID NO: 827862 - RNA, 22 nt, Mycobacterium avium subsp. paratuberculosis
gcaccagguugucgccgcgcca

SEQ ID NO: 827863 - RNA, 19 nt, Mycobacterium avium subsp. paratuberculosis
gcaccaggucguugccggu

SEQ ID NO: 827864 - RNA, 20 nt, Mycobacterium avium subsp. paratuberculosis
gcaccagguggcccgacccg

SEQ ID NO: 827865 - RNA, 14 nt, Mycobacterium avium subsp. paratuberculosis
gcaccagggcgucg

SEQ ID NO: 827866 - RNA, 16 nt, Mycobacterium avium subsp. paratuberculosis
gcaccagggcgucgag

SEQ ID NO: 827867 - RNA, 13 nt, Mycobacterium avium subsp. paratuberculosis
gcaccagggcgug

SEQ ID NO: 827868 - RNA, 18 nt, Mycobacterium avium subsp. paratuberculosis
gcaccaggcgccacagca

SEQ ID NO: 827869 - RNA, 16 nt, Mycobacterium avium subsp. paratuberculosis
gcaccagggccgcgag

SEQ ID NO: 827870 - RNA, 17 nt, Mycobacterium avium subsp. paratuberculosis
gcaccagggccgcgagc

SEQ ID NO: 827871 - RNA, 18 nt, Mycobacterium avium subsp. paratuberculosis
gcaccagguaccggcggg

SEQ ID NO: 827872 - RNA, 21 nt, Mycobacterium avium subsp. paratuberculosis
gcaccagguaccggcgggcga

SEQ ID NO: 827873 - RNA, 22 nt, Mycobacterium avium subsp. paratuberculosis
gcaccagguagauggugaucga

SEQ ID NO: 827874 - RNA, 20 nt, Mycobacterium avium subsp. paratuberculosis
gcaccagguagguggccguc

SEQ ID NO: 827875 - RNA, 21 nt, Mycobacterium avium subsp. paratuberculosis
gcaccaggcccucgccgcggu

SEQ ID NO: 827876 - RNA, 16 nt, Mycobacterium avium subsp. paratuberculosis
gcaccaggcgcaccag

SEQ ID NO: 827877 - RNA, 17 nt, Mycobacterium avium subsp. paratuberculosis
gcaccaggcgcaccagc

SEQ ID NO: 827878 - RNA, 12 nt, Mycobacterium avium subsp. paratuberculosis
gcaccaggcggg

SEQ ID NO: 827879 - RNA, 18 nt, Mycobacterium avium subsp. paratuberculosis
gcaccaggcugaccagcg

SEQ ID NO: 827880 - RNA, 21 nt, Mycobacterium avium subsp. paratuberculosis
gcaccaggcugaccagcgccu

SEQ ID NO: 827881 - RNA, 22 nt, Mycobacterium avium subsp. paratuberculosis
gcaccaggcugaccagcgccuc

SEQ ID NO: 827882 - RNA, 16 nt, Mycobacterium avium subsp. paratuberculosis
gcacgaucccgccgcc

SEQ ID NO: 827883 - RNA, 19 nt, Mycobacterium avium subsp. paratuberculosis
gcacgaucccgccgcccgc

SEQ ID NO: 827884 - RNA, 16 nt, Mycobacterium avium subsp. paratuberculosis
gcacgaugacgaccgg

SEQ ID NO: 827885 - RNA, 17 nt, Mycobacterium avium subsp. paratuberculosis
gcacgaugacgaccggg

SEQ ID NO: 827886 - RNA, 21 nt, Mycobacterium avium subsp. paratuberculosis
gcacgaugacgaccggguccg

SEQ ID NO: 827887 - RNA, 13 nt, Mycobacterium avium subsp. paratuberculosis
gcacgaucggcag

SEQ ID NO: 827888 - RNA, 17 nt, Mycobacterium avium subsp. paratuberculosis
gcacgaucggcagcgcc

SEQ ID NO: 827889 - RNA, 21 nt, Mycobacterium avium subsp. paratuberculosis
gcacgaucggcagcgccaaca

SEQ ID NO: 827890 - RNA, 23 nt, Mycobacterium avium subsp. paratuberculosis
gcacgaucggcagcgccaacaug

SEQ ID NO: 827891 - RNA, 13 nt, Mycobacterium avium subsp. paratuberculosis
gcacgaucgucgc

SEQ ID NO: 827892 - RNA, 17 nt, Mycobacterium avium subsp. paratuberculosis
gcacgaucgucgccgcc

SEQ ID NO: 827893 - RNA, 18 nt, Mycobacterium avium subsp. paratuberculosis
gcacgaucgucgccgcca

SEQ ID NO: 827894 - RNA, 21 nt, Mycobacterium avium subsp. paratuberculosis
gcacgaucucgaccaggccgu

SEQ ID NO: 827895 - RNA, 15 nt, Mycobacterium avium subsp. paratuberculosis
gcacgaucucggcgg

SEQ ID NO: 827896 - RNA, 17 nt, Mycobacterium avium subsp. paratuberculosis
gcacgaucugcaggccg

SEQ ID NO: 827897 - RNA, 15 nt, Mycobacterium avium subsp. paratuberculosis
gcacgagcgucgugc

SEQ ID NO: 827898 - RNA, 21 nt, Mycobacterium avium subsp. paratuberculosis
gcacgagcgaacacgugcagc

SEQ ID NO: 827899 - RNA, 15 nt, Mycobacterium avium subsp. paratuberculosis
gcaccuucgggccga

SEQ ID NO: 827900 - RNA, 15 nt, Mycobacterium avium subsp. paratuberculosis
gcaccuucagcgggc

SEQ ID NO: 827901 - RNA, 18 nt, Mycobacterium avium subsp. paratuberculosis
gcaccuucagcgggcgca

SEQ ID NO: 827902 - RNA, 19 nt, Mycobacterium avium subsp. paratuberculosis
gcaccuucagcgggcgcag

SEQ ID NO: 827903 - RNA, 23 nt, Mycobacterium avium subsp. paratuberculosis
gcaccuuggacgaaacccggcgg

SEQ ID NO: 827904 - RNA, 18 nt, Mycobacterium avium subsp. paratuberculosis
gcacgacgccgcugggcg

SEQ ID NO: 827905 - RNA, 13 nt, Mycobacterium avium subsp. paratuberculosis
gcaccuugaucuc

SEQ ID NO: 827906 - RNA, 18 nt, Mycobacterium avium subsp. paratuberculosis
gcaccuugaucucgucgc

SEQ ID NO: 827907 - RNA, 14 nt, Mycobacterium avium subsp. paratuberculosis
gcaccuugccgguc

SEQ ID NO: 827908 - RNA, 15 nt, Mycobacterium avium subsp. paratuberculosis
gcaccugggugaucu

SEQ ID NO: 827909 - RNA, 23 nt, Mycobacterium avium subsp. paratuberculosis
gcaccugguugaacggcaccccg

SEQ ID NO: 827910 - RNA, 15 nt, Mycobacterium avium subsp. paratuberculosis
gcaccuggcgcaccg

SEQ ID NO: 827911 - RNA, 18 nt, Mycobacterium avium subsp. paratuberculosis
gcaccuggcgcaccgccg

SEQ ID NO: 827912 - RNA, 20 nt, Mycobacterium avium subsp. paratuberculosis
gcaccuggcgcaccgccgcg

SEQ ID NO: 827913 - RNA, 21 nt, Mycobacterium avium subsp. paratuberculosis
gcaccuggcgcaccgccgcgg

SEQ ID NO: 827914 - RNA, 17 nt, Mycobacterium avium subsp. paratuberculosis
gcaccuggcgcagcacc

SEQ ID NO: 827915 - RNA, 19 nt, Mycobacterium avium subsp. paratuberculosis
gcaccuggcgcagcaccga

SEQ ID NO: 827916 - RNA, 22 nt, Mycobacterium avium subsp. paratuberculosis
gcaccucuucgaaagccacccg

SEQ ID NO: 827917 - RNA, 23 nt, Mycobacterium avium subsp. paratuberculosis
gcaccucuucgaaagccacccgc

SEQ ID NO: 827918 - RNA, 15 nt, Mycobacterium avium subsp. paratuberculosis
gcacgccacucgucg

SEQ ID NO: 827919 - RNA, 16 nt, Mycobacterium avium subsp. paratuberculosis
gcacgccacucgucga

SEQ ID NO: 827920 - RNA, 11 nt, Mycobacterium avium subsp. paratuberculosis
gcacgccagca

SEQ ID NO: 827921 - RNA, 15 nt, Mycobacterium avium subsp. paratuberculosis
gcacgcagccgcgcc

SEQ ID NO: 827922 - RNA, 17 nt, Mycobacterium avium subsp. paratuberculosis
gcacgccgagcagcacc

SEQ ID NO: 827923 - RNA, 21 nt, Mycobacterium avium subsp. paratuberculosis
gcacgccaucgccucggccac

SEQ ID NO: 827924 - RNA, 14 nt, Mycobacterium avium subsp. paratuberculosis
gcacgcccagaucg

SEQ ID NO: 827925 - RNA, 17 nt, Mycobacterium avium subsp. paratuberculosis
gcacgcccagaucgacg

SEQ ID NO: 827926 - RNA, 19 nt, Mycobacterium avium subsp. paratuberculosis
gcacgcccagaucgacgcc

SEQ ID NO: 827927 - RNA, 13 nt, Mycobacterium avium subsp. paratuberculosis
gcacgcagcggcg

SEQ ID NO: 827928 - RNA, 19 nt, Mycobacterium avium subsp. paratuberculosis
gcacgcaggcguggcccag

SEQ ID NO: 827929 - RNA, 14 nt, Mycobacterium avium subsp. paratuberculosis
gcacgcagugccgc

SEQ ID NO: 827930 - RNA, 15 nt, Mycobacterium avium subsp. paratuberculosis
gcacgcagugccgca

SEQ ID NO: 827931 - RNA, 18 nt, Mycobacterium avium subsp. paratuberculosis
gcacgcagugccgcacca

SEQ ID NO: 827932 - RNA, 18 nt, Mycobacterium avium subsp. paratuberculosis
gcacgcacggcgaacggc

SEQ ID NO: 827933 - RNA, 22 nt, Mycobacterium avium subsp. paratuberculosis
gcacgcaaaaaccaugccaguc

SEQ ID NO: 827934 - RNA, 16 nt, Mycobacterium avium subsp. paratuberculosis
gcacgauggcgcggcg

SEQ ID NO: 827935 - RNA, 19 nt, Mycobacterium avium subsp. paratuberculosis
gcacgauggcgcggcgcac

SEQ ID NO: 827936 - RNA, 15 nt, Mycobacterium avium subsp. paratuberculosis
gcacgaugccgcgcu

SEQ ID NO: 827937 - RNA, 15 nt, Mycobacterium avium subsp. paratuberculosis
gcacgcggccgcgcc

SEQ ID NO: 827938 - RNA, 13 nt, Mycobacterium avium subsp. paratuberculosis
gcacgcggacacg

SEQ ID NO: 827939 - RNA, 19 nt, Mycobacterium avium subsp. paratuberculosis
gcacgcgcgggucgucggc

SEQ ID NO: 827940 - RNA, 15 nt, Mycobacterium avium subsp. paratuberculosis
gcacgccgggcaugc

SEQ ID NO: 827941 - RNA, 17 nt, Mycobacterium avium subsp. paratuberculosis
gcacgccggucagcacc

SEQ ID NO: 827942 - RNA, 21 nt, Mycobacterium avium subsp. paratuberculosis
gcacgccguccuuggccgcca

SEQ ID NO: 827943 - RNA, 22 nt, Mycobacterium avium subsp. paratuberculosis
gcacgccguccuuggccgccag

SEQ ID NO: 827944 - RNA, 14 nt, Mycobacterium avium subsp. paratuberculosis
gcacgccggggccc

SEQ ID NO: 827945 - RNA, 22 nt, Mycobacterium avium subsp. paratuberculosis
gcacgccggguugggcggcggc

SEQ ID NO: 827946 - RNA, 23 nt, Mycobacterium avium subsp. paratuberculosis
gcacgccggguugggcggcggcc

SEQ ID NO: 827947 - RNA, 15 nt, Mycobacterium avium subsp. paratuberculosis
gcacgccgguagccg

SEQ ID NO: 827948 - RNA, 17 nt, Mycobacterium avium subsp. paratuberculosis
gcacgccggccggcgug

SEQ ID NO: 827949 - RNA, 18 nt, Mycobacterium avium subsp. paratuberculosis
gcacgccggccggcgugg

SEQ ID NO: 827950 - RNA, 12 nt, Mycobacterium avium subsp. paratuberculosis
gcacgccggcgg

SEQ ID NO: 827951 - RNA, 13 nt, Mycobacterium avium subsp. paratuberculosis
gcacgccgccggu

SEQ ID NO: 827952 - RNA, 15 nt, Mycobacterium avium subsp. paratuberculosis
gcacgccggaaucga

SEQ ID NO: 827953 - RNA, 14 nt, Mycobacterium avium subsp. paratuberculosis
gcacgccgaggcgu

SEQ ID NO: 827954 - RNA, 15 nt, Mycobacterium avium subsp. paratuberculosis
gcacgccgaggcgug

SEQ ID NO: 827955 - RNA, 21 nt, Mycobacterium avium subsp. paratuberculosis
gcacgccgaggcgugccgcug

SEQ ID NO: 827956 - RNA, 16 nt, Mycobacterium avium subsp. paratuberculosis
gcacggugggacggcg

SEQ ID NO: 827957 - RNA, 17 nt, Mycobacterium avium subsp. paratuberculosis
gcacggugggacggcgg

SEQ ID NO: 827958 - RNA, 20 nt, Mycobacterium avium subsp. paratuberculosis
gcacggugggacggcgggug

SEQ ID NO: 827959 - RNA, 20 nt, Mycobacterium avium subsp. paratuberculosis
gcacggugggcgccggguca

SEQ ID NO: 827960 - RNA, 18 nt, Mycobacterium avium subsp. paratuberculosis
gcacggugcgccggcagc

SEQ ID NO: 827961 - RNA, 21 nt, Mycobacterium avium subsp. paratuberculosis
gcacggugcgccggcagcggc

SEQ ID NO: 827962 - RNA, 13 nt, Mycobacterium avium subsp. paratuberculosis
gcacggugcgggu

SEQ ID NO: 827963 - RNA, 15 nt, Mycobacterium avium subsp. paratuberculosis
gcacggugcguucgc

SEQ ID NO: 827964 - RNA, 18 nt, Mycobacterium avium subsp. paratuberculosis
gcacgguuggccggcccg

SEQ ID NO: 827965 - RNA, 19 nt, Mycobacterium avium subsp. paratuberculosis
gcacgguuggccggcccgc

SEQ ID NO: 827966 - RNA, 21 nt, Mycobacterium avium subsp. paratuberculosis
gcacgguguagacgcgggccg

SEQ ID NO: 827967 - RNA, 23 nt, Mycobacterium avium subsp. paratuberculosis
gcacgguguagacgcgggccggc

SEQ ID NO: 827968 - RNA, 17 nt, Mycobacterium avium subsp. paratuberculosis
gcacguagcccagcgcg

SEQ ID NO: 827969 - RNA, 18 nt, Mycobacterium avium subsp. paratuberculosis
gcacguagcccagcgcgu

SEQ ID NO: 827970 - RNA, 16 nt, Mycobacterium avium subsp. paratuberculosis
gcacgucacgggccag

SEQ ID NO: 827971 - RNA, 22 nt, Mycobacterium avium subsp. paratuberculosis
gcacgucacgggccaggcgcgc

SEQ ID NO: 827972 - RNA, 13 nt, Mycobacterium avium subsp. paratuberculosis
gcacgucaccgcg

SEQ ID NO: 827973 - RNA, 14 nt, Mycobacterium avium subsp. paratuberculosis
gcacgucaccgcgc

SEQ ID NO: 827974 - RNA, 23 nt, Mycobacterium avium subsp. paratuberculosis
gcacgucaccgcugaugccgccg

SEQ ID NO: 827975 - RNA, 12 nt, Mycobacterium avium subsp. paratuberculosis
gcacgucggcag

SEQ ID NO: 827976 - RNA, 13 nt, Mycobacterium avium subsp. paratuberculosis
gcacgucggccac

SEQ ID NO: 827977 - RNA, 17 nt, Mycobacterium avium subsp. paratuberculosis
gcacgucggccacgccg

SEQ ID NO: 827978 - RNA, 13 nt, Mycobacterium avium subsp. paratuberculosis
gcacgucggccag

SEQ ID NO: 827979 - RNA, 17 nt, Mycobacterium avium subsp. paratuberculosis
gcacgucggccgccagg

SEQ ID NO: 827980 - RNA, 17 nt, Mycobacterium avium subsp. paratuberculosis
gcacgucggcggccgcg

SEQ ID NO: 827981 - RNA, 17 nt, Mycobacterium avium subsp. paratuberculosis
gcacgucgggguggccg

SEQ ID NO: 827982 - RNA, 20 nt, Mycobacterium avium subsp. paratuberculosis
gcacgucgggguggccggcc

SEQ ID NO: 827983 - RNA, 17 nt, Mycobacterium avium subsp. paratuberculosis
gcacgucggucagcgag

SEQ ID NO: 827984 - RNA, 21 nt, Mycobacterium avium subsp. paratuberculosis
gcacgucggucagcgagcggu

SEQ ID NO: 827985 - RNA, 22 nt, Mycobacterium avium subsp. paratuberculosis
gcacucccgcguauugcacggc

SEQ ID NO: 827986 - RNA, 20 nt, Mycobacterium avium subsp. paratuberculosis
gcacgucgcgcggggucggg

SEQ ID NO: 827987 - RNA, 16 nt, Mycobacterium avium subsp. paratuberculosis
gcacgucgccgccgca

SEQ ID NO: 827988 - RNA, 13 nt, Mycobacterium avium subsp. paratuberculosis
gcacgucgccggc

SEQ ID NO: 827989 - RNA, 17 nt, Mycobacterium avium subsp. paratuberculosis
gcacgucgccggcgacc

SEQ ID NO: 827990 - RNA, 19 nt, Mycobacterium avium subsp. paratuberculosis
gcacgucgccggcgaccgc

SEQ ID NO: 827991 - RNA, 13 nt, Mycobacterium avium subsp. paratuberculosis
gcacgucgacgcc

SEQ ID NO: 827992 - RNA, 17 nt, Mycobacterium avium subsp. paratuberculosis
gcacgucgacgccgguc

SEQ ID NO: 827993 - RNA, 16 nt, Mycobacterium avium subsp. paratuberculosis
gcacgucgagcaccgc

SEQ ID NO: 827994 - RNA, 18 nt, Mycobacterium avium subsp. paratuberculosis
gcacgucgagcuccucgg

SEQ ID NO: 827995 - RNA, 22 nt, Mycobacterium avium subsp. paratuberculosis
gcacgucgagcuccucggccag

SEQ ID NO: 827996 - RNA, 23 nt, Mycobacterium avium subsp. paratuberculosis
gcacgucgagcuccucggccagc

SEQ ID NO: 827997 - RNA, 14 nt, Mycobacterium avium subsp. paratuberculosis
gcacguccucgucg

SEQ ID NO: 827998 - RNA, 19 nt, Mycobacterium avium subsp. paratuberculosis
gcacguccucgucggucca

SEQ ID NO: 827999 - RNA, 15 nt, Mycobacterium avium subsp. paratuberculosis
gcacgucgaggucgg

SEQ ID NO: 828000 - RNA, 15 nt, Mycobacterium avium subsp. paratuberculosis
gcacguccgccuccg

SEQ ID NO: 828001 - RNA, 21 nt, Mycobacterium avium subsp. paratuberculosis
gcacguccccgggcaccccgg

SEQ ID NO: 828002 - RNA, 15 nt, Mycobacterium avium subsp. paratuberculosis
gcacgucccgcccgg

SEQ ID NO: 828003 - RNA, 16 nt, Mycobacterium avium subsp. paratuberculosis
gcacgucccgcccggc

SEQ ID NO: 828004 - RNA, 17 nt, Mycobacterium avium subsp. paratuberculosis
gcacgucccgcccggcg

SEQ ID NO: 828005 - RNA, 20 nt, Mycobacterium avium subsp. paratuberculosis
gcacgucccgcccggcgccg

SEQ ID NO: 828006 - RNA, 12 nt, Mycobacterium avium subsp. paratuberculosis
gcacguccagcc

SEQ ID NO: 828007 - RNA, 18 nt, Mycobacterium avium subsp. paratuberculosis
gcacguccagcccgcgcc

SEQ ID NO: 828008 - RNA, 21 nt, Mycobacterium avium subsp. paratuberculosis
gcacguccagcccgcgccagc

SEQ ID NO: 828009 - RNA, 14 nt, Mycobacterium avium subsp. paratuberculosis
gcacgcggaucgcg

SEQ ID NO: 828010 - RNA, 16 nt, Mycobacterium avium subsp. paratuberculosis
gcacgcguugcagcgc

SEQ ID NO: 828011 - RNA, 19 nt, Mycobacterium avium subsp. paratuberculosis
gcacgcguugcagcgccgc

SEQ ID NO: 828012 - RNA, 20 nt, Mycobacterium avium subsp. paratuberculosis
gcacgcguugcagcgccgcg

SEQ ID NO: 828013 - RNA, 12 nt, Mycobacterium avium subsp. paratuberculosis
gcacggacagcu

SEQ ID NO: 828014 - RNA, 17 nt, Mycobacterium avium subsp. paratuberculosis
gcacgcuguccgcguga

SEQ ID NO: 828015 - RNA, 19 nt, Mycobacterium avium subsp. paratuberculosis
gcacgcugucggggucgcg

SEQ ID NO: 828016 - RNA, 22 nt, Mycobacterium avium subsp. paratuberculosis
gcacgcuguuggaaccggccac

SEQ ID NO: 828017 - RNA, 21 nt, Mycobacterium avium subsp. paratuberculosis
gcacgcuuuuucgcgaacuuc

SEQ ID NO: 828018 - RNA, 20 nt, Mycobacterium avium subsp. paratuberculosis
gcacggcgcgcaccgcgggc

SEQ ID NO: 828019 - RNA, 12 nt, Mycobacterium avium subsp. paratuberculosis
gcacggcgcugg

SEQ ID NO: 828020 - RNA, 15 nt, Mycobacterium avium subsp. paratuberculosis
gcacggcggcgaacg

SEQ ID NO: 828021 - RNA, 18 nt, Mycobacterium avium subsp. paratuberculosis
gcacggcggcgaacgccg

SEQ ID NO: 828022 - RNA, 22 nt, Mycobacterium avium subsp. paratuberculosis
gcacggcggcgaacgccgccgu

SEQ ID NO: 828023 - RNA, 13 nt, Mycobacterium avium subsp. paratuberculosis
gcacggcggcgug

SEQ ID NO: 828024 - RNA, 22 nt, Mycobacterium avium subsp. paratuberculosis
gcacggcggcgugcaccgcccg

SEQ ID NO: 828025 - RNA, 21 nt, Mycobacterium avium subsp. paratuberculosis
gcacggcuaccuaggcgucgu

SEQ ID NO: 828026 - RNA, 19 nt, Mycobacterium avium subsp. paratuberculosis
gcacggcugcucccgaaag

SEQ ID NO: 828027 - RNA, 15 nt, Mycobacterium avium subsp. paratuberculosis
gcacggugccgccgu

SEQ ID NO: 828028 - RNA, 18 nt, Mycobacterium avium subsp. paratuberculosis
gcacggugaucagcagca

SEQ ID NO: 828029 - RNA, 16 nt, Mycobacterium avium subsp. paratuberculosis
gcacggugaugcgggu

SEQ ID NO: 828030 - RNA, 17 nt, Mycobacterium avium subsp. paratuberculosis
gcacggugcacacgccg

SEQ ID NO: 828031 - RNA, 20 nt, Mycobacterium avium subsp. paratuberculosis
gcacggugcacacgccgagg

SEQ ID NO: 828032 - RNA, 20 nt, Mycobacterium avium subsp. paratuberculosis
gcacggugcagcagcgccgc

SEQ ID NO: 828033 - RNA, 22 nt, Mycobacterium avium subsp. paratuberculosis
gcacggugcagcagcgccgcga

SEQ ID NO: 828034 - RNA, 14 nt, Mycobacterium avium subsp. paratuberculosis
gcacgggcccgcgg

SEQ ID NO: 828035 - RNA, 16 nt, Mycobacterium avium subsp. paratuberculosis
gcacgggcccgcggga

SEQ ID NO: 828036 - RNA, 16 nt, Mycobacterium avium subsp. paratuberculosis
gcacgggaugaucggc

SEQ ID NO: 828037 - RNA, 19 nt, Mycobacterium avium subsp. paratuberculosis
gcaccgccaucgcggcguu

SEQ ID NO: 828038 - RNA, 16 nt, Mycobacterium avium subsp. paratuberculosis
gcaccgccaucggcau

SEQ ID NO: 828039 - RNA, 18 nt, Mycobacterium avium subsp. paratuberculosis
gcaccgccaucggcaucg

SEQ ID NO: 828040 - RNA, 20 nt, Mycobacterium avium subsp. paratuberculosis
gcaccgcccccgcggcggcc

SEQ ID NO: 828041 - RNA, 21 nt, Mycobacterium avium subsp. paratuberculosis
gcaccgcccccgcggcggcca

SEQ ID NO: 828042 - RNA, 14 nt, Mycobacterium avium subsp. paratuberculosis
gcaccgccagccac

SEQ ID NO: 828043 - RNA, 18 nt, Mycobacterium avium subsp. paratuberculosis
gcaccgagaccaugccgc

SEQ ID NO: 828044 - RNA, 13 nt, Mycobacterium avium subsp. paratuberculosis
gcaccgccccggu

SEQ ID NO: 828045 - RNA, 16 nt, Mycobacterium avium subsp. paratuberculosis
gcaccgccccggucac

SEQ ID NO: 828046 - RNA, 22 nt, Mycobacterium avium subsp. paratuberculosis
gcaccgccccggucaccccggc

SEQ ID NO: 828047 - RNA, 15 nt, Mycobacterium avium subsp. paratuberculosis
gcaccgcccgcgcga

SEQ ID NO: 828048 - RNA, 15 nt, Mycobacterium avium subsp. paratuberculosis
gcaccgcccggguug

SEQ ID NO: 828049 - RNA, 22 nt, Mycobacterium avium subsp. paratuberculosis
gcaccgcccggguugucgacgu

SEQ ID NO: 828050 - RNA, 21 nt, Mycobacterium avium subsp. paratuberculosis
gcaccgccgagccgucgucgc

SEQ ID NO: 828051 - RNA, 18 nt, Mycobacterium avium subsp. paratuberculosis
gcaccgcgucggcgcugg

SEQ ID NO: 828052 - RNA, 16 nt, Mycobacterium avium subsp. paratuberculosis
gcaccgcguccgcguc

SEQ ID NO: 828053 - RNA, 14 nt, Mycobacterium avium subsp. paratuberculosis
gcaccgcgucgacc

SEQ ID NO: 828054 - RNA, 19 nt, Mycobacterium avium subsp. paratuberculosis
gcaccgcgucgaugcgggc

SEQ ID NO: 828055 - RNA, 22 nt, Mycobacterium avium subsp. paratuberculosis
gcaccgcgucgaugcgggcccg

SEQ ID NO: 828056 - RNA, 13 nt, Mycobacterium avium subsp. paratuberculosis
gcaccgcgucggc

SEQ ID NO: 828057 - RNA, 18 nt, Mycobacterium avium subsp. paratuberculosis
gcaccgcggucugcgcca

SEQ ID NO: 828058 - RNA, 20 nt, Mycobacterium avium subsp. paratuberculosis
gcaccgcggucugcgccagc

SEQ ID NO: 828059 - RNA, 22 nt, Mycobacterium avium subsp. paratuberculosis
gcaccgcggucugcgccagcuc

SEQ ID NO: 828060 - RNA, 22 nt, Mycobacterium avium subsp. paratuberculosis
gcaccgcggcgggguccacgca

SEQ ID NO: 828061 - RNA, 15 nt, Mycobacterium avium subsp. paratuberculosis
gcaccgcggcgugga

SEQ ID NO: 828062 - RNA, 22 nt, Mycobacterium avium subsp. paratuberculosis
gcaccgcggcucggucgcgaag

SEQ ID NO: 828063 - RNA, 22 nt, Mycobacterium avium subsp. paratuberculosis
gcaccgcgggggcggccgggcc

SEQ ID NO: 828064 - RNA, 15 nt, Mycobacterium avium subsp. paratuberculosis
gcaccgcggcgcgca

SEQ ID NO: 828065 - RNA, 16 nt, Mycobacterium avium subsp. paratuberculosis
gcaccgccgcgcggcc

SEQ ID NO: 828066 - RNA, 22 nt, Mycobacterium avium subsp. paratuberculosis
gcaccgcggccgucgcggcgau

SEQ ID NO: 828067 - RNA, 16 nt, Mycobacterium avium subsp. paratuberculosis
gcaccgcggccucggc

SEQ ID NO: 828068 - RNA, 18 nt, Mycobacterium avium subsp. paratuberculosis
gcaccgcggccucggcgu

SEQ ID NO: 828069 - RNA, 11 nt, Mycobacterium avium subsp. paratuberculosis
gcaccgcggcg

SEQ ID NO: 828070 - RNA, 15 nt, Mycobacterium avium subsp. paratuberculosis
gcaccgcggcgaucg

SEQ ID NO: 828071 - RNA, 18 nt, Mycobacterium avium subsp. paratuberculosis
gcaccgcggcgaucgccg

SEQ ID NO: 828072 - RNA, 20 nt, Mycobacterium avium subsp. paratuberculosis
gcaccgcggcgaucgccgug

SEQ ID NO: 828073 - RNA, 22 nt, Mycobacterium avium subsp. paratuberculosis
gcaccgcggcgaucgccguggu

SEQ ID NO: 828074 - RNA, 16 nt, Mycobacterium avium subsp. paratuberculosis
gcaccgcggcgaugau

SEQ ID NO: 828075 - RNA, 23 nt, Mycobacterium avium subsp. paratuberculosis
gcaccgcggcgaugauccgcggc

SEQ ID NO: 828076 - RNA, 15 nt, Mycobacterium avium subsp. paratuberculosis
gcaccggcgucgaca

SEQ ID NO: 828077 - RNA, 17 nt, Mycobacterium avium subsp. paratuberculosis
gcaccggcgucgacagc

SEQ ID NO: 828078 - RNA, 18 nt, Mycobacterium avium subsp. paratuberculosis
gcaccggcgucgacagcc

SEQ ID NO: 828079 - RNA, 20 nt, Mycobacterium avium subsp. paratuberculosis
gcaccggcgucgacagccgg

SEQ ID NO: 828080 - RNA, 14 nt, Mycobacterium avium subsp. paratuberculosis
gcaccggcggcagc

SEQ ID NO: 828081 - RNA, 21 nt, Mycobacterium avium subsp. paratuberculosis
gcaccggcggcagcgacucgg

SEQ ID NO: 828082 - RNA, 13 nt, Mycobacterium avium subsp. paratuberculosis
gcaccggcugccc

SEQ ID NO: 828083 - RNA, 12 nt, Mycobacterium avium subsp. paratuberculosis
gcaccggcuggc

SEQ ID NO: 828084 - RNA, 19 nt, Mycobacterium avium subsp. paratuberculosis
gcaccgggaacagccaggc

SEQ ID NO: 828085 - RNA, 21 nt, Mycobacterium avium subsp. paratuberculosis
gcaccgggaaggugucggccg

SEQ ID NO: 828086 - RNA, 15 nt, Mycobacterium avium subsp. paratuberculosis
gcaccgggaccagcg

SEQ ID NO: 828087 - RNA, 17 nt, Mycobacterium avium subsp. paratuberculosis
gcaccgggaccagcgcg

SEQ ID NO: 828088 - RNA, 22 nt, Mycobacterium avium subsp. paratuberculosis
gcaccgggaccagcgcggugcc

SEQ ID NO: 828089 - RNA, 15 nt, Mycobacterium avium subsp. paratuberculosis
gcaccggcuggccga

SEQ ID NO: 828090 - RNA, 22 nt, Mycobacterium avium subsp. paratuberculosis
gcaccggcuggccgagcggcug

SEQ ID NO: 828091 - RNA, 15 nt, Mycobacterium avium subsp. paratuberculosis
gcaccggcuggucgg

SEQ ID NO: 828092 - RNA, 20 nt, Mycobacterium avium subsp. paratuberculosis
gcaccggcuggugcagcagc

SEQ ID NO: 828093 - RNA, 15 nt, Mycobacterium avium subsp. paratuberculosis
gcaccgggcccagcu

SEQ ID NO: 828094 - RNA, 16 nt, Mycobacterium avium subsp. paratuberculosis
gcaccgggcccagcuc

SEQ ID NO: 828095 - RNA, 19 nt, Mycobacterium avium subsp. paratuberculosis
gcaccgggcccgcccgcag

SEQ ID NO: 828096 - RNA, 16 nt, Mycobacterium avium subsp. paratuberculosis
gcaccgcugccggccg

SEQ ID NO: 828097 - RNA, 13 nt, Mycobacterium avium subsp. paratuberculosis
gcaccggcgccau

SEQ ID NO: 828098 - RNA, 19 nt, Mycobacterium avium subsp. paratuberculosis
gcaccggcgccccgggcag

SEQ ID NO: 828099 - RNA, 14 nt, Mycobacterium avium subsp. paratuberculosis
gcaccggcgccgcc

SEQ ID NO: 828100 - RNA, 12 nt, Mycobacterium avium subsp. paratuberculosis
gcaccggcgccu

SEQ ID NO: 828101 - RNA, 16 nt, Mycobacterium avium subsp. paratuberculosis
gcaccggcgccucgau

SEQ ID NO: 828102 - RNA, 22 nt, Mycobacterium avium subsp. paratuberculosis
gcaccggcgccucgaugcgggu

SEQ ID NO: 828103 - RNA, 17 nt, Mycobacterium avium subsp. paratuberculosis
gcaccggcgcgccgcgu

SEQ ID NO: 828104 - RNA, 21 nt, Mycobacterium avium subsp. paratuberculosis
gcaccggcgaguccgcggagg

SEQ ID NO: 828105 - RNA, 22 nt, Mycobacterium avium subsp. paratuberculosis
gcaccggcgaugcagaucacca

SEQ ID NO: 828106 - RNA, 22 nt, Mycobacterium avium subsp. paratuberculosis
gcaccggggucugcacgaugcc

SEQ ID NO: 828107 - RNA, 14 nt, Mycobacterium avium subsp. paratuberculosis
gcaccgggcgucgg

SEQ ID NO: 828108 - RNA, 17 nt, Mycobacterium avium subsp. paratuberculosis
gcaccgggcgucggggc

SEQ ID NO: 828109 - RNA, 17 nt, Mycobacterium avium subsp. paratuberculosis
gcaccggugcaccgcgc

SEQ ID NO: 828110 - RNA, 19 nt, Mycobacterium avium subsp. paratuberculosis
gcaccggugcaccgcgcgc

SEQ ID NO: 828111 - RNA, 20 nt, Mycobacterium avium subsp. paratuberculosis
gcaccggugcaccgcgcgca

SEQ ID NO: 828112 - RNA, 18 nt, Mycobacterium avium subsp. paratuberculosis
gcaccggggccaacuccg

SEQ ID NO: 828113 - RNA, 14 nt, Mycobacterium avium subsp. paratuberculosis
gcaccggggccggc

SEQ ID NO: 828114 - RNA, 17 nt, Mycobacterium avium subsp. paratuberculosis
gcaccggguacaccggc

SEQ ID NO: 828115 - RNA, 18 nt, Mycobacterium avium subsp. paratuberculosis
gcaccggguacaccggcu

SEQ ID NO: 828116 - RNA, 19 nt, Mycobacterium avium subsp. paratuberculosis
gcaccggguacaccggcuc

SEQ ID NO: 828117 - RNA, 13 nt, Mycobacterium avium subsp. paratuberculosis
gcaccgggugggc

SEQ ID NO: 828118 - RNA, 16 nt, Mycobacterium avium subsp. paratuberculosis
gcaccgggugggccga

SEQ ID NO: 828119 - RNA, 18 nt, Mycobacterium avium subsp. paratuberculosis
gcaccgggugggccgacc

SEQ ID NO: 828120 - RNA, 15 nt, Mycobacterium avium subsp. paratuberculosis
gcaccggugcggcgg

SEQ ID NO: 828121 - RNA, 19 nt, Mycobacterium avium subsp. paratuberculosis
gcaccgguuugucggcgcc

SEQ ID NO: 828122 - RNA, 21 nt, Mycobacterium avium subsp. paratuberculosis
gcaccgguuugucggcgcccu

SEQ ID NO: 828123 - RNA, 17 nt, Mycobacterium avium subsp. paratuberculosis
gcaccgucaucgcggcg

SEQ ID NO: 828124 - RNA, 21 nt, Mycobacterium avium subsp. paratuberculosis
gcaccgucaucgcggcgaaca

SEQ ID NO: 828125 - RNA, 18 nt, Mycobacterium avium subsp. paratuberculosis
gcaccguccacagccggc

SEQ ID NO: 828126 - RNA, 20 nt, Mycobacterium avium subsp. paratuberculosis
gcaccguccacagccggcgg

SEQ ID NO: 828127 - RNA, 18 nt, Mycobacterium avium subsp. paratuberculosis
gcaccgucaccgacggcu

SEQ ID NO: 828128 - RNA, 15 nt, Mycobacterium avium subsp. paratuberculosis
gcaccgucaccgccu

SEQ ID NO: 828129 - RNA, 23 nt, Mycobacterium avium subsp. paratuberculosis
gcaccucucgggaaacgcgucgc

SEQ ID NO: 828130 - RNA, 17 nt, Mycobacterium avium subsp. paratuberculosis
gcaccugaaccgcgcac

SEQ ID NO: 828131 - RNA, 17 nt, Mycobacterium avium subsp. paratuberculosis
gcaccugaacggccgcg

SEQ ID NO: 828132 - RNA, 18 nt, Mycobacterium avium subsp. paratuberculosis
gcaccugaacggccgcgc

SEQ ID NO: 828133 - RNA, 20 nt, Mycobacterium avium subsp. paratuberculosis
gcaccugaacggccgcgcag

SEQ ID NO: 828134 - RNA, 19 nt, Mycobacterium avium subsp. paratuberculosis
gcaccugaccgucggccag

SEQ ID NO: 828135 - RNA, 22 nt, Mycobacterium avium subsp. paratuberculosis
gcaccugaccgucggccagaua

SEQ ID NO: 828136 - RNA, 14 nt, Mycobacterium avium subsp. paratuberculosis
gcaccucggcgacc

SEQ ID NO: 828137 - RNA, 13 nt, Mycobacterium avium subsp. paratuberculosis
gcaccucggggcg

SEQ ID NO: 828138 - RNA, 14 nt, Mycobacterium avium subsp. paratuberculosis
gcaccucggccggg

SEQ ID NO: 828139 - RNA, 12 nt, Mycobacterium avium subsp. paratuberculosis
gcaccucgucgc

SEQ ID NO: 828140 - RNA, 14 nt, Mycobacterium avium subsp. paratuberculosis
gcaccucgucgccc

SEQ ID NO: 828141 - RNA, 17 nt, Mycobacterium avium subsp. paratuberculosis
gcaccucgucgcccggc

SEQ ID NO: 828142 - RNA, 18 nt, Mycobacterium avium subsp. paratuberculosis
gcaccucgucgcccggcg

SEQ ID NO: 828143 - RNA, 15 nt, Mycobacterium avium subsp. paratuberculosis
gcaccucgucgccgu

SEQ ID NO: 828144 - RNA, 17 nt, Mycobacterium avium subsp. paratuberculosis
gcaccucgucgccgucg

SEQ ID NO: 828145 - RNA, 18 nt, Mycobacterium avium subsp. paratuberculosis
gcaccucgucgccgucgg

SEQ ID NO: 828146 - RNA, 19 nt, Mycobacterium avium subsp. paratuberculosis
gcaccucgucgccgucggg

SEQ ID NO: 828147 - RNA, 12 nt, Mycobacterium avium subsp. paratuberculosis
gcaccucggcgu

SEQ ID NO: 828148 - RNA, 17 nt, Mycobacterium avium subsp. paratuberculosis
gcaccucggcgucggcg

SEQ ID NO: 828149 - RNA, 19 nt, Mycobacterium avium subsp. paratuberculosis
gcaccucggcgucggcgcg

SEQ ID NO: 828150 - RNA, 13 nt, Mycobacterium avium subsp. paratuberculosis
gcaccgucgucgc

SEQ ID NO: 828151 - RNA, 15 nt, Mycobacterium avium subsp. paratuberculosis
gcaccgucgucgcac

SEQ ID NO: 828152 - RNA, 19 nt, Mycobacterium avium subsp. paratuberculosis
gcaccgucgugccagcgca

SEQ ID NO: 828153 - RNA, 20 nt, Mycobacterium avium subsp. paratuberculosis
gcaccgucgugccagcgcag

SEQ ID NO: 828154 - RNA, 13 nt, Mycobacterium avium subsp. paratuberculosis
gcaccgucgccgg

SEQ ID NO: 828155 - RNA, 15 nt, Mycobacterium avium subsp. paratuberculosis
gcaccgucgccggcg

SEQ ID NO: 828156 - RNA, 20 nt, Mycobacterium avium subsp. paratuberculosis
gcaccgucgccggcggggcg

SEQ ID NO: 828157 - RNA, 13 nt, Mycobacterium avium subsp. paratuberculosis
gcaccgucggcgu

SEQ ID NO: 828158 - RNA, 16 nt, Mycobacterium avium subsp. paratuberculosis
gcacccauccccagga

SEQ ID NO: 828159 - RNA, 15 nt, Mycobacterium avium subsp. paratuberculosis
gcaccccacccgcgc

SEQ ID NO: 828160 - RNA, 17 nt, Mycobacterium avium subsp. paratuberculosis
gcaccccacccgcgcga

SEQ ID NO: 828161 - RNA, 16 nt, Mycobacterium avium subsp. paratuberculosis
gcaccccaccgacagc

SEQ ID NO: 828162 - RNA, 20 nt, Mycobacterium avium subsp. paratuberculosis
gcaccccaccgacagccgga

SEQ ID NO: 828163 - RNA, 22 nt, Mycobacterium avium subsp. paratuberculosis
gcacccccaauugccgggccag

SEQ ID NO: 828164 - RNA, 18 nt, Mycobacterium avium subsp. paratuberculosis
gcacccccagcucgacga

SEQ ID NO: 828165 - RNA, 19 nt, Mycobacterium avium subsp. paratuberculosis
gcacccccagcucgacgac

SEQ ID NO: 828166 - RNA, 19 nt, Mycobacterium avium subsp. paratuberculosis
gcacccccucggcgccggu

SEQ ID NO: 828167 - RNA, 21 nt, Mycobacterium avium subsp. paratuberculosis
gcaccccgaucgcgaucaccg

SEQ ID NO: 828168 - RNA, 13 nt, Mycobacterium avium subsp. paratuberculosis
gcaccccgccgca

SEQ ID NO: 828169 - RNA, 21 nt, Mycobacterium avium subsp. paratuberculosis
gcaccccgccgcagcccaggc

SEQ ID NO: 828170 - RNA, 12 nt, Mycobacterium avium subsp. paratuberculosis
gcaccccgcggu

SEQ ID NO: 828171 - RNA, 15 nt, Mycobacterium avium subsp. paratuberculosis
gcacccagccgugcc

SEQ ID NO: 828172 - RNA, 13 nt, Mycobacterium avium subsp. paratuberculosis
gcacccagccgca

SEQ ID NO: 828173 - RNA, 18 nt, Mycobacterium avium subsp. paratuberculosis
gcacccaggucaccgagg

SEQ ID NO: 828174 - RNA, 19 nt, Mycobacterium avium subsp. paratuberculosis
gcacccagaaacgacauca

SEQ ID NO: 828175 - RNA, 22 nt, Mycobacterium avium subsp. paratuberculosis
gcacccagacguguggcacccg

SEQ ID NO: 828176 - RNA, 17 nt, Mycobacterium avium subsp. paratuberculosis
gcacccagcacagcgag

SEQ ID NO: 828177 - RNA, 13 nt, Mycobacterium avium subsp. paratuberculosis
gcacccagcgggc

SEQ ID NO: 828178 - RNA, 20 nt, Mycobacterium avium subsp. paratuberculosis
gcacccagcgggcgacgucg

SEQ ID NO: 828179 - RNA, 19 nt, Mycobacterium avium subsp. paratuberculosis
gcacccaggaaaaccagcg

SEQ ID NO: 828180 - RNA, 21 nt, Mycobacterium avium subsp. paratuberculosis
gcacccaggaaaaccagcgac

SEQ ID NO: 828181 - RNA, 15 nt, Mycobacterium avium subsp. paratuberculosis
gcacccgcagcucca

SEQ ID NO: 828182 - RNA, 22 nt, Mycobacterium avium subsp. paratuberculosis
gcacccgcaacaccacgucggu

SEQ ID NO: 828183 - RNA, 21 nt, Mycobacterium avium subsp. paratuberculosis
gcacccgaccgacgcccggcu

SEQ ID NO: 828184 - RNA, 12 nt, Mycobacterium avium subsp. paratuberculosis
gcacccgacguc

SEQ ID NO: 828185 - RNA, 19 nt, Mycobacterium avium subsp. paratuberculosis
gcacccgacuucggcucgg

SEQ ID NO: 828186 - RNA, 21 nt, Mycobacterium avium subsp. paratuberculosis
gcacccgacuucggcucggcg

SEQ ID NO: 828187 - RNA, 18 nt, Mycobacterium avium subsp. paratuberculosis
gcacccgauccacggcga

SEQ ID NO: 828188 - RNA, 20 nt, Mycobacterium avium subsp. paratuberculosis
gcacccgauccacggcgacc

SEQ ID NO: 828189 - RNA, 22 nt, Mycobacterium avium subsp. paratuberculosis
gcacccgauccacggcgacccc

SEQ ID NO: 828190 - RNA, 14 nt, Mycobacterium avium subsp. paratuberculosis
gcaccccggucacc

SEQ ID NO: 828191 - RNA, 21 nt, Mycobacterium avium subsp. paratuberculosis
gcaccccgguccaggcgaccg

SEQ ID NO: 828192 - RNA, 23 nt, Mycobacterium avium subsp. paratuberculosis
gcaccccgguccaggcgaccggc

SEQ ID NO: 828193 - RNA, 18 nt, Mycobacterium avium subsp. paratuberculosis
gcacccgaacggaccggg

SEQ ID NO: 828194 - RNA, 21 nt, Mycobacterium avium subsp. paratuberculosis
gcacccgaacggaccgggcgg

SEQ ID NO: 828195 - RNA, 15 nt, Mycobacterium avium subsp. paratuberculosis
gcacccgacacgccg

SEQ ID NO: 828196 - RNA, 16 nt, Mycobacterium avium subsp. paratuberculosis
gcacccgacacgccga

SEQ ID NO: 828197 - RNA, 19 nt, Mycobacterium avium subsp. paratuberculosis
gcacccgacacgccgaugu

SEQ ID NO: 828198 - RNA, 13 nt, Mycobacterium avium subsp. paratuberculosis
gcaccccggcggc

SEQ ID NO: 828199 - RNA, 21 nt, Mycobacterium avium subsp. paratuberculosis
gcaccccggcggccgcgucgg

SEQ ID NO: 828200 - RNA, 14 nt, Mycobacterium avium subsp. paratuberculosis
gcaccccgaaccgc

SEQ ID NO: 828201 - RNA, 19 nt, Mycobacterium avium subsp. paratuberculosis
gcaccccgaaccgcccgcc

SEQ ID NO: 828202 - RNA, 19 nt, Mycobacterium avium subsp. paratuberculosis
gcaccccgucgagcagccg

SEQ ID NO: 828203 - RNA, 20 nt, Mycobacterium avium subsp. paratuberculosis
gcaccccgucgagcagccgc

SEQ ID NO: 828204 - RNA, 15 nt, Mycobacterium avium subsp. paratuberculosis
gcaccccgucgcgga

SEQ ID NO: 828205 - RNA, 19 nt, Mycobacterium avium subsp. paratuberculosis
gcaccccgucgcggacccu

SEQ ID NO: 828206 - RNA, 24 nt, Mycobacterium avium subsp. paratuberculosis
gcaccccgugguagacgccggacg

SEQ ID NO: 828207 - RNA, 14 nt, Mycobacterium avium subsp. paratuberculosis
gcaccccugccgcc

SEQ ID NO: 828208 - RNA, 16 nt, Mycobacterium avium subsp. paratuberculosis
gcaccccugccgccac

SEQ ID NO: 828209 - RNA, 20 nt, Mycobacterium avium subsp. paratuberculosis
gcaccccugccgccaccgcg

SEQ ID NO: 828210 - RNA, 21 nt, Mycobacterium avium subsp. paratuberculosis
gcaccgacgaaaucgucgggc

SEQ ID NO: 828211 - RNA, 14 nt, Mycobacterium avium subsp. paratuberculosis
gcaccgaccagcgg

SEQ ID NO: 828212 - RNA, 15 nt, Mycobacterium avium subsp. paratuberculosis
gcaccgacagggcca

SEQ ID NO: 828213 - RNA, 20 nt, Mycobacterium avium subsp. paratuberculosis
gcaccgacagggccagcgcc

SEQ ID NO: 828214 - RNA, 21 nt, Mycobacterium avium subsp. paratuberculosis
gcaccgacagggccagcgcca

SEQ ID NO: 828215 - RNA, 16 nt, Mycobacterium avium subsp. paratuberculosis
gcaccgacaucagauc

SEQ ID NO: 828216 - RNA, 23 nt, Mycobacterium avium subsp. paratuberculosis
gcaccgacaucagaucgccgacg

SEQ ID NO: 828217 - RNA, 14 nt, Mycobacterium avium subsp. paratuberculosis
gcaccgacgcggcg

SEQ ID NO: 828218 - RNA, 16 nt, Mycobacterium avium subsp. paratuberculosis
gcaccgacggagccga

SEQ ID NO: 828219 - RNA, 15 nt, Mycobacterium avium subsp. paratuberculosis
gcaccgacggccgca

SEQ ID NO: 828220 - RNA, 17 nt, Mycobacterium avium subsp. paratuberculosis
gcaccgacggccgcacc

SEQ ID NO: 828221 - RNA, 19 nt, Mycobacterium avium subsp. paratuberculosis
gcaccgacggccgcacccc

SEQ ID NO: 828222 - RNA, 20 nt, Mycobacterium avium subsp. paratuberculosis
gcaccgacggccgcacccca

SEQ ID NO: 828223 - RNA, 20 nt, Mycobacterium avium subsp. paratuberculosis
gcaccgacuccuccggcccg

SEQ ID NO: 828224 - RNA, 22 nt, Mycobacterium avium subsp. paratuberculosis
gcaccgacuccuccggcccgau

SEQ ID NO: 828225 - RNA, 14 nt, Mycobacterium avium subsp. paratuberculosis
gcaccgacugcggc

SEQ ID NO: 828226 - RNA, 15 nt, Mycobacterium avium subsp. paratuberculosis
gcaccgacugcggcg

SEQ ID NO: 828227 - RNA, 16 nt, Mycobacterium avium subsp. paratuberculosis
gcaccgacugcggcgc

SEQ ID NO: 828228 - RNA, 18 nt, Mycobacterium avium subsp. paratuberculosis
gcaccgagaucucgucga

SEQ ID NO: 828229 - RNA, 20 nt, Mycobacterium avium subsp. paratuberculosis
gcaccgagaucucgucgaug

SEQ ID NO: 828230 - RNA, 19 nt, Mycobacterium avium subsp. paratuberculosis
gcaccgacuguuugaugcc

SEQ ID NO: 828231 - RNA, 14 nt, Mycobacterium avium subsp. paratuberculosis
gcaccgccagcgcc

SEQ ID NO: 828232 - RNA, 18 nt, Mycobacterium avium subsp. paratuberculosis
gcaccgccagcgccggca

SEQ ID NO: 828233 - RNA, 17 nt, Mycobacterium avium subsp. paratuberculosis
gcaccgccagcgcggcg

SEQ ID NO: 828234 - RNA, 18 nt, Mycobacterium avium subsp. paratuberculosis
gcaccgccagcgcggcgg

SEQ ID NO: 828235 - RNA, 21 nt, Mycobacterium avium subsp. paratuberculosis
gcaccgccagcgcggcggcgc

SEQ ID NO: 828236 - RNA, 15 nt, Mycobacterium avium subsp. paratuberculosis
gcaccgccagcaccg

SEQ ID NO: 828237 - RNA, 19 nt, Mycobacterium avium subsp. paratuberculosis
gcaccgccagcaccgacgc

SEQ ID NO: 828238 - RNA, 21 nt, Mycobacterium avium subsp. paratuberculosis
gcaccgccagcaccgacgcgc

SEQ ID NO: 828239 - RNA, 17 nt, Mycobacterium avium subsp. paratuberculosis
gcaccgccagcauccgc

SEQ ID NO: 828240 - RNA, 16 nt, Mycobacterium avium subsp. paratuberculosis
gcaccgaaaucguaga

SEQ ID NO: 828241 - RNA, 14 nt, Mycobacterium avium subsp. paratuberculosis
gcaccgaaccggcg

SEQ ID NO: 828242 - RNA, 19 nt, Mycobacterium avium subsp. paratuberculosis
gcaccgaaccggcgggguc

SEQ ID NO: 828243 - RNA, 16 nt, Mycobacterium avium subsp. paratuberculosis
gcaccgaacgccagca

SEQ ID NO: 828244 - RNA, 22 nt, Mycobacterium avium subsp. paratuberculosis
gcaccgaacgccagcagcugcg

SEQ ID NO: 828245 - RNA, 19 nt, Mycobacterium avium subsp. paratuberculosis
gcacccgcgcgucgcgcag

SEQ ID NO: 828246 - RNA, 12 nt, Mycobacterium avium subsp. paratuberculosis
gcacccgcggcg

SEQ ID NO: 828247 - RNA, 13 nt, Mycobacterium avium subsp. paratuberculosis
gcacccgccagcc

SEQ ID NO: 828248 - RNA, 15 nt, Mycobacterium avium subsp. paratuberculosis
gcacccgccagcccg

SEQ ID NO: 828249 - RNA, 17 nt, Mycobacterium avium subsp. paratuberculosis
gcacccgcccggacgcg

SEQ ID NO: 828250 - RNA, 12 nt, Mycobacterium avium subsp. paratuberculosis
gcacccgccgcc

SEQ ID NO: 828251 - RNA, 14 nt, Mycobacterium avium subsp. paratuberculosis
gcacccgcucgccg

SEQ ID NO: 828252 - RNA, 15 nt, Mycobacterium avium subsp. paratuberculosis
gcacccgcucgcggg

SEQ ID NO: 828253 - RNA, 16 nt, Mycobacterium avium subsp. paratuberculosis
gcacccgcucgcgggc

SEQ ID NO: 828254 - RNA, 17 nt, Mycobacterium avium subsp. paratuberculosis
gcacccgcucgcgggcc

SEQ ID NO: 828255 - RNA, 19 nt, Mycobacterium avium subsp. paratuberculosis
gcacccuugacuaccgcgc

SEQ ID NO: 828256 - RNA, 23 nt, Mycobacterium avium subsp. paratuberculosis
gcacccuugacuaccgcgcccag

SEQ ID NO: 828257 - RNA, 16 nt, Mycobacterium avium subsp. paratuberculosis
gcauccacggccgguu

SEQ ID NO: 828258 - RNA, 17 nt, Mycobacterium avium subsp. paratuberculosis
gcauccacggccgguuc

SEQ ID NO: 828259 - RNA, 23 nt, Mycobacterium avium subsp. paratuberculosis
gcaucaugucgaagaagcggccg

SEQ ID NO: 828260 - RNA, 12 nt, Mycobacterium avium subsp. paratuberculosis
gcaucaugccgc

SEQ ID NO: 828261 - RNA, 14 nt, Mycobacterium avium subsp. paratuberculosis
gcaucaucggcacg

SEQ ID NO: 828262 - RNA, 22 nt, Mycobacterium avium subsp. paratuberculosis
gcaucaguucguucauccgggu

SEQ ID NO: 828263 - RNA, 14 nt, Mycobacterium avium subsp. paratuberculosis
gcaucaacugcacc

SEQ ID NO: 828264 - RNA, 17 nt, Mycobacterium avium subsp. paratuberculosis
gcaucagcgagacgacc

SEQ ID NO: 828265 - RNA, 18 nt, Mycobacterium avium subsp. paratuberculosis
gcaucagcgccaccagca

SEQ ID NO: 828266 - RNA, 20 nt, Mycobacterium avium subsp. paratuberculosis
gcaucagcgccaccagcacc

SEQ ID NO: 828267 - RNA, 21 nt, Mycobacterium avium subsp. paratuberculosis
gcaucagcgccaccagcaccg

SEQ ID NO: 828268 - RNA, 14 nt, Mycobacterium avium subsp. paratuberculosis
gcaucagcggagug

SEQ ID NO: 828269 - RNA, 23 nt, Mycobacterium avium subsp. paratuberculosis
gcaucagcggggcguccagcgag

SEQ ID NO: 828270 - RNA, 13 nt, Mycobacterium avium subsp. paratuberculosis
gcaucagcgugau

SEQ ID NO: 828271 - RNA, 18 nt, Mycobacterium avium subsp. paratuberculosis
gcaucagcucuucgacga

SEQ ID NO: 828272 - RNA, 19 nt, Mycobacterium avium subsp. paratuberculosis
gcaucagcucuucgacgau

SEQ ID NO: 828273 - RNA, 15 nt, Mycobacterium avium subsp. paratuberculosis
gcaucagggcguuga

SEQ ID NO: 828274 - RNA, 15 nt, Mycobacterium avium subsp. paratuberculosis
gcaucagggccagcc

SEQ ID NO: 828275 - RNA, 19 nt, Mycobacterium avium subsp. paratuberculosis
gcauacugcuugccgucga

SEQ ID NO: 828276 - RNA, 15 nt, Mycobacterium avium subsp. paratuberculosis
gcauaccgcccgcgc

SEQ ID NO: 828277 - RNA, 18 nt, Mycobacterium avium subsp. paratuberculosis
gcauaccgcccgcgcugg

SEQ ID NO: 828278 - RNA, 19 nt, Mycobacterium avium subsp. paratuberculosis
gcauaccgcccgcgcuggu

SEQ ID NO: 828279 - RNA, 17 nt, Mycobacterium avium subsp. paratuberculosis
gcaguuccggagcgcgg

SEQ ID NO: 828280 - RNA, 13 nt, Mycobacterium avium subsp. paratuberculosis
gcaguuccucgcc

SEQ ID NO: 828281 - RNA, 16 nt, Mycobacterium avium subsp. paratuberculosis
gcaguuccucgccgga

SEQ ID NO: 828282 - RNA, 17 nt, Mycobacterium avium subsp. paratuberculosis
gcaguuccuugcgcagc

SEQ ID NO: 828283 - RNA, 20 nt, Mycobacterium avium subsp. paratuberculosis
gcaguucgaugcgcucggcg

SEQ ID NO: 828284 - RNA, 21 nt, Mycobacterium avium subsp. paratuberculosis
gcaguucgaugcgcucggcga

SEQ ID NO: 828285 - RNA, 23 nt, Mycobacterium avium subsp. paratuberculosis
gcaguucgaugcgcucggcgacc

SEQ ID NO: 828286 - RNA, 17 nt, Mycobacterium avium subsp. paratuberculosis
gcagugaucggcggaac

SEQ ID NO: 828287 - RNA, 20 nt, Mycobacterium avium subsp. paratuberculosis
gcagugaucggcggaacccg

SEQ ID NO: 828288 - RNA, 21 nt, Mycobacterium avium subsp. paratuberculosis
gcagugaucggcggaacccgg

SEQ ID NO: 828289 - RNA, 23 nt, Mycobacterium avium subsp. paratuberculosis
gcagugaucggcggaacccgggu

SEQ ID NO: 828290 - RNA, 17 nt, Mycobacterium avium subsp. paratuberculosis
gcaguguccagucggcc

SEQ ID NO: 828291 - RNA, 18 nt, Mycobacterium avium subsp. paratuberculosis
gcaguguccagucggccg

SEQ ID NO: 828292 - RNA, 15 nt, Mycobacterium avium subsp. paratuberculosis
gcagugucggaaucg

SEQ ID NO: 828293 - RNA, 17 nt, Mycobacterium avium subsp. paratuberculosis
gcagugucggaaucggc

SEQ ID NO: 828294 - RNA, 22 nt, Mycobacterium avium subsp. paratuberculosis
gcagugaaauucgcgccucggu

SEQ ID NO: 828295 - RNA, 22 nt, Mycobacterium avium subsp. paratuberculosis
gcagucguucggccagcaccag

SEQ ID NO: 828296 - RNA, 14 nt, Mycobacterium avium subsp. paratuberculosis
gcagucugccggug

SEQ ID NO: 828297 - RNA, 16 nt, Mycobacterium avium subsp. paratuberculosis
gcagucugccgguggc

SEQ ID NO: 828298 - RNA, 22 nt, Mycobacterium avium subsp. paratuberculosis
gcagucuuaucuaucuucggcg

SEQ ID NO: 828299 - RNA, 15 nt, Mycobacterium avium subsp. paratuberculosis
gcaguccggcgguca

SEQ ID NO: 828300 - RNA, 12 nt, Mycobacterium avium subsp. paratuberculosis
gcaguccgcgcc

SEQ ID NO: 828301 - RNA, 16 nt, Mycobacterium avium subsp. paratuberculosis
gcaguccgcgccgguc

SEQ ID NO: 828302 - RNA, 17 nt, Mycobacterium avium subsp. paratuberculosis
gcaguccgcgccggucc

SEQ ID NO: 828303 - RNA, 21 nt, Mycobacterium avium subsp. paratuberculosis
gcaguccgcgccggucccgcg

SEQ ID NO: 828304 - RNA, 20 nt, Mycobacterium avium subsp. paratuberculosis
gcaguccccgccuucgaugc

SEQ ID NO: 828305 - RNA, 23 nt, Mycobacterium avium subsp. paratuberculosis
gcagucccucgaucagccacacc

SEQ ID NO: 828306 - RNA, 13 nt, Mycobacterium avium subsp. paratuberculosis
gcagucggccgga

SEQ ID NO: 828307 - RNA, 15 nt, Mycobacterium avium subsp. paratuberculosis
gcagucggcgucgcg

SEQ ID NO: 828308 - RNA, 18 nt, Mycobacterium avium subsp. paratuberculosis
gcagucggcgucgcggcg

SEQ ID NO: 828309 - RNA, 15 nt, Mycobacterium avium subsp. paratuberculosis
gcagucgugacgcgg

SEQ ID NO: 828310 - RNA, 21 nt, Mycobacterium avium subsp. paratuberculosis
gcagucgugacgcggcgucgg

SEQ ID NO: 828311 - RNA, 22 nt, Mycobacterium avium subsp. paratuberculosis
gcagucgugacgcggcgucggg

SEQ ID NO: 828312 - RNA, 12 nt, Mycobacterium avium subsp. paratuberculosis
gcagucgaucac

SEQ ID NO: 828313 - RNA, 17 nt, Mycobacterium avium subsp. paratuberculosis
gcagucgaucagcgacg

SEQ ID NO: 828314 - RNA, 18 nt, Mycobacterium avium subsp. paratuberculosis
gcagucgaucagcgacgg

SEQ ID NO: 828315 - RNA, 13 nt, Mycobacterium avium subsp. paratuberculosis
gcagucgcagcag

SEQ ID NO: 828316 - RNA, 14 nt, Mycobacterium avium subsp. paratuberculosis
gcagucgcagcagc

SEQ ID NO: 828317 - RNA, 21 nt, Mycobacterium avium subsp. paratuberculosis
gcagucgcagcagcagcccga

SEQ ID NO: 828318 - RNA, 14 nt, Mycobacterium avium subsp. paratuberculosis
gcagucgcaggccc

SEQ ID NO: 828319 - RNA, 22 nt, Mycobacterium avium subsp. paratuberculosis
gcagucgcaggccccggauccg

SEQ ID NO: 828320 - RNA, 15 nt, Mycobacterium avium subsp. paratuberculosis
gcagggucagcagca

SEQ ID NO: 828321 - RNA, 21 nt, Mycobacterium avium subsp. paratuberculosis
gcagggucagcagcacccggu

SEQ ID NO: 828322 - RNA, 13 nt, Mycobacterium avium subsp. paratuberculosis
gcagggggcgcag

SEQ ID NO: 828323 - RNA, 23 nt, Mycobacterium avium subsp. paratuberculosis
gcagggggcgcagccgaucgacg

SEQ ID NO: 828324 - RNA, 17 nt, Mycobacterium avium subsp. paratuberculosis
gcagguuggggacggcg

SEQ ID NO: 828325 - RNA, 19 nt, Mycobacterium avium subsp. paratuberculosis
gcagguuggggacggcgag

SEQ ID NO: 828326 - RNA, 22 nt, Mycobacterium avium subsp. paratuberculosis
gcagggugaccgaggccgcccg

SEQ ID NO: 828327 - RNA, 15 nt, Mycobacterium avium subsp. paratuberculosis
gcagguugcgcugga

SEQ ID NO: 828328 - RNA, 18 nt, Mycobacterium avium subsp. paratuberculosis
gcagggucgagaucagca

SEQ ID NO: 828329 - RNA, 23 nt, Mycobacterium avium subsp. paratuberculosis
gcagggucgagaucagcaccggg

SEQ ID NO: 828330 - RNA, 15 nt, Mycobacterium avium subsp. paratuberculosis
gcaguacgcaucggc

SEQ ID NO: 828331 - RNA, 18 nt, Mycobacterium avium subsp. paratuberculosis
gcaguacgcaucggcgcc

SEQ ID NO: 828332 - RNA, 17 nt, Mycobacterium avium subsp. paratuberculosis
gcagguuguccagccgg

SEQ ID NO: 828333 - RNA, 19 nt, Mycobacterium avium subsp. paratuberculosis
gcagguuguccagccggug

SEQ ID NO: 828334 - RNA, 21 nt, Mycobacterium avium subsp. paratuberculosis
gcagguuguccagccggugca

SEQ ID NO: 828335 - RNA, 16 nt, Mycobacterium avium subsp. paratuberculosis
gcagguugucggccaa

SEQ ID NO: 828336 - RNA, 19 nt, Mycobacterium avium subsp. paratuberculosis
gcaguagugguccaccgcc

SEQ ID NO: 828337 - RNA, 20 nt, Mycobacterium avium subsp. paratuberculosis
gcaguagacgccgccgugga

SEQ ID NO: 828338 - RNA, 17 nt, Mycobacterium avium subsp. paratuberculosis
gcaguagcaucggggau

SEQ ID NO: 828339 - RNA, 21 nt, Mycobacterium avium subsp. paratuberculosis
gcaguagccgaucuccaccga

SEQ ID NO: 828340 - RNA, 13 nt, Mycobacterium avium subsp. paratuberculosis
gcaguagcgacgc

SEQ ID NO: 828341 - RNA, 20 nt, Mycobacterium avium subsp. paratuberculosis
gcaguagcgacgcgacgcgc

SEQ ID NO: 828342 - RNA, 15 nt, Mycobacterium avium subsp. paratuberculosis
gcaguagcgcaccgg

SEQ ID NO: 828343 - RNA, 23 nt, Mycobacterium avium subsp. paratuberculosis
gcaguagcgcaccggucagcgcu

SEQ ID NO: 828344 - RNA, 16 nt, Mycobacterium avium subsp. paratuberculosis
gcaguagcgcauaggc

SEQ ID NO: 828345 - RNA, 21 nt, Mycobacterium avium subsp. paratuberculosis
gcaguagcgcauaggccgcga

SEQ ID NO: 828346 - RNA, 16 nt, Mycobacterium avium subsp. paratuberculosis
gcaguacgcgccggcc

SEQ ID NO: 828347 - RNA, 22 nt, Mycobacterium avium subsp. paratuberculosis
gcaguaucuuguucgccgacac

SEQ ID NO: 828348 - RNA, 15 nt, Mycobacterium avium subsp. paratuberculosis
gcaggcccaacguga

SEQ ID NO: 828349 - RNA, 22 nt, Mycobacterium avium subsp. paratuberculosis
gcaggccaggugcagcugcauc

SEQ ID NO: 828350 - RNA, 16 nt, Mycobacterium avium subsp. paratuberculosis
gcaggcccucggccag

SEQ ID NO: 828351 - RNA, 17 nt, Mycobacterium avium subsp. paratuberculosis
gcaggcccucggccagc

SEQ ID NO: 828352 - RNA, 14 nt, Mycobacterium avium subsp. paratuberculosis
gcaggcccgggcgg

SEQ ID NO: 828353 - RNA, 17 nt, Mycobacterium avium subsp. paratuberculosis
gcaggcccgggcggcga

SEQ ID NO: 828354 - RNA, 20 nt, Mycobacterium avium subsp. paratuberculosis
gcaggcccggguagcgcagc

SEQ ID NO: 828355 - RNA, 18 nt, Mycobacterium avium subsp. paratuberculosis
gcaggcccgagcccgacg

SEQ ID NO: 828356 - RNA, 13 nt, Mycobacterium avium subsp. paratuberculosis
gcaggccccgggg

SEQ ID NO: 828357 - RNA, 23 nt, Mycobacterium avium subsp. paratuberculosis
gcaggccccggauccgucgcccc

SEQ ID NO: 828358 - RNA, 24 nt, Mycobacterium avium subsp. paratuberculosis
gcaggccccggauccgucgccccg

SEQ ID NO: 828359 - RNA, 12 nt, Mycobacterium avium subsp. paratuberculosis
gcaggccccggc

SEQ ID NO: 828360 - RNA, 15 nt, Mycobacterium avium subsp. paratuberculosis
gcaggcgagccgaca

SEQ ID NO: 828361 - RNA, 22 nt, Mycobacterium avium subsp. paratuberculosis
gcaggcgaaggugggcagcgcc

SEQ ID NO: 828362 - RNA, 23 nt, Mycobacterium avium subsp. paratuberculosis
gcaggcgaaggugggcagcgcca

SEQ ID NO: 828363 - RNA, 13 nt, Mycobacterium avium subsp. paratuberculosis
gcaggcgacccgc

SEQ ID NO: 828364 - RNA, 16 nt, Mycobacterium avium subsp. paratuberculosis
gcaggcgacccgcacc

SEQ ID NO: 828365 - RNA, 22 nt, Mycobacterium avium subsp. paratuberculosis
gcaggcgacccgcaccgaaauc

SEQ ID NO: 828366 - RNA, 18 nt, Mycobacterium avium subsp. paratuberculosis
gcaggcggaccugggugc

SEQ ID NO: 828367 - RNA, 14 nt, Mycobacterium avium subsp. paratuberculosis
gcaggcggacggcg

SEQ ID NO: 828368 - RNA, 17 nt, Mycobacterium avium subsp. paratuberculosis
gcaggcggacggcgacc

SEQ ID NO: 828369 - RNA, 15 nt, Mycobacterium avium subsp. paratuberculosis
gcaggcggccagcac

SEQ ID NO: 828370 - RNA, 16 nt, Mycobacterium avium subsp. paratuberculosis
gcaggcggccagcacc

SEQ ID NO: 828371 - RNA, 17 nt, Mycobacterium avium subsp. paratuberculosis
gcaggcggaucggcccg

SEQ ID NO: 828372 - RNA, 22 nt, Mycobacterium avium subsp. paratuberculosis
gcaggcgcuggguguuccccgg

SEQ ID NO: 828373 - RNA, 12 nt, Mycobacterium avium subsp. paratuberculosis
gcaggcgauggc

SEQ ID NO: 828374 - RNA, 13 nt, Mycobacterium avium subsp. paratuberculosis
gcaggcgauggcg

SEQ ID NO: 828375 - RNA, 16 nt, Mycobacterium avium subsp. paratuberculosis
gcaggcgauggugccg

SEQ ID NO: 828376 - RNA, 17 nt, Mycobacterium avium subsp. paratuberculosis
gcaggcuggcggcgauc

SEQ ID NO: 828377 - RNA, 19 nt, Mycobacterium avium subsp. paratuberculosis
gcaggcuggcaucgucggc

SEQ ID NO: 828378 - RNA, 17 nt, Mycobacterium avium subsp. paratuberculosis
gcaggcuggcaugccgg

SEQ ID NO: 828379 - RNA, 19 nt, Mycobacterium avium subsp. paratuberculosis
gcaggcggccagggcggcg

SEQ ID NO: 828380 - RNA, 19 nt, Mycobacterium avium subsp. paratuberculosis
gcaggcggcgcgcagccgg

SEQ ID NO: 828381 - RNA, 20 nt, Mycobacterium avium subsp. paratuberculosis
gcaggcggcgcgcagccggc

SEQ ID NO: 828382 - RNA, 21 nt, Mycobacterium avium subsp. paratuberculosis
gcaggcggcgcgcagccggcc

SEQ ID NO: 828383 - RNA, 14 nt, Mycobacterium avium subsp. paratuberculosis
gcaggcggcgcgcc

SEQ ID NO: 828384 - RNA, 14 nt, Mycobacterium avium subsp. paratuberculosis
gcagggaauucagc

SEQ ID NO: 828385 - RNA, 16 nt, Mycobacterium avium subsp. paratuberculosis
gcagggauucggccau

SEQ ID NO: 828386 - RNA, 14 nt, Mycobacterium avium subsp. paratuberculosis
gcagggcaccgacg

SEQ ID NO: 828387 - RNA, 15 nt, Mycobacterium avium subsp. paratuberculosis
gcagggcaccgacgg

SEQ ID NO: 828388 - RNA, 18 nt, Mycobacterium avium subsp. paratuberculosis
gcagggcaccgacggccg

SEQ ID NO: 828389 - RNA, 17 nt, Mycobacterium avium subsp. paratuberculosis
gcagggccagcggcaac

SEQ ID NO: 828390 - RNA, 19 nt, Mycobacterium avium subsp. paratuberculosis
gcagggccagcggcaacug

SEQ ID NO: 828391 - RNA, 17 nt, Mycobacterium avium subsp. paratuberculosis
gcagggccgcuacgccg

SEQ ID NO: 828392 - RNA, 19 nt, Mycobacterium avium subsp. paratuberculosis
gcagggccagcgccucggc

SEQ ID NO: 828393 - RNA, 17 nt, Mycobacterium avium subsp. paratuberculosis
gcagggccaccgucagg

SEQ ID NO: 828394 - RNA, 14 nt, Mycobacterium avium subsp. paratuberculosis
gcagggccagcagc

SEQ ID NO: 828395 - RNA, 17 nt, Mycobacterium avium subsp. paratuberculosis
gcagggcaucucccgcg

SEQ ID NO: 828396 - RNA, 15 nt, Mycobacterium avium subsp. paratuberculosis
gcagggccagcagcc

SEQ ID NO: 828397 - RNA, 19 nt, Mycobacterium avium subsp. paratuberculosis
gcagcuguucgggcagaug

SEQ ID NO: 828398 - RNA, 19 nt, Mycobacterium avium subsp. paratuberculosis
gcagcuucaugcccgcgaa

SEQ ID NO: 828399 - RNA, 16 nt, Mycobacterium avium subsp. paratuberculosis
gcagcuuccgccucgg

SEQ ID NO: 828400 - RNA, 20 nt, Mycobacterium avium subsp. paratuberculosis
gcagcuuccgccucggcgag

SEQ ID NO: 828401 - RNA, 19 nt, Mycobacterium avium subsp. paratuberculosis
gcagcuucgugucaccgcc

SEQ ID NO: 828402 - RNA, 15 nt, Mycobacterium avium subsp. paratuberculosis
gcagcuucuggucau

SEQ ID NO: 828403 - RNA, 21 nt, Mycobacterium avium subsp. paratuberculosis
gcagcuugacgucggucagca

SEQ ID NO: 828404 - RNA, 21 nt, Mycobacterium avium subsp. paratuberculosis
gcagcuggaaauaggccgggc

SEQ ID NO: 828405 - RNA, 23 nt, Mycobacterium avium subsp. paratuberculosis
gcagcuggaacaccacggccggc

SEQ ID NO: 828406 - RNA, 16 nt, Mycobacterium avium subsp. paratuberculosis
gcagcugcugcggccg

SEQ ID NO: 828407 - RNA, 18 nt, Mycobacterium avium subsp. paratuberculosis
gcagcugcugcggccgga

SEQ ID NO: 828408 - RNA, 21 nt, Mycobacterium avium subsp. paratuberculosis
gcagcuggccgugcaccgucg

SEQ ID NO: 828409 - RNA, 12 nt, Mycobacterium avium subsp. paratuberculosis
gcagcuggcgaa

SEQ ID NO: 828410 - RNA, 14 nt, Mycobacterium avium subsp. paratuberculosis
gcagcuuggcggug

SEQ ID NO: 828411 - RNA, 15 nt, Mycobacterium avium subsp. paratuberculosis
gcagcuuggcggugg

SEQ ID NO: 828412 - RNA, 18 nt, Mycobacterium avium subsp. paratuberculosis
gcagcuugggggccgacg

SEQ ID NO: 828413 - RNA, 20 nt, Mycobacterium avium subsp. paratuberculosis
gcagcuugggggccgacgcu

SEQ ID NO: 828414 - RNA, 15 nt, Mycobacterium avium subsp. paratuberculosis
gcagcuugaucgccg

SEQ ID NO: 828415 - RNA, 20 nt, Mycobacterium avium subsp. paratuberculosis
gcagcuugaucgccggggcg

SEQ ID NO: 828416 - RNA, 22 nt, Mycobacterium avium subsp. paratuberculosis
gcaggaaccgcgagcagacgcg

SEQ ID NO: 828417 - RNA, 19 nt, Mycobacterium avium subsp. paratuberculosis
gcaggaaccgggucagcac

SEQ ID NO: 828418 - RNA, 21 nt, Mycobacterium avium subsp. paratuberculosis
gcaggaacagacacagcacgc

SEQ ID NO: 828419 - RNA, 16 nt, Mycobacterium avium subsp. paratuberculosis
gcaggaacuccagcag

SEQ ID NO: 828420 - RNA, 17 nt, Mycobacterium avium subsp. paratuberculosis
gcaggauccgcucgacg

SEQ ID NO: 828421 - RNA, 15 nt, Mycobacterium avium subsp. paratuberculosis
gcaggauccggacga

SEQ ID NO: 828422 - RNA, 13 nt, Mycobacterium avium subsp. paratuberculosis
gcaggaucgcggu

SEQ ID NO: 828423 - RNA, 15 nt, Mycobacterium avium subsp. paratuberculosis
gcaggaucgcgguga

SEQ ID NO: 828424 - RNA, 22 nt, Mycobacterium avium subsp. paratuberculosis
gcaggaucgcggugaccgccgc

SEQ ID NO: 828425 - RNA, 23 nt, Mycobacterium avium subsp. paratuberculosis
gcaggaucgagccggccgucagg

SEQ ID NO: 828426 - RNA, 18 nt, Mycobacterium avium subsp. paratuberculosis
gcaggaugaccgcgucgg

SEQ ID NO: 828427 - RNA, 19 nt, Mycobacterium avium subsp. paratuberculosis
gcaggaugaccgcgucggc

SEQ ID NO: 828428 - RNA, 17 nt, Mycobacterium avium subsp. paratuberculosis
gcaggaugaugaccgac

SEQ ID NO: 828429 - RNA, 17 nt, Mycobacterium avium subsp. paratuberculosis
gcaggaugcccagcacc

SEQ ID NO: 828430 - RNA, 15 nt, Mycobacterium avium subsp. paratuberculosis
gcaggauggucagcg

SEQ ID NO: 828431 - RNA, 15 nt, Mycobacterium avium subsp. paratuberculosis
gcaggaugcguuggc

SEQ ID NO: 828432 - RNA, 17 nt, Mycobacterium avium subsp. paratuberculosis
gcaggaugcguuggccg

SEQ ID NO: 828433 - RNA, 23 nt, Mycobacterium avium subsp. paratuberculosis
gcaggaugcguuggccgagcagc

SEQ ID NO: 828434 - RNA, 16 nt, Mycobacterium avium subsp. paratuberculosis
gcaggagaucggcgcg

SEQ ID NO: 828435 - RNA, 22 nt, Mycobacterium avium subsp. paratuberculosis
gcaggagaucggcgcggagcgu

SEQ ID NO: 828436 - RNA, 13 nt, Mycobacterium avium subsp. paratuberculosis
gcaggacgggggc

SEQ ID NO: 828437 - RNA, 17 nt, Mycobacterium avium subsp. paratuberculosis
gcaggacgggggccggu

SEQ ID NO: 828438 - RNA, 15 nt, Mycobacterium avium subsp. paratuberculosis
gcaggacgguggccg

SEQ ID NO: 828439 - RNA, 16 nt, Mycobacterium avium subsp. paratuberculosis
gcaggacgguggccgu

SEQ ID NO: 828440 - RNA, 18 nt, Mycobacterium avium subsp. paratuberculosis
gcaggacgcgcccggcga

SEQ ID NO: 828441 - RNA, 20 nt, Mycobacterium avium subsp. paratuberculosis
gcaggacgcgcccggcgacg

SEQ ID NO: 828442 - RNA, 23 nt, Mycobacterium avium subsp. paratuberculosis
gcaggacgcgcccggcgacgcgg

SEQ ID NO: 828443 - RNA, 17 nt, Mycobacterium avium subsp. paratuberculosis
gcaggacccguugucgg

SEQ ID NO: 828444 - RNA, 14 nt, Mycobacterium avium subsp. paratuberculosis
gcaggaccgagccg

SEQ ID NO: 828445 - RNA, 22 nt, Mycobacterium avium subsp. paratuberculosis
gcaggaccgagccgcgcgccga

SEQ ID NO: 828446 - RNA, 15 nt, Mycobacterium avium subsp. paratuberculosis
gcaggaccuugucgg

SEQ ID NO: 828447 - RNA, 22 nt, Mycobacterium avium subsp. paratuberculosis
gcaggaccuugucgggccgcgg

SEQ ID NO: 828448 - RNA, 15 nt, Mycobacterium avium subsp. paratuberculosis
gcaggaauuccagcg

SEQ ID NO: 828449 - RNA, 15 nt, Mycobacterium avium subsp. paratuberculosis
gcagcacugagcggc

SEQ ID NO: 828450 - RNA, 15 nt, Mycobacterium avium subsp. paratuberculosis
gcagcacgucguagg

SEQ ID NO: 828451 - RNA, 14 nt, Mycobacterium avium subsp. paratuberculosis
gcagcaccgccagc

SEQ ID NO: 828452 - RNA, 15 nt, Mycobacterium avium subsp. paratuberculosis
gcagcaccgccagca

SEQ ID NO: 828453 - RNA, 17 nt, Mycobacterium avium subsp. paratuberculosis
gcagcaccgccagcauc

SEQ ID NO: 828454 - RNA, 13 nt, Mycobacterium avium subsp. paratuberculosis
gcagcaccggcgc

SEQ ID NO: 828455 - RNA, 15 nt, Mycobacterium avium subsp. paratuberculosis
gcagcaccuccgaca

SEQ ID NO: 828456 - RNA, 15 nt, Mycobacterium avium subsp. paratuberculosis
gcagcacguccccgg

SEQ ID NO: 828457 - RNA, 15 nt, Mycobacterium avium subsp. paratuberculosis
gcagcagaccgccgg

SEQ ID NO: 828458 - RNA, 23 nt, Mycobacterium avium subsp. paratuberculosis
gcagcagaccgccggugcgcagc

SEQ ID NO: 828459 - RNA, 15 nt, Mycobacterium avium subsp. paratuberculosis
gcagcagaccgcgau

SEQ ID NO: 828460 - RNA, 19 nt, Mycobacterium avium subsp. paratuberculosis
gcagcagaaccagcaccgc

SEQ ID NO: 828461 - RNA, 21 nt, Mycobacterium avium subsp. paratuberculosis
gcagcagaaccagcaccgccg

SEQ ID NO: 828462 - RNA, 22 nt, Mycobacterium avium subsp. paratuberculosis
gcagcagaaccagcaccgccgc

SEQ ID NO: 828463 - RNA, 21 nt, Mycobacterium avium subsp. paratuberculosis
gcagcaggugcaucgaccggc

SEQ ID NO: 828464 - RNA, 18 nt, Mycobacterium avium subsp. paratuberculosis
gcagcaggugcaucgcca

SEQ ID NO: 828465 - RNA, 23 nt, Mycobacterium avium subsp. paratuberculosis
gcagcagguuguagucggcgccg

SEQ ID NO: 828466 - RNA, 17 nt, Mycobacterium avium subsp. paratuberculosis
gcagcaggucggccagc

SEQ ID NO: 828467 - RNA, 14 nt, Mycobacterium avium subsp. paratuberculosis
gcagcaggucggcg

SEQ ID NO: 828468 - RNA, 15 nt, Mycobacterium avium subsp. paratuberculosis
gcagcaggucggcgu

SEQ ID NO: 828469 - RNA, 16 nt, Mycobacterium avium subsp. paratuberculosis
gcagcaggucggcgug

SEQ ID NO: 828470 - RNA, 21 nt, Mycobacterium avium subsp. paratuberculosis
gcagcaggucggcgugcucgu

SEQ ID NO: 828471 - RNA, 14 nt, Mycobacterium avium subsp. paratuberculosis
gcagcaggucgucg

SEQ ID NO: 828472 - RNA, 15 nt, Mycobacterium avium subsp. paratuberculosis
gcagcaggucgucga

SEQ ID NO: 828473 - RNA, 20 nt, Mycobacterium avium subsp. paratuberculosis
gcagcaggugcaucgccacc

SEQ ID NO: 828474 - RNA, 24 nt, Mycobacterium avium subsp. paratuberculosis
gcagcaggugcaucgccaccgucg

SEQ ID NO: 828475 - RNA, 14 nt, Mycobacterium avium subsp. paratuberculosis
gcagcaggugcgcc

SEQ ID NO: 828476 - RNA, 18 nt, Mycobacterium avium subsp. paratuberculosis
gcagcagguaaaccagca

SEQ ID NO: 828477 - RNA, 20 nt, Mycobacterium avium subsp. paratuberculosis
gcagcagguaaaccagcagc

SEQ ID NO: 828478 - RNA, 22 nt, Mycobacterium avium subsp. paratuberculosis
gcagcagguaaaccagcagcgc

SEQ ID NO: 828479 - RNA, 18 nt, Mycobacterium avium subsp. paratuberculosis
gcagcagggugccgccgc

SEQ ID NO: 828480 - RNA, 16 nt, Mycobacterium avium subsp. paratuberculosis
gcagcaggcggacggc

SEQ ID NO: 828481 - RNA, 15 nt, Mycobacterium avium subsp. paratuberculosis
gcagcagggcgcgca

SEQ ID NO: 828482 - RNA, 13 nt, Mycobacterium avium subsp. paratuberculosis
gcagcaggcgccg

SEQ ID NO: 828483 - RNA, 16 nt, Mycobacterium avium subsp. paratuberculosis
gcagcaggcgccgguc

SEQ ID NO: 828484 - RNA, 15 nt, Mycobacterium avium subsp. paratuberculosis
gcagccaaccgccgg

SEQ ID NO: 828485 - RNA, 17 nt, Mycobacterium avium subsp. paratuberculosis
gcagccaaccgccgggg

SEQ ID NO: 828486 - RNA, 18 nt, Mycobacterium avium subsp. paratuberculosis
gcagccaaccgccgggga

SEQ ID NO: 828487 - RNA, 12 nt, Mycobacterium avium subsp. paratuberculosis
gcagccaccgcc

SEQ ID NO: 828488 - RNA, 15 nt, Mycobacterium avium subsp. paratuberculosis
gcagccaccgcccga

SEQ ID NO: 828489 - RNA, 16 nt, Mycobacterium avium subsp. paratuberculosis
gcagccacgagcccag

SEQ ID NO: 828490 - RNA, 21 nt, Mycobacterium avium subsp. paratuberculosis
gcagccacgagcccagccguc

SEQ ID NO: 828491 - RNA, 17 nt, Mycobacterium avium subsp. paratuberculosis
gcagccagaccucgccg

SEQ ID NO: 828492 - RNA, 19 nt, Mycobacterium avium subsp. paratuberculosis
gcagccagaccucgccgac

SEQ ID NO: 828493 - RNA, 16 nt, Mycobacterium avium subsp. paratuberculosis
gcagccagcccagccg

SEQ ID NO: 828494 - RNA, 17 nt, Mycobacterium avium subsp. paratuberculosis
gcagccagcccagccgc

SEQ ID NO: 828495 - RNA, 21 nt, Mycobacterium avium subsp. paratuberculosis
gcagccagcccagccgccagc

SEQ ID NO: 828496 - RNA, 12 nt, Mycobacterium avium subsp. paratuberculosis
gcagccagcccg

SEQ ID NO: 828497 - RNA, 13 nt, Mycobacterium avium subsp. paratuberculosis
gcagccagcccgc

SEQ ID NO: 828498 - RNA, 12 nt, Mycobacterium avium subsp. paratuberculosis
gcagccacgcgc

SEQ ID NO: 828499 - RNA, 14 nt, Mycobacterium avium subsp. paratuberculosis
gcagccacccgucg

SEQ ID NO: 828500 - RNA, 17 nt, Mycobacterium avium subsp. paratuberculosis
gcagccacccgucggug

SEQ ID NO: 828501 - RNA, 14 nt, Mycobacterium avium subsp. paratuberculosis
gcagccacgccagc

SEQ ID NO: 828502 - RNA, 17 nt, Mycobacterium avium subsp. paratuberculosis
gcagccacgccagccag

SEQ ID NO: 828503 - RNA, 19 nt, Mycobacterium avium subsp. paratuberculosis
gcagccacgccagccaggc

SEQ ID NO: 828504 - RNA, 14 nt, Mycobacterium avium subsp. paratuberculosis
gcagcauguuggcg

SEQ ID NO: 828505 - RNA, 16 nt, Mycobacterium avium subsp. paratuberculosis
gcagcauucgccgggg

SEQ ID NO: 828506 - RNA, 21 nt, Mycobacterium avium subsp. paratuberculosis
gcagcauucgccggggucgcg

SEQ ID NO: 828507 - RNA, 22 nt, Mycobacterium avium subsp. paratuberculosis
gcagcaucucuugaugcagcgc

SEQ ID NO: 828508 - RNA, 22 nt, Mycobacterium avium subsp. paratuberculosis
gcagcaugccgagcaccuccga

SEQ ID NO: 828509 - RNA, 23 nt, Mycobacterium avium subsp. paratuberculosis
gcagcauggacccgaagucgacg

SEQ ID NO: 828510 - RNA, 20 nt, Mycobacterium avium subsp. paratuberculosis
gcagcauccagguggcgccu

SEQ ID NO: 828511 - RNA, 14 nt, Mycobacterium avium subsp. paratuberculosis
gcagcauccgcacc

SEQ ID NO: 828512 - RNA, 15 nt, Mycobacterium avium subsp. paratuberculosis
gcagcauccgcacca

SEQ ID NO: 828513 - RNA, 16 nt, Mycobacterium avium subsp. paratuberculosis
gcagcauccgcaccag

SEQ ID NO: 828514 - RNA, 16 nt, Mycobacterium avium subsp. paratuberculosis
gcagcauccgccgacg

SEQ ID NO: 828515 - RNA, 18 nt, Mycobacterium avium subsp. paratuberculosis
gcagcauccgccgacgau

SEQ ID NO: 828516 - RNA, 13 nt, Mycobacterium avium subsp. paratuberculosis
gcagcaucgggac

SEQ ID NO: 828517 - RNA, 20 nt, Mycobacterium avium subsp. paratuberculosis
gcagcaucgggacgccugcc

SEQ ID NO: 828518 - RNA, 13 nt, Mycobacterium avium subsp. paratuberculosis
gcagcaucggcag

SEQ ID NO: 828519 - RNA, 15 nt, Mycobacterium avium subsp. paratuberculosis
gcagcaucggcagau

SEQ ID NO: 828520 - RNA, 12 nt, Mycobacterium avium subsp. paratuberculosis
gcagaucgccag

SEQ ID NO: 828521 - RNA, 16 nt, Mycobacterium avium subsp. paratuberculosis
gcagaucgccagcacc

SEQ ID NO: 828522 - RNA, 17 nt, Mycobacterium avium subsp. paratuberculosis
gcagaucgucgaacucg

SEQ ID NO: 828523 - RNA, 14 nt, Mycobacterium avium subsp. paratuberculosis
gcagaucgucgacc

SEQ ID NO: 828524 - RNA, 16 nt, Mycobacterium avium subsp. paratuberculosis
gcagaucgcggcccgc

SEQ ID NO: 828525 - RNA, 19 nt, Mycobacterium avium subsp. paratuberculosis
gcagaucgcggcccgccgc

SEQ ID NO: 828526 - RNA, 23 nt, Mycobacterium avium subsp. paratuberculosis
gcagaucgcggcccgccgcucac

SEQ ID NO: 828527 - RNA, 19 nt, Mycobacterium avium subsp. paratuberculosis
gcagaugaugccgucacug

SEQ ID NO: 828528 - RNA, 23 nt, Mycobacterium avium subsp. paratuberculosis
gcagcacaccuuccaccaccgcg

SEQ ID NO: 828529 - RNA, 17 nt, Mycobacterium avium subsp. paratuberculosis
gcagcaauugacgccga

SEQ ID NO: 828530 - RNA, 16 nt, Mycobacterium avium subsp. paratuberculosis
gcagcaccgcgucggc

SEQ ID NO: 828531 - RNA, 17 nt, Mycobacterium avium subsp. paratuberculosis
gcagcaccgcgucggcg

SEQ ID NO: 828532 - RNA, 19 nt, Mycobacterium avium subsp. paratuberculosis
gcagcaccgcgucggcgcu

SEQ ID NO: 828533 - RNA, 17 nt, Mycobacterium avium subsp. paratuberculosis
gcagcaccggcaccgcg

SEQ ID NO: 828534 - RNA, 18 nt, Mycobacterium avium subsp. paratuberculosis
gcagcaccggcaccgcgg

SEQ ID NO: 828535 - RNA, 13 nt, Mycobacterium avium subsp. paratuberculosis
gcagcaccgccga

SEQ ID NO: 828536 - RNA, 15 nt, Mycobacterium avium subsp. paratuberculosis
gcagcaccgccgaca

SEQ ID NO: 828537 - RNA, 16 nt, Mycobacterium avium subsp. paratuberculosis
gcagcaccgccgagcc

SEQ ID NO: 828538 - RNA, 14 nt, Mycobacterium avium subsp. paratuberculosis
gcagcaccgcgacc

SEQ ID NO: 828539 - RNA, 15 nt, Mycobacterium avium subsp. paratuberculosis
gcagcaccgcgaccg

SEQ ID NO: 828540 - RNA, 15 nt, Mycobacterium avium subsp. paratuberculosis
gcagcacccgcaccg

SEQ ID NO: 828541 - RNA, 15 nt, Mycobacterium avium subsp. paratuberculosis
gcagcacccgggccu

SEQ ID NO: 828542 - RNA, 20 nt, Mycobacterium avium subsp. paratuberculosis
gcagcacccgggccugcggc

SEQ ID NO: 828543 - RNA, 22 nt, Mycobacterium avium subsp. paratuberculosis
gcagcacccgggccugcggcgg

SEQ ID NO: 828544 - RNA, 15 nt, Mycobacterium avium subsp. paratuberculosis
gcagcacccggucgc

SEQ ID NO: 828545 - RNA, 16 nt, Mycobacterium avium subsp. paratuberculosis
gcagcacccggucgcc

SEQ ID NO: 828546 - RNA, 18 nt, Mycobacterium avium subsp. paratuberculosis
gcagcaccaggcccuccu

SEQ ID NO: 828547 - RNA, 21 nt, Mycobacterium avium subsp. paratuberculosis
gcagcaccaggcccucgccgc

SEQ ID NO: 828548 - RNA, 20 nt, Mycobacterium avium subsp. paratuberculosis
gcagcacccggucgccggug

SEQ ID NO: 828549 - RNA, 16 nt, Mycobacterium avium subsp. paratuberculosis
gcagcaccgaaccggc

SEQ ID NO: 828550 - RNA, 17 nt, Mycobacterium avium subsp. paratuberculosis
gcagcaccgaaccggcg

SEQ ID NO: 828551 - RNA, 19 nt, Mycobacterium avium subsp. paratuberculosis
gcagcaccgaaccggcggg

SEQ ID NO: 828552 - RNA, 15 nt, Mycobacterium avium subsp. paratuberculosis
gcagcacccgacuuc

SEQ ID NO: 828553 - RNA, 12 nt, Mycobacterium avium subsp. paratuberculosis
gcagcacccgca

SEQ ID NO: 828554 - RNA, 13 nt, Mycobacterium avium subsp. paratuberculosis
gcagcacccgcac

SEQ ID NO: 828555 - RNA, 14 nt, Mycobacterium avium subsp. paratuberculosis
gcagcacccgcacc

SEQ ID NO: 828556 - RNA, 13 nt, Mycobacterium avium subsp. paratuberculosis
gcagcaccacgaa

SEQ ID NO: 828557 - RNA, 23 nt, Mycobacterium avium subsp. paratuberculosis
gcagcaccaggcugaccagcgcc

SEQ ID NO: 828558 - RNA, 12 nt, Mycobacterium avium subsp. paratuberculosis
gcagcaccagcg

SEQ ID NO: 828559 - RNA, 14 nt, Mycobacterium avium subsp. paratuberculosis
gcagcaccagcggc

SEQ ID NO: 828560 - RNA, 17 nt, Mycobacterium avium subsp. paratuberculosis
gcagcaccagcggcacc

SEQ ID NO: 828561 - RNA, 15 nt, Mycobacterium avium subsp. paratuberculosis
gcagcaccagcgugg

SEQ ID NO: 828562 - RNA, 18 nt, Mycobacterium avium subsp. paratuberculosis
gcagcaccagcguggccg

SEQ ID NO: 828563 - RNA, 15 nt, Mycobacterium avium subsp. paratuberculosis
gcagcaccacccgca

SEQ ID NO: 828564 - RNA, 14 nt, Mycobacterium avium subsp. paratuberculosis
gcagcacauccagc

SEQ ID NO: 828565 - RNA, 16 nt, Mycobacterium avium subsp. paratuberculosis
gcagauccagaugccg

SEQ ID NO: 828566 - RNA, 17 nt, Mycobacterium avium subsp. paratuberculosis
gcagauccagaugccgg

SEQ ID NO: 828567 - RNA, 17 nt, Mycobacterium avium subsp. paratuberculosis
gcagaucaucgagggcg

SEQ ID NO: 828568 - RNA, 21 nt, Mycobacterium avium subsp. paratuberculosis
gcagaucaucgagggcguccu

SEQ ID NO: 828569 - RNA, 19 nt, Mycobacterium avium subsp. paratuberculosis
gcagaucagggcgauggcc

SEQ ID NO: 828570 - RNA, 16 nt, Mycobacterium avium subsp. paratuberculosis
gcagaucccgccggcg

SEQ ID NO: 828571 - RNA, 17 nt, Mycobacterium avium subsp. paratuberculosis
gcagaucccgccggcgg

SEQ ID NO: 828572 - RNA, 19 nt, Mycobacterium avium subsp. paratuberculosis
gcagaucccgccggcggcc

SEQ ID NO: 828573 - RNA, 20 nt, Mycobacterium avium subsp. paratuberculosis
gcagaucccgccggcggcca

SEQ ID NO: 828574 - RNA, 21 nt, Mycobacterium avium subsp. paratuberculosis
gcagaucccgccggcggccac

SEQ ID NO: 828575 - RNA, 23 nt, Mycobacterium avium subsp. paratuberculosis
gcagaucccgccggcggccacga

SEQ ID NO: 828576 - RNA, 20 nt, Mycobacterium avium subsp. paratuberculosis
gcagauccgcucgccgucgg

SEQ ID NO: 828577 - RNA, 14 nt, Mycobacterium avium subsp. paratuberculosis
gcagauagcccagc

SEQ ID NO: 828578 - RNA, 15 nt, Mycobacterium avium subsp. paratuberculosis
gcagauaggacccgg

SEQ ID NO: 828579 - RNA, 17 nt, Mycobacterium avium subsp. paratuberculosis
gcagauaggacccggcg

SEQ ID NO: 828580 - RNA, 15 nt, Mycobacterium avium subsp. paratuberculosis
gcagauaggcggcga

SEQ ID NO: 828581 - RNA, 16 nt, Mycobacterium avium subsp. paratuberculosis
gcagauaggcggcgac

SEQ ID NO: 828582 - RNA, 16 nt, Mycobacterium avium subsp. paratuberculosis
gcacucgauggcggcg

SEQ ID NO: 828583 - RNA, 19 nt, Mycobacterium avium subsp. paratuberculosis
gcacucgauggcggcgaug

SEQ ID NO: 828584 - RNA, 13 nt, Mycobacterium avium subsp. paratuberculosis
gcacucgagcguc

SEQ ID NO: 828585 - RNA, 16 nt, Mycobacterium avium subsp. paratuberculosis
gcacucgaucagcacc

SEQ ID NO: 828586 - RNA, 17 nt, Mycobacterium avium subsp. paratuberculosis
gcacucgaucagcaccg

SEQ ID NO: 828587 - RNA, 20 nt, Mycobacterium avium subsp. paratuberculosis
gcacucgaucagcaccgcca

SEQ ID NO: 828588 - RNA, 21 nt, Mycobacterium avium subsp. paratuberculosis
gcacucgaucagcaccgccac

SEQ ID NO: 828589 - RNA, 22 nt, Mycobacterium avium subsp. paratuberculosis
gcacucgaucagcaccgccacg

SEQ ID NO: 828590 - RNA, 16 nt, Mycobacterium avium subsp. paratuberculosis
gcacuccgucgcgauc

SEQ ID NO: 828591 - RNA, 18 nt, Mycobacterium avium subsp. paratuberculosis
gcacuccuugcugucggu

SEQ ID NO: 828592 - RNA, 13 nt, Mycobacterium avium subsp. paratuberculosis
gcacucgaacggc

SEQ ID NO: 828593 - RNA, 17 nt, Mycobacterium avium subsp. paratuberculosis
gcacucgaacggcccgg

SEQ ID NO: 828594 - RNA, 21 nt, Mycobacterium avium subsp. paratuberculosis
gcacucgccucggaggccacc

SEQ ID NO: 828595 - RNA, 18 nt, Mycobacterium avium subsp. paratuberculosis
gcacucgcgggacggcgg

SEQ ID NO: 828596 - RNA, 20 nt, Mycobacterium avium subsp. paratuberculosis
gcacucgcgggacggcggcg

SEQ ID NO: 828597 - RNA, 13 nt, Mycobacterium avium subsp. paratuberculosis
gcacucggcgaug

SEQ ID NO: 828598 - RNA, 22 nt, Mycobacterium avium subsp. paratuberculosis
gcagagcggugacaucgccacc

SEQ ID NO: 828599 - RNA, 12 nt, Mycobacterium avium subsp. paratuberculosis
gcagagcgguga

SEQ ID NO: 828600 - RNA, 20 nt, Mycobacterium avium subsp. paratuberculosis
gcagagcgaugggcgcgauc

SEQ ID NO: 828601 - RNA, 17 nt, Mycobacterium avium subsp. paratuberculosis
gcagcuccaucgacgga

SEQ ID NO: 828602 - RNA, 22 nt, Mycobacterium avium subsp. paratuberculosis
gcagcucauacagcggcgcgcg

SEQ ID NO: 828603 - RNA, 15 nt, Mycobacterium avium subsp. paratuberculosis
gcagcucccccggcg

SEQ ID NO: 828604 - RNA, 18 nt, Mycobacterium avium subsp. paratuberculosis
gcagcucccacucguagu

SEQ ID NO: 828605 - RNA, 15 nt, Mycobacterium avium subsp. paratuberculosis
gcagcuccggucggc

SEQ ID NO: 828606 - RNA, 17 nt, Mycobacterium avium subsp. paratuberculosis
gcagcuccucggcggcc

SEQ ID NO: 828607 - RNA, 18 nt, Mycobacterium avium subsp. paratuberculosis
gcagcuccucggcggccu

SEQ ID NO: 828608 - RNA, 20 nt, Mycobacterium avium subsp. paratuberculosis
gcagcuccucggcggccucg

SEQ ID NO: 828609 - RNA, 22 nt, Mycobacterium avium subsp. paratuberculosis
gcagcuccuugagccgccgcgg

SEQ ID NO: 828610 - RNA, 23 nt, Mycobacterium avium subsp. paratuberculosis
gcagcuccuugagccgccgcggc

SEQ ID NO: 828611 - RNA, 15 nt, Mycobacterium avium subsp. paratuberculosis
gcagcucgccggcgc

SEQ ID NO: 828612 - RNA, 17 nt, Mycobacterium avium subsp. paratuberculosis
gcagcucgccgguggcg

SEQ ID NO: 828613 - RNA, 20 nt, Mycobacterium avium subsp. paratuberculosis
gcagcucgccgguggcggcg

SEQ ID NO: 828614 - RNA, 14 nt, Mycobacterium avium subsp. paratuberculosis
gcagcucgcgcagc

SEQ ID NO: 828615 - RNA, 18 nt, Mycobacterium avium subsp. paratuberculosis
gcagcucgcgcagccggc

SEQ ID NO: 828616 - RNA, 20 nt, Mycobacterium avium subsp. paratuberculosis
gcagcucgcgcagccggccg

SEQ ID NO: 828617 - RNA, 18 nt, Mycobacterium avium subsp. paratuberculosis
gcagcucgcgcagcuggc

SEQ ID NO: 828618 - RNA, 18 nt, Mycobacterium avium subsp. paratuberculosis
gcagcucgacgaccucgc

SEQ ID NO: 828619 - RNA, 19 nt, Mycobacterium avium subsp. paratuberculosis
gcagcucgacgaccucgcc

SEQ ID NO: 828620 - RNA, 22 nt, Mycobacterium avium subsp. paratuberculosis
gcagcucgacgaccucgccgac

SEQ ID NO: 828621 - RNA, 23 nt, Mycobacterium avium subsp. paratuberculosis
gcagcucgacgaccucgccgacg

SEQ ID NO: 828622 - RNA, 17 nt, Mycobacterium avium subsp. paratuberculosis
gcagcucgaucacccag

SEQ ID NO: 828623 - RNA, 18 nt, Mycobacterium avium subsp. paratuberculosis
gcagcucgaucacccagg

SEQ ID NO: 828624 - RNA, 23 nt, Mycobacterium avium subsp. paratuberculosis
gcagcugaagugcacucggcgau

SEQ ID NO: 828625 - RNA, 17 nt, Mycobacterium avium subsp. paratuberculosis
gcagcugauagcccgcc

SEQ ID NO: 828626 - RNA, 19 nt, Mycobacterium avium subsp. paratuberculosis
gcagcugauagcccgccgc

SEQ ID NO: 828627 - RNA, 20 nt, Mycobacterium avium subsp. paratuberculosis
gcagcugauagcccgccgcg

SEQ ID NO: 828628 - RNA, 20 nt, Mycobacterium avium subsp. paratuberculosis
gcagcugaucggggcccacc

SEQ ID NO: 828629 - RNA, 14 nt, Mycobacterium avium subsp. paratuberculosis
gcagcugcaucucc

SEQ ID NO: 828630 - RNA, 21 nt, Mycobacterium avium subsp. paratuberculosis
gcagcugcaucuccguggacg

SEQ ID NO: 828631 - RNA, 15 nt, Mycobacterium avium subsp. paratuberculosis
gcagcugcccgagcg

SEQ ID NO: 828632 - RNA, 17 nt, Mycobacterium avium subsp. paratuberculosis
gcagcugcgcgucgaag

SEQ ID NO: 828633 - RNA, 16 nt, Mycobacterium avium subsp. paratuberculosis
gcagcugccgaacugg

SEQ ID NO: 828634 - RNA, 16 nt, Mycobacterium avium subsp. paratuberculosis
gcagcugcgucaugcc

SEQ ID NO: 828635 - RNA, 19 nt, Mycobacterium avium subsp. paratuberculosis
gcagcugcgucaugccgua

SEQ ID NO: 828636 - RNA, 20 nt, Mycobacterium avium subsp. paratuberculosis
gcagcugcgucggcaccagc

SEQ ID NO: 828637 - RNA, 18 nt, Mycobacterium avium subsp. paratuberculosis
gcagcucgggcagcccgc

SEQ ID NO: 828638 - RNA, 13 nt, Mycobacterium avium subsp. paratuberculosis
gcagcucggcggc

SEQ ID NO: 828639 - RNA, 15 nt, Mycobacterium avium subsp. paratuberculosis
gcagcucggcggccu

SEQ ID NO: 828640 - RNA, 16 nt, Mycobacterium avium subsp. paratuberculosis
gcagcucgcggauccg

SEQ ID NO: 828641 - RNA, 17 nt, Mycobacterium avium subsp. paratuberculosis
gcagcucgcugagcggg

SEQ ID NO: 828642 - RNA, 18 nt, Mycobacterium avium subsp. paratuberculosis
gcagcucgcugagcggga

SEQ ID NO: 828643 - RNA, 14 nt, Mycobacterium avium subsp. paratuberculosis
gcagcucgccgagc

SEQ ID NO: 828644 - RNA, 13 nt, Mycobacterium avium subsp. paratuberculosis
gcagcucgccggc

SEQ ID NO: 828645 - RNA, 23 nt, Mycobacterium avium subsp. paratuberculosis
gcagcucguugugaauccagccg

SEQ ID NO: 828646 - RNA, 14 nt, Mycobacterium avium subsp. paratuberculosis
gcagcucgucgacg

SEQ ID NO: 828647 - RNA, 16 nt, Mycobacterium avium subsp. paratuberculosis
gcagcucgucgacguc

SEQ ID NO: 828648 - RNA, 12 nt, Mycobacterium avium subsp. paratuberculosis
gcagcucgucgg

SEQ ID NO: 828649 - RNA, 19 nt, Mycobacterium avium subsp. paratuberculosis
gcagcucgucggcgcgcca

SEQ ID NO: 828650 - RNA, 23 nt, Mycobacterium avium subsp. paratuberculosis
gcagcucgucggcgcgccacccg

SEQ ID NO: 828651 - RNA, 13 nt, Mycobacterium avium subsp. paratuberculosis
gcagcucgucgug

SEQ ID NO: 828652 - RNA, 16 nt, Mycobacterium avium subsp. paratuberculosis
gcagcucggugcgcac

SEQ ID NO: 828653 - RNA, 15 nt, Mycobacterium avium subsp. paratuberculosis
gcagcucgguggccg

SEQ ID NO: 828654 - RNA, 22 nt, Mycobacterium avium subsp. paratuberculosis
gcagcucggggucggcgucggg

SEQ ID NO: 828655 - RNA, 15 nt, Mycobacterium avium subsp. paratuberculosis
gcagcucggucacca

SEQ ID NO: 828656 - RNA, 23 nt, Mycobacterium avium subsp. paratuberculosis
gcagcucggugcagaccccggcg

SEQ ID NO: 828657 - RNA, 18 nt, Mycobacterium avium subsp. paratuberculosis
gcagcggacccggucggc

SEQ ID NO: 828658 - RNA, 20 nt, Mycobacterium avium subsp. paratuberculosis
gcagcggacccggucggccg

SEQ ID NO: 828659 - RNA, 18 nt, Mycobacterium avium subsp. paratuberculosis
gcagcgcggauuccagcg

SEQ ID NO: 828660 - RNA, 19 nt, Mycobacterium avium subsp. paratuberculosis
gcagcgcggauuccagcgc

SEQ ID NO: 828661 - RNA, 21 nt, Mycobacterium avium subsp. paratuberculosis
gcagcgcggauuccagcgcga

SEQ ID NO: 828662 - RNA, 22 nt, Mycobacterium avium subsp. paratuberculosis
gcagcgcggauuccagcgcgac

SEQ ID NO: 828663 - RNA, 20 nt, Mycobacterium avium subsp. paratuberculosis
gcagcggcacccgguccggc

SEQ ID NO: 828664 - RNA, 23 nt, Mycobacterium avium subsp. paratuberculosis
gcagcggcacccgguccggcccg

SEQ ID NO: 828665 - RNA, 15 nt, Mycobacterium avium subsp. paratuberculosis
gcagcggcaccaacc

SEQ ID NO: 828666 - RNA, 23 nt, Mycobacterium avium subsp. paratuberculosis
gcagcggcaccaacccgaucggc

SEQ ID NO: 828667 - RNA, 22 nt, Mycobacterium avium subsp. paratuberculosis
gcagcggaugccggaggcgccg

SEQ ID NO: 828668 - RNA, 13 nt, Mycobacterium avium subsp. paratuberculosis
gcagcggccggcg

SEQ ID NO: 828669 - RNA, 14 nt, Mycobacterium avium subsp. paratuberculosis
gcagcggccggcgc

SEQ ID NO: 828670 - RNA, 15 nt, Mycobacterium avium subsp. paratuberculosis
gcagcgggucgucgg

SEQ ID NO: 828671 - RNA, 17 nt, Mycobacterium avium subsp. paratuberculosis
gcagcgggucgucgggc

SEQ ID NO: 828672 - RNA, 19 nt, Mycobacterium avium subsp. paratuberculosis
gcagcgggucgucgggccg

SEQ ID NO: 828673 - RNA, 22 nt, Mycobacterium avium subsp. paratuberculosis
gcagcggccgcaaucggcgccg

SEQ ID NO: 828674 - RNA, 19 nt, Mycobacterium avium subsp. paratuberculosis
gcagcggguuuggccgcgg

SEQ ID NO: 828675 - RNA, 21 nt, Mycobacterium avium subsp. paratuberculosis
gcagcggguugcgguccccgg

SEQ ID NO: 828676 - RNA, 15 nt, Mycobacterium avium subsp. paratuberculosis
gcagcggcagccacg

SEQ ID NO: 828677 - RNA, 16 nt, Mycobacterium avium subsp. paratuberculosis
gcagcggcagccacgg

SEQ ID NO: 828678 - RNA, 17 nt, Mycobacterium avium subsp. paratuberculosis
gcagcggcagcgaacug

SEQ ID NO: 828679 - RNA, 18 nt, Mycobacterium avium subsp. paratuberculosis
gcagcggcaugcccccga

SEQ ID NO: 828680 - RNA, 15 nt, Mycobacterium avium subsp. paratuberculosis
gcagcgucgccagcc

SEQ ID NO: 828681 - RNA, 17 nt, Mycobacterium avium subsp. paratuberculosis
gcagcgugggcaccggc

SEQ ID NO: 828682 - RNA, 18 nt, Mycobacterium avium subsp. paratuberculosis
gcagcgugggcaccggca

SEQ ID NO: 828683 - RNA, 21 nt, Mycobacterium avium subsp. paratuberculosis
gcagcgugggcaccggcaccg

SEQ ID NO: 828684 - RNA, 17 nt, Mycobacterium avium subsp. paratuberculosis
gcagcguuccgucggcg

SEQ ID NO: 828685 - RNA, 17 nt, Mycobacterium avium subsp. paratuberculosis
gcagcguucggucagca

SEQ ID NO: 828686 - RNA, 17 nt, Mycobacterium avium subsp. paratuberculosis
gcagcgugguccagcac

SEQ ID NO: 828687 - RNA, 18 nt, Mycobacterium avium subsp. paratuberculosis
gcagcgugguccagcacg

SEQ ID NO: 828688 - RNA, 19 nt, Mycobacterium avium subsp. paratuberculosis
gcagcguggucuccuggcc

SEQ ID NO: 828689 - RNA, 20 nt, Mycobacterium avium subsp. paratuberculosis
gcagcgugucggggucggcg

SEQ ID NO: 828690 - RNA, 23 nt, Mycobacterium avium subsp. paratuberculosis
gcagcgugucggggucggcgccg

SEQ ID NO: 828691 - RNA, 17 nt, Mycobacterium avium subsp. paratuberculosis
gcagcgucacgucgacg

SEQ ID NO: 828692 - RNA, 16 nt, Mycobacterium avium subsp. paratuberculosis
gcagcggugccgcccg

SEQ ID NO: 828693 - RNA, 22 nt, Mycobacterium avium subsp. paratuberculosis
gcagcggugucaccgacgccag

SEQ ID NO: 828694 - RNA, 18 nt, Mycobacterium avium subsp. paratuberculosis
gcagcggugacacccagg

SEQ ID NO: 828695 - RNA, 15 nt, Mycobacterium avium subsp. paratuberculosis
gcagcggugaucgcg

SEQ ID NO: 828696 - RNA, 20 nt, Mycobacterium avium subsp. paratuberculosis
gcagcggugcagccccgcac

SEQ ID NO: 828697 - RNA, 14 nt, Mycobacterium avium subsp. paratuberculosis
gcagccagucgccg

SEQ ID NO: 828698 - RNA, 17 nt, Mycobacterium avium subsp. paratuberculosis
gcagccagucgccggcc

SEQ ID NO: 828699 - RNA, 19 nt, Mycobacterium avium subsp. paratuberculosis
gcagccagucgccggccag

SEQ ID NO: 828700 - RNA, 15 nt, Mycobacterium avium subsp. paratuberculosis
gcagccagucgguca

SEQ ID NO: 828701 - RNA, 15 nt, Mycobacterium avium subsp. paratuberculosis
gcagccagguccggg

SEQ ID NO: 828702 - RNA, 12 nt, Mycobacterium avium subsp. paratuberculosis
gcagccagguga

SEQ ID NO: 828703 - RNA, 24 nt, Mycobacterium avium subsp. paratuberculosis
gcagccagguggugaacucuucgc

SEQ ID NO: 828704 - RNA, 14 nt, Mycobacterium avium subsp. paratuberculosis
gcagccagcgcagc

SEQ ID NO: 828705 - RNA, 15 nt, Mycobacterium avium subsp. paratuberculosis
gcagccagcgcagca

SEQ ID NO: 828706 - RNA, 13 nt, Mycobacterium avium subsp. paratuberculosis
gcagccagcgccg

SEQ ID NO: 828707 - RNA, 15 nt, Mycobacterium avium subsp. paratuberculosis
gcagccagcgccgca

SEQ ID NO: 828708 - RNA, 14 nt, Mycobacterium avium subsp. paratuberculosis
gcagccagccuggc

SEQ ID NO: 828709 - RNA, 16 nt, Mycobacterium avium subsp. paratuberculosis
gcagccagccuggcgg

SEQ ID NO: 828710 - RNA, 23 nt, Mycobacterium avium subsp. paratuberculosis
gcagccagccuggcggcgacccg

SEQ ID NO: 828711 - RNA, 15 nt, Mycobacterium avium subsp. paratuberculosis
gcagccagcucggcg

SEQ ID NO: 828712 - RNA, 16 nt, Mycobacterium avium subsp. paratuberculosis
gcagccagcucggcgu

SEQ ID NO: 828713 - RNA, 21 nt, Mycobacterium avium subsp. paratuberculosis
gcagccgucccuguucgcgcc

SEQ ID NO: 828714 - RNA, 23 nt, Mycobacterium avium subsp. paratuberculosis
gcagccgucccuguucgcgccgg

SEQ ID NO: 828715 - RNA, 17 nt, Mycobacterium avium subsp. paratuberculosis
gcagccgucgaucuuga

SEQ ID NO: 828716 - RNA, 21 nt, Mycobacterium avium subsp. paratuberculosis
gcagccgucgaucuugacgug

SEQ ID NO: 828717 - RNA, 16 nt, Mycobacterium avium subsp. paratuberculosis
gcagccgucgaugccg

SEQ ID NO: 828718 - RNA, 18 nt, Mycobacterium avium subsp. paratuberculosis
gcagccgucgaugccggc

SEQ ID NO: 828719 - RNA, 23 nt, Mycobacterium avium subsp. paratuberculosis
gcagccgucgaugccggcgacga

SEQ ID NO: 828720 - RNA, 21 nt, Mycobacterium avium subsp. paratuberculosis
gcagccguuccaucgggccca

SEQ ID NO: 828721 - RNA, 22 nt, Mycobacterium avium subsp. paratuberculosis
gcagccgggucaguucgcggcg

SEQ ID NO: 828722 - RNA, 16 nt, Mycobacterium avium subsp. paratuberculosis
gcagccgggugcgggc

SEQ ID NO: 828723 - RNA, 17 nt, Mycobacterium avium subsp. paratuberculosis
gcagccgggugcgggcc

SEQ ID NO: 828724 - RNA, 19 nt, Mycobacterium avium subsp. paratuberculosis
gcagccgggugcgggccag

SEQ ID NO: 828725 - RNA, 19 nt, Mycobacterium avium subsp. paratuberculosis
gcagccgggugcggugcag

SEQ ID NO: 828726 - RNA, 13 nt, Mycobacterium avium subsp. paratuberculosis
gcagccggguggc

SEQ ID NO: 828727 - RNA, 15 nt, Mycobacterium avium subsp. paratuberculosis
gcagccggguggccc

SEQ ID NO: 828728 - RNA, 18 nt, Mycobacterium avium subsp. paratuberculosis
gcagccggguggcccgcc

SEQ ID NO: 828729 - RNA, 15 nt, Mycobacterium avium subsp. paratuberculosis
gcagccgggugggcg

SEQ ID NO: 828730 - RNA, 12 nt, Mycobacterium avium subsp. paratuberculosis
gcagccgguaca

SEQ ID NO: 828731 - RNA, 16 nt, Mycobacterium avium subsp. paratuberculosis
gcagccgguccaugug

SEQ ID NO: 828732 - RNA, 12 nt, Mycobacterium avium subsp. paratuberculosis
gcagccgguccg

SEQ ID NO: 828733 - RNA, 14 nt, Mycobacterium avium subsp. paratuberculosis
gcagccgguccggc

SEQ ID NO: 828734 - RNA, 17 nt, Mycobacterium avium subsp. paratuberculosis
gcagccggucgaggucg

SEQ ID NO: 828735 - RNA, 18 nt, Mycobacterium avium subsp. paratuberculosis
gcagccggucgaggucgc

SEQ ID NO: 828736 - RNA, 19 nt, Mycobacterium avium subsp. paratuberculosis
gcagccggucgaggucgcc

SEQ ID NO: 828737 - RNA, 17 nt, Mycobacterium avium subsp. paratuberculosis
gcagcgacggaucggcc

SEQ ID NO: 828738 - RNA, 21 nt, Mycobacterium avium subsp. paratuberculosis
gcagcgacggaucggccgcgu

SEQ ID NO: 828739 - RNA, 14 nt, Mycobacterium avium subsp. paratuberculosis
gcagcgagaaccgg

SEQ ID NO: 828740 - RNA, 18 nt, Mycobacterium avium subsp. paratuberculosis
gcagcgagaaccggcgca

SEQ ID NO: 828741 - RNA, 17 nt, Mycobacterium avium subsp. paratuberculosis
gcagcgagaccggcacg

SEQ ID NO: 828742 - RNA, 22 nt, Mycobacterium avium subsp. paratuberculosis
gcagcgagaccggcacggugca

SEQ ID NO: 828743 - RNA, 24 nt, Mycobacterium avium subsp. paratuberculosis
gcagcgagaccggcacggugcaca

SEQ ID NO: 828744 - RNA, 19 nt, Mycobacterium avium subsp. paratuberculosis
gcagcgagaccucccggcg

SEQ ID NO: 828745 - RNA, 22 nt, Mycobacterium avium subsp. paratuberculosis
gcagcgacucgggcaggauggu

SEQ ID NO: 828746 - RNA, 23 nt, Mycobacterium avium subsp. paratuberculosis
gcagcgacucgggcaggaugguc

SEQ ID NO: 828747 - RNA, 16 nt, Mycobacterium avium subsp. paratuberculosis
gcagcgacucguuggc

SEQ ID NO: 828748 - RNA, 21 nt, Mycobacterium avium subsp. paratuberculosis
gcagcgacucguuggccggcu

SEQ ID NO: 828749 - RNA, 22 nt, Mycobacterium avium subsp. paratuberculosis
gcagcgacucguuggccggcuc

SEQ ID NO: 828750 - RNA, 21 nt, Mycobacterium avium subsp. paratuberculosis
gcagcgacuggcccucggagg

SEQ ID NO: 828751 - RNA, 22 nt, Mycobacterium avium subsp. paratuberculosis
gcagcgacuugaccagcagcug

SEQ ID NO: 828752 - RNA, 12 nt, Mycobacterium avium subsp. paratuberculosis
gcagcgccagcg

SEQ ID NO: 828753 - RNA, 13 nt, Mycobacterium avium subsp. paratuberculosis
gcagcgaucggcg

SEQ ID NO: 828754 - RNA, 18 nt, Mycobacterium avium subsp. paratuberculosis
gcagcgaucggcggcucg

SEQ ID NO: 828755 - RNA, 20 nt, Mycobacterium avium subsp. paratuberculosis
gcagcgccagcaccgccugg

SEQ ID NO: 828756 - RNA, 18 nt, Mycobacterium avium subsp. paratuberculosis
gcagcgccagcaccgggc

SEQ ID NO: 828757 - RNA, 19 nt, Mycobacterium avium subsp. paratuberculosis
gcagcgccagcaccgggcc

SEQ ID NO: 828758 - RNA, 13 nt, Mycobacterium avium subsp. paratuberculosis
gcagcgccagcag

SEQ ID NO: 828759 - RNA, 22 nt, Mycobacterium avium subsp. paratuberculosis
gcagcgagucgaaggcgcgggc

SEQ ID NO: 828760 - RNA, 16 nt, Mycobacterium avium subsp. paratuberculosis
gcagcgaggcgauggu

SEQ ID NO: 828761 - RNA, 17 nt, Mycobacterium avium subsp. paratuberculosis
gcagcgaggcgcgcagg

SEQ ID NO: 828762 - RNA, 17 nt, Mycobacterium avium subsp. paratuberculosis
gcagcgaggcguccagc

SEQ ID NO: 828763 - RNA, 16 nt, Mycobacterium avium subsp. paratuberculosis
gcagcgaggccucgcc

SEQ ID NO: 828764 - RNA, 13 nt, Mycobacterium avium subsp. paratuberculosis
gcagcgccgcgcc

SEQ ID NO: 828765 - RNA, 15 nt, Mycobacterium avium subsp. paratuberculosis
gcagcgccgcgccga

SEQ ID NO: 828766 - RNA, 16 nt, Mycobacterium avium subsp. paratuberculosis
gcagcgccgcggccgg

SEQ ID NO: 828767 - RNA, 20 nt, Mycobacterium avium subsp. paratuberculosis
gcagcgccgcggccggugcc

SEQ ID NO: 828768 - RNA, 15 nt, Mycobacterium avium subsp. paratuberculosis
gcagcgccgcggcgc

SEQ ID NO: 828769 - RNA, 14 nt, Mycobacterium avium subsp. paratuberculosis
gcagcgccgcgacg

SEQ ID NO: 828770 - RNA, 15 nt, Mycobacterium avium subsp. paratuberculosis
gcagcgccgcgacga

SEQ ID NO: 828771 - RNA, 13 nt, Mycobacterium avium subsp. paratuberculosis
gcagcgccgcccg

SEQ ID NO: 828772 - RNA, 14 nt, Mycobacterium avium subsp. paratuberculosis
gcagcgccgcccgc

SEQ ID NO: 828773 - RNA, 16 nt, Mycobacterium avium subsp. paratuberculosis
gcagcgccgcccgcac

SEQ ID NO: 828774 - RNA, 22 nt, Mycobacterium avium subsp. paratuberculosis
gcagcgccgcccgcaccugcgc

SEQ ID NO: 828775 - RNA, 16 nt, Mycobacterium avium subsp. paratuberculosis
gcagcgccgccaccgg

SEQ ID NO: 828776 - RNA, 18 nt, Mycobacterium avium subsp. paratuberculosis
gcagcgccgccaccggcc

SEQ ID NO: 828777 - RNA, 23 nt, Mycobacterium avium subsp. paratuberculosis
gcagcgccgccaccggccggucc

SEQ ID NO: 828778 - RNA, 11 nt, Mycobacterium avium subsp. paratuberculosis
gcagcgcccgg

SEQ ID NO: 828779 - RNA, 20 nt, Mycobacterium avium subsp. paratuberculosis
gcagcgcccgggccaggacc

SEQ ID NO: 828780 - RNA, 15 nt, Mycobacterium avium subsp. paratuberculosis
gcagcgcccagccga

SEQ ID NO: 828781 - RNA, 15 nt, Mycobacterium avium subsp. paratuberculosis
gcagcgccccggucc

SEQ ID NO: 828782 - RNA, 16 nt, Mycobacterium avium subsp. paratuberculosis
gcagcgcccaccgcuc

SEQ ID NO: 828783 - RNA, 20 nt, Mycobacterium avium subsp. paratuberculosis
gcagcgccaggcagaagcuc

SEQ ID NO: 828784 - RNA, 14 nt, Mycobacterium avium subsp. paratuberculosis
gcagcgccagcgcg

SEQ ID NO: 828785 - RNA, 19 nt, Mycobacterium avium subsp. paratuberculosis
gcagcgccagcgcgcccgc

SEQ ID NO: 828786 - RNA, 13 nt, Mycobacterium avium subsp. paratuberculosis
gcagcgccagcgg

SEQ ID NO: 828787 - RNA, 15 nt, Mycobacterium avium subsp. paratuberculosis
gcagcgccagcggga

SEQ ID NO: 828788 - RNA, 15 nt, Mycobacterium avium subsp. paratuberculosis
gcagcgcggcauggc

SEQ ID NO: 828789 - RNA, 20 nt, Mycobacterium avium subsp. paratuberculosis
gcagcgcggcauggcuggcg

SEQ ID NO: 828790 - RNA, 11 nt, Mycobacterium avium subsp. paratuberculosis
gcagcgcggcc

SEQ ID NO: 828791 - RNA, 14 nt, Mycobacterium avium subsp. paratuberculosis
gcagcgcgcgggug

SEQ ID NO: 828792 - RNA, 18 nt, Mycobacterium avium subsp. paratuberculosis
gcagcgcgcgaccgcgau

SEQ ID NO: 828793 - RNA, 14 nt, Mycobacterium avium subsp. paratuberculosis
gcagcgcgccgcgc

SEQ ID NO: 828794 - RNA, 20 nt, Mycobacterium avium subsp. paratuberculosis
gcagcgcgccgcgcuggccg

SEQ ID NO: 828795 - RNA, 14 nt, Mycobacterium avium subsp. paratuberculosis
gcagcgcgcccagg

SEQ ID NO: 828796 - RNA, 22 nt, Mycobacterium avium subsp. paratuberculosis
gcagcgccgcuucgucgccggc

SEQ ID NO: 828797 - RNA, 14 nt, Mycobacterium avium subsp. paratuberculosis
gcagcgccggcagc

SEQ ID NO: 828798 - RNA, 14 nt, Mycobacterium avium subsp. paratuberculosis
gcagcgccguccgc

SEQ ID NO: 828799 - RNA, 13 nt, Mycobacterium avium subsp. paratuberculosis
gcagcgccggcag

SEQ ID NO: 828800 - RNA, 15 nt, Mycobacterium avium subsp. paratuberculosis
gcagcgccucgagca

SEQ ID NO: 828801 - RNA, 18 nt, Mycobacterium avium subsp. paratuberculosis
gcagcgccucgccgggcc

SEQ ID NO: 828802 - RNA, 14 nt, Mycobacterium avium subsp. paratuberculosis
gcagcgcgaugccg

SEQ ID NO: 828803 - RNA, 15 nt, Mycobacterium avium subsp. paratuberculosis
gcagcgcgaugccgg

SEQ ID NO: 828804 - RNA, 19 nt, Mycobacterium avium subsp. paratuberculosis
gcagcgcgaugccggccag

SEQ ID NO: 828805 - RNA, 15 nt, Mycobacterium avium subsp. paratuberculosis
gcagcgcgauguccg

SEQ ID NO: 828806 - RNA, 20 nt, Mycobacterium avium subsp. paratuberculosis
gcagcgcgauguccgacagc

SEQ ID NO: 828807 - RNA, 12 nt, Mycobacterium avium subsp. paratuberculosis
gauugcgcccgc

SEQ ID NO: 828808 - RNA, 15 nt, Mycobacterium avium subsp. paratuberculosis
gauugcgcggcgccg

SEQ ID NO: 828809 - RNA, 17 nt, Mycobacterium avium subsp. paratuberculosis
gauuccagcgcgaccgc

SEQ ID NO: 828810 - RNA, 13 nt, Mycobacterium avium subsp. paratuberculosis
gauuccagcgcgu

SEQ ID NO: 828811 - RNA, 18 nt, Mycobacterium avium subsp. paratuberculosis
gauucagccggcgggcgc

SEQ ID NO: 828812 - RNA, 22 nt, Mycobacterium avium subsp. paratuberculosis
gauucagccggcgggcgcucga

SEQ ID NO: 828813 - RNA, 21 nt, Mycobacterium avium subsp. paratuberculosis
gauuccggcacccgccagccc

SEQ ID NO: 828814 - RNA, 17 nt, Mycobacterium avium subsp. paratuberculosis
gauuccggccggccgcc

SEQ ID NO: 828815 - RNA, 14 nt, Mycobacterium avium subsp. paratuberculosis
gauucccgaccccg

SEQ ID NO: 828816 - RNA, 12 nt, Mycobacterium avium subsp. paratuberculosis
gauucccgccgg

SEQ ID NO: 828817 - RNA, 15 nt, Mycobacterium avium subsp. paratuberculosis
gauuuggccgucauc

SEQ ID NO: 828818 - RNA, 23 nt, Mycobacterium avium subsp. paratuberculosis
gauuggcgccacugccgccgccc

SEQ ID NO: 828819 - RNA, 19 nt, Mycobacterium avium subsp. paratuberculosis
gauuuugaaauagccgcgc

SEQ ID NO: 828820 - RNA, 17 nt, Mycobacterium avium subsp. paratuberculosis
gcaaaccggaccgccgc

SEQ ID NO: 828821 - RNA, 18 nt, Mycobacterium avium subsp. paratuberculosis
gcaaaccggaccgccgcg

SEQ ID NO: 828822 - RNA, 18 nt, Mycobacterium avium subsp. paratuberculosis
gcaaaagcauccggccgu

SEQ ID NO: 828823 - RNA, 20 nt, Mycobacterium avium subsp. paratuberculosis
gcaaaacggugcggccucga

SEQ ID NO: 828824 - RNA, 15 nt, Mycobacterium avium subsp. paratuberculosis
gcaaaacgcugggcg

SEQ ID NO: 828825 - RNA, 20 nt, Mycobacterium avium subsp. paratuberculosis
gauguagcggacgggccgca

SEQ ID NO: 828826 - RNA, 21 nt, Mycobacterium avium subsp. paratuberculosis
gaugucacccucgaggccgac

SEQ ID NO: 828827 - RNA, 15 nt, Mycobacterium avium subsp. paratuberculosis
gauguccaggccguc

SEQ ID NO: 828828 - RNA, 19 nt, Mycobacterium avium subsp. paratuberculosis
gauguccaggccgucgagg

SEQ ID NO: 828829 - RNA, 17 nt, Mycobacterium avium subsp. paratuberculosis
gaugucgacgaugcgcu

SEQ ID NO: 828830 - RNA, 19 nt, Mycobacterium avium subsp. paratuberculosis
gaugucgacgaugcgcugc

SEQ ID NO: 828831 - RNA, 16 nt, Mycobacterium avium subsp. paratuberculosis
gaugucgacgccgugc

SEQ ID NO: 828832 - RNA, 20 nt, Mycobacterium avium subsp. paratuberculosis
gaugucgacgccgugcugcc

SEQ ID NO: 828833 - RNA, 15 nt, Mycobacterium avium subsp. paratuberculosis
gauguccccgcgggu

SEQ ID NO: 828834 - RNA, 21 nt, Mycobacterium avium subsp. paratuberculosis
gauguccccgcgggugacgcu

SEQ ID NO: 828835 - RNA, 20 nt, Mycobacterium avium subsp. paratuberculosis
gaugguguucugcucgucgg

SEQ ID NO: 828836 - RNA, 14 nt, Mycobacterium avium subsp. paratuberculosis
gauguagcggcggu

SEQ ID NO: 828837 - RNA, 15 nt, Mycobacterium avium subsp. paratuberculosis
gauguagcggcgguc

SEQ ID NO: 828838 - RNA, 16 nt, Mycobacterium avium subsp. paratuberculosis
gauggcguucugcacc

SEQ ID NO: 828839 - RNA, 20 nt, Mycobacterium avium subsp. paratuberculosis
gauggcguucugcaccgacu

SEQ ID NO: 828840 - RNA, 18 nt, Mycobacterium avium subsp. paratuberculosis
gauggcgucggccagcgg

SEQ ID NO: 828841 - RNA, 21 nt, Mycobacterium avium subsp. paratuberculosis
gaugguguggaucgcuucggc

SEQ ID NO: 828842 - RNA, 18 nt, Mycobacterium avium subsp. paratuberculosis
gauggcguccaccgacau

SEQ ID NO: 828843 - RNA, 23 nt, Mycobacterium avium subsp. paratuberculosis
gauggcguagcgggucagcucca

SEQ ID NO: 828844 - RNA, 14 nt, Mycobacterium avium subsp. paratuberculosis
gauggcgucgacgu

SEQ ID NO: 828845 - RNA, 16 nt, Mycobacterium avium subsp. paratuberculosis
gauggcgucgacgugc

SEQ ID NO: 828846 - RNA, 22 nt, Mycobacterium avium subsp. paratuberculosis
gauggcgucgacgugcgcggcg

SEQ ID NO: 828847 - RNA, 14 nt, Mycobacterium avium subsp. paratuberculosis
gauggcggugugga

SEQ ID NO: 828848 - RNA, 17 nt, Mycobacterium avium subsp. paratuberculosis
gaugugaucggcggcca

SEQ ID NO: 828849 - RNA, 17 nt, Mycobacterium avium subsp. paratuberculosis
gauguuggccgcgacgc

SEQ ID NO: 828850 - RNA, 15 nt, Mycobacterium avium subsp. paratuberculosis
gauguugccgccacu

SEQ ID NO: 828851 - RNA, 15 nt, Mycobacterium avium subsp. paratuberculosis
gauguugcggccggc

SEQ ID NO: 828852 - RNA, 14 nt, Mycobacterium avium subsp. paratuberculosis
gauguugcggcggc

SEQ ID NO: 828853 - RNA, 16 nt, Mycobacterium avium subsp. paratuberculosis
gauguugcggcggccg

SEQ ID NO: 828854 - RNA, 14 nt, Mycobacterium avium subsp. paratuberculosis
gaugucgugcgguc

SEQ ID NO: 828855 - RNA, 16 nt, Mycobacterium avium subsp. paratuberculosis
gaugucgugggcgugc

SEQ ID NO: 828856 - RNA, 18 nt, Mycobacterium avium subsp. paratuberculosis
gaugucuagccgccgagc

SEQ ID NO: 828857 - RNA, 17 nt, Mycobacterium avium subsp. paratuberculosis
gaugucuccgcgcagcc

SEQ ID NO: 828858 - RNA, 18 nt, Mycobacterium avium subsp. paratuberculosis
gaugucugaucgcguagc

SEQ ID NO: 828859 - RNA, 16 nt, Mycobacterium avium subsp. paratuberculosis
gaugucgccggcgacc

SEQ ID NO: 828860 - RNA, 14 nt, Mycobacterium avium subsp. paratuberculosis
gaugucgcccggcg

SEQ ID NO: 828861 - RNA, 15 nt, Mycobacterium avium subsp. paratuberculosis
gaugucgcccggcgg

SEQ ID NO: 828862 - RNA, 13 nt, Mycobacterium avium subsp. paratuberculosis
gaugucgccgacc

SEQ ID NO: 828863 - RNA, 22 nt, Mycobacterium avium subsp. paratuberculosis
gaugucgccgcagaucagggcg

SEQ ID NO: 828864 - RNA, 16 nt, Mycobacterium avium subsp. paratuberculosis
gaugucgcgcggcugc

SEQ ID NO: 828865 - RNA, 20 nt, Mycobacterium avium subsp. paratuberculosis
gaugucgcgcggcugcucga

SEQ ID NO: 828866 - RNA, 22 nt, Mycobacterium avium subsp. paratuberculosis
gaugucgcgcggcugcucgaac

SEQ ID NO: 828867 - RNA, 24 nt, Mycobacterium avium subsp. paratuberculosis
gaugucgcugccgccgccggcggu

SEQ ID NO: 828868 - RNA, 16 nt, Mycobacterium avium subsp. paratuberculosis
gaugucggugagcgcc

SEQ ID NO: 828869 - RNA, 17 nt, Mycobacterium avium subsp. paratuberculosis
gaugucggugguguggc

SEQ ID NO: 828870 - RNA, 20 nt, Mycobacterium avium subsp. paratuberculosis
gaugucggugugcagcagcu

SEQ ID NO: 828871 - RNA, 20 nt, Mycobacterium avium subsp. paratuberculosis
gaugucgguguggaccgcgc

SEQ ID NO: 828872 - RNA, 21 nt, Mycobacterium avium subsp. paratuberculosis
gaugucgcgaaaaucgguggu

SEQ ID NO: 828873 - RNA, 17 nt, Mycobacterium avium subsp. paratuberculosis
gaugucguaggcgcggu

SEQ ID NO: 828874 - RNA, 23 nt, Mycobacterium avium subsp. paratuberculosis
gaugucgucgaacgcggcgaagc

SEQ ID NO: 828875 - RNA, 12 nt, Mycobacterium avium subsp. paratuberculosis
gaugucggccag

SEQ ID NO: 828876 - RNA, 19 nt, Mycobacterium avium subsp. paratuberculosis
gaugucggccagcgcggcg

SEQ ID NO: 828877 - RNA, 17 nt, Mycobacterium avium subsp. paratuberculosis
gaugucggccaggaucg

SEQ ID NO: 828878 - RNA, 13 nt, Mycobacterium avium subsp. paratuberculosis
gaugucggccggc

SEQ ID NO: 828879 - RNA, 14 nt, Mycobacterium avium subsp. paratuberculosis
gaugucggccggca

SEQ ID NO: 828880 - RNA, 13 nt, Mycobacterium avium subsp. paratuberculosis
gaugucggcggcc

SEQ ID NO: 828881 - RNA, 16 nt, Mycobacterium avium subsp. paratuberculosis
gaugucggcggcccgg

SEQ ID NO: 828882 - RNA, 14 nt, Mycobacterium avium subsp. paratuberculosis
gaugucggcggccg

SEQ ID NO: 828883 - RNA, 13 nt, Mycobacterium avium subsp. paratuberculosis
gauggacacgcug

SEQ ID NO: 828884 - RNA, 20 nt, Mycobacterium avium subsp. paratuberculosis
gauggacacgcugccgaggu

SEQ ID NO: 828885 - RNA, 15 nt, Mycobacterium avium subsp. paratuberculosis
gauggacgacgugcc

SEQ ID NO: 828886 - RNA, 15 nt, Mycobacterium avium subsp. paratuberculosis
gauggacgcgguggu

SEQ ID NO: 828887 - RNA, 17 nt, Mycobacterium avium subsp. paratuberculosis
gauggacgcgguggugc

SEQ ID NO: 828888 - RNA, 14 nt, Mycobacterium avium subsp. paratuberculosis
gauggccaucgucg

SEQ ID NO: 828889 - RNA, 18 nt, Mycobacterium avium subsp. paratuberculosis
gauggccaucuggccgcg

SEQ ID NO: 828890 - RNA, 19 nt, Mycobacterium avium subsp. paratuberculosis
gauggccaucuggccgcgg

SEQ ID NO: 828891 - RNA, 13 nt, Mycobacterium avium subsp. paratuberculosis
gauggccagcgcg

SEQ ID NO: 828892 - RNA, 14 nt, Mycobacterium avium subsp. paratuberculosis
gauggacggggcga

SEQ ID NO: 828893 - RNA, 19 nt, Mycobacterium avium subsp. paratuberculosis
gauggccaggcccagcccg

SEQ ID NO: 828894 - RNA, 20 nt, Mycobacterium avium subsp. paratuberculosis
gauggccagguagugguggg

SEQ ID NO: 828895 - RNA, 13 nt, Mycobacterium avium subsp. paratuberculosis
gauggccgcccgc

SEQ ID NO: 828896 - RNA, 17 nt, Mycobacterium avium subsp. paratuberculosis
gauggccauggccagga

SEQ ID NO: 828897 - RNA, 23 nt, Mycobacterium avium subsp. paratuberculosis
gauggccauggccaggaacggcg

SEQ ID NO: 828898 - RNA, 16 nt, Mycobacterium avium subsp. paratuberculosis
gauggcccaggccgcg

SEQ ID NO: 828899 - RNA, 18 nt, Mycobacterium avium subsp. paratuberculosis
gauggccccggcgagucu

SEQ ID NO: 828900 - RNA, 20 nt, Mycobacterium avium subsp. paratuberculosis
gauggcccgccagaucgcca

SEQ ID NO: 828901 - RNA, 16 nt, Mycobacterium avium subsp. paratuberculosis
gauggcccgcugcgcc

SEQ ID NO: 828902 - RNA, 18 nt, Mycobacterium avium subsp. paratuberculosis
gauggcccggaccgccgc

SEQ ID NO: 828903 - RNA, 19 nt, Mycobacterium avium subsp. paratuberculosis
gauggcccggaccgccgcg

SEQ ID NO: 828904 - RNA, 20 nt, Mycobacterium avium subsp. paratuberculosis
gauggcccggaccgccgcgg

SEQ ID NO: 828905 - RNA, 14 nt, Mycobacterium avium subsp. paratuberculosis
gauggcgcuggccg

SEQ ID NO: 828906 - RNA, 14 nt, Mycobacterium avium subsp. paratuberculosis
gauggcggcgcgga

SEQ ID NO: 828907 - RNA, 13 nt, Mycobacterium avium subsp. paratuberculosis
gauggcggcggcc

SEQ ID NO: 828908 - RNA, 16 nt, Mycobacterium avium subsp. paratuberculosis
gauggcggcggcccgc

SEQ ID NO: 828909 - RNA, 18 nt, Mycobacterium avium subsp. paratuberculosis
gauggcgggcgcgccggc

SEQ ID NO: 828910 - RNA, 17 nt, Mycobacterium avium subsp. paratuberculosis
gauggcgguccaccacc

SEQ ID NO: 828911 - RNA, 18 nt, Mycobacterium avium subsp. paratuberculosis
gaugcggaugcccgccgg

SEQ ID NO: 828912 - RNA, 16 nt, Mycobacterium avium subsp. paratuberculosis
gaugcggaucucggug

SEQ ID NO: 828913 - RNA, 17 nt, Mycobacterium avium subsp. paratuberculosis
gaugcggaucucggugc

SEQ ID NO: 828914 - RNA, 15 nt, Mycobacterium avium subsp. paratuberculosis
gaugcggucccgcgg

SEQ ID NO: 828915 - RNA, 14 nt, Mycobacterium avium subsp. paratuberculosis
gaugcggucgauca

SEQ ID NO: 828916 - RNA, 21 nt, Mycobacterium avium subsp. paratuberculosis
gaugcggucgaugagcuggug

SEQ ID NO: 828917 - RNA, 17 nt, Mycobacterium avium subsp. paratuberculosis
gaugcggcaccagcccg

SEQ ID NO: 828918 - RNA, 21 nt, Mycobacterium avium subsp. paratuberculosis
gaugcggcaccagcccgccgu

SEQ ID NO: 828919 - RNA, 21 nt, Mycobacterium avium subsp. paratuberculosis
gaugcggcacgcgucaccgga

SEQ ID NO: 828920 - RNA, 14 nt, Mycobacterium avium subsp. paratuberculosis
gaugcggguguuga

SEQ ID NO: 828921 - RNA, 21 nt, Mycobacterium avium subsp. paratuberculosis
gaugcggguguugcgcagcgu

SEQ ID NO: 828922 - RNA, 21 nt, Mycobacterium avium subsp. paratuberculosis
gaugcgcugugcgggugaggc

SEQ ID NO: 828923 - RNA, 14 nt, Mycobacterium avium subsp. paratuberculosis
gaugcgcuccagca

SEQ ID NO: 828924 - RNA, 21 nt, Mycobacterium avium subsp. paratuberculosis
gaugcgcuccagcaggcuggc

SEQ ID NO: 828925 - RNA, 14 nt, Mycobacterium avium subsp. paratuberculosis
gaugcgcucggcga

SEQ ID NO: 828926 - RNA, 15 nt, Mycobacterium avium subsp. paratuberculosis
gaugcgcucggcgac

SEQ ID NO: 828927 - RNA, 21 nt, Mycobacterium avium subsp. paratuberculosis
gaugcggucgucgcccaccga

SEQ ID NO: 828928 - RNA, 22 nt, Mycobacterium avium subsp. paratuberculosis
gaugcggucgucgcccaccgac

SEQ ID NO: 828929 - RNA, 23 nt, Mycobacterium avium subsp. paratuberculosis
gaugcggugccgggccaggucga

SEQ ID NO: 828930 - RNA, 16 nt, Mycobacterium avium subsp. paratuberculosis
gaugcggugccgggug

SEQ ID NO: 828931 - RNA, 12 nt, Mycobacterium avium subsp. paratuberculosis
gaugcguucggc

SEQ ID NO: 828932 - RNA, 15 nt, Mycobacterium avium subsp. paratuberculosis
gaugcgugcgguggu

SEQ ID NO: 828933 - RNA, 15 nt, Mycobacterium avium subsp. paratuberculosis
gaugcgucccguugg

SEQ ID NO: 828934 - RNA, 16 nt, Mycobacterium avium subsp. paratuberculosis
gaugcuggggucggcc

SEQ ID NO: 828935 - RNA, 19 nt, Mycobacterium avium subsp. paratuberculosis
gaugcuggggucggccagc

SEQ ID NO: 828936 - RNA, 20 nt, Mycobacterium avium subsp. paratuberculosis
gaugcuggggucggccagcg

SEQ ID NO: 828937 - RNA, 17 nt, Mycobacterium avium subsp. paratuberculosis
gaugcuggccaucgccg

SEQ ID NO: 828938 - RNA, 16 nt, Mycobacterium avium subsp. paratuberculosis
gaugcuggugacgccg

SEQ ID NO: 828939 - RNA, 13 nt, Mycobacterium avium subsp. paratuberculosis
gaugcugugcgcu

SEQ ID NO: 828940 - RNA, 22 nt, Mycobacterium avium subsp. paratuberculosis
gaugcuguggaagggccccggc

SEQ ID NO: 828941 - RNA, 14 nt, Mycobacterium avium subsp. paratuberculosis
gauggaagcgguga

SEQ ID NO: 828942 - RNA, 21 nt, Mycobacterium avium subsp. paratuberculosis
gauggaagcggugauggcgau

SEQ ID NO: 828943 - RNA, 17 nt, Mycobacterium avium subsp. paratuberculosis
gaugccgguacggccga

SEQ ID NO: 828944 - RNA, 21 nt, Mycobacterium avium subsp. paratuberculosis
gaugccgguacggccgacgcc

SEQ ID NO: 828945 - RNA, 18 nt, Mycobacterium avium subsp. paratuberculosis
gaugccggggcagcaccc

SEQ ID NO: 828946 - RNA, 20 nt, Mycobacterium avium subsp. paratuberculosis
gaugccggggcagcacccgc

SEQ ID NO: 828947 - RNA, 17 nt, Mycobacterium avium subsp. paratuberculosis
gaugccguaggacagga

SEQ ID NO: 828948 - RNA, 19 nt, Mycobacterium avium subsp. paratuberculosis
gaugccgucacugucggcg

SEQ ID NO: 828949 - RNA, 20 nt, Mycobacterium avium subsp. paratuberculosis
gaugccgucacugucggcgc

SEQ ID NO: 828950 - RNA, 22 nt, Mycobacterium avium subsp. paratuberculosis
gaugccguccagcaacgccgac

SEQ ID NO: 828951 - RNA, 20 nt, Mycobacterium avium subsp. paratuberculosis
gaugccguccuugucgcgca

SEQ ID NO: 828952 - RNA, 22 nt, Mycobacterium avium subsp. paratuberculosis
gaugccguccuugucgcgcacc

SEQ ID NO: 828953 - RNA, 13 nt, Mycobacterium avium subsp. paratuberculosis
gaugccggugcag

SEQ ID NO: 828954 - RNA, 15 nt, Mycobacterium avium subsp. paratuberculosis
gaugccgucgguggu

SEQ ID NO: 828955 - RNA, 22 nt, Mycobacterium avium subsp. paratuberculosis
gaugccgguguucaagccggcg

SEQ ID NO: 828956 - RNA, 23 nt, Mycobacterium avium subsp. paratuberculosis
gaugcgaucgaugaauccgcgca

SEQ ID NO: 828957 - RNA, 14 nt, Mycobacterium avium subsp. paratuberculosis
gaugcgcagcagcg

SEQ ID NO: 828958 - RNA, 14 nt, Mycobacterium avium subsp. paratuberculosis
gaugcgccaccgac

SEQ ID NO: 828959 - RNA, 15 nt, Mycobacterium avium subsp. paratuberculosis
gaugcgccaccgaca

SEQ ID NO: 828960 - RNA, 18 nt, Mycobacterium avium subsp. paratuberculosis
gaugcgcaccgugccgcc

SEQ ID NO: 828961 - RNA, 20 nt, Mycobacterium avium subsp. paratuberculosis
gaugcgcacccccggggccu

SEQ ID NO: 828962 - RNA, 17 nt, Mycobacterium avium subsp. paratuberculosis
gaugcgcaccgcggcgu

SEQ ID NO: 828963 - RNA, 22 nt, Mycobacterium avium subsp. paratuberculosis
gaugcgcaccgcggcgugcgcc

SEQ ID NO: 828964 - RNA, 17 nt, Mycobacterium avium subsp. paratuberculosis
gaugcgcaccacgcccg

SEQ ID NO: 828965 - RNA, 19 nt, Mycobacterium avium subsp. paratuberculosis
gaugcgcaccacgcccgac

SEQ ID NO: 828966 - RNA, 22 nt, Mycobacterium avium subsp. paratuberculosis
gaugcgcaccacgcccgacgac

SEQ ID NO: 828967 - RNA, 22 nt, Mycobacterium avium subsp. paratuberculosis
gaugccggcgguaccgccgauc

SEQ ID NO: 828968 - RNA, 14 nt, Mycobacterium avium subsp. paratuberculosis
gaugccggcggugu

SEQ ID NO: 828969 - RNA, 19 nt, Mycobacterium avium subsp. paratuberculosis
gaugccggcuugggcgaau

SEQ ID NO: 828970 - RNA, 20 nt, Mycobacterium avium subsp. paratuberculosis
gaugccgcccaucagcagga

SEQ ID NO: 828971 - RNA, 17 nt, Mycobacterium avium subsp. paratuberculosis
gaugccgccccugcugg

SEQ ID NO: 828972 - RNA, 22 nt, Mycobacterium avium subsp. paratuberculosis
gaugccgcccuugcucgcggcg

SEQ ID NO: 828973 - RNA, 16 nt, Mycobacterium avium subsp. paratuberculosis
gaugccggcgacgaac

SEQ ID NO: 828974 - RNA, 16 nt, Mycobacterium avium subsp. paratuberculosis
gaugccggcgcccagc

SEQ ID NO: 828975 - RNA, 17 nt, Mycobacterium avium subsp. paratuberculosis
gaugccggcgcccagcg

SEQ ID NO: 828976 - RNA, 18 nt, Mycobacterium avium subsp. paratuberculosis
gaugccggcgcccagcgg

SEQ ID NO: 828977 - RNA, 20 nt, Mycobacterium avium subsp. paratuberculosis
gaugccggcgcccagcggcg

SEQ ID NO: 828978 - RNA, 12 nt, Mycobacterium avium subsp. paratuberculosis
gaugccgcccac

SEQ ID NO: 828979 - RNA, 13 nt, Mycobacterium avium subsp. paratuberculosis
gaugccgcccacc

SEQ ID NO: 828980 - RNA, 16 nt, Mycobacterium avium subsp. paratuberculosis
gaugccgcccaccacc

SEQ ID NO: 828981 - RNA, 17 nt, Mycobacterium avium subsp. paratuberculosis
gaugccgcccaccaccg

SEQ ID NO: 828982 - RNA, 19 nt, Mycobacterium avium subsp. paratuberculosis
gaugccgcccaccaccggc

SEQ ID NO: 828983 - RNA, 20 nt, Mycobacterium avium subsp. paratuberculosis
gaugccgcccaccaccggcu

SEQ ID NO: 828984 - RNA, 13 nt, Mycobacterium avium subsp. paratuberculosis
gaugccgaucggg

SEQ ID NO: 828985 - RNA, 23 nt, Mycobacterium avium subsp. paratuberculosis
gaugccgaucggggcgcagcccg

SEQ ID NO: 828986 - RNA, 22 nt, Mycobacterium avium subsp. paratuberculosis
gaugccgaggauuucgcgaucg

SEQ ID NO: 828987 - RNA, 20 nt, Mycobacterium avium subsp. paratuberculosis
gaugcccuuggcggccacga

SEQ ID NO: 828988 - RNA, 12 nt, Mycobacterium avium subsp. paratuberculosis
gaugccgacacc

SEQ ID NO: 828989 - RNA, 14 nt, Mycobacterium avium subsp. paratuberculosis
gaugccgacgucgg

SEQ ID NO: 828990 - RNA, 16 nt, Mycobacterium avium subsp. paratuberculosis
gaugccgacgucggug

SEQ ID NO: 828991 - RNA, 16 nt, Mycobacterium avium subsp. paratuberculosis
gaugccgagcagcucg

SEQ ID NO: 828992 - RNA, 17 nt, Mycobacterium avium subsp. paratuberculosis
gaugccgagcagcucgg

SEQ ID NO: 828993 - RNA, 16 nt, Mycobacterium avium subsp. paratuberculosis
gaugccgagcgccgcg

SEQ ID NO: 828994 - RNA, 21 nt, Mycobacterium avium subsp. paratuberculosis
gaugccagcagguccgccggu

SEQ ID NO: 828995 - RNA, 21 nt, Mycobacterium avium subsp. paratuberculosis
gaugcagugguugagcagcag

SEQ ID NO: 828996 - RNA, 20 nt, Mycobacterium avium subsp. paratuberculosis
gaugcauucguccauccgcu

SEQ ID NO: 828997 - RNA, 17 nt, Mycobacterium avium subsp. paratuberculosis
gaugccagacgaacgcg

SEQ ID NO: 828998 - RNA, 20 nt, Mycobacterium avium subsp. paratuberculosis
gaugccagacgaacgcggcc

SEQ ID NO: 828999 - RNA, 22 nt, Mycobacterium avium subsp. paratuberculosis
gaugccagacgaacgcggccgc

SEQ ID NO: 829000 - RNA, 14 nt, Mycobacterium avium subsp. paratuberculosis
gaugcccagggcgc

SEQ ID NO: 829001 - RNA, 14 nt, Mycobacterium avium subsp. paratuberculosis
gaugcccaggccgg

SEQ ID NO: 829002 - RNA, 15 nt, Mycobacterium avium subsp. paratuberculosis
gaugcccaggccggc

SEQ ID NO: 829003 - RNA, 16 nt, Mycobacterium avium subsp. paratuberculosis
gaugcccaucacgccc

SEQ ID NO: 829004 - RNA, 13 nt, Mycobacterium avium subsp. paratuberculosis
gaugcccaggccg

SEQ ID NO: 829005 - RNA, 13 nt, Mycobacterium avium subsp. paratuberculosis
gaugcccagcacc

SEQ ID NO: 829006 - RNA, 16 nt, Mycobacterium avium subsp. paratuberculosis
gaugcccaggcccacc

SEQ ID NO: 829007 - RNA, 17 nt, Mycobacterium avium subsp. paratuberculosis
gaugcccaggcccacca

SEQ ID NO: 829008 - RNA, 17 nt, Mycobacterium avium subsp. paratuberculosis
gaugcccagcgcgcggu

SEQ ID NO: 829009 - RNA, 16 nt, Mycobacterium avium subsp. paratuberculosis
gaugcccagcggcaug

SEQ ID NO: 829010 - RNA, 18 nt, Mycobacterium avium subsp. paratuberculosis
gaugcccagcagcggggc

SEQ ID NO: 829011 - RNA, 24 nt, Mycobacterium avium subsp. paratuberculosis
gaugcccagcagcggggcgagcug

SEQ ID NO: 829012 - RNA, 22 nt, Mycobacterium avium subsp. paratuberculosis
gaugcccagccccucgacgucc

SEQ ID NO: 829013 - RNA, 17 nt, Mycobacterium avium subsp. paratuberculosis
gaugcccacccgcucgg

SEQ ID NO: 829014 - RNA, 18 nt, Mycobacterium avium subsp. paratuberculosis
gaugcccacccgcucggc

SEQ ID NO: 829015 - RNA, 21 nt, Mycobacterium avium subsp. paratuberculosis
gaugcccacccgcucggcgau

SEQ ID NO: 829016 - RNA, 15 nt, Mycobacterium avium subsp. paratuberculosis
gaugccgaccgacag

SEQ ID NO: 829017 - RNA, 18 nt, Mycobacterium avium subsp. paratuberculosis
gaugccgaccgacagccg

SEQ ID NO: 829018 - RNA, 15 nt, Mycobacterium avium subsp. paratuberculosis
gaugccgaacuccgc

SEQ ID NO: 829019 - RNA, 17 nt, Mycobacterium avium subsp. paratuberculosis
gaugcccuuggccagca

SEQ ID NO: 829020 - RNA, 19 nt, Mycobacterium avium subsp. paratuberculosis
gaugcccgugaucgccacg

SEQ ID NO: 829021 - RNA, 17 nt, Mycobacterium avium subsp. paratuberculosis
gaugcccuagcgguggc

SEQ ID NO: 829022 - RNA, 13 nt, Mycobacterium avium subsp. paratuberculosis
gaugcccgcgccg

SEQ ID NO: 829023 - RNA, 19 nt, Mycobacterium avium subsp. paratuberculosis
gaugcccgccccgcccggc

SEQ ID NO: 829024 - RNA, 22 nt, Mycobacterium avium subsp. paratuberculosis
gaugcccgccccgcccggcggc

SEQ ID NO: 829025 - RNA, 13 nt, Mycobacterium avium subsp. paratuberculosis
gaugcccgccggc

SEQ ID NO: 829026 - RNA, 14 nt, Mycobacterium avium subsp. paratuberculosis
gaugcccgccggcc

SEQ ID NO: 829027 - RNA, 19 nt, Mycobacterium avium subsp. paratuberculosis
gaugcccgccggcgucugc

SEQ ID NO: 829028 - RNA, 15 nt, Mycobacterium avium subsp. paratuberculosis
gaugccccaggcgaa

SEQ ID NO: 829029 - RNA, 13 nt, Mycobacterium avium subsp. paratuberculosis
gaugcccgggccg

SEQ ID NO: 829030 - RNA, 14 nt, Mycobacterium avium subsp. paratuberculosis
gaugcccgggccgu

SEQ ID NO: 829031 - RNA, 21 nt, Mycobacterium avium subsp. paratuberculosis
gaugcccggggugcuggcgua

SEQ ID NO: 829032 - RNA, 19 nt, Mycobacterium avium subsp. paratuberculosis
gaugcccgucacggccguc

SEQ ID NO: 829033 - RNA, 17 nt, Mycobacterium avium subsp. paratuberculosis
gaugcccaagccggcca

SEQ ID NO: 829034 - RNA, 17 nt, Mycobacterium avium subsp. paratuberculosis
gaugcccgacaccgccc

SEQ ID NO: 829035 - RNA, 20 nt, Mycobacterium avium subsp. paratuberculosis
gaugcccgacaccgccccgc

SEQ ID NO: 829036 - RNA, 16 nt, Mycobacterium avium subsp. paratuberculosis
gaucgacuccgggugg

SEQ ID NO: 829037 - RNA, 22 nt, Mycobacterium avium subsp. paratuberculosis
gaucgacgucaccaccgggucg

SEQ ID NO: 829038 - RNA, 23 nt, Mycobacterium avium subsp. paratuberculosis
gaucgacgucagcucccccgaca

SEQ ID NO: 829039 - RNA, 16 nt, Mycobacterium avium subsp. paratuberculosis
gaucgacgucgacuga

SEQ ID NO: 829040 - RNA, 14 nt, Mycobacterium avium subsp. paratuberculosis
gaucgaccggacga

SEQ ID NO: 829041 - RNA, 15 nt, Mycobacterium avium subsp. paratuberculosis
gaucgagccgcggcc

SEQ ID NO: 829042 - RNA, 16 nt, Mycobacterium avium subsp. paratuberculosis
gaucgagccgcggccc

SEQ ID NO: 829043 - RNA, 13 nt, Mycobacterium avium subsp. paratuberculosis
gaucgagccggug

SEQ ID NO: 829044 - RNA, 18 nt, Mycobacterium avium subsp. paratuberculosis
gaucgagcacccggcggg

SEQ ID NO: 829045 - RNA, 14 nt, Mycobacterium avium subsp. paratuberculosis
gaucgagcaccggg

SEQ ID NO: 829046 - RNA, 16 nt, Mycobacterium avium subsp. paratuberculosis
gaucgaggccagcgcg

SEQ ID NO: 829047 - RNA, 17 nt, Mycobacterium avium subsp. paratuberculosis
gaucgaggccagcgcga

SEQ ID NO: 829048 - RNA, 16 nt, Mycobacterium avium subsp. paratuberculosis
gaucgaggacaccgcg

SEQ ID NO: 829049 - RNA, 22 nt, Mycobacterium avium subsp. paratuberculosis
gaucgagguagcgugcgcccga

SEQ ID NO: 829050 - RNA, 12 nt, Mycobacterium avium subsp. paratuberculosis
gaucgccgcgaa

SEQ ID NO: 829051 - RNA, 14 nt, Mycobacterium avium subsp. paratuberculosis
gaucgccgcgaaca

SEQ ID NO: 829052 - RNA, 23 nt, Mycobacterium avium subsp. paratuberculosis
gaucgccgcgcauucaccagcug

SEQ ID NO: 829053 - RNA, 17 nt, Mycobacterium avium subsp. paratuberculosis
gaucgccgcgcccagca

SEQ ID NO: 829054 - RNA, 19 nt, Mycobacterium avium subsp. paratuberculosis
gaucgccgcgcccagcacg

SEQ ID NO: 829055 - RNA, 16 nt, Mycobacterium avium subsp. paratuberculosis
gaucgccggacagcgg

SEQ ID NO: 829056 - RNA, 18 nt, Mycobacterium avium subsp. paratuberculosis
gaucgccggacagcgggc

SEQ ID NO: 829057 - RNA, 20 nt, Mycobacterium avium subsp. paratuberculosis
gaucgccggacagcgggccg

SEQ ID NO: 829058 - RNA, 15 nt, Mycobacterium avium subsp. paratuberculosis
gaucgccggaucgag

SEQ ID NO: 829059 - RNA, 19 nt, Mycobacterium avium subsp. paratuberculosis
gaucgccggaucgccgagg

SEQ ID NO: 829060 - RNA, 17 nt, Mycobacterium avium subsp. paratuberculosis
gaucgcgaucaccgcgg

SEQ ID NO: 829061 - RNA, 16 nt, Mycobacterium avium subsp. paratuberculosis
gaucgcgacggccggg

SEQ ID NO: 829062 - RNA, 20 nt, Mycobacterium avium subsp. paratuberculosis
gaucgcgacggccggggcca

SEQ ID NO: 829063 - RNA, 17 nt, Mycobacterium avium subsp. paratuberculosis
gaucgcgagcagggcgg

SEQ ID NO: 829064 - RNA, 20 nt, Mycobacterium avium subsp. paratuberculosis
gaucgcgagcagggcgggca

SEQ ID NO: 829065 - RNA, 21 nt, Mycobacterium avium subsp. paratuberculosis
gaucgcgaagaccagcguguc

SEQ ID NO: 829066 - RNA, 16 nt, Mycobacterium avium subsp. paratuberculosis
gaucgcgaccaccggc

SEQ ID NO: 829067 - RNA, 14 nt, Mycobacterium avium subsp. paratuberculosis
gaucgccggcgccg

SEQ ID NO: 829068 - RNA, 20 nt, Mycobacterium avium subsp. paratuberculosis
gaucgccucggccuuggcca

SEQ ID NO: 829069 - RNA, 17 nt, Mycobacterium avium subsp. paratuberculosis
gaucgccggugcggccg

SEQ ID NO: 829070 - RNA, 18 nt, Mycobacterium avium subsp. paratuberculosis
gaucgccggugcggccgc

SEQ ID NO: 829071 - RNA, 13 nt, Mycobacterium avium subsp. paratuberculosis
gaucgccgggucg

SEQ ID NO: 829072 - RNA, 20 nt, Mycobacterium avium subsp. paratuberculosis
gaucgccgggucgcacgccg

SEQ ID NO: 829073 - RNA, 22 nt, Mycobacterium avium subsp. paratuberculosis
gaucgccgggucgcacgccggu

SEQ ID NO: 829074 - RNA, 14 nt, Mycobacterium avium subsp. paratuberculosis
gaucgccgggaugg

SEQ ID NO: 829075 - RNA, 14 nt, Mycobacterium avium subsp. paratuberculosis
gaucgccgcggacc

SEQ ID NO: 829076 - RNA, 13 nt, Mycobacterium avium subsp. paratuberculosis
gaucgccuccguc

SEQ ID NO: 829077 - RNA, 22 nt, Mycobacterium avium subsp. paratuberculosis
gaucgccuccgucagcgccgcc

SEQ ID NO: 829078 - RNA, 22 nt, Mycobacterium avium subsp. paratuberculosis
gaucgcgauccgggcgccggcc

SEQ ID NO: 829079 - RNA, 14 nt, Mycobacterium avium subsp. paratuberculosis
gaucgcgaucgccg

SEQ ID NO: 829080 - RNA, 17 nt, Mycobacterium avium subsp. paratuberculosis
gaucgcgaugucgacgg

SEQ ID NO: 829081 - RNA, 12 nt, Mycobacterium avium subsp. paratuberculosis
gaucgcgccggc

SEQ ID NO: 829082 - RNA, 14 nt, Mycobacterium avium subsp. paratuberculosis
gaucgcgccggccg

SEQ ID NO: 829083 - RNA, 15 nt, Mycobacterium avium subsp. paratuberculosis
gaucgcgccggccgc

SEQ ID NO: 829084 - RNA, 19 nt, Mycobacterium avium subsp. paratuberculosis
gaucgcgccggccgccgcg

SEQ ID NO: 829085 - RNA, 20 nt, Mycobacterium avium subsp. paratuberculosis
gaucgcgccggccgccgcga

SEQ ID NO: 829086 - RNA, 14 nt, Mycobacterium avium subsp. paratuberculosis
gaucgcggccagcg

SEQ ID NO: 829087 - RNA, 13 nt, Mycobacterium avium subsp. paratuberculosis
gaucgcguagucc

SEQ ID NO: 829088 - RNA, 19 nt, Mycobacterium avium subsp. paratuberculosis
gaucgcgucaaccaccggc

SEQ ID NO: 829089 - RNA, 21 nt, Mycobacterium avium subsp. paratuberculosis
gaucgcgucgacggcgccgga

SEQ ID NO: 829090 - RNA, 15 nt, Mycobacterium avium subsp. paratuberculosis
gaucgcggccagcgu

SEQ ID NO: 829091 - RNA, 20 nt, Mycobacterium avium subsp. paratuberculosis
gaucgcggccagcgugaaca

SEQ ID NO: 829092 - RNA, 13 nt, Mycobacterium avium subsp. paratuberculosis
gaucgcgccgauc

SEQ ID NO: 829093 - RNA, 22 nt, Mycobacterium avium subsp. paratuberculosis
gaucgcgccuugggccaucccg

SEQ ID NO: 829094 - RNA, 17 nt, Mycobacterium avium subsp. paratuberculosis
gaucgcgcugaccaggc

SEQ ID NO: 829095 - RNA, 14 nt, Mycobacterium avium subsp. paratuberculosis
gaucgcugacgccg

SEQ ID NO: 829096 - RNA, 20 nt, Mycobacterium avium subsp. paratuberculosis
gaucgcuucggccagcgcgu

SEQ ID NO: 829097 - RNA, 18 nt, Mycobacterium avium subsp. paratuberculosis
gaucgcguucugcaccag

SEQ ID NO: 829098 - RNA, 20 nt, Mycobacterium avium subsp. paratuberculosis
gaucgcguucugcaccagcu

SEQ ID NO: 829099 - RNA, 23 nt, Mycobacterium avium subsp. paratuberculosis
gaucgcguucugcaccagcucgg

SEQ ID NO: 829100 - RNA, 21 nt, Mycobacterium avium subsp. paratuberculosis
gaucggccagcgcggccgggc

SEQ ID NO: 829101 - RNA, 13 nt, Mycobacterium avium subsp. paratuberculosis
gaucggaccgcac

SEQ ID NO: 829102 - RNA, 15 nt, Mycobacterium avium subsp. paratuberculosis
gaucggaccgcacca

SEQ ID NO: 829103 - RNA, 20 nt, Mycobacterium avium subsp. paratuberculosis
gaucggaccgcaccaccacg

SEQ ID NO: 829104 - RNA, 16 nt, Mycobacterium avium subsp. paratuberculosis
gaucggcccccgggcc

SEQ ID NO: 829105 - RNA, 17 nt, Mycobacterium avium subsp. paratuberculosis
gaucggcccccgggccc

SEQ ID NO: 829106 - RNA, 22 nt, Mycobacterium avium subsp. paratuberculosis
gaucggcccgacggguucgcgc

SEQ ID NO: 829107 - RNA, 20 nt, Mycobacterium avium subsp. paratuberculosis
gaucggccaggcgcccagca

SEQ ID NO: 829108 - RNA, 21 nt, Mycobacterium avium subsp. paratuberculosis
gaucggccagguugucgucgg

SEQ ID NO: 829109 - RNA, 13 nt, Mycobacterium avium subsp. paratuberculosis
gaucggcccggcc

SEQ ID NO: 829110 - RNA, 20 nt, Mycobacterium avium subsp. paratuberculosis
gaucggccauggugccgccg

SEQ ID NO: 829111 - RNA, 21 nt, Mycobacterium avium subsp. paratuberculosis
gaucggccauggugccgccgu

SEQ ID NO: 829112 - RNA, 15 nt, Mycobacterium avium subsp. paratuberculosis
gaucggccgcgucgg

SEQ ID NO: 829113 - RNA, 20 nt, Mycobacterium avium subsp. paratuberculosis
gaucggccgcugcccgggca

SEQ ID NO: 829114 - RNA, 23 nt, Mycobacterium avium subsp. paratuberculosis
gaucggccgcugcgggcgggccg

SEQ ID NO: 829115 - RNA, 23 nt, Mycobacterium avium subsp. paratuberculosis
gaucccagaauucgccggggcac

SEQ ID NO: 829116 - RNA, 13 nt, Mycobacterium avium subsp. paratuberculosis
gauccccagcggc

SEQ ID NO: 829117 - RNA, 23 nt, Mycobacterium avium subsp. paratuberculosis
gauccccgcgcugggcuggccgu

SEQ ID NO: 829118 - RNA, 21 nt, Mycobacterium avium subsp. paratuberculosis
gauccagguacugggcguggu

SEQ ID NO: 829119 - RNA, 15 nt, Mycobacterium avium subsp. paratuberculosis
gaucacggugaucgc

SEQ ID NO: 829120 - RNA, 18 nt, Mycobacterium avium subsp. paratuberculosis
gaucacggugaucgccgg

SEQ ID NO: 829121 - RNA, 19 nt, Mycobacterium avium subsp. paratuberculosis
gaucacgccgccggggcgc

SEQ ID NO: 829122 - RNA, 13 nt, Mycobacterium avium subsp. paratuberculosis
gaucacgcggcgg

SEQ ID NO: 829123 - RNA, 17 nt, Mycobacterium avium subsp. paratuberculosis
gaucacgccggugagca

SEQ ID NO: 829124 - RNA, 16 nt, Mycobacterium avium subsp. paratuberculosis
gaucacgacgcgaccg

SEQ ID NO: 829125 - RNA, 17 nt, Mycobacterium avium subsp. paratuberculosis
gaucacgaacagguccg

SEQ ID NO: 829126 - RNA, 13 nt, Mycobacterium avium subsp. paratuberculosis
gaucacgauguug

SEQ ID NO: 829127 - RNA, 16 nt, Mycobacterium avium subsp. paratuberculosis
gaucaccgcgcucggc

SEQ ID NO: 829128 - RNA, 18 nt, Mycobacterium avium subsp. paratuberculosis
gaucaccgcgcucggcga

SEQ ID NO: 829129 - RNA, 13 nt, Mycobacterium avium subsp. paratuberculosis
gaucaccgcggcc

SEQ ID NO: 829130 - RNA, 14 nt, Mycobacterium avium subsp. paratuberculosis
gaucaccgcggcca

SEQ ID NO: 829131 - RNA, 20 nt, Mycobacterium avium subsp. paratuberculosis
gaucaccgcggccaccaccg

SEQ ID NO: 829132 - RNA, 15 nt, Mycobacterium avium subsp. paratuberculosis
gaucaccuugcggcc

SEQ ID NO: 829133 - RNA, 16 nt, Mycobacterium avium subsp. paratuberculosis
gaucaccuugcggccg

SEQ ID NO: 829134 - RNA, 17 nt, Mycobacterium avium subsp. paratuberculosis
gaucaccgacagcgcgu

SEQ ID NO: 829135 - RNA, 16 nt, Mycobacterium avium subsp. paratuberculosis
gaucaccgccagcgcg

SEQ ID NO: 829136 - RNA, 14 nt, Mycobacterium avium subsp. paratuberculosis
gaucaccgccgcgg

SEQ ID NO: 829137 - RNA, 15 nt, Mycobacterium avium subsp. paratuberculosis
gaucaccgccgcggc

SEQ ID NO: 829138 - RNA, 20 nt, Mycobacterium avium subsp. paratuberculosis
gaucacccgccggguggccg

SEQ ID NO: 829139 - RNA, 18 nt, Mycobacterium avium subsp. paratuberculosis
gaucacccucggcguccc

SEQ ID NO: 829140 - RNA, 15 nt, Mycobacterium avium subsp. paratuberculosis
gaucacccagccguu

SEQ ID NO: 829141 - RNA, 23 nt, Mycobacterium avium subsp. paratuberculosis
gaucacccccgacaccguggugg

SEQ ID NO: 829142 - RNA, 21 nt, Mycobacterium avium subsp. paratuberculosis
gaucgacccgcuccgacgcgg

SEQ ID NO: 829143 - RNA, 14 nt, Mycobacterium avium subsp. paratuberculosis
gaucgacgccgaca

SEQ ID NO: 829144 - RNA, 19 nt, Mycobacterium avium subsp. paratuberculosis
gaucgacgccgacaucgcg

SEQ ID NO: 829145 - RNA, 14 nt, Mycobacterium avium subsp. paratuberculosis
gaucgacgccgacc

SEQ ID NO: 829146 - RNA, 18 nt, Mycobacterium avium subsp. paratuberculosis
gaucgacgccgaccgcgg

SEQ ID NO: 829147 - RNA, 20 nt, Mycobacterium avium subsp. paratuberculosis
gaucgacgccgaccgcgguc

SEQ ID NO: 829148 - RNA, 17 nt, Mycobacterium avium subsp. paratuberculosis
gaucgacgagccgggcc

SEQ ID NO: 829149 - RNA, 18 nt, Mycobacterium avium subsp. paratuberculosis
gaucgacgagccgggcca

SEQ ID NO: 829150 - RNA, 14 nt, Mycobacterium avium subsp. paratuberculosis
gaucgacgacgcca

SEQ ID NO: 829151 - RNA, 23 nt, Mycobacterium avium subsp. paratuberculosis
gaucgacgacgccagcugccgcg

SEQ ID NO: 829152 - RNA, 19 nt, Mycobacterium avium subsp. paratuberculosis
gauccucgucuccggcggc

SEQ ID NO: 829153 - RNA, 19 nt, Mycobacterium avium subsp. paratuberculosis
gauccucgccgcgggccag

SEQ ID NO: 829154 - RNA, 23 nt, Mycobacterium avium subsp. paratuberculosis
gauccucgccgcgggccagccag

SEQ ID NO: 829155 - RNA, 16 nt, Mycobacterium avium subsp. paratuberculosis
gauccgucgccccgca

SEQ ID NO: 829156 - RNA, 14 nt, Mycobacterium avium subsp. paratuberculosis
gauccgguccagcc

SEQ ID NO: 829157 - RNA, 16 nt, Mycobacterium avium subsp. paratuberculosis
gauccgguccagcccg

SEQ ID NO: 829158 - RNA, 22 nt, Mycobacterium avium subsp. paratuberculosis
gauccggucgaucaccucgucg

SEQ ID NO: 829159 - RNA, 14 nt, Mycobacterium avium subsp. paratuberculosis
gauccggucgauga

SEQ ID NO: 829160 - RNA, 18 nt, Mycobacterium avium subsp. paratuberculosis
gauccggugaccgcgacg

SEQ ID NO: 829161 - RNA, 23 nt, Mycobacterium avium subsp. paratuberculosis
gaucccgggccguucagcgggcg

SEQ ID NO: 829162 - RNA, 14 nt, Mycobacterium avium subsp. paratuberculosis
gaucccgucgucgg

SEQ ID NO: 829163 - RNA, 21 nt, Mycobacterium avium subsp. paratuberculosis
gaucccgucgucggcgccgcg

SEQ ID NO: 829164 - RNA, 23 nt, Mycobacterium avium subsp. paratuberculosis
gauccggggggcggggucgaagu

SEQ ID NO: 829165 - RNA, 22 nt, Mycobacterium avium subsp. paratuberculosis
gaucccggcgagcacgccgccg

SEQ ID NO: 829166 - RNA, 18 nt, Mycobacterium avium subsp. paratuberculosis
gauccgguaccagaucga

SEQ ID NO: 829167 - RNA, 15 nt, Mycobacterium avium subsp. paratuberculosis
gaucccggggcgcgc

SEQ ID NO: 829168 - RNA, 18 nt, Mycobacterium avium subsp. paratuberculosis
gaucccggggcgcgcugg

SEQ ID NO: 829169 - RNA, 21 nt, Mycobacterium avium subsp. paratuberculosis
gauccgggcacgcagcggcgu

SEQ ID NO: 829170 - RNA, 21 nt, Mycobacterium avium subsp. paratuberculosis
gauccgggcauggucaccgga

SEQ ID NO: 829171 - RNA, 16 nt, Mycobacterium avium subsp. paratuberculosis
gauccgggccggucgg

SEQ ID NO: 829172 - RNA, 22 nt, Mycobacterium avium subsp. paratuberculosis
gauccgggcgccauccgccacc

SEQ ID NO: 829173 - RNA, 13 nt, Mycobacterium avium subsp. paratuberculosis
gauccgggcgccg

SEQ ID NO: 829174 - RNA, 14 nt, Mycobacterium avium subsp. paratuberculosis
gauccgggcgccgg

SEQ ID NO: 829175 - RNA, 20 nt, Mycobacterium avium subsp. paratuberculosis
gauccgggcgccggccggcg

SEQ ID NO: 829176 - RNA, 15 nt, Mycobacterium avium subsp. paratuberculosis
gauccgggcgccggu

SEQ ID NO: 829177 - RNA, 13 nt, Mycobacterium avium subsp. paratuberculosis
gaucccgccggcg

SEQ ID NO: 829178 - RNA, 14 nt, Mycobacterium avium subsp. paratuberculosis
gaucccgccggcgg

SEQ ID NO: 829179 - RNA, 17 nt, Mycobacterium avium subsp. paratuberculosis
gaucccgccggcggcca

SEQ ID NO: 829180 - RNA, 14 nt, Mycobacterium avium subsp. paratuberculosis
gaucccgcuggcca

SEQ ID NO: 829181 - RNA, 19 nt, Mycobacterium avium subsp. paratuberculosis
gaucccgaaaccgucgacc

SEQ ID NO: 829182 - RNA, 20 nt, Mycobacterium avium subsp. paratuberculosis
gaucccgaaaccgucgacca

SEQ ID NO: 829183 - RNA, 17 nt, Mycobacterium avium subsp. paratuberculosis
gaucccgaacugccgcg

SEQ ID NO: 829184 - RNA, 17 nt, Mycobacterium avium subsp. paratuberculosis
gaucccgauccucgccu

SEQ ID NO: 829185 - RNA, 17 nt, Mycobacterium avium subsp. paratuberculosis
gaucccgcagccgcgac

SEQ ID NO: 829186 - RNA, 13 nt, Mycobacterium avium subsp. paratuberculosis
gaucccgccgccc

SEQ ID NO: 829187 - RNA, 22 nt, Mycobacterium avium subsp. paratuberculosis
gaucgugggcaacacgucgucc

SEQ ID NO: 829188 - RNA, 15 nt, Mycobacterium avium subsp. paratuberculosis
gaucguguggccgcc

SEQ ID NO: 829189 - RNA, 19 nt, Mycobacterium avium subsp. paratuberculosis
gaucguugaugucgguggu

SEQ ID NO: 829190 - RNA, 15 nt, Mycobacterium avium subsp. paratuberculosis
gaucucaucgucgag

SEQ ID NO: 829191 - RNA, 23 nt, Mycobacterium avium subsp. paratuberculosis
gaucuccaccguguucaccagcg

SEQ ID NO: 829192 - RNA, 20 nt, Mycobacterium avium subsp. paratuberculosis
gaucgucuggccguugauga

SEQ ID NO: 829193 - RNA, 21 nt, Mycobacterium avium subsp. paratuberculosis
gaucgugcgcccauccggcgc

SEQ ID NO: 829194 - RNA, 23 nt, Mycobacterium avium subsp. paratuberculosis
gaucgugcuguggaacacgucgg

SEQ ID NO: 829195 - RNA, 16 nt, Mycobacterium avium subsp. paratuberculosis
gaucgugucccggcgc

SEQ ID NO: 829196 - RNA, 18 nt, Mycobacterium avium subsp. paratuberculosis
gaucguguccgcgccggc

SEQ ID NO: 829197 - RNA, 15 nt, Mycobacterium avium subsp. paratuberculosis
gaucgugucgaucgu

SEQ ID NO: 829198 - RNA, 21 nt, Mycobacterium avium subsp. paratuberculosis
gaucgugucuggccccgucgu

SEQ ID NO: 829199 - RNA, 19 nt, Mycobacterium avium subsp. paratuberculosis
gaucggcgccuugguccgc

SEQ ID NO: 829200 - RNA, 17 nt, Mycobacterium avium subsp. paratuberculosis
gaucggcgcccaccgcg

SEQ ID NO: 829201 - RNA, 19 nt, Mycobacterium avium subsp. paratuberculosis
gaucggcgcccaccgcggc

SEQ ID NO: 829202 - RNA, 15 nt, Mycobacterium avium subsp. paratuberculosis
gaucggcgagccggg

SEQ ID NO: 829203 - RNA, 22 nt, Mycobacterium avium subsp. paratuberculosis
gaucggcgagccgggaccgugc

SEQ ID NO: 829204 - RNA, 15 nt, Mycobacterium avium subsp. paratuberculosis
gaucgucucggccag

SEQ ID NO: 829205 - RNA, 18 nt, Mycobacterium avium subsp. paratuberculosis
gaucgucucggccagccg

SEQ ID NO: 829206 - RNA, 19 nt, Mycobacterium avium subsp. paratuberculosis
gaucgucucggccagccgg

SEQ ID NO: 829207 - RNA, 17 nt, Mycobacterium avium subsp. paratuberculosis
gaucgucuugaccgccc

SEQ ID NO: 829208 - RNA, 20 nt, Mycobacterium avium subsp. paratuberculosis
gaucgucuugaccgcccggg

SEQ ID NO: 829209 - RNA, 23 nt, Mycobacterium avium subsp. paratuberculosis
gaucgucuugccgaagaugucgg

SEQ ID NO: 829210 - RNA, 15 nt, Mycobacterium avium subsp. paratuberculosis
gaucggcgcgccgaa

SEQ ID NO: 829211 - RNA, 15 nt, Mycobacterium avium subsp. paratuberculosis
gaucggcgcggcgaa

SEQ ID NO: 829212 - RNA, 16 nt, Mycobacterium avium subsp. paratuberculosis
gaucuggcgcagcguc

SEQ ID NO: 829213 - RNA, 16 nt, Mycobacterium avium subsp. paratuberculosis
gaucuggcgcaucagc

SEQ ID NO: 829214 - RNA, 16 nt, Mycobacterium avium subsp. paratuberculosis
gaucuucucgauggug

SEQ ID NO: 829215 - RNA, 13 nt, Mycobacterium avium subsp. paratuberculosis
gaucugggcggcg

SEQ ID NO: 829216 - RNA, 19 nt, Mycobacterium avium subsp. paratuberculosis
gaucugggcggcgggacgg

SEQ ID NO: 829217 - RNA, 22 nt, Mycobacterium avium subsp. paratuberculosis
gaucuugucguccagugacgcc

SEQ ID NO: 829218 - RNA, 13 nt, Mycobacterium avium subsp. paratuberculosis
gaucuugaucgcc

SEQ ID NO: 829219 - RNA, 17 nt, Mycobacterium avium subsp. paratuberculosis
gaucuugcccagccacg

SEQ ID NO: 829220 - RNA, 20 nt, Mycobacterium avium subsp. paratuberculosis
gaucuucucggugucgucga

SEQ ID NO: 829221 - RNA, 18 nt, Mycobacterium avium subsp. paratuberculosis
gaucuugccgucggccgc

SEQ ID NO: 829222 - RNA, 19 nt, Mycobacterium avium subsp. paratuberculosis
gaucuugccgucggccgcc

SEQ ID NO: 829223 - RNA, 19 nt, Mycobacterium avium subsp. paratuberculosis
gaucuugcgaaagcgcggg

SEQ ID NO: 829224 - RNA, 14 nt, Mycobacterium avium subsp. paratuberculosis
gaucugcgccguga

SEQ ID NO: 829225 - RNA, 17 nt, Mycobacterium avium subsp. paratuberculosis
gaucugcggcaccacgc

SEQ ID NO: 829226 - RNA, 19 nt, Mycobacterium avium subsp. paratuberculosis
gaucugcggcaccacgcug

SEQ ID NO: 829227 - RNA, 20 nt, Mycobacterium avium subsp. paratuberculosis
gaucucggucaccgagcggc

SEQ ID NO: 829228 - RNA, 20 nt, Mycobacterium avium subsp. paratuberculosis
gaucucggugccggugauga

SEQ ID NO: 829229 - RNA, 18 nt, Mycobacterium avium subsp. paratuberculosis
gaucugcgcaagaagggc

SEQ ID NO: 829230 - RNA, 12 nt, Mycobacterium avium subsp. paratuberculosis
gaucugcgccgc

SEQ ID NO: 829231 - RNA, 11 nt, Mycobacterium avium subsp. paratuberculosis
gaucugcucgg

SEQ ID NO: 829232 - RNA, 21 nt, Mycobacterium avium subsp. paratuberculosis
gaucugcucgugcaaaccgga

SEQ ID NO: 829233 - RNA, 19 nt, Mycobacterium avium subsp. paratuberculosis
gaucugcgucauggagauc

SEQ ID NO: 829234 - RNA, 17 nt, Mycobacterium avium subsp. paratuberculosis
gaucugcuccggggugg

SEQ ID NO: 829235 - RNA, 14 nt, Mycobacterium avium subsp. paratuberculosis
gaucucggagaccu

SEQ ID NO: 829236 - RNA, 20 nt, Mycobacterium avium subsp. paratuberculosis
gaucucggccagcgggcggc

SEQ ID NO: 829237 - RNA, 16 nt, Mycobacterium avium subsp. paratuberculosis
gaucucggcggacucg

SEQ ID NO: 829238 - RNA, 15 nt, Mycobacterium avium subsp. paratuberculosis
gaucucggcggccgc

SEQ ID NO: 829239 - RNA, 13 nt, Mycobacterium avium subsp. paratuberculosis
gaucucggcguac

SEQ ID NO: 829240 - RNA, 13 nt, Mycobacterium avium subsp. paratuberculosis
gaucucgcgcagg

SEQ ID NO: 829241 - RNA, 17 nt, Mycobacterium avium subsp. paratuberculosis
gaucucgcgcagguccg

SEQ ID NO: 829242 - RNA, 23 nt, Mycobacterium avium subsp. paratuberculosis
gaucucgccgaaggccgggucgg

SEQ ID NO: 829243 - RNA, 13 nt, Mycobacterium avium subsp. paratuberculosis
gaucucgcgccgc

SEQ ID NO: 829244 - RNA, 14 nt, Mycobacterium avium subsp. paratuberculosis
gaucucgcgccgcg

SEQ ID NO: 829245 - RNA, 16 nt, Mycobacterium avium subsp. paratuberculosis
gaucucgcgccgcgca

SEQ ID NO: 829246 - RNA, 13 nt, Mycobacterium avium subsp. paratuberculosis
gaucucgccgagc

SEQ ID NO: 829247 - RNA, 23 nt, Mycobacterium avium subsp. paratuberculosis
gaucucgccgagcacaccgucgc

SEQ ID NO: 829248 - RNA, 16 nt, Mycobacterium avium subsp. paratuberculosis
gaucucgccgcggugg

SEQ ID NO: 829249 - RNA, 17 nt, Mycobacterium avium subsp. paratuberculosis
gaucucgccgcgguggu

SEQ ID NO: 829250 - RNA, 20 nt, Mycobacterium avium subsp. paratuberculosis
gaucucgccgcggugguggg

SEQ ID NO: 829251 - RNA, 16 nt, Mycobacterium avium subsp. paratuberculosis
gaugagcugggcggcg

SEQ ID NO: 829252 - RNA, 21 nt, Mycobacterium avium subsp. paratuberculosis
gaugagcugggcggcgcgcug

SEQ ID NO: 829253 - RNA, 23 nt, Mycobacterium avium subsp. paratuberculosis
gaugaggucgcgaccgccggaca

SEQ ID NO: 829254 - RNA, 23 nt, Mycobacterium avium subsp. paratuberculosis
gaugaucaacacgucgucgugcg

SEQ ID NO: 829255 - RNA, 18 nt, Mycobacterium avium subsp. paratuberculosis
gaugaucaccucggugau

SEQ ID NO: 829256 - RNA, 14 nt, Mycobacterium avium subsp. paratuberculosis
gaugaucagccgcc

SEQ ID NO: 829257 - RNA, 17 nt, Mycobacterium avium subsp. paratuberculosis
gaugaucagccgcccga

SEQ ID NO: 829258 - RNA, 14 nt, Mycobacterium avium subsp. paratuberculosis
gaugacggcggcgg

SEQ ID NO: 829259 - RNA, 15 nt, Mycobacterium avium subsp. paratuberculosis
gaugacguugcgcgc

SEQ ID NO: 829260 - RNA, 23 nt, Mycobacterium avium subsp. paratuberculosis
gaugacguuggugaucgccgacg

SEQ ID NO: 829261 - RNA, 19 nt, Mycobacterium avium subsp. paratuberculosis
gaugagauccuuugcggcc

SEQ ID NO: 829262 - RNA, 17 nt, Mycobacterium avium subsp. paratuberculosis
gaugagccucagcgcgc

SEQ ID NO: 829263 - RNA, 19 nt, Mycobacterium avium subsp. paratuberculosis
gaugagcgagaugaucagc

SEQ ID NO: 829264 - RNA, 14 nt, Mycobacterium avium subsp. paratuberculosis
gaugacgcugccgc

SEQ ID NO: 829265 - RNA, 22 nt, Mycobacterium avium subsp. paratuberculosis
gaugacgccgcgccgcccggcg

SEQ ID NO: 829266 - RNA, 13 nt, Mycobacterium avium subsp. paratuberculosis
gaugacgccgcgg

SEQ ID NO: 829267 - RNA, 17 nt, Mycobacterium avium subsp. paratuberculosis
gaugacggggcguuggu

SEQ ID NO: 829268 - RNA, 19 nt, Mycobacterium avium subsp. paratuberculosis
gaugacggucugcaccggg

SEQ ID NO: 829269 - RNA, 15 nt, Mycobacterium avium subsp. paratuberculosis
gaugacgucgcgcug

SEQ ID NO: 829270 - RNA, 16 nt, Mycobacterium avium subsp. paratuberculosis
gaugacgucgcgcugc

SEQ ID NO: 829271 - RNA, 21 nt, Mycobacterium avium subsp. paratuberculosis
gaugacgucgcgcugccggcc

SEQ ID NO: 829272 - RNA, 14 nt, Mycobacterium avium subsp. paratuberculosis
gaugacgucgucgc

SEQ ID NO: 829273 - RNA, 19 nt, Mycobacterium avium subsp. paratuberculosis
gaugacgucgucgcggcgc

SEQ ID NO: 829274 - RNA, 19 nt, Mycobacterium avium subsp. paratuberculosis
gaugacgugcaccaccgcg

SEQ ID NO: 829275 - RNA, 22 nt, Mycobacterium avium subsp. paratuberculosis
gaugacgaauuccgcaccgguc

SEQ ID NO: 829276 - RNA, 20 nt, Mycobacterium avium subsp. paratuberculosis
gaugacgacggucaccggca

SEQ ID NO: 829277 - RNA, 24 nt, Mycobacterium avium subsp. paratuberculosis
gaugacgaugaugucgcccggcgg

SEQ ID NO: 829278 - RNA, 21 nt, Mycobacterium avium subsp. paratuberculosis
gaugaccuccuugcccagcgc

SEQ ID NO: 829279 - RNA, 23 nt, Mycobacterium avium subsp. paratuberculosis
gaugaccuccuugcccagcgcgg

SEQ ID NO: 829280 - RNA, 13 nt, Mycobacterium avium subsp. paratuberculosis
gaugaccucgcgc

SEQ ID NO: 829281 - RNA, 19 nt, Mycobacterium avium subsp. paratuberculosis
gaugaccucgcgcagcccc

SEQ ID NO: 829282 - RNA, 15 nt, Mycobacterium avium subsp. paratuberculosis
gaugaccucgcgccc

SEQ ID NO: 829283 - RNA, 19 nt, Mycobacterium avium subsp. paratuberculosis
gaugaccucgcgcccggcg

SEQ ID NO: 829284 - RNA, 22 nt, Mycobacterium avium subsp. paratuberculosis
gaugcacccggacgugaucgcg

SEQ ID NO: 829285 - RNA, 18 nt, Mycobacterium avium subsp. paratuberculosis
gaugaugguggcggccac

SEQ ID NO: 829286 - RNA, 23 nt, Mycobacterium avium subsp. paratuberculosis
gaugauuucggcguggcgguggc

SEQ ID NO: 829287 - RNA, 12 nt, Mycobacterium avium subsp. paratuberculosis
gaugcagcgccu

SEQ ID NO: 829288 - RNA, 20 nt, Mycobacterium avium subsp. paratuberculosis
gaugcagcagguugcggugu

SEQ ID NO: 829289 - RNA, 20 nt, Mycobacterium avium subsp. paratuberculosis
gaugcagcacauccagcccu

SEQ ID NO: 829290 - RNA, 21 nt, Mycobacterium avium subsp. paratuberculosis
gaugcagcacauccagcccug

SEQ ID NO: 829291 - RNA, 14 nt, Mycobacterium avium subsp. paratuberculosis
gaugcacggucggc

SEQ ID NO: 829292 - RNA, 21 nt, Mycobacterium avium subsp. paratuberculosis
gaugcacggucggccccgcgc

SEQ ID NO: 829293 - RNA, 22 nt, Mycobacterium avium subsp. paratuberculosis
gaugcacggucggccccgcgca

SEQ ID NO: 829294 - RNA, 20 nt, Mycobacterium avium subsp. paratuberculosis
gaugauccgcggcgccgggc

SEQ ID NO: 829295 - RNA, 22 nt, Mycobacterium avium subsp. paratuberculosis
gaugauccgcggcgccgggcgg

SEQ ID NO: 829296 - RNA, 18 nt, Mycobacterium avium subsp. paratuberculosis
gaugaucaggccggaccg

SEQ ID NO: 829297 - RNA, 22 nt, Mycobacterium avium subsp. paratuberculosis
gaugauccuggccuggucggcc

SEQ ID NO: 829298 - RNA, 23 nt, Mycobacterium avium subsp. paratuberculosis
gaugauccuggccuggucggccg

SEQ ID NO: 829299 - RNA, 16 nt, Mycobacterium avium subsp. paratuberculosis
gaugaucgagccgcgg

SEQ ID NO: 829300 - RNA, 21 nt, Mycobacterium avium subsp. paratuberculosis
gaugaucgagccgcggcccgc

SEQ ID NO: 829301 - RNA, 21 nt, Mycobacterium avium subsp. paratuberculosis
gaugaucgccgauccgggcgg

SEQ ID NO: 829302 - RNA, 17 nt, Mycobacterium avium subsp. paratuberculosis
gaugaucgucucggccg

SEQ ID NO: 829303 - RNA, 19 nt, Mycobacterium avium subsp. paratuberculosis
gaugaugaaaccggccagc

SEQ ID NO: 829304 - RNA, 15 nt, Mycobacterium avium subsp. paratuberculosis
gaugaugaccgacau

SEQ ID NO: 829305 - RNA, 17 nt, Mycobacterium avium subsp. paratuberculosis
gaugaugucggcggccg

SEQ ID NO: 829306 - RNA, 15 nt, Mycobacterium avium subsp. paratuberculosis
gaugaugucguuggu

SEQ ID NO: 829307 - RNA, 17 nt, Mycobacterium avium subsp. paratuberculosis
gaugauguucuccggcc

SEQ ID NO: 829308 - RNA, 16 nt, Mycobacterium avium subsp. paratuberculosis
gaugauggcgucgacg

SEQ ID NO: 829309 - RNA, 14 nt, Mycobacterium avium subsp. paratuberculosis
gaugaugggcgauc

SEQ ID NO: 829310 - RNA, 13 nt, Mycobacterium avium subsp. paratuberculosis
gaugaugccggcc

SEQ ID NO: 829311 - RNA, 17 nt, Mycobacterium avium subsp. paratuberculosis
gaugaugccggccgcgu

SEQ ID NO: 829312 - RNA, 22 nt, Mycobacterium avium subsp. paratuberculosis
gaugaugccgucacugucggcg

SEQ ID NO: 829313 - RNA, 23 nt, Mycobacterium avium subsp. paratuberculosis
gagcuacugcugguagacccggg

SEQ ID NO: 829314 - RNA, 14 nt, Mycobacterium avium subsp. paratuberculosis
gagcucaccgccga

SEQ ID NO: 829315 - RNA, 17 nt, Mycobacterium avium subsp. paratuberculosis
gagcucaccgccgauga

SEQ ID NO: 829316 - RNA, 14 nt, Mycobacterium avium subsp. paratuberculosis
gagcucaggccggc

SEQ ID NO: 829317 - RNA, 15 nt, Mycobacterium avium subsp. paratuberculosis
gagcucaggccggcc

SEQ ID NO: 829318 - RNA, 14 nt, Mycobacterium avium subsp. paratuberculosis
gagcuccucggcca

SEQ ID NO: 829319 - RNA, 17 nt, Mycobacterium avium subsp. paratuberculosis
gagcuccucggccagcg

SEQ ID NO: 829320 - RNA, 20 nt, Mycobacterium avium subsp. paratuberculosis
gagcugaaguucaccaccgc

SEQ ID NO: 829321 - RNA, 24 nt, Mycobacterium avium subsp. paratuberculosis
gagcugaaguucaccaccgcgcug

SEQ ID NO: 829322 - RNA, 15 nt, Mycobacterium avium subsp. paratuberculosis
gagcugacacccgac

SEQ ID NO: 829323 - RNA, 23 nt, Mycobacterium avium subsp. paratuberculosis
gagcugacacccgacgaagccgc

SEQ ID NO: 829324 - RNA, 17 nt, Mycobacterium avium subsp. paratuberculosis
gagcugaccuggcugac

SEQ ID NO: 829325 - RNA, 22 nt, Mycobacterium avium subsp. paratuberculosis
gagcugaccuggcugacggcgu

SEQ ID NO: 829326 - RNA, 18 nt, Mycobacterium avium subsp. paratuberculosis
gagcugaucgcggccggc

SEQ ID NO: 829327 - RNA, 19 nt, Mycobacterium avium subsp. paratuberculosis
gagcugaucgcggccggcg

SEQ ID NO: 829328 - RNA, 22 nt, Mycobacterium avium subsp. paratuberculosis
gagcugaucgcggccggcgagu

SEQ ID NO: 829329 - RNA, 22 nt, Mycobacterium avium subsp. paratuberculosis
gagcugaucgcgucgacggcgc

SEQ ID NO: 829330 - RNA, 14 nt, Mycobacterium avium subsp. paratuberculosis
gagcugaucggcgu

SEQ ID NO: 829331 - RNA, 23 nt, Mycobacterium avium subsp. paratuberculosis
gagcucgggcgcgaacagcgccg

SEQ ID NO: 829332 - RNA, 21 nt, Mycobacterium avium subsp. paratuberculosis
gagcucgugaugguccagcac

SEQ ID NO: 829333 - RNA, 16 nt, Mycobacterium avium subsp. paratuberculosis
gagcucguucucggcg

SEQ ID NO: 829334 - RNA, 20 nt, Mycobacterium avium subsp. paratuberculosis
gagcucguucucggcgaaca

SEQ ID NO: 829335 - RNA, 24 nt, Mycobacterium avium subsp. paratuberculosis
gagcucgcagucgaucagcgacgg

SEQ ID NO: 829336 - RNA, 19 nt, Mycobacterium avium subsp. paratuberculosis
gagcucgcggcgcagcucg

SEQ ID NO: 829337 - RNA, 17 nt, Mycobacterium avium subsp. paratuberculosis
gagcucggccaccagcg

SEQ ID NO: 829338 - RNA, 22 nt, Mycobacterium avium subsp. paratuberculosis
gagcucggccuugagccggucg

SEQ ID NO: 829339 - RNA, 21 nt, Mycobacterium avium subsp. paratuberculosis
gagcucggcgaggucguucga

SEQ ID NO: 829340 - RNA, 23 nt, Mycobacterium avium subsp. paratuberculosis
gagcguuccagguucagcccggc

SEQ ID NO: 829341 - RNA, 19 nt, Mycobacterium avium subsp. paratuberculosis
gagcguuccuuacgccgac

SEQ ID NO: 829342 - RNA, 16 nt, Mycobacterium avium subsp. paratuberculosis
gagcguucggcgcgga

SEQ ID NO: 829343 - RNA, 16 nt, Mycobacterium avium subsp. paratuberculosis
gagcguucuccacccg

SEQ ID NO: 829344 - RNA, 15 nt, Mycobacterium avium subsp. paratuberculosis
gagcgugaacuuaac

SEQ ID NO: 829345 - RNA, 17 nt, Mycobacterium avium subsp. paratuberculosis
gagcguggacaccgcac

SEQ ID NO: 829346 - RNA, 14 nt, Mycobacterium avium subsp. paratuberculosis
gagcgucauuccgc

SEQ ID NO: 829347 - RNA, 19 nt, Mycobacterium avium subsp. paratuberculosis
gagcgucauuccgccgcgc

SEQ ID NO: 829348 - RNA, 21 nt, Mycobacterium avium subsp. paratuberculosis
gagcgucauuccgccgcgccc

SEQ ID NO: 829349 - RNA, 17 nt, Mycobacterium avium subsp. paratuberculosis
gagcgucgccaccaccu

SEQ ID NO: 829350 - RNA, 12 nt, Mycobacterium avium subsp. paratuberculosis
gagcgucgugcg

SEQ ID NO: 829351 - RNA, 23 nt, Mycobacterium avium subsp. paratuberculosis
gagcguagcccuaccggcucggc

SEQ ID NO: 829352 - RNA, 12 nt, Mycobacterium avium subsp. paratuberculosis
gagcgucacgcc

SEQ ID NO: 829353 - RNA, 21 nt, Mycobacterium avium subsp. paratuberculosis
gagcgucacgccagcgugacg

SEQ ID NO: 829354 - RNA, 18 nt, Mycobacterium avium subsp. paratuberculosis
gagcgucacgccgcgccc

SEQ ID NO: 829355 - RNA, 20 nt, Mycobacterium avium subsp. paratuberculosis
gagcgucacgcuggcgugac

SEQ ID NO: 829356 - RNA, 21 nt, Mycobacterium avium subsp. paratuberculosis
gagcgucacgcuggcgugaca

SEQ ID NO: 829357 - RNA, 20 nt, Mycobacterium avium subsp. paratuberculosis
gagcgucacgcuggcguggc

SEQ ID NO: 829358 - RNA, 21 nt, Mycobacterium avium subsp. paratuberculosis
gagcgucacgcuggcguggcg

SEQ ID NO: 829359 - RNA, 21 nt, Mycobacterium avium subsp. paratuberculosis
gagcggcgcguccauggucga

SEQ ID NO: 829360 - RNA, 13 nt, Mycobacterium avium subsp. paratuberculosis
gagcggcgccacg

SEQ ID NO: 829361 - RNA, 16 nt, Mycobacterium avium subsp. paratuberculosis
gagcggcgccacgugg

SEQ ID NO: 829362 - RNA, 23 nt, Mycobacterium avium subsp. paratuberculosis
gagcgggacgcgcagaucgucga

SEQ ID NO: 829363 - RNA, 20 nt, Mycobacterium avium subsp. paratuberculosis
gagcgggauccccaccguga

SEQ ID NO: 829364 - RNA, 22 nt, Mycobacterium avium subsp. paratuberculosis
gagcgggauccccaccgugacg

SEQ ID NO: 829365 - RNA, 16 nt, Mycobacterium avium subsp. paratuberculosis
gagcgggaucccgcag

SEQ ID NO: 829366 - RNA, 21 nt, Mycobacterium avium subsp. paratuberculosis
gagcgggaucccgcagccgcg

SEQ ID NO: 829367 - RNA, 22 nt, Mycobacterium avium subsp. paratuberculosis
gagcgggaucccgcagccgcga

SEQ ID NO: 829368 - RNA, 23 nt, Mycobacterium avium subsp. paratuberculosis
gagcgggaucccgcagccgcgac

SEQ ID NO: 829369 - RNA, 19 nt, Mycobacterium avium subsp. paratuberculosis
gagcgggaucugcgccgcc

SEQ ID NO: 829370 - RNA, 13 nt, Mycobacterium avium subsp. paratuberculosis
gagcggcgguauc

SEQ ID NO: 829371 - RNA, 22 nt, Mycobacterium avium subsp. paratuberculosis
gagcggcugcuggucgacguca

SEQ ID NO: 829372 - RNA, 16 nt, Mycobacterium avium subsp. paratuberculosis
gagcgggcacgccgcc

SEQ ID NO: 829373 - RNA, 20 nt, Mycobacterium avium subsp. paratuberculosis
gagcggcccaacacgcccug

SEQ ID NO: 829374 - RNA, 15 nt, Mycobacterium avium subsp. paratuberculosis
gagcggcccagcucg

SEQ ID NO: 829375 - RNA, 16 nt, Mycobacterium avium subsp. paratuberculosis
gagcggcccagcucgg

SEQ ID NO: 829376 - RNA, 21 nt, Mycobacterium avium subsp. paratuberculosis
gagcggcccagcucggugauc

SEQ ID NO: 829377 - RNA, 19 nt, Mycobacterium avium subsp. paratuberculosis
gagcggcccgcaccgaugg

SEQ ID NO: 829378 - RNA, 15 nt, Mycobacterium avium subsp. paratuberculosis
gagcggcccugcgcg

SEQ ID NO: 829379 - RNA, 17 nt, Mycobacterium avium subsp. paratuberculosis
gagcggccgcagcgcau

SEQ ID NO: 829380 - RNA, 13 nt, Mycobacterium avium subsp. paratuberculosis
gagcggaucggcg

SEQ ID NO: 829381 - RNA, 20 nt, Mycobacterium avium subsp. paratuberculosis
gagcggauggcgccgucgag

SEQ ID NO: 829382 - RNA, 20 nt, Mycobacterium avium subsp. paratuberculosis
gagcggcacgaucggcagcg

SEQ ID NO: 829383 - RNA, 23 nt, Mycobacterium avium subsp. paratuberculosis
gagcggugucgcuuugcggcgaa

SEQ ID NO: 829384 - RNA, 24 nt, Mycobacterium avium subsp. paratuberculosis
gagcggugucgcuuugcggcgaac

SEQ ID NO: 829385 - RNA, 16 nt, Mycobacterium avium subsp. paratuberculosis
gagcgguuggcgacgc

SEQ ID NO: 829386 - RNA, 14 nt, Mycobacterium avium subsp. paratuberculosis
gagcggugacaucg

SEQ ID NO: 829387 - RNA, 17 nt, Mycobacterium avium subsp. paratuberculosis
gagcggugacaucgcca

SEQ ID NO: 829388 - RNA, 19 nt, Mycobacterium avium subsp. paratuberculosis
gagcggugacaucgccacc

SEQ ID NO: 829389 - RNA, 20 nt, Mycobacterium avium subsp. paratuberculosis
gagcggugacaucgccaccu

SEQ ID NO: 829390 - RNA, 14 nt, Mycobacterium avium subsp. paratuberculosis
gagcggugaccucg

SEQ ID NO: 829391 - RNA, 17 nt, Mycobacterium avium subsp. paratuberculosis
gagcgggucggccggcg

SEQ ID NO: 829392 - RNA, 14 nt, Mycobacterium avium subsp. paratuberculosis
gagcgggucgucgu

SEQ ID NO: 829393 - RNA, 15 nt, Mycobacterium avium subsp. paratuberculosis
gagcgggucgucguu

SEQ ID NO: 829394 - RNA, 22 nt, Mycobacterium avium subsp. paratuberculosis
gagcgggugaaucgacaccgca

SEQ ID NO: 829395 - RNA, 23 nt, Mycobacterium avium subsp. paratuberculosis
gagcgggugaaucgacaccgcac

SEQ ID NO: 829396 - RNA, 13 nt, Mycobacterium avium subsp. paratuberculosis
gagcgggccacgc

SEQ ID NO: 829397 - RNA, 14 nt, Mycobacterium avium subsp. paratuberculosis
gagcgggccacgca

SEQ ID NO: 829398 - RNA, 13 nt, Mycobacterium avium subsp. paratuberculosis
gagcgggccgacc

SEQ ID NO: 829399 - RNA, 22 nt, Mycobacterium avium subsp. paratuberculosis
gagcgcaacguguacucggcgu

SEQ ID NO: 829400 - RNA, 14 nt, Mycobacterium avium subsp. paratuberculosis
gagcgcaccagauu

SEQ ID NO: 829401 - RNA, 14 nt, Mycobacterium avium subsp. paratuberculosis
gagcgcaccgccca

SEQ ID NO: 829402 - RNA, 13 nt, Mycobacterium avium subsp. paratuberculosis
gagcgccagcgcg

SEQ ID NO: 829403 - RNA, 18 nt, Mycobacterium avium subsp. paratuberculosis
gagcgccagcgcggugcc

SEQ ID NO: 829404 - RNA, 20 nt, Mycobacterium avium subsp. paratuberculosis
gagcgccagcgcggugccca

SEQ ID NO: 829405 - RNA, 23 nt, Mycobacterium avium subsp. paratuberculosis
gagcgccagcgcggugcccagcc

SEQ ID NO: 829406 - RNA, 13 nt, Mycobacterium avium subsp. paratuberculosis
gagcgccaggcca

SEQ ID NO: 829407 - RNA, 16 nt, Mycobacterium avium subsp. paratuberculosis
gagcgccaggccaugg

SEQ ID NO: 829408 - RNA, 22 nt, Mycobacterium avium subsp. paratuberculosis
gagcgccaggccauggcgcacc

SEQ ID NO: 829409 - RNA, 13 nt, Mycobacterium avium subsp. paratuberculosis
gagcgccaccccg

SEQ ID NO: 829410 - RNA, 17 nt, Mycobacterium avium subsp. paratuberculosis
gagccuucuucgccgca

SEQ ID NO: 829411 - RNA, 18 nt, Mycobacterium avium subsp. paratuberculosis
gagccuucuucgccgcaa

SEQ ID NO: 829412 - RNA, 18 nt, Mycobacterium avium subsp. paratuberculosis
gagccuucuucgccgcag

SEQ ID NO: 829413 - RNA, 19 nt, Mycobacterium avium subsp. paratuberculosis
gagccuugcuggcggccuu

SEQ ID NO: 829414 - RNA, 13 nt, Mycobacterium avium subsp. paratuberculosis
gagccuuggucgc

SEQ ID NO: 829415 - RNA, 19 nt, Mycobacterium avium subsp. paratuberculosis
gagccuuggucgcggccuu

SEQ ID NO: 829416 - RNA, 17 nt, Mycobacterium avium subsp. paratuberculosis
gagcgaaggugccgcga

SEQ ID NO: 829417 - RNA, 23 nt, Mycobacterium avium subsp. paratuberculosis
gagcgacauggucgggcgcacca

SEQ ID NO: 829418 - RNA, 18 nt, Mycobacterium avium subsp. paratuberculosis
gagcgagaugaucagccg

SEQ ID NO: 829419 - RNA, 23 nt, Mycobacterium avium subsp. paratuberculosis
gagcgagaugaucagccgcccga

SEQ ID NO: 829420 - RNA, 13 nt, Mycobacterium avium subsp. paratuberculosis
gagcgagcgcacc

SEQ ID NO: 829421 - RNA, 14 nt, Mycobacterium avium subsp. paratuberculosis
gagcgaggccauca

SEQ ID NO: 829422 - RNA, 16 nt, Mycobacterium avium subsp. paratuberculosis
gagcgccccagggccu

SEQ ID NO: 829423 - RNA, 14 nt, Mycobacterium avium subsp. paratuberculosis
gagcgcccggccag

SEQ ID NO: 829424 - RNA, 13 nt, Mycobacterium avium subsp. paratuberculosis
gagcgcccgggcg

SEQ ID NO: 829425 - RNA, 16 nt, Mycobacterium avium subsp. paratuberculosis
gagcgcccgggcguuc

SEQ ID NO: 829426 - RNA, 13 nt, Mycobacterium avium subsp. paratuberculosis
gagcgcccggucg

SEQ ID NO: 829427 - RNA, 13 nt, Mycobacterium avium subsp. paratuberculosis
gagcgccggggcg

SEQ ID NO: 829428 - RNA, 14 nt, Mycobacterium avium subsp. paratuberculosis
gagcgccggggcgg

SEQ ID NO: 829429 - RNA, 14 nt, Mycobacterium avium subsp. paratuberculosis
gagcgccgcggcca

SEQ ID NO: 829430 - RNA, 15 nt, Mycobacterium avium subsp. paratuberculosis
gagcgccgcggccac

SEQ ID NO: 829431 - RNA, 22 nt, Mycobacterium avium subsp. paratuberculosis
gagcgccgcggccaccgggucg

SEQ ID NO: 829432 - RNA, 12 nt, Mycobacterium avium subsp. paratuberculosis
gagcgcgaagcc

SEQ ID NO: 829433 - RNA, 17 nt, Mycobacterium avium subsp. paratuberculosis
gagcgcgaaaaccagca

SEQ ID NO: 829434 - RNA, 23 nt, Mycobacterium avium subsp. paratuberculosis
gagcgcgaaaaccagcaccggca

SEQ ID NO: 829435 - RNA, 13 nt, Mycobacterium avium subsp. paratuberculosis
gagcgcgccgagc

SEQ ID NO: 829436 - RNA, 16 nt, Mycobacterium avium subsp. paratuberculosis
gagcgcgccgaggugg

SEQ ID NO: 829437 - RNA, 22 nt, Mycobacterium avium subsp. paratuberculosis
gagcgcgccgagguggcccgcc

SEQ ID NO: 829438 - RNA, 16 nt, Mycobacterium avium subsp. paratuberculosis
gagcgcgccggcccga

SEQ ID NO: 829439 - RNA, 20 nt, Mycobacterium avium subsp. paratuberculosis
gagcgcguucuccaccgcgc

SEQ ID NO: 829440 - RNA, 14 nt, Mycobacterium avium subsp. paratuberculosis
gagcgcuaccgcgc

SEQ ID NO: 829441 - RNA, 18 nt, Mycobacterium avium subsp. paratuberculosis
gagcgcuaccgcgcucac

SEQ ID NO: 829442 - RNA, 18 nt, Mycobacterium avium subsp. paratuberculosis
gagcgcucggacucagga

SEQ ID NO: 829443 - RNA, 16 nt, Mycobacterium avium subsp. paratuberculosis
gagcgcuccaccaccg

SEQ ID NO: 829444 - RNA, 22 nt, Mycobacterium avium subsp. paratuberculosis
gagcgcuggccuugaucgggua

SEQ ID NO: 829445 - RNA, 13 nt, Mycobacterium avium subsp. paratuberculosis
gagcgcuggucgg

SEQ ID NO: 829446 - RNA, 16 nt, Mycobacterium avium subsp. paratuberculosis
gagcgcuggucggcga

SEQ ID NO: 829447 - RNA, 18 nt, Mycobacterium avium subsp. paratuberculosis
gagcgcgguccacggugg

SEQ ID NO: 829448 - RNA, 13 nt, Mycobacterium avium subsp. paratuberculosis
gagcgcggcaugc

SEQ ID NO: 829449 - RNA, 18 nt, Mycobacterium avium subsp. paratuberculosis
gagcgcgucgucgccgaa

SEQ ID NO: 829450 - RNA, 14 nt, Mycobacterium avium subsp. paratuberculosis
gagcgcgucguugc

SEQ ID NO: 829451 - RNA, 18 nt, Mycobacterium avium subsp. paratuberculosis
gagcgcgugcacgaacgc

SEQ ID NO: 829452 - RNA, 13 nt, Mycobacterium avium subsp. paratuberculosis
gagcgcggcccgc

SEQ ID NO: 829453 - RNA, 14 nt, Mycobacterium avium subsp. paratuberculosis
gagcgcggcccgcc

SEQ ID NO: 829454 - RNA, 16 nt, Mycobacterium avium subsp. paratuberculosis
gagcgcggcccgccga

SEQ ID NO: 829455 - RNA, 14 nt, Mycobacterium avium subsp. paratuberculosis
gagcgcgcggugau

SEQ ID NO: 829456 - RNA, 18 nt, Mycobacterium avium subsp. paratuberculosis
gagcgcgcucaaccgccc

SEQ ID NO: 829457 - RNA, 21 nt, Mycobacterium avium subsp. paratuberculosis
gagcgcgcuguaggucgcgua

SEQ ID NO: 829458 - RNA, 14 nt, Mycobacterium avium subsp. paratuberculosis
gagcgcgcugugcg

SEQ ID NO: 829459 - RNA, 10 nt, Mycobacterium avium subsp. paratuberculosis
gagcgcggca

SEQ ID NO: 829460 - RNA, 22 nt, Mycobacterium avium subsp. paratuberculosis
gagcaguucgaugcgcucggcg

SEQ ID NO: 829461 - RNA, 18 nt, Mycobacterium avium subsp. paratuberculosis
gagcagugcaucgcugcc

SEQ ID NO: 829462 - RNA, 14 nt, Mycobacterium avium subsp. paratuberculosis
gagcaucgggcgca

SEQ ID NO: 829463 - RNA, 20 nt, Mycobacterium avium subsp. paratuberculosis
gagcaucggguugccggcgg

SEQ ID NO: 829464 - RNA, 21 nt, Mycobacterium avium subsp. paratuberculosis
gagcaucggguugccggcggc

SEQ ID NO: 829465 - RNA, 14 nt, Mycobacterium avium subsp. paratuberculosis
gagcaugcggguga

SEQ ID NO: 829466 - RNA, 13 nt, Mycobacterium avium subsp. paratuberculosis
gagcccagcguga

SEQ ID NO: 829467 - RNA, 14 nt, Mycobacterium avium subsp. paratuberculosis
gagcccagcgugaa

SEQ ID NO: 829468 - RNA, 16 nt, Mycobacterium avium subsp. paratuberculosis
gagcccagcugcgcgg

SEQ ID NO: 829469 - RNA, 16 nt, Mycobacterium avium subsp. paratuberculosis
gagcccagcuuggcgc

SEQ ID NO: 829470 - RNA, 18 nt, Mycobacterium avium subsp. paratuberculosis
gagcccaccgcgcccagc

SEQ ID NO: 829471 - RNA, 21 nt, Mycobacterium avium subsp. paratuberculosis
gagcccaccgcgcccagcccc

SEQ ID NO: 829472 - RNA, 19 nt, Mycobacterium avium subsp. paratuberculosis
gagccaguucgccagcaug

SEQ ID NO: 829473 - RNA, 19 nt, Mycobacterium avium subsp. paratuberculosis
gagccauaaaccggccggc

SEQ ID NO: 829474 - RNA, 23 nt, Mycobacterium avium subsp. paratuberculosis
gagccauaaaccggccggcgcgc

SEQ ID NO: 829475 - RNA, 15 nt, Mycobacterium avium subsp. paratuberculosis
gagcauuggcgaugg

SEQ ID NO: 829476 - RNA, 16 nt, Mycobacterium avium subsp. paratuberculosis
gagcauuucgcgcacg

SEQ ID NO: 829477 - RNA, 20 nt, Mycobacterium avium subsp. paratuberculosis
gagccacaacaugucccggg

SEQ ID NO: 829478 - RNA, 17 nt, Mycobacterium avium subsp. paratuberculosis
gagccaccacugcgccg

SEQ ID NO: 829479 - RNA, 23 nt, Mycobacterium avium subsp. paratuberculosis
gagccagacgguggggcuggccg

SEQ ID NO: 829480 - RNA, 15 nt, Mycobacterium avium subsp. paratuberculosis
gagccagcugcgcgu

SEQ ID NO: 829481 - RNA, 17 nt, Mycobacterium avium subsp. paratuberculosis
gagccagcugcgcgucg

SEQ ID NO: 829482 - RNA, 21 nt, Mycobacterium avium subsp. paratuberculosis
gagccagcugcgcgucggccg

SEQ ID NO: 829483 - RNA, 23 nt, Mycobacterium avium subsp. paratuberculosis
gagccagcugcgcgucggccgca

SEQ ID NO: 829484 - RNA, 14 nt, Mycobacterium avium subsp. paratuberculosis
gacgucgguguagc

SEQ ID NO: 829485 - RNA, 21 nt, Mycobacterium avium subsp. paratuberculosis
gacgucgguguagucggcgau

SEQ ID NO: 829486 - RNA, 22 nt, Mycobacterium avium subsp. paratuberculosis
gacgucgguguagucggcgauc

SEQ ID NO: 829487 - RNA, 13 nt, Mycobacterium avium subsp. paratuberculosis
gacgucgucgacc

SEQ ID NO: 829488 - RNA, 14 nt, Mycobacterium avium subsp. paratuberculosis
gacgucgucgacgu

SEQ ID NO: 829489 - RNA, 16 nt, Mycobacterium avium subsp. paratuberculosis
gacgucgucgacgucc

SEQ ID NO: 829490 - RNA, 14 nt, Mycobacterium avium subsp. paratuberculosis
gacgucgucgccca

SEQ ID NO: 829491 - RNA, 15 nt, Mycobacterium avium subsp. paratuberculosis
gacgucgucgcggcg

SEQ ID NO: 829492 - RNA, 17 nt, Mycobacterium avium subsp. paratuberculosis
gacgucgucgcggcgcu

SEQ ID NO: 829493 - RNA, 22 nt, Mycobacterium avium subsp. paratuberculosis
gacgucgucgcggcgcugccgg

SEQ ID NO: 829494 - RNA, 15 nt, Mycobacterium avium subsp. paratuberculosis
gacgucgugcacgcc

SEQ ID NO: 829495 - RNA, 21 nt, Mycobacterium avium subsp. paratuberculosis
gacgucguggcccggauggcc

SEQ ID NO: 829496 - RNA, 23 nt, Mycobacterium avium subsp. paratuberculosis
gacgucguuuuccagccggcgca

SEQ ID NO: 829497 - RNA, 23 nt, Mycobacterium avium subsp. paratuberculosis
gacgucucauaccagugcccgag

SEQ ID NO: 829498 - RNA, 17 nt, Mycobacterium avium subsp. paratuberculosis
gacgucugcggcucggc

SEQ ID NO: 829499 - RNA, 18 nt, Mycobacterium avium subsp. paratuberculosis
gacgucugcggcucggcg

SEQ ID NO: 829500 - RNA, 19 nt, Mycobacterium avium subsp. paratuberculosis
gacgucugcggcucggcgc

SEQ ID NO: 829501 - RNA, 13 nt, Mycobacterium avium subsp. paratuberculosis
gacgucugggccg

SEQ ID NO: 829502 - RNA, 18 nt, Mycobacterium avium subsp. paratuberculosis
gagcagcaggucggcgug

SEQ ID NO: 829503 - RNA, 14 nt, Mycobacterium avium subsp. paratuberculosis
gagcagcaugccga

SEQ ID NO: 829504 - RNA, 20 nt, Mycobacterium avium subsp. paratuberculosis
gagcagcaugccgagcaccu

SEQ ID NO: 829505 - RNA, 23 nt, Mycobacterium avium subsp. paratuberculosis
gagcagcaugccgagcaccuccg

SEQ ID NO: 829506 - RNA, 14 nt, Mycobacterium avium subsp. paratuberculosis
gagcagcagccgca

SEQ ID NO: 829507 - RNA, 22 nt, Mycobacterium avium subsp. paratuberculosis
gagcagcagccgcagcggcggc

SEQ ID NO: 829508 - RNA, 13 nt, Mycobacterium avium subsp. paratuberculosis
gagcagcagcgcg

SEQ ID NO: 829509 - RNA, 21 nt, Mycobacterium avium subsp. paratuberculosis
gagcagcccggcgaacaccac

SEQ ID NO: 829510 - RNA, 15 nt, Mycobacterium avium subsp. paratuberculosis
gagcagccgcaacca

SEQ ID NO: 829511 - RNA, 13 nt, Mycobacterium avium subsp. paratuberculosis
gagcagcgcccgg

SEQ ID NO: 829512 - RNA, 19 nt, Mycobacterium avium subsp. paratuberculosis
gagcagcgcccgggugcgc

SEQ ID NO: 829513 - RNA, 20 nt, Mycobacterium avium subsp. paratuberculosis
gagcagcgcccgggugcgcu

SEQ ID NO: 829514 - RNA, 22 nt, Mycobacterium avium subsp. paratuberculosis
gagcagcgcgaugccggccagg

SEQ ID NO: 829515 - RNA, 23 nt, Mycobacterium avium subsp. paratuberculosis
gagcagcgcgaugccggccaggc

SEQ ID NO: 829516 - RNA, 22 nt, Mycobacterium avium subsp. paratuberculosis
gagcagcgcgcgcuugcgcucg

SEQ ID NO: 829517 - RNA, 15 nt, Mycobacterium avium subsp. paratuberculosis
gagcaggaccgagcc

SEQ ID NO: 829518 - RNA, 16 nt, Mycobacterium avium subsp. paratuberculosis
gagcaggaccgagccg

SEQ ID NO: 829519 - RNA, 18 nt, Mycobacterium avium subsp. paratuberculosis
gagcaggaccgagccgcg

SEQ ID NO: 829520 - RNA, 23 nt, Mycobacterium avium subsp. paratuberculosis
gagcaggaccgagccgcgcgccg

SEQ ID NO: 829521 - RNA, 16 nt, Mycobacterium avium subsp. paratuberculosis
gagcagcucagccgcc

SEQ ID NO: 829522 - RNA, 22 nt, Mycobacterium avium subsp. paratuberculosis
gagcagcucgacaucggccgcc

SEQ ID NO: 829523 - RNA, 13 nt, Mycobacterium avium subsp. paratuberculosis
gagcagcucgcgg

SEQ ID NO: 829524 - RNA, 15 nt, Mycobacterium avium subsp. paratuberculosis
gagcagcucggcggc

SEQ ID NO: 829525 - RNA, 16 nt, Mycobacterium avium subsp. paratuberculosis
gagcagcucggcggcc

SEQ ID NO: 829526 - RNA, 19 nt, Mycobacterium avium subsp. paratuberculosis
gagcagcucggcggccugc

SEQ ID NO: 829527 - RNA, 20 nt, Mycobacterium avium subsp. paratuberculosis
gagcagcucggucaccagcg

SEQ ID NO: 829528 - RNA, 21 nt, Mycobacterium avium subsp. paratuberculosis
gagcagcugcagcgucgggua

SEQ ID NO: 829529 - RNA, 20 nt, Mycobacterium avium subsp. paratuberculosis
gagcagcugggacagcguca

SEQ ID NO: 829530 - RNA, 13 nt, Mycobacterium avium subsp. paratuberculosis
gagcagcggggug

SEQ ID NO: 829531 - RNA, 17 nt, Mycobacterium avium subsp. paratuberculosis
gagcagcggggugagca

SEQ ID NO: 829532 - RNA, 21 nt, Mycobacterium avium subsp. paratuberculosis
gagcagcggggugagcaccgc

SEQ ID NO: 829533 - RNA, 22 nt, Mycobacterium avium subsp. paratuberculosis
gagcagcggggugagcaccgcg

SEQ ID NO: 829534 - RNA, 23 nt, Mycobacterium avium subsp. paratuberculosis
gagcagcggggugagcaccgcga

SEQ ID NO: 829535 - RNA, 13 nt, Mycobacterium avium subsp. paratuberculosis
gagcagcgggucg

SEQ ID NO: 829536 - RNA, 14 nt, Mycobacterium avium subsp. paratuberculosis
gagcagcgguuggc

SEQ ID NO: 829537 - RNA, 19 nt, Mycobacterium avium subsp. paratuberculosis
gagcaggcuggcaugccgg

SEQ ID NO: 829538 - RNA, 17 nt, Mycobacterium avium subsp. paratuberculosis
gagcaggcuucgcagca

SEQ ID NO: 829539 - RNA, 15 nt, Mycobacterium avium subsp. paratuberculosis
gagcagggccagcgg

SEQ ID NO: 829540 - RNA, 17 nt, Mycobacterium avium subsp. paratuberculosis
gagcagggccagcggca

SEQ ID NO: 829541 - RNA, 17 nt, Mycobacterium avium subsp. paratuberculosis
gagcaggacgguggccg

SEQ ID NO: 829542 - RNA, 21 nt, Mycobacterium avium subsp. paratuberculosis
gagcaggucaccggaugcacg

SEQ ID NO: 829543 - RNA, 21 nt, Mycobacterium avium subsp. paratuberculosis
gagcagguucuccucccagcc

SEQ ID NO: 829544 - RNA, 20 nt, Mycobacterium avium subsp. paratuberculosis
gagccguccggguucgacgc

SEQ ID NO: 829545 - RNA, 18 nt, Mycobacterium avium subsp. paratuberculosis
gagccguuuggcgccgcc

SEQ ID NO: 829546 - RNA, 23 nt, Mycobacterium avium subsp. paratuberculosis
gagccguuuggcgccgcccacca

SEQ ID NO: 829547 - RNA, 17 nt, Mycobacterium avium subsp. paratuberculosis
gagccucagggcgcgcu

SEQ ID NO: 829548 - RNA, 18 nt, Mycobacterium avium subsp. paratuberculosis
gagccucagggcgcgcug

SEQ ID NO: 829549 - RNA, 21 nt, Mycobacterium avium subsp. paratuberculosis
gagccucagggcgcgcugucg

SEQ ID NO: 829550 - RNA, 22 nt, Mycobacterium avium subsp. paratuberculosis
gagccgucucggagcggugucg

SEQ ID NO: 829551 - RNA, 20 nt, Mycobacterium avium subsp. paratuberculosis
gagccgguagaucagcgccu

SEQ ID NO: 829552 - RNA, 21 nt, Mycobacterium avium subsp. paratuberculosis
gagccgguagggccggucacc

SEQ ID NO: 829553 - RNA, 20 nt, Mycobacterium avium subsp. paratuberculosis
gagccgggugcccgcguaca

SEQ ID NO: 829554 - RNA, 15 nt, Mycobacterium avium subsp. paratuberculosis
gagccgggcggccag

SEQ ID NO: 829555 - RNA, 17 nt, Mycobacterium avium subsp. paratuberculosis
gagccgggcggccagcg

SEQ ID NO: 829556 - RNA, 20 nt, Mycobacterium avium subsp. paratuberculosis
gagccgggcggccagcgugg

SEQ ID NO: 829557 - RNA, 17 nt, Mycobacterium avium subsp. paratuberculosis
gagccgguccgaccagc

SEQ ID NO: 829558 - RNA, 20 nt, Mycobacterium avium subsp. paratuberculosis
gagccgguccgaccagcggc

SEQ ID NO: 829559 - RNA, 16 nt, Mycobacterium avium subsp. paratuberculosis
gagccgguccgacggc

SEQ ID NO: 829560 - RNA, 16 nt, Mycobacterium avium subsp. paratuberculosis
gagccggucgaacgcc

SEQ ID NO: 829561 - RNA, 17 nt, Mycobacterium avium subsp. paratuberculosis
gagccggucgaacgcca

SEQ ID NO: 829562 - RNA, 19 nt, Mycobacterium avium subsp. paratuberculosis
gagccggucgaacgccagc

SEQ ID NO: 829563 - RNA, 21 nt, Mycobacterium avium subsp. paratuberculosis
gagccggucgaacgccagcgc

SEQ ID NO: 829564 - RNA, 17 nt, Mycobacterium avium subsp. paratuberculosis
gagccggucugggcgac

SEQ ID NO: 829565 - RNA, 19 nt, Mycobacterium avium subsp. paratuberculosis
gagccggucugggcgacca

SEQ ID NO: 829566 - RNA, 23 nt, Mycobacterium avium subsp. paratuberculosis
gagccggugguuuugcggcccug

SEQ ID NO: 829567 - RNA, 24 nt, Mycobacterium avium subsp. paratuberculosis
gagccgguugacccucagcagggc

SEQ ID NO: 829568 - RNA, 17 nt, Mycobacterium avium subsp. paratuberculosis
gagccgcuugguggcgc

SEQ ID NO: 829569 - RNA, 20 nt, Mycobacterium avium subsp. paratuberculosis
gagccgcuugguggcgccgg

SEQ ID NO: 829570 - RNA, 17 nt, Mycobacterium avium subsp. paratuberculosis
gagccgcuccaccgcgu

SEQ ID NO: 829571 - RNA, 19 nt, Mycobacterium avium subsp. paratuberculosis
gagccgcucccgcagcggg

SEQ ID NO: 829572 - RNA, 21 nt, Mycobacterium avium subsp. paratuberculosis
gagccgcucccgcagcggggc

SEQ ID NO: 829573 - RNA, 14 nt, Mycobacterium avium subsp. paratuberculosis
gagccgcucgcgca

SEQ ID NO: 829574 - RNA, 18 nt, Mycobacterium avium subsp. paratuberculosis
gagccgcucgcgcaccgg

SEQ ID NO: 829575 - RNA, 19 nt, Mycobacterium avium subsp. paratuberculosis
gagccgcucgcgcaccggg

SEQ ID NO: 829576 - RNA, 15 nt, Mycobacterium avium subsp. paratuberculosis
gagccgcucgucgag

SEQ ID NO: 829577 - RNA, 16 nt, Mycobacterium avium subsp. paratuberculosis
gagccggcacgcgcgc

SEQ ID NO: 829578 - RNA, 21 nt, Mycobacterium avium subsp. paratuberculosis
gagccggcacggccggccggc

SEQ ID NO: 829579 - RNA, 16 nt, Mycobacterium avium subsp. paratuberculosis
gagccggaugcggccg

SEQ ID NO: 829580 - RNA, 18 nt, Mycobacterium avium subsp. paratuberculosis
gagccggacaucucccgc

SEQ ID NO: 829581 - RNA, 20 nt, Mycobacterium avium subsp. paratuberculosis
gagccgggcagcgcgacacc

SEQ ID NO: 829582 - RNA, 22 nt, Mycobacterium avium subsp. paratuberculosis
gagccgggccaauuacgcugcg

SEQ ID NO: 829583 - RNA, 18 nt, Mycobacterium avium subsp. paratuberculosis
gagccggcggcggugcgu

SEQ ID NO: 829584 - RNA, 12 nt, Mycobacterium avium subsp. paratuberculosis
gagccggcguac

SEQ ID NO: 829585 - RNA, 22 nt, Mycobacterium avium subsp. paratuberculosis
gagccggcguuauuugugcgcu

SEQ ID NO: 829586 - RNA, 14 nt, Mycobacterium avium subsp. paratuberculosis
gagccggccggaca

SEQ ID NO: 829587 - RNA, 14 nt, Mycobacterium avium subsp. paratuberculosis
gagccggccgccga

SEQ ID NO: 829588 - RNA, 15 nt, Mycobacterium avium subsp. paratuberculosis
gagccggccucgccg

SEQ ID NO: 829589 - RNA, 22 nt, Mycobacterium avium subsp. paratuberculosis
gagccggccucgccggcgccgg

SEQ ID NO: 829590 - RNA, 22 nt, Mycobacterium avium subsp. paratuberculosis
gagccggccagguugaccacca

SEQ ID NO: 829591 - RNA, 16 nt, Mycobacterium avium subsp. paratuberculosis
gagccggcccugcggc

SEQ ID NO: 829592 - RNA, 23 nt, Mycobacterium avium subsp. paratuberculosis
gagccggcccugcggccagugcc

SEQ ID NO: 829593 - RNA, 17 nt, Mycobacterium avium subsp. paratuberculosis
gagccggcgcaccgcgu

SEQ ID NO: 829594 - RNA, 19 nt, Mycobacterium avium subsp. paratuberculosis
gagccggcgcaccgcgucg

SEQ ID NO: 829595 - RNA, 18 nt, Mycobacterium avium subsp. paratuberculosis
gagccggcgcacucccgc

SEQ ID NO: 829596 - RNA, 13 nt, Mycobacterium avium subsp. paratuberculosis
gagcccgccggcg

SEQ ID NO: 829597 - RNA, 14 nt, Mycobacterium avium subsp. paratuberculosis
gagcccgccggcgg

SEQ ID NO: 829598 - RNA, 18 nt, Mycobacterium avium subsp. paratuberculosis
gagcccgaugcuggccau

SEQ ID NO: 829599 - RNA, 21 nt, Mycobacterium avium subsp. paratuberculosis
gagcccgcaaaucagccgagc

SEQ ID NO: 829600 - RNA, 16 nt, Mycobacterium avium subsp. paratuberculosis
gagcccgaacacgggc

SEQ ID NO: 829601 - RNA, 19 nt, Mycobacterium avium subsp. paratuberculosis
gagcccgaacacgggcggc

SEQ ID NO: 829602 - RNA, 16 nt, Mycobacterium avium subsp. paratuberculosis
gagcccgacggcagca

SEQ ID NO: 829603 - RNA, 22 nt, Mycobacterium avium subsp. paratuberculosis
gagcccgacggcagcaccgccg

SEQ ID NO: 829604 - RNA, 13 nt, Mycobacterium avium subsp. paratuberculosis
gagcccgggaacg

SEQ ID NO: 829605 - RNA, 15 nt, Mycobacterium avium subsp. paratuberculosis
gagcccgggaacguc

SEQ ID NO: 829606 - RNA, 16 nt, Mycobacterium avium subsp. paratuberculosis
gagcccgggcaggcgg

SEQ ID NO: 829607 - RNA, 17 nt, Mycobacterium avium subsp. paratuberculosis
gagcccgggcaggcggc

SEQ ID NO: 829608 - RNA, 16 nt, Mycobacterium avium subsp. paratuberculosis
gagcccggccaguccg

SEQ ID NO: 829609 - RNA, 15 nt, Mycobacterium avium subsp. paratuberculosis
gagcccgucgacguc

SEQ ID NO: 829610 - RNA, 16 nt, Mycobacterium avium subsp. paratuberculosis
gagcccgucgacgucg

SEQ ID NO: 829611 - RNA, 19 nt, Mycobacterium avium subsp. paratuberculosis
gagcccgucgacgucgaga

SEQ ID NO: 829612 - RNA, 13 nt, Mycobacterium avium subsp. paratuberculosis
gagcccgucgucg

SEQ ID NO: 829613 - RNA, 15 nt, Mycobacterium avium subsp. paratuberculosis
gagcccuucgcggug

SEQ ID NO: 829614 - RNA, 18 nt, Mycobacterium avium subsp. paratuberculosis
gagcccuucgcggugugc

SEQ ID NO: 829615 - RNA, 22 nt, Mycobacterium avium subsp. paratuberculosis
gagcccuuugcgcugcccgaug

SEQ ID NO: 829616 - RNA, 16 nt, Mycobacterium avium subsp. paratuberculosis
gagccgaccucggcga

SEQ ID NO: 829617 - RNA, 18 nt, Mycobacterium avium subsp. paratuberculosis
gagccgaccucggcgacg

SEQ ID NO: 829618 - RNA, 21 nt, Mycobacterium avium subsp. paratuberculosis
gagccgacgaagaucccgcug

SEQ ID NO: 829619 - RNA, 19 nt, Mycobacterium avium subsp. paratuberculosis
gagccgagcaccaggcgca

SEQ ID NO: 829620 - RNA, 22 nt, Mycobacterium avium subsp. paratuberculosis
gagccgagcaccaggcgcacca

SEQ ID NO: 829621 - RNA, 18 nt, Mycobacterium avium subsp. paratuberculosis
gagccgagcaccggcagc

SEQ ID NO: 829622 - RNA, 16 nt, Mycobacterium avium subsp. paratuberculosis
gagccgagcaccgggc

SEQ ID NO: 829623 - RNA, 18 nt, Mycobacterium avium subsp. paratuberculosis
gagccgagcaccgggcug

SEQ ID NO: 829624 - RNA, 22 nt, Mycobacterium avium subsp. paratuberculosis
gagccgagcaccgggcugucgg

SEQ ID NO: 829625 - RNA, 14 nt, Mycobacterium avium subsp. paratuberculosis
gagccgcgcgccga

SEQ ID NO: 829626 - RNA, 15 nt, Mycobacterium avium subsp. paratuberculosis
gagccgcggauggcc

SEQ ID NO: 829627 - RNA, 23 nt, Mycobacterium avium subsp. paratuberculosis
gagccgcggauggccucggcgau

SEQ ID NO: 829628 - RNA, 13 nt, Mycobacterium avium subsp. paratuberculosis
gagccgcggguga

SEQ ID NO: 829629 - RNA, 13 nt, Mycobacterium avium subsp. paratuberculosis
gagccgccugcgc

SEQ ID NO: 829630 - RNA, 23 nt, Mycobacterium avium subsp. paratuberculosis
gagccgccugcgcgccgucggcg

SEQ ID NO: 829631 - RNA, 13 nt, Mycobacterium avium subsp. paratuberculosis
gagccgccggggc

SEQ ID NO: 829632 - RNA, 15 nt, Mycobacterium avium subsp. paratuberculosis
gagccgccggggcgc

SEQ ID NO: 829633 - RNA, 19 nt, Mycobacterium avium subsp. paratuberculosis
gagccgccggggcgccgcc

SEQ ID NO: 829634 - RNA, 20 nt, Mycobacterium avium subsp. paratuberculosis
gagccgccggggcgccgccg

SEQ ID NO: 829635 - RNA, 22 nt, Mycobacterium avium subsp. paratuberculosis
gagccgcccacguucagcgacu

SEQ ID NO: 829636 - RNA, 21 nt, Mycobacterium avium subsp. paratuberculosis
gagccgcccaggcgggccagc

SEQ ID NO: 829637 - RNA, 22 nt, Mycobacterium avium subsp. paratuberculosis
gagccgcccaggcgggccagcu

SEQ ID NO: 829638 - RNA, 11 nt, Mycobacterium avium subsp. paratuberculosis
gagccgccgag

SEQ ID NO: 829639 - RNA, 12 nt, Mycobacterium avium subsp. paratuberculosis
gagccgccgcgg

SEQ ID NO: 829640 - RNA, 14 nt, Mycobacterium avium subsp. paratuberculosis
gagccgccgcggca

SEQ ID NO: 829641 - RNA, 21 nt, Mycobacterium avium subsp. paratuberculosis
gagccgccgcggcaccuucac

SEQ ID NO: 829642 - RNA, 15 nt, Mycobacterium avium subsp. paratuberculosis
gagccgccgcggguc

SEQ ID NO: 829643 - RNA, 14 nt, Mycobacterium avium subsp. paratuberculosis
gagccgaugcccag

SEQ ID NO: 829644 - RNA, 20 nt, Mycobacterium avium subsp. paratuberculosis
gagccgaugcccagcagcgg

SEQ ID NO: 829645 - RNA, 22 nt, Mycobacterium avium subsp. paratuberculosis
gagccgaugcccagcagcgggg

SEQ ID NO: 829646 - RNA, 14 nt, Mycobacterium avium subsp. paratuberculosis
gagccgagccgacc

SEQ ID NO: 829647 - RNA, 18 nt, Mycobacterium avium subsp. paratuberculosis
gagccgagccgacccggg

SEQ ID NO: 829648 - RNA, 20 nt, Mycobacterium avium subsp. paratuberculosis
gagccgaggaucugguaugc

SEQ ID NO: 829649 - RNA, 22 nt, Mycobacterium avium subsp. paratuberculosis
gagccgcagucgaucaccgaga

SEQ ID NO: 829650 - RNA, 23 nt, Mycobacterium avium subsp. paratuberculosis
gagccgcaucgcaagaaccucca

SEQ ID NO: 829651 - RNA, 17 nt, Mycobacterium avium subsp. paratuberculosis
gagccgccacagcgccu

SEQ ID NO: 829652 - RNA, 19 nt, Mycobacterium avium subsp. paratuberculosis
gagccgccacagcgccucg

SEQ ID NO: 829653 - RNA, 12 nt, Mycobacterium avium subsp. paratuberculosis
gagccgcaccgc

SEQ ID NO: 829654 - RNA, 12 nt, Mycobacterium avium subsp. paratuberculosis
gagccgcagccg

SEQ ID NO: 829655 - RNA, 13 nt, Mycobacterium avium subsp. paratuberculosis
gagccgcagccgg

SEQ ID NO: 829656 - RNA, 14 nt, Mycobacterium avium subsp. paratuberculosis
gagccgcagccggg

SEQ ID NO: 829657 - RNA, 14 nt, Mycobacterium avium subsp. paratuberculosis
gauaauggcggccg

SEQ ID NO: 829658 - RNA, 22 nt, Mycobacterium avium subsp. paratuberculosis
gauaagcggauugaccagcacg

SEQ ID NO: 829659 - RNA, 23 nt, Mycobacterium avium subsp. paratuberculosis
gauaagcggauugaccagcacgu

SEQ ID NO: 829660 - RNA, 23 nt, Mycobacterium avium subsp. paratuberculosis
gauaacucuacugcugcgggugc

SEQ ID NO: 829661 - RNA, 17 nt, Mycobacterium avium subsp. paratuberculosis
gagucgaagcggugcac

SEQ ID NO: 829662 - RNA, 20 nt, Mycobacterium avium subsp. paratuberculosis
gagucgaaggcgcgggcguc

SEQ ID NO: 829663 - RNA, 16 nt, Mycobacterium avium subsp. paratuberculosis
gagucgagcaccgcga

SEQ ID NO: 829664 - RNA, 18 nt, Mycobacterium avium subsp. paratuberculosis
gagucgagcaccgcgacc

SEQ ID NO: 829665 - RNA, 22 nt, Mycobacterium avium subsp. paratuberculosis
gagucgagcaccgcgaccacgc

SEQ ID NO: 829666 - RNA, 23 nt, Mycobacterium avium subsp. paratuberculosis
gagucgagcaccgcgaccacgcc

SEQ ID NO: 829667 - RNA, 18 nt, Mycobacterium avium subsp. paratuberculosis
gaguccggcucggugccg

SEQ ID NO: 829668 - RNA, 16 nt, Mycobacterium avium subsp. paratuberculosis
gaguccacgacguccu

SEQ ID NO: 829669 - RNA, 13 nt, Mycobacterium avium subsp. paratuberculosis
gaguccagcacgc

SEQ ID NO: 829670 - RNA, 14 nt, Mycobacterium avium subsp. paratuberculosis
gaguccagcacgcc

SEQ ID NO: 829671 - RNA, 14 nt, Mycobacterium avium subsp. paratuberculosis
gaguccagccagcc

SEQ ID NO: 829672 - RNA, 23 nt, Mycobacterium avium subsp. paratuberculosis
gagucauucugaauucggccacc

SEQ ID NO: 829673 - RNA, 15 nt, Mycobacterium avium subsp. paratuberculosis
gagucccaugggcug

SEQ ID NO: 829674 - RNA, 15 nt, Mycobacterium avium subsp. paratuberculosis
gagucccggcgcacc

SEQ ID NO: 829675 - RNA, 14 nt, Mycobacterium avium subsp. paratuberculosis
gagucccucggcga

SEQ ID NO: 829676 - RNA, 21 nt, Mycobacterium avium subsp. paratuberculosis
gaguccgcggaggcgagcagc

SEQ ID NO: 829677 - RNA, 15 nt, Mycobacterium avium subsp. paratuberculosis
gagucgaucgccagc

SEQ ID NO: 829678 - RNA, 18 nt, Mycobacterium avium subsp. paratuberculosis
gagucgaucgccagcgcg

SEQ ID NO: 829679 - RNA, 16 nt, Mycobacterium avium subsp. paratuberculosis
gaguucgccgucgacg

SEQ ID NO: 829680 - RNA, 22 nt, Mycobacterium avium subsp. paratuberculosis
gaguucgccgucgacggugauc

SEQ ID NO: 829681 - RNA, 17 nt, Mycobacterium avium subsp. paratuberculosis
gaguucgcggcgcagca

SEQ ID NO: 829682 - RNA, 17 nt, Mycobacterium avium subsp. paratuberculosis
gaguucggcggcccgcu

SEQ ID NO: 829683 - RNA, 15 nt, Mycobacterium avium subsp. paratuberculosis
gaguucuuucaugcc

SEQ ID NO: 829684 - RNA, 21 nt, Mycobacterium avium subsp. paratuberculosis
gaguucggccagaucggccag

SEQ ID NO: 829685 - RNA, 22 nt, Mycobacterium avium subsp. paratuberculosis
gaguucggccagaucggccagg

SEQ ID NO: 829686 - RNA, 17 nt, Mycobacterium avium subsp. paratuberculosis
gauaaccguccacaccg

SEQ ID NO: 829687 - RNA, 18 nt, Mycobacterium avium subsp. paratuberculosis
gauaacccagcaccacca

SEQ ID NO: 829688 - RNA, 19 nt, Mycobacterium avium subsp. paratuberculosis
gauaacccagcaccaccac

SEQ ID NO: 829689 - RNA, 14 nt, Mycobacterium avium subsp. paratuberculosis
gaguucgucggcga

SEQ ID NO: 829690 - RNA, 15 nt, Mycobacterium avium subsp. paratuberculosis
gaguucgucggcgau

SEQ ID NO: 829691 - RNA, 14 nt, Mycobacterium avium subsp. paratuberculosis
gauagggccggccg

SEQ ID NO: 829692 - RNA, 13 nt, Mycobacterium avium subsp. paratuberculosis
gauagggcgugau

SEQ ID NO: 829693 - RNA, 15 nt, Mycobacterium avium subsp. paratuberculosis
gauaggggcagggca

SEQ ID NO: 829694 - RNA, 20 nt, Mycobacterium avium subsp. paratuberculosis
gauaggucacgccgggguag

SEQ ID NO: 829695 - RNA, 14 nt, Mycobacterium avium subsp. paratuberculosis
gauagucgcgggug

SEQ ID NO: 829696 - RNA, 14 nt, Mycobacterium avium subsp. paratuberculosis
gauacgcgacgaac

SEQ ID NO: 829697 - RNA, 20 nt, Mycobacterium avium subsp. paratuberculosis
gauacgcgacgaaccgccac

SEQ ID NO: 829698 - RNA, 20 nt, Mycobacterium avium subsp. paratuberculosis
gauacucgggcaacgcgccg

SEQ ID NO: 829699 - RNA, 21 nt, Mycobacterium avium subsp. paratuberculosis
gauacucgggcaacgcgccgg

SEQ ID NO: 829700 - RNA, 13 nt, Mycobacterium avium subsp. paratuberculosis
gauacuccucgcg

SEQ ID NO: 829701 - RNA, 15 nt, Mycobacterium avium subsp. paratuberculosis
gauacuccucgcggu

SEQ ID NO: 829702 - RNA, 18 nt, Mycobacterium avium subsp. paratuberculosis
gauacggucgcaccgcgg

SEQ ID NO: 829703 - RNA, 21 nt, Mycobacterium avium subsp. paratuberculosis
gaucaacgccgggucgacgcc

SEQ ID NO: 829704 - RNA, 14 nt, Mycobacterium avium subsp. paratuberculosis
gaucaacagccgcc

SEQ ID NO: 829705 - RNA, 17 nt, Mycobacterium avium subsp. paratuberculosis
gaucaacaggcccagca

SEQ ID NO: 829706 - RNA, 21 nt, Mycobacterium avium subsp. paratuberculosis
gaucaacaccgccagcaccgc

SEQ ID NO: 829707 - RNA, 18 nt, Mycobacterium avium subsp. paratuberculosis
gaucaacaccgguccggc

SEQ ID NO: 829708 - RNA, 15 nt, Mycobacterium avium subsp. paratuberculosis
gauaucggccgcggg

SEQ ID NO: 829709 - RNA, 21 nt, Mycobacterium avium subsp. paratuberculosis
gauaucggccgcggggccggc

SEQ ID NO: 829710 - RNA, 16 nt, Mycobacterium avium subsp. paratuberculosis
gaucaccaccccggug

SEQ ID NO: 829711 - RNA, 21 nt, Mycobacterium avium subsp. paratuberculosis
gaucaccaccccggugccgca

SEQ ID NO: 829712 - RNA, 22 nt, Mycobacterium avium subsp. paratuberculosis
gaucaccaccccggugccgcag

SEQ ID NO: 829713 - RNA, 16 nt, Mycobacterium avium subsp. paratuberculosis
gaucaccaugaucagc

SEQ ID NO: 829714 - RNA, 20 nt, Mycobacterium avium subsp. paratuberculosis
gaucaccaugaucagcgccg

SEQ ID NO: 829715 - RNA, 17 nt, Mycobacterium avium subsp. paratuberculosis
gaucaccaggcccaggc

SEQ ID NO: 829716 - RNA, 20 nt, Mycobacterium avium subsp. paratuberculosis
gaucaccaggcccaggccga

SEQ ID NO: 829717 - RNA, 19 nt, Mycobacterium avium subsp. paratuberculosis
gaucaacgcggacacggcc

SEQ ID NO: 829718 - RNA, 22 nt, Mycobacterium avium subsp. paratuberculosis
gaucaacgcggacacggccggg

SEQ ID NO: 829719 - RNA, 20 nt, Mycobacterium avium subsp. paratuberculosis
gaucaacgggucgagcacgu

SEQ ID NO: 829720 - RNA, 18 nt, Mycobacterium avium subsp. paratuberculosis
gaucacagcgcccuugag

SEQ ID NO: 829721 - RNA, 15 nt, Mycobacterium avium subsp. paratuberculosis
gaucaaggaaccggc

SEQ ID NO: 829722 - RNA, 14 nt, Mycobacterium avium subsp. paratuberculosis
gaggugaaccgcga

SEQ ID NO: 829723 - RNA, 16 nt, Mycobacterium avium subsp. paratuberculosis
gaggugaaccgcgacg

SEQ ID NO: 829724 - RNA, 17 nt, Mycobacterium avium subsp. paratuberculosis
gaggugaaccgcgacgc

SEQ ID NO: 829725 - RNA, 16 nt, Mycobacterium avium subsp. paratuberculosis
gaggugaagccguugu

SEQ ID NO: 829726 - RNA, 20 nt, Mycobacterium avium subsp. paratuberculosis
gaggugaauaccacugcgcg

SEQ ID NO: 829727 - RNA, 23 nt, Mycobacterium avium subsp. paratuberculosis
gaggugaauaccacugcgcgccc

SEQ ID NO: 829728 - RNA, 15 nt, Mycobacterium avium subsp. paratuberculosis
gaggugacgucgcgc

SEQ ID NO: 829729 - RNA, 16 nt, Mycobacterium avium subsp. paratuberculosis
gaggugacgucgcgcc

SEQ ID NO: 829730 - RNA, 19 nt, Mycobacterium avium subsp. paratuberculosis
gaggugaucgcgaacgcgc

SEQ ID NO: 829731 - RNA, 23 nt, Mycobacterium avium subsp. paratuberculosis
gaggugaucgcgaacgcgccggu

SEQ ID NO: 829732 - RNA, 21 nt, Mycobacterium avium subsp. paratuberculosis
gaggucucccgguccacggug

SEQ ID NO: 829733 - RNA, 19 nt, Mycobacterium avium subsp. paratuberculosis
gaggucuucggucccggcg

SEQ ID NO: 829734 - RNA, 22 nt, Mycobacterium avium subsp. paratuberculosis
gaggucuuucaucgccccggcg

SEQ ID NO: 829735 - RNA, 15 nt, Mycobacterium avium subsp. paratuberculosis
gaggucggucgcggc

SEQ ID NO: 829736 - RNA, 23 nt, Mycobacterium avium subsp. paratuberculosis
gaggguuuccacgugcacggcgc

SEQ ID NO: 829737 - RNA, 17 nt, Mycobacterium avium subsp. paratuberculosis
gaggucgcgaccgccgg

SEQ ID NO: 829738 - RNA, 16 nt, Mycobacterium avium subsp. paratuberculosis
gaggucgcggcggccg

SEQ ID NO: 829739 - RNA, 17 nt, Mycobacterium avium subsp. paratuberculosis
gaggucgcggcggccgg

SEQ ID NO: 829740 - RNA, 21 nt, Mycobacterium avium subsp. paratuberculosis
gaggucgcggcggccggcgcc

SEQ ID NO: 829741 - RNA, 20 nt, Mycobacterium avium subsp. paratuberculosis
gagguaauggugggcguggc

SEQ ID NO: 829742 - RNA, 18 nt, Mycobacterium avium subsp. paratuberculosis
gaggguucgguggccccg

SEQ ID NO: 829743 - RNA, 23 nt, Mycobacterium avium subsp. paratuberculosis
gagguacucgagcgugcccgcgc

SEQ ID NO: 829744 - RNA, 19 nt, Mycobacterium avium subsp. paratuberculosis
gaggucgccgacgccgucg

SEQ ID NO: 829745 - RNA, 21 nt, Mycobacterium avium subsp. paratuberculosis
gagggugacgguggcguccuc

SEQ ID NO: 829746 - RNA, 17 nt, Mycobacterium avium subsp. paratuberculosis
gagggugccggccaccg

SEQ ID NO: 829747 - RNA, 19 nt, Mycobacterium avium subsp. paratuberculosis
gagggucgccaggccaccg

SEQ ID NO: 829748 - RNA, 22 nt, Mycobacterium avium subsp. paratuberculosis
gaggucgucgggcgccgguucc

SEQ ID NO: 829749 - RNA, 19 nt, Mycobacterium avium subsp. paratuberculosis
gagucacccggcuggccgc

SEQ ID NO: 829750 - RNA, 20 nt, Mycobacterium avium subsp. paratuberculosis
gagucacccggcuggccgca

SEQ ID NO: 829751 - RNA, 14 nt, Mycobacterium avium subsp. paratuberculosis
gaguaaccggugcg

SEQ ID NO: 829752 - RNA, 16 nt, Mycobacterium avium subsp. paratuberculosis
gaggugaugccgucca

SEQ ID NO: 829753 - RNA, 19 nt, Mycobacterium avium subsp. paratuberculosis
gaggugaugccguccagca

SEQ ID NO: 829754 - RNA, 21 nt, Mycobacterium avium subsp. paratuberculosis
gaggugauguuggccgcgacg

SEQ ID NO: 829755 - RNA, 22 nt, Mycobacterium avium subsp. paratuberculosis
gaggugcaacacucgagcgcgc

SEQ ID NO: 829756 - RNA, 20 nt, Mycobacterium avium subsp. paratuberculosis
gaguagaccuuguccggcgu

SEQ ID NO: 829757 - RNA, 17 nt, Mycobacterium avium subsp. paratuberculosis
gaggcgaaugcggccau

SEQ ID NO: 829758 - RNA, 18 nt, Mycobacterium avium subsp. paratuberculosis
gaggcgaaugcggccaug

SEQ ID NO: 829759 - RNA, 19 nt, Mycobacterium avium subsp. paratuberculosis
gaggcgaaugcggccaugu

SEQ ID NO: 829760 - RNA, 18 nt, Mycobacterium avium subsp. paratuberculosis
gaggccugcgcggccgcg

SEQ ID NO: 829761 - RNA, 23 nt, Mycobacterium avium subsp. paratuberculosis
gaggccuucuuucguucgauguc

SEQ ID NO: 829762 - RNA, 12 nt, Mycobacterium avium subsp. paratuberculosis
gaggccucgccg

SEQ ID NO: 829763 - RNA, 22 nt, Mycobacterium avium subsp. paratuberculosis
gaggcgcaggaggcggccaaca

SEQ ID NO: 829764 - RNA, 16 nt, Mycobacterium avium subsp. paratuberculosis
gaggcgauggugcccu

SEQ ID NO: 829765 - RNA, 16 nt, Mycobacterium avium subsp. paratuberculosis
gaggcgcaacaccgga

SEQ ID NO: 829766 - RNA, 18 nt, Mycobacterium avium subsp. paratuberculosis
gaggcgaucgcggccacc

SEQ ID NO: 829767 - RNA, 14 nt, Mycobacterium avium subsp. paratuberculosis
gaggcgacccccgg

SEQ ID NO: 829768 - RNA, 14 nt, Mycobacterium avium subsp. paratuberculosis
gaggcgagcagccg

SEQ ID NO: 829769 - RNA, 16 nt, Mycobacterium avium subsp. paratuberculosis
gaggcgagcagccggg

SEQ ID NO: 829770 - RNA, 23 nt, Mycobacterium avium subsp. paratuberculosis
gaggcguuuucggugugccgcug

SEQ ID NO: 829771 - RNA, 14 nt, Mycobacterium avium subsp. paratuberculosis
gaggcgcgcaggua

SEQ ID NO: 829772 - RNA, 23 nt, Mycobacterium avium subsp. paratuberculosis
gaggcguucggcgauccgggcac

SEQ ID NO: 829773 - RNA, 16 nt, Mycobacterium avium subsp. paratuberculosis
gaggcguuggcccgca

SEQ ID NO: 829774 - RNA, 20 nt, Mycobacterium avium subsp. paratuberculosis
gaggcguuggcccgcacccg

SEQ ID NO: 829775 - RNA, 16 nt, Mycobacterium avium subsp. paratuberculosis
gaggcucaggccggug

SEQ ID NO: 829776 - RNA, 17 nt, Mycobacterium avium subsp. paratuberculosis
gaggcucaggccggugg

SEQ ID NO: 829777 - RNA, 19 nt, Mycobacterium avium subsp. paratuberculosis
gaggcucaggccgguggcg

SEQ ID NO: 829778 - RNA, 19 nt, Mycobacterium avium subsp. paratuberculosis
gaggcuggguugcucgccg

SEQ ID NO: 829779 - RNA, 20 nt, Mycobacterium avium subsp. paratuberculosis
gaggcugucggaggccucca

SEQ ID NO: 829780 - RNA, 17 nt, Mycobacterium avium subsp. paratuberculosis
gaggcuguccagcagcg

SEQ ID NO: 829781 - RNA, 21 nt, Mycobacterium avium subsp. paratuberculosis
gagggaacgccgaucaccggc

SEQ ID NO: 829782 - RNA, 18 nt, Mycobacterium avium subsp. paratuberculosis
gagggcucaacaggcgag

SEQ ID NO: 829783 - RNA, 23 nt, Mycobacterium avium subsp. paratuberculosis
gagggucaagauaccggccggcg

SEQ ID NO: 829784 - RNA, 20 nt, Mycobacterium avium subsp. paratuberculosis
gagcuuuucgucggugcgcg

SEQ ID NO: 829785 - RNA, 21 nt, Mycobacterium avium subsp. paratuberculosis
gagcuuuucgucggugcgcgc

SEQ ID NO: 829786 - RNA, 15 nt, Mycobacterium avium subsp. paratuberculosis
gaggaaagcucgcga

SEQ ID NO: 829787 - RNA, 21 nt, Mycobacterium avium subsp. paratuberculosis
gaggaacccgaccgcgaugca

SEQ ID NO: 829788 - RNA, 18 nt, Mycobacterium avium subsp. paratuberculosis
gagcuggugggccaucgc

SEQ ID NO: 829789 - RNA, 20 nt, Mycobacterium avium subsp. paratuberculosis
gagcuggugggccaucgcca

SEQ ID NO: 829790 - RNA, 15 nt, Mycobacterium avium subsp. paratuberculosis
gagcugucggugacg

SEQ ID NO: 829791 - RNA, 14 nt, Mycobacterium avium subsp. paratuberculosis
gagcugugccgcgg

SEQ ID NO: 829792 - RNA, 19 nt, Mycobacterium avium subsp. paratuberculosis
gagcugugccgcggugcgg

SEQ ID NO: 829793 - RNA, 15 nt, Mycobacterium avium subsp. paratuberculosis
gagcuucugcccggc

SEQ ID NO: 829794 - RNA, 14 nt, Mycobacterium avium subsp. paratuberculosis
gagcuucccggcgg

SEQ ID NO: 829795 - RNA, 14 nt, Mycobacterium avium subsp. paratuberculosis
gagcuuccgccgag

SEQ ID NO: 829796 - RNA, 14 nt, Mycobacterium avium subsp. paratuberculosis
gagcugggcccgcg

SEQ ID NO: 829797 - RNA, 13 nt, Mycobacterium avium subsp. paratuberculosis
gagcugggccggc

SEQ ID NO: 829798 - RNA, 16 nt, Mycobacterium avium subsp. paratuberculosis
gagcugggccggcgcc

SEQ ID NO: 829799 - RNA, 13 nt, Mycobacterium avium subsp. paratuberculosis
gagcugggcggcg

SEQ ID NO: 829800 - RNA, 14 nt, Mycobacterium avium subsp. paratuberculosis
gagcugggcggcgc

SEQ ID NO: 829801 - RNA, 16 nt, Mycobacterium avium subsp. paratuberculosis
gagcugggcggcgcgc

SEQ ID NO: 829802 - RNA, 13 nt, Mycobacterium avium subsp. paratuberculosis
gagcugcgggugc

SEQ ID NO: 829803 - RNA, 22 nt, Mycobacterium avium subsp. paratuberculosis
gagcuggccguugauggaagcg

SEQ ID NO: 829804 - RNA, 20 nt, Mycobacterium avium subsp. paratuberculosis
gagcuggccgcccaccacga

SEQ ID NO: 829805 - RNA, 14 nt, Mycobacterium avium subsp. paratuberculosis
gagcuggccgcgca

SEQ ID NO: 829806 - RNA, 18 nt, Mycobacterium avium subsp. paratuberculosis
gagcuggccgcgcagcgu

SEQ ID NO: 829807 - RNA, 19 nt, Mycobacterium avium subsp. paratuberculosis
gagcuggccgcgcagcgug

SEQ ID NO: 829808 - RNA, 22 nt, Mycobacterium avium subsp. paratuberculosis
gagcuggccgcgcagcgugucg

SEQ ID NO: 829809 - RNA, 21 nt, Mycobacterium avium subsp. paratuberculosis
gagcugcaacgcgucggcgcc

SEQ ID NO: 829810 - RNA, 22 nt, Mycobacterium avium subsp. paratuberculosis
gagcugcgcgccccggcccggc

SEQ ID NO: 829811 - RNA, 23 nt, Mycobacterium avium subsp. paratuberculosis
gagcugcgcgccccggcccggcg

SEQ ID NO: 829812 - RNA, 15 nt, Mycobacterium avium subsp. paratuberculosis
gagcugcugccgccg

SEQ ID NO: 829813 - RNA, 16 nt, Mycobacterium avium subsp. paratuberculosis
gagcugcuucgucgcc

SEQ ID NO: 829814 - RNA, 22 nt, Mycobacterium avium subsp. paratuberculosis
gagcugcuucgucgccgggcug

SEQ ID NO: 829815 - RNA, 20 nt, Mycobacterium avium subsp. paratuberculosis
gaggagucgggaaaucggac

SEQ ID NO: 829816 - RNA, 13 nt, Mycobacterium avium subsp. paratuberculosis
gaggagucgggca

SEQ ID NO: 829817 - RNA, 20 nt, Mycobacterium avium subsp. paratuberculosis
gaggagucgggcaaucggac

SEQ ID NO: 829818 - RNA, 12 nt, Mycobacterium avium subsp. paratuberculosis
gaggaucgcgau

SEQ ID NO: 829819 - RNA, 16 nt, Mycobacterium avium subsp. paratuberculosis
gaggaucgcggccacg

SEQ ID NO: 829820 - RNA, 17 nt, Mycobacterium avium subsp. paratuberculosis
gaggaucgcggccacgc

SEQ ID NO: 829821 - RNA, 19 nt, Mycobacterium avium subsp. paratuberculosis
gaggaucugcacgucggcg

SEQ ID NO: 829822 - RNA, 20 nt, Mycobacterium avium subsp. paratuberculosis
gaggaucugcacgucggcgg

SEQ ID NO: 829823 - RNA, 18 nt, Mycobacterium avium subsp. paratuberculosis
gaggaucugggcggcggg

SEQ ID NO: 829824 - RNA, 20 nt, Mycobacterium avium subsp. paratuberculosis
gaggaucugggcggcgggac

SEQ ID NO: 829825 - RNA, 21 nt, Mycobacterium avium subsp. paratuberculosis
gaggaucugggcggcgggacg

SEQ ID NO: 829826 - RNA, 22 nt, Mycobacterium avium subsp. paratuberculosis
gaggagggugucggcggggccg

SEQ ID NO: 829827 - RNA, 19 nt, Mycobacterium avium subsp. paratuberculosis
gaggaucgcaggauggccu

SEQ ID NO: 829828 - RNA, 14 nt, Mycobacterium avium subsp. paratuberculosis
gaggauuucgcgau

SEQ ID NO: 829829 - RNA, 21 nt, Mycobacterium avium subsp. paratuberculosis
gaggauuucgcgaucgaggau

SEQ ID NO: 829830 - RNA, 20 nt, Mycobacterium avium subsp. paratuberculosis
gaggaugguggugcaggcga

SEQ ID NO: 829831 - RNA, 15 nt, Mycobacterium avium subsp. paratuberculosis
gaggaugucgacgau

SEQ ID NO: 829832 - RNA, 21 nt, Mycobacterium avium subsp. paratuberculosis
gaggagacgucggccgggucg

SEQ ID NO: 829833 - RNA, 15 nt, Mycobacterium avium subsp. paratuberculosis
gaggaggccgcggcg

SEQ ID NO: 829834 - RNA, 16 nt, Mycobacterium avium subsp. paratuberculosis
gaggacgucgucgacg

SEQ ID NO: 829835 - RNA, 19 nt, Mycobacterium avium subsp. paratuberculosis
gaggacgucgucgacgucc

SEQ ID NO: 829836 - RNA, 19 nt, Mycobacterium avium subsp. paratuberculosis
gaggacacguuggccagau

SEQ ID NO: 829837 - RNA, 19 nt, Mycobacterium avium subsp. paratuberculosis
gaggacagggaggacagca

SEQ ID NO: 829838 - RNA, 13 nt, Mycobacterium avium subsp. paratuberculosis
gaggaccggcgcc

SEQ ID NO: 829839 - RNA, 13 nt, Mycobacterium avium subsp. paratuberculosis
gaggacgaggccc

SEQ ID NO: 829840 - RNA, 14 nt, Mycobacterium avium subsp. paratuberculosis
gaauucgccgacgc

SEQ ID NO: 829841 - RNA, 16 nt, Mycobacterium avium subsp. paratuberculosis
gaauucgccgacgcgc

SEQ ID NO: 829842 - RNA, 13 nt, Mycobacterium avium subsp. paratuberculosis
gaauucggccacc

SEQ ID NO: 829843 - RNA, 21 nt, Mycobacterium avium subsp. paratuberculosis
gaauucggccaccgacugcga

SEQ ID NO: 829844 - RNA, 22 nt, Mycobacterium avium subsp. paratuberculosis
gaauucggccaccgacugcgac

SEQ ID NO: 829845 - RNA, 16 nt, Mycobacterium avium subsp. paratuberculosis
gaauuccuggccggug

SEQ ID NO: 829846 - RNA, 17 nt, Mycobacterium avium subsp. paratuberculosis
gaauuccaugucgucga

SEQ ID NO: 829847 - RNA, 16 nt, Mycobacterium avium subsp. paratuberculosis
gaauucgaccacggcc

SEQ ID NO: 829848 - RNA, 14 nt, Mycobacterium avium subsp. paratuberculosis
gaauuccgcaccgg

SEQ ID NO: 829849 - RNA, 13 nt, Mycobacterium avium subsp. paratuberculosis
gaauuccggcgcg

SEQ ID NO: 829850 - RNA, 23 nt, Mycobacterium avium subsp. paratuberculosis
gaauucgguggcgauggugcugc

SEQ ID NO: 829851 - RNA, 19 nt, Mycobacterium avium subsp. paratuberculosis
gaauucgguugucgcggug

SEQ ID NO: 829852 - RNA, 16 nt, Mycobacterium avium subsp. paratuberculosis
gaauucgucggcggug

SEQ ID NO: 829853 - RNA, 16 nt, Mycobacterium avium subsp. paratuberculosis
gaauucuggccgaccg

SEQ ID NO: 829854 - RNA, 17 nt, Mycobacterium avium subsp. paratuberculosis
gaauugaagaagcgggc

SEQ ID NO: 829855 - RNA, 19 nt, Mycobacterium avium subsp. paratuberculosis
gaauugaagcccugcucgg

SEQ ID NO: 829856 - RNA, 19 nt, Mycobacterium avium subsp. paratuberculosis
gaaguuuccccaccaggcg

SEQ ID NO: 829857 - RNA, 14 nt, Mycobacterium avium subsp. paratuberculosis
gaaucgacaccgca

SEQ ID NO: 829858 - RNA, 15 nt, Mycobacterium avium subsp. paratuberculosis
gaaucgccgagcucg

SEQ ID NO: 829859 - RNA, 15 nt, Mycobacterium avium subsp. paratuberculosis
gaaucgaccggguug

SEQ ID NO: 829860 - RNA, 18 nt, Mycobacterium avium subsp. paratuberculosis
gaaucgagggcgcgcagc

SEQ ID NO: 829861 - RNA, 23 nt, Mycobacterium avium subsp. paratuberculosis
gaaucgcgggaucggccggcgag

SEQ ID NO: 829862 - RNA, 18 nt, Mycobacterium avium subsp. paratuberculosis
gaaucgcgguagcgcucg

SEQ ID NO: 829863 - RNA, 16 nt, Mycobacterium avium subsp. paratuberculosis
gaaucgguccggcgaa

SEQ ID NO: 829864 - RNA, 14 nt, Mycobacterium avium subsp. paratuberculosis
gaaucgcuugacca

SEQ ID NO: 829865 - RNA, 14 nt, Mycobacterium avium subsp. paratuberculosis
gaaucgucgccguc

SEQ ID NO: 829866 - RNA, 17 nt, Mycobacterium avium subsp. paratuberculosis
gaaucgguucggccaga

SEQ ID NO: 829867 - RNA, 20 nt, Mycobacterium avium subsp. paratuberculosis
gaaguuguagacguagugca

SEQ ID NO: 829868 - RNA, 16 nt, Mycobacterium avium subsp. paratuberculosis
gaaguuggccaccggg

SEQ ID NO: 829869 - RNA, 14 nt, Mycobacterium avium subsp. paratuberculosis
gaaguugccgguca

SEQ ID NO: 829870 - RNA, 15 nt, Mycobacterium avium subsp. paratuberculosis
gaaguugaucgcggc

SEQ ID NO: 829871 - RNA, 18 nt, Mycobacterium avium subsp. paratuberculosis
gaaguucucgcacccggu

SEQ ID NO: 829872 - RNA, 16 nt, Mycobacterium avium subsp. paratuberculosis
gaaguucaccaccgcg

SEQ ID NO: 829873 - RNA, 18 nt, Mycobacterium avium subsp. paratuberculosis
gaaguucaccaccgcgcu

SEQ ID NO: 829874 - RNA, 17 nt, Mycobacterium avium subsp. paratuberculosis
gaaguuccagccgaucg

SEQ ID NO: 829875 - RNA, 20 nt, Mycobacterium avium subsp. paratuberculosis
gaaguucggcaucucggccg

SEQ ID NO: 829876 - RNA, 15 nt, Mycobacterium avium subsp. paratuberculosis
gaagugcgccagcga

SEQ ID NO: 829877 - RNA, 22 nt, Mycobacterium avium subsp. paratuberculosis
gaagugcgccagcgacggccgg

SEQ ID NO: 829878 - RNA, 13 nt, Mycobacterium avium subsp. paratuberculosis
gaagugccggcga

SEQ ID NO: 829879 - RNA, 13 nt, Mycobacterium avium subsp. paratuberculosis
gaagugccggucc

SEQ ID NO: 829880 - RNA, 14 nt, Mycobacterium avium subsp. paratuberculosis
gaaguggacaugca

SEQ ID NO: 829881 - RNA, 21 nt, Mycobacterium avium subsp. paratuberculosis
gaagugcucgaacgcgccgau

SEQ ID NO: 829882 - RNA, 23 nt, Mycobacterium avium subsp. paratuberculosis
gaagugcucgaacgcgccgaucg

SEQ ID NO: 829883 - RNA, 20 nt, Mycobacterium avium subsp. paratuberculosis
gaagugcucgagcacaucgg

SEQ ID NO: 829884 - RNA, 22 nt, Mycobacterium avium subsp. paratuberculosis
gaagugcucgagcacaucggcg

SEQ ID NO: 829885 - RNA, 22 nt, Mycobacterium avium subsp. paratuberculosis
gaaguggcagcgcuccugcagc

SEQ ID NO: 829886 - RNA, 16 nt, Mycobacterium avium subsp. paratuberculosis
gaaguauucgccgucg

SEQ ID NO: 829887 - RNA, 15 nt, Mycobacterium avium subsp. paratuberculosis
gaaguccggcgcgcc

SEQ ID NO: 829888 - RNA, 16 nt, Mycobacterium avium subsp. paratuberculosis
gaaguccggcgcgccc

SEQ ID NO: 829889 - RNA, 18 nt, Mycobacterium avium subsp. paratuberculosis
gaaguccggcgcgcccgg

SEQ ID NO: 829890 - RNA, 19 nt, Mycobacterium avium subsp. paratuberculosis
gaaguccggcgcgcccgga

SEQ ID NO: 829891 - RNA, 17 nt, Mycobacterium avium subsp. paratuberculosis
gaaguagggcagcccga

SEQ ID NO: 829892 - RNA, 14 nt, Mycobacterium avium subsp. paratuberculosis
gaaguagggccgca

SEQ ID NO: 829893 - RNA, 18 nt, Mycobacterium avium subsp. paratuberculosis
gaaguccugcgccgcggu

SEQ ID NO: 829894 - RNA, 20 nt, Mycobacterium avium subsp. paratuberculosis
gaaguccugcgccgcggugc

SEQ ID NO: 829895 - RNA, 19 nt, Mycobacterium avium subsp. paratuberculosis
gaaguccaugaacggcagc

SEQ ID NO: 829896 - RNA, 20 nt, Mycobacterium avium subsp. paratuberculosis
gaaguccaugaacggcagcu

SEQ ID NO: 829897 - RNA, 24 nt, Mycobacterium avium subsp. paratuberculosis
gaaguccuuguggcccaggccggc

SEQ ID NO: 829898 - RNA, 22 nt, Mycobacterium avium subsp. paratuberculosis
gaagucgaccggggcgccccgc

SEQ ID NO: 829899 - RNA, 19 nt, Mycobacterium avium subsp. paratuberculosis
gaagucgacggcggugacg

SEQ ID NO: 829900 - RNA, 19 nt, Mycobacterium avium subsp. paratuberculosis
gaagucggugcccagcgcg

SEQ ID NO: 829901 - RNA, 17 nt, Mycobacterium avium subsp. paratuberculosis
gaagucgccggccagga

SEQ ID NO: 829902 - RNA, 13 nt, Mycobacterium avium subsp. paratuberculosis
gaagucgccgucc

SEQ ID NO: 829903 - RNA, 21 nt, Mycobacterium avium subsp. paratuberculosis
gaagucgauugccgcggccgc

SEQ ID NO: 829904 - RNA, 22 nt, Mycobacterium avium subsp. paratuberculosis
gaagucgcccgcguugcggcgc

SEQ ID NO: 829905 - RNA, 13 nt, Mycobacterium avium subsp. paratuberculosis
gaagucgccgccc

SEQ ID NO: 829906 - RNA, 18 nt, Mycobacterium avium subsp. paratuberculosis
gaagucgccgcccgggcc

SEQ ID NO: 829907 - RNA, 16 nt, Mycobacterium avium subsp. paratuberculosis
gaaggugucggccggg

SEQ ID NO: 829908 - RNA, 19 nt, Mycobacterium avium subsp. paratuberculosis
gaagguguuggugcggggu

SEQ ID NO: 829909 - RNA, 13 nt, Mycobacterium avium subsp. paratuberculosis
gaaguagccggcg

SEQ ID NO: 829910 - RNA, 14 nt, Mycobacterium avium subsp. paratuberculosis
gaaguagccggcga

SEQ ID NO: 829911 - RNA, 22 nt, Mycobacterium avium subsp. paratuberculosis
gaaggugaccaucgggucgucg

SEQ ID NO: 829912 - RNA, 16 nt, Mycobacterium avium subsp. paratuberculosis
gaaggucuuucgucgc

SEQ ID NO: 829913 - RNA, 20 nt, Mycobacterium avium subsp. paratuberculosis
gaaggugacgucgccgaugg

SEQ ID NO: 829914 - RNA, 23 nt, Mycobacterium avium subsp. paratuberculosis
gaaggugccgcgaugcccgccgg

SEQ ID NO: 829915 - RNA, 20 nt, Mycobacterium avium subsp. paratuberculosis
gaagguggcacgccacucgu

SEQ ID NO: 829916 - RNA, 22 nt, Mycobacterium avium subsp. paratuberculosis
gaagguggcacgccacucgucg

SEQ ID NO: 829917 - RNA, 17 nt, Mycobacterium avium subsp. paratuberculosis
gaaggucugcagcagcc

SEQ ID NO: 829918 - RNA, 17 nt, Mycobacterium avium subsp. paratuberculosis
gaagggccccggcaucg

SEQ ID NO: 829919 - RNA, 18 nt, Mycobacterium avium subsp. paratuberculosis
gaagggcccgccgguggc

SEQ ID NO: 829920 - RNA, 13 nt, Mycobacterium avium subsp. paratuberculosis
gaagggcgccagc

SEQ ID NO: 829921 - RNA, 19 nt, Mycobacterium avium subsp. paratuberculosis
gaagggcgccagcaccucg

SEQ ID NO: 829922 - RNA, 20 nt, Mycobacterium avium subsp. paratuberculosis
gaagggcgccagcaccucga

SEQ ID NO: 829923 - RNA, 14 nt, Mycobacterium avium subsp. paratuberculosis
gaagggcgccagcc

SEQ ID NO: 829924 - RNA, 15 nt, Mycobacterium avium subsp. paratuberculosis
gaagggcgccagccg

SEQ ID NO: 829925 - RNA, 16 nt, Mycobacterium avium subsp. paratuberculosis
gaaggcgugcucgauc

SEQ ID NO: 829926 - RNA, 21 nt, Mycobacterium avium subsp. paratuberculosis
gaagggcuuuagaaggccgcc

SEQ ID NO: 829927 - RNA, 16 nt, Mycobacterium avium subsp. paratuberculosis
gaagguccgguaggcg

SEQ ID NO: 829928 - RNA, 14 nt, Mycobacterium avium subsp. paratuberculosis
gacaaaggaggggc

SEQ ID NO: 829929 - RNA, 19 nt, Mycobacterium avium subsp. paratuberculosis
gacaaagaucacagcgccc

SEQ ID NO: 829930 - RNA, 14 nt, Mycobacterium avium subsp. paratuberculosis
gaauugggcgagua

SEQ ID NO: 829931 - RNA, 23 nt, Mycobacterium avium subsp. paratuberculosis
gaauugcuuuuugaccaccggca

SEQ ID NO: 829932 - RNA, 13 nt, Mycobacterium avium subsp. paratuberculosis
gacaacagcacga

SEQ ID NO: 829933 - RNA, 15 nt, Mycobacterium avium subsp. paratuberculosis
gacaacauccgcgac

SEQ ID NO: 829934 - RNA, 17 nt, Mycobacterium avium subsp. paratuberculosis
gacaacauccgcgacga

SEQ ID NO: 829935 - RNA, 13 nt, Mycobacterium avium subsp. paratuberculosis
gacaacagcgccg

SEQ ID NO: 829936 - RNA, 14 nt, Mycobacterium avium subsp. paratuberculosis
gacaacagcgccga

SEQ ID NO: 829937 - RNA, 16 nt, Mycobacterium avium subsp. paratuberculosis
gacaacagcgccgaga

SEQ ID NO: 829938 - RNA, 15 nt, Mycobacterium avium subsp. paratuberculosis
gacaccgcuggccga

SEQ ID NO: 829939 - RNA, 18 nt, Mycobacterium avium subsp. paratuberculosis
gacaccgcuggccgaggc

SEQ ID NO: 829940 - RNA, 20 nt, Mycobacterium avium subsp. paratuberculosis
gacaccggcacgucggccac

SEQ ID NO: 829941 - RNA, 20 nt, Mycobacterium avium subsp. paratuberculosis
gacacgaucggcaugacgcc

SEQ ID NO: 829942 - RNA, 20 nt, Mycobacterium avium subsp. paratuberculosis
gacacgauguugaugucgcg

SEQ ID NO: 829943 - RNA, 22 nt, Mycobacterium avium subsp. paratuberculosis
gacacgauguugaugucgcgcg

SEQ ID NO: 829944 - RNA, 14 nt, Mycobacterium avium subsp. paratuberculosis
gacacgccccgaug

SEQ ID NO: 829945 - RNA, 17 nt, Mycobacterium avium subsp. paratuberculosis
gacacgccccgauggua

SEQ ID NO: 829946 - RNA, 16 nt, Mycobacterium avium subsp. paratuberculosis
gacaccucgccguccu

SEQ ID NO: 829947 - RNA, 15 nt, Mycobacterium avium subsp. paratuberculosis
gacaccucggccagc

SEQ ID NO: 829948 - RNA, 21 nt, Mycobacterium avium subsp. paratuberculosis
gacaccucggccagcgccgcg

SEQ ID NO: 829949 - RNA, 13 nt, Mycobacterium avium subsp. paratuberculosis
gacaccucgucga

SEQ ID NO: 829950 - RNA, 16 nt, Mycobacterium avium subsp. paratuberculosis
gacaccugcucaccga

SEQ ID NO: 829951 - RNA, 14 nt, Mycobacterium avium subsp. paratuberculosis
gacacgaacgacgc

SEQ ID NO: 829952 - RNA, 19 nt, Mycobacterium avium subsp. paratuberculosis
gacacgaacgacgcggcac

SEQ ID NO: 829953 - RNA, 21 nt, Mycobacterium avium subsp. paratuberculosis
gacacgaauacccuucggccg

SEQ ID NO: 829954 - RNA, 14 nt, Mycobacterium avium subsp. paratuberculosis
gacaccgugguggc

SEQ ID NO: 829955 - RNA, 15 nt, Mycobacterium avium subsp. paratuberculosis
gacaccgugguggcg

SEQ ID NO: 829956 - RNA, 18 nt, Mycobacterium avium subsp. paratuberculosis
gacaccgugguggcggcg

SEQ ID NO: 829957 - RNA, 14 nt, Mycobacterium avium subsp. paratuberculosis
gacaccgucgccgu

SEQ ID NO: 829958 - RNA, 15 nt, Mycobacterium avium subsp. paratuberculosis
gacaccgucgccgug

SEQ ID NO: 829959 - RNA, 17 nt, Mycobacterium avium subsp. paratuberculosis
gacaccgucgccgugau

SEQ ID NO: 829960 - RNA, 14 nt, Mycobacterium avium subsp. paratuberculosis
gacaccgucgcgca

SEQ ID NO: 829961 - RNA, 15 nt, Mycobacterium avium subsp. paratuberculosis
gacaccgucgcgcac

SEQ ID NO: 829962 - RNA, 22 nt, Mycobacterium avium subsp. paratuberculosis
gacaccggcgugaugacggcgg

SEQ ID NO: 829963 - RNA, 14 nt, Mycobacterium avium subsp. paratuberculosis
gacaccgggugcgu

SEQ ID NO: 829964 - RNA, 20 nt, Mycobacterium avium subsp. paratuberculosis
gacaccgggugcguccagac

SEQ ID NO: 829965 - RNA, 13 nt, Mycobacterium avium subsp. paratuberculosis
gacaccggccggg

SEQ ID NO: 829966 - RNA, 22 nt, Mycobacterium avium subsp. paratuberculosis
gacacgccgacgauccgcgccg

SEQ ID NO: 829967 - RNA, 23 nt, Mycobacterium avium subsp. paratuberculosis
gacacgccgacgauccgcgccgc

SEQ ID NO: 829968 - RNA, 12 nt, Mycobacterium avium subsp. paratuberculosis
gacacgcgccgg

SEQ ID NO: 829969 - RNA, 14 nt, Mycobacterium avium subsp. paratuberculosis
gacacgcgccggcg

SEQ ID NO: 829970 - RNA, 15 nt, Mycobacterium avium subsp. paratuberculosis
gacacgcgccggcgc

SEQ ID NO: 829971 - RNA, 13 nt, Mycobacterium avium subsp. paratuberculosis
gacacgggccgcg

SEQ ID NO: 829972 - RNA, 16 nt, Mycobacterium avium subsp. paratuberculosis
gacacgggccgcgccg

SEQ ID NO: 829973 - RNA, 17 nt, Mycobacterium avium subsp. paratuberculosis
gacacgggccgcgccga

SEQ ID NO: 829974 - RNA, 21 nt, Mycobacterium avium subsp. paratuberculosis
gacacguaaagcauuggccca

SEQ ID NO: 829975 - RNA, 14 nt, Mycobacterium avium subsp. paratuberculosis
gacacguaggccgc

SEQ ID NO: 829976 - RNA, 18 nt, Mycobacterium avium subsp. paratuberculosis
gacacguaggccgccugc

SEQ ID NO: 829977 - RNA, 12 nt, Mycobacterium avium subsp. paratuberculosis
gacacgucgaca

SEQ ID NO: 829978 - RNA, 13 nt, Mycobacterium avium subsp. paratuberculosis
gacacggccagcg

SEQ ID NO: 829979 - RNA, 14 nt, Mycobacterium avium subsp. paratuberculosis
gacacggcggcgcg

SEQ ID NO: 829980 - RNA, 17 nt, Mycobacterium avium subsp. paratuberculosis
gacacggcggcgcgggc

SEQ ID NO: 829981 - RNA, 19 nt, Mycobacterium avium subsp. paratuberculosis
gacacggcggcgcgggcgg

SEQ ID NO: 829982 - RNA, 22 nt, Mycobacterium avium subsp. paratuberculosis
gacacggcggcgcgggcggcgu

SEQ ID NO: 829983 - RNA, 17 nt, Mycobacterium avium subsp. paratuberculosis
gacacucggucaccggu

SEQ ID NO: 829984 - RNA, 22 nt, Mycobacterium avium subsp. paratuberculosis
gacacugcaacuacgcacccga

SEQ ID NO: 829985 - RNA, 22 nt, Mycobacterium avium subsp. paratuberculosis
gacacguuggccagaugcccgc

SEQ ID NO: 829986 - RNA, 19 nt, Mycobacterium avium subsp. paratuberculosis
gacagauacuucgucgaac

SEQ ID NO: 829987 - RNA, 21 nt, Mycobacterium avium subsp. paratuberculosis
gacagccacuccauccggaac

SEQ ID NO: 829988 - RNA, 18 nt, Mycobacterium avium subsp. paratuberculosis
gacagcaaaccgaccgcc

SEQ ID NO: 829989 - RNA, 20 nt, Mycobacterium avium subsp. paratuberculosis
gacagcaaaccgaccgccgc

SEQ ID NO: 829990 - RNA, 21 nt, Mycobacterium avium subsp. paratuberculosis
gacagcaaaccgaccgccgcg

SEQ ID NO: 829991 - RNA, 21 nt, Mycobacterium avium subsp. paratuberculosis
gacagaugccagacgaacgcg

SEQ ID NO: 829992 - RNA, 19 nt, Mycobacterium avium subsp. paratuberculosis
gacagaugcggcaccagcc

SEQ ID NO: 829993 - RNA, 22 nt, Mycobacterium avium subsp. paratuberculosis
gacagaugcggcaccagcccgc

SEQ ID NO: 829994 - RNA, 24 nt, Mycobacterium avium subsp. paratuberculosis
gacagaugcggcaccagcccgccg

SEQ ID NO: 829995 - RNA, 22 nt, Mycobacterium avium subsp. paratuberculosis
gacagcaacgccagggccccgu

SEQ ID NO: 829996 - RNA, 16 nt, Mycobacterium avium subsp. paratuberculosis
gacagccacagcucgg

SEQ ID NO: 829997 - RNA, 21 nt, Mycobacterium avium subsp. paratuberculosis
gacaguucgguggggccgccg

SEQ ID NO: 829998 - RNA, 19 nt, Mycobacterium avium subsp. paratuberculosis
gacaucagaucgccgacga

SEQ ID NO: 829999 - RNA, 15 nt, Mycobacterium avium subsp. paratuberculosis
gacaucggcgccgac

SEQ ID NO: 830000 - RNA, 22 nt, Mycobacterium avium subsp. paratuberculosis
gacaucggugaccgucgccgac

SEQ ID NO: 830001 - RNA, 23 nt, Mycobacterium avium subsp. paratuberculosis
gacaucaagugcaagggcgacau

SEQ ID NO: 830002 - RNA, 22 nt, Mycobacterium avium subsp. paratuberculosis
gacauaggucagguuggggccg

SEQ ID NO: 830003 - RNA, 15 nt, Mycobacterium avium subsp. paratuberculosis
gacaucaccaccgcc

SEQ ID NO: 830004 - RNA, 17 nt, Mycobacterium avium subsp. paratuberculosis
gacaucaccaccgccgg

SEQ ID NO: 830005 - RNA, 19 nt, Mycobacterium avium subsp. paratuberculosis
gacaucaccaccgccgggg

SEQ ID NO: 830006 - RNA, 17 nt, Mycobacterium avium subsp. paratuberculosis
gacagccccgagccgcg

SEQ ID NO: 830007 - RNA, 22 nt, Mycobacterium avium subsp. paratuberculosis
gacagcgucaccaaugcgccgg

SEQ ID NO: 830008 - RNA, 16 nt, Mycobacterium avium subsp. paratuberculosis
gacagcgucagccccg

SEQ ID NO: 830009 - RNA, 19 nt, Mycobacterium avium subsp. paratuberculosis
gacagccgcaccggcgccg

SEQ ID NO: 830010 - RNA, 15 nt, Mycobacterium avium subsp. paratuberculosis
gacagccgcccggcg

SEQ ID NO: 830011 - RNA, 23 nt, Mycobacterium avium subsp. paratuberculosis
gacagcggcgcgguuucggcguc

SEQ ID NO: 830012 - RNA, 18 nt, Mycobacterium avium subsp. paratuberculosis
gacagcgggccgacccgg

SEQ ID NO: 830013 - RNA, 16 nt, Mycobacterium avium subsp. paratuberculosis
gacagccgcgccgaca

SEQ ID NO: 830014 - RNA, 22 nt, Mycobacterium avium subsp. paratuberculosis
gacagccgggaaucgagggcgc

SEQ ID NO: 830015 - RNA, 16 nt, Mycobacterium avium subsp. paratuberculosis
gacagccggucgacga

SEQ ID NO: 830016 - RNA, 16 nt, Mycobacterium avium subsp. paratuberculosis
gacagccggucgcgca

SEQ ID NO: 830017 - RNA, 17 nt, Mycobacterium avium subsp. paratuberculosis
gacagccggucgcgcau

SEQ ID NO: 830018 - RNA, 22 nt, Mycobacterium avium subsp. paratuberculosis
gacagccggucgcgcaucgccu

SEQ ID NO: 830019 - RNA, 16 nt, Mycobacterium avium subsp. paratuberculosis
gacagcucgccggccg

SEQ ID NO: 830020 - RNA, 17 nt, Mycobacterium avium subsp. paratuberculosis
gacagcguggucgcgca

SEQ ID NO: 830021 - RNA, 15 nt, Mycobacterium avium subsp. paratuberculosis
gacagcucaccgggc

SEQ ID NO: 830022 - RNA, 18 nt, Mycobacterium avium subsp. paratuberculosis
gacagcucaccgggcucg

SEQ ID NO: 830023 - RNA, 15 nt, Mycobacterium avium subsp. paratuberculosis
gacagcugagcagcc

SEQ ID NO: 830024 - RNA, 13 nt, Mycobacterium avium subsp. paratuberculosis
gacagcugcgcgg

SEQ ID NO: 830025 - RNA, 17 nt, Mycobacterium avium subsp. paratuberculosis
gacagcugcgcgggcgc

SEQ ID NO: 830026 - RNA, 21 nt, Mycobacterium avium subsp. paratuberculosis
gacagcugcgcgggcgcggcc

SEQ ID NO: 830027 - RNA, 21 nt, Mycobacterium avium subsp. paratuberculosis
gacaggaugcuggggucggcc

SEQ ID NO: 830028 - RNA, 15 nt, Mycobacterium avium subsp. paratuberculosis
gacaggaacgggccg

SEQ ID NO: 830029 - RNA, 17 nt, Mycobacterium avium subsp. paratuberculosis
gacaggaacgggccggc

SEQ ID NO: 830030 - RNA, 18 nt, Mycobacterium avium subsp. paratuberculosis
gacaggaacgggccggcg

SEQ ID NO: 830031 - RNA, 15 nt, Mycobacterium avium subsp. paratuberculosis
gacauucacgaggcc

SEQ ID NO: 830032 - RNA, 17 nt, Mycobacterium avium subsp. paratuberculosis
gacauucggggccacca

SEQ ID NO: 830033 - RNA, 21 nt, Mycobacterium avium subsp. paratuberculosis
gacauucggggccaccaggcc

SEQ ID NO: 830034 - RNA, 22 nt, Mycobacterium avium subsp. paratuberculosis
gacauggacgcggccucaccgc

SEQ ID NO: 830035 - RNA, 17 nt, Mycobacterium avium subsp. paratuberculosis
gacaugccggcgccgau

SEQ ID NO: 830036 - RNA, 13 nt, Mycobacterium avium subsp. paratuberculosis
gacaugcuguucc

SEQ ID NO: 830037 - RNA, 22 nt, Mycobacterium avium subsp. paratuberculosis
gacauggucgggcgcaccacga

SEQ ID NO: 830038 - RNA, 19 nt, Mycobacterium avium subsp. paratuberculosis
gacaugcccggcgacggcg

SEQ ID NO: 830039 - RNA, 17 nt, Mycobacterium avium subsp. paratuberculosis
gacaugccgagcagcac

SEQ ID NO: 830040 - RNA, 18 nt, Mycobacterium avium subsp. paratuberculosis
gacaugccgagcagcacc

SEQ ID NO: 830041 - RNA, 22 nt, Mycobacterium avium subsp. paratuberculosis
gacaugccgagcagcaccgcga

SEQ ID NO: 830042 - RNA, 16 nt, Mycobacterium avium subsp. paratuberculosis
gacaugaccaccgcgu

SEQ ID NO: 830043 - RNA, 19 nt, Mycobacterium avium subsp. paratuberculosis
gacaugaccaccgcgucgg

SEQ ID NO: 830044 - RNA, 15 nt, Mycobacterium avium subsp. paratuberculosis
gacaucucgacggug

SEQ ID NO: 830045 - RNA, 14 nt, Mycobacterium avium subsp. paratuberculosis
gacaucucggugag

SEQ ID NO: 830046 - RNA, 16 nt, Mycobacterium avium subsp. paratuberculosis
gacaucugccgggcgg

SEQ ID NO: 830047 - RNA, 15 nt, Mycobacterium avium subsp. paratuberculosis
gacaucgucgcgccc

SEQ ID NO: 830048 - RNA, 22 nt, Mycobacterium avium subsp. paratuberculosis
gaccaacuccaccgcccggaug

SEQ ID NO: 830049 - RNA, 19 nt, Mycobacterium avium subsp. paratuberculosis
gaccaacacccccgcgcug

SEQ ID NO: 830050 - RNA, 13 nt, Mycobacterium avium subsp. paratuberculosis
gaccaacgccgcc

SEQ ID NO: 830051 - RNA, 15 nt, Mycobacterium avium subsp. paratuberculosis
gaccaacgggcggcg

SEQ ID NO: 830052 - RNA, 19 nt, Mycobacterium avium subsp. paratuberculosis
gacauggccagcaccaucc

SEQ ID NO: 830053 - RNA, 19 nt, Mycobacterium avium subsp. paratuberculosis
gaagauguugcggcggccg

SEQ ID NO: 830054 - RNA, 23 nt, Mycobacterium avium subsp. paratuberculosis
gaagaugcgccggguccagccgc

SEQ ID NO: 830055 - RNA, 16 nt, Mycobacterium avium subsp. paratuberculosis
gaagauggucgcgccg

SEQ ID NO: 830056 - RNA, 14 nt, Mycobacterium avium subsp. paratuberculosis
gaagaucucggcca

SEQ ID NO: 830057 - RNA, 15 nt, Mycobacterium avium subsp. paratuberculosis
gaagaucugccggug

SEQ ID NO: 830058 - RNA, 20 nt, Mycobacterium avium subsp. paratuberculosis
gaagcaggccaggugcagcu

SEQ ID NO: 830059 - RNA, 23 nt, Mycobacterium avium subsp. paratuberculosis
gaagcacaccguucccaccggcu

SEQ ID NO: 830060 - RNA, 17 nt, Mycobacterium avium subsp. paratuberculosis
gaagcagaacgccauca

SEQ ID NO: 830061 - RNA, 20 nt, Mycobacterium avium subsp. paratuberculosis
gaagcagaacgccaucacca

SEQ ID NO: 830062 - RNA, 21 nt, Mycobacterium avium subsp. paratuberculosis
gaagcagaacuucuccgccgg

SEQ ID NO: 830063 - RNA, 15 nt, Mycobacterium avium subsp. paratuberculosis
gaagccccaggcccg

SEQ ID NO: 830064 - RNA, 19 nt, Mycobacterium avium subsp. paratuberculosis
gaagccccaggcccgguug

SEQ ID NO: 830065 - RNA, 15 nt, Mycobacterium avium subsp. paratuberculosis
gaagcccaccgccgu

SEQ ID NO: 830066 - RNA, 13 nt, Mycobacterium avium subsp. paratuberculosis
gaagcccaccgcg

SEQ ID NO: 830067 - RNA, 19 nt, Mycobacterium avium subsp. paratuberculosis
gaagcccaccgcggugacc

SEQ ID NO: 830068 - RNA, 13 nt, Mycobacterium avium subsp. paratuberculosis
gaagcccagcacc

SEQ ID NO: 830069 - RNA, 15 nt, Mycobacterium avium subsp. paratuberculosis
gaagcccagcacccg

SEQ ID NO: 830070 - RNA, 13 nt, Mycobacterium avium subsp. paratuberculosis
gaagcccagcgcg

SEQ ID NO: 830071 - RNA, 17 nt, Mycobacterium avium subsp. paratuberculosis
gaagcccagcgcguuga

SEQ ID NO: 830072 - RNA, 15 nt, Mycobacterium avium subsp. paratuberculosis
gaagcccgugcgacg

SEQ ID NO: 830073 - RNA, 18 nt, Mycobacterium avium subsp. paratuberculosis
gaagcccaugccgaugcc

SEQ ID NO: 830074 - RNA, 16 nt, Mycobacterium avium subsp. paratuberculosis
gaagccccggaccgga

SEQ ID NO: 830075 - RNA, 21 nt, Mycobacterium avium subsp. paratuberculosis
gaagcccgacaucugccgggc

SEQ ID NO: 830076 - RNA, 13 nt, Mycobacterium avium subsp. paratuberculosis
gaagccgaacgcg

SEQ ID NO: 830077 - RNA, 17 nt, Mycobacterium avium subsp. paratuberculosis
gaagccgaacgcgcugu

SEQ ID NO: 830078 - RNA, 17 nt, Mycobacterium avium subsp. paratuberculosis
gaagcccgagcgucacg

SEQ ID NO: 830079 - RNA, 15 nt, Mycobacterium avium subsp. paratuberculosis
gaagcccgcagcgaa

SEQ ID NO: 830080 - RNA, 13 nt, Mycobacterium avium subsp. paratuberculosis
gaagccaugccgg

SEQ ID NO: 830081 - RNA, 15 nt, Mycobacterium avium subsp. paratuberculosis
gaagcccucgucgaa

SEQ ID NO: 830082 - RNA, 13 nt, Mycobacterium avium subsp. paratuberculosis
gaagcccugcucg

SEQ ID NO: 830083 - RNA, 14 nt, Mycobacterium avium subsp. paratuberculosis
gaagcccugcucgg

SEQ ID NO: 830084 - RNA, 21 nt, Mycobacterium avium subsp. paratuberculosis
gaagcccugcucggugaugcc

SEQ ID NO: 830085 - RNA, 22 nt, Mycobacterium avium subsp. paratuberculosis
gaagcccugcucggugaugccg

SEQ ID NO: 830086 - RNA, 19 nt, Mycobacterium avium subsp. paratuberculosis
gaagcccuucaccucggcc

SEQ ID NO: 830087 - RNA, 13 nt, Mycobacterium avium subsp. paratuberculosis
gaagccgacgccg

SEQ ID NO: 830088 - RNA, 13 nt, Mycobacterium avium subsp. paratuberculosis
gaagccgacgucc

SEQ ID NO: 830089 - RNA, 16 nt, Mycobacterium avium subsp. paratuberculosis
gaagccgacgucgacc

SEQ ID NO: 830090 - RNA, 18 nt, Mycobacterium avium subsp. paratuberculosis
gaagccgaggucgccgac

SEQ ID NO: 830091 - RNA, 17 nt, Mycobacterium avium subsp. paratuberculosis
gaagccgaucaccggcg

SEQ ID NO: 830092 - RNA, 18 nt, Mycobacterium avium subsp. paratuberculosis
gaagccgaucaccggcgc

SEQ ID NO: 830093 - RNA, 19 nt, Mycobacterium avium subsp. paratuberculosis
gaagcgcagaucgcgcauc

SEQ ID NO: 830094 - RNA, 13 nt, Mycobacterium avium subsp. paratuberculosis
gaagcgcagcacc

SEQ ID NO: 830095 - RNA, 14 nt, Mycobacterium avium subsp. paratuberculosis
gaagccgugggugc

SEQ ID NO: 830096 - RNA, 16 nt, Mycobacterium avium subsp. paratuberculosis
gaagccgugggugccg

SEQ ID NO: 830097 - RNA, 22 nt, Mycobacterium avium subsp. paratuberculosis
gaagccguugaugcgcaccgcg

SEQ ID NO: 830098 - RNA, 18 nt, Mycobacterium avium subsp. paratuberculosis
gaagccguugccgccgcg

SEQ ID NO: 830099 - RNA, 19 nt, Mycobacterium avium subsp. paratuberculosis
gaagccguugccgccgcgc

SEQ ID NO: 830100 - RNA, 16 nt, Mycobacterium avium subsp. paratuberculosis
gaagcgcaucgccggc

SEQ ID NO: 830101 - RNA, 21 nt, Mycobacterium avium subsp. paratuberculosis
gaagcgcaucgccggcgcgcu

SEQ ID NO: 830102 - RNA, 22 nt, Mycobacterium avium subsp. paratuberculosis
gaagcgccacggggcgccgcug

SEQ ID NO: 830103 - RNA, 15 nt, Mycobacterium avium subsp. paratuberculosis
gaagcgcagcagcuc

SEQ ID NO: 830104 - RNA, 17 nt, Mycobacterium avium subsp. paratuberculosis
gaagcgcagcagcucgu

SEQ ID NO: 830105 - RNA, 13 nt, Mycobacterium avium subsp. paratuberculosis
gaagcgcagcguc

SEQ ID NO: 830106 - RNA, 17 nt, Mycobacterium avium subsp. paratuberculosis
gaagcgcagcgucuccu

SEQ ID NO: 830107 - RNA, 21 nt, Mycobacterium avium subsp. paratuberculosis
gaagccggccccgcccggggc

SEQ ID NO: 830108 - RNA, 13 nt, Mycobacterium avium subsp. paratuberculosis
gaagccguagacg

SEQ ID NO: 830109 - RNA, 19 nt, Mycobacterium avium subsp. paratuberculosis
gaagccgugcacgccgucg

SEQ ID NO: 830110 - RNA, 20 nt, Mycobacterium avium subsp. paratuberculosis
gaagccgugcacgccgucgu

SEQ ID NO: 830111 - RNA, 19 nt, Mycobacterium avium subsp. paratuberculosis
gaagccuggcacgacgccg

SEQ ID NO: 830112 - RNA, 20 nt, Mycobacterium avium subsp. paratuberculosis
gaagccuggcacgacgccgc

SEQ ID NO: 830113 - RNA, 21 nt, Mycobacterium avium subsp. paratuberculosis
gaagccuggcacgacgccgcc

SEQ ID NO: 830114 - RNA, 19 nt, Mycobacterium avium subsp. paratuberculosis
gaagccggcgacgaccgca

SEQ ID NO: 830115 - RNA, 20 nt, Mycobacterium avium subsp. paratuberculosis
gaagccggcgacgaccgcac

SEQ ID NO: 830116 - RNA, 15 nt, Mycobacterium avium subsp. paratuberculosis
gaagccggcgcaggu

SEQ ID NO: 830117 - RNA, 14 nt, Mycobacterium avium subsp. paratuberculosis
gaagccggugccca

SEQ ID NO: 830118 - RNA, 18 nt, Mycobacterium avium subsp. paratuberculosis
gaagccggugcccaucgc

SEQ ID NO: 830119 - RNA, 12 nt, Mycobacterium avium subsp. paratuberculosis
gaagccgccgac

SEQ ID NO: 830120 - RNA, 16 nt, Mycobacterium avium subsp. paratuberculosis
gaagccgcuggaaguc

SEQ ID NO: 830121 - RNA, 22 nt, Mycobacterium avium subsp. paratuberculosis
gaagccgcauggugcggguguc

SEQ ID NO: 830122 - RNA, 20 nt, Mycobacterium avium subsp. paratuberculosis
gaagccgcagcaggugcgcc

SEQ ID NO: 830123 - RNA, 17 nt, Mycobacterium avium subsp. paratuberculosis
gaagcugucgccgaggu

SEQ ID NO: 830124 - RNA, 17 nt, Mycobacterium avium subsp. paratuberculosis
gaagcuuucggugcgca

SEQ ID NO: 830125 - RNA, 13 nt, Mycobacterium avium subsp. paratuberculosis
gaaggacagccgg

SEQ ID NO: 830126 - RNA, 23 nt, Mycobacterium avium subsp. paratuberculosis
gaagcugguggugaucggccagg

SEQ ID NO: 830127 - RNA, 14 nt, Mycobacterium avium subsp. paratuberculosis
gaagcuggcgaaca

SEQ ID NO: 830128 - RNA, 14 nt, Mycobacterium avium subsp. paratuberculosis
gaagcugcgccaca

SEQ ID NO: 830129 - RNA, 17 nt, Mycobacterium avium subsp. paratuberculosis
gaaggccaaggccagca

SEQ ID NO: 830130 - RNA, 18 nt, Mycobacterium avium subsp. paratuberculosis
gaaggccaaggccagcaa

SEQ ID NO: 830131 - RNA, 22 nt, Mycobacterium avium subsp. paratuberculosis
gaaggacgccucgcgcagcgcg

SEQ ID NO: 830132 - RNA, 16 nt, Mycobacterium avium subsp. paratuberculosis
gaaggacgucaggccg

SEQ ID NO: 830133 - RNA, 22 nt, Mycobacterium avium subsp. paratuberculosis
gaaggccaggugcacgccgagc

SEQ ID NO: 830134 - RNA, 20 nt, Mycobacterium avium subsp. paratuberculosis
gaaggccagguugccacgcg

SEQ ID NO: 830135 - RNA, 14 nt, Mycobacterium avium subsp. paratuberculosis
gaaggccgccgggu

SEQ ID NO: 830136 - RNA, 17 nt, Mycobacterium avium subsp. paratuberculosis
gaaggcgacgucggucg

SEQ ID NO: 830137 - RNA, 12 nt, Mycobacterium avium subsp. paratuberculosis
gaaggccgggcu

SEQ ID NO: 830138 - RNA, 14 nt, Mycobacterium avium subsp. paratuberculosis
gaaggcgccgaugg

SEQ ID NO: 830139 - RNA, 19 nt, Mycobacterium avium subsp. paratuberculosis
gaaggcgcgggcguccacg

SEQ ID NO: 830140 - RNA, 14 nt, Mycobacterium avium subsp. paratuberculosis
gaaggcggccgcga

SEQ ID NO: 830141 - RNA, 18 nt, Mycobacterium avium subsp. paratuberculosis
gaaggcggccgcgagccc

SEQ ID NO: 830142 - RNA, 19 nt, Mycobacterium avium subsp. paratuberculosis
gaaggcggccgcgagcccg

SEQ ID NO: 830143 - RNA, 22 nt, Mycobacterium avium subsp. paratuberculosis
gaaggcggccgcgagcccggcg

SEQ ID NO: 830144 - RNA, 16 nt, Mycobacterium avium subsp. paratuberculosis
gaaggcggccaccgcg

SEQ ID NO: 830145 - RNA, 22 nt, Mycobacterium avium subsp. paratuberculosis
gaaggcggccaccgcggccagc

SEQ ID NO: 830146 - RNA, 12 nt, Mycobacterium avium subsp. paratuberculosis
gaaggcggcguc

SEQ ID NO: 830147 - RNA, 16 nt, Mycobacterium avium subsp. paratuberculosis
gaaggcggcgucgaug

SEQ ID NO: 830148 - RNA, 16 nt, Mycobacterium avium subsp. paratuberculosis
gaaggcggcgccggcc

SEQ ID NO: 830149 - RNA, 17 nt, Mycobacterium avium subsp. paratuberculosis
gaaggcggcgccggccg

SEQ ID NO: 830150 - RNA, 22 nt, Mycobacterium avium subsp. paratuberculosis
gaagcugccguugcgccagcgg

SEQ ID NO: 830151 - RNA, 12 nt, Mycobacterium avium subsp. paratuberculosis
gaagcugccgac

SEQ ID NO: 830152 - RNA, 14 nt, Mycobacterium avium subsp. paratuberculosis
gaagcuccacgccg

SEQ ID NO: 830153 - RNA, 17 nt, Mycobacterium avium subsp. paratuberculosis
gaagcucagcugcugcg

SEQ ID NO: 830154 - RNA, 18 nt, Mycobacterium avium subsp. paratuberculosis
gaagcucaucaccggcgc

SEQ ID NO: 830155 - RNA, 15 nt, Mycobacterium avium subsp. paratuberculosis
gaagcguaugccggu

SEQ ID NO: 830156 - RNA, 17 nt, Mycobacterium avium subsp. paratuberculosis
gaagcggugcaccaccg

SEQ ID NO: 830157 - RNA, 14 nt, Mycobacterium avium subsp. paratuberculosis
gaagcguugcgcgu

SEQ ID NO: 830158 - RNA, 19 nt, Mycobacterium avium subsp. paratuberculosis
gaagcuaaaccccacggcc

SEQ ID NO: 830159 - RNA, 21 nt, Mycobacterium avium subsp. paratuberculosis
gaagcuaaaccccacggccgc

SEQ ID NO: 830160 - RNA, 20 nt, Mycobacterium avium subsp. paratuberculosis
gaagcuagcuucacgcucgg

SEQ ID NO: 830161 - RNA, 14 nt, Mycobacterium avium subsp. paratuberculosis
gaagcgcgaugcgg

SEQ ID NO: 830162 - RNA, 13 nt, Mycobacterium avium subsp. paratuberculosis
gaagcgcgcaucg

SEQ ID NO: 830163 - RNA, 20 nt, Mycobacterium avium subsp. paratuberculosis
gaagcgcuuucccugcucga

SEQ ID NO: 830164 - RNA, 15 nt, Mycobacterium avium subsp. paratuberculosis
gaagcggcgcggguc

SEQ ID NO: 830165 - RNA, 15 nt, Mycobacterium avium subsp. paratuberculosis
gaagcggcccgagau

SEQ ID NO: 830166 - RNA, 15 nt, Mycobacterium avium subsp. paratuberculosis
gaagcgggccaaaga

SEQ ID NO: 830167 - RNA, 17 nt, Mycobacterium avium subsp. paratuberculosis
gaagcgggccaaagagc

SEQ ID NO: 830168 - RNA, 23 nt, Mycobacterium avium subsp. paratuberculosis
gaagcgggcggcgaacaccagca

SEQ ID NO: 830169 - RNA, 15 nt, Mycobacterium avium subsp. paratuberculosis
gaaacgacgucgcca

SEQ ID NO: 830170 - RNA, 18 nt, Mycobacterium avium subsp. paratuberculosis
gaaaccucuugcggcgca

SEQ ID NO: 830171 - RNA, 15 nt, Mycobacterium avium subsp. paratuberculosis
gaaacgccgcgcucg

SEQ ID NO: 830172 - RNA, 17 nt, Mycobacterium avium subsp. paratuberculosis
gaaacggcccaucacgu

SEQ ID NO: 830173 - RNA, 19 nt, Mycobacterium avium subsp. paratuberculosis
gaacgacggugcgcccguc

SEQ ID NO: 830174 - RNA, 22 nt, Mycobacterium avium subsp. paratuberculosis
gaacgacggugcgcccgucguc

SEQ ID NO: 830175 - RNA, 16 nt, Mycobacterium avium subsp. paratuberculosis
gaaacggugcccgcag

SEQ ID NO: 830176 - RNA, 23 nt, Mycobacterium avium subsp. paratuberculosis
gaacgagccggacaucucccgca

SEQ ID NO: 830177 - RNA, 15 nt, Mycobacterium avium subsp. paratuberculosis
gaacgaggccgacgu

SEQ ID NO: 830178 - RNA, 17 nt, Mycobacterium avium subsp. paratuberculosis
gaacgaggccgacgugg

SEQ ID NO: 830179 - RNA, 17 nt, Mycobacterium avium subsp. paratuberculosis
gaacgaggccgcgccgu

SEQ ID NO: 830180 - RNA, 13 nt, Mycobacterium avium subsp. paratuberculosis
gaacgcaccaccg

SEQ ID NO: 830181 - RNA, 16 nt, Mycobacterium avium subsp. paratuberculosis
gaacgcaccaccgcgg

SEQ ID NO: 830182 - RNA, 16 nt, Mycobacterium avium subsp. paratuberculosis
gaacgcaagaagucgg

SEQ ID NO: 830183 - RNA, 17 nt, Mycobacterium avium subsp. paratuberculosis
gaacgaucggcuccagc

SEQ ID NO: 830184 - RNA, 21 nt, Mycobacterium avium subsp. paratuberculosis
gaacgaucggcuccagcgccc

SEQ ID NO: 830185 - RNA, 19 nt, Mycobacterium avium subsp. paratuberculosis
gaacgauggugugcagcaa

SEQ ID NO: 830186 - RNA, 17 nt, Mycobacterium avium subsp. paratuberculosis
gaacgaguuucccgucg

SEQ ID NO: 830187 - RNA, 15 nt, Mycobacterium avium subsp. paratuberculosis
gaacgggcagccacg

SEQ ID NO: 830188 - RNA, 12 nt, Mycobacterium avium subsp. paratuberculosis
gaacgggcugaa

SEQ ID NO: 830189 - RNA, 18 nt, Mycobacterium avium subsp. paratuberculosis
gaacggucagccgcggcu

SEQ ID NO: 830190 - RNA, 20 nt, Mycobacterium avium subsp. paratuberculosis
gaacgguuuuucccagcggc

SEQ ID NO: 830191 - RNA, 22 nt, Mycobacterium avium subsp. paratuberculosis
gaacgguuuuucccagcggccg

SEQ ID NO: 830192 - RNA, 22 nt, Mycobacterium avium subsp. paratuberculosis
gaacgccaccuucaccgcgccg

SEQ ID NO: 830193 - RNA, 15 nt, Mycobacterium avium subsp. paratuberculosis
gaacgcguucgucgg

SEQ ID NO: 830194 - RNA, 17 nt, Mycobacterium avium subsp. paratuberculosis
gaacgcguucgucggcg

SEQ ID NO: 830195 - RNA, 18 nt, Mycobacterium avium subsp. paratuberculosis
gaacgcugccaggcggug

SEQ ID NO: 830196 - RNA, 20 nt, Mycobacterium avium subsp. paratuberculosis
gaacgcugccaggcgguggc

SEQ ID NO: 830197 - RNA, 14 nt, Mycobacterium avium subsp. paratuberculosis
gaacggcggaaccg

SEQ ID NO: 830198 - RNA, 16 nt, Mycobacterium avium subsp. paratuberculosis
gaacggcggcagcgag

SEQ ID NO: 830199 - RNA, 18 nt, Mycobacterium avium subsp. paratuberculosis
gaacgcuuccagcaccac

SEQ ID NO: 830200 - RNA, 22 nt, Mycobacterium avium subsp. paratuberculosis
gaacggcuugcgcucggccggg

SEQ ID NO: 830201 - RNA, 16 nt, Mycobacterium avium subsp. paratuberculosis
gaacgccagcagccgc

SEQ ID NO: 830202 - RNA, 19 nt, Mycobacterium avium subsp. paratuberculosis
gaacgccagcagccgcagc

SEQ ID NO: 830203 - RNA, 17 nt, Mycobacterium avium subsp. paratuberculosis
gaacgcgucccgggccu

SEQ ID NO: 830204 - RNA, 18 nt, Mycobacterium avium subsp. paratuberculosis
gaacgcgucgaccgccgc

SEQ ID NO: 830205 - RNA, 15 nt, Mycobacterium avium subsp. paratuberculosis
gaacgcgucgcccac

SEQ ID NO: 830206 - RNA, 16 nt, Mycobacterium avium subsp. paratuberculosis
gaacgcgucgcccacg

SEQ ID NO: 830207 - RNA, 19 nt, Mycobacterium avium subsp. paratuberculosis
gaacgcgucgcccacgccg

SEQ ID NO: 830208 - RNA, 14 nt, Mycobacterium avium subsp. paratuberculosis
gaacgcgucgcgcc

SEQ ID NO: 830209 - RNA, 20 nt, Mycobacterium avium subsp. paratuberculosis
gaacgcgucggucagcggcg

SEQ ID NO: 830210 - RNA, 15 nt, Mycobacterium avium subsp. paratuberculosis
gaacgcggcgccgac

SEQ ID NO: 830211 - RNA, 16 nt, Mycobacterium avium subsp. paratuberculosis
gaacgcggcgccgacg

SEQ ID NO: 830212 - RNA, 20 nt, Mycobacterium avium subsp. paratuberculosis
gaacgcggcggaggccugcg

SEQ ID NO: 830213 - RNA, 17 nt, Mycobacterium avium subsp. paratuberculosis
gaacgcggugagcgugc

SEQ ID NO: 830214 - RNA, 16 nt, Mycobacterium avium subsp. paratuberculosis
gaacgcggugggcacc

SEQ ID NO: 830215 - RNA, 20 nt, Mycobacterium avium subsp. paratuberculosis
gaacgcggugggcaccagca

SEQ ID NO: 830216 - RNA, 19 nt, Mycobacterium avium subsp. paratuberculosis
gaacgcguacacggcccgc

SEQ ID NO: 830217 - RNA, 17 nt, Mycobacterium avium subsp. paratuberculosis
gaacgcguacagcgccc

SEQ ID NO: 830218 - RNA, 23 nt, Mycobacterium avium subsp. paratuberculosis
gaacgccagcagcugcgggacca

SEQ ID NO: 830219 - RNA, 17 nt, Mycobacterium avium subsp. paratuberculosis
gaacgccaucaccagcg

SEQ ID NO: 830220 - RNA, 19 nt, Mycobacterium avium subsp. paratuberculosis
gaacgccaucaccagcgcg

SEQ ID NO: 830221 - RNA, 21 nt, Mycobacterium avium subsp. paratuberculosis
gaacgccaucaccagcgcgua

SEQ ID NO: 830222 - RNA, 16 nt, Mycobacterium avium subsp. paratuberculosis
gaagaccuggccggcc

SEQ ID NO: 830223 - RNA, 19 nt, Mycobacterium avium subsp. paratuberculosis
gaagacguaggcggccagc

SEQ ID NO: 830224 - RNA, 23 nt, Mycobacterium avium subsp. paratuberculosis
gaagacguaggcggccagcagca

SEQ ID NO: 830225 - RNA, 13 nt, Mycobacterium avium subsp. paratuberculosis
gaagacgucggcg

SEQ ID NO: 830226 - RNA, 20 nt, Mycobacterium avium subsp. paratuberculosis
gaagacgaugaaaccccagc

SEQ ID NO: 830227 - RNA, 13 nt, Mycobacterium avium subsp. paratuberculosis
gaagagcggcgug

SEQ ID NO: 830228 - RNA, 23 nt, Mycobacterium avium subsp. paratuberculosis
gaagaguugggucgcguccgcga

SEQ ID NO: 830229 - RNA, 21 nt, Mycobacterium avium subsp. paratuberculosis
gaagaggcgcgcuaacggcgc

SEQ ID NO: 830230 - RNA, 16 nt, Mycobacterium avium subsp. paratuberculosis
gaagaggugcucgacg

SEQ ID NO: 830231 - RNA, 13 nt, Mycobacterium avium subsp. paratuberculosis
gaagagccggcgu

SEQ ID NO: 830232 - RNA, 14 nt, Mycobacterium avium subsp. paratuberculosis
gaagaucaccgcga

SEQ ID NO: 830233 - RNA, 12 nt, Mycobacterium avium subsp. paratuberculosis
gaagaucagcag

SEQ ID NO: 830234 - RNA, 21 nt, Mycobacterium avium subsp. paratuberculosis
gaagaucgaaaugaccgcgcc

SEQ ID NO: 830235 - RNA, 22 nt, Mycobacterium avium subsp. paratuberculosis
gaagaucuucucggugucgucg

SEQ ID NO: 830236 - RNA, 16 nt, Mycobacterium avium subsp. paratuberculosis
gaagaugaccugaucg

SEQ ID NO: 830237 - RNA, 17 nt, Mycobacterium avium subsp. paratuberculosis
gaagaugaccugaucga

SEQ ID NO: 830238 - RNA, 22 nt, Mycobacterium avium subsp. paratuberculosis
gaagaugaccugaucgaguucc

SEQ ID NO: 830239 - RNA, 17 nt, Mycobacterium avium subsp. paratuberculosis
gaagaugaucagcgcgc

SEQ ID NO: 830240 - RNA, 21 nt, Mycobacterium avium subsp. paratuberculosis
gaagaugaucucgccgagcgg

SEQ ID NO: 830241 - RNA, 22 nt, Mycobacterium avium subsp. paratuberculosis
gaagaucgucgucccgucggcg

SEQ ID NO: 830242 - RNA, 22 nt, Mycobacterium avium subsp. paratuberculosis
gaagaacggugucacguccacg

SEQ ID NO: 830243 - RNA, 20 nt, Mycobacterium avium subsp. paratuberculosis
gaagaacuccgcgauggccu

SEQ ID NO: 830244 - RNA, 17 nt, Mycobacterium avium subsp. paratuberculosis
gaacuugcuggccgagu

SEQ ID NO: 830245 - RNA, 16 nt, Mycobacterium avium subsp. paratuberculosis
gaacuugaucaccgcg

SEQ ID NO: 830246 - RNA, 17 nt, Mycobacterium avium subsp. paratuberculosis
gaacuugaucaccgcgu

SEQ ID NO: 830247 - RNA, 22 nt, Mycobacterium avium subsp. paratuberculosis
gaacuucgccagcgggccgacc

SEQ ID NO: 830248 - RNA, 16 nt, Mycobacterium avium subsp. paratuberculosis
gaacuucuccgccggc

SEQ ID NO: 830249 - RNA, 17 nt, Mycobacterium avium subsp. paratuberculosis
gaacuucuccgccggca

SEQ ID NO: 830250 - RNA, 20 nt, Mycobacterium avium subsp. paratuberculosis
gaacgugugggugagcaucg

SEQ ID NO: 830251 - RNA, 19 nt, Mycobacterium avium subsp. paratuberculosis
gaacugggugggcagcgga

SEQ ID NO: 830252 - RNA, 18 nt, Mycobacterium avium subsp. paratuberculosis
gaacugguuccacaccac

SEQ ID NO: 830253 - RNA, 17 nt, Mycobacterium avium subsp. paratuberculosis
gaacgucgucagcaccg

SEQ ID NO: 830254 - RNA, 15 nt, Mycobacterium avium subsp. paratuberculosis
gaacgugauggcgaa

SEQ ID NO: 830255 - RNA, 20 nt, Mycobacterium avium subsp. paratuberculosis
gaacgucgcguccgagcagc

SEQ ID NO: 830256 - RNA, 15 nt, Mycobacterium avium subsp. paratuberculosis
gaacgucucgguguc

SEQ ID NO: 830257 - RNA, 14 nt, Mycobacterium avium subsp. paratuberculosis
gaacgucacggcga

SEQ ID NO: 830258 - RNA, 20 nt, Mycobacterium avium subsp. paratuberculosis
gaacgucaggcccagcgagg

SEQ ID NO: 830259 - RNA, 21 nt, Mycobacterium avium subsp. paratuberculosis
gaacgucaggcccagcgaggc

SEQ ID NO: 830260 - RNA, 13 nt, Mycobacterium avium subsp. paratuberculosis
gaacgucaggccg

SEQ ID NO: 830261 - RNA, 20 nt, Mycobacterium avium subsp. paratuberculosis
gaacgucauggccagcucgu

SEQ ID NO: 830262 - RNA, 15 nt, Mycobacterium avium subsp. paratuberculosis
gaacgucccguuggu

SEQ ID NO: 830263 - RNA, 17 nt, Mycobacterium avium subsp. paratuberculosis
gaacgucgagcgcggcc

SEQ ID NO: 830264 - RNA, 19 nt, Mycobacterium avium subsp. paratuberculosis
gaacgucgagcgcggcccg

SEQ ID NO: 830265 - RNA, 21 nt, Mycobacterium avium subsp. paratuberculosis
gaacgucgagcgcggcccgcc

SEQ ID NO: 830266 - RNA, 17 nt, Mycobacterium avium subsp. paratuberculosis
gaacgucgauccccgca

SEQ ID NO: 830267 - RNA, 15 nt, Mycobacterium avium subsp. paratuberculosis
gacguagucgcgcac

SEQ ID NO: 830268 - RNA, 15 nt, Mycobacterium avium subsp. paratuberculosis
gacgucacgacgguc

SEQ ID NO: 830269 - RNA, 15 nt, Mycobacterium avium subsp. paratuberculosis
gacgucaggccgguc

SEQ ID NO: 830270 - RNA, 20 nt, Mycobacterium avium subsp. paratuberculosis
gacgucaggccggucagcga

SEQ ID NO: 830271 - RNA, 14 nt, Mycobacterium avium subsp. paratuberculosis
gacgucaggguggc

SEQ ID NO: 830272 - RNA, 15 nt, Mycobacterium avium subsp. paratuberculosis
gacgucauccggcug

SEQ ID NO: 830273 - RNA, 18 nt, Mycobacterium avium subsp. paratuberculosis
gacgucauccggcugccc

SEQ ID NO: 830274 - RNA, 23 nt, Mycobacterium avium subsp. paratuberculosis
gacgucagcccgcgucgcgcagc

SEQ ID NO: 830275 - RNA, 18 nt, Mycobacterium avium subsp. paratuberculosis
gacgucagcucccccgac

SEQ ID NO: 830276 - RNA, 17 nt, Mycobacterium avium subsp. paratuberculosis
gacguccaccagggugg

SEQ ID NO: 830277 - RNA, 21 nt, Mycobacterium avium subsp. paratuberculosis
gacguccaccaggguggccgc

SEQ ID NO: 830278 - RNA, 19 nt, Mycobacterium avium subsp. paratuberculosis
gacgucccagcacaacgcc

SEQ ID NO: 830279 - RNA, 15 nt, Mycobacterium avium subsp. paratuberculosis
gacguccaucgggac

SEQ ID NO: 830280 - RNA, 20 nt, Mycobacterium avium subsp. paratuberculosis
gacguccaucgggaccgcgg

SEQ ID NO: 830281 - RNA, 16 nt, Mycobacterium avium subsp. paratuberculosis
gacguccaggccggcg

SEQ ID NO: 830282 - RNA, 20 nt, Mycobacterium avium subsp. paratuberculosis
gacgucgggcugggcggggu

SEQ ID NO: 830283 - RNA, 13 nt, Mycobacterium avium subsp. paratuberculosis
gacgucggucagc

SEQ ID NO: 830284 - RNA, 20 nt, Mycobacterium avium subsp. paratuberculosis
gacgucggucagcaucgggu

SEQ ID NO: 830285 - RNA, 12 nt, Mycobacterium avium subsp. paratuberculosis
gacgucggcguc

SEQ ID NO: 830286 - RNA, 17 nt, Mycobacterium avium subsp. paratuberculosis
gacgucggcgucaucga

SEQ ID NO: 830287 - RNA, 14 nt, Mycobacterium avium subsp. paratuberculosis
gacgucgaugccgg

SEQ ID NO: 830288 - RNA, 15 nt, Mycobacterium avium subsp. paratuberculosis
gacgucgaugccggc

SEQ ID NO: 830289 - RNA, 16 nt, Mycobacterium avium subsp. paratuberculosis
gacgucgaugccggcc

SEQ ID NO: 830290 - RNA, 17 nt, Mycobacterium avium subsp. paratuberculosis
gacgucgaugccggcca

SEQ ID NO: 830291 - RNA, 19 nt, Mycobacterium avium subsp. paratuberculosis
gacgucgaugccggccagc

SEQ ID NO: 830292 - RNA, 20 nt, Mycobacterium avium subsp. paratuberculosis
gacgucgaugccggccagcg

SEQ ID NO: 830293 - RNA, 21 nt, Mycobacterium avium subsp. paratuberculosis
gacgucgaugccggccagcgg

SEQ ID NO: 830294 - RNA, 19 nt, Mycobacterium avium subsp. paratuberculosis
gacgucgaugugcucgggg

SEQ ID NO: 830295 - RNA, 19 nt, Mycobacterium avium subsp. paratuberculosis
gacgucgacgugggcggcc

SEQ ID NO: 830296 - RNA, 23 nt, Mycobacterium avium subsp. paratuberculosis
gacgucgacgugggcggccacca

SEQ ID NO: 830297 - RNA, 22 nt, Mycobacterium avium subsp. paratuberculosis
gacgucgacugaucgacgagcc

SEQ ID NO: 830298 - RNA, 20 nt, Mycobacterium avium subsp. paratuberculosis
gacgucgagaaaggccagca

SEQ ID NO: 830299 - RNA, 23 nt, Mycobacterium avium subsp. paratuberculosis
gacgucgagaaaggccagcacgc

SEQ ID NO: 830300 - RNA, 23 nt, Mycobacterium avium subsp. paratuberculosis
gacgucgagccagcgggccgagc

SEQ ID NO: 830301 - RNA, 24 nt, Mycobacterium avium subsp. paratuberculosis
gacgucgagccagcgggccgagcg

SEQ ID NO: 830302 - RNA, 16 nt, Mycobacterium avium subsp. paratuberculosis
gacgucgagcggcgcc

SEQ ID NO: 830303 - RNA, 13 nt, Mycobacterium avium subsp. paratuberculosis
gacguccgggccg

SEQ ID NO: 830304 - RNA, 15 nt, Mycobacterium avium subsp. paratuberculosis
gacguccgggccgcc

SEQ ID NO: 830305 - RNA, 16 nt, Mycobacterium avium subsp. paratuberculosis
gacguccgggccgccu

SEQ ID NO: 830306 - RNA, 17 nt, Mycobacterium avium subsp. paratuberculosis
gacguccgcgucggcgc

SEQ ID NO: 830307 - RNA, 19 nt, Mycobacterium avium subsp. paratuberculosis
gacguccgcgucggcgccg

SEQ ID NO: 830308 - RNA, 15 nt, Mycobacterium avium subsp. paratuberculosis
gacguccucgacgau

SEQ ID NO: 830309 - RNA, 17 nt, Mycobacterium avium subsp. paratuberculosis
gacguccucgaugccga

SEQ ID NO: 830310 - RNA, 20 nt, Mycobacterium avium subsp. paratuberculosis
gacguccuggaucgcgcagg

SEQ ID NO: 830311 - RNA, 13 nt, Mycobacterium avium subsp. paratuberculosis
gacgucgaccgcg

SEQ ID NO: 830312 - RNA, 14 nt, Mycobacterium avium subsp. paratuberculosis
gacgucgaccgcga

SEQ ID NO: 830313 - RNA, 15 nt, Mycobacterium avium subsp. paratuberculosis
gacgucgaccgcgac

SEQ ID NO: 830314 - RNA, 16 nt, Mycobacterium avium subsp. paratuberculosis
gacgucgaccgcgacg

SEQ ID NO: 830315 - RNA, 20 nt, Mycobacterium avium subsp. paratuberculosis
gacgucgaccgcgacgaccu

SEQ ID NO: 830316 - RNA, 15 nt, Mycobacterium avium subsp. paratuberculosis
gacgucgaccgcgcc

SEQ ID NO: 830317 - RNA, 19 nt, Mycobacterium avium subsp. paratuberculosis
gacguccuugacccggccg

SEQ ID NO: 830318 - RNA, 20 nt, Mycobacterium avium subsp. paratuberculosis
gacguccuugacccggccgc

SEQ ID NO: 830319 - RNA, 21 nt, Mycobacterium avium subsp. paratuberculosis
gacguccuugacccggccgca

SEQ ID NO: 830320 - RNA, 17 nt, Mycobacterium avium subsp. paratuberculosis
gacguccuugaucagca

SEQ ID NO: 830321 - RNA, 19 nt, Mycobacterium avium subsp. paratuberculosis
gacgucgaccuugcagccc

SEQ ID NO: 830322 - RNA, 14 nt, Mycobacterium avium subsp. paratuberculosis
gacgucgacgaccc

SEQ ID NO: 830323 - RNA, 23 nt, Mycobacterium avium subsp. paratuberculosis
gacggugaacuucaccgucugcu

SEQ ID NO: 830324 - RNA, 15 nt, Mycobacterium avium subsp. paratuberculosis
gacggugaugucgcc

SEQ ID NO: 830325 - RNA, 14 nt, Mycobacterium avium subsp. paratuberculosis
gacggugacgccgg

SEQ ID NO: 830326 - RNA, 20 nt, Mycobacterium avium subsp. paratuberculosis
gacggucgugcugggccggg

SEQ ID NO: 830327 - RNA, 21 nt, Mycobacterium avium subsp. paratuberculosis
gacggucgugcugggccgggc

SEQ ID NO: 830328 - RNA, 13 nt, Mycobacterium avium subsp. paratuberculosis
gacggucugccgg

SEQ ID NO: 830329 - RNA, 16 nt, Mycobacterium avium subsp. paratuberculosis
gacggucugccgggac

SEQ ID NO: 830330 - RNA, 19 nt, Mycobacterium avium subsp. paratuberculosis
gacggucugggaggcggcg

SEQ ID NO: 830331 - RNA, 17 nt, Mycobacterium avium subsp. paratuberculosis
gacggucuucccgccgc

SEQ ID NO: 830332 - RNA, 17 nt, Mycobacterium avium subsp. paratuberculosis
gacggugaccggcgcgc

SEQ ID NO: 830333 - RNA, 17 nt, Mycobacterium avium subsp. paratuberculosis
gacggugaccggcucga

SEQ ID NO: 830334 - RNA, 14 nt, Mycobacterium avium subsp. paratuberculosis
gacggugcgcccgu

SEQ ID NO: 830335 - RNA, 14 nt, Mycobacterium avium subsp. paratuberculosis
gacggugccgccgu

SEQ ID NO: 830336 - RNA, 17 nt, Mycobacterium avium subsp. paratuberculosis
gacggugcgugccagca

SEQ ID NO: 830337 - RNA, 20 nt, Mycobacterium avium subsp. paratuberculosis
gacggugcgugccagcagcu

SEQ ID NO: 830338 - RNA, 14 nt, Mycobacterium avium subsp. paratuberculosis
gacggugcuggcga

SEQ ID NO: 830339 - RNA, 19 nt, Mycobacterium avium subsp. paratuberculosis
gacggugcuggcgauguga

SEQ ID NO: 830340 - RNA, 22 nt, Mycobacterium avium subsp. paratuberculosis
gacguagcaccagucggccauc

SEQ ID NO: 830341 - RNA, 23 nt, Mycobacterium avium subsp. paratuberculosis
gacguagcaccagucggccauca

SEQ ID NO: 830342 - RNA, 14 nt, Mycobacterium avium subsp. paratuberculosis
gacguagcccgccg

SEQ ID NO: 830343 - RNA, 13 nt, Mycobacterium avium subsp. paratuberculosis
gacguaggccaga

SEQ ID NO: 830344 - RNA, 14 nt, Mycobacterium avium subsp. paratuberculosis
gacguaggcggcca

SEQ ID NO: 830345 - RNA, 17 nt, Mycobacterium avium subsp. paratuberculosis
gacguaggcggccagca

SEQ ID NO: 830346 - RNA, 17 nt, Mycobacterium avium subsp. paratuberculosis
gacgguggagcggccca

SEQ ID NO: 830347 - RNA, 22 nt, Mycobacterium avium subsp. paratuberculosis
gacguaggugagcaacgccagc

SEQ ID NO: 830348 - RNA, 18 nt, Mycobacterium avium subsp. paratuberculosis
gacguaguccggccaguc

SEQ ID NO: 830349 - RNA, 16 nt, Mycobacterium avium subsp. paratuberculosis
gacgggccaccagcgc

SEQ ID NO: 830350 - RNA, 14 nt, Mycobacterium avium subsp. paratuberculosis
gacgggcacccgcg

SEQ ID NO: 830351 - RNA, 16 nt, Mycobacterium avium subsp. paratuberculosis
gacgggcacccgcgcg

SEQ ID NO: 830352 - RNA, 23 nt, Mycobacterium avium subsp. paratuberculosis
gacgggcacccgcgcgucgcgca

SEQ ID NO: 830353 - RNA, 15 nt, Mycobacterium avium subsp. paratuberculosis
gacgggcccagcgcg

SEQ ID NO: 830354 - RNA, 17 nt, Mycobacterium avium subsp. paratuberculosis
gacgggccgcauccgcg

SEQ ID NO: 830355 - RNA, 18 nt, Mycobacterium avium subsp. paratuberculosis
gacgggccgcauccgcga

SEQ ID NO: 830356 - RNA, 22 nt, Mycobacterium avium subsp. paratuberculosis
gacgggccgcauccgcgagccg

SEQ ID NO: 830357 - RNA, 20 nt, Mycobacterium avium subsp. paratuberculosis
gacgggccuagugccggggg

SEQ ID NO: 830358 - RNA, 14 nt, Mycobacterium avium subsp. paratuberculosis
gacgggaccgcacg

SEQ ID NO: 830359 - RNA, 20 nt, Mycobacterium avium subsp. paratuberculosis
gacgggaucggcgcgucggc

SEQ ID NO: 830360 - RNA, 13 nt, Mycobacterium avium subsp. paratuberculosis
gacgggcaccagu

SEQ ID NO: 830361 - RNA, 17 nt, Mycobacterium avium subsp. paratuberculosis
gacgggcgugccggcgg

SEQ ID NO: 830362 - RNA, 18 nt, Mycobacterium avium subsp. paratuberculosis
gacgggcgugccggcggc

SEQ ID NO: 830363 - RNA, 20 nt, Mycobacterium avium subsp. paratuberculosis
gacgggcgugccggcggcgg

SEQ ID NO: 830364 - RNA, 21 nt, Mycobacterium avium subsp. paratuberculosis
gacgggcguguagccugcggc

SEQ ID NO: 830365 - RNA, 12 nt, Mycobacterium avium subsp. paratuberculosis
gacgggcgaucu

SEQ ID NO: 830366 - RNA, 14 nt, Mycobacterium avium subsp. paratuberculosis
gacgggcucggcgu

SEQ ID NO: 830367 - RNA, 16 nt, Mycobacterium avium subsp. paratuberculosis
gacgggcugauccgcg

SEQ ID NO: 830368 - RNA, 20 nt, Mycobacterium avium subsp. paratuberculosis
gacgggcugcugcacgucgc

SEQ ID NO: 830369 - RNA, 13 nt, Mycobacterium avium subsp. paratuberculosis
gacggggcgaugc

SEQ ID NO: 830370 - RNA, 14 nt, Mycobacterium avium subsp. paratuberculosis
gacggggcgaugcc

SEQ ID NO: 830371 - RNA, 18 nt, Mycobacterium avium subsp. paratuberculosis
gacggggcgaugccgaca

SEQ ID NO: 830372 - RNA, 18 nt, Mycobacterium avium subsp. paratuberculosis
gacgggcugucccggccg

SEQ ID NO: 830373 - RNA, 19 nt, Mycobacterium avium subsp. paratuberculosis
gacgcgugcgucaucgcgc

SEQ ID NO: 830374 - RNA, 12 nt, Mycobacterium avium subsp. paratuberculosis
gacgcgucgaca

SEQ ID NO: 830375 - RNA, 15 nt, Mycobacterium avium subsp. paratuberculosis
gacgcggcucgcgcg

SEQ ID NO: 830376 - RNA, 16 nt, Mycobacterium avium subsp. paratuberculosis
gacgcggcucgcgcgg

SEQ ID NO: 830377 - RNA, 17 nt, Mycobacterium avium subsp. paratuberculosis
gacgcggcucgcgcggu

SEQ ID NO: 830378 - RNA, 22 nt, Mycobacterium avium subsp. paratuberculosis
gacgcguccguagugcucggcg

SEQ ID NO: 830379 - RNA, 13 nt, Mycobacterium avium subsp. paratuberculosis
gacgcggcggccg

SEQ ID NO: 830380 - RNA, 16 nt, Mycobacterium avium subsp. paratuberculosis
gacgcggcggccgaca

SEQ ID NO: 830381 - RNA, 13 nt, Mycobacterium avium subsp. paratuberculosis
gacgcggccagcg

SEQ ID NO: 830382 - RNA, 14 nt, Mycobacterium avium subsp. paratuberculosis
gacgcggccagcgc

SEQ ID NO: 830383 - RNA, 17 nt, Mycobacterium avium subsp. paratuberculosis
gacgcggcgaccaccac

SEQ ID NO: 830384 - RNA, 20 nt, Mycobacterium avium subsp. paratuberculosis
gacgcggcgaccaccaccgc

SEQ ID NO: 830385 - RNA, 13 nt, Mycobacterium avium subsp. paratuberculosis
gacggcagcaccu

SEQ ID NO: 830386 - RNA, 15 nt, Mycobacterium avium subsp. paratuberculosis
gacggcagcaccucg

SEQ ID NO: 830387 - RNA, 19 nt, Mycobacterium avium subsp. paratuberculosis
gacggcagcaccucgcgca

SEQ ID NO: 830388 - RNA, 15 nt, Mycobacterium avium subsp. paratuberculosis
gacggcagcaccgcc

SEQ ID NO: 830389 - RNA, 17 nt, Mycobacterium avium subsp. paratuberculosis
gacgcguuguugcucgg

SEQ ID NO: 830390 - RNA, 20 nt, Mycobacterium avium subsp. paratuberculosis
gacgcguuguugcucggcgg

SEQ ID NO: 830391 - RNA, 21 nt, Mycobacterium avium subsp. paratuberculosis
gacgcguuguugcucggcggc

SEQ ID NO: 830392 - RNA, 17 nt, Mycobacterium avium subsp. paratuberculosis
gacgcucacccggccca

SEQ ID NO: 830393 - RNA, 18 nt, Mycobacterium avium subsp. paratuberculosis
gacgcucacccggcccac

SEQ ID NO: 830394 - RNA, 20 nt, Mycobacterium avium subsp. paratuberculosis
gacgcucacccggcccaccg

SEQ ID NO: 830395 - RNA, 22 nt, Mycobacterium avium subsp. paratuberculosis
gacgcucacccggcccaccggc

SEQ ID NO: 830396 - RNA, 13 nt, Mycobacterium avium subsp. paratuberculosis
gacgcucaggcgu

SEQ ID NO: 830397 - RNA, 18 nt, Mycobacterium avium subsp. paratuberculosis
gacgcucaggcguccagc

SEQ ID NO: 830398 - RNA, 21 nt, Mycobacterium avium subsp. paratuberculosis
gacgcucaggcguccagccag

SEQ ID NO: 830399 - RNA, 15 nt, Mycobacterium avium subsp. paratuberculosis
gacggccagcgcggc

SEQ ID NO: 830400 - RNA, 20 nt, Mycobacterium avium subsp. paratuberculosis
gacggccagcagcaccgcgu

SEQ ID NO: 830401 - RNA, 22 nt, Mycobacterium avium subsp. paratuberculosis
gacggccagcagggcgccgacg

SEQ ID NO: 830402 - RNA, 20 nt, Mycobacterium avium subsp. paratuberculosis
gacggcccacgucgcgccga

SEQ ID NO: 830403 - RNA, 21 nt, Mycobacterium avium subsp. paratuberculosis
gacggcccacgucgcgccgau

SEQ ID NO: 830404 - RNA, 16 nt, Mycobacterium avium subsp. paratuberculosis
gacggccccccgggca

SEQ ID NO: 830405 - RNA, 13 nt, Mycobacterium avium subsp. paratuberculosis
gacggcccgacga

SEQ ID NO: 830406 - RNA, 16 nt, Mycobacterium avium subsp. paratuberculosis
gacggcccgacgacgc

SEQ ID NO: 830407 - RNA, 17 nt, Mycobacterium avium subsp. paratuberculosis
gacggccagaccgcaca

SEQ ID NO: 830408 - RNA, 17 nt, Mycobacterium avium subsp. paratuberculosis
gacggcauugcagcgga

SEQ ID NO: 830409 - RNA, 17 nt, Mycobacterium avium subsp. paratuberculosis
gacggcaugccgggcca

SEQ ID NO: 830410 - RNA, 23 nt, Mycobacterium avium subsp. paratuberculosis
gacggcaugccgggccagccggc

SEQ ID NO: 830411 - RNA, 21 nt, Mycobacterium avium subsp. paratuberculosis
gacggcagcgcgauccggggg

SEQ ID NO: 830412 - RNA, 16 nt, Mycobacterium avium subsp. paratuberculosis
gacggcagcggcacca

SEQ ID NO: 830413 - RNA, 21 nt, Mycobacterium avium subsp. paratuberculosis
gacggcagcggcaccaacccg

SEQ ID NO: 830414 - RNA, 14 nt, Mycobacterium avium subsp. paratuberculosis
gacggcaucggcgc

SEQ ID NO: 830415 - RNA, 17 nt, Mycobacterium avium subsp. paratuberculosis
gacggcaucggcgcccu

SEQ ID NO: 830416 - RNA, 22 nt, Mycobacterium avium subsp. paratuberculosis
gacggcaucggcgcccucgccg

SEQ ID NO: 830417 - RNA, 22 nt, Mycobacterium avium subsp. paratuberculosis
gacggcgcuggccgcggccagc

SEQ ID NO: 830418 - RNA, 23 nt, Mycobacterium avium subsp. paratuberculosis
gacggcgcuggccgcggccagcu

SEQ ID NO: 830419 - RNA, 19 nt, Mycobacterium avium subsp. paratuberculosis
gacggcgccugauccgcgg

SEQ ID NO: 830420 - RNA, 15 nt, Mycobacterium avium subsp. paratuberculosis
gacggcuuccgcgga

SEQ ID NO: 830421 - RNA, 17 nt, Mycobacterium avium subsp. paratuberculosis
gacgggagucgggcccg

SEQ ID NO: 830422 - RNA, 19 nt, Mycobacterium avium subsp. paratuberculosis
gacgggagucgggcccgcc

SEQ ID NO: 830423 - RNA, 19 nt, Mycobacterium avium subsp. paratuberculosis
gacgggaacucggccagcu

SEQ ID NO: 830424 - RNA, 22 nt, Mycobacterium avium subsp. paratuberculosis
gacgggaagaucgcagcgguga

SEQ ID NO: 830425 - RNA, 12 nt, Mycobacterium avium subsp. paratuberculosis
gacggcgccgcg

SEQ ID NO: 830426 - RNA, 16 nt, Mycobacterium avium subsp. paratuberculosis
gacggcgccgcggccg

SEQ ID NO: 830427 - RNA, 21 nt, Mycobacterium avium subsp. paratuberculosis
gacggcgccgcggccguugcu

SEQ ID NO: 830428 - RNA, 22 nt, Mycobacterium avium subsp. paratuberculosis
gacggcgcccgccccgacgugc

SEQ ID NO: 830429 - RNA, 21 nt, Mycobacterium avium subsp. paratuberculosis
gacggcgcgguggcgugcagc

SEQ ID NO: 830430 - RNA, 15 nt, Mycobacterium avium subsp. paratuberculosis
gacggcgcucaccgg

SEQ ID NO: 830431 - RNA, 16 nt, Mycobacterium avium subsp. paratuberculosis
gacggcgcucaccggc

SEQ ID NO: 830432 - RNA, 18 nt, Mycobacterium avium subsp. paratuberculosis
gacggcgcucaccggcgu

SEQ ID NO: 830433 - RNA, 20 nt, Mycobacterium avium subsp. paratuberculosis
gacggcgcucaccggcgugg

SEQ ID NO: 830434 - RNA, 14 nt, Mycobacterium avium subsp. paratuberculosis
gacggcgcgcccga

SEQ ID NO: 830435 - RNA, 15 nt, Mycobacterium avium subsp. paratuberculosis
gacggcgcgaacgca

SEQ ID NO: 830436 - RNA, 16 nt, Mycobacterium avium subsp. paratuberculosis
gacggccugcaccacc

SEQ ID NO: 830437 - RNA, 22 nt, Mycobacterium avium subsp. paratuberculosis
gacggccucgccgucgcgaucg

SEQ ID NO: 830438 - RNA, 15 nt, Mycobacterium avium subsp. paratuberculosis
gacggccggcccugc

SEQ ID NO: 830439 - RNA, 19 nt, Mycobacterium avium subsp. paratuberculosis
gacggccggcccugcacgc

SEQ ID NO: 830440 - RNA, 15 nt, Mycobacterium avium subsp. paratuberculosis
gacggccggcgucac

SEQ ID NO: 830441 - RNA, 20 nt, Mycobacterium avium subsp. paratuberculosis
gacggccgggcccucggacg

SEQ ID NO: 830442 - RNA, 14 nt, Mycobacterium avium subsp. paratuberculosis
gacggccggggcca

SEQ ID NO: 830443 - RNA, 17 nt, Mycobacterium avium subsp. paratuberculosis
gacggccggggccagca

SEQ ID NO: 830444 - RNA, 14 nt, Mycobacterium avium subsp. paratuberculosis
gacggccggugacu

SEQ ID NO: 830445 - RNA, 23 nt, Mycobacterium avium subsp. paratuberculosis
gacggccggugacuccuccucgg

SEQ ID NO: 830446 - RNA, 14 nt, Mycobacterium avium subsp. paratuberculosis
gacggccguacgcg

SEQ ID NO: 830447 - RNA, 17 nt, Mycobacterium avium subsp. paratuberculosis
gacggccguccggucgc

SEQ ID NO: 830448 - RNA, 13 nt, Mycobacterium avium subsp. paratuberculosis
gacggccgccgcg

SEQ ID NO: 830449 - RNA, 16 nt, Mycobacterium avium subsp. paratuberculosis
gacggccgcgccgaac

SEQ ID NO: 830450 - RNA, 23 nt, Mycobacterium avium subsp. paratuberculosis
gacggccgcgccgaacaccacgc

SEQ ID NO: 830451 - RNA, 18 nt, Mycobacterium avium subsp. paratuberculosis
gacggccgcggcgcggcc

SEQ ID NO: 830452 - RNA, 22 nt, Mycobacterium avium subsp. paratuberculosis
gacggccgcggcgcggcccggc

SEQ ID NO: 830453 - RNA, 15 nt, Mycobacterium avium subsp. paratuberculosis
gacggccgcggcggu

SEQ ID NO: 830454 - RNA, 19 nt, Mycobacterium avium subsp. paratuberculosis
gacggccgcaccccacccg

SEQ ID NO: 830455 - RNA, 21 nt, Mycobacterium avium subsp. paratuberculosis
gacggccgcaccccacccgcg

SEQ ID NO: 830456 - RNA, 18 nt, Mycobacterium avium subsp. paratuberculosis
gacggccccagacgaagu

SEQ ID NO: 830457 - RNA, 13 nt, Mycobacterium avium subsp. paratuberculosis
gacggcgaacggu

SEQ ID NO: 830458 - RNA, 15 nt, Mycobacterium avium subsp. paratuberculosis
gacggcgaacgucga

SEQ ID NO: 830459 - RNA, 20 nt, Mycobacterium avium subsp. paratuberculosis
gacggcgaacuuggccgaca

SEQ ID NO: 830460 - RNA, 15 nt, Mycobacterium avium subsp. paratuberculosis
gacggcgaagccggc

SEQ ID NO: 830461 - RNA, 16 nt, Mycobacterium avium subsp. paratuberculosis
gacggcgaagccggcg

SEQ ID NO: 830462 - RNA, 17 nt, Mycobacterium avium subsp. paratuberculosis
gacggcgaagccggcgu

SEQ ID NO: 830463 - RNA, 21 nt, Mycobacterium avium subsp. paratuberculosis
gacggcgacggcguccgggcg

SEQ ID NO: 830464 - RNA, 15 nt, Mycobacterium avium subsp. paratuberculosis
gacggcgagccgggc

SEQ ID NO: 830465 - RNA, 17 nt, Mycobacterium avium subsp. paratuberculosis
gacggcgagccgggccg

SEQ ID NO: 830466 - RNA, 19 nt, Mycobacterium avium subsp. paratuberculosis
gacggcgagccgggccggg

SEQ ID NO: 830467 - RNA, 16 nt, Mycobacterium avium subsp. paratuberculosis
gacggcgagcggcccu

SEQ ID NO: 830468 - RNA, 18 nt, Mycobacterium avium subsp. paratuberculosis
gacggcgagcggcccugc

SEQ ID NO: 830469 - RNA, 17 nt, Mycobacterium avium subsp. paratuberculosis
gacggcgaggaucgcga

SEQ ID NO: 830470 - RNA, 22 nt, Mycobacterium avium subsp. paratuberculosis
gacggcgaccacaccgucgacg

SEQ ID NO: 830471 - RNA, 20 nt, Mycobacterium avium subsp. paratuberculosis
gacggcgaccauccacucgg

SEQ ID NO: 830472 - RNA, 23 nt, Mycobacterium avium subsp. paratuberculosis
gacggcgaccucuaacgucucgg

SEQ ID NO: 830473 - RNA, 20 nt, Mycobacterium avium subsp. paratuberculosis
gacggcgacggcagcgcgau

SEQ ID NO: 830474 - RNA, 14 nt, Mycobacterium avium subsp. paratuberculosis
gacggcgacggcca

SEQ ID NO: 830475 - RNA, 12 nt, Mycobacterium avium subsp. paratuberculosis
gacgccagcacc

SEQ ID NO: 830476 - RNA, 20 nt, Mycobacterium avium subsp. paratuberculosis
gacgccagcaugaucaccgc

SEQ ID NO: 830477 - RNA, 21 nt, Mycobacterium avium subsp. paratuberculosis
gacgccagcaugaucaccgcc

SEQ ID NO: 830478 - RNA, 14 nt, Mycobacterium avium subsp. paratuberculosis
gacgccacggcgaa

SEQ ID NO: 830479 - RNA, 16 nt, Mycobacterium avium subsp. paratuberculosis
gacgccacggggcugc

SEQ ID NO: 830480 - RNA, 20 nt, Mycobacterium avium subsp. paratuberculosis
gacgccacggggcugcgggc

SEQ ID NO: 830481 - RNA, 13 nt, Mycobacterium avium subsp. paratuberculosis
gacgccaccgcga

SEQ ID NO: 830482 - RNA, 17 nt, Mycobacterium avium subsp. paratuberculosis
gacgccgcgcuggccgg

SEQ ID NO: 830483 - RNA, 17 nt, Mycobacterium avium subsp. paratuberculosis
gacgccgcggaagcccc

SEQ ID NO: 830484 - RNA, 13 nt, Mycobacterium avium subsp. paratuberculosis
gacgccgcgcagc

SEQ ID NO: 830485 - RNA, 18 nt, Mycobacterium avium subsp. paratuberculosis
gacgccgcgcagcggggc

SEQ ID NO: 830486 - RNA, 13 nt, Mycobacterium avium subsp. paratuberculosis
gacgccgcgccgc

SEQ ID NO: 830487 - RNA, 12 nt, Mycobacterium avium subsp. paratuberculosis
gacgccgccgug

SEQ ID NO: 830488 - RNA, 13 nt, Mycobacterium avium subsp. paratuberculosis
gacgccgccgagg

SEQ ID NO: 830489 - RNA, 19 nt, Mycobacterium avium subsp. paratuberculosis
gacgccgcccucucacggc

SEQ ID NO: 830490 - RNA, 21 nt, Mycobacterium avium subsp. paratuberculosis
gacgccgcccucucacggcgg

SEQ ID NO: 830491 - RNA, 17 nt, Mycobacterium avium subsp. paratuberculosis
gacgccggacagcuggc

SEQ ID NO: 830492 - RNA, 18 nt, Mycobacterium avium subsp. paratuberculosis
gacgccggacagcuggcg

SEQ ID NO: 830493 - RNA, 13 nt, Mycobacterium avium subsp. paratuberculosis
gacgccggacccc

SEQ ID NO: 830494 - RNA, 15 nt, Mycobacterium avium subsp. paratuberculosis
gacgccgcgguggcc

SEQ ID NO: 830495 - RNA, 16 nt, Mycobacterium avium subsp. paratuberculosis
gacgccgcgguggccg

SEQ ID NO: 830496 - RNA, 20 nt, Mycobacterium avium subsp. paratuberculosis
gacgccgcucggccagcgca

SEQ ID NO: 830497 - RNA, 14 nt, Mycobacterium avium subsp. paratuberculosis
gacgccgcugccgg

SEQ ID NO: 830498 - RNA, 19 nt, Mycobacterium avium subsp. paratuberculosis
gacgccgcugccggggugc

SEQ ID NO: 830499 - RNA, 16 nt, Mycobacterium avium subsp. paratuberculosis
gacgccgcugcgugcc

SEQ ID NO: 830500 - RNA, 17 nt, Mycobacterium avium subsp. paratuberculosis
gacgccgcugcgugccc

SEQ ID NO: 830501 - RNA, 16 nt, Mycobacterium avium subsp. paratuberculosis
gacgccgugcugccgg

SEQ ID NO: 830502 - RNA, 19 nt, Mycobacterium avium subsp. paratuberculosis
gacgccgugguccagccgg

SEQ ID NO: 830503 - RNA, 23 nt, Mycobacterium avium subsp. paratuberculosis
gacgccgugguccagccggucgc

SEQ ID NO: 830504 - RNA, 16 nt, Mycobacterium avium subsp. paratuberculosis
gacgccguccgacgug

SEQ ID NO: 830505 - RNA, 16 nt, Mycobacterium avium subsp. paratuberculosis
gacgcgaagucgccgc

SEQ ID NO: 830506 - RNA, 17 nt, Mycobacterium avium subsp. paratuberculosis
gacgcgaagucgccgcc

SEQ ID NO: 830507 - RNA, 19 nt, Mycobacterium avium subsp. paratuberculosis
gacgcgaagucgccgcccg

SEQ ID NO: 830508 - RNA, 15 nt, Mycobacterium avium subsp. paratuberculosis
gacgcgaaagcaccc

SEQ ID NO: 830509 - RNA, 17 nt, Mycobacterium avium subsp. paratuberculosis
gacgcgaaagcacccga

SEQ ID NO: 830510 - RNA, 19 nt, Mycobacterium avium subsp. paratuberculosis
gacgccguugcggugcucg

SEQ ID NO: 830511 - RNA, 22 nt, Mycobacterium avium subsp. paratuberculosis
gacgccguucagguaggucaac

SEQ ID NO: 830512 - RNA, 21 nt, Mycobacterium avium subsp. paratuberculosis
gacgccguugacaccgggugc

SEQ ID NO: 830513 - RNA, 20 nt, Mycobacterium avium subsp. paratuberculosis
gacgccgucgagccugguga

SEQ ID NO: 830514 - RNA, 15 nt, Mycobacterium avium subsp. paratuberculosis
gacgccucaggcgag

SEQ ID NO: 830515 - RNA, 14 nt, Mycobacterium avium subsp. paratuberculosis
gacgccucccccac

SEQ ID NO: 830516 - RNA, 15 nt, Mycobacterium avium subsp. paratuberculosis
gacgccucccccacc

SEQ ID NO: 830517 - RNA, 17 nt, Mycobacterium avium subsp. paratuberculosis
gacgccucccccacccg

SEQ ID NO: 830518 - RNA, 18 nt, Mycobacterium avium subsp. paratuberculosis
gacgccucccccacccgc

SEQ ID NO: 830519 - RNA, 23 nt, Mycobacterium avium subsp. paratuberculosis
gacgccucccccacccgcacggu

SEQ ID NO: 830520 - RNA, 14 nt, Mycobacterium avium subsp. paratuberculosis
gacgccucgcgcag

SEQ ID NO: 830521 - RNA, 16 nt, Mycobacterium avium subsp. paratuberculosis
gacgccucgcgcagcg

SEQ ID NO: 830522 - RNA, 19 nt, Mycobacterium avium subsp. paratuberculosis
gacgccucgcgcagcgcgu

SEQ ID NO: 830523 - RNA, 16 nt, Mycobacterium avium subsp. paratuberculosis
gacgcgauggcgcugg

SEQ ID NO: 830524 - RNA, 22 nt, Mycobacterium avium subsp. paratuberculosis
gacgcgauggcgcuggccgcga

SEQ ID NO: 830525 - RNA, 15 nt, Mycobacterium avium subsp. paratuberculosis
gacgcgcgcggcguc

SEQ ID NO: 830526 - RNA, 13 nt, Mycobacterium avium subsp. paratuberculosis
gacgcgcccggcg

SEQ ID NO: 830527 - RNA, 15 nt, Mycobacterium avium subsp. paratuberculosis
gacgcgcccggcgac

SEQ ID NO: 830528 - RNA, 20 nt, Mycobacterium avium subsp. paratuberculosis
gacgcgccgcacugcacggc

SEQ ID NO: 830529 - RNA, 22 nt, Mycobacterium avium subsp. paratuberculosis
gacgcgccgcacugcacggccu

SEQ ID NO: 830530 - RNA, 15 nt, Mycobacterium avium subsp. paratuberculosis
gacgcgacgcgcucg

SEQ ID NO: 830531 - RNA, 21 nt, Mycobacterium avium subsp. paratuberculosis
gacgcgacgcgcucggcgacc

SEQ ID NO: 830532 - RNA, 23 nt, Mycobacterium avium subsp. paratuberculosis
gacgcgacgcgcucggcgaccgc

SEQ ID NO: 830533 - RNA, 14 nt, Mycobacterium avium subsp. paratuberculosis
gacgcgaccgcgcg

SEQ ID NO: 830534 - RNA, 15 nt, Mycobacterium avium subsp. paratuberculosis
gacgcgaccgcgcgg

SEQ ID NO: 830535 - RNA, 13 nt, Mycobacterium avium subsp. paratuberculosis
gacgcgaccggcc

SEQ ID NO: 830536 - RNA, 16 nt, Mycobacterium avium subsp. paratuberculosis
gacgcgaccggcccga

SEQ ID NO: 830537 - RNA, 17 nt, Mycobacterium avium subsp. paratuberculosis
gacgcgaaugucgacca

SEQ ID NO: 830538 - RNA, 13 nt, Mycobacterium avium subsp. paratuberculosis
gacgcgaccaggc

SEQ ID NO: 830539 - RNA, 14 nt, Mycobacterium avium subsp. paratuberculosis
gacgcgaccaggcc

SEQ ID NO: 830540 - RNA, 21 nt, Mycobacterium avium subsp. paratuberculosis
gacgcgcucagccccagcgga

SEQ ID NO: 830541 - RNA, 20 nt, Mycobacterium avium subsp. paratuberculosis
gacgcgcuuguacaggucga

SEQ ID NO: 830542 - RNA, 13 nt, Mycobacterium avium subsp. paratuberculosis
gacgcgcucggcg

SEQ ID NO: 830543 - RNA, 16 nt, Mycobacterium avium subsp. paratuberculosis
gacgcggccucaccgc

SEQ ID NO: 830544 - RNA, 13 nt, Mycobacterium avium subsp. paratuberculosis
gacgcggcgcgac

SEQ ID NO: 830545 - RNA, 14 nt, Mycobacterium avium subsp. paratuberculosis
gacgcggcgcgaca

SEQ ID NO: 830546 - RNA, 19 nt, Mycobacterium avium subsp. paratuberculosis
gacgcggcgcgacaccgcg

SEQ ID NO: 830547 - RNA, 20 nt, Mycobacterium avium subsp. paratuberculosis
gacgcggcgcgacaccgcgg

SEQ ID NO: 830548 - RNA, 15 nt, Mycobacterium avium subsp. paratuberculosis
gacgcggcgcgcgau

SEQ ID NO: 830549 - RNA, 23 nt, Mycobacterium avium subsp. paratuberculosis
gacgcggcgcgcgauggacagca

SEQ ID NO: 830550 - RNA, 14 nt, Mycobacterium avium subsp. paratuberculosis
gacgcggcggacga

SEQ ID NO: 830551 - RNA, 22 nt, Mycobacterium avium subsp. paratuberculosis
gacgcggcggacgauguccgcc

SEQ ID NO: 830552 - RNA, 20 nt, Mycobacterium avium subsp. paratuberculosis
gacgauugucggggccgcac

SEQ ID NO: 830553 - RNA, 20 nt, Mycobacterium avium subsp. paratuberculosis
gacgcaaaagccccgcgaca

SEQ ID NO: 830554 - RNA, 17 nt, Mycobacterium avium subsp. paratuberculosis
gacgcauguccgccguc

SEQ ID NO: 830555 - RNA, 17 nt, Mycobacterium avium subsp. paratuberculosis
gacgcacgaaaccgcgu

SEQ ID NO: 830556 - RNA, 15 nt, Mycobacterium avium subsp. paratuberculosis
gacgcaccucggccg

SEQ ID NO: 830557 - RNA, 17 nt, Mycobacterium avium subsp. paratuberculosis
gacgcaccucggccggg

SEQ ID NO: 830558 - RNA, 13 nt, Mycobacterium avium subsp. paratuberculosis
gacgaugucgacc

SEQ ID NO: 830559 - RNA, 22 nt, Mycobacterium avium subsp. paratuberculosis
gacgaugucgaugacggcggcg

SEQ ID NO: 830560 - RNA, 23 nt, Mycobacterium avium subsp. paratuberculosis
gacgaugucgaugacggcggcgc

SEQ ID NO: 830561 - RNA, 23 nt, Mycobacterium avium subsp. paratuberculosis
gacgaugggccgcccgcuggggc

SEQ ID NO: 830562 - RNA, 12 nt, Mycobacterium avium subsp. paratuberculosis
gacgauggcgac

SEQ ID NO: 830563 - RNA, 21 nt, Mycobacterium avium subsp. paratuberculosis
gacgauggcccggaccgccgc

SEQ ID NO: 830564 - RNA, 22 nt, Mycobacterium avium subsp. paratuberculosis
gacgauggcccggaccgccgcg

SEQ ID NO: 830565 - RNA, 17 nt, Mycobacterium avium subsp. paratuberculosis
gacgauggcccgggcca

SEQ ID NO: 830566 - RNA, 19 nt, Mycobacterium avium subsp. paratuberculosis
gacgauggcccgggccaca

SEQ ID NO: 830567 - RNA, 21 nt, Mycobacterium avium subsp. paratuberculosis
gacgaugaacagucggccggc

SEQ ID NO: 830568 - RNA, 22 nt, Mycobacterium avium subsp. paratuberculosis
gacgaugaacagucggccggcg

SEQ ID NO: 830569 - RNA, 13 nt, Mycobacterium avium subsp. paratuberculosis
gacgaugacgcgg

SEQ ID NO: 830570 - RNA, 19 nt, Mycobacterium avium subsp. paratuberculosis
gacgaugagggccagcagu

SEQ ID NO: 830571 - RNA, 22 nt, Mycobacterium avium subsp. paratuberculosis
gacgaugaugucgcccggcggc

SEQ ID NO: 830572 - RNA, 14 nt, Mycobacterium avium subsp. paratuberculosis
gacgaugccggccg

SEQ ID NO: 830573 - RNA, 15 nt, Mycobacterium avium subsp. paratuberculosis
gacgaugcggccggc

SEQ ID NO: 830574 - RNA, 16 nt, Mycobacterium avium subsp. paratuberculosis
gacgaugcggccggcg

SEQ ID NO: 830575 - RNA, 18 nt, Mycobacterium avium subsp. paratuberculosis
gacgaugcggccggcggg

SEQ ID NO: 830576 - RNA, 20 nt, Mycobacterium avium subsp. paratuberculosis
gacgaugcggggccggcggc

SEQ ID NO: 830577 - RNA, 17 nt, Mycobacterium avium subsp. paratuberculosis
gacgaugcggggcggcg

SEQ ID NO: 830578 - RNA, 19 nt, Mycobacterium avium subsp. paratuberculosis
gacgaugcggggcggcggg

SEQ ID NO: 830579 - RNA, 21 nt, Mycobacterium avium subsp. paratuberculosis
gacgaggugaugccguccagc

SEQ ID NO: 830580 - RNA, 13 nt, Mycobacterium avium subsp. paratuberculosis
gacgaggagaccu

SEQ ID NO: 830581 - RNA, 15 nt, Mycobacterium avium subsp. paratuberculosis
gacgaggcgggcgau

SEQ ID NO: 830582 - RNA, 18 nt, Mycobacterium avium subsp. paratuberculosis
gacgaggcgggcgaucuc

SEQ ID NO: 830583 - RNA, 21 nt, Mycobacterium avium subsp. paratuberculosis
gacgagucccaugggcugcaa

SEQ ID NO: 830584 - RNA, 14 nt, Mycobacterium avium subsp. paratuberculosis
gacgagucgacgcu

SEQ ID NO: 830585 - RNA, 21 nt, Mycobacterium avium subsp. paratuberculosis
gacgagucgacgcugugcgcc

SEQ ID NO: 830586 - RNA, 14 nt, Mycobacterium avium subsp. paratuberculosis
gacgaggggcagca

SEQ ID NO: 830587 - RNA, 17 nt, Mycobacterium avium subsp. paratuberculosis
gacgaggggcagcagcg

SEQ ID NO: 830588 - RNA, 20 nt, Mycobacterium avium subsp. paratuberculosis
gacgaggggcagcagcgccc

SEQ ID NO: 830589 - RNA, 16 nt, Mycobacterium avium subsp. paratuberculosis
gacgauaucggccgcg

SEQ ID NO: 830590 - RNA, 16 nt, Mycobacterium avium subsp. paratuberculosis
gacgaguggucggccg

SEQ ID NO: 830591 - RNA, 17 nt, Mycobacterium avium subsp. paratuberculosis
gacgaguggucggccgc

SEQ ID NO: 830592 - RNA, 22 nt, Mycobacterium avium subsp. paratuberculosis
gacgaguggucggccgcccacg

SEQ ID NO: 830593 - RNA, 16 nt, Mycobacterium avium subsp. paratuberculosis
gacgaguuccaccucg

SEQ ID NO: 830594 - RNA, 12 nt, Mycobacterium avium subsp. paratuberculosis
gacgaucaccgc

SEQ ID NO: 830595 - RNA, 15 nt, Mycobacterium avium subsp. paratuberculosis
gacgaucaccggcuu

SEQ ID NO: 830596 - RNA, 15 nt, Mycobacterium avium subsp. paratuberculosis
gacgaucacgacgcg

SEQ ID NO: 830597 - RNA, 16 nt, Mycobacterium avium subsp. paratuberculosis
gacgaucacgacgcga

SEQ ID NO: 830598 - RNA, 13 nt, Mycobacterium avium subsp. paratuberculosis
gacgaucagcagc

SEQ ID NO: 830599 - RNA, 22 nt, Mycobacterium avium subsp. paratuberculosis
gacgaucagcagccgggccugc

SEQ ID NO: 830600 - RNA, 16 nt, Mycobacterium avium subsp. paratuberculosis
gacgaucuguaguugc

SEQ ID NO: 830601 - RNA, 20 nt, Mycobacterium avium subsp. paratuberculosis
gacgaucucgugggucagcu

SEQ ID NO: 830602 - RNA, 15 nt, Mycobacterium avium subsp. paratuberculosis
gacgaucugcacacg

SEQ ID NO: 830603 - RNA, 14 nt, Mycobacterium avium subsp. paratuberculosis
gacgaucucgccgu

SEQ ID NO: 830604 - RNA, 16 nt, Mycobacterium avium subsp. paratuberculosis
gacgaucucgccgucc

SEQ ID NO: 830605 - RNA, 14 nt, Mycobacterium avium subsp. paratuberculosis
gacgaucggcucga

SEQ ID NO: 830606 - RNA, 13 nt, Mycobacterium avium subsp. paratuberculosis
gacgaucgucgac

SEQ ID NO: 830607 - RNA, 15 nt, Mycobacterium avium subsp. paratuberculosis
gacgaucgucgacgu

SEQ ID NO: 830608 - RNA, 15 nt, Mycobacterium avium subsp. paratuberculosis
gacgauccacagcgc

SEQ ID NO: 830609 - RNA, 16 nt, Mycobacterium avium subsp. paratuberculosis
gacgauccacagcgcg

SEQ ID NO: 830610 - RNA, 18 nt, Mycobacterium avium subsp. paratuberculosis
gacgauccgggccggucg

SEQ ID NO: 830611 - RNA, 20 nt, Mycobacterium avium subsp. paratuberculosis
gacgauccgggccggucggu

SEQ ID NO: 830612 - RNA, 14 nt, Mycobacterium avium subsp. paratuberculosis
gacgaucccggcga

SEQ ID NO: 830613 - RNA, 15 nt, Mycobacterium avium subsp. paratuberculosis
gacgauccgcgccgc

SEQ ID NO: 830614 - RNA, 16 nt, Mycobacterium avium subsp. paratuberculosis
gacgaucgcgccggcc

SEQ ID NO: 830615 - RNA, 18 nt, Mycobacterium avium subsp. paratuberculosis
gacgaucgcgccggccgc

SEQ ID NO: 830616 - RNA, 22 nt, Mycobacterium avium subsp. paratuberculosis
gacgaucgcgccggccgccgcg

SEQ ID NO: 830617 - RNA, 18 nt, Mycobacterium avium subsp. paratuberculosis
gaccucccccgacgccga

SEQ ID NO: 830618 - RNA, 20 nt, Mycobacterium avium subsp. paratuberculosis
gaccucccccgacgccgaca

SEQ ID NO: 830619 - RNA, 15 nt, Mycobacterium avium subsp. paratuberculosis
gaccucccggcgcca

SEQ ID NO: 830620 - RNA, 17 nt, Mycobacterium avium subsp. paratuberculosis
gaccuccaaugcgcccu

SEQ ID NO: 830621 - RNA, 18 nt, Mycobacterium avium subsp. paratuberculosis
gaccuccaaugcgcccug

SEQ ID NO: 830622 - RNA, 19 nt, Mycobacterium avium subsp. paratuberculosis
gaccuccuugcccagcgcg

SEQ ID NO: 830623 - RNA, 15 nt, Mycobacterium avium subsp. paratuberculosis
gaccuccugcaaggc

SEQ ID NO: 830624 - RNA, 20 nt, Mycobacterium avium subsp. paratuberculosis
gaccuccugcaaggcccccg

SEQ ID NO: 830625 - RNA, 14 nt, Mycobacterium avium subsp. paratuberculosis
gaccucgaccagcc

SEQ ID NO: 830626 - RNA, 15 nt, Mycobacterium avium subsp. paratuberculosis
gaccucgaccagccg

SEQ ID NO: 830627 - RNA, 17 nt, Mycobacterium avium subsp. paratuberculosis
gaccucgaccagccggu

SEQ ID NO: 830628 - RNA, 16 nt, Mycobacterium avium subsp. paratuberculosis
gaccucgagcaccggc

SEQ ID NO: 830629 - RNA, 16 nt, Mycobacterium avium subsp. paratuberculosis
gaccucgagcagcgcg

SEQ ID NO: 830630 - RNA, 18 nt, Mycobacterium avium subsp. paratuberculosis
gaccucgagcagcgcgcg

SEQ ID NO: 830631 - RNA, 19 nt, Mycobacterium avium subsp. paratuberculosis
gaccucgagcgucacgcug

SEQ ID NO: 830632 - RNA, 17 nt, Mycobacterium avium subsp. paratuberculosis
gaccugcggaucgcggg

SEQ ID NO: 830633 - RNA, 17 nt, Mycobacterium avium subsp. paratuberculosis
gaccugcggcucgucgg

SEQ ID NO: 830634 - RNA, 15 nt, Mycobacterium avium subsp. paratuberculosis
gaccugcgcgacggc

SEQ ID NO: 830635 - RNA, 18 nt, Mycobacterium avium subsp. paratuberculosis
gaccugccggcgaucacc

SEQ ID NO: 830636 - RNA, 16 nt, Mycobacterium avium subsp. paratuberculosis
gaccugcaucucgacc

SEQ ID NO: 830637 - RNA, 14 nt, Mycobacterium avium subsp. paratuberculosis
gaccugcagcgccu

SEQ ID NO: 830638 - RNA, 14 nt, Mycobacterium avium subsp. paratuberculosis
gaccucggccacca

SEQ ID NO: 830639 - RNA, 19 nt, Mycobacterium avium subsp. paratuberculosis
gaccucgcgcgucacgcug

SEQ ID NO: 830640 - RNA, 15 nt, Mycobacterium avium subsp. paratuberculosis
gaccucgccgacggu

SEQ ID NO: 830641 - RNA, 14 nt, Mycobacterium avium subsp. paratuberculosis
gaccucgccgacgu

SEQ ID NO: 830642 - RNA, 16 nt, Mycobacterium avium subsp. paratuberculosis
gaccucgccgacgucc

SEQ ID NO: 830643 - RNA, 18 nt, Mycobacterium avium subsp. paratuberculosis
gaccucgccgcccucgcc

SEQ ID NO: 830644 - RNA, 20 nt, Mycobacterium avium subsp. paratuberculosis
gaccucgaugcgcagggcgg

SEQ ID NO: 830645 - RNA, 17 nt, Mycobacterium avium subsp. paratuberculosis
gaccucgauggcgacgc

SEQ ID NO: 830646 - RNA, 18 nt, Mycobacterium avium subsp. paratuberculosis
gaccucgauggcgacgca

SEQ ID NO: 830647 - RNA, 14 nt, Mycobacterium avium subsp. paratuberculosis
gaccucgcgcaccg

SEQ ID NO: 830648 - RNA, 14 nt, Mycobacterium avium subsp. paratuberculosis
gaccucgcgcagcc

SEQ ID NO: 830649 - RNA, 15 nt, Mycobacterium avium subsp. paratuberculosis
gaccucgcgcagccc

SEQ ID NO: 830650 - RNA, 18 nt, Mycobacterium avium subsp. paratuberculosis
gaccucgcgcccggcgcc

SEQ ID NO: 830651 - RNA, 22 nt, Mycobacterium avium subsp. paratuberculosis
gaccucgcgcccggcgccggcc

SEQ ID NO: 830652 - RNA, 15 nt, Mycobacterium avium subsp. paratuberculosis
gaccucgcgccgcga

SEQ ID NO: 830653 - RNA, 16 nt, Mycobacterium avium subsp. paratuberculosis
gaccucgcgccgcgau

SEQ ID NO: 830654 - RNA, 15 nt, Mycobacterium avium subsp. paratuberculosis
gaccgcuugacgccg

SEQ ID NO: 830655 - RNA, 17 nt, Mycobacterium avium subsp. paratuberculosis
gaccggaucggccagca

SEQ ID NO: 830656 - RNA, 17 nt, Mycobacterium avium subsp. paratuberculosis
gaccggcaccagcagcc

SEQ ID NO: 830657 - RNA, 22 nt, Mycobacterium avium subsp. paratuberculosis
gaccggaagccuguuggccaga

SEQ ID NO: 830658 - RNA, 17 nt, Mycobacterium avium subsp. paratuberculosis
gaccggaugaugccggu

SEQ ID NO: 830659 - RNA, 18 nt, Mycobacterium avium subsp. paratuberculosis
gaccgcguuggcgccgac

SEQ ID NO: 830660 - RNA, 16 nt, Mycobacterium avium subsp. paratuberculosis
gaccgcgugucggcac

SEQ ID NO: 830661 - RNA, 13 nt, Mycobacterium avium subsp. paratuberculosis
gaccgcgugugcc

SEQ ID NO: 830662 - RNA, 16 nt, Mycobacterium avium subsp. paratuberculosis
gaccgcgucggcgccg

SEQ ID NO: 830663 - RNA, 13 nt, Mycobacterium avium subsp. paratuberculosis
gaccggccagcag

SEQ ID NO: 830664 - RNA, 14 nt, Mycobacterium avium subsp. paratuberculosis
gaccgucgccgacc

SEQ ID NO: 830665 - RNA, 17 nt, Mycobacterium avium subsp. paratuberculosis
gaccgucgccgaccagc

SEQ ID NO: 830666 - RNA, 18 nt, Mycobacterium avium subsp. paratuberculosis
gaccgucgccgaccagcc

SEQ ID NO: 830667 - RNA, 19 nt, Mycobacterium avium subsp. paratuberculosis
gaccguccccguccgugca

SEQ ID NO: 830668 - RNA, 14 nt, Mycobacterium avium subsp. paratuberculosis
gaccgucgaccaac

SEQ ID NO: 830669 - RNA, 15 nt, Mycobacterium avium subsp. paratuberculosis
gaccgucgcgcagcc

SEQ ID NO: 830670 - RNA, 22 nt, Mycobacterium avium subsp. paratuberculosis
gaccgucgcgcagcccgaucgc

SEQ ID NO: 830671 - RNA, 19 nt, Mycobacterium avium subsp. paratuberculosis
gaccgucgggacggccagc

SEQ ID NO: 830672 - RNA, 20 nt, Mycobacterium avium subsp. paratuberculosis
gaccgucgggacggccagca

SEQ ID NO: 830673 - RNA, 21 nt, Mycobacterium avium subsp. paratuberculosis
gaccgucgggacggccagcag

SEQ ID NO: 830674 - RNA, 14 nt, Mycobacterium avium subsp. paratuberculosis
gaccgucggccaga

SEQ ID NO: 830675 - RNA, 18 nt, Mycobacterium avium subsp. paratuberculosis
gaccgucuucuucagccg

SEQ ID NO: 830676 - RNA, 22 nt, Mycobacterium avium subsp. paratuberculosis
gaccgucagcagggccucgccg

SEQ ID NO: 830677 - RNA, 17 nt, Mycobacterium avium subsp. paratuberculosis
gaccgucaucaucaccg

SEQ ID NO: 830678 - RNA, 20 nt, Mycobacterium avium subsp. paratuberculosis
gaccgucaucaucaccggga

SEQ ID NO: 830679 - RNA, 14 nt, Mycobacterium avium subsp. paratuberculosis
gaccggcagcaccg

SEQ ID NO: 830680 - RNA, 18 nt, Mycobacterium avium subsp. paratuberculosis
gaccggcagcaccggccg

SEQ ID NO: 830681 - RNA, 14 nt, Mycobacterium avium subsp. paratuberculosis
gaccggcagccgcg

SEQ ID NO: 830682 - RNA, 15 nt, Mycobacterium avium subsp. paratuberculosis
gaccggcagccgcgc

SEQ ID NO: 830683 - RNA, 21 nt, Mycobacterium avium subsp. paratuberculosis
gacgaacuccgagccggugga

SEQ ID NO: 830684 - RNA, 16 nt, Mycobacterium avium subsp. paratuberculosis
gacgaacgcggccgcc

SEQ ID NO: 830685 - RNA, 17 nt, Mycobacterium avium subsp. paratuberculosis
gacgaacgcggccgcca

SEQ ID NO: 830686 - RNA, 19 nt, Mycobacterium avium subsp. paratuberculosis
gacgaacgcggccgccagc

SEQ ID NO: 830687 - RNA, 22 nt, Mycobacterium avium subsp. paratuberculosis
gacgaacgcggccgccagcgca

SEQ ID NO: 830688 - RNA, 15 nt, Mycobacterium avium subsp. paratuberculosis
gacgaacgcggcgga

SEQ ID NO: 830689 - RNA, 17 nt, Mycobacterium avium subsp. paratuberculosis
gacgacaccgugugacg

SEQ ID NO: 830690 - RNA, 13 nt, Mycobacterium avium subsp. paratuberculosis
gacgaagaccggg

SEQ ID NO: 830691 - RNA, 17 nt, Mycobacterium avium subsp. paratuberculosis
gacgaagaccgggucgu

SEQ ID NO: 830692 - RNA, 15 nt, Mycobacterium avium subsp. paratuberculosis
gacgaagcagcucgc

SEQ ID NO: 830693 - RNA, 20 nt, Mycobacterium avium subsp. paratuberculosis
gacgaagcagcucgcguagc

SEQ ID NO: 830694 - RNA, 13 nt, Mycobacterium avium subsp. paratuberculosis
gacgaagccgccg

SEQ ID NO: 830695 - RNA, 23 nt, Mycobacterium avium subsp. paratuberculosis
gacgaagccgccgcccucgguga

SEQ ID NO: 830696 - RNA, 22 nt, Mycobacterium avium subsp. paratuberculosis
gacgaccagguccaccccgcca

SEQ ID NO: 830697 - RNA, 13 nt, Mycobacterium avium subsp. paratuberculosis
gacgaccaucagc

SEQ ID NO: 830698 - RNA, 16 nt, Mycobacterium avium subsp. paratuberculosis
gacgaccgcaccgacc

SEQ ID NO: 830699 - RNA, 17 nt, Mycobacterium avium subsp. paratuberculosis
gacgaccgcaccgacca

SEQ ID NO: 830700 - RNA, 23 nt, Mycobacterium avium subsp. paratuberculosis
gacgaccgcaccgaccagcggga

SEQ ID NO: 830701 - RNA, 14 nt, Mycobacterium avium subsp. paratuberculosis
gacgaccaccagga

SEQ ID NO: 830702 - RNA, 13 nt, Mycobacterium avium subsp. paratuberculosis
gacgacccgaucc

SEQ ID NO: 830703 - RNA, 13 nt, Mycobacterium avium subsp. paratuberculosis
gacgaccgcgacg

SEQ ID NO: 830704 - RNA, 18 nt, Mycobacterium avium subsp. paratuberculosis
gacgaccgcgacggcgcc

SEQ ID NO: 830705 - RNA, 21 nt, Mycobacterium avium subsp. paratuberculosis
gacgaccgcgacggcgcccgc

SEQ ID NO: 830706 - RNA, 12 nt, Mycobacterium avium subsp. paratuberculosis
gacgaccgcguc

SEQ ID NO: 830707 - RNA, 14 nt, Mycobacterium avium subsp. paratuberculosis
gacgaccggcagcc

SEQ ID NO: 830708 - RNA, 19 nt, Mycobacterium avium subsp. paratuberculosis
gacgaccggcagccgcgcc

SEQ ID NO: 830709 - RNA, 21 nt, Mycobacterium avium subsp. paratuberculosis
gacgaccggcagccgcgccca

SEQ ID NO: 830710 - RNA, 22 nt, Mycobacterium avium subsp. paratuberculosis
gacgaccggcagccgcgcccac

SEQ ID NO: 830711 - RNA, 23 nt, Mycobacterium avium subsp. paratuberculosis
gacgaccggcagccgcgcccacc

SEQ ID NO: 830712 - RNA, 21 nt, Mycobacterium avium subsp. paratuberculosis
gaccugugcgccccacggcgc

SEQ ID NO: 830713 - RNA, 18 nt, Mycobacterium avium subsp. paratuberculosis
gacgaacccgccgcggcc

SEQ ID NO: 830714 - RNA, 13 nt, Mycobacterium avium subsp. paratuberculosis
gacgaacgacgug

SEQ ID NO: 830715 - RNA, 14 nt, Mycobacterium avium subsp. paratuberculosis
gacgaacgacgugu

SEQ ID NO: 830716 - RNA, 23 nt, Mycobacterium avium subsp. paratuberculosis
gacgaacgacguguucaacgcgc

SEQ ID NO: 830717 - RNA, 14 nt, Mycobacterium avium subsp. paratuberculosis
gacgaacgccacca

SEQ ID NO: 830718 - RNA, 13 nt, Mycobacterium avium subsp. paratuberculosis
gacgaacgccggc

SEQ ID NO: 830719 - RNA, 17 nt, Mycobacterium avium subsp. paratuberculosis
gacgaacgccggcauca

SEQ ID NO: 830720 - RNA, 16 nt, Mycobacterium avium subsp. paratuberculosis
gacgaacgcgccgccc

SEQ ID NO: 830721 - RNA, 22 nt, Mycobacterium avium subsp. paratuberculosis
gaccuguuugaacaccucgaag

SEQ ID NO: 830722 - RNA, 24 nt, Mycobacterium avium subsp. paratuberculosis
gaccuguuugaacaccucgaagcc

SEQ ID NO: 830723 - RNA, 17 nt, Mycobacterium avium subsp. paratuberculosis
gaccuguuuggccagcc

SEQ ID NO: 830724 - RNA, 19 nt, Mycobacterium avium subsp. paratuberculosis
gaccuguuuggccagccag

SEQ ID NO: 830725 - RNA, 15 nt, Mycobacterium avium subsp. paratuberculosis
gaccugguugccgcc

SEQ ID NO: 830726 - RNA, 23 nt, Mycobacterium avium subsp. paratuberculosis
gaccugguugccgcccucggccg

SEQ ID NO: 830727 - RNA, 16 nt, Mycobacterium avium subsp. paratuberculosis
gaccuguccgaucacc

SEQ ID NO: 830728 - RNA, 18 nt, Mycobacterium avium subsp. paratuberculosis
gaccuggucgccgaacgu

SEQ ID NO: 830729 - RNA, 14 nt, Mycobacterium avium subsp. paratuberculosis
gaccuggugcucga

SEQ ID NO: 830730 - RNA, 20 nt, Mycobacterium avium subsp. paratuberculosis
gaccugcgggcccaccgcgc

SEQ ID NO: 830731 - RNA, 15 nt, Mycobacterium avium subsp. paratuberculosis
gaccugguccaccgc

SEQ ID NO: 830732 - RNA, 16 nt, Mycobacterium avium subsp. paratuberculosis
gaccugguccaccgcg

SEQ ID NO: 830733 - RNA, 17 nt, Mycobacterium avium subsp. paratuberculosis
gaccugguccaccgcgg

SEQ ID NO: 830734 - RNA, 14 nt, Mycobacterium avium subsp. paratuberculosis
gacgacuucggccu

SEQ ID NO: 830735 - RNA, 17 nt, Mycobacterium avium subsp. paratuberculosis
gacgacuucggccucgg

SEQ ID NO: 830736 - RNA, 19 nt, Mycobacterium avium subsp. paratuberculosis
gacgacucguucgacgccg

SEQ ID NO: 830737 - RNA, 16 nt, Mycobacterium avium subsp. paratuberculosis
gacgacguugcgggcc

SEQ ID NO: 830738 - RNA, 17 nt, Mycobacterium avium subsp. paratuberculosis
gacgacguugcgggcca

SEQ ID NO: 830739 - RNA, 20 nt, Mycobacterium avium subsp. paratuberculosis
gacgacguuggccagcaccg

SEQ ID NO: 830740 - RNA, 21 nt, Mycobacterium avium subsp. paratuberculosis
gacgacguuggccagcaccgc

SEQ ID NO: 830741 - RNA, 23 nt, Mycobacterium avium subsp. paratuberculosis
gacgacguuggccagcaccgcgg

SEQ ID NO: 830742 - RNA, 13 nt, Mycobacterium avium subsp. paratuberculosis
gacgacgucgacc

SEQ ID NO: 830743 - RNA, 16 nt, Mycobacterium avium subsp. paratuberculosis
gacgacgucgaccgcg

SEQ ID NO: 830744 - RNA, 20 nt, Mycobacterium avium subsp. paratuberculosis
gacgacgucgaccgcgccgg

SEQ ID NO: 830745 - RNA, 14 nt, Mycobacterium avium subsp. paratuberculosis
gacgacgucgcgca

SEQ ID NO: 830746 - RNA, 22 nt, Mycobacterium avium subsp. paratuberculosis
gacgacgugcccuuccccggcg

SEQ ID NO: 830747 - RNA, 21 nt, Mycobacterium avium subsp. paratuberculosis
gacgacgugguggaugaugcc

SEQ ID NO: 830748 - RNA, 16 nt, Mycobacterium avium subsp. paratuberculosis
gacgagcgggccgauc

SEQ ID NO: 830749 - RNA, 15 nt, Mycobacterium avium subsp. paratuberculosis
gacgagcucaccgcc

SEQ ID NO: 830750 - RNA, 15 nt, Mycobacterium avium subsp. paratuberculosis
gacgagcucgccgcu

SEQ ID NO: 830751 - RNA, 18 nt, Mycobacterium avium subsp. paratuberculosis
gacgagcucgccgcuguc

SEQ ID NO: 830752 - RNA, 21 nt, Mycobacterium avium subsp. paratuberculosis
gacgagagcggaucggcggcg

SEQ ID NO: 830753 - RNA, 14 nt, Mycobacterium avium subsp. paratuberculosis
gacgagccgggcca

SEQ ID NO: 830754 - RNA, 15 nt, Mycobacterium avium subsp. paratuberculosis
gacgagcccgccggc

SEQ ID NO: 830755 - RNA, 16 nt, Mycobacterium avium subsp. paratuberculosis
gacgagcccgccggcg

SEQ ID NO: 830756 - RNA, 13 nt, Mycobacterium avium subsp. paratuberculosis
gacgagcccgcgc

SEQ ID NO: 830757 - RNA, 16 nt, Mycobacterium avium subsp. paratuberculosis
gacgagcccgcgccca

SEQ ID NO: 830758 - RNA, 13 nt, Mycobacterium avium subsp. paratuberculosis
gacgagccgccgc

SEQ ID NO: 830759 - RNA, 22 nt, Mycobacterium avium subsp. paratuberculosis
gacgagccgccgcgggucggcg

SEQ ID NO: 830760 - RNA, 23 nt, Mycobacterium avium subsp. paratuberculosis
gacgagaucgguuggcucgcaga

SEQ ID NO: 830761 - RNA, 18 nt, Mycobacterium avium subsp. paratuberculosis
gacgacgaacgcggugag

SEQ ID NO: 830762 - RNA, 23 nt, Mycobacterium avium subsp. paratuberculosis
gacgacgaacggguaggugcccg

SEQ ID NO: 830763 - RNA, 19 nt, Mycobacterium avium subsp. paratuberculosis
gacgaccuugucgcgcacc

SEQ ID NO: 830764 - RNA, 22 nt, Mycobacterium avium subsp. paratuberculosis
gacgaccuugucgcgcacccgc

SEQ ID NO: 830765 - RNA, 22 nt, Mycobacterium avium subsp. paratuberculosis
gacgacgaaaaugaugccgacc

SEQ ID NO: 830766 - RNA, 14 nt, Mycobacterium avium subsp. paratuberculosis
gacgaccucccccg

SEQ ID NO: 830767 - RNA, 18 nt, Mycobacterium avium subsp. paratuberculosis
gacgaccucccccgacgc

SEQ ID NO: 830768 - RNA, 22 nt, Mycobacterium avium subsp. paratuberculosis
gacgaccucccccgacgccgac

SEQ ID NO: 830769 - RNA, 14 nt, Mycobacterium avium subsp. paratuberculosis
gacgaccucgcccg

SEQ ID NO: 830770 - RNA, 17 nt, Mycobacterium avium subsp. paratuberculosis
gacgaccucgcccgccg

SEQ ID NO: 830771 - RNA, 18 nt, Mycobacterium avium subsp. paratuberculosis
gacgaccucgcccgccgc

SEQ ID NO: 830772 - RNA, 20 nt, Mycobacterium avium subsp. paratuberculosis
gacgaccucgcccgccgcga

SEQ ID NO: 830773 - RNA, 13 nt, Mycobacterium avium subsp. paratuberculosis
gacgaccucgccg

SEQ ID NO: 830774 - RNA, 15 nt, Mycobacterium avium subsp. paratuberculosis
gacgaccucgccgac

SEQ ID NO: 830775 - RNA, 19 nt, Mycobacterium avium subsp. paratuberculosis
gacgaccucgccgacgucc

SEQ ID NO: 830776 - RNA, 20 nt, Mycobacterium avium subsp. paratuberculosis
gacgaccucggugucgaggu

SEQ ID NO: 830777 - RNA, 14 nt, Mycobacterium avium subsp. paratuberculosis
gacgaccucgucgu

SEQ ID NO: 830778 - RNA, 17 nt, Mycobacterium avium subsp. paratuberculosis
gacgaccugggcgccgu

SEQ ID NO: 830779 - RNA, 19 nt, Mycobacterium avium subsp. paratuberculosis
gacgaccugggcgccgucg

SEQ ID NO: 830780 - RNA, 21 nt, Mycobacterium avium subsp. paratuberculosis
gacgaccugggcgccgucgcc

SEQ ID NO: 830781 - RNA, 22 nt, Mycobacterium avium subsp. paratuberculosis
gacgaccugggcgccgucgccg

SEQ ID NO: 830782 - RNA, 17 nt, Mycobacterium avium subsp. paratuberculosis
gacgaccuggucgccgc

SEQ ID NO: 830783 - RNA, 18 nt, Mycobacterium avium subsp. paratuberculosis
gacgaccuggucgccgcc

SEQ ID NO: 830784 - RNA, 19 nt, Mycobacterium avium subsp. paratuberculosis
gacgaccuggucgccgccg

SEQ ID NO: 830785 - RNA, 17 nt, Mycobacterium avium subsp. paratuberculosis
gacgacgccaccaucga

SEQ ID NO: 830786 - RNA, 19 nt, Mycobacterium avium subsp. paratuberculosis
gacgacgccaccaucgagu

SEQ ID NO: 830787 - RNA, 17 nt, Mycobacterium avium subsp. paratuberculosis
gacgacgccagcugccg

SEQ ID NO: 830788 - RNA, 18 nt, Mycobacterium avium subsp. paratuberculosis
gacgacgccagcugccgc

SEQ ID NO: 830789 - RNA, 19 nt, Mycobacterium avium subsp. paratuberculosis
gacgacgccagcugccgcg

SEQ ID NO: 830790 - RNA, 15 nt, Mycobacterium avium subsp. paratuberculosis
gacgacggccaccgc

SEQ ID NO: 830791 - RNA, 17 nt, Mycobacterium avium subsp. paratuberculosis
gacgacggccaccgcga

SEQ ID NO: 830792 - RNA, 13 nt, Mycobacterium avium subsp. paratuberculosis
gacgacggccagc

SEQ ID NO: 830793 - RNA, 20 nt, Mycobacterium avium subsp. paratuberculosis
gacgacggcgaacgucgaug

SEQ ID NO: 830794 - RNA, 15 nt, Mycobacterium avium subsp. paratuberculosis
gacgacggcgccgcc

SEQ ID NO: 830795 - RNA, 20 nt, Mycobacterium avium subsp. paratuberculosis
gacgacggcgccgcccgggc

SEQ ID NO: 830796 - RNA, 14 nt, Mycobacterium avium subsp. paratuberculosis
gacgacggcggagu

SEQ ID NO: 830797 - RNA, 19 nt, Mycobacterium avium subsp. paratuberculosis
gacgacgcggucgucgucg

SEQ ID NO: 830798 - RNA, 14 nt, Mycobacterium avium subsp. paratuberculosis
gacgacggcgggga

SEQ ID NO: 830799 - RNA, 13 nt, Mycobacterium avium subsp. paratuberculosis
gacgacggguggg

SEQ ID NO: 830800 - RNA, 16 nt, Mycobacterium avium subsp. paratuberculosis
gacgacggucaccggc

SEQ ID NO: 830801 - RNA, 17 nt, Mycobacterium avium subsp. paratuberculosis
gacgacggucaccggca

SEQ ID NO: 830802 - RNA, 16 nt, Mycobacterium avium subsp. paratuberculosis
gacgacggucuucccg

SEQ ID NO: 830803 - RNA, 19 nt, Mycobacterium avium subsp. paratuberculosis
gacgacggucuucccgccg

SEQ ID NO: 830804 - RNA, 20 nt, Mycobacterium avium subsp. paratuberculosis
gacgacggucuucccgccgc

SEQ ID NO: 830805 - RNA, 21 nt, Mycobacterium avium subsp. paratuberculosis
gacgacggucuucccgccgcc

SEQ ID NO: 830806 - RNA, 15 nt, Mycobacterium avium subsp. paratuberculosis
gaccaccagcgugcu

SEQ ID NO: 830807 - RNA, 21 nt, Mycobacterium avium subsp. paratuberculosis
gaccaccaggaaggucccggu

SEQ ID NO: 830808 - RNA, 19 nt, Mycobacterium avium subsp. paratuberculosis
gaccaccaggagcaccugc

SEQ ID NO: 830809 - RNA, 12 nt, Mycobacterium avium subsp. paratuberculosis
gaccaccaggua

SEQ ID NO: 830810 - RNA, 23 nt, Mycobacterium avium subsp. paratuberculosis
gaccaccaugauguagcggcggu

SEQ ID NO: 830811 - RNA, 15 nt, Mycobacterium avium subsp. paratuberculosis
gaccacccggcgggc

SEQ ID NO: 830812 - RNA, 14 nt, Mycobacterium avium subsp. paratuberculosis
gaccacccgcagcg

SEQ ID NO: 830813 - RNA, 18 nt, Mycobacterium avium subsp. paratuberculosis
gaccacccgcagcgcggc

SEQ ID NO: 830814 - RNA, 21 nt, Mycobacterium avium subsp. paratuberculosis
gaccacccacucccagccgcc

SEQ ID NO: 830815 - RNA, 22 nt, Mycobacterium avium subsp. paratuberculosis
gaccacccacucccagccgccg

SEQ ID NO: 830816 - RNA, 18 nt, Mycobacterium avium subsp. paratuberculosis
gaccacccccagcccgcc

SEQ ID NO: 830817 - RNA, 20 nt, Mycobacterium avium subsp. paratuberculosis
gaccacccccagcccgccgg

SEQ ID NO: 830818 - RNA, 22 nt, Mycobacterium avium subsp. paratuberculosis
gaccacccccagcccgccgggc

SEQ ID NO: 830819 - RNA, 13 nt, Mycobacterium avium subsp. paratuberculosis
gaccaccgccggc

SEQ ID NO: 830820 - RNA, 15 nt, Mycobacterium avium subsp. paratuberculosis
gaccaccgccggccc

SEQ ID NO: 830821 - RNA, 17 nt, Mycobacterium avium subsp. paratuberculosis
gaccaccgccggcccgg

SEQ ID NO: 830822 - RNA, 19 nt, Mycobacterium avium subsp. paratuberculosis
gaccaccgccggcccggcg

SEQ ID NO: 830823 - RNA, 16 nt, Mycobacterium avium subsp. paratuberculosis
gaccacccucaccacg

SEQ ID NO: 830824 - RNA, 18 nt, Mycobacterium avium subsp. paratuberculosis
gaccaccgagccgggcag

SEQ ID NO: 830825 - RNA, 15 nt, Mycobacterium avium subsp. paratuberculosis
gaccaugucggcgac

SEQ ID NO: 830826 - RNA, 18 nt, Mycobacterium avium subsp. paratuberculosis
gaccauggcgcggcggcc

SEQ ID NO: 830827 - RNA, 22 nt, Mycobacterium avium subsp. paratuberculosis
gacccaacucaugggcccggcc

SEQ ID NO: 830828 - RNA, 22 nt, Mycobacterium avium subsp. paratuberculosis
gaccaccgcgugcgagccgagc

SEQ ID NO: 830829 - RNA, 21 nt, Mycobacterium avium subsp. paratuberculosis
gacccacagcugccggccguu

SEQ ID NO: 830830 - RNA, 13 nt, Mycobacterium avium subsp. paratuberculosis
gacccaccagccg

SEQ ID NO: 830831 - RNA, 19 nt, Mycobacterium avium subsp. paratuberculosis
gacccagacuugggcagca

SEQ ID NO: 830832 - RNA, 22 nt, Mycobacterium avium subsp. paratuberculosis
gacccagacuugggcagcaggu

SEQ ID NO: 830833 - RNA, 20 nt, Mycobacterium avium subsp. paratuberculosis
gacccagcagcggccggcgc

SEQ ID NO: 830834 - RNA, 16 nt, Mycobacterium avium subsp. paratuberculosis
gacccagcaucgccgc

SEQ ID NO: 830835 - RNA, 17 nt, Mycobacterium avium subsp. paratuberculosis
gacccagcaucgccgcg

SEQ ID NO: 830836 - RNA, 13 nt, Mycobacterium avium subsp. paratuberculosis
gacccagcccgau

SEQ ID NO: 830837 - RNA, 17 nt, Mycobacterium avium subsp. paratuberculosis
gacccagcccggcgacg

SEQ ID NO: 830838 - RNA, 22 nt, Mycobacterium avium subsp. paratuberculosis
gacccagcuccucggccagcac

SEQ ID NO: 830839 - RNA, 15 nt, Mycobacterium avium subsp. paratuberculosis
gacccgcucgggcgc

SEQ ID NO: 830840 - RNA, 14 nt, Mycobacterium avium subsp. paratuberculosis
gacccgcugcagcu

SEQ ID NO: 830841 - RNA, 18 nt, Mycobacterium avium subsp. paratuberculosis
gacccgcuccagcggcca

SEQ ID NO: 830842 - RNA, 20 nt, Mycobacterium avium subsp. paratuberculosis
gacccgcuccagcggccaca

SEQ ID NO: 830843 - RNA, 22 nt, Mycobacterium avium subsp. paratuberculosis
gacccgcucccgggacagcccg

SEQ ID NO: 830844 - RNA, 23 nt, Mycobacterium avium subsp. paratuberculosis
gacccgcucccgggacagcccga

SEQ ID NO: 830845 - RNA, 18 nt, Mycobacterium avium subsp. paratuberculosis
gacccgcuccgacgcggu

SEQ ID NO: 830846 - RNA, 19 nt, Mycobacterium avium subsp. paratuberculosis
gacccgcuccgacgcggug

SEQ ID NO: 830847 - RNA, 13 nt, Mycobacterium avium subsp. paratuberculosis
gacccgcucgacg

SEQ ID NO: 830848 - RNA, 14 nt, Mycobacterium avium subsp. paratuberculosis
gacccgcucgacgc

SEQ ID NO: 830849 - RNA, 15 nt, Mycobacterium avium subsp. paratuberculosis
gacccgcggcgccgc

SEQ ID NO: 830850 - RNA, 16 nt, Mycobacterium avium subsp. paratuberculosis
gacccgcggcgccgcg

SEQ ID NO: 830851 - RNA, 20 nt, Mycobacterium avium subsp. paratuberculosis
gacccgcggcgccgcggcgg

SEQ ID NO: 830852 - RNA, 20 nt, Mycobacterium avium subsp. paratuberculosis
gacccgccuggccaccucga

SEQ ID NO: 830853 - RNA, 12 nt, Mycobacterium avium subsp. paratuberculosis
gacccgcgaccc

SEQ ID NO: 830854 - RNA, 13 nt, Mycobacterium avium subsp. paratuberculosis
gacccgcgacccc

SEQ ID NO: 830855 - RNA, 15 nt, Mycobacterium avium subsp. paratuberculosis
gacccgguagcgcag

SEQ ID NO: 830856 - RNA, 17 nt, Mycobacterium avium subsp. paratuberculosis
gacccgguagcgcagca

SEQ ID NO: 830857 - RNA, 20 nt, Mycobacterium avium subsp. paratuberculosis
gacccgguagcgcagcacca

SEQ ID NO: 830858 - RNA, 12 nt, Mycobacterium avium subsp. paratuberculosis
gacccggucagc

SEQ ID NO: 830859 - RNA, 17 nt, Mycobacterium avium subsp. paratuberculosis
gacccggucagcucgcc

SEQ ID NO: 830860 - RNA, 17 nt, Mycobacterium avium subsp. paratuberculosis
gacccgcuucgcccggc

SEQ ID NO: 830861 - RNA, 16 nt, Mycobacterium avium subsp. paratuberculosis
gacccggucggccgcg

SEQ ID NO: 830862 - RNA, 21 nt, Mycobacterium avium subsp. paratuberculosis
gacccgguugaaggccgcgcu

SEQ ID NO: 830863 - RNA, 17 nt, Mycobacterium avium subsp. paratuberculosis
gacccguaauugaucgu

SEQ ID NO: 830864 - RNA, 20 nt, Mycobacterium avium subsp. paratuberculosis
gacccguaggagcugacggc

SEQ ID NO: 830865 - RNA, 18 nt, Mycobacterium avium subsp. paratuberculosis
gacccguccagcagcaug

SEQ ID NO: 830866 - RNA, 18 nt, Mycobacterium avium subsp. paratuberculosis
gacccguccagcgugugc

SEQ ID NO: 830867 - RNA, 20 nt, Mycobacterium avium subsp. paratuberculosis
gaccccgcccagcgacucgg

SEQ ID NO: 830868 - RNA, 23 nt, Mycobacterium avium subsp. paratuberculosis
gaccccgcccagcgacucggcca

SEQ ID NO: 830869 - RNA, 13 nt, Mycobacterium avium subsp. paratuberculosis
gaccccgccggcc

SEQ ID NO: 830870 - RNA, 15 nt, Mycobacterium avium subsp. paratuberculosis
gaccccgccggcccg

SEQ ID NO: 830871 - RNA, 17 nt, Mycobacterium avium subsp. paratuberculosis
gaccccgccgucgacgc

SEQ ID NO: 830872 - RNA, 18 nt, Mycobacterium avium subsp. paratuberculosis
gacccgccgcaacagccg

SEQ ID NO: 830873 - RNA, 21 nt, Mycobacterium avium subsp. paratuberculosis
gacccgccgcaacagccggcc

SEQ ID NO: 830874 - RNA, 23 nt, Mycobacterium avium subsp. paratuberculosis
gacccgccgcaacagccggcccg

SEQ ID NO: 830875 - RNA, 12 nt, Mycobacterium avium subsp. paratuberculosis
gacccgccgcgg

SEQ ID NO: 830876 - RNA, 21 nt, Mycobacterium avium subsp. paratuberculosis
gacccccggugucugaccucg

SEQ ID NO: 830877 - RNA, 13 nt, Mycobacterium avium subsp. paratuberculosis
gacccccucgucg

SEQ ID NO: 830878 - RNA, 20 nt, Mycobacterium avium subsp. paratuberculosis
gacccccucgucgaucgcgg

SEQ ID NO: 830879 - RNA, 17 nt, Mycobacterium avium subsp. paratuberculosis
gaccccgaaggcguugg

SEQ ID NO: 830880 - RNA, 19 nt, Mycobacterium avium subsp. paratuberculosis
gaccccgaugcgcucaccc

SEQ ID NO: 830881 - RNA, 17 nt, Mycobacterium avium subsp. paratuberculosis
gaccccgaugcgcucgc

SEQ ID NO: 830882 - RNA, 20 nt, Mycobacterium avium subsp. paratuberculosis
gaccccgaugcgcucgccga

SEQ ID NO: 830883 - RNA, 16 nt, Mycobacterium avium subsp. paratuberculosis
gaccccacaccuucgc

SEQ ID NO: 830884 - RNA, 13 nt, Mycobacterium avium subsp. paratuberculosis
gaccccacagcgc

SEQ ID NO: 830885 - RNA, 12 nt, Mycobacterium avium subsp. paratuberculosis
gacccccaccac

SEQ ID NO: 830886 - RNA, 14 nt, Mycobacterium avium subsp. paratuberculosis
gacccccaccgcga

SEQ ID NO: 830887 - RNA, 16 nt, Mycobacterium avium subsp. paratuberculosis
gacccccaccgcgaca

SEQ ID NO: 830888 - RNA, 14 nt, Mycobacterium avium subsp. paratuberculosis
gaccccagcgugac

SEQ ID NO: 830889 - RNA, 15 nt, Mycobacterium avium subsp. paratuberculosis
gaccccccgacgccg

SEQ ID NO: 830890 - RNA, 18 nt, Mycobacterium avium subsp. paratuberculosis
gaccccccgacgccgacg

SEQ ID NO: 830891 - RNA, 16 nt, Mycobacterium avium subsp. paratuberculosis
gacccaggccgccgcc

SEQ ID NO: 830892 - RNA, 17 nt, Mycobacterium avium subsp. paratuberculosis
gacccaggccgccgcca

SEQ ID NO: 830893 - RNA, 20 nt, Mycobacterium avium subsp. paratuberculosis
gacccaggccgccgccaccg

SEQ ID NO: 830894 - RNA, 18 nt, Mycobacterium avium subsp. paratuberculosis
gacccgucggggugcgcc

SEQ ID NO: 830895 - RNA, 22 nt, Mycobacterium avium subsp. paratuberculosis
gacccgucggggugcgccaggc

SEQ ID NO: 830896 - RNA, 14 nt, Mycobacterium avium subsp. paratuberculosis
gacccguuccccgg

SEQ ID NO: 830897 - RNA, 17 nt, Mycobacterium avium subsp. paratuberculosis
gacccguuccggcgaga

SEQ ID NO: 830898 - RNA, 18 nt, Mycobacterium avium subsp. paratuberculosis
gacccugccgucaccggc

SEQ ID NO: 830899 - RNA, 16 nt, Mycobacterium avium subsp. paratuberculosis
gacccuucgaacgcga

SEQ ID NO: 830900 - RNA, 14 nt, Mycobacterium avium subsp. paratuberculosis
gaccgaacccgggc

SEQ ID NO: 830901 - RNA, 16 nt, Mycobacterium avium subsp. paratuberculosis
gaccgaacccgggcgc

SEQ ID NO: 830902 - RNA, 21 nt, Mycobacterium avium subsp. paratuberculosis
gaccgccaccagaucgugucc

SEQ ID NO: 830903 - RNA, 17 nt, Mycobacterium avium subsp. paratuberculosis
gacccugugggucgaca

SEQ ID NO: 830904 - RNA, 18 nt, Mycobacterium avium subsp. paratuberculosis
gacccuggaugaucucga

SEQ ID NO: 830905 - RNA, 17 nt, Mycobacterium avium subsp. paratuberculosis
gacccuggccagcaccg

SEQ ID NO: 830906 - RNA, 20 nt, Mycobacterium avium subsp. paratuberculosis
gacccuggccagcaccgcgg

SEQ ID NO: 830907 - RNA, 21 nt, Mycobacterium avium subsp. paratuberculosis
gaccgccaccucgagcucacc

SEQ ID NO: 830908 - RNA, 17 nt, Mycobacterium avium subsp. paratuberculosis
gaccgccagcaccgcgg

SEQ ID NO: 830909 - RNA, 12 nt, Mycobacterium avium subsp. paratuberculosis
gaccgccagcag

SEQ ID NO: 830910 - RNA, 17 nt, Mycobacterium avium subsp. paratuberculosis
gaccgccagcagcagcc

SEQ ID NO: 830911 - RNA, 20 nt, Mycobacterium avium subsp. paratuberculosis
gaccgccagcagcagccgcg

SEQ ID NO: 830912 - RNA, 21 nt, Mycobacterium avium subsp. paratuberculosis
gaccgccagcagcagccgcgc

SEQ ID NO: 830913 - RNA, 14 nt, Mycobacterium avium subsp. paratuberculosis
gaccgccgccgcga

SEQ ID NO: 830914 - RNA, 13 nt, Mycobacterium avium subsp. paratuberculosis
gaccgccgagcgg

SEQ ID NO: 830915 - RNA, 14 nt, Mycobacterium avium subsp. paratuberculosis
gaccgccgagcggg

SEQ ID NO: 830916 - RNA, 18 nt, Mycobacterium avium subsp. paratuberculosis
gaccgccgagcgggcgau

SEQ ID NO: 830917 - RNA, 16 nt, Mycobacterium avium subsp. paratuberculosis
gaccgcccaggacccg

SEQ ID NO: 830918 - RNA, 13 nt, Mycobacterium avium subsp. paratuberculosis
gaccgcccgcucg

SEQ ID NO: 830919 - RNA, 22 nt, Mycobacterium avium subsp. paratuberculosis
gaccgcccgcucgacggccggu

SEQ ID NO: 830920 - RNA, 17 nt, Mycobacterium avium subsp. paratuberculosis
gaccgccgacaccaccg

SEQ ID NO: 830921 - RNA, 20 nt, Mycobacterium avium subsp. paratuberculosis
gaccgccgacaccaccgcgc

SEQ ID NO: 830922 - RNA, 23 nt, Mycobacterium avium subsp. paratuberculosis
gaccgccuuggcgcgcucggugg

SEQ ID NO: 830923 - RNA, 18 nt, Mycobacterium avium subsp. paratuberculosis
gaccgccuugucggcgau

SEQ ID NO: 830924 - RNA, 20 nt, Mycobacterium avium subsp. paratuberculosis
gaccgccuugucggcgaugu

SEQ ID NO: 830925 - RNA, 21 nt, Mycobacterium avium subsp. paratuberculosis
gaccgccuugucggcgauguc

SEQ ID NO: 830926 - RNA, 16 nt, Mycobacterium avium subsp. paratuberculosis
gaccgccucgucggga

SEQ ID NO: 830927 - RNA, 14 nt, Mycobacterium avium subsp. paratuberculosis
gaccgccugcggca

SEQ ID NO: 830928 - RNA, 16 nt, Mycobacterium avium subsp. paratuberculosis
gaccgcgacgcugccg

SEQ ID NO: 830929 - RNA, 12 nt, Mycobacterium avium subsp. paratuberculosis
gaccgcgacggc

SEQ ID NO: 830930 - RNA, 14 nt, Mycobacterium avium subsp. paratuberculosis
gaccgcgacggcgc

SEQ ID NO: 830931 - RNA, 16 nt, Mycobacterium avium subsp. paratuberculosis
gaccgcgacggcgccc

SEQ ID NO: 830932 - RNA, 17 nt, Mycobacterium avium subsp. paratuberculosis
gaccgcgacggcgcccg

SEQ ID NO: 830933 - RNA, 18 nt, Mycobacterium avium subsp. paratuberculosis
gaccgcgacggcgcccgc

SEQ ID NO: 830934 - RNA, 19 nt, Mycobacterium avium subsp. paratuberculosis
gaccgcgacggcgcccgcc

SEQ ID NO: 830935 - RNA, 20 nt, Mycobacterium avium subsp. paratuberculosis
gaccgccugcuugagguuga

SEQ ID NO: 830936 - RNA, 14 nt, Mycobacterium avium subsp. paratuberculosis
gaccgccugucagu

SEQ ID NO: 830937 - RNA, 16 nt, Mycobacterium avium subsp. paratuberculosis
gaccgccucgauggcc

SEQ ID NO: 830938 - RNA, 23 nt, Mycobacterium avium subsp. paratuberculosis
gaccgccucgauggcccgcucgg

SEQ ID NO: 830939 - RNA, 18 nt, Mycobacterium avium subsp. paratuberculosis
gaccgccggugcgcagcu

SEQ ID NO: 830940 - RNA, 17 nt, Mycobacterium avium subsp. paratuberculosis
gaccgccguggcguuac

SEQ ID NO: 830941 - RNA, 15 nt, Mycobacterium avium subsp. paratuberculosis
gaccgccgcgcucgg

SEQ ID NO: 830942 - RNA, 19 nt, Mycobacterium avium subsp. paratuberculosis
gaccgccgcggcgcccggc

SEQ ID NO: 830943 - RNA, 14 nt, Mycobacterium avium subsp. paratuberculosis
gaccgccgcggcgg

SEQ ID NO: 830944 - RNA, 15 nt, Mycobacterium avium subsp. paratuberculosis
gaccgccgcggcggc

SEQ ID NO: 830945 - RNA, 16 nt, Mycobacterium avium subsp. paratuberculosis
gaccgccgcggcggcc

SEQ ID NO: 830946 - RNA, 21 nt, Mycobacterium avium subsp. paratuberculosis
gaccgccgcguacagccagcc

SEQ ID NO: 830947 - RNA, 20 nt, Mycobacterium avium subsp. paratuberculosis
gaccgccggacaccaccgcg

SEQ ID NO: 830948 - RNA, 15 nt, Mycobacterium avium subsp. paratuberculosis
gaccgcguccgaggc

SEQ ID NO: 830949 - RNA, 16 nt, Mycobacterium avium subsp. paratuberculosis
gaccgcgucgacggcg

SEQ ID NO: 830950 - RNA, 17 nt, Mycobacterium avium subsp. paratuberculosis
gaccgcgucgacggcgu

SEQ ID NO: 830951 - RNA, 13 nt, Mycobacterium avium subsp. paratuberculosis
gaccgcgucggcg

SEQ ID NO: 830952 - RNA, 15 nt, Mycobacterium avium subsp. paratuberculosis
gaccgcgcgcggcgc

SEQ ID NO: 830953 - RNA, 20 nt, Mycobacterium avium subsp. paratuberculosis
gaccgcgcgcggcgccgcgu

SEQ ID NO: 830954 - RNA, 20 nt, Mycobacterium avium subsp. paratuberculosis
gaccgcgguggcggugcggu

SEQ ID NO: 830955 - RNA, 12 nt, Mycobacterium avium subsp. paratuberculosis
gaccgcgccggg

SEQ ID NO: 830956 - RNA, 12 nt, Mycobacterium avium subsp. paratuberculosis
gaccgcgcgccg

SEQ ID NO: 830957 - RNA, 14 nt, Mycobacterium avium subsp. paratuberculosis
gaccgcgcgccggc

SEQ ID NO: 830958 - RNA, 16 nt, Mycobacterium avium subsp. paratuberculosis
gaccgcgcgccggcca

SEQ ID NO: 830959 - RNA, 12 nt, Mycobacterium avium subsp. paratuberculosis
gaccgcgcgggc

SEQ ID NO: 830960 - RNA, 17 nt, Mycobacterium avium subsp. paratuberculosis
gaccgcgcgggccagcg

SEQ ID NO: 830961 - RNA, 19 nt, Mycobacterium avium subsp. paratuberculosis
gaccgcgcgggccagcgcc

SEQ ID NO: 830962 - RNA, 20 nt, Mycobacterium avium subsp. paratuberculosis
gaccgcgcgggccagcgccu

SEQ ID NO: 830963 - RNA, 21 nt, Mycobacterium avium subsp. paratuberculosis
gaccgcgcaccggcgcuggua

SEQ ID NO: 830964 - RNA, 16 nt, Mycobacterium avium subsp. paratuberculosis
gaccgcgcaggcggcg

SEQ ID NO: 830965 - RNA, 22 nt, Mycobacterium avium subsp. paratuberculosis
gaccgcgcaggcggcgacggcc

SEQ ID NO: 830966 - RNA, 13 nt, Mycobacterium avium subsp. paratuberculosis
gaccgcgccgcgg

SEQ ID NO: 830967 - RNA, 15 nt, Mycobacterium avium subsp. paratuberculosis
gaccgcgccgcgggu

SEQ ID NO: 830968 - RNA, 18 nt, Mycobacterium avium subsp. paratuberculosis
gaccgcgccgcgggugac

SEQ ID NO: 830969 - RNA, 19 nt, Mycobacterium avium subsp. paratuberculosis
gaccgcgacgggcucggcg

SEQ ID NO: 830970 - RNA, 22 nt, Mycobacterium avium subsp. paratuberculosis
gaccgcgacgggcucggcguac

SEQ ID NO: 830971 - RNA, 18 nt, Mycobacterium avium subsp. paratuberculosis
gaccgcgacguggcgcag

SEQ ID NO: 830972 - RNA, 23 nt, Mycobacterium avium subsp. paratuberculosis
gaccgcgaucagccccagggugc

SEQ ID NO: 830973 - RNA, 19 nt, Mycobacterium avium subsp. paratuberculosis
gaccgcgaucagggccgcg

SEQ ID NO: 830974 - RNA, 20 nt, Mycobacterium avium subsp. paratuberculosis
gaccgcgaucagggccgcgg

SEQ ID NO: 830975 - RNA, 18 nt, Mycobacterium avium subsp. paratuberculosis
gaccgcgacgaccucgcc

SEQ ID NO: 830976 - RNA, 22 nt, Mycobacterium avium subsp. paratuberculosis
gaccgcgacgaccucgcccgcc

SEQ ID NO: 830977 - RNA, 12 nt, Mycobacterium avium subsp. paratuberculosis
gaccgcgaugcg

SEQ ID NO: 830978 - RNA, 19 nt, Mycobacterium avium subsp. paratuberculosis
gaaaaacgcgguguagucg

SEQ ID NO: 830979 - RNA, 19 nt, Mycobacterium avium subsp. paratuberculosis
cuuugggaagaggcgcgcu

SEQ ID NO: 830980 - RNA, 18 nt, Mycobacterium avium subsp. paratuberculosis
cuuuggucgaacacuucg

SEQ ID NO: 830981 - RNA, 17 nt, Mycobacterium avium subsp. paratuberculosis
gaaaaccagcaccggca

SEQ ID NO: 830982 - RNA, 20 nt, Mycobacterium avium subsp. paratuberculosis
gaaaaccagcgacgccagcg

SEQ ID NO: 830983 - RNA, 22 nt, Mycobacterium avium subsp. paratuberculosis
gaaaauccagaacagccagucg

SEQ ID NO: 830984 - RNA, 23 nt, Mycobacterium avium subsp. paratuberculosis
gaaaagcuucuugcugccgucgg

SEQ ID NO: 830985 - RNA, 13 nt, Mycobacterium avium subsp. paratuberculosis
gaaaccgucgacc

SEQ ID NO: 830986 - RNA, 16 nt, Mycobacterium avium subsp. paratuberculosis
gaaaccgucggcccgc

SEQ ID NO: 830987 - RNA, 16 nt, Mycobacterium avium subsp. paratuberculosis
gaaaccgucuccggcg

SEQ ID NO: 830988 - RNA, 22 nt, Mycobacterium avium subsp. paratuberculosis
gaaaccggcgggaacucgaugc

SEQ ID NO: 830989 - RNA, 20 nt, Mycobacterium avium subsp. paratuberculosis
gaaaccggucaacggcucgg

SEQ ID NO: 830990 - RNA, 21 nt, Mycobacterium avium subsp. paratuberculosis
gaaaccggcgccgaagcccgc

SEQ ID NO: 830991 - RNA, 11 nt, Mycobacterium avium subsp. paratuberculosis
gaaaccggaug

SEQ ID NO: 830992 - RNA, 16 nt, Mycobacterium avium subsp. paratuberculosis
gaaaccggaugaugcc

SEQ ID NO: 830993 - RNA, 13 nt, Mycobacterium avium subsp. paratuberculosis
gaaaccggccagc

SEQ ID NO: 830994 - RNA, 18 nt, Mycobacterium avium subsp. paratuberculosis
gaaacccucgacgccggg

SEQ ID NO: 830995 - RNA, 15 nt, Mycobacterium avium subsp. paratuberculosis
cuugucagcggccuc

SEQ ID NO: 830996 - RNA, 14 nt, Mycobacterium avium subsp. paratuberculosis
cuuguccggcgucc

SEQ ID NO: 830997 - RNA, 16 nt, Mycobacterium avium subsp. paratuberculosis
cuuguacaugucgucg

SEQ ID NO: 830998 - RNA, 14 nt, Mycobacterium avium subsp. paratuberculosis
cuugucaccgaacc

SEQ ID NO: 830999 - RNA, 14 nt, Mycobacterium avium subsp. paratuberculosis
cuugucgcgcaccc

SEQ ID NO: 831000 - RNA, 22 nt, Mycobacterium avium subsp. paratuberculosis
cuugucgcgcaccgcggcgggg

SEQ ID NO: 831001 - RNA, 14 nt, Mycobacterium avium subsp. paratuberculosis
cuugucgcagaccc

SEQ ID NO: 831002 - RNA, 17 nt, Mycobacterium avium subsp. paratuberculosis
cuuuccaccucgagcaa

SEQ ID NO: 831003 - RNA, 14 nt, Mycobacterium avium subsp. paratuberculosis
cuuucaucgccccg

SEQ ID NO: 831004 - RNA, 20 nt, Mycobacterium avium subsp. paratuberculosis
cuuucaucgccccggcgacg

SEQ ID NO: 831005 - RNA, 23 nt, Mycobacterium avium subsp. paratuberculosis
cuuugcauacagcaggcuguccu

SEQ ID NO: 831006 - RNA, 16 nt, Mycobacterium avium subsp. paratuberculosis
cuuugccguggcggcg

SEQ ID NO: 831007 - RNA, 22 nt, Mycobacterium avium subsp. paratuberculosis
cuuuggcuaaacaauggccccg

SEQ ID NO: 831008 - RNA, 15 nt, Mycobacterium avium subsp. paratuberculosis
cuuucgggucgacga

SEQ ID NO: 831009 - RNA, 18 nt, Mycobacterium avium subsp. paratuberculosis
cuuucgauuucgccugca

SEQ ID NO: 831010 - RNA, 14 nt, Mycobacterium avium subsp. paratuberculosis
cuuucgucgcuugg

SEQ ID NO: 831011 - RNA, 14 nt, Mycobacterium avium subsp. paratuberculosis
cuuucgcggucagc

SEQ ID NO: 831012 - RNA, 18 nt, Mycobacterium avium subsp. paratuberculosis
cuuucgcgucugcucgcc

SEQ ID NO: 831013 - RNA, 19 nt, Mycobacterium avium subsp. paratuberculosis
cuuucgcgucugcucgccg

SEQ ID NO: 831014 - RNA, 16 nt, Mycobacterium avium subsp. paratuberculosis
cuuggacagcagcagc

SEQ ID NO: 831015 - RNA, 16 nt, Mycobacterium avium subsp. paratuberculosis
cuuggacaggcccagc

SEQ ID NO: 831016 - RNA, 21 nt, Mycobacterium avium subsp. paratuberculosis
cuugcguugcgcggcggccaa

SEQ ID NO: 831017 - RNA, 20 nt, Mycobacterium avium subsp. paratuberculosis
cuuggacgaaacccggcgga

SEQ ID NO: 831018 - RNA, 20 nt, Mycobacterium avium subsp. paratuberculosis
cuuggagccgagcaccgggc

SEQ ID NO: 831019 - RNA, 18 nt, Mycobacterium avium subsp. paratuberculosis
cuuggacucccccaccac

SEQ ID NO: 831020 - RNA, 15 nt, Mycobacterium avium subsp. paratuberculosis
cuugcgggugaucca

SEQ ID NO: 831021 - RNA, 15 nt, Mycobacterium avium subsp. paratuberculosis
cuugcgggcggucag

SEQ ID NO: 831022 - RNA, 21 nt, Mycobacterium avium subsp. paratuberculosis
cuugcgugcgggucgcgcggc

SEQ ID NO: 831023 - RNA, 18 nt, Mycobacterium avium subsp. paratuberculosis
cuugcguucccagcccgg

SEQ ID NO: 831024 - RNA, 17 nt, Mycobacterium avium subsp. paratuberculosis
cuugcguuccucgacgg

SEQ ID NO: 831025 - RNA, 14 nt, Mycobacterium avium subsp. paratuberculosis
cuugccgccggcgc

SEQ ID NO: 831026 - RNA, 14 nt, Mycobacterium avium subsp. paratuberculosis
cuugccgccgcagc

SEQ ID NO: 831027 - RNA, 23 nt, Mycobacterium avium subsp. paratuberculosis
cuugccggagcccagcuuggcgc

SEQ ID NO: 831028 - RNA, 23 nt, Mycobacterium avium subsp. paratuberculosis
cuugccggucuuguagucgacca

SEQ ID NO: 831029 - RNA, 12 nt, Mycobacterium avium subsp. paratuberculosis
cuugcggcgcaa

SEQ ID NO: 831030 - RNA, 14 nt, Mycobacterium avium subsp. paratuberculosis
cuugcggcgcaacc

SEQ ID NO: 831031 - RNA, 23 nt, Mycobacterium avium subsp. paratuberculosis
cuugcggcgcagccagcucggcg

SEQ ID NO: 831032 - RNA, 14 nt, Mycobacterium avium subsp. paratuberculosis
cuugcggccgauca

SEQ ID NO: 831033 - RNA, 14 nt, Mycobacterium avium subsp. paratuberculosis
cuugcggccgcgac

SEQ ID NO: 831034 - RNA, 15 nt, Mycobacterium avium subsp. paratuberculosis
cuugcggccggcggc

SEQ ID NO: 831035 - RNA, 14 nt, Mycobacterium avium subsp. paratuberculosis
cuugccgucgacgc

SEQ ID NO: 831036 - RNA, 21 nt, Mycobacterium avium subsp. paratuberculosis
cuugcggcccaaccggaucgg

SEQ ID NO: 831037 - RNA, 17 nt, Mycobacterium avium subsp. paratuberculosis
cuuggucacaaagcccg

SEQ ID NO: 831038 - RNA, 14 nt, Mycobacterium avium subsp. paratuberculosis
cuuggggaagccgg

SEQ ID NO: 831039 - RNA, 22 nt, Mycobacterium avium subsp. paratuberculosis
cuugggucccaucgcugccacg

SEQ ID NO: 831040 - RNA, 13 nt, Mycobacterium avium subsp. paratuberculosis
cuugggcucggcg

SEQ ID NO: 831041 - RNA, 13 nt, Mycobacterium avium subsp. paratuberculosis
cuugggccggucg

SEQ ID NO: 831042 - RNA, 15 nt, Mycobacterium avium subsp. paratuberculosis
cuugggaaugucgua

SEQ ID NO: 831043 - RNA, 20 nt, Mycobacterium avium subsp. paratuberculosis
cuuggcuugaaaguccgccg

SEQ ID NO: 831044 - RNA, 20 nt, Mycobacterium avium subsp. paratuberculosis
cuugggcacguacgcgcuga

SEQ ID NO: 831045 - RNA, 19 nt, Mycobacterium avium subsp. paratuberculosis
cuuggcguauucggcgcgc

SEQ ID NO: 831046 - RNA, 13 nt, Mycobacterium avium subsp. paratuberculosis
cuuggcgucgauc

SEQ ID NO: 831047 - RNA, 19 nt, Mycobacterium avium subsp. paratuberculosis
cuuggcgucgaucagcgcg

SEQ ID NO: 831048 - RNA, 20 nt, Mycobacterium avium subsp. paratuberculosis
cuuggcgucgaucagcgcgc

SEQ ID NO: 831049 - RNA, 22 nt, Mycobacterium avium subsp. paratuberculosis
cuuggcgucgaucagcgcgccg

SEQ ID NO: 831050 - RNA, 15 nt, Mycobacterium avium subsp. paratuberculosis
cuuggcacgggcccg

SEQ ID NO: 831051 - RNA, 13 nt, Mycobacterium avium subsp. paratuberculosis
cuuggcgacgaag

SEQ ID NO: 831052 - RNA, 18 nt, Mycobacterium avium subsp. paratuberculosis
cuuggcauuuccggcuau

SEQ ID NO: 831053 - RNA, 16 nt, Mycobacterium avium subsp. paratuberculosis
cuuggcgcgccgcacc

SEQ ID NO: 831054 - RNA, 16 nt, Mycobacterium avium subsp. paratuberculosis
cuuggcgcgcucggug

SEQ ID NO: 831055 - RNA, 15 nt, Mycobacterium avium subsp. paratuberculosis
cuuggcggccagcgc

SEQ ID NO: 831056 - RNA, 16 nt, Mycobacterium avium subsp. paratuberculosis
cuuggcggccagcgcc

SEQ ID NO: 831057 - RNA, 15 nt, Mycobacterium avium subsp. paratuberculosis
cuuggcggccugcgc

SEQ ID NO: 831058 - RNA, 14 nt, Mycobacterium avium subsp. paratuberculosis
cuuggcggcggcca

SEQ ID NO: 831059 - RNA, 14 nt, Mycobacterium avium subsp. paratuberculosis
cuuggcggcggccu

SEQ ID NO: 831060 - RNA, 14 nt, Mycobacterium avium subsp. paratuberculosis
cuuggcggcggucu

SEQ ID NO: 831061 - RNA, 22 nt, Mycobacterium avium subsp. paratuberculosis
cuuggcggcggucuucuuggcc

SEQ ID NO: 831062 - RNA, 15 nt, Mycobacterium avium subsp. paratuberculosis
cuugaagucggugug

SEQ ID NO: 831063 - RNA, 17 nt, Mycobacterium avium subsp. paratuberculosis
cuugaacggcgcgucgu

SEQ ID NO: 831064 - RNA, 18 nt, Mycobacterium avium subsp. paratuberculosis
cuugaacgccgcccccgc

SEQ ID NO: 831065 - RNA, 19 nt, Mycobacterium avium subsp. paratuberculosis
cuugaacgcguacagcgcc

SEQ ID NO: 831066 - RNA, 15 nt, Mycobacterium avium subsp. paratuberculosis
cuugaacucggccag

SEQ ID NO: 831067 - RNA, 13 nt, Mycobacterium avium subsp. paratuberculosis
cuugaccaggaug

SEQ ID NO: 831068 - RNA, 19 nt, Mycobacterium avium subsp. paratuberculosis
cuugacccgcaaggccgcc

SEQ ID NO: 831069 - RNA, 20 nt, Mycobacterium avium subsp. paratuberculosis
cuugacccgcaaggccgcca

SEQ ID NO: 831070 - RNA, 16 nt, Mycobacterium avium subsp. paratuberculosis
cuugacccggccgcac

SEQ ID NO: 831071 - RNA, 13 nt, Mycobacterium avium subsp. paratuberculosis
cuugaccgcagcc

SEQ ID NO: 831072 - RNA, 20 nt, Mycobacterium avium subsp. paratuberculosis
cuugaccacccggucgacga

SEQ ID NO: 831073 - RNA, 14 nt, Mycobacterium avium subsp. paratuberculosis
cuugacggccgcgg

SEQ ID NO: 831074 - RNA, 15 nt, Mycobacterium avium subsp. paratuberculosis
cuugacggccgcggc

SEQ ID NO: 831075 - RNA, 16 nt, Mycobacterium avium subsp. paratuberculosis
cuugacggccgcggcg

SEQ ID NO: 831076 - RNA, 19 nt, Mycobacterium avium subsp. paratuberculosis
cuugacggccgcggcggug

SEQ ID NO: 831077 - RNA, 23 nt, Mycobacterium avium subsp. paratuberculosis
cuugacggccgcggcggugccgg

SEQ ID NO: 831078 - RNA, 14 nt, Mycobacterium avium subsp. paratuberculosis
cuugacggccgggc

SEQ ID NO: 831079 - RNA, 13 nt, Mycobacterium avium subsp. paratuberculosis
cuugacggcgacg

SEQ ID NO: 831080 - RNA, 13 nt, Mycobacterium avium subsp. paratuberculosis
cuugaccuugggc

SEQ ID NO: 831081 - RNA, 20 nt, Mycobacterium avium subsp. paratuberculosis
cuugaccuugggcauccgcu

SEQ ID NO: 831082 - RNA, 17 nt, Mycobacterium avium subsp. paratuberculosis
cuugaccggcucgccgg

SEQ ID NO: 831083 - RNA, 14 nt, Mycobacterium avium subsp. paratuberculosis
cuugaccgggcucc

SEQ ID NO: 831084 - RNA, 20 nt, Mycobacterium avium subsp. paratuberculosis
cuugagcgccagcgcggugc

SEQ ID NO: 831085 - RNA, 14 nt, Mycobacterium avium subsp. paratuberculosis
cuugagcgcgucgu

SEQ ID NO: 831086 - RNA, 14 nt, Mycobacterium avium subsp. paratuberculosis
cuugagcaccgcgu

SEQ ID NO: 831087 - RNA, 17 nt, Mycobacterium avium subsp. paratuberculosis
cuugagcaccgcgucgu

SEQ ID NO: 831088 - RNA, 20 nt, Mycobacterium avium subsp. paratuberculosis
cuugacgugcgacaccggcg

SEQ ID NO: 831089 - RNA, 23 nt, Mycobacterium avium subsp. paratuberculosis
cuugacguggaaauugcugacca

SEQ ID NO: 831090 - RNA, 23 nt, Mycobacterium avium subsp. paratuberculosis
cuugacguagaagucgauugccg

SEQ ID NO: 831091 - RNA, 18 nt, Mycobacterium avium subsp. paratuberculosis
cuugacggcuuccgcgga

SEQ ID NO: 831092 - RNA, 17 nt, Mycobacterium avium subsp. paratuberculosis
cuugacgacggccaccg

SEQ ID NO: 831093 - RNA, 16 nt, Mycobacterium avium subsp. paratuberculosis
cuugacgccgccgaac

SEQ ID NO: 831094 - RNA, 13 nt, Mycobacterium avium subsp. paratuberculosis
cuugacgccgggc

SEQ ID NO: 831095 - RNA, 16 nt, Mycobacterium avium subsp. paratuberculosis
cuugagcccgucgacg

SEQ ID NO: 831096 - RNA, 22 nt, Mycobacterium avium subsp. paratuberculosis
cuugagccgccacggggcccgc

SEQ ID NO: 831097 - RNA, 16 nt, Mycobacterium avium subsp. paratuberculosis
cuugagccgccgcggc

SEQ ID NO: 831098 - RNA, 13 nt, Mycobacterium avium subsp. paratuberculosis
cuugaugaugccg

SEQ ID NO: 831099 - RNA, 14 nt, Mycobacterium avium subsp. paratuberculosis
cuugaugaugccgg

SEQ ID NO: 831100 - RNA, 15 nt, Mycobacterium avium subsp. paratuberculosis
cuugaugaugccggc

SEQ ID NO: 831101 - RNA, 20 nt, Mycobacterium avium subsp. paratuberculosis
cuugaugaugccggccgcgu

SEQ ID NO: 831102 - RNA, 20 nt, Mycobacterium avium subsp. paratuberculosis
cuugaugaugcugucgguga

SEQ ID NO: 831103 - RNA, 20 nt, Mycobacterium avium subsp. paratuberculosis
cuugaugaugucggcggccg

SEQ ID NO: 831104 - RNA, 14 nt, Mycobacterium avium subsp. paratuberculosis
cuugaugcagcgcc

SEQ ID NO: 831105 - RNA, 21 nt, Mycobacterium avium subsp. paratuberculosis
cuugaucagcgggcuguccgc

SEQ ID NO: 831106 - RNA, 16 nt, Mycobacterium avium subsp. paratuberculosis
cuugaucaggucgccg

SEQ ID NO: 831107 - RNA, 16 nt, Mycobacterium avium subsp. paratuberculosis
cuugauccggccgcgg

SEQ ID NO: 831108 - RNA, 17 nt, Mycobacterium avium subsp. paratuberculosis
cuugauccggccgcgga

SEQ ID NO: 831109 - RNA, 15 nt, Mycobacterium avium subsp. paratuberculosis
cuugaucgcacccau

SEQ ID NO: 831110 - RNA, 15 nt, Mycobacterium avium subsp. paratuberculosis
cuugaucucggcggc

SEQ ID NO: 831111 - RNA, 17 nt, Mycobacterium avium subsp. paratuberculosis
cuugaucucgucgcggc

SEQ ID NO: 831112 - RNA, 20 nt, Mycobacterium avium subsp. paratuberculosis
cuugaucucgucgcggcugc

SEQ ID NO: 831113 - RNA, 23 nt, Mycobacterium avium subsp. paratuberculosis
cuugagcuucccggcggucgccg

SEQ ID NO: 831114 - RNA, 15 nt, Mycobacterium avium subsp. paratuberculosis
cuugaugaacgccuc

SEQ ID NO: 831115 - RNA, 13 nt, Mycobacterium avium subsp. paratuberculosis
cuugcaaggcggg

SEQ ID NO: 831116 - RNA, 15 nt, Mycobacterium avium subsp. paratuberculosis
cuugcacccagcgga

SEQ ID NO: 831117 - RNA, 18 nt, Mycobacterium avium subsp. paratuberculosis
cuugcagcuguccugcca

SEQ ID NO: 831118 - RNA, 20 nt, Mycobacterium avium subsp. paratuberculosis
cuugcagcuguccugccaga

SEQ ID NO: 831119 - RNA, 14 nt, Mycobacterium avium subsp. paratuberculosis
cuuccaccugcggu

SEQ ID NO: 831120 - RNA, 23 nt, Mycobacterium avium subsp. paratuberculosis
cuuccagcccguugucgagcacc

SEQ ID NO: 831121 - RNA, 14 nt, Mycobacterium avium subsp. paratuberculosis
cuuccagcaccacc

SEQ ID NO: 831122 - RNA, 18 nt, Mycobacterium avium subsp. paratuberculosis
cuucccacagucgcuggg

SEQ ID NO: 831123 - RNA, 14 nt, Mycobacterium avium subsp. paratuberculosis
cuucccggccgcca

SEQ ID NO: 831124 - RNA, 12 nt, Mycobacterium avium subsp. paratuberculosis
cuucccggcggu

SEQ ID NO: 831125 - RNA, 18 nt, Mycobacterium avium subsp. paratuberculosis
cuucccaaccccgggcgg

SEQ ID NO: 831126 - RNA, 19 nt, Mycobacterium avium subsp. paratuberculosis
cuucccagugccgcaggug

SEQ ID NO: 831127 - RNA, 23 nt, Mycobacterium avium subsp. paratuberculosis
cuuccccggcggccggccccggc

SEQ ID NO: 831128 - RNA, 15 nt, Mycobacterium avium subsp. paratuberculosis
cuucacaggccgccu

SEQ ID NO: 831129 - RNA, 14 nt, Mycobacterium avium subsp. paratuberculosis
cuuccaccaccgcg

SEQ ID NO: 831130 - RNA, 20 nt, Mycobacterium avium subsp. paratuberculosis
cuuccaccaccgcggcgccg

SEQ ID NO: 831131 - RNA, 14 nt, Mycobacterium avium subsp. paratuberculosis
cuucauggucgucg

SEQ ID NO: 831132 - RNA, 22 nt, Mycobacterium avium subsp. paratuberculosis
cuucaccagggugccccgcgac

SEQ ID NO: 831133 - RNA, 19 nt, Mycobacterium avium subsp. paratuberculosis
cuuccgagacguggucggg

SEQ ID NO: 831134 - RNA, 15 nt, Mycobacterium avium subsp. paratuberculosis
cuuccgcccggcgag

SEQ ID NO: 831135 - RNA, 13 nt, Mycobacterium avium subsp. paratuberculosis
cuuccgccgagac

SEQ ID NO: 831136 - RNA, 15 nt, Mycobacterium avium subsp. paratuberculosis
cuuccgccgagacgg

SEQ ID NO: 831137 - RNA, 19 nt, Mycobacterium avium subsp. paratuberculosis
cuuccgccgagucgcgccg

SEQ ID NO: 831138 - RNA, 23 nt, Mycobacterium avium subsp. paratuberculosis
cuuccgccgagucgcgccgcguc

SEQ ID NO: 831139 - RNA, 23 nt, Mycobacterium avium subsp. paratuberculosis
cuucgagccgggcgcgggcgccg

SEQ ID NO: 831140 - RNA, 14 nt, Mycobacterium avium subsp. paratuberculosis
cuucgacggugaug

SEQ ID NO: 831141 - RNA, 15 nt, Mycobacterium avium subsp. paratuberculosis
cuucgacggccggcc

SEQ ID NO: 831142 - RNA, 12 nt, Mycobacterium avium subsp. paratuberculosis
cuucgacccgca

SEQ ID NO: 831143 - RNA, 22 nt, Mycobacterium avium subsp. paratuberculosis
cuucgacccgcauccgccgggc

SEQ ID NO: 831144 - RNA, 21 nt, Mycobacterium avium subsp. paratuberculosis
cuucgacccgguagcgcagca

SEQ ID NO: 831145 - RNA, 16 nt, Mycobacterium avium subsp. paratuberculosis
cuucgaaaagcuguug

SEQ ID NO: 831146 - RNA, 14 nt, Mycobacterium avium subsp. paratuberculosis
cuucgaacgcgacg

SEQ ID NO: 831147 - RNA, 23 nt, Mycobacterium avium subsp. paratuberculosis
cuuccgggaagucgucguugagc

SEQ ID NO: 831148 - RNA, 17 nt, Mycobacterium avium subsp. paratuberculosis
cuucuugcugcccgcgg

SEQ ID NO: 831149 - RNA, 15 nt, Mycobacterium avium subsp. paratuberculosis
cuucuuggccgcggc

SEQ ID NO: 831150 - RNA, 22 nt, Mycobacterium avium subsp. paratuberculosis
cuucuucagccccucggggcug

SEQ ID NO: 831151 - RNA, 17 nt, Mycobacterium avium subsp. paratuberculosis
cuucuucagccgcagcu

SEQ ID NO: 831152 - RNA, 16 nt, Mycobacterium avium subsp. paratuberculosis
cuucuuggcggcggcc

SEQ ID NO: 831153 - RNA, 18 nt, Mycobacterium avium subsp. paratuberculosis
cuucuuggcggcggccuu

SEQ ID NO: 831154 - RNA, 23 nt, Mycobacterium avium subsp. paratuberculosis
cuucugcgccgguucgcuggcgg

SEQ ID NO: 831155 - RNA, 14 nt, Mycobacterium avium subsp. paratuberculosis
cuucugcgcgccgu

SEQ ID NO: 831156 - RNA, 15 nt, Mycobacterium avium subsp. paratuberculosis
cuucucggacgcccg

SEQ ID NO: 831157 - RNA, 18 nt, Mycobacterium avium subsp. paratuberculosis
cuucucggugucgucgac

SEQ ID NO: 831158 - RNA, 19 nt, Mycobacterium avium subsp. paratuberculosis
cuucugccacucgucgaug

SEQ ID NO: 831159 - RNA, 14 nt, Mycobacterium avium subsp. paratuberculosis
cuucgccagcgggc

SEQ ID NO: 831160 - RNA, 22 nt, Mycobacterium avium subsp. paratuberculosis
cuucgccgcaaccuucuuggcc

SEQ ID NO: 831161 - RNA, 13 nt, Mycobacterium avium subsp. paratuberculosis
cuucgccgcagcc

SEQ ID NO: 831162 - RNA, 17 nt, Mycobacterium avium subsp. paratuberculosis
cuucggcuuucucgcca

SEQ ID NO: 831163 - RNA, 23 nt, Mycobacterium avium subsp. paratuberculosis
cuucgccggggccuucuuggcgg

SEQ ID NO: 831164 - RNA, 13 nt, Mycobacterium avium subsp. paratuberculosis
cuucgggaucagc

SEQ ID NO: 831165 - RNA, 20 nt, Mycobacterium avium subsp. paratuberculosis
cuucggggauguagccgccg

SEQ ID NO: 831166 - RNA, 19 nt, Mycobacterium avium subsp. paratuberculosis
cuucggggguggccagcuu

SEQ ID NO: 831167 - RNA, 17 nt, Mycobacterium avium subsp. paratuberculosis
cuucggucaucgugauc

SEQ ID NO: 831168 - RNA, 13 nt, Mycobacterium avium subsp. paratuberculosis
cuucggucccggc

SEQ ID NO: 831169 - RNA, 16 nt, Mycobacterium avium subsp. paratuberculosis
cuucggucccggcggg

SEQ ID NO: 831170 - RNA, 18 nt, Mycobacterium avium subsp. paratuberculosis
cuucggucgcgacccggu

SEQ ID NO: 831171 - RNA, 19 nt, Mycobacterium avium subsp. paratuberculosis
cuucggucgcgacccgguc

SEQ ID NO: 831172 - RNA, 15 nt, Mycobacterium avium subsp. paratuberculosis
cuucgggucgccggu

SEQ ID NO: 831173 - RNA, 14 nt, Mycobacterium avium subsp. paratuberculosis
cuucuacggcgggc

SEQ ID NO: 831174 - RNA, 21 nt, Mycobacterium avium subsp. paratuberculosis
cuucguaacacccucggucgg

SEQ ID NO: 831175 - RNA, 13 nt, Mycobacterium avium subsp. paratuberculosis
cuucuccacgccg

SEQ ID NO: 831176 - RNA, 15 nt, Mycobacterium avium subsp. paratuberculosis
cuucucccgcggcag

SEQ ID NO: 831177 - RNA, 15 nt, Mycobacterium avium subsp. paratuberculosis
cuucuccgccggcag

SEQ ID NO: 831178 - RNA, 14 nt, Mycobacterium avium subsp. paratuberculosis
cuucuccgccgggc

SEQ ID NO: 831179 - RNA, 14 nt, Mycobacterium avium subsp. paratuberculosis
cuucuccgcggccg

SEQ ID NO: 831180 - RNA, 19 nt, Mycobacterium avium subsp. paratuberculosis
cuucuccgcggccgcgcgc

SEQ ID NO: 831181 - RNA, 16 nt, Mycobacterium avium subsp. paratuberculosis
cuucucgcgcaccgcg

SEQ ID NO: 831182 - RNA, 23 nt, Mycobacterium avium subsp. paratuberculosis
cuucucgaaccggggcaccacgu

SEQ ID NO: 831183 - RNA, 14 nt, Mycobacterium avium subsp. paratuberculosis
cuucaaaaaccugu

SEQ ID NO: 831184 - RNA, 21 nt, Mycobacterium avium subsp. paratuberculosis
cuucaacuugcgcgacgccgu

SEQ ID NO: 831185 - RNA, 18 nt, Mycobacterium avium subsp. paratuberculosis
cuuacgccggggucgaca

SEQ ID NO: 831186 - RNA, 22 nt, Mycobacterium avium subsp. paratuberculosis
cuguuggccagauacuccucgg

SEQ ID NO: 831187 - RNA, 16 nt, Mycobacterium avium subsp. paratuberculosis
cuuaccggcgggcggc

SEQ ID NO: 831188 - RNA, 14 nt, Mycobacterium avium subsp. paratuberculosis
cuggucgaacagca

SEQ ID NO: 831189 - RNA, 18 nt, Mycobacterium avium subsp. paratuberculosis
cuggucgaacagcacgcc

SEQ ID NO: 831190 - RNA, 19 nt, Mycobacterium avium subsp. paratuberculosis
cuggucgaacagcacgccg

SEQ ID NO: 831191 - RNA, 22 nt, Mycobacterium avium subsp. paratuberculosis
cuggucgaacagcacgccggcc

SEQ ID NO: 831192 - RNA, 23 nt, Mycobacterium avium subsp. paratuberculosis
cuggucgaacagcacgccggccg

SEQ ID NO: 831193 - RNA, 12 nt, Mycobacterium avium subsp. paratuberculosis
cuguccugcggu

SEQ ID NO: 831194 - RNA, 22 nt, Mycobacterium avium subsp. paratuberculosis
cuguccugcgguucgggcccca

SEQ ID NO: 831195 - RNA, 19 nt, Mycobacterium avium subsp. paratuberculosis
cuguccggucucggucgcg

SEQ ID NO: 831196 - RNA, 21 nt, Mycobacterium avium subsp. paratuberculosis
cuguccggucucggucgcggc

SEQ ID NO: 831197 - RNA, 14 nt, Mycobacterium avium subsp. paratuberculosis
cuguccucccagcg

SEQ ID NO: 831198 - RNA, 22 nt, Mycobacterium avium subsp. paratuberculosis
cuguccgcgugaaugcccagcg

SEQ ID NO: 831199 - RNA, 21 nt, Mycobacterium avium subsp. paratuberculosis
cuguccugccgggcgucgacg

SEQ ID NO: 831200 - RNA, 12 nt, Mycobacterium avium subsp. paratuberculosis
cugucgaacacc

SEQ ID NO: 831201 - RNA, 20 nt, Mycobacterium avium subsp. paratuberculosis
cugucgaacaccgugccguc

SEQ ID NO: 831202 - RNA, 16 nt, Mycobacterium avium subsp. paratuberculosis
cuguccgggucguagc

SEQ ID NO: 831203 - RNA, 17 nt, Mycobacterium avium subsp. paratuberculosis
cugucgucgaccaacgc

SEQ ID NO: 831204 - RNA, 20 nt, Mycobacterium avium subsp. paratuberculosis
cugucgucgaccaacgccau

SEQ ID NO: 831205 - RNA, 16 nt, Mycobacterium avium subsp. paratuberculosis
cugugaggcaccgaac

SEQ ID NO: 831206 - RNA, 16 nt, Mycobacterium avium subsp. paratuberculosis
cugugcugccugccgu

SEQ ID NO: 831207 - RNA, 15 nt, Mycobacterium avium subsp. paratuberculosis
cuguggaacacgucg

SEQ ID NO: 831208 - RNA, 23 nt, Mycobacterium avium subsp. paratuberculosis
cuguggaagggccccggcaucga

SEQ ID NO: 831209 - RNA, 15 nt, Mycobacterium avium subsp. paratuberculosis
cugugaucgcugacg

SEQ ID NO: 831210 - RNA, 15 nt, Mycobacterium avium subsp. paratuberculosis
cuguggacaggucga

SEQ ID NO: 831211 - RNA, 23 nt, Mycobacterium avium subsp. paratuberculosis
cuguggaucgugucuggccccgu

SEQ ID NO: 831212 - RNA, 12 nt, Mycobacterium avium subsp. paratuberculosis
cuguggugacgg

SEQ ID NO: 831213 - RNA, 13 nt, Mycobacterium avium subsp. paratuberculosis
cugugggucgaca

SEQ ID NO: 831214 - RNA, 21 nt, Mycobacterium avium subsp. paratuberculosis
cuguuaagacuucggcgaacu

SEQ ID NO: 831215 - RNA, 23 nt, Mycobacterium avium subsp. paratuberculosis
cugcuaccuagcuugggugagcu

SEQ ID NO: 831216 - RNA, 16 nt, Mycobacterium avium subsp. paratuberculosis
cugcguucggcgauca

SEQ ID NO: 831217 - RNA, 20 nt, Mycobacterium avium subsp. paratuberculosis
cugcguugcggcacaggcga

SEQ ID NO: 831218 - RNA, 18 nt, Mycobacterium avium subsp. paratuberculosis
cugcguguggcgcacgcc

SEQ ID NO: 831219 - RNA, 18 nt, Mycobacterium avium subsp. paratuberculosis
cugcgugcugggcaccgu

SEQ ID NO: 831220 - RNA, 20 nt, Mycobacterium avium subsp. paratuberculosis
cugcgucaucggcucgaucg

SEQ ID NO: 831221 - RNA, 20 nt, Mycobacterium avium subsp. paratuberculosis
cugcgucauggagaucaccg

SEQ ID NO: 831222 - RNA, 23 nt, Mycobacterium avium subsp. paratuberculosis
cugcgucauggagaucaccgcgu

SEQ ID NO: 831223 - RNA, 21 nt, Mycobacterium avium subsp. paratuberculosis
cugcguccgauaccagccgcg

SEQ ID NO: 831224 - RNA, 16 nt, Mycobacterium avium subsp. paratuberculosis
cugcguccggcccggc

SEQ ID NO: 831225 - RNA, 18 nt, Mycobacterium avium subsp. paratuberculosis
cugcguccggcccggcgu

SEQ ID NO: 831226 - RNA, 20 nt, Mycobacterium avium subsp. paratuberculosis
cugcgucggcaccagcggca

SEQ ID NO: 831227 - RNA, 18 nt, Mycobacterium avium subsp. paratuberculosis
cugcgugcccggaucgcc

SEQ ID NO: 831228 - RNA, 20 nt, Mycobacterium avium subsp. paratuberculosis
cugcgugcccggaucgccga

SEQ ID NO: 831229 - RNA, 23 nt, Mycobacterium avium subsp. paratuberculosis
cugcgugcccggaucgccgaacg

SEQ ID NO: 831230 - RNA, 21 nt, Mycobacterium avium subsp. paratuberculosis
cugcggcugggucggucccga

SEQ ID NO: 831231 - RNA, 20 nt, Mycobacterium avium subsp. paratuberculosis
cugcggcugguagaugccga

SEQ ID NO: 831232 - RNA, 20 nt, Mycobacterium avium subsp. paratuberculosis
cugcgggaacagcgggaaca

SEQ ID NO: 831233 - RNA, 20 nt, Mycobacterium avium subsp. paratuberculosis
cugcggcugcaucaugccgc

SEQ ID NO: 831234 - RNA, 23 nt, Mycobacterium avium subsp. paratuberculosis
cugcgggaacgucauggccagcu

SEQ ID NO: 831235 - RNA, 17 nt, Mycobacterium avium subsp. paratuberculosis
cugcgggaagccgaguu

SEQ ID NO: 831236 - RNA, 21 nt, Mycobacterium avium subsp. paratuberculosis
cugcgggaccagcgccucggc

SEQ ID NO: 831237 - RNA, 14 nt, Mycobacterium avium subsp. paratuberculosis
cugcgggacgccgu

SEQ ID NO: 831238 - RNA, 13 nt, Mycobacterium avium subsp. paratuberculosis
cugcgggcgccgg

SEQ ID NO: 831239 - RNA, 14 nt, Mycobacterium avium subsp. paratuberculosis
cugcgggcgccggc

SEQ ID NO: 831240 - RNA, 17 nt, Mycobacterium avium subsp. paratuberculosis
cugcgggcgccggcugc

SEQ ID NO: 831241 - RNA, 18 nt, Mycobacterium avium subsp. paratuberculosis
cugcgggcgccggcugcc

SEQ ID NO: 831242 - RNA, 15 nt, Mycobacterium avium subsp. paratuberculosis
cugcgggccagcgca

SEQ ID NO: 831243 - RNA, 11 nt, Mycobacterium avium subsp. paratuberculosis
cugcgggccca

SEQ ID NO: 831244 - RNA, 21 nt, Mycobacterium avium subsp. paratuberculosis
cugcgggcccaccgcgcgcug

SEQ ID NO: 831245 - RNA, 22 nt, Mycobacterium avium subsp. paratuberculosis
cugcgggcccaccgcgcgcugc

SEQ ID NO: 831246 - RNA, 22 nt, Mycobacterium avium subsp. paratuberculosis
cugcgggcccagcucggugcgc

SEQ ID NO: 831247 - RNA, 13 nt, Mycobacterium avium subsp. paratuberculosis
cugcggcucggcg

SEQ ID NO: 831248 - RNA, 16 nt, Mycobacterium avium subsp. paratuberculosis
cugcggcucgucggcg

SEQ ID NO: 831249 - RNA, 16 nt, Mycobacterium avium subsp. paratuberculosis
cugcggcggccgcagc

SEQ ID NO: 831250 - RNA, 14 nt, Mycobacterium avium subsp. paratuberculosis
cugcggcgccgggc

SEQ ID NO: 831251 - RNA, 16 nt, Mycobacterium avium subsp. paratuberculosis
cugcggcgcggccacc

SEQ ID NO: 831252 - RNA, 19 nt, Mycobacterium avium subsp. paratuberculosis
cugcggugagcugaucgcg

SEQ ID NO: 831253 - RNA, 17 nt, Mycobacterium avium subsp. paratuberculosis
cugcggugaugcgcggc

SEQ ID NO: 831254 - RNA, 18 nt, Mycobacterium avium subsp. paratuberculosis
cugcggugaugcgcggcg

SEQ ID NO: 831255 - RNA, 19 nt, Mycobacterium avium subsp. paratuberculosis
cugcggugaugcgcggcga

SEQ ID NO: 831256 - RNA, 17 nt, Mycobacterium avium subsp. paratuberculosis
cugcgguucacaaaggc

SEQ ID NO: 831257 - RNA, 19 nt, Mycobacterium avium subsp. paratuberculosis
cugcgguucgucgcggcgg

SEQ ID NO: 831258 - RNA, 15 nt, Mycobacterium avium subsp. paratuberculosis
cugcgguuggccggc

SEQ ID NO: 831259 - RNA, 18 nt, Mycobacterium avium subsp. paratuberculosis
cugcgguuggccggccgg

SEQ ID NO: 831260 - RNA, 19 nt, Mycobacterium avium subsp. paratuberculosis
cugcgguacacguggccga

SEQ ID NO: 831261 - RNA, 21 nt, Mycobacterium avium subsp. paratuberculosis
cugcgguacacguggccgauc

SEQ ID NO: 831262 - RNA, 17 nt, Mycobacterium avium subsp. paratuberculosis
cugcgguaugccaagcc

SEQ ID NO: 831263 - RNA, 14 nt, Mycobacterium avium subsp. paratuberculosis
cugcgggcgggccg

SEQ ID NO: 831264 - RNA, 21 nt, Mycobacterium avium subsp. paratuberculosis
cugcggggccuucucgccguu

SEQ ID NO: 831265 - RNA, 15 nt, Mycobacterium avium subsp. paratuberculosis
cugcgggucagcagc

SEQ ID NO: 831266 - RNA, 16 nt, Mycobacterium avium subsp. paratuberculosis
cugcgggucagcagcu

SEQ ID NO: 831267 - RNA, 13 nt, Mycobacterium avium subsp. paratuberculosis
cugcgggucucgc

SEQ ID NO: 831268 - RNA, 13 nt, Mycobacterium avium subsp. paratuberculosis
cugcgggugcggc

SEQ ID NO: 831269 - RNA, 15 nt, Mycobacterium avium subsp. paratuberculosis
cugcgggugcucagc

SEQ ID NO: 831270 - RNA, 23 nt, Mycobacterium avium subsp. paratuberculosis
cugcucguugugcauguggccgu

SEQ ID NO: 831271 - RNA, 15 nt, Mycobacterium avium subsp. paratuberculosis
cugcucugcgcgcgg

SEQ ID NO: 831272 - RNA, 18 nt, Mycobacterium avium subsp. paratuberculosis
cugcucugcgcgcggugc

SEQ ID NO: 831273 - RNA, 14 nt, Mycobacterium avium subsp. paratuberculosis
cugcucggugaugc

SEQ ID NO: 831274 - RNA, 17 nt, Mycobacterium avium subsp. paratuberculosis
cugcucggugaugccga

SEQ ID NO: 831275 - RNA, 17 nt, Mycobacterium avium subsp. paratuberculosis
cugcucguccuggcgcu

SEQ ID NO: 831276 - RNA, 19 nt, Mycobacterium avium subsp. paratuberculosis
cugcucguccuggcgcugg

SEQ ID NO: 831277 - RNA, 16 nt, Mycobacterium avium subsp. paratuberculosis
cugcucgugcaaaccg

SEQ ID NO: 831278 - RNA, 21 nt, Mycobacterium avium subsp. paratuberculosis
cugcucgugcaaaccggaccg

SEQ ID NO: 831279 - RNA, 14 nt, Mycobacterium avium subsp. paratuberculosis
cugcucguucguca

SEQ ID NO: 831280 - RNA, 20 nt, Mycobacterium avium subsp. paratuberculosis
cugcucguucgucaugacga

SEQ ID NO: 831281 - RNA, 20 nt, Mycobacterium avium subsp. paratuberculosis
cugcucuucgcgcgcggcgu

SEQ ID NO: 831282 - RNA, 22 nt, Mycobacterium avium subsp. paratuberculosis
cugcucuucgcgcgcggcgugg

SEQ ID NO: 831283 - RNA, 15 nt, Mycobacterium avium subsp. paratuberculosis
cugcugccgccgcag

SEQ ID NO: 831284 - RNA, 24 nt, Mycobacterium avium subsp. paratuberculosis
cugcugcgcagacccgguggccga

SEQ ID NO: 831285 - RNA, 15 nt, Mycobacterium avium subsp. paratuberculosis
cugcugcagcgcccg

SEQ ID NO: 831286 - RNA, 19 nt, Mycobacterium avium subsp. paratuberculosis
cugcugcacguccgccucc

SEQ ID NO: 831287 - RNA, 17 nt, Mycobacterium avium subsp. paratuberculosis
cugcugcacgucgccgg

SEQ ID NO: 831288 - RNA, 20 nt, Mycobacterium avium subsp. paratuberculosis
cugcucgcagauggucggga

SEQ ID NO: 831289 - RNA, 23 nt, Mycobacterium avium subsp. paratuberculosis
cugcucgcagauggucgggacgu

SEQ ID NO: 831290 - RNA, 20 nt, Mycobacterium avium subsp. paratuberculosis
cugcucgaucucggccaccg

SEQ ID NO: 831291 - RNA, 13 nt, Mycobacterium avium subsp. paratuberculosis
cugcucgccguca

SEQ ID NO: 831292 - RNA, 15 nt, Mycobacterium avium subsp. paratuberculosis
cugcucgccggcuac

SEQ ID NO: 831293 - RNA, 13 nt, Mycobacterium avium subsp. paratuberculosis
cugcucgcgcccu

SEQ ID NO: 831294 - RNA, 12 nt, Mycobacterium avium subsp. paratuberculosis
cugcucgguguc

SEQ ID NO: 831295 - RNA, 14 nt, Mycobacterium avium subsp. paratuberculosis
cugcucggccaccg

SEQ ID NO: 831296 - RNA, 13 nt, Mycobacterium avium subsp. paratuberculosis
cugcucggcgggu

SEQ ID NO: 831297 - RNA, 16 nt, Mycobacterium avium subsp. paratuberculosis
cugcucgcuguggcgg

SEQ ID NO: 831298 - RNA, 22 nt, Mycobacterium avium subsp. paratuberculosis
cugcucgcuugccagccgggcc

SEQ ID NO: 831299 - RNA, 19 nt, Mycobacterium avium subsp. paratuberculosis
cugcucgcgguuccugcgc

SEQ ID NO: 831300 - RNA, 15 nt, Mycobacterium avium subsp. paratuberculosis
cugcucggccagcgg

SEQ ID NO: 831301 - RNA, 13 nt, Mycobacterium avium subsp. paratuberculosis
cugcucggccgca

SEQ ID NO: 831302 - RNA, 16 nt, Mycobacterium avium subsp. paratuberculosis
cugcucggccgcaucg

SEQ ID NO: 831303 - RNA, 20 nt, Mycobacterium avium subsp. paratuberculosis
cugcucgaugcgcgccagca

SEQ ID NO: 831304 - RNA, 22 nt, Mycobacterium avium subsp. paratuberculosis
cugcucgaugcgcgccagcagc

SEQ ID NO: 831305 - RNA, 17 nt, Mycobacterium avium subsp. paratuberculosis
cugcucgagggccucca

SEQ ID NO: 831306 - RNA, 23 nt, Mycobacterium avium subsp. paratuberculosis
cugcucgagggccuccaccacca

SEQ ID NO: 831307 - RNA, 22 nt, Mycobacterium avium subsp. paratuberculosis
cugcuccucgaaccucgcggcg

SEQ ID NO: 831308 - RNA, 15 nt, Mycobacterium avium subsp. paratuberculosis
cugcucgaccagccc

SEQ ID NO: 831309 - RNA, 16 nt, Mycobacterium avium subsp. paratuberculosis
cugcucgaccagcccc

SEQ ID NO: 831310 - RNA, 14 nt, Mycobacterium avium subsp. paratuberculosis
cugcucgaccagcg

SEQ ID NO: 831311 - RNA, 17 nt, Mycobacterium avium subsp. paratuberculosis
cugcucgaccucggcga

SEQ ID NO: 831312 - RNA, 19 nt, Mycobacterium avium subsp. paratuberculosis
cugcucgaccucggcgacc

SEQ ID NO: 831313 - RNA, 22 nt, Mycobacterium avium subsp. paratuberculosis
cugcucgaccucggcgaccagc

SEQ ID NO: 831314 - RNA, 14 nt, Mycobacterium avium subsp. paratuberculosis
cugcucccaggacg

SEQ ID NO: 831315 - RNA, 18 nt, Mycobacterium avium subsp. paratuberculosis
cugcucccaggacggcgc

SEQ ID NO: 831316 - RNA, 20 nt, Mycobacterium avium subsp. paratuberculosis
cugcucccaggcgucgucgu

SEQ ID NO: 831317 - RNA, 15 nt, Mycobacterium avium subsp. paratuberculosis
cugcgccucgaucag

SEQ ID NO: 831318 - RNA, 23 nt, Mycobacterium avium subsp. paratuberculosis
cugcgccgugaagggcccgccgg

SEQ ID NO: 831319 - RNA, 19 nt, Mycobacterium avium subsp. paratuberculosis
cugcgccgucaccggcugc

SEQ ID NO: 831320 - RNA, 15 nt, Mycobacterium avium subsp. paratuberculosis
cugcgccgucaucga

SEQ ID NO: 831321 - RNA, 20 nt, Mycobacterium avium subsp. paratuberculosis
cugcgccgucaucgacaccg

SEQ ID NO: 831322 - RNA, 17 nt, Mycobacterium avium subsp. paratuberculosis
cugcgccggggccgcgg

SEQ ID NO: 831323 - RNA, 18 nt, Mycobacterium avium subsp. paratuberculosis
cugcgccggcgcggccag

SEQ ID NO: 831324 - RNA, 13 nt, Mycobacterium avium subsp. paratuberculosis
cugcgccggcggu

SEQ ID NO: 831325 - RNA, 14 nt, Mycobacterium avium subsp. paratuberculosis
cugcgccggcggug

SEQ ID NO: 831326 - RNA, 18 nt, Mycobacterium avium subsp. paratuberculosis
cugcgccggcggugucga

SEQ ID NO: 831327 - RNA, 24 nt, Mycobacterium avium subsp. paratuberculosis
cugcgccggcuuucgaagagccgg

SEQ ID NO: 831328 - RNA, 14 nt, Mycobacterium avium subsp. paratuberculosis
cugcgccgacuuga

SEQ ID NO: 831329 - RNA, 23 nt, Mycobacterium avium subsp. paratuberculosis
cugcgccgccuccgggcugccgu

SEQ ID NO: 831330 - RNA, 12 nt, Mycobacterium avium subsp. paratuberculosis
cugcgccgcggu

SEQ ID NO: 831331 - RNA, 17 nt, Mycobacterium avium subsp. paratuberculosis
cugcgccgcgucgacgc

SEQ ID NO: 831332 - RNA, 19 nt, Mycobacterium avium subsp. paratuberculosis
cugcgccgcgucgacgccg

SEQ ID NO: 831333 - RNA, 16 nt, Mycobacterium avium subsp. paratuberculosis
cugcgccagccgucgc

SEQ ID NO: 831334 - RNA, 15 nt, Mycobacterium avium subsp. paratuberculosis
cugcgccagcagcag

SEQ ID NO: 831335 - RNA, 16 nt, Mycobacterium avium subsp. paratuberculosis
cugcgccagcagcagc

SEQ ID NO: 831336 - RNA, 15 nt, Mycobacterium avium subsp. paratuberculosis
cugcgccagcugggu

SEQ ID NO: 831337 - RNA, 19 nt, Mycobacterium avium subsp. paratuberculosis
cugcgccagcuccagcagc

SEQ ID NO: 831338 - RNA, 23 nt, Mycobacterium avium subsp. paratuberculosis
cugcgccaggauccgcccgccgg

SEQ ID NO: 831339 - RNA, 12 nt, Mycobacterium avium subsp. paratuberculosis
cugcgccccggc

SEQ ID NO: 831340 - RNA, 15 nt, Mycobacterium avium subsp. paratuberculosis
cugcgccccggcguc

SEQ ID NO: 831341 - RNA, 16 nt, Mycobacterium avium subsp. paratuberculosis
cugcgcccgaucggcg

SEQ ID NO: 831342 - RNA, 13 nt, Mycobacterium avium subsp. paratuberculosis
cugcgcaccgcgg

SEQ ID NO: 831343 - RNA, 13 nt, Mycobacterium avium subsp. paratuberculosis
cugcgcacccggu

SEQ ID NO: 831344 - RNA, 17 nt, Mycobacterium avium subsp. paratuberculosis
cugcgcaccgccagcac

SEQ ID NO: 831345 - RNA, 18 nt, Mycobacterium avium subsp. paratuberculosis
cugcgcaccgccagcacc

SEQ ID NO: 831346 - RNA, 19 nt, Mycobacterium avium subsp. paratuberculosis
cugcgcaccgccagcaccg

SEQ ID NO: 831347 - RNA, 20 nt, Mycobacterium avium subsp. paratuberculosis
cugcgcaccgccagcaccga

SEQ ID NO: 831348 - RNA, 22 nt, Mycobacterium avium subsp. paratuberculosis
cugcgcacguagcccagcgcgu

SEQ ID NO: 831349 - RNA, 16 nt, Mycobacterium avium subsp. paratuberculosis
cugcgcagcaccgucc

SEQ ID NO: 831350 - RNA, 17 nt, Mycobacterium avium subsp. paratuberculosis
cugcgcagcagcgccag

SEQ ID NO: 831351 - RNA, 14 nt, Mycobacterium avium subsp. paratuberculosis
cugcgcagccgugc

SEQ ID NO: 831352 - RNA, 17 nt, Mycobacterium avium subsp. paratuberculosis
cugcgcagccgugccca

SEQ ID NO: 831353 - RNA, 13 nt, Mycobacterium avium subsp. paratuberculosis
cugcgcagcgcag

SEQ ID NO: 831354 - RNA, 17 nt, Mycobacterium avium subsp. paratuberculosis
cugcgcagcgcagcacc

SEQ ID NO: 831355 - RNA, 13 nt, Mycobacterium avium subsp. paratuberculosis
cugcgaucgccga

SEQ ID NO: 831356 - RNA, 16 nt, Mycobacterium avium subsp. paratuberculosis
cugcgaucgccgacgc

SEQ ID NO: 831357 - RNA, 17 nt, Mycobacterium avium subsp. paratuberculosis
cugcgaucgccgacgcc

SEQ ID NO: 831358 - RNA, 16 nt, Mycobacterium avium subsp. paratuberculosis
cugcgcaacaccucgg

SEQ ID NO: 831359 - RNA, 21 nt, Mycobacterium avium subsp. paratuberculosis
cugcgcaacaccucggcgacg

SEQ ID NO: 831360 - RNA, 20 nt, Mycobacterium avium subsp. paratuberculosis
cugcgaugauggucaccguc

SEQ ID NO: 831361 - RNA, 16 nt, Mycobacterium avium subsp. paratuberculosis
cugcacgaugccgacc

SEQ ID NO: 831362 - RNA, 22 nt, Mycobacterium avium subsp. paratuberculosis
cugcacgaaauaaccgcgcggc

SEQ ID NO: 831363 - RNA, 14 nt, Mycobacterium avium subsp. paratuberculosis
cugcacgacgaccg

SEQ ID NO: 831364 - RNA, 15 nt, Mycobacterium avium subsp. paratuberculosis
cugcacgacgaccgc

SEQ ID NO: 831365 - RNA, 15 nt, Mycobacterium avium subsp. paratuberculosis
cugcacgcacggcga

SEQ ID NO: 831366 - RNA, 22 nt, Mycobacterium avium subsp. paratuberculosis
cugcacgcaaaaaccaugccag

SEQ ID NO: 831367 - RNA, 14 nt, Mycobacterium avium subsp. paratuberculosis
cugcaccugcggca

SEQ ID NO: 831368 - RNA, 21 nt, Mycobacterium avium subsp. paratuberculosis
cugcacgaagucgaccgcggc

SEQ ID NO: 831369 - RNA, 18 nt, Mycobacterium avium subsp. paratuberculosis
cugcaccuugcccgucgc

SEQ ID NO: 831370 - RNA, 16 nt, Mycobacterium avium subsp. paratuberculosis
cugcgcgcggugcacg

SEQ ID NO: 831371 - RNA, 19 nt, Mycobacterium avium subsp. paratuberculosis
cugcgcgcguuguccagca

SEQ ID NO: 831372 - RNA, 23 nt, Mycobacterium avium subsp. paratuberculosis
cugcgcgcguuguccagcagcgc

SEQ ID NO: 831373 - RNA, 15 nt, Mycobacterium avium subsp. paratuberculosis
cugcgcggccgaacu

SEQ ID NO: 831374 - RNA, 14 nt, Mycobacterium avium subsp. paratuberculosis
cugcgcggccgcgu

SEQ ID NO: 831375 - RNA, 19 nt, Mycobacterium avium subsp. paratuberculosis
cugcgcggccgcgucggcg

SEQ ID NO: 831376 - RNA, 21 nt, Mycobacterium avium subsp. paratuberculosis
cugcgcggcggcguccgcggc

SEQ ID NO: 831377 - RNA, 22 nt, Mycobacterium avium subsp. paratuberculosis
cugcgcggcggcguccgcggcc

SEQ ID NO: 831378 - RNA, 14 nt, Mycobacterium avium subsp. paratuberculosis
cugcgcggcgaugc

SEQ ID NO: 831379 - RNA, 13 nt, Mycobacterium avium subsp. paratuberculosis
cugcgcucagcac

SEQ ID NO: 831380 - RNA, 14 nt, Mycobacterium avium subsp. paratuberculosis
cugcgcucagcacg

SEQ ID NO: 831381 - RNA, 15 nt, Mycobacterium avium subsp. paratuberculosis
cugcgcgggcgcggc

SEQ ID NO: 831382 - RNA, 19 nt, Mycobacterium avium subsp. paratuberculosis
cugcgcuaccaggcgugca

SEQ ID NO: 831383 - RNA, 16 nt, Mycobacterium avium subsp. paratuberculosis
cugcgcgucggccgca

SEQ ID NO: 831384 - RNA, 14 nt, Mycobacterium avium subsp. paratuberculosis
cugcgcgucgucgc

SEQ ID NO: 831385 - RNA, 11 nt, Mycobacterium avium subsp. paratuberculosis
cugcgcgucgg

SEQ ID NO: 831386 - RNA, 21 nt, Mycobacterium avium subsp. paratuberculosis
cugcgcgucggagaucaccgg

SEQ ID NO: 831387 - RNA, 20 nt, Mycobacterium avium subsp. paratuberculosis
cugcgcgggucggcgccggc

SEQ ID NO: 831388 - RNA, 22 nt, Mycobacterium avium subsp. paratuberculosis
cugcgcgggucggcgccggcca

SEQ ID NO: 831389 - RNA, 17 nt, Mycobacterium avium subsp. paratuberculosis
cugcgcgaaaggcccac

SEQ ID NO: 831390 - RNA, 19 nt, Mycobacterium avium subsp. paratuberculosis
cugcgcgaaaggcccaccg

SEQ ID NO: 831391 - RNA, 18 nt, Mycobacterium avium subsp. paratuberculosis
cugcgccuuuugcacccg

SEQ ID NO: 831392 - RNA, 19 nt, Mycobacterium avium subsp. paratuberculosis
cugcgccuuuugcacccgc

SEQ ID NO: 831393 - RNA, 20 nt, Mycobacterium avium subsp. paratuberculosis
cugcgccuuuugcacccgcc

SEQ ID NO: 831394 - RNA, 15 nt, Mycobacterium avium subsp. paratuberculosis
cugcgcgaccugcuu

SEQ ID NO: 831395 - RNA, 20 nt, Mycobacterium avium subsp. paratuberculosis
cugcgcgacgaauccgguga

SEQ ID NO: 831396 - RNA, 21 nt, Mycobacterium avium subsp. paratuberculosis
cugcgcgacgaauccggugac

SEQ ID NO: 831397 - RNA, 17 nt, Mycobacterium avium subsp. paratuberculosis
cugcgcgagcagaucgc

SEQ ID NO: 831398 - RNA, 14 nt, Mycobacterium avium subsp. paratuberculosis
cugcgcgaucgccg

SEQ ID NO: 831399 - RNA, 19 nt, Mycobacterium avium subsp. paratuberculosis
cugcgcgccccggcccggc

SEQ ID NO: 831400 - RNA, 13 nt, Mycobacterium avium subsp. paratuberculosis
cugcgcgcccgag

SEQ ID NO: 831401 - RNA, 12 nt, Mycobacterium avium subsp. paratuberculosis
cugcgcgccgau

SEQ ID NO: 831402 - RNA, 21 nt, Mycobacterium avium subsp. paratuberculosis
cugcgcgccgauguggccggc

SEQ ID NO: 831403 - RNA, 15 nt, Mycobacterium avium subsp. paratuberculosis
cugcgcgccggcggc

SEQ ID NO: 831404 - RNA, 17 nt, Mycobacterium avium subsp. paratuberculosis
cugcgcgccggcggccg

SEQ ID NO: 831405 - RNA, 20 nt, Mycobacterium avium subsp. paratuberculosis
cugcgcgccggcggccgccg

SEQ ID NO: 831406 - RNA, 20 nt, Mycobacterium avium subsp. paratuberculosis
cugcggcagguaggcgccgc

SEQ ID NO: 831407 - RNA, 22 nt, Mycobacterium avium subsp. paratuberculosis
cugcggcaggucggccagcgcc

SEQ ID NO: 831408 - RNA, 15 nt, Mycobacterium avium subsp. paratuberculosis
cugcggcacggugcg

SEQ ID NO: 831409 - RNA, 17 nt, Mycobacterium avium subsp. paratuberculosis
cugcggcaacagcacca

SEQ ID NO: 831410 - RNA, 13 nt, Mycobacterium avium subsp. paratuberculosis
cugcggcacacca

SEQ ID NO: 831411 - RNA, 15 nt, Mycobacterium avium subsp. paratuberculosis
cugcggcacaccagc

SEQ ID NO: 831412 - RNA, 13 nt, Mycobacterium avium subsp. paratuberculosis
cugcggcaccacg

SEQ ID NO: 831413 - RNA, 14 nt, Mycobacterium avium subsp. paratuberculosis
cugcggcaccacgc

SEQ ID NO: 831414 - RNA, 20 nt, Mycobacterium avium subsp. paratuberculosis
cugcggcgagucccggcgca

SEQ ID NO: 831415 - RNA, 21 nt, Mycobacterium avium subsp. paratuberculosis
cugcggccugcacaggggcgc

SEQ ID NO: 831416 - RNA, 23 nt, Mycobacterium avium subsp. paratuberculosis
cugcggccccugcggggugucga

SEQ ID NO: 831417 - RNA, 14 nt, Mycobacterium avium subsp. paratuberculosis
cugcggcccgucgc

SEQ ID NO: 831418 - RNA, 15 nt, Mycobacterium avium subsp. paratuberculosis
cugcggcccgucgcc

SEQ ID NO: 831419 - RNA, 19 nt, Mycobacterium avium subsp. paratuberculosis
cugcggcccgucgccgugc

SEQ ID NO: 831420 - RNA, 19 nt, Mycobacterium avium subsp. paratuberculosis
cugcggccagugccgggcc

SEQ ID NO: 831421 - RNA, 14 nt, Mycobacterium avium subsp. paratuberculosis
cugcgcucgccguc

SEQ ID NO: 831422 - RNA, 16 nt, Mycobacterium avium subsp. paratuberculosis
cugcgcucgccgucgg

SEQ ID NO: 831423 - RNA, 17 nt, Mycobacterium avium subsp. paratuberculosis
cugcgcucgccgucggc

SEQ ID NO: 831424 - RNA, 16 nt, Mycobacterium avium subsp. paratuberculosis
cugcgcuucgagcaga

SEQ ID NO: 831425 - RNA, 17 nt, Mycobacterium avium subsp. paratuberculosis
cugcggaccaucuacga

SEQ ID NO: 831426 - RNA, 21 nt, Mycobacterium avium subsp. paratuberculosis
cugcggaccaucuacgaccuc

SEQ ID NO: 831427 - RNA, 16 nt, Mycobacterium avium subsp. paratuberculosis
cugcuugccgucgacg

SEQ ID NO: 831428 - RNA, 14 nt, Mycobacterium avium subsp. paratuberculosis
cugcuugaacagca

SEQ ID NO: 831429 - RNA, 12 nt, Mycobacterium avium subsp. paratuberculosis
cugcuucgucgc

SEQ ID NO: 831430 - RNA, 20 nt, Mycobacterium avium subsp. paratuberculosis
cugcuugaugaugccggccg

SEQ ID NO: 831431 - RNA, 22 nt, Mycobacterium avium subsp. paratuberculosis
cugcuugaugaugccggccgcg

SEQ ID NO: 831432 - RNA, 23 nt, Mycobacterium avium subsp. paratuberculosis
cugcuugaugaugccggccgcgu

SEQ ID NO: 831433 - RNA, 22 nt, Mycobacterium avium subsp. paratuberculosis
cugcuugaugaugucggcggcc

SEQ ID NO: 831434 - RNA, 23 nt, Mycobacterium avium subsp. paratuberculosis
cugcuugaugaugucggcggccg

SEQ ID NO: 831435 - RNA, 23 nt, Mycobacterium avium subsp. paratuberculosis
cugcuuguugagggugacggugg

SEQ ID NO: 831436 - RNA, 17 nt, Mycobacterium avium subsp. paratuberculosis
cugcuugggcagcagcu

SEQ ID NO: 831437 - RNA, 12 nt, Mycobacterium avium subsp. paratuberculosis
cugcuugggcgc

SEQ ID NO: 831438 - RNA, 20 nt, Mycobacterium avium subsp. paratuberculosis
cugcuuggucaccugacgcu

SEQ ID NO: 831439 - RNA, 16 nt, Mycobacterium avium subsp. paratuberculosis
cuggaacagcgggccg

SEQ ID NO: 831440 - RNA, 14 nt, Mycobacterium avium subsp. paratuberculosis
cuggaacagguagu

SEQ ID NO: 831441 - RNA, 18 nt, Mycobacterium avium subsp. paratuberculosis
cuggaaauaggccgggca

SEQ ID NO: 831442 - RNA, 13 nt, Mycobacterium avium subsp. paratuberculosis
cuggaaccggguc

SEQ ID NO: 831443 - RNA, 17 nt, Mycobacterium avium subsp. paratuberculosis
cuggaaccgggucucgc

SEQ ID NO: 831444 - RNA, 19 nt, Mycobacterium avium subsp. paratuberculosis
cuggaaccgaaucggucga

SEQ ID NO: 831445 - RNA, 19 nt, Mycobacterium avium subsp. paratuberculosis
cuggacauucacgaggccg

SEQ ID NO: 831446 - RNA, 23 nt, Mycobacterium avium subsp. paratuberculosis
cuggaauaccuugccggagugcg

SEQ ID NO: 831447 - RNA, 22 nt, Mycobacterium avium subsp. paratuberculosis
cuggaaggacgucaggccgguc

SEQ ID NO: 831448 - RNA, 16 nt, Mycobacterium avium subsp. paratuberculosis
cuggaagaugacccgc

SEQ ID NO: 831449 - RNA, 23 nt, Mycobacterium avium subsp. paratuberculosis
cuggaagcgcaucgccggcgcgc

SEQ ID NO: 831450 - RNA, 17 nt, Mycobacterium avium subsp. paratuberculosis
cuggaaggcgaucacga

SEQ ID NO: 831451 - RNA, 13 nt, Mycobacterium avium subsp. paratuberculosis
cugcugcgggugc

SEQ ID NO: 831452 - RNA, 12 nt, Mycobacterium avium subsp. paratuberculosis
cugcugcggccg

SEQ ID NO: 831453 - RNA, 14 nt, Mycobacterium avium subsp. paratuberculosis
cugcugcucggccg

SEQ ID NO: 831454 - RNA, 23 nt, Mycobacterium avium subsp. paratuberculosis
cugcuggauggucucgcgcaccu

SEQ ID NO: 831455 - RNA, 17 nt, Mycobacterium avium subsp. paratuberculosis
cugcugggacgggucgg

SEQ ID NO: 831456 - RNA, 21 nt, Mycobacterium avium subsp. paratuberculosis
cugcugggacgggucggcggc

SEQ ID NO: 831457 - RNA, 15 nt, Mycobacterium avium subsp. paratuberculosis
cugcuggcugcggcc

SEQ ID NO: 831458 - RNA, 14 nt, Mycobacterium avium subsp. paratuberculosis
cugcuggccgggcu

SEQ ID NO: 831459 - RNA, 14 nt, Mycobacterium avium subsp. paratuberculosis
cugcugggcggcac

SEQ ID NO: 831460 - RNA, 16 nt, Mycobacterium avium subsp. paratuberculosis
cugcugggcggcacca

SEQ ID NO: 831461 - RNA, 18 nt, Mycobacterium avium subsp. paratuberculosis
cugcugggcgggcagccg

SEQ ID NO: 831462 - RNA, 19 nt, Mycobacterium avium subsp. paratuberculosis
cugcuguagcucacggugu

SEQ ID NO: 831463 - RNA, 22 nt, Mycobacterium avium subsp. paratuberculosis
cugcuguagcucacggugucgg

SEQ ID NO: 831464 - RNA, 14 nt, Mycobacterium avium subsp. paratuberculosis
cugcuggucgacgu

SEQ ID NO: 831465 - RNA, 18 nt, Mycobacterium avium subsp. paratuberculosis
cugcuggucgacgucauc

SEQ ID NO: 831466 - RNA, 14 nt, Mycobacterium avium subsp. paratuberculosis
cugcugggugccgc

SEQ ID NO: 831467 - RNA, 21 nt, Mycobacterium avium subsp. paratuberculosis
cugcuggucuugccgugcagc

SEQ ID NO: 831468 - RNA, 22 nt, Mycobacterium avium subsp. paratuberculosis
cuggauguccaggccgucgagg

SEQ ID NO: 831469 - RNA, 16 nt, Mycobacterium avium subsp. paratuberculosis
cuggcaucgucggcgc

SEQ ID NO: 831470 - RNA, 23 nt, Mycobacterium avium subsp. paratuberculosis
cuggccagguacaccaccagguu

SEQ ID NO: 831471 - RNA, 13 nt, Mycobacterium avium subsp. paratuberculosis
cuggccaccagca

SEQ ID NO: 831472 - RNA, 15 nt, Mycobacterium avium subsp. paratuberculosis
cuggccaacucgacc

SEQ ID NO: 831473 - RNA, 13 nt, Mycobacterium avium subsp. paratuberculosis
cuggccggccucg

SEQ ID NO: 831474 - RNA, 14 nt, Mycobacterium avium subsp. paratuberculosis
cuggccggccacca

SEQ ID NO: 831475 - RNA, 16 nt, Mycobacterium avium subsp. paratuberculosis
cuggccggccaccagc

SEQ ID NO: 831476 - RNA, 17 nt, Mycobacterium avium subsp. paratuberculosis
cuggccggccaccagcg

SEQ ID NO: 831477 - RNA, 20 nt, Mycobacterium avium subsp. paratuberculosis
cuggccggacgggucgaccg

SEQ ID NO: 831478 - RNA, 21 nt, Mycobacterium avium subsp. paratuberculosis
cuggccggacgggucgaccgc

SEQ ID NO: 831479 - RNA, 21 nt, Mycobacterium avium subsp. paratuberculosis
cuggccggagcggugcggcuc

SEQ ID NO: 831480 - RNA, 14 nt, Mycobacterium avium subsp. paratuberculosis
cuggccgcgggugc

SEQ ID NO: 831481 - RNA, 19 nt, Mycobacterium avium subsp. paratuberculosis
cuggccgcggccagcugcc

SEQ ID NO: 831482 - RNA, 16 nt, Mycobacterium avium subsp. paratuberculosis
cuggccgcggcgaucg

SEQ ID NO: 831483 - RNA, 21 nt, Mycobacterium avium subsp. paratuberculosis
cuggccgcgaacggcccgccg

SEQ ID NO: 831484 - RNA, 14 nt, Mycobacterium avium subsp. paratuberculosis
cuggccgcgcagcg

SEQ ID NO: 831485 - RNA, 21 nt, Mycobacterium avium subsp. paratuberculosis
cuggccgccgcuagucgccca

SEQ ID NO: 831486 - RNA, 12 nt, Mycobacterium avium subsp. paratuberculosis
cuggccgccgug

SEQ ID NO: 831487 - RNA, 21 nt, Mycobacterium avium subsp. paratuberculosis
cuggccgcacggugcagcagc

SEQ ID NO: 831488 - RNA, 20 nt, Mycobacterium avium subsp. paratuberculosis
cuggccgauggucagcugcc

SEQ ID NO: 831489 - RNA, 23 nt, Mycobacterium avium subsp. paratuberculosis
cuggccgauggucagcugccgca

SEQ ID NO: 831490 - RNA, 16 nt, Mycobacterium avium subsp. paratuberculosis
cuggccgauggucagc

SEQ ID NO: 831491 - RNA, 19 nt, Mycobacterium avium subsp. paratuberculosis
cuggccgaguaggaagcca

SEQ ID NO: 831492 - RNA, 17 nt, Mycobacterium avium subsp. paratuberculosis
cuggccgaucuugucga

SEQ ID NO: 831493 - RNA, 19 nt, Mycobacterium avium subsp. paratuberculosis
cuggccgaucuugucgacc

SEQ ID NO: 831494 - RNA, 15 nt, Mycobacterium avium subsp. paratuberculosis
cuggccgaccgccgc

SEQ ID NO: 831495 - RNA, 16 nt, Mycobacterium avium subsp. paratuberculosis
cuggccgaccgccgcc

SEQ ID NO: 831496 - RNA, 18 nt, Mycobacterium avium subsp. paratuberculosis
cuggcccagacaggccgg

SEQ ID NO: 831497 - RNA, 21 nt, Mycobacterium avium subsp. paratuberculosis
cuggcccagacaggccggccg

SEQ ID NO: 831498 - RNA, 14 nt, Mycobacterium avium subsp. paratuberculosis
cuggcccagccgcg

SEQ ID NO: 831499 - RNA, 23 nt, Mycobacterium avium subsp. paratuberculosis
cuggcccagccgcgucacgucgg

SEQ ID NO: 831500 - RNA, 23 nt, Mycobacterium avium subsp. paratuberculosis
cuggccaugcuuucgaucaucga

SEQ ID NO: 831501 - RNA, 21 nt, Mycobacterium avium subsp. paratuberculosis
cuggcucaacacguccuggcg

SEQ ID NO: 831502 - RNA, 13 nt, Mycobacterium avium subsp. paratuberculosis
cuggcugacggcg

SEQ ID NO: 831503 - RNA, 14 nt, Mycobacterium avium subsp. paratuberculosis
cuggcuccccggcg

SEQ ID NO: 831504 - RNA, 22 nt, Mycobacterium avium subsp. paratuberculosis
cuggcucggcaccagagcgccg

SEQ ID NO: 831505 - RNA, 17 nt, Mycobacterium avium subsp. paratuberculosis
cuggcgucgggcuugcg

SEQ ID NO: 831506 - RNA, 18 nt, Mycobacterium avium subsp. paratuberculosis
cuggcguggcgccggcgc

SEQ ID NO: 831507 - RNA, 20 nt, Mycobacterium avium subsp. paratuberculosis
cuggcguggcgccggcgcgc

SEQ ID NO: 831508 - RNA, 21 nt, Mycobacterium avium subsp. paratuberculosis
cuggcguggcgccggcgcgcg

SEQ ID NO: 831509 - RNA, 18 nt, Mycobacterium avium subsp. paratuberculosis
cuggcguucgccgaggaa

SEQ ID NO: 831510 - RNA, 21 nt, Mycobacterium avium subsp. paratuberculosis
cuggcguugagcacgcggacc

SEQ ID NO: 831511 - RNA, 22 nt, Mycobacterium avium subsp. paratuberculosis
cuggcguugagcacgcggaccu

SEQ ID NO: 831512 - RNA, 17 nt, Mycobacterium avium subsp. paratuberculosis
cuggcguugaugcgggc

SEQ ID NO: 831513 - RNA, 22 nt, Mycobacterium avium subsp. paratuberculosis
cuggcguugaugcgggcgugcg

SEQ ID NO: 831514 - RNA, 15 nt, Mycobacterium avium subsp. paratuberculosis
cuggcggcggcgguc

SEQ ID NO: 831515 - RNA, 22 nt, Mycobacterium avium subsp. paratuberculosis
cuggcguagaucugcacgcugu

SEQ ID NO: 831516 - RNA, 14 nt, Mycobacterium avium subsp. paratuberculosis
cuggcggcgaucac

SEQ ID NO: 831517 - RNA, 18 nt, Mycobacterium avium subsp. paratuberculosis
cuggcggcgaucaccgcc

SEQ ID NO: 831518 - RNA, 14 nt, Mycobacterium avium subsp. paratuberculosis
cuggcggcgacccg

SEQ ID NO: 831519 - RNA, 12 nt, Mycobacterium avium subsp. paratuberculosis
cuggcggccggc

SEQ ID NO: 831520 - RNA, 13 nt, Mycobacterium avium subsp. paratuberculosis
cuggcggccggcc

SEQ ID NO: 831521 - RNA, 15 nt, Mycobacterium avium subsp. paratuberculosis
cuggcggccggccgc

SEQ ID NO: 831522 - RNA, 16 nt, Mycobacterium avium subsp. paratuberculosis
cuggcggccaucgccg

SEQ ID NO: 831523 - RNA, 20 nt, Mycobacterium avium subsp. paratuberculosis
cuggcggccaucgccgcggu

SEQ ID NO: 831524 - RNA, 13 nt, Mycobacterium avium subsp. paratuberculosis
cuggcgucguugg

SEQ ID NO: 831525 - RNA, 20 nt, Mycobacterium avium subsp. paratuberculosis
cuggcgucguuggcgccguc

SEQ ID NO: 831526 - RNA, 22 nt, Mycobacterium avium subsp. paratuberculosis
cuggcgugaaucuuggccagca

SEQ ID NO: 831527 - RNA, 16 nt, Mycobacterium avium subsp. paratuberculosis
cuggcgugacgcucga

SEQ ID NO: 831528 - RNA, 21 nt, Mycobacterium avium subsp. paratuberculosis
cuggcgugacgcucgacggcc

SEQ ID NO: 831529 - RNA, 18 nt, Mycobacterium avium subsp. paratuberculosis
cuggcgugacgcucgagg

SEQ ID NO: 831530 - RNA, 16 nt, Mycobacterium avium subsp. paratuberculosis
cuggcgugacgcucgc

SEQ ID NO: 831531 - RNA, 20 nt, Mycobacterium avium subsp. paratuberculosis
cuggcgugacgcucgccggc

SEQ ID NO: 831532 - RNA, 16 nt, Mycobacterium avium subsp. paratuberculosis
cuggcgugacgcucgg

SEQ ID NO: 831533 - RNA, 22 nt, Mycobacterium avium subsp. paratuberculosis
cuggcgugacgcucggccgugg

SEQ ID NO: 831534 - RNA, 23 nt, Mycobacterium avium subsp. paratuberculosis
cuggcgugacgcucggccguggc

SEQ ID NO: 831535 - RNA, 18 nt, Mycobacterium avium subsp. paratuberculosis
cuggcgugacgcucggcg

SEQ ID NO: 831536 - RNA, 22 nt, Mycobacterium avium subsp. paratuberculosis
cuggcgugacgcucggcgccgc

SEQ ID NO: 831537 - RNA, 23 nt, Mycobacterium avium subsp. paratuberculosis
cuggcgugacgcucggcgccggc

SEQ ID NO: 831538 - RNA, 22 nt, Mycobacterium avium subsp. paratuberculosis
cuggcgugacgcucggcgcguc

SEQ ID NO: 831539 - RNA, 16 nt, Mycobacterium avium subsp. paratuberculosis
cuggcgugacggucga

SEQ ID NO: 831540 - RNA, 20 nt, Mycobacterium avium subsp. paratuberculosis
cuggcgugacguucggccaa

SEQ ID NO: 831541 - RNA, 13 nt, Mycobacterium avium subsp. paratuberculosis
cuggcgucgaucg

SEQ ID NO: 831542 - RNA, 21 nt, Mycobacterium avium subsp. paratuberculosis
cuggcgugcuugaacgccgcc

SEQ ID NO: 831543 - RNA, 22 nt, Mycobacterium avium subsp. paratuberculosis
cuggcgugcuugaacgccgccc

SEQ ID NO: 831544 - RNA, 16 nt, Mycobacterium avium subsp. paratuberculosis
cuggcguggcacccgg

SEQ ID NO: 831545 - RNA, 18 nt, Mycobacterium avium subsp. paratuberculosis
cuggcguggcacccgggc

SEQ ID NO: 831546 - RNA, 14 nt, Mycobacterium avium subsp. paratuberculosis
cuggcgcugcucgg

SEQ ID NO: 831547 - RNA, 23 nt, Mycobacterium avium subsp. paratuberculosis
cuggcgcuggugcagcagggcgc

SEQ ID NO: 831548 - RNA, 19 nt, Mycobacterium avium subsp. paratuberculosis
cuggcgcugcgcuucgagc

SEQ ID NO: 831549 - RNA, 20 nt, Mycobacterium avium subsp. paratuberculosis
cuggcgcugggagcgggcca

SEQ ID NO: 831550 - RNA, 13 nt, Mycobacterium avium subsp. paratuberculosis
cuggcggauggcg

SEQ ID NO: 831551 - RNA, 14 nt, Mycobacterium avium subsp. paratuberculosis
cuggcggauggcgc

SEQ ID NO: 831552 - RNA, 14 nt, Mycobacterium avium subsp. paratuberculosis
cuggcggaaggccg

SEQ ID NO: 831553 - RNA, 24 nt, Mycobacterium avium subsp. paratuberculosis
cuggcggacccgcucccgggacag

SEQ ID NO: 831554 - RNA, 21 nt, Mycobacterium avium subsp. paratuberculosis
cuggccguggccgugaugcgc

SEQ ID NO: 831555 - RNA, 16 nt, Mycobacterium avium subsp. paratuberculosis
cuggccguggucggcg

SEQ ID NO: 831556 - RNA, 21 nt, Mycobacterium avium subsp. paratuberculosis
cuggccguggucggcgaugcg

SEQ ID NO: 831557 - RNA, 17 nt, Mycobacterium avium subsp. paratuberculosis
cuggccguucaggucga

SEQ ID NO: 831558 - RNA, 22 nt, Mycobacterium avium subsp. paratuberculosis
cuggccguucaggucgaucagc

SEQ ID NO: 831559 - RNA, 14 nt, Mycobacterium avium subsp. paratuberculosis
cuggccguccggau

SEQ ID NO: 831560 - RNA, 13 nt, Mycobacterium avium subsp. paratuberculosis
cuggccgucgcgg

SEQ ID NO: 831561 - RNA, 14 nt, Mycobacterium avium subsp. paratuberculosis
cuggccgucgcggc

SEQ ID NO: 831562 - RNA, 16 nt, Mycobacterium avium subsp. paratuberculosis
cuggccgucgcggcgc

SEQ ID NO: 831563 - RNA, 20 nt, Mycobacterium avium subsp. paratuberculosis
cuggccgucgucgaggccga

SEQ ID NO: 831564 - RNA, 20 nt, Mycobacterium avium subsp. paratuberculosis
cuggccgugcaccgucgccg

SEQ ID NO: 831565 - RNA, 14 nt, Mycobacterium avium subsp. paratuberculosis
cuggccggugcgga

SEQ ID NO: 831566 - RNA, 13 nt, Mycobacterium avium subsp. paratuberculosis
cuggccgggcucg

SEQ ID NO: 831567 - RNA, 14 nt, Mycobacterium avium subsp. paratuberculosis
cuggccgggcucga

SEQ ID NO: 831568 - RNA, 20 nt, Mycobacterium avium subsp. paratuberculosis
cuggccgggcucgagggcgg

SEQ ID NO: 831569 - RNA, 21 nt, Mycobacterium avium subsp. paratuberculosis
cuggccgggcucgagggcggc

SEQ ID NO: 831570 - RNA, 14 nt, Mycobacterium avium subsp. paratuberculosis
cuggccggccucga

SEQ ID NO: 831571 - RNA, 23 nt, Mycobacterium avium subsp. paratuberculosis
cuggccggccucgaugucgucga

SEQ ID NO: 831572 - RNA, 24 nt, Mycobacterium avium subsp. paratuberculosis
cugguaugccuuggcccgcgcggc

SEQ ID NO: 831573 - RNA, 20 nt, Mycobacterium avium subsp. paratuberculosis
cuggucaugaaggcgacguc

SEQ ID NO: 831574 - RNA, 21 nt, Mycobacterium avium subsp. paratuberculosis
cuggucaugaaggcgacgucg

SEQ ID NO: 831575 - RNA, 19 nt, Mycobacterium avium subsp. paratuberculosis
cugguccuccaacggcacc

SEQ ID NO: 831576 - RNA, 19 nt, Mycobacterium avium subsp. paratuberculosis
cugguccucgauccggucc

SEQ ID NO: 831577 - RNA, 15 nt, Mycobacterium avium subsp. paratuberculosis
cugguccugcggcug

SEQ ID NO: 831578 - RNA, 16 nt, Mycobacterium avium subsp. paratuberculosis
cugguccugcggcugg

SEQ ID NO: 831579 - RNA, 17 nt, Mycobacterium avium subsp. paratuberculosis
cugguccggccggccga

SEQ ID NO: 831580 - RNA, 15 nt, Mycobacterium avium subsp. paratuberculosis
cugguccaccgcggc

SEQ ID NO: 831581 - RNA, 16 nt, Mycobacterium avium subsp. paratuberculosis
cugguccaccgcggcg

SEQ ID NO: 831582 - RNA, 17 nt, Mycobacterium avium subsp. paratuberculosis
cugguccaccgcggcgg

SEQ ID NO: 831583 - RNA, 19 nt, Mycobacterium avium subsp. paratuberculosis
cuggucacccacuggcggc

SEQ ID NO: 831584 - RNA, 13 nt, Mycobacterium avium subsp. paratuberculosis
cugguaggcggcg

SEQ ID NO: 831585 - RNA, 22 nt, Mycobacterium avium subsp. paratuberculosis
cugguagggguccuccagcggc

SEQ ID NO: 831586 - RNA, 15 nt, Mycobacterium avium subsp. paratuberculosis
cuggguccgauugcc

SEQ ID NO: 831587 - RNA, 13 nt, Mycobacterium avium subsp. paratuberculosis
cugguaggccgcc

SEQ ID NO: 831588 - RNA, 17 nt, Mycobacterium avium subsp. paratuberculosis
cugguaguacaccgggc

SEQ ID NO: 831589 - RNA, 23 nt, Mycobacterium avium subsp. paratuberculosis
cugguaguacaccgggcuggugu

SEQ ID NO: 831590 - RNA, 18 nt, Mycobacterium avium subsp. paratuberculosis
cugggucaccacggucac

SEQ ID NO: 831591 - RNA, 20 nt, Mycobacterium avium subsp. paratuberculosis
cugggucaccgucacgucgu

SEQ ID NO: 831592 - RNA, 14 nt, Mycobacterium avium subsp. paratuberculosis
cugggucaucaccu

SEQ ID NO: 831593 - RNA, 15 nt, Mycobacterium avium subsp. paratuberculosis
cugggggucggugac

SEQ ID NO: 831594 - RNA, 13 nt, Mycobacterium avium subsp. paratuberculosis
cugggcggcggcg

SEQ ID NO: 831595 - RNA, 16 nt, Mycobacterium avium subsp. paratuberculosis
cuggcugagcagcacc

SEQ ID NO: 831596 - RNA, 23 nt, Mycobacterium avium subsp. paratuberculosis
cuggcugagcagcacccgacuuc

SEQ ID NO: 831597 - RNA, 19 nt, Mycobacterium avium subsp. paratuberculosis
cuggcuggucacccacugg

SEQ ID NO: 831598 - RNA, 24 nt, Mycobacterium avium subsp. paratuberculosis
cugggcgaccagauaggccagcgc

SEQ ID NO: 831599 - RNA, 15 nt, Mycobacterium avium subsp. paratuberculosis
cugggcgaccaugcc

SEQ ID NO: 831600 - RNA, 16 nt, Mycobacterium avium subsp. paratuberculosis
cugggccuggcgcucc

SEQ ID NO: 831601 - RNA, 16 nt, Mycobacterium avium subsp. paratuberculosis
cugggccuccggcggc

SEQ ID NO: 831602 - RNA, 18 nt, Mycobacterium avium subsp. paratuberculosis
cugggccuccggcggcag

SEQ ID NO: 831603 - RNA, 14 nt, Mycobacterium avium subsp. paratuberculosis
cuggcuguagcggu

SEQ ID NO: 831604 - RNA, 16 nt, Mycobacterium avium subsp. paratuberculosis
cugggccgccagccgg

SEQ ID NO: 831605 - RNA, 19 nt, Mycobacterium avium subsp. paratuberculosis
cugggccgccagccgguac

SEQ ID NO: 831606 - RNA, 13 nt, Mycobacterium avium subsp. paratuberculosis
cugggccgccguc

SEQ ID NO: 831607 - RNA, 12 nt, Mycobacterium avium subsp. paratuberculosis
cugggccgcggc

SEQ ID NO: 831608 - RNA, 14 nt, Mycobacterium avium subsp. paratuberculosis
cugggccggcgccg

SEQ ID NO: 831609 - RNA, 19 nt, Mycobacterium avium subsp. paratuberculosis
cugggcgaagccgaggucu

SEQ ID NO: 831610 - RNA, 24 nt, Mycobacterium avium subsp. paratuberculosis
cugggcgauugcguugaucgacgg

SEQ ID NO: 831611 - RNA, 23 nt, Mycobacterium avium subsp. paratuberculosis
cugggcgccauggcccacgacgu

SEQ ID NO: 831612 - RNA, 19 nt, Mycobacterium avium subsp. paratuberculosis
cugggcgcccagaugccgc

SEQ ID NO: 831613 - RNA, 14 nt, Mycobacterium avium subsp. paratuberculosis
cugggcgccgccgg

SEQ ID NO: 831614 - RNA, 15 nt, Mycobacterium avium subsp. paratuberculosis
cugggcgccgccggc

SEQ ID NO: 831615 - RNA, 18 nt, Mycobacterium avium subsp. paratuberculosis
cugggcgccgccggcguc

SEQ ID NO: 831616 - RNA, 23 nt, Mycobacterium avium subsp. paratuberculosis
cugggcggcgacaucgccgagac

SEQ ID NO: 831617 - RNA, 15 nt, Mycobacterium avium subsp. paratuberculosis
cugggcggcgcgcug

SEQ ID NO: 831618 - RNA, 16 nt, Mycobacterium avium subsp. paratuberculosis
cugggcggcgcgcugc

SEQ ID NO: 831619 - RNA, 19 nt, Mycobacterium avium subsp. paratuberculosis
cugggcggcgcgcugcggc

SEQ ID NO: 831620 - RNA, 18 nt, Mycobacterium avium subsp. paratuberculosis
cugggcggcaccacccgg

SEQ ID NO: 831621 - RNA, 21 nt, Mycobacterium avium subsp. paratuberculosis
cugggcggccaccgcgccccg

SEQ ID NO: 831622 - RNA, 19 nt, Mycobacterium avium subsp. paratuberculosis
cugggcgcuagcugcgccg

SEQ ID NO: 831623 - RNA, 21 nt, Mycobacterium avium subsp. paratuberculosis
cugggcggacgggaccacccg

SEQ ID NO: 831624 - RNA, 16 nt, Mycobacterium avium subsp. paratuberculosis
cugggcgccgucgccg

SEQ ID NO: 831625 - RNA, 16 nt, Mycobacterium avium subsp. paratuberculosis
cuccaauacggcccgg

SEQ ID NO: 831626 - RNA, 20 nt, Mycobacterium avium subsp. paratuberculosis
cuccaauacggcccggcgaa

SEQ ID NO: 831627 - RNA, 19 nt, Mycobacterium avium subsp. paratuberculosis
cuccaccaccuggccggcc

SEQ ID NO: 831628 - RNA, 20 nt, Mycobacterium avium subsp. paratuberculosis
cuccaccaccuggccggcca

SEQ ID NO: 831629 - RNA, 19 nt, Mycobacterium avium subsp. paratuberculosis
cuccacauacgcggcggcc

SEQ ID NO: 831630 - RNA, 18 nt, Mycobacterium avium subsp. paratuberculosis
cuccaccaaacgaaguga

SEQ ID NO: 831631 - RNA, 14 nt, Mycobacterium avium subsp. paratuberculosis
cuccaccagcggcg

SEQ ID NO: 831632 - RNA, 17 nt, Mycobacterium avium subsp. paratuberculosis
cuccaccagcggcgcgu

SEQ ID NO: 831633 - RNA, 19 nt, Mycobacterium avium subsp. paratuberculosis
cuccaccagguucgcgcag

SEQ ID NO: 831634 - RNA, 22 nt, Mycobacterium avium subsp. paratuberculosis
cuccacccccuacgccguggcc

SEQ ID NO: 831635 - RNA, 16 nt, Mycobacterium avium subsp. paratuberculosis
cuccaccugcggcacc

SEQ ID NO: 831636 - RNA, 19 nt, Mycobacterium avium subsp. paratuberculosis
cuccaccugcggcaccucg

SEQ ID NO: 831637 - RNA, 19 nt, Mycobacterium avium subsp. paratuberculosis
cuccaccgcguccugcagg

SEQ ID NO: 831638 - RNA, 20 nt, Mycobacterium avium subsp. paratuberculosis
cuccaccguguucaccagcg

SEQ ID NO: 831639 - RNA, 16 nt, Mycobacterium avium subsp. paratuberculosis
cuccacccugccgacc

SEQ ID NO: 831640 - RNA, 19 nt, Mycobacterium avium subsp. paratuberculosis
cuccacccugccgaccugc

SEQ ID NO: 831641 - RNA, 23 nt, Mycobacterium avium subsp. paratuberculosis
cuccacccugccgaccugcgcga

SEQ ID NO: 831642 - RNA, 14 nt, Mycobacterium avium subsp. paratuberculosis
cuccaccgccaccg

SEQ ID NO: 831643 - RNA, 14 nt, Mycobacterium avium subsp. paratuberculosis
cuccaccgcccgga

SEQ ID NO: 831644 - RNA, 16 nt, Mycobacterium avium subsp. paratuberculosis
cuccaccgcgcgcggg

SEQ ID NO: 831645 - RNA, 21 nt, Mycobacterium avium subsp. paratuberculosis
cucauacagcggcgcgcgccg

SEQ ID NO: 831646 - RNA, 17 nt, Mycobacterium avium subsp. paratuberculosis
cucaggcgagcacccgg

SEQ ID NO: 831647 - RNA, 17 nt, Mycobacterium avium subsp. paratuberculosis
cucauagccggccgcgu

SEQ ID NO: 831648 - RNA, 12 nt, Mycobacterium avium subsp. paratuberculosis
cuccaacggcac

SEQ ID NO: 831649 - RNA, 21 nt, Mycobacterium avium subsp. paratuberculosis
cuccaacugcauuucggacgg

SEQ ID NO: 831650 - RNA, 16 nt, Mycobacterium avium subsp. paratuberculosis
cuccaguugacggcgc

SEQ ID NO: 831651 - RNA, 20 nt, Mycobacterium avium subsp. paratuberculosis
cuccagguuguggugcacga

SEQ ID NO: 831652 - RNA, 17 nt, Mycobacterium avium subsp. paratuberculosis
cucccagucccagcaca

SEQ ID NO: 831653 - RNA, 14 nt, Mycobacterium avium subsp. paratuberculosis
cucccaggccgcgg

SEQ ID NO: 831654 - RNA, 16 nt, Mycobacterium avium subsp. paratuberculosis
cuccauccgccgucga

SEQ ID NO: 831655 - RNA, 15 nt, Mycobacterium avium subsp. paratuberculosis
cuccauccgggcggc

SEQ ID NO: 831656 - RNA, 14 nt, Mycobacterium avium subsp. paratuberculosis
cuccaugaaccggu

SEQ ID NO: 831657 - RNA, 13 nt, Mycobacterium avium subsp. paratuberculosis
cuccacgucgucg

SEQ ID NO: 831658 - RNA, 16 nt, Mycobacterium avium subsp. paratuberculosis
cuccacgccgccggga

SEQ ID NO: 831659 - RNA, 22 nt, Mycobacterium avium subsp. paratuberculosis
cuccacgaugcccgucacggcc

SEQ ID NO: 831660 - RNA, 19 nt, Mycobacterium avium subsp. paratuberculosis
cuccacggugcgcaccgac

SEQ ID NO: 831661 - RNA, 15 nt, Mycobacterium avium subsp. paratuberculosis
cuccagaucgccgcc

SEQ ID NO: 831662 - RNA, 18 nt, Mycobacterium avium subsp. paratuberculosis
cuccagaugcgguggugg

SEQ ID NO: 831663 - RNA, 17 nt, Mycobacterium avium subsp. paratuberculosis
cuccagcacccgcaacg

SEQ ID NO: 831664 - RNA, 19 nt, Mycobacterium avium subsp. paratuberculosis
cuauuggccgagccgggcg

SEQ ID NO: 831665 - RNA, 20 nt, Mycobacterium avium subsp. paratuberculosis
cuauuggccgagccgggcgg

SEQ ID NO: 831666 - RNA, 20 nt, Mycobacterium avium subsp. paratuberculosis
cucaccgguggccgcgucga

SEQ ID NO: 831667 - RNA, 21 nt, Mycobacterium avium subsp. paratuberculosis
cucaccgguggccgcgucgac

SEQ ID NO: 831668 - RNA, 19 nt, Mycobacterium avium subsp. paratuberculosis
cucaccgguggugagaccc

SEQ ID NO: 831669 - RNA, 22 nt, Mycobacterium avium subsp. paratuberculosis
cucaccgucgcggucagcucga

SEQ ID NO: 831670 - RNA, 20 nt, Mycobacterium avium subsp. paratuberculosis
cucaccggccagggccgccg

SEQ ID NO: 831671 - RNA, 15 nt, Mycobacterium avium subsp. paratuberculosis
cucaccgcgggccag

SEQ ID NO: 831672 - RNA, 23 nt, Mycobacterium avium subsp. paratuberculosis
cucaccgcgggccaggcccaccg

SEQ ID NO: 831673 - RNA, 21 nt, Mycobacterium avium subsp. paratuberculosis
cucaccgcgucagcagcgcga

SEQ ID NO: 831674 - RNA, 16 nt, Mycobacterium avium subsp. paratuberculosis
cucaccggcggcggcc

SEQ ID NO: 831675 - RNA, 13 nt, Mycobacterium avium subsp. paratuberculosis
cucaccugcggcc

SEQ ID NO: 831676 - RNA, 13 nt, Mycobacterium avium subsp. paratuberculosis
cucaccugcgugc

SEQ ID NO: 831677 - RNA, 14 nt, Mycobacterium avium subsp. paratuberculosis
cucaccugcgugcc

SEQ ID NO: 831678 - RNA, 21 nt, Mycobacterium avium subsp. paratuberculosis
cucaccugcguugcggcacag

SEQ ID NO: 831679 - RNA, 13 nt, Mycobacterium avium subsp. paratuberculosis
cucaccgccgaug

SEQ ID NO: 831680 - RNA, 15 nt, Mycobacterium avium subsp. paratuberculosis
cucaccgccgaugau

SEQ ID NO: 831681 - RNA, 14 nt, Mycobacterium avium subsp. paratuberculosis
cucacccggcccac

SEQ ID NO: 831682 - RNA, 23 nt, Mycobacterium avium subsp. paratuberculosis
cucaccccggccagggugccgac

SEQ ID NO: 831683 - RNA, 21 nt, Mycobacterium avium subsp. paratuberculosis
cucaggaauuugcggcccggc

SEQ ID NO: 831684 - RNA, 19 nt, Mycobacterium avium subsp. paratuberculosis
cucagcugcugcgcggcgg

SEQ ID NO: 831685 - RNA, 19 nt, Mycobacterium avium subsp. paratuberculosis
cucagcguucacgucgauc

SEQ ID NO: 831686 - RNA, 13 nt, Mycobacterium avium subsp. paratuberculosis
cucagcgucgaug

SEQ ID NO: 831687 - RNA, 15 nt, Mycobacterium avium subsp. paratuberculosis
cucagcccggcccag

SEQ ID NO: 831688 - RNA, 13 nt, Mycobacterium avium subsp. paratuberculosis
cucagcccggcgc

SEQ ID NO: 831689 - RNA, 14 nt, Mycobacterium avium subsp. paratuberculosis
cucagccgcacgga

SEQ ID NO: 831690 - RNA, 16 nt, Mycobacterium avium subsp. paratuberculosis
cucagcgggcggccag

SEQ ID NO: 831691 - RNA, 13 nt, Mycobacterium avium subsp. paratuberculosis
cucaggaucagca

SEQ ID NO: 831692 - RNA, 13 nt, Mycobacterium avium subsp. paratuberculosis
cucaggccggccu

SEQ ID NO: 831693 - RNA, 14 nt, Mycobacterium avium subsp. paratuberculosis
cucacgcagggcca

SEQ ID NO: 831694 - RNA, 18 nt, Mycobacterium avium subsp. paratuberculosis
cucacgacuccuggccga

SEQ ID NO: 831695 - RNA, 16 nt, Mycobacterium avium subsp. paratuberculosis
cucagcacggccgcgg

SEQ ID NO: 831696 - RNA, 19 nt, Mycobacterium avium subsp. paratuberculosis
cucagcacggccgcggcca

SEQ ID NO: 831697 - RNA, 21 nt, Mycobacterium avium subsp. paratuberculosis
cucagaccauggcgcggcggc

SEQ ID NO: 831698 - RNA, 22 nt, Mycobacterium avium subsp. paratuberculosis
cucagcaacccgccgagcguga

SEQ ID NO: 831699 - RNA, 15 nt, Mycobacterium avium subsp. paratuberculosis
cucagccccagcgga

SEQ ID NO: 831700 - RNA, 18 nt, Mycobacterium avium subsp. paratuberculosis
cucagccccagcggagcg

SEQ ID NO: 831701 - RNA, 19 nt, Mycobacterium avium subsp. paratuberculosis
cucagcagggcggcaccga

SEQ ID NO: 831702 - RNA, 20 nt, Mycobacterium avium subsp. paratuberculosis
cucagcccgauucagccggc

SEQ ID NO: 831703 - RNA, 14 nt, Mycobacterium avium subsp. paratuberculosis
cucagcccggcagc

SEQ ID NO: 831704 - RNA, 22 nt, Mycobacterium avium subsp. paratuberculosis
cuaggugacccaauccggcuga

SEQ ID NO: 831705 - RNA, 19 nt, Mycobacterium avium subsp. paratuberculosis
cuagggcccacgcucgacg

SEQ ID NO: 831706 - RNA, 13 nt, Mycobacterium avium subsp. paratuberculosis
cuaggucaccgga

SEQ ID NO: 831707 - RNA, 15 nt, Mycobacterium avium subsp. paratuberculosis
cuagguccggcgcga

SEQ ID NO: 831708 - RNA, 16 nt, Mycobacterium avium subsp. paratuberculosis
cuagguccggcgcgac

SEQ ID NO: 831709 - RNA, 18 nt, Mycobacterium avium subsp. paratuberculosis
cuagguccggcgcgacca

SEQ ID NO: 831710 - RNA, 14 nt, Mycobacterium avium subsp. paratuberculosis
cuaggccagcagcg

SEQ ID NO: 831711 - RNA, 16 nt, Mycobacterium avium subsp. paratuberculosis
cuaggccagcagcgcg

SEQ ID NO: 831712 - RNA, 21 nt, Mycobacterium avium subsp. paratuberculosis
cuagcuucacgcucggcgccg

SEQ ID NO: 831713 - RNA, 20 nt, Mycobacterium avium subsp. paratuberculosis
cuagcuucacguucggcgag

SEQ ID NO: 831714 - RNA, 15 nt, Mycobacterium avium subsp. paratuberculosis
cuaggacgcgggccu

SEQ ID NO: 831715 - RNA, 19 nt, Mycobacterium avium subsp. paratuberculosis
cuaggacgcgggccugggc

SEQ ID NO: 831716 - RNA, 14 nt, Mycobacterium avium subsp. paratuberculosis
cuacgggcgcaccg

SEQ ID NO: 831717 - RNA, 21 nt, Mycobacterium avium subsp. paratuberculosis
cuacgggcgcaccgcgcgcca

SEQ ID NO: 831718 - RNA, 15 nt, Mycobacterium avium subsp. paratuberculosis
cuacgucggcuggcg

SEQ ID NO: 831719 - RNA, 18 nt, Mycobacterium avium subsp. paratuberculosis
cuacgucggcuggcgugc

SEQ ID NO: 831720 - RNA, 16 nt, Mycobacterium avium subsp. paratuberculosis
cuacgcacccgacacg

SEQ ID NO: 831721 - RNA, 23 nt, Mycobacterium avium subsp. paratuberculosis
cuacgacauccugcgcaucgagc

SEQ ID NO: 831722 - RNA, 14 nt, Mycobacterium avium subsp. paratuberculosis
cuacgcgagcugcu

SEQ ID NO: 831723 - RNA, 21 nt, Mycobacterium avium subsp. paratuberculosis
cuacgcgagcugcuucgucgc

SEQ ID NO: 831724 - RNA, 13 nt, Mycobacterium avium subsp. paratuberculosis
cuacggcgggccg

SEQ ID NO: 831725 - RNA, 14 nt, Mycobacterium avium subsp. paratuberculosis
cuacggcgggccgg

SEQ ID NO: 831726 - RNA, 18 nt, Mycobacterium avium subsp. paratuberculosis
cuacggcgggccggcgcc

SEQ ID NO: 831727 - RNA, 21 nt, Mycobacterium avium subsp. paratuberculosis
cuacggcgggccggcgccggu

SEQ ID NO: 831728 - RNA, 19 nt, Mycobacterium avium subsp. paratuberculosis
cuagguuuggccagcaccg

SEQ ID NO: 831729 - RNA, 22 nt, Mycobacterium avium subsp. paratuberculosis
cuagguuuggccagcaccgcgg

SEQ ID NO: 831730 - RNA, 23 nt, Mycobacterium avium subsp. paratuberculosis
cuagguuuggccagcaccgcggc

SEQ ID NO: 831731 - RNA, 19 nt, Mycobacterium avium subsp. paratuberculosis
cuagugccgggggccgagc

SEQ ID NO: 831732 - RNA, 17 nt, Mycobacterium avium subsp. paratuberculosis
cuagucgcccagcagcc

SEQ ID NO: 831733 - RNA, 21 nt, Mycobacterium avium subsp. paratuberculosis
cuagucgcccagcagcccggc

SEQ ID NO: 831734 - RNA, 15 nt, Mycobacterium avium subsp. paratuberculosis
cuaucgcccggcgcc

SEQ ID NO: 831735 - RNA, 14 nt, Mycobacterium avium subsp. paratuberculosis
cuaaccgcgggcau

SEQ ID NO: 831736 - RNA, 18 nt, Mycobacterium avium subsp. paratuberculosis
cuaaccgcgggcaucgcc

SEQ ID NO: 831737 - RNA, 23 nt, Mycobacterium avium subsp. paratuberculosis
cuaacugagcccggcgacgaagc

SEQ ID NO: 831738 - RNA, 14 nt, Mycobacterium avium subsp. paratuberculosis
cuaacgugcccggc

SEQ ID NO: 831739 - RNA, 15 nt, Mycobacterium avium subsp. paratuberculosis
cuaacgugcccggcc

SEQ ID NO: 831740 - RNA, 18 nt, Mycobacterium avium subsp. paratuberculosis
cuaaggccgcugcccggc

SEQ ID NO: 831741 - RNA, 19 nt, Mycobacterium avium subsp. paratuberculosis
cuaaggccgcugcccggcg

SEQ ID NO: 831742 - RNA, 17 nt, Mycobacterium avium subsp. paratuberculosis
cuaaugcaucgaugccg

SEQ ID NO: 831743 - RNA, 17 nt, Mycobacterium avium subsp. paratuberculosis
cuaccggguggccagca

SEQ ID NO: 831744 - RNA, 19 nt, Mycobacterium avium subsp. paratuberculosis
cuaccggguggccagcacc

SEQ ID NO: 831745 - RNA, 14 nt, Mycobacterium avium subsp. paratuberculosis
cuaccuaggcgucg

SEQ ID NO: 831746 - RNA, 21 nt, Mycobacterium avium subsp. paratuberculosis
cuaccugaccagcggcgcgcc

SEQ ID NO: 831747 - RNA, 15 nt, Mycobacterium avium subsp. paratuberculosis
cguucgucgccggug

SEQ ID NO: 831748 - RNA, 16 nt, Mycobacterium avium subsp. paratuberculosis
cguucguagggacugc

SEQ ID NO: 831749 - RNA, 15 nt, Mycobacterium avium subsp. paratuberculosis
cguucgacgccggug

SEQ ID NO: 831750 - RNA, 20 nt, Mycobacterium avium subsp. paratuberculosis
cguucggguuacguggacgc

SEQ ID NO: 831751 - RNA, 14 nt, Mycobacterium avium subsp. paratuberculosis
cguuccgccacggc

SEQ ID NO: 831752 - RNA, 18 nt, Mycobacterium avium subsp. paratuberculosis
cguuccgccacggcgggg

SEQ ID NO: 831753 - RNA, 21 nt, Mycobacterium avium subsp. paratuberculosis
cguuccgcgacaaggucgacc

SEQ ID NO: 831754 - RNA, 13 nt, Mycobacterium avium subsp. paratuberculosis
cguucccugcgcg

SEQ ID NO: 831755 - RNA, 23 nt, Mycobacterium avium subsp. paratuberculosis
cguuccucgacguaggccagauc

SEQ ID NO: 831756 - RNA, 18 nt, Mycobacterium avium subsp. paratuberculosis
cguuccggcggccggcgg

SEQ ID NO: 831757 - RNA, 14 nt, Mycobacterium avium subsp. paratuberculosis
cgugcuugaacgcc

SEQ ID NO: 831758 - RNA, 22 nt, Mycobacterium avium subsp. paratuberculosis
cgugcuugaacgccgcccccgc

SEQ ID NO: 831759 - RNA, 15 nt, Mycobacterium avium subsp. paratuberculosis
cgugcugugcgggcg

SEQ ID NO: 831760 - RNA, 16 nt, Mycobacterium avium subsp. paratuberculosis
cgugcugugcgggcgg

SEQ ID NO: 831761 - RNA, 18 nt, Mycobacterium avium subsp. paratuberculosis
cgugcugugcgggcggug

SEQ ID NO: 831762 - RNA, 19 nt, Mycobacterium avium subsp. paratuberculosis
cgugcuguggaacacgucg

SEQ ID NO: 831763 - RNA, 20 nt, Mycobacterium avium subsp. paratuberculosis
cgugcuguggaacacgucgg

SEQ ID NO: 831764 - RNA, 22 nt, Mycobacterium avium subsp. paratuberculosis
cgugcuguggaacacgucggcg

SEQ ID NO: 831765 - RNA, 21 nt, Mycobacterium avium subsp. paratuberculosis
cgugcuggggguggcgucgac

SEQ ID NO: 831766 - RNA, 22 nt, Mycobacterium avium subsp. paratuberculosis
cgugcuggggguggcgucgacg

SEQ ID NO: 831767 - RNA, 23 nt, Mycobacterium avium subsp. paratuberculosis
cgugcuggggguggcgucgacgg

SEQ ID NO: 831768 - RNA, 23 nt, Mycobacterium avium subsp. paratuberculosis
cgugcucggaguaguccagcacc

SEQ ID NO: 831769 - RNA, 15 nt, Mycobacterium avium subsp. paratuberculosis
cgugcucggcggccg

SEQ ID NO: 831770 - RNA, 16 nt, Mycobacterium avium subsp. paratuberculosis
cgugcucggcggccgc

SEQ ID NO: 831771 - RNA, 14 nt, Mycobacterium avium subsp. paratuberculosis
cgugcucggcggcg

SEQ ID NO: 831772 - RNA, 14 nt, Mycobacterium avium subsp. paratuberculosis
cgugcucgucgcgg

SEQ ID NO: 831773 - RNA, 15 nt, Mycobacterium avium subsp. paratuberculosis
cgugcucgucgcgga

SEQ ID NO: 831774 - RNA, 17 nt, Mycobacterium avium subsp. paratuberculosis
cgugcucgucgcggagg

SEQ ID NO: 831775 - RNA, 14 nt, Mycobacterium avium subsp. paratuberculosis
cgugcucgucggcg

SEQ ID NO: 831776 - RNA, 18 nt, Mycobacterium avium subsp. paratuberculosis
cguggaaaucgagcgcgc

SEQ ID NO: 831777 - RNA, 21 nt, Mycobacterium avium subsp. paratuberculosis
cgugcuuuugcgucugcucgc

SEQ ID NO: 831778 - RNA, 22 nt, Mycobacterium avium subsp. paratuberculosis
cgugcuuggccagcucggcggc

SEQ ID NO: 831779 - RNA, 22 nt, Mycobacterium avium subsp. paratuberculosis
cguggaacacgcccagcgccgc

SEQ ID NO: 831780 - RNA, 13 nt, Mycobacterium avium subsp. paratuberculosis
cguggaacgacgc

SEQ ID NO: 831781 - RNA, 19 nt, Mycobacterium avium subsp. paratuberculosis
cguggaacgcgucgcgcca

SEQ ID NO: 831782 - RNA, 21 nt, Mycobacterium avium subsp. paratuberculosis
cguugacgaccuugucgcgca

SEQ ID NO: 831783 - RNA, 17 nt, Mycobacterium avium subsp. paratuberculosis
cguugaccggccggucg

SEQ ID NO: 831784 - RNA, 20 nt, Mycobacterium avium subsp. paratuberculosis
cguugaccgggccgcuggug

SEQ ID NO: 831785 - RNA, 22 nt, Mycobacterium avium subsp. paratuberculosis
cguugaccgggucgccgaucac

SEQ ID NO: 831786 - RNA, 15 nt, Mycobacterium avium subsp. paratuberculosis
cguugacaccgggug

SEQ ID NO: 831787 - RNA, 15 nt, Mycobacterium avium subsp. paratuberculosis
cguugaccaacgccg

SEQ ID NO: 831788 - RNA, 14 nt, Mycobacterium avium subsp. paratuberculosis
cguugaccagaccg

SEQ ID NO: 831789 - RNA, 23 nt, Mycobacterium avium subsp. paratuberculosis
cguugaccccgacggcgccgcgg

SEQ ID NO: 831790 - RNA, 18 nt, Mycobacterium avium subsp. paratuberculosis
cguugaccgacgccucca

SEQ ID NO: 831791 - RNA, 16 nt, Mycobacterium avium subsp. paratuberculosis
cguugaccgcggcgau

SEQ ID NO: 831792 - RNA, 22 nt, Mycobacterium avium subsp. paratuberculosis
cguucuccauccgggcggccag

SEQ ID NO: 831793 - RNA, 14 nt, Mycobacterium avium subsp. paratuberculosis
cguucuccaccgcg

SEQ ID NO: 831794 - RNA, 16 nt, Mycobacterium avium subsp. paratuberculosis
cguucuccaccgcgcg

SEQ ID NO: 831795 - RNA, 21 nt, Mycobacterium avium subsp. paratuberculosis
cguucuccagcacccgcaacg

SEQ ID NO: 831796 - RNA, 14 nt, Mycobacterium avium subsp. paratuberculosis
cguucgucgucgcg

SEQ ID NO: 831797 - RNA, 17 nt, Mycobacterium avium subsp. paratuberculosis
cguucguuuuucgucca

SEQ ID NO: 831798 - RNA, 23 nt, Mycobacterium avium subsp. paratuberculosis
cguucugcaagaacccgaacgcg

SEQ ID NO: 831799 - RNA, 13 nt, Mycobacterium avium subsp. paratuberculosis
cguucucggcgaa

SEQ ID NO: 831800 - RNA, 15 nt, Mycobacterium avium subsp. paratuberculosis
cguugaucagggcgg

SEQ ID NO: 831801 - RNA, 18 nt, Mycobacterium avium subsp. paratuberculosis
cguugaucaugucgaugc

SEQ ID NO: 831802 - RNA, 19 nt, Mycobacterium avium subsp. paratuberculosis
cguugaucaugucgaugcc

SEQ ID NO: 831803 - RNA, 23 nt, Mycobacterium avium subsp. paratuberculosis
cguugaucacguugucgcggccc

SEQ ID NO: 831804 - RNA, 15 nt, Mycobacterium avium subsp. paratuberculosis
cguugaucgcgccga

SEQ ID NO: 831805 - RNA, 15 nt, Mycobacterium avium subsp. paratuberculosis
cguugacgcugggcg

SEQ ID NO: 831806 - RNA, 21 nt, Mycobacterium avium subsp. paratuberculosis
cguugacgcugggcggcgaca

SEQ ID NO: 831807 - RNA, 21 nt, Mycobacterium avium subsp. paratuberculosis
cguugaccugcuugagcccgu

SEQ ID NO: 831808 - RNA, 15 nt, Mycobacterium avium subsp. paratuberculosis
cguugaugucggcca

SEQ ID NO: 831809 - RNA, 21 nt, Mycobacterium avium subsp. paratuberculosis
cguugcacaccaccagcgagg

SEQ ID NO: 831810 - RNA, 18 nt, Mycobacterium avium subsp. paratuberculosis
cguugaugaucgccgauc

SEQ ID NO: 831811 - RNA, 15 nt, Mycobacterium avium subsp. paratuberculosis
cguugaucuugaccg

SEQ ID NO: 831812 - RNA, 19 nt, Mycobacterium avium subsp. paratuberculosis
cguugaugccgucgaucac

SEQ ID NO: 831813 - RNA, 16 nt, Mycobacterium avium subsp. paratuberculosis
cguugaugcgcaccgc

SEQ ID NO: 831814 - RNA, 14 nt, Mycobacterium avium subsp. paratuberculosis
cguugaugcgggcg

SEQ ID NO: 831815 - RNA, 18 nt, Mycobacterium avium subsp. paratuberculosis
cguuggcaggcccgguag

SEQ ID NO: 831816 - RNA, 11 nt, Mycobacterium avium subsp. paratuberculosis
cguuggccgcc

SEQ ID NO: 831817 - RNA, 20 nt, Mycobacterium avium subsp. paratuberculosis
cguuggccgccacgaugcug

SEQ ID NO: 831818 - RNA, 18 nt, Mycobacterium avium subsp. paratuberculosis
cguuggcccgccgcggcu

SEQ ID NO: 831819 - RNA, 15 nt, Mycobacterium avium subsp. paratuberculosis
cguuggccagcgccu

SEQ ID NO: 831820 - RNA, 18 nt, Mycobacterium avium subsp. paratuberculosis
cguuggccagcgccucca

SEQ ID NO: 831821 - RNA, 21 nt, Mycobacterium avium subsp. paratuberculosis
cguuggccagguugcgccguc

SEQ ID NO: 831822 - RNA, 18 nt, Mycobacterium avium subsp. paratuberculosis
cguuggacuccaccgcca

SEQ ID NO: 831823 - RNA, 18 nt, Mycobacterium avium subsp. paratuberculosis
cguugcuggcgcgauagc

SEQ ID NO: 831824 - RNA, 14 nt, Mycobacterium avium subsp. paratuberculosis
cguugcgcggccgc

SEQ ID NO: 831825 - RNA, 17 nt, Mycobacterium avium subsp. paratuberculosis
cguugcgcggccgcaug

SEQ ID NO: 831826 - RNA, 21 nt, Mycobacterium avium subsp. paratuberculosis
cguugcggaucgaacggcgga

SEQ ID NO: 831827 - RNA, 23 nt, Mycobacterium avium subsp. paratuberculosis
cguugcggaucucgaccucgucg

SEQ ID NO: 831828 - RNA, 14 nt, Mycobacterium avium subsp. paratuberculosis
cguugcggccgucc

SEQ ID NO: 831829 - RNA, 15 nt, Mycobacterium avium subsp. paratuberculosis
cguugcggccgucca

SEQ ID NO: 831830 - RNA, 13 nt, Mycobacterium avium subsp. paratuberculosis
cguugcgggccag

SEQ ID NO: 831831 - RNA, 15 nt, Mycobacterium avium subsp. paratuberculosis
cguugcgggcggcgc

SEQ ID NO: 831832 - RNA, 19 nt, Mycobacterium avium subsp. paratuberculosis
cguugcgggugucgccggu

SEQ ID NO: 831833 - RNA, 20 nt, Mycobacterium avium subsp. paratuberculosis
cguugcgggugucgccggug

SEQ ID NO: 831834 - RNA, 17 nt, Mycobacterium avium subsp. paratuberculosis
cguugcggugcucgucg

SEQ ID NO: 831835 - RNA, 18 nt, Mycobacterium avium subsp. paratuberculosis
cguugcgccagcaccgac

SEQ ID NO: 831836 - RNA, 21 nt, Mycobacterium avium subsp. paratuberculosis
cguugcgccagcaccgacagc

SEQ ID NO: 831837 - RNA, 14 nt, Mycobacterium avium subsp. paratuberculosis
cguugcgccagcgg

SEQ ID NO: 831838 - RNA, 13 nt, Mycobacterium avium subsp. paratuberculosis
cguugcgccccag

SEQ ID NO: 831839 - RNA, 13 nt, Mycobacterium avium subsp. paratuberculosis
cguugcgcccggc

SEQ ID NO: 831840 - RNA, 17 nt, Mycobacterium avium subsp. paratuberculosis
cguugcgcccggccauc

SEQ ID NO: 831841 - RNA, 11 nt, Mycobacterium avium subsp. paratuberculosis
cguugcgccgc

SEQ ID NO: 831842 - RNA, 13 nt, Mycobacterium avium subsp. paratuberculosis
cguugcgccgcca

SEQ ID NO: 831843 - RNA, 15 nt, Mycobacterium avium subsp. paratuberculosis
cguugccgcgcgccc

SEQ ID NO: 831844 - RNA, 20 nt, Mycobacterium avium subsp. paratuberculosis
cguugccgcgcgcccgcggc

SEQ ID NO: 831845 - RNA, 18 nt, Mycobacterium avium subsp. paratuberculosis
cguugccgccgcgcgcgg

SEQ ID NO: 831846 - RNA, 19 nt, Mycobacterium avium subsp. paratuberculosis
cguugccgccgcgcgcggc

SEQ ID NO: 831847 - RNA, 21 nt, Mycobacterium avium subsp. paratuberculosis
cguugccgcacaccgcgcaga

SEQ ID NO: 831848 - RNA, 13 nt, Mycobacterium avium subsp. paratuberculosis
cguugccgccggc

SEQ ID NO: 831849 - RNA, 15 nt, Mycobacterium avium subsp. paratuberculosis
cguugccgccggcgc

SEQ ID NO: 831850 - RNA, 18 nt, Mycobacterium avium subsp. paratuberculosis
cguugccgccggcgcggu

SEQ ID NO: 831851 - RNA, 14 nt, Mycobacterium avium subsp. paratuberculosis
cguugccggugccg

SEQ ID NO: 831852 - RNA, 20 nt, Mycobacterium avium subsp. paratuberculosis
cguugccggugccgacgauc

SEQ ID NO: 831853 - RNA, 17 nt, Mycobacterium avium subsp. paratuberculosis
cguugccggcccgcagc

SEQ ID NO: 831854 - RNA, 21 nt, Mycobacterium avium subsp. paratuberculosis
cguugccggcccgcagcgccu

SEQ ID NO: 831855 - RNA, 16 nt, Mycobacterium avium subsp. paratuberculosis
cguugccggccgaagu

SEQ ID NO: 831856 - RNA, 13 nt, Mycobacterium avium subsp. paratuberculosis
cguugccggcggc

SEQ ID NO: 831857 - RNA, 17 nt, Mycobacterium avium subsp. paratuberculosis
cguugccggcggccagc

SEQ ID NO: 831858 - RNA, 20 nt, Mycobacterium avium subsp. paratuberculosis
cguugccggcggccagcauc

SEQ ID NO: 831859 - RNA, 15 nt, Mycobacterium avium subsp. paratuberculosis
cguugccggcggcga

SEQ ID NO: 831860 - RNA, 18 nt, Mycobacterium avium subsp. paratuberculosis
cguugccggcggcgaagc

SEQ ID NO: 831861 - RNA, 16 nt, Mycobacterium avium subsp. paratuberculosis
cguugcgaaacaacgc

SEQ ID NO: 831862 - RNA, 20 nt, Mycobacterium avium subsp. paratuberculosis
cguugcgagucaucgccacc

SEQ ID NO: 831863 - RNA, 12 nt, Mycobacterium avium subsp. paratuberculosis
cguugcccgccg

SEQ ID NO: 831864 - RNA, 13 nt, Mycobacterium avium subsp. paratuberculosis
cguugcccgccgc

SEQ ID NO: 831865 - RNA, 18 nt, Mycobacterium avium subsp. paratuberculosis
cguugcccgccgcggcga

SEQ ID NO: 831866 - RNA, 23 nt, Mycobacterium avium subsp. paratuberculosis
cguugcccgccgcggcgagccgg

SEQ ID NO: 831867 - RNA, 15 nt, Mycobacterium avium subsp. paratuberculosis
cguugcccgcugcgg

SEQ ID NO: 831868 - RNA, 15 nt, Mycobacterium avium subsp. paratuberculosis
cguugcccaggaagu

SEQ ID NO: 831869 - RNA, 16 nt, Mycobacterium avium subsp. paratuberculosis
cguugccaggccgcga

SEQ ID NO: 831870 - RNA, 15 nt, Mycobacterium avium subsp. paratuberculosis
cguugcccgaucagc

SEQ ID NO: 831871 - RNA, 17 nt, Mycobacterium avium subsp. paratuberculosis
cguugcccgaucagccg

SEQ ID NO: 831872 - RNA, 19 nt, Mycobacterium avium subsp. paratuberculosis
cguugcccgaucagccggg

SEQ ID NO: 831873 - RNA, 16 nt, Mycobacterium avium subsp. paratuberculosis
cguugccagccggugc

SEQ ID NO: 831874 - RNA, 16 nt, Mycobacterium avium subsp. paratuberculosis
cguugcauuucggcgu

SEQ ID NO: 831875 - RNA, 20 nt, Mycobacterium avium subsp. paratuberculosis
cguugcauuucggcguccuc

SEQ ID NO: 831876 - RNA, 17 nt, Mycobacterium avium subsp. paratuberculosis
cguugcagcgccgcggc

SEQ ID NO: 831877 - RNA, 12 nt, Mycobacterium avium subsp. paratuberculosis
cuaaagccgacu

SEQ ID NO: 831878 - RNA, 15 nt, Mycobacterium avium subsp. paratuberculosis
cuaaagccgacugcc

SEQ ID NO: 831879 - RNA, 18 nt, Mycobacterium avium subsp. paratuberculosis
cuaaacaauggccccggc

SEQ ID NO: 831880 - RNA, 14 nt, Mycobacterium avium subsp. paratuberculosis
cguuuucggcgcgc

SEQ ID NO: 831881 - RNA, 15 nt, Mycobacterium avium subsp. paratuberculosis
cguuuucggcgcgca

SEQ ID NO: 831882 - RNA, 22 nt, Mycobacterium avium subsp. paratuberculosis
cguuuugaaauccgggcgcgga

SEQ ID NO: 831883 - RNA, 16 nt, Mycobacterium avium subsp. paratuberculosis
cguuuuuguggguggu

SEQ ID NO: 831884 - RNA, 18 nt, Mycobacterium avium subsp. paratuberculosis
cguuugccgucgaggggg

SEQ ID NO: 831885 - RNA, 19 nt, Mycobacterium avium subsp. paratuberculosis
cguuuccuggugcaccagg

SEQ ID NO: 831886 - RNA, 14 nt, Mycobacterium avium subsp. paratuberculosis
cguuuccagcgccg

SEQ ID NO: 831887 - RNA, 15 nt, Mycobacterium avium subsp. paratuberculosis
cguuuccguccggcg

SEQ ID NO: 831888 - RNA, 21 nt, Mycobacterium avium subsp. paratuberculosis
cguuuccguccggcgacaugc

SEQ ID NO: 831889 - RNA, 16 nt, Mycobacterium avium subsp. paratuberculosis
cguugugcucgucgau

SEQ ID NO: 831890 - RNA, 20 nt, Mycobacterium avium subsp. paratuberculosis
cguugugcuucuggcucaac

SEQ ID NO: 831891 - RNA, 17 nt, Mycobacterium avium subsp. paratuberculosis
cguugugaauccagccg

SEQ ID NO: 831892 - RNA, 17 nt, Mycobacterium avium subsp. paratuberculosis
cguugugacccgcucgg

SEQ ID NO: 831893 - RNA, 18 nt, Mycobacterium avium subsp. paratuberculosis
cguugugacccgcucggg

SEQ ID NO: 831894 - RNA, 15 nt, Mycobacterium avium subsp. paratuberculosis
cguuguggccacccu

SEQ ID NO: 831895 - RNA, 16 nt, Mycobacterium avium subsp. paratuberculosis
cguuguggcggccagc

SEQ ID NO: 831896 - RNA, 20 nt, Mycobacterium avium subsp. paratuberculosis
cguugugggccagcgcggug

SEQ ID NO: 831897 - RNA, 15 nt, Mycobacterium avium subsp. paratuberculosis
cguuguuggcggugg

SEQ ID NO: 831898 - RNA, 13 nt, Mycobacterium avium subsp. paratuberculosis
cguuguugcgcgg

SEQ ID NO: 831899 - RNA, 14 nt, Mycobacterium avium subsp. paratuberculosis
cguuguugcucggc

SEQ ID NO: 831900 - RNA, 15 nt, Mycobacterium avium subsp. paratuberculosis
cguuguugcucggcg

SEQ ID NO: 831901 - RNA, 18 nt, Mycobacterium avium subsp. paratuberculosis
cguuguugcucggcggcc

SEQ ID NO: 831902 - RNA, 15 nt, Mycobacterium avium subsp. paratuberculosis
cguuguucaggucga

SEQ ID NO: 831903 - RNA, 17 nt, Mycobacterium avium subsp. paratuberculosis
cguuguucaggucgaug

SEQ ID NO: 831904 - RNA, 17 nt, Mycobacterium avium subsp. paratuberculosis
cguugucgagcaccgcg

SEQ ID NO: 831905 - RNA, 18 nt, Mycobacterium avium subsp. paratuberculosis
cguugucgagcaccgcga

SEQ ID NO: 831906 - RNA, 19 nt, Mycobacterium avium subsp. paratuberculosis
cguugucggcgacggcggg

SEQ ID NO: 831907 - RNA, 15 nt, Mycobacterium avium subsp. paratuberculosis
cguugucgucgccgg

SEQ ID NO: 831908 - RNA, 20 nt, Mycobacterium avium subsp. paratuberculosis
cguugucgucggggcuggcg

SEQ ID NO: 831909 - RNA, 14 nt, Mycobacterium avium subsp. paratuberculosis
cguugucucggcgc

SEQ ID NO: 831910 - RNA, 17 nt, Mycobacterium avium subsp. paratuberculosis
cguugucgagcgagccg

SEQ ID NO: 831911 - RNA, 19 nt, Mycobacterium avium subsp. paratuberculosis
cguugucgaggucggugag

SEQ ID NO: 831912 - RNA, 16 nt, Mycobacterium avium subsp. paratuberculosis
cguuggcggcgucgag

SEQ ID NO: 831913 - RNA, 17 nt, Mycobacterium avium subsp. paratuberculosis
cguuggcggcgucgagu

SEQ ID NO: 831914 - RNA, 21 nt, Mycobacterium avium subsp. paratuberculosis
cguuggcggccagcgcgccgc

SEQ ID NO: 831915 - RNA, 22 nt, Mycobacterium avium subsp. paratuberculosis
cguuggcggccagcgcgccgcc

SEQ ID NO: 831916 - RNA, 14 nt, Mycobacterium avium subsp. paratuberculosis
cguuggcgccgguc

SEQ ID NO: 831917 - RNA, 18 nt, Mycobacterium avium subsp. paratuberculosis
cguuggcgccggucgacg

SEQ ID NO: 831918 - RNA, 14 nt, Mycobacterium avium subsp. paratuberculosis
cguuggcgccgucc

SEQ ID NO: 831919 - RNA, 18 nt, Mycobacterium avium subsp. paratuberculosis
cguuggcgaucucgaugg

SEQ ID NO: 831920 - RNA, 16 nt, Mycobacterium avium subsp. paratuberculosis
cguuggccugcgcgac

SEQ ID NO: 831921 - RNA, 16 nt, Mycobacterium avium subsp. paratuberculosis
cguugggcagcucggc

SEQ ID NO: 831922 - RNA, 20 nt, Mycobacterium avium subsp. paratuberculosis
cguuggcuuuucgggccggc

SEQ ID NO: 831923 - RNA, 17 nt, Mycobacterium avium subsp. paratuberculosis
cguuggcguagucgacu

SEQ ID NO: 831924 - RNA, 23 nt, Mycobacterium avium subsp. paratuberculosis
cguuggcguggauggccggccgg

SEQ ID NO: 831925 - RNA, 20 nt, Mycobacterium avium subsp. paratuberculosis
cguuguccacccccgcggug

SEQ ID NO: 831926 - RNA, 21 nt, Mycobacterium avium subsp. paratuberculosis
cguuguccacccccgcgguga

SEQ ID NO: 831927 - RNA, 15 nt, Mycobacterium avium subsp. paratuberculosis
cguuguccagcagcg

SEQ ID NO: 831928 - RNA, 16 nt, Mycobacterium avium subsp. paratuberculosis
cguuguccagcagcgc

SEQ ID NO: 831929 - RNA, 18 nt, Mycobacterium avium subsp. paratuberculosis
cguuguccagcagcgccg

SEQ ID NO: 831930 - RNA, 12 nt, Mycobacterium avium subsp. paratuberculosis
cguuggugcggu

SEQ ID NO: 831931 - RNA, 17 nt, Mycobacterium avium subsp. paratuberculosis
cguuggugacgcucacc

SEQ ID NO: 831932 - RNA, 19 nt, Mycobacterium avium subsp. paratuberculosis
cguuggugaucgccgacgu

SEQ ID NO: 831933 - RNA, 18 nt, Mycobacterium avium subsp. paratuberculosis
cguuggugaugcggucgg

SEQ ID NO: 831934 - RNA, 19 nt, Mycobacterium avium subsp. paratuberculosis
cguuggugaugcggucggc

SEQ ID NO: 831935 - RNA, 17 nt, Mycobacterium avium subsp. paratuberculosis
cguuggucaccaucagc

SEQ ID NO: 831936 - RNA, 23 nt, Mycobacterium avium subsp. paratuberculosis
cguuggucaccaucagcggcucg

SEQ ID NO: 831937 - RNA, 20 nt, Mycobacterium avium subsp. paratuberculosis
cguugggguccucgauggcg

SEQ ID NO: 831938 - RNA, 19 nt, Mycobacterium avium subsp. paratuberculosis
cguugggccagcggcgccg

SEQ ID NO: 831939 - RNA, 17 nt, Mycobacterium avium subsp. paratuberculosis
cguugggcgggaucgcg

SEQ ID NO: 831940 - RNA, 12 nt, Mycobacterium avium subsp. paratuberculosis
cucugucgucga

SEQ ID NO: 831941 - RNA, 13 nt, Mycobacterium avium subsp. paratuberculosis
cucugucgucgac

SEQ ID NO: 831942 - RNA, 17 nt, Mycobacterium avium subsp. paratuberculosis
cucuucgccggacagcc

SEQ ID NO: 831943 - RNA, 18 nt, Mycobacterium avium subsp. paratuberculosis
cucuucgccggacagccg

SEQ ID NO: 831944 - RNA, 13 nt, Mycobacterium avium subsp. paratuberculosis
cucuucgacccgc

SEQ ID NO: 831945 - RNA, 14 nt, Mycobacterium avium subsp. paratuberculosis
cucuucgacccgca

SEQ ID NO: 831946 - RNA, 22 nt, Mycobacterium avium subsp. paratuberculosis
cucuucgacccgguagcgcagc

SEQ ID NO: 831947 - RNA, 22 nt, Mycobacterium avium subsp. paratuberculosis
cucuuccucgggcagucugccg

SEQ ID NO: 831948 - RNA, 21 nt, Mycobacterium avium subsp. paratuberculosis
cucuucggggguggccagcuu

SEQ ID NO: 831949 - RNA, 20 nt, Mycobacterium avium subsp. paratuberculosis
cugaaagccgaggcgcaaca

SEQ ID NO: 831950 - RNA, 18 nt, Mycobacterium avium subsp. paratuberculosis
cucucgucgacgauggcc

SEQ ID NO: 831951 - RNA, 13 nt, Mycobacterium avium subsp. paratuberculosis
cucucggcgccgu

SEQ ID NO: 831952 - RNA, 18 nt, Mycobacterium avium subsp. paratuberculosis
cucucggcgccguccagc

SEQ ID NO: 831953 - RNA, 20 nt, Mycobacterium avium subsp. paratuberculosis
cucucggcgccguccagcuc

SEQ ID NO: 831954 - RNA, 19 nt, Mycobacterium avium subsp. paratuberculosis
cucucgggaaacgcgucgc

SEQ ID NO: 831955 - RNA, 10 nt, Mycobacterium avium subsp. paratuberculosis
cucuggccga

SEQ ID NO: 831956 - RNA, 18 nt, Mycobacterium avium subsp. paratuberculosis
cucuggcgugacgcucgg

SEQ ID NO: 831957 - RNA, 22 nt, Mycobacterium avium subsp. paratuberculosis
cucuggcgugacgcucggcgcg

SEQ ID NO: 831958 - RNA, 18 nt, Mycobacterium avium subsp. paratuberculosis
cucgugcagccggcggcg

SEQ ID NO: 831959 - RNA, 19 nt, Mycobacterium avium subsp. paratuberculosis
cucgugcagccggcggcgc

SEQ ID NO: 831960 - RNA, 19 nt, Mycobacterium avium subsp. paratuberculosis
cucgugcaugugcucggcg

SEQ ID NO: 831961 - RNA, 16 nt, Mycobacterium avium subsp. paratuberculosis
cucgugcccgggcccg

SEQ ID NO: 831962 - RNA, 15 nt, Mycobacterium avium subsp. paratuberculosis
cucgugccgcacccg

SEQ ID NO: 831963 - RNA, 19 nt, Mycobacterium avium subsp. paratuberculosis
cucgucggccagcgagucc

SEQ ID NO: 831964 - RNA, 14 nt, Mycobacterium avium subsp. paratuberculosis
cucgucggccgcga

SEQ ID NO: 831965 - RNA, 19 nt, Mycobacterium avium subsp. paratuberculosis
cucgucggccgcgacgacc

SEQ ID NO: 831966 - RNA, 13 nt, Mycobacterium avium subsp. paratuberculosis
cucgucggcgaac

SEQ ID NO: 831967 - RNA, 14 nt, Mycobacterium avium subsp. paratuberculosis
cucgucggcgagca

SEQ ID NO: 831968 - RNA, 18 nt, Mycobacterium avium subsp. paratuberculosis
cucgugaugguccagcac

SEQ ID NO: 831969 - RNA, 15 nt, Mycobacterium avium subsp. paratuberculosis
cucgugcaaaccgga

SEQ ID NO: 831970 - RNA, 18 nt, Mycobacterium avium subsp. paratuberculosis
cucgugcaaggccugcgc

SEQ ID NO: 831971 - RNA, 21 nt, Mycobacterium avium subsp. paratuberculosis
cucgugcaaggccugcgccuu

SEQ ID NO: 831972 - RNA, 20 nt, Mycobacterium avium subsp. paratuberculosis
cucgugcacaugcccgucgg

SEQ ID NO: 831973 - RNA, 23 nt, Mycobacterium avium subsp. paratuberculosis
cucgugguggacggucagcgcgc

SEQ ID NO: 831974 - RNA, 16 nt, Mycobacterium avium subsp. paratuberculosis
cucguguccgaugacg

SEQ ID NO: 831975 - RNA, 20 nt, Mycobacterium avium subsp. paratuberculosis
cucguguccgaugacgagca

SEQ ID NO: 831976 - RNA, 19 nt, Mycobacterium avium subsp. paratuberculosis
cucgugggaaugcggcugg

SEQ ID NO: 831977 - RNA, 14 nt, Mycobacterium avium subsp. paratuberculosis
cucgugggucagcu

SEQ ID NO: 831978 - RNA, 22 nt, Mycobacterium avium subsp. paratuberculosis
cucguggaaaucgagcgcgcug

SEQ ID NO: 831979 - RNA, 23 nt, Mycobacterium avium subsp. paratuberculosis
cucguggaaaucgagcgcgcugu

SEQ ID NO: 831980 - RNA, 15 nt, Mycobacterium avium subsp. paratuberculosis
cucggggcguggcgg

SEQ ID NO: 831981 - RNA, 20 nt, Mycobacterium avium subsp. paratuberculosis
cucggggcguggcggaagcg

SEQ ID NO: 831982 - RNA, 13 nt, Mycobacterium avium subsp. paratuberculosis
cucggggcucgcg

SEQ ID NO: 831983 - RNA, 17 nt, Mycobacterium avium subsp. paratuberculosis
cucggggcucgcggugu

SEQ ID NO: 831984 - RNA, 14 nt, Mycobacterium avium subsp. paratuberculosis
cucgggggccgcuc

SEQ ID NO: 831985 - RNA, 19 nt, Mycobacterium avium subsp. paratuberculosis
cucgggggcgggcaccucg

SEQ ID NO: 831986 - RNA, 22 nt, Mycobacterium avium subsp. paratuberculosis
cucgggggugaaggcggccacc

SEQ ID NO: 831987 - RNA, 16 nt, Mycobacterium avium subsp. paratuberculosis
cucgggguacucggcg

SEQ ID NO: 831988 - RNA, 16 nt, Mycobacterium avium subsp. paratuberculosis
cucgggguagccggcc

SEQ ID NO: 831989 - RNA, 19 nt, Mycobacterium avium subsp. paratuberculosis
cucgggguagccggcccgc

SEQ ID NO: 831990 - RNA, 18 nt, Mycobacterium avium subsp. paratuberculosis
cucgggguaguucagcgc

SEQ ID NO: 831991 - RNA, 15 nt, Mycobacterium avium subsp. paratuberculosis
cucggggucggccga

SEQ ID NO: 831992 - RNA, 14 nt, Mycobacterium avium subsp. paratuberculosis
cucggggucggcgu

SEQ ID NO: 831993 - RNA, 15 nt, Mycobacterium avium subsp. paratuberculosis
cucgggcucgucguu

SEQ ID NO: 831994 - RNA, 17 nt, Mycobacterium avium subsp. paratuberculosis
cucgggcucgucguugc

SEQ ID NO: 831995 - RNA, 14 nt, Mycobacterium avium subsp. paratuberculosis
cucggggaucgcca

SEQ ID NO: 831996 - RNA, 18 nt, Mycobacterium avium subsp. paratuberculosis
cucggggaugucgaaauc

SEQ ID NO: 831997 - RNA, 12 nt, Mycobacterium avium subsp. paratuberculosis
cucgggcggccg

SEQ ID NO: 831998 - RNA, 17 nt, Mycobacterium avium subsp. paratuberculosis
cucgggcgcgaacagcg

SEQ ID NO: 831999 - RNA, 13 nt, Mycobacterium avium subsp. paratuberculosis
cucgggccggcag

SEQ ID NO: 832000 - RNA, 16 nt, Mycobacterium avium subsp. paratuberculosis
cucgggccggcagccg

SEQ ID NO: 832001 - RNA, 20 nt, Mycobacterium avium subsp. paratuberculosis
cucgggccggcagccggcca

SEQ ID NO: 832002 - RNA, 15 nt, Mycobacterium avium subsp. paratuberculosis
cucgggccggcgccg

SEQ ID NO: 832003 - RNA, 17 nt, Mycobacterium avium subsp. paratuberculosis
cucgggccggcgccgac

SEQ ID NO: 832004 - RNA, 19 nt, Mycobacterium avium subsp. paratuberculosis
cucgggccggcgccgacga

SEQ ID NO: 832005 - RNA, 20 nt, Mycobacterium avium subsp. paratuberculosis
cucgggccggcgccgacgac

SEQ ID NO: 832006 - RNA, 21 nt, Mycobacterium avium subsp. paratuberculosis
cucgggccggcgccgacgacg

SEQ ID NO: 832007 - RNA, 21 nt, Mycobacterium avium subsp. paratuberculosis
cucgggcauuggcagcucggg

SEQ ID NO: 832008 - RNA, 22 nt, Mycobacterium avium subsp. paratuberculosis
cucgggccagcccauguccagg

SEQ ID NO: 832009 - RNA, 20 nt, Mycobacterium avium subsp. paratuberculosis
cucgggcccgagguccucgc

SEQ ID NO: 832010 - RNA, 20 nt, Mycobacterium avium subsp. paratuberculosis
cucgggcagcgugucccggu

SEQ ID NO: 832011 - RNA, 15 nt, Mycobacterium avium subsp. paratuberculosis
cucgggcagcccgcc

SEQ ID NO: 832012 - RNA, 22 nt, Mycobacterium avium subsp. paratuberculosis
cucgggcacguccagcccgcgc

SEQ ID NO: 832013 - RNA, 20 nt, Mycobacterium avium subsp. paratuberculosis
cucgggcagcagcaccagcg

SEQ ID NO: 832014 - RNA, 19 nt, Mycobacterium avium subsp. paratuberculosis
cucgggcaccccugccgcc

SEQ ID NO: 832015 - RNA, 23 nt, Mycobacterium avium subsp. paratuberculosis
cucgggcaccccugccgccaccg

SEQ ID NO: 832016 - RNA, 15 nt, Mycobacterium avium subsp. paratuberculosis
cucggucaccccgga

SEQ ID NO: 832017 - RNA, 22 nt, Mycobacterium avium subsp. paratuberculosis
cucggucaccgagcggccgucc

SEQ ID NO: 832018 - RNA, 20 nt, Mycobacterium avium subsp. paratuberculosis
cucggucaccucgucgaucc

SEQ ID NO: 832019 - RNA, 16 nt, Mycobacterium avium subsp. paratuberculosis
cucggucaaguccgcg

SEQ ID NO: 832020 - RNA, 13 nt, Mycobacterium avium subsp. paratuberculosis
cucggucaccagc

SEQ ID NO: 832021 - RNA, 14 nt, Mycobacterium avium subsp. paratuberculosis
cucggucaccagcg

SEQ ID NO: 832022 - RNA, 15 nt, Mycobacterium avium subsp. paratuberculosis
cucgggugucgccga

SEQ ID NO: 832023 - RNA, 16 nt, Mycobacterium avium subsp. paratuberculosis
cucggguguggacggc

SEQ ID NO: 832024 - RNA, 17 nt, Mycobacterium avium subsp. paratuberculosis
cucggguguggacggcg

SEQ ID NO: 832025 - RNA, 21 nt, Mycobacterium avium subsp. paratuberculosis
cucggguuugccgacgguguc

SEQ ID NO: 832026 - RNA, 16 nt, Mycobacterium avium subsp. paratuberculosis
cucgguacccccgccg

SEQ ID NO: 832027 - RNA, 18 nt, Mycobacterium avium subsp. paratuberculosis
cucgguacccccgccggg

SEQ ID NO: 832028 - RNA, 22 nt, Mycobacterium avium subsp. paratuberculosis
cucgguacccccgccggggccg

SEQ ID NO: 832029 - RNA, 13 nt, Mycobacterium avium subsp. paratuberculosis
cucggggcugcgc

SEQ ID NO: 832030 - RNA, 15 nt, Mycobacterium avium subsp. paratuberculosis
cucggucagcucggg

SEQ ID NO: 832031 - RNA, 17 nt, Mycobacterium avium subsp. paratuberculosis
cucggucaggcccaggu

SEQ ID NO: 832032 - RNA, 14 nt, Mycobacterium avium subsp. paratuberculosis
cucggucaggaucg

SEQ ID NO: 832033 - RNA, 13 nt, Mycobacterium avium subsp. paratuberculosis
cucggucagcacc

SEQ ID NO: 832034 - RNA, 18 nt, Mycobacterium avium subsp. paratuberculosis
cucggucagguagccgag

SEQ ID NO: 832035 - RNA, 15 nt, Mycobacterium avium subsp. paratuberculosis
cucggucgccacggc

SEQ ID NO: 832036 - RNA, 19 nt, Mycobacterium avium subsp. paratuberculosis
cucggucgccacggccggc

SEQ ID NO: 832037 - RNA, 21 nt, Mycobacterium avium subsp. paratuberculosis
cucggucgccacggccggcag

SEQ ID NO: 832038 - RNA, 17 nt, Mycobacterium avium subsp. paratuberculosis
cucggucgccagcaccg

SEQ ID NO: 832039 - RNA, 23 nt, Mycobacterium avium subsp. paratuberculosis
cucggucgcgaagacgcuggcca

SEQ ID NO: 832040 - RNA, 17 nt, Mycobacterium avium subsp. paratuberculosis
cucggucgcggcgaucg

SEQ ID NO: 832041 - RNA, 20 nt, Mycobacterium avium subsp. paratuberculosis
cucggucgcggcgucgcggu

SEQ ID NO: 832042 - RNA, 22 nt, Mycobacterium avium subsp. paratuberculosis
cucggucgcggcgucgcgguag

SEQ ID NO: 832043 - RNA, 15 nt, Mycobacterium avium subsp. paratuberculosis
cucggucgcggucgg

SEQ ID NO: 832044 - RNA, 17 nt, Mycobacterium avium subsp. paratuberculosis
cucggucgcggucggcg

SEQ ID NO: 832045 - RNA, 22 nt, Mycobacterium avium subsp. paratuberculosis
cucggucgcgugaccggcggug

SEQ ID NO: 832046 - RNA, 23 nt, Mycobacterium avium subsp. paratuberculosis
cucggucgcgugaccggcggugc

SEQ ID NO: 832047 - RNA, 21 nt, Mycobacterium avium subsp. paratuberculosis
cucgucaaccgcagucguucg

SEQ ID NO: 832048 - RNA, 18 nt, Mycobacterium avium subsp. paratuberculosis
cucguaguuggggccggc

SEQ ID NO: 832049 - RNA, 19 nt, Mycobacterium avium subsp. paratuberculosis
cucguaguuggggccggcc

SEQ ID NO: 832050 - RNA, 13 nt, Mycobacterium avium subsp. paratuberculosis
cucgucaccgugg

SEQ ID NO: 832051 - RNA, 19 nt, Mycobacterium avium subsp. paratuberculosis
cucgucaccgugggcggcg

SEQ ID NO: 832052 - RNA, 14 nt, Mycobacterium avium subsp. paratuberculosis
cucguccaccagcu

SEQ ID NO: 832053 - RNA, 15 nt, Mycobacterium avium subsp. paratuberculosis
cucguccagcgucgc

SEQ ID NO: 832054 - RNA, 18 nt, Mycobacterium avium subsp. paratuberculosis
cucguccagcgucgcggc

SEQ ID NO: 832055 - RNA, 19 nt, Mycobacterium avium subsp. paratuberculosis
cucguccagcgucgcggcc

SEQ ID NO: 832056 - RNA, 20 nt, Mycobacterium avium subsp. paratuberculosis
cucguccaggguggccagca

SEQ ID NO: 832057 - RNA, 21 nt, Mycobacterium avium subsp. paratuberculosis
cucguccaggguggccagcac

SEQ ID NO: 832058 - RNA, 13 nt, Mycobacterium avium subsp. paratuberculosis
cucgucgaucgcg

SEQ ID NO: 832059 - RNA, 18 nt, Mycobacterium avium subsp. paratuberculosis
cucgucgaucgcggcgau

SEQ ID NO: 832060 - RNA, 13 nt, Mycobacterium avium subsp. paratuberculosis
cucgucgaugacg

SEQ ID NO: 832061 - RNA, 16 nt, Mycobacterium avium subsp. paratuberculosis
cucgucgaugcacgcc

SEQ ID NO: 832062 - RNA, 20 nt, Mycobacterium avium subsp. paratuberculosis
cucgucgaugcacgccggaa

SEQ ID NO: 832063 - RNA, 23 nt, Mycobacterium avium subsp. paratuberculosis
cucgucgaugccguagaccagca

SEQ ID NO: 832064 - RNA, 22 nt, Mycobacterium avium subsp. paratuberculosis
cucguccaggugcacccgcggc

SEQ ID NO: 832065 - RNA, 17 nt, Mycobacterium avium subsp. paratuberculosis
cucgucgaugggcucga

SEQ ID NO: 832066 - RNA, 18 nt, Mycobacterium avium subsp. paratuberculosis
cucgucgcccggcgucca

SEQ ID NO: 832067 - RNA, 20 nt, Mycobacterium avium subsp. paratuberculosis
cucgucgcggaacagccggc

SEQ ID NO: 832068 - RNA, 20 nt, Mycobacterium avium subsp. paratuberculosis
cucgucgcggaacgggucga

SEQ ID NO: 832069 - RNA, 14 nt, Mycobacterium avium subsp. paratuberculosis
cucgucgcgggcgc

SEQ ID NO: 832070 - RNA, 18 nt, Mycobacterium avium subsp. paratuberculosis
cucgucggaggcgucgac

SEQ ID NO: 832071 - RNA, 21 nt, Mycobacterium avium subsp. paratuberculosis
cucgucggaggcgucgacgcg

SEQ ID NO: 832072 - RNA, 14 nt, Mycobacterium avium subsp. paratuberculosis
cucguagcgggcga

SEQ ID NO: 832073 - RNA, 24 nt, Mycobacterium avium subsp. paratuberculosis
cucguagcuggugcgcagcccgcc

SEQ ID NO: 832074 - RNA, 23 nt, Mycobacterium avium subsp. paratuberculosis
cucggugcgccagaucagcgugg

SEQ ID NO: 832075 - RNA, 16 nt, Mycobacterium avium subsp. paratuberculosis
cucguagcccaccucg

SEQ ID NO: 832076 - RNA, 17 nt, Mycobacterium avium subsp. paratuberculosis
cucggugaugccgagcg

SEQ ID NO: 832077 - RNA, 17 nt, Mycobacterium avium subsp. paratuberculosis
cucggugaugccggcca

SEQ ID NO: 832078 - RNA, 14 nt, Mycobacterium avium subsp. paratuberculosis
cucggugccgguga

SEQ ID NO: 832079 - RNA, 17 nt, Mycobacterium avium subsp. paratuberculosis
cucggugccgucgaucg

SEQ ID NO: 832080 - RNA, 14 nt, Mycobacterium avium subsp. paratuberculosis
cucggugcgcaccc

SEQ ID NO: 832081 - RNA, 14 nt, Mycobacterium avium subsp. paratuberculosis
cucggucugggcga

SEQ ID NO: 832082 - RNA, 23 nt, Mycobacterium avium subsp. paratuberculosis
cucggucugggcgaacggcaacg

SEQ ID NO: 832083 - RNA, 17 nt, Mycobacterium avium subsp. paratuberculosis
cucggugaagccgcgga

SEQ ID NO: 832084 - RNA, 23 nt, Mycobacterium avium subsp. paratuberculosis
cucggugacgaacucaagggcgu

SEQ ID NO: 832085 - RNA, 18 nt, Mycobacterium avium subsp. paratuberculosis
cucggugagccgcuggau

SEQ ID NO: 832086 - RNA, 19 nt, Mycobacterium avium subsp. paratuberculosis
cucggugagccgcuggaug

SEQ ID NO: 832087 - RNA, 22 nt, Mycobacterium avium subsp. paratuberculosis
cucggugaucaccaugaucagc

SEQ ID NO: 832088 - RNA, 22 nt, Mycobacterium avium subsp. paratuberculosis
cucggugaucucaccggcggcg

SEQ ID NO: 832089 - RNA, 15 nt, Mycobacterium avium subsp. paratuberculosis
cucggugaugaucgc

SEQ ID NO: 832090 - RNA, 20 nt, Mycobacterium avium subsp. paratuberculosis
cucggugaugaucgccgggu

SEQ ID NO: 832091 - RNA, 19 nt, Mycobacterium avium subsp. paratuberculosis
cugaugcccucgccgguca

SEQ ID NO: 832092 - RNA, 11 nt, Mycobacterium avium subsp. paratuberculosis
cugaugcggcc

SEQ ID NO: 832093 - RNA, 18 nt, Mycobacterium avium subsp. paratuberculosis
cugauacgacguccgggc

SEQ ID NO: 832094 - RNA, 13 nt, Mycobacterium avium subsp. paratuberculosis
cugaguucgguga

SEQ ID NO: 832095 - RNA, 22 nt, Mycobacterium avium subsp. paratuberculosis
cugaguucggugaacugcagcc

SEQ ID NO: 832096 - RNA, 20 nt, Mycobacterium avium subsp. paratuberculosis
cugagcugguuucgggucga

SEQ ID NO: 832097 - RNA, 17 nt, Mycobacterium avium subsp. paratuberculosis
cugagcugugccgcggu

SEQ ID NO: 832098 - RNA, 19 nt, Mycobacterium avium subsp. paratuberculosis
cugagcuuuucgucggugc

SEQ ID NO: 832099 - RNA, 17 nt, Mycobacterium avium subsp. paratuberculosis
cugaggcccggugagcc

SEQ ID NO: 832100 - RNA, 14 nt, Mycobacterium avium subsp. paratuberculosis
cugcacacgggccc

SEQ ID NO: 832101 - RNA, 22 nt, Mycobacterium avium subsp. paratuberculosis
cugcacacgggcccguccgcga

SEQ ID NO: 832102 - RNA, 18 nt, Mycobacterium avium subsp. paratuberculosis
cugcacagcuucggcgcc

SEQ ID NO: 832103 - RNA, 15 nt, Mycobacterium avium subsp. paratuberculosis
cugcaccggcgacgg

SEQ ID NO: 832104 - RNA, 18 nt, Mycobacterium avium subsp. paratuberculosis
cugcaccggcgacggcgg

SEQ ID NO: 832105 - RNA, 17 nt, Mycobacterium avium subsp. paratuberculosis
cugcaccguuuccggug

SEQ ID NO: 832106 - RNA, 16 nt, Mycobacterium avium subsp. paratuberculosis
cugcaccggggccggc

SEQ ID NO: 832107 - RNA, 20 nt, Mycobacterium avium subsp. paratuberculosis
cugcaccggggccggcgggg

SEQ ID NO: 832108 - RNA, 19 nt, Mycobacterium avium subsp. paratuberculosis
cugcaccggguacaccggc

SEQ ID NO: 832109 - RNA, 23 nt, Mycobacterium avium subsp. paratuberculosis
cugauugcccuuggacaccugca

SEQ ID NO: 832110 - RNA, 19 nt, Mycobacterium avium subsp. paratuberculosis
cugauguccuuguggucga

SEQ ID NO: 832111 - RNA, 20 nt, Mycobacterium avium subsp. paratuberculosis
cugaugguggcgcgcaucgu

SEQ ID NO: 832112 - RNA, 20 nt, Mycobacterium avium subsp. paratuberculosis
cugauggcggcggcccgccg

SEQ ID NO: 832113 - RNA, 22 nt, Mycobacterium avium subsp. paratuberculosis
cugauggcggcggcccgccgcg

SEQ ID NO: 832114 - RNA, 15 nt, Mycobacterium avium subsp. paratuberculosis
cugauuguugacggu

SEQ ID NO: 832115 - RNA, 13 nt, Mycobacterium avium subsp. paratuberculosis
cugaccuggcuga

SEQ ID NO: 832116 - RNA, 17 nt, Mycobacterium avium subsp. paratuberculosis
cugaccugugcgcccca

SEQ ID NO: 832117 - RNA, 18 nt, Mycobacterium avium subsp. paratuberculosis
cugaccugugcgccccac

SEQ ID NO: 832118 - RNA, 18 nt, Mycobacterium avium subsp. paratuberculosis
cugaccucgccgcccucg

SEQ ID NO: 832119 - RNA, 14 nt, Mycobacterium avium subsp. paratuberculosis
cugaccucgcgccg

SEQ ID NO: 832120 - RNA, 17 nt, Mycobacterium avium subsp. paratuberculosis
cugaccucgcgccgcga

SEQ ID NO: 832121 - RNA, 21 nt, Mycobacterium avium subsp. paratuberculosis
cugaccuucuuggucagcggc

SEQ ID NO: 832122 - RNA, 18 nt, Mycobacterium avium subsp. paratuberculosis
cugacgaucgucgacguc

SEQ ID NO: 832123 - RNA, 14 nt, Mycobacterium avium subsp. paratuberculosis
cugacgcaucacca

SEQ ID NO: 832124 - RNA, 15 nt, Mycobacterium avium subsp. paratuberculosis
cugacgcaccucgcu

SEQ ID NO: 832125 - RNA, 20 nt, Mycobacterium avium subsp. paratuberculosis
cugacgauucuugaccaccu

SEQ ID NO: 832126 - RNA, 15 nt, Mycobacterium avium subsp. paratuberculosis
cugacgaugcggccg

SEQ ID NO: 832127 - RNA, 17 nt, Mycobacterium avium subsp. paratuberculosis
cugacgaugcggccggc

SEQ ID NO: 832128 - RNA, 18 nt, Mycobacterium avium subsp. paratuberculosis
cugacgaugcggccggcg

SEQ ID NO: 832129 - RNA, 19 nt, Mycobacterium avium subsp. paratuberculosis
cugacgauggcgaccgcgc

SEQ ID NO: 832130 - RNA, 16 nt, Mycobacterium avium subsp. paratuberculosis
cugacgccacgcguca

SEQ ID NO: 832131 - RNA, 18 nt, Mycobacterium avium subsp. paratuberculosis
cugacgcgaccgcgcggc

SEQ ID NO: 832132 - RNA, 13 nt, Mycobacterium avium subsp. paratuberculosis
cugacgccgcggu

SEQ ID NO: 832133 - RNA, 13 nt, Mycobacterium avium subsp. paratuberculosis
cugacgccggucg

SEQ ID NO: 832134 - RNA, 13 nt, Mycobacterium avium subsp. paratuberculosis
cugaaggcgcggg

SEQ ID NO: 832135 - RNA, 14 nt, Mycobacterium avium subsp. paratuberculosis
cugaccgucgacca

SEQ ID NO: 832136 - RNA, 17 nt, Mycobacterium avium subsp. paratuberculosis
cugaccgugcuuggcgg

SEQ ID NO: 832137 - RNA, 18 nt, Mycobacterium avium subsp. paratuberculosis
cugaagaucaacagccgc

SEQ ID NO: 832138 - RNA, 20 nt, Mycobacterium avium subsp. paratuberculosis
cugaagaucgaaaugaccgc

SEQ ID NO: 832139 - RNA, 13 nt, Mycobacterium avium subsp. paratuberculosis
cugaacagcgcgc

SEQ ID NO: 832140 - RNA, 22 nt, Mycobacterium avium subsp. paratuberculosis
cugaacagcgcgccgaacaccu

SEQ ID NO: 832141 - RNA, 19 nt, Mycobacterium avium subsp. paratuberculosis
cugaacagcagcagcagcg

SEQ ID NO: 832142 - RNA, 15 nt, Mycobacterium avium subsp. paratuberculosis
cugaagcccaccgcc

SEQ ID NO: 832143 - RNA, 15 nt, Mycobacterium avium subsp. paratuberculosis
cugagcagcccgacc

SEQ ID NO: 832144 - RNA, 14 nt, Mycobacterium avium subsp. paratuberculosis
cugagcagcagguc

SEQ ID NO: 832145 - RNA, 16 nt, Mycobacterium avium subsp. paratuberculosis
cugagcagcaggucgg

SEQ ID NO: 832146 - RNA, 18 nt, Mycobacterium avium subsp. paratuberculosis
cugagcagcaggucggcg

SEQ ID NO: 832147 - RNA, 20 nt, Mycobacterium avium subsp. paratuberculosis
cugagcacccgcagcucgcc

SEQ ID NO: 832148 - RNA, 21 nt, Mycobacterium avium subsp. paratuberculosis
cugagcacccgcagcucgccg

SEQ ID NO: 832149 - RNA, 23 nt, Mycobacterium avium subsp. paratuberculosis
cugagcacccgcagcucgccgag

SEQ ID NO: 832150 - RNA, 17 nt, Mycobacterium avium subsp. paratuberculosis
cugagcacccgcccgga

SEQ ID NO: 832151 - RNA, 22 nt, Mycobacterium avium subsp. paratuberculosis
cugagcacccgcccggacgcgc

SEQ ID NO: 832152 - RNA, 16 nt, Mycobacterium avium subsp. paratuberculosis
cugagcagcucgcgga

SEQ ID NO: 832153 - RNA, 23 nt, Mycobacterium avium subsp. paratuberculosis
cugagcagcucgcggauccgcag

SEQ ID NO: 832154 - RNA, 18 nt, Mycobacterium avium subsp. paratuberculosis
cugagcaaccgccgaaac

SEQ ID NO: 832155 - RNA, 14 nt, Mycobacterium avium subsp. paratuberculosis
cugagcaaccgguu

SEQ ID NO: 832156 - RNA, 19 nt, Mycobacterium avium subsp. paratuberculosis
cugacuccaucccgugcgg

SEQ ID NO: 832157 - RNA, 18 nt, Mycobacterium avium subsp. paratuberculosis
cugacugcgaucgccgac

SEQ ID NO: 832158 - RNA, 19 nt, Mycobacterium avium subsp. paratuberculosis
cugacugcgaucgccgacg

SEQ ID NO: 832159 - RNA, 17 nt, Mycobacterium avium subsp. paratuberculosis
cugacgcucggucgcca

SEQ ID NO: 832160 - RNA, 24 nt, Mycobacterium avium subsp. paratuberculosis
cugacgcucggucgccacggccgg

SEQ ID NO: 832161 - RNA, 14 nt, Mycobacterium avium subsp. paratuberculosis
cugacgcggcgggc

SEQ ID NO: 832162 - RNA, 23 nt, Mycobacterium avium subsp. paratuberculosis
cucgaaugcggcugccggccaag

SEQ ID NO: 832163 - RNA, 14 nt, Mycobacterium avium subsp. paratuberculosis
cucgaagucgccgg

SEQ ID NO: 832164 - RNA, 17 nt, Mycobacterium avium subsp. paratuberculosis
cucgaagucgccggccu

SEQ ID NO: 832165 - RNA, 17 nt, Mycobacterium avium subsp. paratuberculosis
cucgaaguggcagcgcu

SEQ ID NO: 832166 - RNA, 12 nt, Mycobacterium avium subsp. paratuberculosis
cuccuggccgcc

SEQ ID NO: 832167 - RNA, 17 nt, Mycobacterium avium subsp. paratuberculosis
cuccuggccgccgugca

SEQ ID NO: 832168 - RNA, 21 nt, Mycobacterium avium subsp. paratuberculosis
cuccugggugaguucgucggc

SEQ ID NO: 832169 - RNA, 23 nt, Mycobacterium avium subsp. paratuberculosis
cuccugccguucggccagcgccg

SEQ ID NO: 832170 - RNA, 23 nt, Mycobacterium avium subsp. paratuberculosis
cuccuggaagaagucggugucga

SEQ ID NO: 832171 - RNA, 19 nt, Mycobacterium avium subsp. paratuberculosis
cuccuggaaggacgucagg

SEQ ID NO: 832172 - RNA, 17 nt, Mycobacterium avium subsp. paratuberculosis
cucgacacgggccgcgc

SEQ ID NO: 832173 - RNA, 21 nt, Mycobacterium avium subsp. paratuberculosis
cucgacacgggccgcgccgag

SEQ ID NO: 832174 - RNA, 17 nt, Mycobacterium avium subsp. paratuberculosis
cucgacaggcagcccgg

SEQ ID NO: 832175 - RNA, 20 nt, Mycobacterium avium subsp. paratuberculosis
cucgacaggcagcccggcug

SEQ ID NO: 832176 - RNA, 23 nt, Mycobacterium avium subsp. paratuberculosis
cucgacaggcagcccggcugcgc

SEQ ID NO: 832177 - RNA, 13 nt, Mycobacterium avium subsp. paratuberculosis
cucgaccacccgc

SEQ ID NO: 832178 - RNA, 18 nt, Mycobacterium avium subsp. paratuberculosis
cucgaccacccggcgggc

SEQ ID NO: 832179 - RNA, 20 nt, Mycobacterium avium subsp. paratuberculosis
cucgaccacccggcgggcca

SEQ ID NO: 832180 - RNA, 16 nt, Mycobacterium avium subsp. paratuberculosis
cucgacaucggccgcc

SEQ ID NO: 832181 - RNA, 23 nt, Mycobacterium avium subsp. paratuberculosis
cucgaccaccucuucgcggucca

SEQ ID NO: 832182 - RNA, 15 nt, Mycobacterium avium subsp. paratuberculosis
cuccugccagcggcg

SEQ ID NO: 832183 - RNA, 14 nt, Mycobacterium avium subsp. paratuberculosis
cuccugcagcgcgg

SEQ ID NO: 832184 - RNA, 13 nt, Mycobacterium avium subsp. paratuberculosis
cuccugcacgcgc

SEQ ID NO: 832185 - RNA, 23 nt, Mycobacterium avium subsp. paratuberculosis
cuccugcacgcgcgggucgucgg

SEQ ID NO: 832186 - RNA, 18 nt, Mycobacterium avium subsp. paratuberculosis
cuccguugucgaggucgg

SEQ ID NO: 832187 - RNA, 16 nt, Mycobacterium avium subsp. paratuberculosis
cuccucggggaugacg

SEQ ID NO: 832188 - RNA, 16 nt, Mycobacterium avium subsp. paratuberculosis
cuccucggucagcggc

SEQ ID NO: 832189 - RNA, 20 nt, Mycobacterium avium subsp. paratuberculosis
cuccucggucagcucggggu

SEQ ID NO: 832190 - RNA, 19 nt, Mycobacterium avium subsp. paratuberculosis
cuccucgguguacagcgcc

SEQ ID NO: 832191 - RNA, 17 nt, Mycobacterium avium subsp. paratuberculosis
cuccucuucgcugccgc

SEQ ID NO: 832192 - RNA, 18 nt, Mycobacterium avium subsp. paratuberculosis
cuccucuucgcugccgcc

SEQ ID NO: 832193 - RNA, 23 nt, Mycobacterium avium subsp. paratuberculosis
cuccuaugucggugcggcgggcu

SEQ ID NO: 832194 - RNA, 20 nt, Mycobacterium avium subsp. paratuberculosis
cuccguugggucucaucccg

SEQ ID NO: 832195 - RNA, 21 nt, Mycobacterium avium subsp. paratuberculosis
cuccguugggucucaucccgc

SEQ ID NO: 832196 - RNA, 14 nt, Mycobacterium avium subsp. paratuberculosis
cuccgugcuggccg

SEQ ID NO: 832197 - RNA, 14 nt, Mycobacterium avium subsp. paratuberculosis
cuccguggacggcg

SEQ ID NO: 832198 - RNA, 17 nt, Mycobacterium avium subsp. paratuberculosis
cuccguggacggcgagc

SEQ ID NO: 832199 - RNA, 21 nt, Mycobacterium avium subsp. paratuberculosis
cuccguggacggcgagcggcc

SEQ ID NO: 832200 - RNA, 24 nt, Mycobacterium avium subsp. paratuberculosis
cuccccggcgaucucgagcauccg

SEQ ID NO: 832201 - RNA, 16 nt, Mycobacterium avium subsp. paratuberculosis
cucccgagcaucgccg

SEQ ID NO: 832202 - RNA, 19 nt, Mycobacterium avium subsp. paratuberculosis
cucccgagcaucgccgagc

SEQ ID NO: 832203 - RNA, 17 nt, Mycobacterium avium subsp. paratuberculosis
cucccgcagcgccagcg

SEQ ID NO: 832204 - RNA, 19 nt, Mycobacterium avium subsp. paratuberculosis
cucccgauggcucgcgggg

SEQ ID NO: 832205 - RNA, 12 nt, Mycobacterium avium subsp. paratuberculosis
cuccccggccag

SEQ ID NO: 832206 - RNA, 18 nt, Mycobacterium avium subsp. paratuberculosis
cuccccggccagcacgcc

SEQ ID NO: 832207 - RNA, 21 nt, Mycobacterium avium subsp. paratuberculosis
cuccccggacagccacuccau

SEQ ID NO: 832208 - RNA, 20 nt, Mycobacterium avium subsp. paratuberculosis
cuccccgcuagccucaacga

SEQ ID NO: 832209 - RNA, 13 nt, Mycobacterium avium subsp. paratuberculosis
cuccccgagcacg

SEQ ID NO: 832210 - RNA, 15 nt, Mycobacterium avium subsp. paratuberculosis
cuccccgagcacguc

SEQ ID NO: 832211 - RNA, 17 nt, Mycobacterium avium subsp. paratuberculosis
cuccccgagcacgucga

SEQ ID NO: 832212 - RNA, 19 nt, Mycobacterium avium subsp. paratuberculosis
cuccccgcccggcaacacg

SEQ ID NO: 832213 - RNA, 16 nt, Mycobacterium avium subsp. paratuberculosis
cuccccauccgcggcc

SEQ ID NO: 832214 - RNA, 20 nt, Mycobacterium avium subsp. paratuberculosis
cuccccauccgcggccaccg

SEQ ID NO: 832215 - RNA, 13 nt, Mycobacterium avium subsp. paratuberculosis
cucccccacccgc

SEQ ID NO: 832216 - RNA, 14 nt, Mycobacterium avium subsp. paratuberculosis
cucccccacccgca

SEQ ID NO: 832217 - RNA, 14 nt, Mycobacterium avium subsp. paratuberculosis
cucccccgacgccg

SEQ ID NO: 832218 - RNA, 17 nt, Mycobacterium avium subsp. paratuberculosis
cucccccgacgccgaca

SEQ ID NO: 832219 - RNA, 22 nt, Mycobacterium avium subsp. paratuberculosis
cucccccgagucggagacccgc

SEQ ID NO: 832220 - RNA, 14 nt, Mycobacterium avium subsp. paratuberculosis
cucccccgcccgga

SEQ ID NO: 832221 - RNA, 15 nt, Mycobacterium avium subsp. paratuberculosis
cucccgcgccgcggc

SEQ ID NO: 832222 - RNA, 20 nt, Mycobacterium avium subsp. paratuberculosis
cucccgcgccgcggccagcg

SEQ ID NO: 832223 - RNA, 14 nt, Mycobacterium avium subsp. paratuberculosis
cucccgcgcgcugu

SEQ ID NO: 832224 - RNA, 14 nt, Mycobacterium avium subsp. paratuberculosis
cucccgcggcagcc

SEQ ID NO: 832225 - RNA, 21 nt, Mycobacterium avium subsp. paratuberculosis
cucccgcguauugcacggcgg

SEQ ID NO: 832226 - RNA, 24 nt, Mycobacterium avium subsp. paratuberculosis
cucccgcguauugcacggcggcga

SEQ ID NO: 832227 - RNA, 23 nt, Mycobacterium avium subsp. paratuberculosis
cuccgggguggccuuguggucga

SEQ ID NO: 832228 - RNA, 14 nt, Mycobacterium avium subsp. paratuberculosis
cuccgggcugaccu

SEQ ID NO: 832229 - RNA, 16 nt, Mycobacterium avium subsp. paratuberculosis
cuccgguaccacgccg

SEQ ID NO: 832230 - RNA, 19 nt, Mycobacterium avium subsp. paratuberculosis
cuccgguaccacgccgucg

SEQ ID NO: 832231 - RNA, 20 nt, Mycobacterium avium subsp. paratuberculosis
cuccgguaccacgccgucga

SEQ ID NO: 832232 - RNA, 22 nt, Mycobacterium avium subsp. paratuberculosis
cuccgguaccacgccgucgacg

SEQ ID NO: 832233 - RNA, 18 nt, Mycobacterium avium subsp. paratuberculosis
cuccgguuugcgccggcu

SEQ ID NO: 832234 - RNA, 23 nt, Mycobacterium avium subsp. paratuberculosis
cuccggucgcgucgugcggccgg

SEQ ID NO: 832235 - RNA, 23 nt, Mycobacterium avium subsp. paratuberculosis
cuccggugaaccgcugaccagga

SEQ ID NO: 832236 - RNA, 14 nt, Mycobacterium avium subsp. paratuberculosis
cuccgucagcgccg

SEQ ID NO: 832237 - RNA, 18 nt, Mycobacterium avium subsp. paratuberculosis
cuccgucgagucggccac

SEQ ID NO: 832238 - RNA, 22 nt, Mycobacterium avium subsp. paratuberculosis
cuccgucgcgaucacaccacca

SEQ ID NO: 832239 - RNA, 17 nt, Mycobacterium avium subsp. paratuberculosis
cuccguccaccggcacg

SEQ ID NO: 832240 - RNA, 19 nt, Mycobacterium avium subsp. paratuberculosis
cuccguccaccggcacggc

SEQ ID NO: 832241 - RNA, 13 nt, Mycobacterium avium subsp. paratuberculosis
cuccgucagcgcc

SEQ ID NO: 832242 - RNA, 13 nt, Mycobacterium avium subsp. paratuberculosis
cucgacguucggc

SEQ ID NO: 832243 - RNA, 16 nt, Mycobacterium avium subsp. paratuberculosis
cucgacguucggcggg

SEQ ID NO: 832244 - RNA, 18 nt, Mycobacterium avium subsp. paratuberculosis
cucgacguucggcgggca

SEQ ID NO: 832245 - RNA, 14 nt, Mycobacterium avium subsp. paratuberculosis
cucgagcacgcccu

SEQ ID NO: 832246 - RNA, 14 nt, Mycobacterium avium subsp. paratuberculosis
cucgagcagcgcgc

SEQ ID NO: 832247 - RNA, 15 nt, Mycobacterium avium subsp. paratuberculosis
cucgagcagcgcgcg

SEQ ID NO: 832248 - RNA, 20 nt, Mycobacterium avium subsp. paratuberculosis
cucgagcaccacggcccgcg

SEQ ID NO: 832249 - RNA, 11 nt, Mycobacterium avium subsp. paratuberculosis
cucgagcaccg

SEQ ID NO: 832250 - RNA, 19 nt, Mycobacterium avium subsp. paratuberculosis
cucgagauucugcagccgc

SEQ ID NO: 832251 - RNA, 18 nt, Mycobacterium avium subsp. paratuberculosis
cucgagcaacggccgcag

SEQ ID NO: 832252 - RNA, 19 nt, Mycobacterium avium subsp. paratuberculosis
cucgagcaacggccgcagc

SEQ ID NO: 832253 - RNA, 20 nt, Mycobacterium avium subsp. paratuberculosis
cucgagcaacggccgcagcg

SEQ ID NO: 832254 - RNA, 18 nt, Mycobacterium avium subsp. paratuberculosis
cucgauaauggcggccgc

SEQ ID NO: 832255 - RNA, 20 nt, Mycobacterium avium subsp. paratuberculosis
cucgauaauggcggccgccg

SEQ ID NO: 832256 - RNA, 17 nt, Mycobacterium avium subsp. paratuberculosis
cucgaguuuggccagcu

SEQ ID NO: 832257 - RNA, 14 nt, Mycobacterium avium subsp. paratuberculosis
cucgagcaucacga

SEQ ID NO: 832258 - RNA, 18 nt, Mycobacterium avium subsp. paratuberculosis
cucgagcauccggugccg

SEQ ID NO: 832259 - RNA, 20 nt, Mycobacterium avium subsp. paratuberculosis
cucgagugccggcagcccgg

SEQ ID NO: 832260 - RNA, 16 nt, Mycobacterium avium subsp. paratuberculosis
cucgacccgggccagc

SEQ ID NO: 832261 - RNA, 19 nt, Mycobacterium avium subsp. paratuberculosis
cucgacccguuccggcgag

SEQ ID NO: 832262 - RNA, 14 nt, Mycobacterium avium subsp. paratuberculosis
cucgaccgcggcga

SEQ ID NO: 832263 - RNA, 15 nt, Mycobacterium avium subsp. paratuberculosis
cucgaccgcggcgau

SEQ ID NO: 832264 - RNA, 22 nt, Mycobacterium avium subsp. paratuberculosis
cucgaccgcggcgauggcccgc

SEQ ID NO: 832265 - RNA, 18 nt, Mycobacterium avium subsp. paratuberculosis
cucgaccgcggcgccgau

SEQ ID NO: 832266 - RNA, 16 nt, Mycobacterium avium subsp. paratuberculosis
cucgaccgcgguggcg

SEQ ID NO: 832267 - RNA, 16 nt, Mycobacterium avium subsp. paratuberculosis
cucgacguccaggccg

SEQ ID NO: 832268 - RNA, 18 nt, Mycobacterium avium subsp. paratuberculosis
cucgacguccaggccggc

SEQ ID NO: 832269 - RNA, 20 nt, Mycobacterium avium subsp. paratuberculosis
cucgacguccaggccggcgc

SEQ ID NO: 832270 - RNA, 21 nt, Mycobacterium avium subsp. paratuberculosis
cucgacguccaggccggcgcc

SEQ ID NO: 832271 - RNA, 22 nt, Mycobacterium avium subsp. paratuberculosis
cucgacguccaggccggcgccg

SEQ ID NO: 832272 - RNA, 13 nt, Mycobacterium avium subsp. paratuberculosis
cucgaccagcccc

SEQ ID NO: 832273 - RNA, 16 nt, Mycobacterium avium subsp. paratuberculosis
cucgaccccucggcau

SEQ ID NO: 832274 - RNA, 15 nt, Mycobacterium avium subsp. paratuberculosis
cucgacccgcaccuc

SEQ ID NO: 832275 - RNA, 16 nt, Mycobacterium avium subsp. paratuberculosis
cucgacccgcaccucg

SEQ ID NO: 832276 - RNA, 18 nt, Mycobacterium avium subsp. paratuberculosis
cucgacccgcaccucgaa

SEQ ID NO: 832277 - RNA, 17 nt, Mycobacterium avium subsp. paratuberculosis
cucgaccagccgggucc

SEQ ID NO: 832278 - RNA, 16 nt, Mycobacterium avium subsp. paratuberculosis
cucgaccagccggugg

SEQ ID NO: 832279 - RNA, 17 nt, Mycobacterium avium subsp. paratuberculosis
cucgaccagccggugga

SEQ ID NO: 832280 - RNA, 14 nt, Mycobacterium avium subsp. paratuberculosis
cucgaccagcgccg

SEQ ID NO: 832281 - RNA, 16 nt, Mycobacterium avium subsp. paratuberculosis
cucgaccagcgccgag

SEQ ID NO: 832282 - RNA, 17 nt, Mycobacterium avium subsp. paratuberculosis
cucgaccagcgccgaga

SEQ ID NO: 832283 - RNA, 14 nt, Mycobacterium avium subsp. paratuberculosis
cucgaccagcgcgc

SEQ ID NO: 832284 - RNA, 15 nt, Mycobacterium avium subsp. paratuberculosis
cucgaccagcgcgcc

SEQ ID NO: 832285 - RNA, 18 nt, Mycobacterium avium subsp. paratuberculosis
cucgaccagcgcgccgcc

SEQ ID NO: 832286 - RNA, 20 nt, Mycobacterium avium subsp. paratuberculosis
cucgaccagcgcgccgccca

SEQ ID NO: 832287 - RNA, 16 nt, Mycobacterium avium subsp. paratuberculosis
cucgaucgacaccucg

SEQ ID NO: 832288 - RNA, 16 nt, Mycobacterium avium subsp. paratuberculosis
cucgaucgccaccgag

SEQ ID NO: 832289 - RNA, 18 nt, Mycobacterium avium subsp. paratuberculosis
cucgaucgccaccgagau

SEQ ID NO: 832290 - RNA, 20 nt, Mycobacterium avium subsp. paratuberculosis
cucgauccgguccagcccgg

SEQ ID NO: 832291 - RNA, 21 nt, Mycobacterium avium subsp. paratuberculosis
cucgauccgguccagcccggu

SEQ ID NO: 832292 - RNA, 17 nt, Mycobacterium avium subsp. paratuberculosis
cucgaucagcggcaucg

SEQ ID NO: 832293 - RNA, 17 nt, Mycobacterium avium subsp. paratuberculosis
cucgaucguccgaggcc

SEQ ID NO: 832294 - RNA, 21 nt, Mycobacterium avium subsp. paratuberculosis
cucgaucguccgaggccccgc

SEQ ID NO: 832295 - RNA, 14 nt, Mycobacterium avium subsp. paratuberculosis
cucgaucgccgcgc

SEQ ID NO: 832296 - RNA, 15 nt, Mycobacterium avium subsp. paratuberculosis
cucgaucgccgcgcc

SEQ ID NO: 832297 - RNA, 17 nt, Mycobacterium avium subsp. paratuberculosis
cucgaucgccgcgccca

SEQ ID NO: 832298 - RNA, 15 nt, Mycobacterium avium subsp. paratuberculosis
cucgaucgcggucac

SEQ ID NO: 832299 - RNA, 17 nt, Mycobacterium avium subsp. paratuberculosis
cucgaucugcagccggc

SEQ ID NO: 832300 - RNA, 22 nt, Mycobacterium avium subsp. paratuberculosis
cucgaucugcagccggcgcggc

SEQ ID NO: 832301 - RNA, 14 nt, Mycobacterium avium subsp. paratuberculosis
cucgaucuggcgga

SEQ ID NO: 832302 - RNA, 19 nt, Mycobacterium avium subsp. paratuberculosis
cucgaucugggccaggauc

SEQ ID NO: 832303 - RNA, 18 nt, Mycobacterium avium subsp. paratuberculosis
cucgaucaacgccggguc

SEQ ID NO: 832304 - RNA, 19 nt, Mycobacterium avium subsp. paratuberculosis
cucgaucaucaccaccgcc

SEQ ID NO: 832305 - RNA, 12 nt, Mycobacterium avium subsp. paratuberculosis
cucgaucaccga

SEQ ID NO: 832306 - RNA, 19 nt, Mycobacterium avium subsp. paratuberculosis
cucgaucaccgggcggccg

SEQ ID NO: 832307 - RNA, 18 nt, Mycobacterium avium subsp. paratuberculosis
cucgaucagagcgggccg

SEQ ID NO: 832308 - RNA, 22 nt, Mycobacterium avium subsp. paratuberculosis
cucgaucagagcgggccgaccg

SEQ ID NO: 832309 - RNA, 16 nt, Mycobacterium avium subsp. paratuberculosis
cucgaucagcaccgcc

SEQ ID NO: 832310 - RNA, 15 nt, Mycobacterium avium subsp. paratuberculosis
cucgauggcccgcuc

SEQ ID NO: 832311 - RNA, 17 nt, Mycobacterium avium subsp. paratuberculosis
cucgauggcccgcucgg

SEQ ID NO: 832312 - RNA, 14 nt, Mycobacterium avium subsp. paratuberculosis
cucgauggccucgu

SEQ ID NO: 832313 - RNA, 13 nt, Mycobacterium avium subsp. paratuberculosis
cucgauggcgacg

SEQ ID NO: 832314 - RNA, 17 nt, Mycobacterium avium subsp. paratuberculosis
cucgauggcgacgcacg

SEQ ID NO: 832315 - RNA, 18 nt, Mycobacterium avium subsp. paratuberculosis
cucgaugggggugccgca

SEQ ID NO: 832316 - RNA, 20 nt, Mycobacterium avium subsp. paratuberculosis
cucgaugggggugccgcagc

SEQ ID NO: 832317 - RNA, 20 nt, Mycobacterium avium subsp. paratuberculosis
cucgauggguguggcgucga

SEQ ID NO: 832318 - RNA, 20 nt, Mycobacterium avium subsp. paratuberculosis
cucgauggguucuucgacca

SEQ ID NO: 832319 - RNA, 14 nt, Mycobacterium avium subsp. paratuberculosis
cucgauggcggcgg

SEQ ID NO: 832320 - RNA, 15 nt, Mycobacterium avium subsp. paratuberculosis
cucgauggcggcggc

SEQ ID NO: 832321 - RNA, 22 nt, Mycobacterium avium subsp. paratuberculosis
cucgauggaauucgucggcggu

SEQ ID NO: 832322 - RNA, 14 nt, Mycobacterium avium subsp. paratuberculosis
cucgauggccagcg

SEQ ID NO: 832323 - RNA, 15 nt, Mycobacterium avium subsp. paratuberculosis
cucgauggccagcgc

SEQ ID NO: 832324 - RNA, 17 nt, Mycobacterium avium subsp. paratuberculosis
cucgauggccagcgcgu

SEQ ID NO: 832325 - RNA, 19 nt, Mycobacterium avium subsp. paratuberculosis
cucgauggccagcgcgucg

SEQ ID NO: 832326 - RNA, 20 nt, Mycobacterium avium subsp. paratuberculosis
cucgauggccagcgcgucgc

SEQ ID NO: 832327 - RNA, 14 nt, Mycobacterium avium subsp. paratuberculosis
cucgaugcgcgcca

SEQ ID NO: 832328 - RNA, 13 nt, Mycobacterium avium subsp. paratuberculosis
cucgaugcggcag

SEQ ID NO: 832329 - RNA, 13 nt, Mycobacterium avium subsp. paratuberculosis
cucgaugcggccg

SEQ ID NO: 832330 - RNA, 16 nt, Mycobacterium avium subsp. paratuberculosis
cucgaugcgcaccgug

SEQ ID NO: 832331 - RNA, 14 nt, Mycobacterium avium subsp. paratuberculosis
cucgaugcgcaccu

SEQ ID NO: 832332 - RNA, 19 nt, Mycobacterium avium subsp. paratuberculosis
cucgaugcgcagggcggaa

SEQ ID NO: 832333 - RNA, 17 nt, Mycobacterium avium subsp. paratuberculosis
cucgaugcacggucggc

SEQ ID NO: 832334 - RNA, 23 nt, Mycobacterium avium subsp. paratuberculosis
cucgaugcggguguugcgcagcg

SEQ ID NO: 832335 - RNA, 19 nt, Mycobacterium avium subsp. paratuberculosis
cucgaugccgaccgacagc

SEQ ID NO: 832336 - RNA, 22 nt, Mycobacterium avium subsp. paratuberculosis
cucgaugccgaccgacagccgc

SEQ ID NO: 832337 - RNA, 14 nt, Mycobacterium avium subsp. paratuberculosis
cucgaugacgccgg

SEQ ID NO: 832338 - RNA, 15 nt, Mycobacterium avium subsp. paratuberculosis
cucgaugacgccgga

SEQ ID NO: 832339 - RNA, 12 nt, Mycobacterium avium subsp. paratuberculosis
cucgaugagcga

SEQ ID NO: 832340 - RNA, 19 nt, Mycobacterium avium subsp. paratuberculosis
cucgaucuugugcucgagc

SEQ ID NO: 832341 - RNA, 23 nt, Mycobacterium avium subsp. paratuberculosis
cucgaucugguucaccgccacca

SEQ ID NO: 832342 - RNA, 18 nt, Mycobacterium avium subsp. paratuberculosis
cucgcgcacuucgcgggc

SEQ ID NO: 832343 - RNA, 21 nt, Mycobacterium avium subsp. paratuberculosis
cucgcgcacuucgcgggcggc

SEQ ID NO: 832344 - RNA, 23 nt, Mycobacterium avium subsp. paratuberculosis
cucgcgcacuucgcgggcggcgc

SEQ ID NO: 832345 - RNA, 22 nt, Mycobacterium avium subsp. paratuberculosis
cucgcgcagcaccgaugccaga

SEQ ID NO: 832346 - RNA, 14 nt, Mycobacterium avium subsp. paratuberculosis
cucgcgcagcacga

SEQ ID NO: 832347 - RNA, 20 nt, Mycobacterium avium subsp. paratuberculosis
cucgccguuuugccgccgag

SEQ ID NO: 832348 - RNA, 23 nt, Mycobacterium avium subsp. paratuberculosis
cucgccguugcgggucggcguca

SEQ ID NO: 832349 - RNA, 23 nt, Mycobacterium avium subsp. paratuberculosis
cucgcgcaccgcgggcucgaaca

SEQ ID NO: 832350 - RNA, 17 nt, Mycobacterium avium subsp. paratuberculosis
cucgcgcaccggcugcc

SEQ ID NO: 832351 - RNA, 14 nt, Mycobacterium avium subsp. paratuberculosis
cucgcgcaccggga

SEQ ID NO: 832352 - RNA, 17 nt, Mycobacterium avium subsp. paratuberculosis
cucgcgcaccgggacca

SEQ ID NO: 832353 - RNA, 15 nt, Mycobacterium avium subsp. paratuberculosis
cucgcgcagcuggcc

SEQ ID NO: 832354 - RNA, 14 nt, Mycobacterium avium subsp. paratuberculosis
cucgcgcaggaaca

SEQ ID NO: 832355 - RNA, 20 nt, Mycobacterium avium subsp. paratuberculosis
cucgcgcaggaacuccagca

SEQ ID NO: 832356 - RNA, 14 nt, Mycobacterium avium subsp. paratuberculosis
cucgcgcagccggc

SEQ ID NO: 832357 - RNA, 22 nt, Mycobacterium avium subsp. paratuberculosis
cucgcgcagccggccgaccgcc

SEQ ID NO: 832358 - RNA, 19 nt, Mycobacterium avium subsp. paratuberculosis
cucgcgcagcgcgucgggc

SEQ ID NO: 832359 - RNA, 14 nt, Mycobacterium avium subsp. paratuberculosis
cucgcgcaggucac

SEQ ID NO: 832360 - RNA, 16 nt, Mycobacterium avium subsp. paratuberculosis
cucgcgcaucagcgga

SEQ ID NO: 832361 - RNA, 17 nt, Mycobacterium avium subsp. paratuberculosis
cucgcgcccggcgccgg

SEQ ID NO: 832362 - RNA, 22 nt, Mycobacterium avium subsp. paratuberculosis
cucgcgcccggcgccggcccgc

SEQ ID NO: 832363 - RNA, 13 nt, Mycobacterium avium subsp. paratuberculosis
cucgcgccgaccc

SEQ ID NO: 832364 - RNA, 19 nt, Mycobacterium avium subsp. paratuberculosis
cucgcgccgccacgcggcg

SEQ ID NO: 832365 - RNA, 23 nt, Mycobacterium avium subsp. paratuberculosis
cucgcgccgcgaucucggcggac

SEQ ID NO: 832366 - RNA, 13 nt, Mycobacterium avium subsp. paratuberculosis
cucgcgccgggcg

SEQ ID NO: 832367 - RNA, 15 nt, Mycobacterium avium subsp. paratuberculosis
cucgcgccgggcggc

SEQ ID NO: 832368 - RNA, 13 nt, Mycobacterium avium subsp. paratuberculosis
cucgcgcgcgagc

SEQ ID NO: 832369 - RNA, 14 nt, Mycobacterium avium subsp. paratuberculosis
cucgcgcgggucga

SEQ ID NO: 832370 - RNA, 16 nt, Mycobacterium avium subsp. paratuberculosis
cucgcgcgggucgagc

SEQ ID NO: 832371 - RNA, 23 nt, Mycobacterium avium subsp. paratuberculosis
cucgcgcgggucgagcagcagcc

SEQ ID NO: 832372 - RNA, 13 nt, Mycobacterium avium subsp. paratuberculosis
cucgcgcgguguu

SEQ ID NO: 832373 - RNA, 22 nt, Mycobacterium avium subsp. paratuberculosis
cucgcgcgguguuuggccgcgc

SEQ ID NO: 832374 - RNA, 17 nt, Mycobacterium avium subsp. paratuberculosis
cucgcgcugcaugccgg

SEQ ID NO: 832375 - RNA, 15 nt, Mycobacterium avium subsp. paratuberculosis
cucgcgcggggcggc

SEQ ID NO: 832376 - RNA, 23 nt, Mycobacterium avium subsp. paratuberculosis
cucgcgcggggcggccgccgggc

SEQ ID NO: 832377 - RNA, 16 nt, Mycobacterium avium subsp. paratuberculosis
cucgcgcucccggcgc

SEQ ID NO: 832378 - RNA, 18 nt, Mycobacterium avium subsp. paratuberculosis
cucgcgcucccggcgccg

SEQ ID NO: 832379 - RNA, 20 nt, Mycobacterium avium subsp. paratuberculosis
cucgccgucgaaggccgggc

SEQ ID NO: 832380 - RNA, 20 nt, Mycobacterium avium subsp. paratuberculosis
cucgccgugcagcaccucga

SEQ ID NO: 832381 - RNA, 15 nt, Mycobacterium avium subsp. paratuberculosis
cucgccgucggccag

SEQ ID NO: 832382 - RNA, 17 nt, Mycobacterium avium subsp. paratuberculosis
cucgccgucggccagca

SEQ ID NO: 832383 - RNA, 19 nt, Mycobacterium avium subsp. paratuberculosis
cucgccgucggccagcagc

SEQ ID NO: 832384 - RNA, 19 nt, Mycobacterium avium subsp. paratuberculosis
cucgccggucagcacgucg

SEQ ID NO: 832385 - RNA, 16 nt, Mycobacterium avium subsp. paratuberculosis
cucgccggucagcgca

SEQ ID NO: 832386 - RNA, 20 nt, Mycobacterium avium subsp. paratuberculosis
cucgccggucagcgcauccu

SEQ ID NO: 832387 - RNA, 17 nt, Mycobacterium avium subsp. paratuberculosis
cucgccgguggcggcga

SEQ ID NO: 832388 - RNA, 23 nt, Mycobacterium avium subsp. paratuberculosis
cucgccgguggcggcgacaucga

SEQ ID NO: 832389 - RNA, 17 nt, Mycobacterium avium subsp. paratuberculosis
cucgccgucacaccgcg

SEQ ID NO: 832390 - RNA, 19 nt, Mycobacterium avium subsp. paratuberculosis
cucgccgucacaccgcggc

SEQ ID NO: 832391 - RNA, 13 nt, Mycobacterium avium subsp. paratuberculosis
cucgccgggcccg

SEQ ID NO: 832392 - RNA, 14 nt, Mycobacterium avium subsp. paratuberculosis
cucgccgggcccgc

SEQ ID NO: 832393 - RNA, 18 nt, Mycobacterium avium subsp. paratuberculosis
cucgccgggcccgcucac

SEQ ID NO: 832394 - RNA, 21 nt, Mycobacterium avium subsp. paratuberculosis
cucgccgggcugcacgcugcg

SEQ ID NO: 832395 - RNA, 20 nt, Mycobacterium avium subsp. paratuberculosis
cucgccggggacgacggcgg

SEQ ID NO: 832396 - RNA, 22 nt, Mycobacterium avium subsp. paratuberculosis
cucgccggggacgacggcgggg

SEQ ID NO: 832397 - RNA, 14 nt, Mycobacterium avium subsp. paratuberculosis
cucgauguugaucg

SEQ ID NO: 832398 - RNA, 16 nt, Mycobacterium avium subsp. paratuberculosis
cucgauguugaucgcc

SEQ ID NO: 832399 - RNA, 23 nt, Mycobacterium avium subsp. paratuberculosis
cucgauguugaucgccaugcugg

SEQ ID NO: 832400 - RNA, 16 nt, Mycobacterium avium subsp. paratuberculosis
cucgauguagccgggc

SEQ ID NO: 832401 - RNA, 13 nt, Mycobacterium avium subsp. paratuberculosis
cucgauggcgccg

SEQ ID NO: 832402 - RNA, 12 nt, Mycobacterium avium subsp. paratuberculosis
cucgauggucgc

SEQ ID NO: 832403 - RNA, 14 nt, Mycobacterium avium subsp. paratuberculosis
cucgauggucgucg

SEQ ID NO: 832404 - RNA, 14 nt, Mycobacterium avium subsp. paratuberculosis
cucgcucagcccgg

SEQ ID NO: 832405 - RNA, 20 nt, Mycobacterium avium subsp. paratuberculosis
cucgcguggccugggcgacc

SEQ ID NO: 832406 - RNA, 21 nt, Mycobacterium avium subsp. paratuberculosis
cucgcguggccugggcgacca

SEQ ID NO: 832407 - RNA, 16 nt, Mycobacterium avium subsp. paratuberculosis
cucgcucaacccgucg

SEQ ID NO: 832408 - RNA, 20 nt, Mycobacterium avium subsp. paratuberculosis
cucgcucaacccgucgcggg

SEQ ID NO: 832409 - RNA, 17 nt, Mycobacterium avium subsp. paratuberculosis
cucgcgguugggccgcc

SEQ ID NO: 832410 - RNA, 18 nt, Mycobacterium avium subsp. paratuberculosis
cucgcgguugggccgccg

SEQ ID NO: 832411 - RNA, 23 nt, Mycobacterium avium subsp. paratuberculosis
cucgcgguugcggguggcggccg

SEQ ID NO: 832412 - RNA, 16 nt, Mycobacterium avium subsp. paratuberculosis
cucgcguccccgcgcc

SEQ ID NO: 832413 - RNA, 22 nt, Mycobacterium avium subsp. paratuberculosis
cucgcgucgacgucgggcacgg

SEQ ID NO: 832414 - RNA, 22 nt, Mycobacterium avium subsp. paratuberculosis
cucgcguucgcuuucgccgggc

SEQ ID NO: 832415 - RNA, 23 nt, Mycobacterium avium subsp. paratuberculosis
cucgcguucgcuuucgccgggcg

SEQ ID NO: 832416 - RNA, 18 nt, Mycobacterium avium subsp. paratuberculosis
cucgcguucgggcccggc

SEQ ID NO: 832417 - RNA, 22 nt, Mycobacterium avium subsp. paratuberculosis
cucgcguucgggcccggccgcc

SEQ ID NO: 832418 - RNA, 23 nt, Mycobacterium avium subsp. paratuberculosis
cucgcguucgggcccggccgcca

SEQ ID NO: 832419 - RNA, 14 nt, Mycobacterium avium subsp. paratuberculosis
cucgcggcgcagcu

SEQ ID NO: 832420 - RNA, 22 nt, Mycobacterium avium subsp. paratuberculosis
cucgcggcgcagcucgcgcagc

SEQ ID NO: 832421 - RNA, 14 nt, Mycobacterium avium subsp. paratuberculosis
cucgcggucgggga

SEQ ID NO: 832422 - RNA, 18 nt, Mycobacterium avium subsp. paratuberculosis
cucgcggcaaggcgcaga

SEQ ID NO: 832423 - RNA, 19 nt, Mycobacterium avium subsp. paratuberculosis
cucgcggauccgggccggc

SEQ ID NO: 832424 - RNA, 19 nt, Mycobacterium avium subsp. paratuberculosis
cucgcggaaccgcuugagc

SEQ ID NO: 832425 - RNA, 15 nt, Mycobacterium avium subsp. paratuberculosis
cucgcgcugccgcgc

SEQ ID NO: 832426 - RNA, 16 nt, Mycobacterium avium subsp. paratuberculosis
cucgcgcuggcggcca

SEQ ID NO: 832427 - RNA, 21 nt, Mycobacterium avium subsp. paratuberculosis
cucggccaccagaugccgggc

SEQ ID NO: 832428 - RNA, 13 nt, Mycobacterium avium subsp. paratuberculosis
cucggaggccacc

SEQ ID NO: 832429 - RNA, 23 nt, Mycobacterium avium subsp. paratuberculosis
cucggaggccaccgcgccgucuu

SEQ ID NO: 832430 - RNA, 19 nt, Mycobacterium avium subsp. paratuberculosis
cucggagaccuuggcgcug

SEQ ID NO: 832431 - RNA, 22 nt, Mycobacterium avium subsp. paratuberculosis
cucggagaugauggccgcgccg

SEQ ID NO: 832432 - RNA, 23 nt, Mycobacterium avium subsp. paratuberculosis
cucggagaugauggccgcgccgc

SEQ ID NO: 832433 - RNA, 16 nt, Mycobacterium avium subsp. paratuberculosis
cucggaggugccgcgc

SEQ ID NO: 832434 - RNA, 20 nt, Mycobacterium avium subsp. paratuberculosis
cucggacagguggccgauca

SEQ ID NO: 832435 - RNA, 21 nt, Mycobacterium avium subsp. paratuberculosis
cucggaccgguaggcgcaccg

SEQ ID NO: 832436 - RNA, 12 nt, Mycobacterium avium subsp. paratuberculosis
cucggaccgguu

SEQ ID NO: 832437 - RNA, 23 nt, Mycobacterium avium subsp. paratuberculosis
cucggacgacucguucgacgccg

SEQ ID NO: 832438 - RNA, 13 nt, Mycobacterium avium subsp. paratuberculosis
cucggacgcccgu

SEQ ID NO: 832439 - RNA, 18 nt, Mycobacterium avium subsp. paratuberculosis
cucggacgccggcagccg

SEQ ID NO: 832440 - RNA, 20 nt, Mycobacterium avium subsp. paratuberculosis
cucggaaugaacugccgcgg

SEQ ID NO: 832441 - RNA, 18 nt, Mycobacterium avium subsp. paratuberculosis
cucgcuguccugccgggc

SEQ ID NO: 832442 - RNA, 17 nt, Mycobacterium avium subsp. paratuberculosis
cucgcuugccagccggg

SEQ ID NO: 832443 - RNA, 21 nt, Mycobacterium avium subsp. paratuberculosis
cucgcuugccagccgggccga

SEQ ID NO: 832444 - RNA, 20 nt, Mycobacterium avium subsp. paratuberculosis
cucggcuuccgagccgguga

SEQ ID NO: 832445 - RNA, 18 nt, Mycobacterium avium subsp. paratuberculosis
cucgggaaaugcgucggc

SEQ ID NO: 832446 - RNA, 15 nt, Mycobacterium avium subsp. paratuberculosis
cucgggaacggucag

SEQ ID NO: 832447 - RNA, 16 nt, Mycobacterium avium subsp. paratuberculosis
cucgggaacggucagc

SEQ ID NO: 832448 - RNA, 19 nt, Mycobacterium avium subsp. paratuberculosis
cucgggaacggucagccgc

SEQ ID NO: 832449 - RNA, 16 nt, Mycobacterium avium subsp. paratuberculosis
cucgggauagccgagc

SEQ ID NO: 832450 - RNA, 20 nt, Mycobacterium avium subsp. paratuberculosis
cucgggauagccgagcggcg

SEQ ID NO: 832451 - RNA, 16 nt, Mycobacterium avium subsp. paratuberculosis
cucgggcaacgcgccg

SEQ ID NO: 832452 - RNA, 17 nt, Mycobacterium avium subsp. paratuberculosis
cucgggcaacgcgccgg

SEQ ID NO: 832453 - RNA, 20 nt, Mycobacterium avium subsp. paratuberculosis
cucgggcaccacgccgacgu

SEQ ID NO: 832454 - RNA, 22 nt, Mycobacterium avium subsp. paratuberculosis
cucggcggugccguccucggcc

SEQ ID NO: 832455 - RNA, 23 nt, Mycobacterium avium subsp. paratuberculosis
cucggcguagaggugcagcgggc

SEQ ID NO: 832456 - RNA, 18 nt, Mycobacterium avium subsp. paratuberculosis
cucggcguccccggcggu

SEQ ID NO: 832457 - RNA, 18 nt, Mycobacterium avium subsp. paratuberculosis
cucggcguccgcggcgga

SEQ ID NO: 832458 - RNA, 22 nt, Mycobacterium avium subsp. paratuberculosis
cucggcgucgaagcgcaugccg

SEQ ID NO: 832459 - RNA, 14 nt, Mycobacterium avium subsp. paratuberculosis
cucggcgucgcacg

SEQ ID NO: 832460 - RNA, 15 nt, Mycobacterium avium subsp. paratuberculosis
cucggcgucgcacgu

SEQ ID NO: 832461 - RNA, 17 nt, Mycobacterium avium subsp. paratuberculosis
cucggcgucgcacgugg

SEQ ID NO: 832462 - RNA, 13 nt, Mycobacterium avium subsp. paratuberculosis
cucggcgucggcg

SEQ ID NO: 832463 - RNA, 14 nt, Mycobacterium avium subsp. paratuberculosis
cucggcgugcccgc

SEQ ID NO: 832464 - RNA, 22 nt, Mycobacterium avium subsp. paratuberculosis
cucggcguggcgcucagcggca

SEQ ID NO: 832465 - RNA, 19 nt, Mycobacterium avium subsp. paratuberculosis
cucggcguugagccggcgc

SEQ ID NO: 832466 - RNA, 23 nt, Mycobacterium avium subsp. paratuberculosis
cucggcguugagccggcgcaccg

SEQ ID NO: 832467 - RNA, 13 nt, Mycobacterium avium subsp. paratuberculosis
cucggcgccgccg

SEQ ID NO: 832468 - RNA, 16 nt, Mycobacterium avium subsp. paratuberculosis
cucggcguacagcccg

SEQ ID NO: 832469 - RNA, 17 nt, Mycobacterium avium subsp. paratuberculosis
cucggcguacagcccgc

SEQ ID NO: 832470 - RNA, 17 nt, Mycobacterium avium subsp. paratuberculosis
cucggcguacaggccgu

SEQ ID NO: 832471 - RNA, 23 nt, Mycobacterium avium subsp. paratuberculosis
cucggcggggggagaggcgcggc

SEQ ID NO: 832472 - RNA, 22 nt, Mycobacterium avium subsp. paratuberculosis
cucggcggguugcugagccgcc

SEQ ID NO: 832473 - RNA, 23 nt, Mycobacterium avium subsp. paratuberculosis
cucggcggguugcugagccgccg

SEQ ID NO: 832474 - RNA, 16 nt, Mycobacterium avium subsp. paratuberculosis
cucggcgggcucgcgc

SEQ ID NO: 832475 - RNA, 13 nt, Mycobacterium avium subsp. paratuberculosis
cucggcggcgcgc

SEQ ID NO: 832476 - RNA, 14 nt, Mycobacterium avium subsp. paratuberculosis
cucggcgggaucgg

SEQ ID NO: 832477 - RNA, 19 nt, Mycobacterium avium subsp. paratuberculosis
cucggcgggccgcccggcg

SEQ ID NO: 832478 - RNA, 14 nt, Mycobacterium avium subsp. paratuberculosis
cucggcggcggcgc

SEQ ID NO: 832479 - RNA, 15 nt, Mycobacterium avium subsp. paratuberculosis
cucggcggcggcgcg

SEQ ID NO: 832480 - RNA, 16 nt, Mycobacterium avium subsp. paratuberculosis
cucggcggcggcgcgc

SEQ ID NO: 832481 - RNA, 18 nt, Mycobacterium avium subsp. paratuberculosis
cucggcggcggcgcgccg

SEQ ID NO: 832482 - RNA, 13 nt, Mycobacterium avium subsp. paratuberculosis
cucggcggcgggg

SEQ ID NO: 832483 - RNA, 20 nt, Mycobacterium avium subsp. paratuberculosis
cucggcggcggggucguugc

SEQ ID NO: 832484 - RNA, 14 nt, Mycobacterium avium subsp. paratuberculosis
cucggcggccucgc

SEQ ID NO: 832485 - RNA, 23 nt, Mycobacterium avium subsp. paratuberculosis
cucggcggccucgccgucgaagg

SEQ ID NO: 832486 - RNA, 23 nt, Mycobacterium avium subsp. paratuberculosis
cucggcggccgccuuggugaucc

SEQ ID NO: 832487 - RNA, 14 nt, Mycobacterium avium subsp. paratuberculosis
cucggcggccggga

SEQ ID NO: 832488 - RNA, 15 nt, Mycobacterium avium subsp. paratuberculosis
cucggcggccgggau

SEQ ID NO: 832489 - RNA, 14 nt, Mycobacterium avium subsp. paratuberculosis
cucggcggccgggu

SEQ ID NO: 832490 - RNA, 13 nt, Mycobacterium avium subsp. paratuberculosis
cucggcggcgcag

SEQ ID NO: 832491 - RNA, 24 nt, Mycobacterium avium subsp. paratuberculosis
cucggcggcgcgcaggcgcgcggc

SEQ ID NO: 832492 - RNA, 15 nt, Mycobacterium avium subsp. paratuberculosis
cucggcggcaccgcc

SEQ ID NO: 832493 - RNA, 13 nt, Mycobacterium avium subsp. paratuberculosis
cucggcggcccgc

SEQ ID NO: 832494 - RNA, 12 nt, Mycobacterium avium subsp. paratuberculosis
cucggcggccga

SEQ ID NO: 832495 - RNA, 14 nt, Mycobacterium avium subsp. paratuberculosis
cucggcggccgagc

SEQ ID NO: 832496 - RNA, 15 nt, Mycobacterium avium subsp. paratuberculosis
cucggcggccgagcg

SEQ ID NO: 832497 - RNA, 14 nt, Mycobacterium avium subsp. paratuberculosis
cucggcggccgcca

SEQ ID NO: 832498 - RNA, 17 nt, Mycobacterium avium subsp. paratuberculosis
cucggcggccgcccggg

SEQ ID NO: 832499 - RNA, 12 nt, Mycobacterium avium subsp. paratuberculosis
cucggcgccggu

SEQ ID NO: 832500 - RNA, 13 nt, Mycobacterium avium subsp. paratuberculosis
cucggcgccggug

SEQ ID NO: 832501 - RNA, 14 nt, Mycobacterium avium subsp. paratuberculosis
cucggcgccggugg

SEQ ID NO: 832502 - RNA, 23 nt, Mycobacterium avium subsp. paratuberculosis
cucggcgccgguggugucgacgg

SEQ ID NO: 832503 - RNA, 14 nt, Mycobacterium avium subsp. paratuberculosis
cucggcgccgucca

SEQ ID NO: 832504 - RNA, 20 nt, Mycobacterium avium subsp. paratuberculosis
cucggcgccgucgccggacu

SEQ ID NO: 832505 - RNA, 15 nt, Mycobacterium avium subsp. paratuberculosis
cucggcgccucggcg

SEQ ID NO: 832506 - RNA, 16 nt, Mycobacterium avium subsp. paratuberculosis
cucggcgcgacguugu

SEQ ID NO: 832507 - RNA, 12 nt, Mycobacterium avium subsp. paratuberculosis
cucggcgccgcc

SEQ ID NO: 832508 - RNA, 13 nt, Mycobacterium avium subsp. paratuberculosis
cucggcgcgcggg

SEQ ID NO: 832509 - RNA, 18 nt, Mycobacterium avium subsp. paratuberculosis
cucggcgcuccagcgggc

SEQ ID NO: 832510 - RNA, 14 nt, Mycobacterium avium subsp. paratuberculosis
cucggcgcucgccg

SEQ ID NO: 832511 - RNA, 17 nt, Mycobacterium avium subsp. paratuberculosis
cucggcgcucgccgcgc

SEQ ID NO: 832512 - RNA, 21 nt, Mycobacterium avium subsp. paratuberculosis
cucggcgcugcccgccgcggu

SEQ ID NO: 832513 - RNA, 19 nt, Mycobacterium avium subsp. paratuberculosis
cucggcgcugucggcgggg

SEQ ID NO: 832514 - RNA, 21 nt, Mycobacterium avium subsp. paratuberculosis
cucggcggacaucgccucggc

SEQ ID NO: 832515 - RNA, 15 nt, Mycobacterium avium subsp. paratuberculosis
cucggcggacucggc

SEQ ID NO: 832516 - RNA, 19 nt, Mycobacterium avium subsp. paratuberculosis
cucggcggacucggcgaag

SEQ ID NO: 832517 - RNA, 13 nt, Mycobacterium avium subsp. paratuberculosis
cucggcgcaggug

SEQ ID NO: 832518 - RNA, 13 nt, Mycobacterium avium subsp. paratuberculosis
cucggcgccgacc

SEQ ID NO: 832519 - RNA, 14 nt, Mycobacterium avium subsp. paratuberculosis
cucggcgccgagcg

SEQ ID NO: 832520 - RNA, 16 nt, Mycobacterium avium subsp. paratuberculosis
cucggcgaucaccgcg

SEQ ID NO: 832521 - RNA, 18 nt, Mycobacterium avium subsp. paratuberculosis
cucggcgaucaccgcguu

SEQ ID NO: 832522 - RNA, 17 nt, Mycobacterium avium subsp. paratuberculosis
cucggcgaucagcugcc

SEQ ID NO: 832523 - RNA, 19 nt, Mycobacterium avium subsp. paratuberculosis
cucggcgaucggccgcugc

SEQ ID NO: 832524 - RNA, 19 nt, Mycobacterium avium subsp. paratuberculosis
cucggcgacaacagcgccg

SEQ ID NO: 832525 - RNA, 23 nt, Mycobacterium avium subsp. paratuberculosis
cucggccagccccaccaccgcca

SEQ ID NO: 832526 - RNA, 18 nt, Mycobacterium avium subsp. paratuberculosis
cucggcgaagucaucacc

SEQ ID NO: 832527 - RNA, 17 nt, Mycobacterium avium subsp. paratuberculosis
cucggcgaccgcccggg

SEQ ID NO: 832528 - RNA, 13 nt, Mycobacterium avium subsp. paratuberculosis
cucggcgacgaug

SEQ ID NO: 832529 - RNA, 14 nt, Mycobacterium avium subsp. paratuberculosis
cucggcgacgaugg

SEQ ID NO: 832530 - RNA, 15 nt, Mycobacterium avium subsp. paratuberculosis
cucggcgacgauggc

SEQ ID NO: 832531 - RNA, 15 nt, Mycobacterium avium subsp. paratuberculosis
cucggcgacgcugug

SEQ ID NO: 832532 - RNA, 16 nt, Mycobacterium avium subsp. paratuberculosis
cucggcgagcaccgug

SEQ ID NO: 832533 - RNA, 24 nt, Mycobacterium avium subsp. paratuberculosis
cucggcgagcaccgugccgucggc

SEQ ID NO: 832534 - RNA, 18 nt, Mycobacterium avium subsp. paratuberculosis
cucggcgagcgaggccau

SEQ ID NO: 832535 - RNA, 18 nt, Mycobacterium avium subsp. paratuberculosis
cucggcgagcugcgggug

SEQ ID NO: 832536 - RNA, 16 nt, Mycobacterium avium subsp. paratuberculosis
cucggcgaggucgucg

SEQ ID NO: 832537 - RNA, 19 nt, Mycobacterium avium subsp. paratuberculosis
cucggcgaggucgucgagg

SEQ ID NO: 832538 - RNA, 17 nt, Mycobacterium avium subsp. paratuberculosis
cucggcgaggucguucg

SEQ ID NO: 832539 - RNA, 20 nt, Mycobacterium avium subsp. paratuberculosis
cucggccagcuggucguagc

SEQ ID NO: 832540 - RNA, 17 nt, Mycobacterium avium subsp. paratuberculosis
cucggccagcgccgcgc

SEQ ID NO: 832541 - RNA, 16 nt, Mycobacterium avium subsp. paratuberculosis
cucggccagcgcgccg

SEQ ID NO: 832542 - RNA, 17 nt, Mycobacterium avium subsp. paratuberculosis
cucggccagcgcgccgc

SEQ ID NO: 832543 - RNA, 18 nt, Mycobacterium avium subsp. paratuberculosis
cucggccagcgcgccgca

SEQ ID NO: 832544 - RNA, 19 nt, Mycobacterium avium subsp. paratuberculosis
cucggccagcgggugaugg

SEQ ID NO: 832545 - RNA, 13 nt, Mycobacterium avium subsp. paratuberculosis
cucggccagcgcc

SEQ ID NO: 832546 - RNA, 14 nt, Mycobacterium avium subsp. paratuberculosis
cucggccagcgcag

SEQ ID NO: 832547 - RNA, 16 nt, Mycobacterium avium subsp. paratuberculosis
cucggccagcgcagcg

SEQ ID NO: 832548 - RNA, 14 nt, Mycobacterium avium subsp. paratuberculosis
cucggccaccgcgc

SEQ ID NO: 832549 - RNA, 16 nt, Mycobacterium avium subsp. paratuberculosis
cgucgugguggccgcg

SEQ ID NO: 832550 - RNA, 17 nt, Mycobacterium avium subsp. paratuberculosis
cgucgugguggccgcga

SEQ ID NO: 832551 - RNA, 18 nt, Mycobacterium avium subsp. paratuberculosis
cgucguguccgggcccga

SEQ ID NO: 832552 - RNA, 18 nt, Mycobacterium avium subsp. paratuberculosis
cgucguugagcacaccca

SEQ ID NO: 832553 - RNA, 16 nt, Mycobacterium avium subsp. paratuberculosis
cgucguugagcaucac

SEQ ID NO: 832554 - RNA, 18 nt, Mycobacterium avium subsp. paratuberculosis
cgucguugagcaucacca

SEQ ID NO: 832555 - RNA, 21 nt, Mycobacterium avium subsp. paratuberculosis
cgucguugaccgaggcgaucg

SEQ ID NO: 832556 - RNA, 18 nt, Mycobacterium avium subsp. paratuberculosis
cgucguugaacgcgcggg

SEQ ID NO: 832557 - RNA, 22 nt, Mycobacterium avium subsp. paratuberculosis
cgucucaggaauuugcggcccg

SEQ ID NO: 832558 - RNA, 18 nt, Mycobacterium avium subsp. paratuberculosis
cgucucagucggccaccg

SEQ ID NO: 832559 - RNA, 20 nt, Mycobacterium avium subsp. paratuberculosis
cgucucagucggccaccgcg

SEQ ID NO: 832560 - RNA, 15 nt, Mycobacterium avium subsp. paratuberculosis
cgucucauaccagug

SEQ ID NO: 832561 - RNA, 15 nt, Mycobacterium avium subsp. paratuberculosis
cgucucccccgauca

SEQ ID NO: 832562 - RNA, 16 nt, Mycobacterium avium subsp. paratuberculosis
cgucucccccgaucag

SEQ ID NO: 832563 - RNA, 14 nt, Mycobacterium avium subsp. paratuberculosis
cgucuccggcgcgg

SEQ ID NO: 832564 - RNA, 14 nt, Mycobacterium avium subsp. paratuberculosis
cgucuccggcggca

SEQ ID NO: 832565 - RNA, 14 nt, Mycobacterium avium subsp. paratuberculosis
cgucuccggcgggc

SEQ ID NO: 832566 - RNA, 16 nt, Mycobacterium avium subsp. paratuberculosis
cgucuccggcgggcug

SEQ ID NO: 832567 - RNA, 17 nt, Mycobacterium avium subsp. paratuberculosis
cgucuccggcgggcugg

SEQ ID NO: 832568 - RNA, 13 nt, Mycobacterium avium subsp. paratuberculosis
cgucuccggcgua

SEQ ID NO: 832569 - RNA, 18 nt, Mycobacterium avium subsp. paratuberculosis
cgucuccuggggcagauc

SEQ ID NO: 832570 - RNA, 20 nt, Mycobacterium avium subsp. paratuberculosis
cgucgucccaggguugccgc

SEQ ID NO: 832571 - RNA, 22 nt, Mycobacterium avium subsp. paratuberculosis
cgucgucccaggguugccgcac

SEQ ID NO: 832572 - RNA, 20 nt, Mycobacterium avium subsp. paratuberculosis
cgucguccgcaaccgccggc

SEQ ID NO: 832573 - RNA, 23 nt, Mycobacterium avium subsp. paratuberculosis
cgucguccagcuucucggcgucc

SEQ ID NO: 832574 - RNA, 15 nt, Mycobacterium avium subsp. paratuberculosis
cgucguccacgccca

SEQ ID NO: 832575 - RNA, 17 nt, Mycobacterium avium subsp. paratuberculosis
cgucguccacgcccagc

SEQ ID NO: 832576 - RNA, 22 nt, Mycobacterium avium subsp. paratuberculosis
cgucgucaucgucuccgcuguc

SEQ ID NO: 832577 - RNA, 17 nt, Mycobacterium avium subsp. paratuberculosis
cgucgguggucucguac

SEQ ID NO: 832578 - RNA, 21 nt, Mycobacterium avium subsp. paratuberculosis
cgucguggguauccgccgcca

SEQ ID NO: 832579 - RNA, 20 nt, Mycobacterium avium subsp. paratuberculosis
cgucgugggugacccggccg

SEQ ID NO: 832580 - RNA, 16 nt, Mycobacterium avium subsp. paratuberculosis
cgucgugggcgauccg

SEQ ID NO: 832581 - RNA, 17 nt, Mycobacterium avium subsp. paratuberculosis
cgucgugggcgauccgc

SEQ ID NO: 832582 - RNA, 17 nt, Mycobacterium avium subsp. paratuberculosis
cgucgugguagcggucg

SEQ ID NO: 832583 - RNA, 12 nt, Mycobacterium avium subsp. paratuberculosis
cgucguggucga

SEQ ID NO: 832584 - RNA, 14 nt, Mycobacterium avium subsp. paratuberculosis
cgucguggucgacg

SEQ ID NO: 832585 - RNA, 22 nt, Mycobacterium avium subsp. paratuberculosis
cgucguggucgacgccgugguc

SEQ ID NO: 832586 - RNA, 18 nt, Mycobacterium avium subsp. paratuberculosis
cgucguccucuucgcgga

SEQ ID NO: 832587 - RNA, 15 nt, Mycobacterium avium subsp. paratuberculosis
cgucugcucgccggc

SEQ ID NO: 832588 - RNA, 17 nt, Mycobacterium avium subsp. paratuberculosis
cgucugcucgccggcua

SEQ ID NO: 832589 - RNA, 15 nt, Mycobacterium avium subsp. paratuberculosis
cgucugcucggcggc

SEQ ID NO: 832590 - RNA, 16 nt, Mycobacterium avium subsp. paratuberculosis
cgucugcucggcggcu

SEQ ID NO: 832591 - RNA, 16 nt, Mycobacterium avium subsp. paratuberculosis
cgucugcucggcgggu

SEQ ID NO: 832592 - RNA, 18 nt, Mycobacterium avium subsp. paratuberculosis
cgucugcucggcggguca

SEQ ID NO: 832593 - RNA, 17 nt, Mycobacterium avium subsp. paratuberculosis
cgucuggcagccggccg

SEQ ID NO: 832594 - RNA, 18 nt, Mycobacterium avium subsp. paratuberculosis
cgucuggcagccggccgg

SEQ ID NO: 832595 - RNA, 19 nt, Mycobacterium avium subsp. paratuberculosis
cgucuggcagccggccggc

SEQ ID NO: 832596 - RNA, 14 nt, Mycobacterium avium subsp. paratuberculosis
cgucugcuggaugg

SEQ ID NO: 832597 - RNA, 19 nt, Mycobacterium avium subsp. paratuberculosis
cgucugggccgccgagcag

SEQ ID NO: 832598 - RNA, 13 nt, Mycobacterium avium subsp. paratuberculosis
cgucuugcagccg

SEQ ID NO: 832599 - RNA, 15 nt, Mycobacterium avium subsp. paratuberculosis
cgucuugcugggugg

SEQ ID NO: 832600 - RNA, 19 nt, Mycobacterium avium subsp. paratuberculosis
cgucuuggacgcccgcgac

SEQ ID NO: 832601 - RNA, 14 nt, Mycobacterium avium subsp. paratuberculosis
cgucuucggggccg

SEQ ID NO: 832602 - RNA, 16 nt, Mycobacterium avium subsp. paratuberculosis
cgucuucuucucgccg

SEQ ID NO: 832603 - RNA, 16 nt, Mycobacterium avium subsp. paratuberculosis
cgucuucuuggccgcg

SEQ ID NO: 832604 - RNA, 17 nt, Mycobacterium avium subsp. paratuberculosis
cgucuucuuggccgcgg

SEQ ID NO: 832605 - RNA, 13 nt, Mycobacterium avium subsp. paratuberculosis
cgucuugaccgcc

SEQ ID NO: 832606 - RNA, 15 nt, Mycobacterium avium subsp. paratuberculosis
cgucugcgccagcug

SEQ ID NO: 832607 - RNA, 16 nt, Mycobacterium avium subsp. paratuberculosis
cgucugcgccagcugg

SEQ ID NO: 832608 - RNA, 22 nt, Mycobacterium avium subsp. paratuberculosis
cgucugcgccccggcgucgaug

SEQ ID NO: 832609 - RNA, 18 nt, Mycobacterium avium subsp. paratuberculosis
cgucugcauccggaaccg

SEQ ID NO: 832610 - RNA, 20 nt, Mycobacterium avium subsp. paratuberculosis
cgucugcauccggaaccggg

SEQ ID NO: 832611 - RNA, 23 nt, Mycobacterium avium subsp. paratuberculosis
cgucugcauccggaaccgggcac

SEQ ID NO: 832612 - RNA, 22 nt, Mycobacterium avium subsp. paratuberculosis
cgucugcucccaggacggcgcg

SEQ ID NO: 832613 - RNA, 13 nt, Mycobacterium avium subsp. paratuberculosis
cgucugcggcucg

SEQ ID NO: 832614 - RNA, 18 nt, Mycobacterium avium subsp. paratuberculosis
cgucugcgggaagcccac

SEQ ID NO: 832615 - RNA, 21 nt, Mycobacterium avium subsp. paratuberculosis
cgucugcgggaagcccaccgc

SEQ ID NO: 832616 - RNA, 11 nt, Mycobacterium avium subsp. paratuberculosis
cgucucgaacc

SEQ ID NO: 832617 - RNA, 22 nt, Mycobacterium avium subsp. paratuberculosis
cgucucgaaccgucuagcggcg

SEQ ID NO: 832618 - RNA, 16 nt, Mycobacterium avium subsp. paratuberculosis
cgucucgaccacccgg

SEQ ID NO: 832619 - RNA, 20 nt, Mycobacterium avium subsp. paratuberculosis
cgucucgaccacccggcggg

SEQ ID NO: 832620 - RNA, 21 nt, Mycobacterium avium subsp. paratuberculosis
cgucucgaccacccggcgggc

SEQ ID NO: 832621 - RNA, 15 nt, Mycobacterium avium subsp. paratuberculosis
cgucucgacggcgcc

SEQ ID NO: 832622 - RNA, 20 nt, Mycobacterium avium subsp. paratuberculosis
cgucgggaauggggcccggu

SEQ ID NO: 832623 - RNA, 21 nt, Mycobacterium avium subsp. paratuberculosis
cgucggcggucuuggcggcca

SEQ ID NO: 832624 - RNA, 15 nt, Mycobacterium avium subsp. paratuberculosis
cgucggcggugccga

SEQ ID NO: 832625 - RNA, 12 nt, Mycobacterium avium subsp. paratuberculosis
cgucggcggugg

SEQ ID NO: 832626 - RNA, 22 nt, Mycobacterium avium subsp. paratuberculosis
cgucggcggugguccgcgcgac

SEQ ID NO: 832627 - RNA, 23 nt, Mycobacterium avium subsp. paratuberculosis
cgucggcggugguccgcgcgacc

SEQ ID NO: 832628 - RNA, 22 nt, Mycobacterium avium subsp. paratuberculosis
cgucggcgggcaccucggccag

SEQ ID NO: 832629 - RNA, 20 nt, Mycobacterium avium subsp. paratuberculosis
cgucggcggggaagggcucc

SEQ ID NO: 832630 - RNA, 18 nt, Mycobacterium avium subsp. paratuberculosis
cgucggcggcgacggcga

SEQ ID NO: 832631 - RNA, 21 nt, Mycobacterium avium subsp. paratuberculosis
cgucggcggcgacggcgacca

SEQ ID NO: 832632 - RNA, 15 nt, Mycobacterium avium subsp. paratuberculosis
cgucggcggcggcgg

SEQ ID NO: 832633 - RNA, 13 nt, Mycobacterium avium subsp. paratuberculosis
cgucggcggccga

SEQ ID NO: 832634 - RNA, 14 nt, Mycobacterium avium subsp. paratuberculosis
cgucggcggccgac

SEQ ID NO: 832635 - RNA, 13 nt, Mycobacterium avium subsp. paratuberculosis
cgucggcggccgc

SEQ ID NO: 832636 - RNA, 11 nt, Mycobacterium avium subsp. paratuberculosis
cgucggcggcc

SEQ ID NO: 832637 - RNA, 20 nt, Mycobacterium avium subsp. paratuberculosis
cgucggcgcuggccagcgcg

SEQ ID NO: 832638 - RNA, 23 nt, Mycobacterium avium subsp. paratuberculosis
cgucggcgcuggccagcgcgacg

SEQ ID NO: 832639 - RNA, 14 nt, Mycobacterium avium subsp. paratuberculosis
cgucggcggacugg

SEQ ID NO: 832640 - RNA, 21 nt, Mycobacterium avium subsp. paratuberculosis
cgucggcggagaugacgugga

SEQ ID NO: 832641 - RNA, 23 nt, Mycobacterium avium subsp. paratuberculosis
cgucggcggagaugacguggauc

SEQ ID NO: 832642 - RNA, 18 nt, Mycobacterium avium subsp. paratuberculosis
cgucggcggaggucaugg

SEQ ID NO: 832643 - RNA, 21 nt, Mycobacterium avium subsp. paratuberculosis
cgucggcggaggucauggcga

SEQ ID NO: 832644 - RNA, 14 nt, Mycobacterium avium subsp. paratuberculosis
cgucggcgcggucg

SEQ ID NO: 832645 - RNA, 13 nt, Mycobacterium avium subsp. paratuberculosis
cgucggcgcgucg

SEQ ID NO: 832646 - RNA, 22 nt, Mycobacterium avium subsp. paratuberculosis
cgucggcgcgucguacaccucg

SEQ ID NO: 832647 - RNA, 13 nt, Mycobacterium avium subsp. paratuberculosis
cgucggcgcgugc

SEQ ID NO: 832648 - RNA, 15 nt, Mycobacterium avium subsp. paratuberculosis
cgucggcgcgcucgg

SEQ ID NO: 832649 - RNA, 17 nt, Mycobacterium avium subsp. paratuberculosis
cgucggcgcgcucggug

SEQ ID NO: 832650 - RNA, 20 nt, Mycobacterium avium subsp. paratuberculosis
cgucggcgcgcucggugcug

SEQ ID NO: 832651 - RNA, 15 nt, Mycobacterium avium subsp. paratuberculosis
cgucggcgcggccgg

SEQ ID NO: 832652 - RNA, 18 nt, Mycobacterium avium subsp. paratuberculosis
cgucggcgccgccgagcc

SEQ ID NO: 832653 - RNA, 16 nt, Mycobacterium avium subsp. paratuberculosis
cgucggcgccgcgccg

SEQ ID NO: 832654 - RNA, 18 nt, Mycobacterium avium subsp. paratuberculosis
cgucggcgccgcgccggc

SEQ ID NO: 832655 - RNA, 16 nt, Mycobacterium avium subsp. paratuberculosis
cgucggcgccggaucg

SEQ ID NO: 832656 - RNA, 14 nt, Mycobacterium avium subsp. paratuberculosis
cgucggcgccggcg

SEQ ID NO: 832657 - RNA, 16 nt, Mycobacterium avium subsp. paratuberculosis
cgucggcgccggcgcg

SEQ ID NO: 832658 - RNA, 14 nt, Mycobacterium avium subsp. paratuberculosis
cgucggcgccguag

SEQ ID NO: 832659 - RNA, 16 nt, Mycobacterium avium subsp. paratuberculosis
cgucggcgccgucgcg

SEQ ID NO: 832660 - RNA, 18 nt, Mycobacterium avium subsp. paratuberculosis
cgucggcgccgucgcggg

SEQ ID NO: 832661 - RNA, 15 nt, Mycobacterium avium subsp. paratuberculosis
cgucggcgcgcaccg

SEQ ID NO: 832662 - RNA, 18 nt, Mycobacterium avium subsp. paratuberculosis
cgucggcgcgcaccgcga

SEQ ID NO: 832663 - RNA, 14 nt, Mycobacterium avium subsp. paratuberculosis
cgucggcgcgcagg

SEQ ID NO: 832664 - RNA, 14 nt, Mycobacterium avium subsp. paratuberculosis
cgucggcgcccggc

SEQ ID NO: 832665 - RNA, 18 nt, Mycobacterium avium subsp. paratuberculosis
cgucggcgcccggcaccg

SEQ ID NO: 832666 - RNA, 21 nt, Mycobacterium avium subsp. paratuberculosis
cgucggcgcccggcaccggga

SEQ ID NO: 832667 - RNA, 15 nt, Mycobacterium avium subsp. paratuberculosis
cgucggcgcgccacc

SEQ ID NO: 832668 - RNA, 17 nt, Mycobacterium avium subsp. paratuberculosis
cgucggcgcgccacccg

SEQ ID NO: 832669 - RNA, 22 nt, Mycobacterium avium subsp. paratuberculosis
cgucggcgauggcggcgugcag

SEQ ID NO: 832670 - RNA, 15 nt, Mycobacterium avium subsp. paratuberculosis
cgucggcgaugcggu

SEQ ID NO: 832671 - RNA, 12 nt, Mycobacterium avium subsp. paratuberculosis
cgucggcgaugg

SEQ ID NO: 832672 - RNA, 13 nt, Mycobacterium avium subsp. paratuberculosis
cgucggcgaucgc

SEQ ID NO: 832673 - RNA, 20 nt, Mycobacterium avium subsp. paratuberculosis
cgucggcgaucgccagcacg

SEQ ID NO: 832674 - RNA, 22 nt, Mycobacterium avium subsp. paratuberculosis
cgucggcgaucgccagcacggu

SEQ ID NO: 832675 - RNA, 19 nt, Mycobacterium avium subsp. paratuberculosis
cgucggcgaucgccgggga

SEQ ID NO: 832676 - RNA, 14 nt, Mycobacterium avium subsp. paratuberculosis
cgucggcgaucucg

SEQ ID NO: 832677 - RNA, 15 nt, Mycobacterium avium subsp. paratuberculosis
cgucggcgacggcgu

SEQ ID NO: 832678 - RNA, 17 nt, Mycobacterium avium subsp. paratuberculosis
cgucggcgacggcgucc

SEQ ID NO: 832679 - RNA, 14 nt, Mycobacterium avium subsp. paratuberculosis
cgucggcgagcagc

SEQ ID NO: 832680 - RNA, 17 nt, Mycobacterium avium subsp. paratuberculosis
cgucggcgagcuuggcg

SEQ ID NO: 832681 - RNA, 23 nt, Mycobacterium avium subsp. paratuberculosis
cgucggcgaacagugcacugccg

SEQ ID NO: 832682 - RNA, 21 nt, Mycobacterium avium subsp. paratuberculosis
cgucggcgaacggccagucca

SEQ ID NO: 832683 - RNA, 23 nt, Mycobacterium avium subsp. paratuberculosis
cgucggcgaacuccagaucgccg

SEQ ID NO: 832684 - RNA, 14 nt, Mycobacterium avium subsp. paratuberculosis
cgucggcgaccgcg

SEQ ID NO: 832685 - RNA, 19 nt, Mycobacterium avium subsp. paratuberculosis
cgucggcgaccgcgcgcgg

SEQ ID NO: 832686 - RNA, 17 nt, Mycobacterium avium subsp. paratuberculosis
cgucggccuccagccgg

SEQ ID NO: 832687 - RNA, 20 nt, Mycobacterium avium subsp. paratuberculosis
cgucggccuccagccggcgg

SEQ ID NO: 832688 - RNA, 16 nt, Mycobacterium avium subsp. paratuberculosis
cgucggccugcgcugc

SEQ ID NO: 832689 - RNA, 21 nt, Mycobacterium avium subsp. paratuberculosis
cgucggccugcgcugcggcca

SEQ ID NO: 832690 - RNA, 13 nt, Mycobacterium avium subsp. paratuberculosis
cgucggccucggc

SEQ ID NO: 832691 - RNA, 15 nt, Mycobacterium avium subsp. paratuberculosis
cgucggccucggcgg

SEQ ID NO: 832692 - RNA, 17 nt, Mycobacterium avium subsp. paratuberculosis
cgucggccucggcggcc

SEQ ID NO: 832693 - RNA, 18 nt, Mycobacterium avium subsp. paratuberculosis
cgucggccucggcggccg

SEQ ID NO: 832694 - RNA, 20 nt, Mycobacterium avium subsp. paratuberculosis
cgucggccucggcggccggg

SEQ ID NO: 832695 - RNA, 16 nt, Mycobacterium avium subsp. paratuberculosis
cgucggccugcccgcg

SEQ ID NO: 832696 - RNA, 15 nt, Mycobacterium avium subsp. paratuberculosis
cgucgggcagcagcu

SEQ ID NO: 832697 - RNA, 14 nt, Mycobacterium avium subsp. paratuberculosis
cgucgggccacaac

SEQ ID NO: 832698 - RNA, 14 nt, Mycobacterium avium subsp. paratuberculosis
cgucgggaccgucg

SEQ ID NO: 832699 - RNA, 16 nt, Mycobacterium avium subsp. paratuberculosis
cgucgggaccgucgcg

SEQ ID NO: 832700 - RNA, 17 nt, Mycobacterium avium subsp. paratuberculosis
cgucgggcacaucccgc

SEQ ID NO: 832701 - RNA, 14 nt, Mycobacterium avium subsp. paratuberculosis
cgucgggcaccacg

SEQ ID NO: 832702 - RNA, 15 nt, Mycobacterium avium subsp. paratuberculosis
cgucgggcaccacgg

SEQ ID NO: 832703 - RNA, 14 nt, Mycobacterium avium subsp. paratuberculosis
cgucgggcaccagc

SEQ ID NO: 832704 - RNA, 19 nt, Mycobacterium avium subsp. paratuberculosis
cgucgggcaccagcaccga

SEQ ID NO: 832705 - RNA, 16 nt, Mycobacterium avium subsp. paratuberculosis
cgucgggcaccgccag

SEQ ID NO: 832706 - RNA, 17 nt, Mycobacterium avium subsp. paratuberculosis
cgucgggcaccgccagg

SEQ ID NO: 832707 - RNA, 15 nt, Mycobacterium avium subsp. paratuberculosis
cgucgggcacgguca

SEQ ID NO: 832708 - RNA, 12 nt, Mycobacterium avium subsp. paratuberculosis
cgucgggcgcca

SEQ ID NO: 832709 - RNA, 17 nt, Mycobacterium avium subsp. paratuberculosis
cgucggucaggccggcg

SEQ ID NO: 832710 - RNA, 20 nt, Mycobacterium avium subsp. paratuberculosis
cgucggucaggccggcgccg

SEQ ID NO: 832711 - RNA, 15 nt, Mycobacterium avium subsp. paratuberculosis
cgucgggccgcagca

SEQ ID NO: 832712 - RNA, 11 nt, Mycobacterium avium subsp. paratuberculosis
cgucgggccgg

SEQ ID NO: 832713 - RNA, 14 nt, Mycobacterium avium subsp. paratuberculosis
cgucgggccguccg

SEQ ID NO: 832714 - RNA, 13 nt, Mycobacterium avium subsp. paratuberculosis
cgucgggcgccgg

SEQ ID NO: 832715 - RNA, 20 nt, Mycobacterium avium subsp. paratuberculosis
cgucgggcgccggcgcgucc

SEQ ID NO: 832716 - RNA, 13 nt, Mycobacterium avium subsp. paratuberculosis
cgucggucagcga

SEQ ID NO: 832717 - RNA, 15 nt, Mycobacterium avium subsp. paratuberculosis
cgucggucagcgcca

SEQ ID NO: 832718 - RNA, 17 nt, Mycobacterium avium subsp. paratuberculosis
cgucggucagcggcguc

SEQ ID NO: 832719 - RNA, 18 nt, Mycobacterium avium subsp. paratuberculosis
cgucggucagcggcguca

SEQ ID NO: 832720 - RNA, 20 nt, Mycobacterium avium subsp. paratuberculosis
cgucggucagcggcgucagg

SEQ ID NO: 832721 - RNA, 15 nt, Mycobacterium avium subsp. paratuberculosis
cgucggucggcagga

SEQ ID NO: 832722 - RNA, 16 nt, Mycobacterium avium subsp. paratuberculosis
cgucggugaacgccgg

SEQ ID NO: 832723 - RNA, 17 nt, Mycobacterium avium subsp. paratuberculosis
cgucggugaacgccggu

SEQ ID NO: 832724 - RNA, 18 nt, Mycobacterium avium subsp. paratuberculosis
cgucggugaacgccggug

SEQ ID NO: 832725 - RNA, 19 nt, Mycobacterium avium subsp. paratuberculosis
cgucggugaacgccgguga

SEQ ID NO: 832726 - RNA, 14 nt, Mycobacterium avium subsp. paratuberculosis
cgucguacaccucg

SEQ ID NO: 832727 - RNA, 17 nt, Mycobacterium avium subsp. paratuberculosis
cgucguacagcagcccc

SEQ ID NO: 832728 - RNA, 14 nt, Mycobacterium avium subsp. paratuberculosis
cgucgucagcaccg

SEQ ID NO: 832729 - RNA, 15 nt, Mycobacterium avium subsp. paratuberculosis
cgucgguuucggucg

SEQ ID NO: 832730 - RNA, 19 nt, Mycobacterium avium subsp. paratuberculosis
cgucgguuucggucgcggu

SEQ ID NO: 832731 - RNA, 20 nt, Mycobacterium avium subsp. paratuberculosis
cgucgguuucggucgcggug

SEQ ID NO: 832732 - RNA, 19 nt, Mycobacterium avium subsp. paratuberculosis
cgucgguggggugaggcac

SEQ ID NO: 832733 - RNA, 22 nt, Mycobacterium avium subsp. paratuberculosis
cgucgguggggugaggcacccg

SEQ ID NO: 832734 - RNA, 15 nt, Mycobacterium avium subsp. paratuberculosis
cgucgguguagucgg

SEQ ID NO: 832735 - RNA, 17 nt, Mycobacterium avium subsp. paratuberculosis
cgucgguguagucggcg

SEQ ID NO: 832736 - RNA, 18 nt, Mycobacterium avium subsp. paratuberculosis
cgucgguguagucggcga

SEQ ID NO: 832737 - RNA, 21 nt, Mycobacterium avium subsp. paratuberculosis
cgucgguguagucggcgaucg

SEQ ID NO: 832738 - RNA, 22 nt, Mycobacterium avium subsp. paratuberculosis
cgucgguguagucggcgaucgg

SEQ ID NO: 832739 - RNA, 14 nt, Mycobacterium avium subsp. paratuberculosis
cgucgguggugacg

SEQ ID NO: 832740 - RNA, 19 nt, Mycobacterium avium subsp. paratuberculosis
cgucggugggccgccgcgg

SEQ ID NO: 832741 - RNA, 19 nt, Mycobacterium avium subsp. paratuberculosis
cgucgguggcggcggcgac

SEQ ID NO: 832742 - RNA, 15 nt, Mycobacterium avium subsp. paratuberculosis
cgucgguggcggugg

SEQ ID NO: 832743 - RNA, 16 nt, Mycobacterium avium subsp. paratuberculosis
cgucggugcggggcgg

SEQ ID NO: 832744 - RNA, 15 nt, Mycobacterium avium subsp. paratuberculosis
cgucggugcgguagg

SEQ ID NO: 832745 - RNA, 15 nt, Mycobacterium avium subsp. paratuberculosis
cgucggugcgcgccg

SEQ ID NO: 832746 - RNA, 16 nt, Mycobacterium avium subsp. paratuberculosis
cgucggugcgcgccgc

SEQ ID NO: 832747 - RNA, 13 nt, Mycobacterium avium subsp. paratuberculosis
cgucggugacgcc

SEQ ID NO: 832748 - RNA, 16 nt, Mycobacterium avium subsp. paratuberculosis
cgucggugacggugug

SEQ ID NO: 832749 - RNA, 13 nt, Mycobacterium avium subsp. paratuberculosis
cgucggucccgac

SEQ ID NO: 832750 - RNA, 18 nt, Mycobacterium avium subsp. paratuberculosis
cgucggugccgcguucgg

SEQ ID NO: 832751 - RNA, 23 nt, Mycobacterium avium subsp. paratuberculosis
cgugaaaucguggcuuucggcgc

SEQ ID NO: 832752 - RNA, 20 nt, Mycobacterium avium subsp. paratuberculosis
cgugaaacuagcuucacgcu

SEQ ID NO: 832753 - RNA, 20 nt, Mycobacterium avium subsp. paratuberculosis
cgugaaacuagcuucacggu

SEQ ID NO: 832754 - RNA, 19 nt, Mycobacterium avium subsp. paratuberculosis
cgugaaacuagcuucacgu

SEQ ID NO: 832755 - RNA, 20 nt, Mycobacterium avium subsp. paratuberculosis
cgugaaacuagcuucacguu

SEQ ID NO: 832756 - RNA, 19 nt, Mycobacterium avium subsp. paratuberculosis
cgugaaacuaguuucacgu

SEQ ID NO: 832757 - RNA, 20 nt, Mycobacterium avium subsp. paratuberculosis
cgugaaacuaguuucacguu

SEQ ID NO: 832758 - RNA, 15 nt, Mycobacterium avium subsp. paratuberculosis
cgucuugcccagcgg

SEQ ID NO: 832759 - RNA, 17 nt, Mycobacterium avium subsp. paratuberculosis
cgucuuggugcgagcca

SEQ ID NO: 832760 - RNA, 21 nt, Mycobacterium avium subsp. paratuberculosis
cgucuuggugcgagccaccuc

SEQ ID NO: 832761 - RNA, 21 nt, Mycobacterium avium subsp. paratuberculosis
cgucuuggugugugcgucggc

SEQ ID NO: 832762 - RNA, 13 nt, Mycobacterium avium subsp. paratuberculosis
cgugaagccggug

SEQ ID NO: 832763 - RNA, 14 nt, Mycobacterium avium subsp. paratuberculosis
cgugaagccggugg

SEQ ID NO: 832764 - RNA, 19 nt, Mycobacterium avium subsp. paratuberculosis
cgugaagcuagcuucacgc

SEQ ID NO: 832765 - RNA, 23 nt, Mycobacterium avium subsp. paratuberculosis
cgugaagcuagcuucacgcucgg

SEQ ID NO: 832766 - RNA, 20 nt, Mycobacterium avium subsp. paratuberculosis
cgugaagcuaguuucacgcu

SEQ ID NO: 832767 - RNA, 23 nt, Mycobacterium avium subsp. paratuberculosis
cgugaagcuaguuucacguucgc

SEQ ID NO: 832768 - RNA, 17 nt, Mycobacterium avium subsp. paratuberculosis
cgugaacugugcggugc

SEQ ID NO: 832769 - RNA, 19 nt, Mycobacterium avium subsp. paratuberculosis
cgugaacuuaacuucacgc

SEQ ID NO: 832770 - RNA, 20 nt, Mycobacterium avium subsp. paratuberculosis
cgugaacuuaacuucacgcu

SEQ ID NO: 832771 - RNA, 23 nt, Mycobacterium avium subsp. paratuberculosis
cgugaacuuaacuucacgcucgg

SEQ ID NO: 832772 - RNA, 14 nt, Mycobacterium avium subsp. paratuberculosis
cgugacggucgacc

SEQ ID NO: 832773 - RNA, 20 nt, Mycobacterium avium subsp. paratuberculosis
cgugacggucgaccucgagc

SEQ ID NO: 832774 - RNA, 19 nt, Mycobacterium avium subsp. paratuberculosis
cgugacguaagugucgugg

SEQ ID NO: 832775 - RNA, 16 nt, Mycobacterium avium subsp. paratuberculosis
cgugacggcaucggcg

SEQ ID NO: 832776 - RNA, 22 nt, Mycobacterium avium subsp. paratuberculosis
cgugacggcaucggcgcccucg

SEQ ID NO: 832777 - RNA, 14 nt, Mycobacterium avium subsp. paratuberculosis
cgugacggccgcgg

SEQ ID NO: 832778 - RNA, 16 nt, Mycobacterium avium subsp. paratuberculosis
cgugacggccgcggcg

SEQ ID NO: 832779 - RNA, 13 nt, Mycobacterium avium subsp. paratuberculosis
cgugacggcgggg

SEQ ID NO: 832780 - RNA, 19 nt, Mycobacterium avium subsp. paratuberculosis
cgugaguucgcugaccgcc

SEQ ID NO: 832781 - RNA, 12 nt, Mycobacterium avium subsp. paratuberculosis
cgugacgcgcgu

SEQ ID NO: 832782 - RNA, 14 nt, Mycobacterium avium subsp. paratuberculosis
cgugacgcggcguc

SEQ ID NO: 832783 - RNA, 22 nt, Mycobacterium avium subsp. paratuberculosis
cgugacgcucgccggcggccgc

SEQ ID NO: 832784 - RNA, 14 nt, Mycobacterium avium subsp. paratuberculosis
cgugacgcucgcgu

SEQ ID NO: 832785 - RNA, 19 nt, Mycobacterium avium subsp. paratuberculosis
cgugaaguuaacuucacgc

SEQ ID NO: 832786 - RNA, 20 nt, Mycobacterium avium subsp. paratuberculosis
cgugaaguuaacuucacgcu

SEQ ID NO: 832787 - RNA, 23 nt, Mycobacterium avium subsp. paratuberculosis
cgugaaguuaacuucacgcucgc

SEQ ID NO: 832788 - RNA, 20 nt, Mycobacterium avium subsp. paratuberculosis
cgugaaguuaguuucacgcu

SEQ ID NO: 832789 - RNA, 16 nt, Mycobacterium avium subsp. paratuberculosis
cgugacgccgggccgc

SEQ ID NO: 832790 - RNA, 17 nt, Mycobacterium avium subsp. paratuberculosis
cgugacgccgggccgcc

SEQ ID NO: 832791 - RNA, 18 nt, Mycobacterium avium subsp. paratuberculosis
cgugacgccgggccgccg

SEQ ID NO: 832792 - RNA, 20 nt, Mycobacterium avium subsp. paratuberculosis
cgugacgccgggccgccgcg

SEQ ID NO: 832793 - RNA, 22 nt, Mycobacterium avium subsp. paratuberculosis
cgugacgccgggccgccgcggc

SEQ ID NO: 832794 - RNA, 15 nt, Mycobacterium avium subsp. paratuberculosis
cgugacgcucggccg

SEQ ID NO: 832795 - RNA, 16 nt, Mycobacterium avium subsp. paratuberculosis
cgugacgcucggccgu

SEQ ID NO: 832796 - RNA, 15 nt, Mycobacterium avium subsp. paratuberculosis
cgugacgcucggccu

SEQ ID NO: 832797 - RNA, 16 nt, Mycobacterium avium subsp. paratuberculosis
cgugacgcucggccuc

SEQ ID NO: 832798 - RNA, 17 nt, Mycobacterium avium subsp. paratuberculosis
cgugacgcucggcgccg

SEQ ID NO: 832799 - RNA, 19 nt, Mycobacterium avium subsp. paratuberculosis
cgugacgcucggcgccgcg

SEQ ID NO: 832800 - RNA, 20 nt, Mycobacterium avium subsp. paratuberculosis
cgugacgcucggcgccgcgg

SEQ ID NO: 832801 - RNA, 18 nt, Mycobacterium avium subsp. paratuberculosis
cgugacgcucggcgccgg

SEQ ID NO: 832802 - RNA, 19 nt, Mycobacterium avium subsp. paratuberculosis
cgugacgcucggcgccggc

SEQ ID NO: 832803 - RNA, 20 nt, Mycobacterium avium subsp. paratuberculosis
cgugacgcucggcgccggcc

SEQ ID NO: 832804 - RNA, 23 nt, Mycobacterium avium subsp. paratuberculosis
cgugacgcucggcgccggccguc

SEQ ID NO: 832805 - RNA, 16 nt, Mycobacterium avium subsp. paratuberculosis
cgugacgcucggcgcg

SEQ ID NO: 832806 - RNA, 17 nt, Mycobacterium avium subsp. paratuberculosis
cgugacgcucggcgcgu

SEQ ID NO: 832807 - RNA, 19 nt, Mycobacterium avium subsp. paratuberculosis
cgugacgcucggcgcgucg

SEQ ID NO: 832808 - RNA, 20 nt, Mycobacterium avium subsp. paratuberculosis
cgugacgcucggcgcgucgu

SEQ ID NO: 832809 - RNA, 15 nt, Mycobacterium avium subsp. paratuberculosis
cgugacgcucggcgg

SEQ ID NO: 832810 - RNA, 16 nt, Mycobacterium avium subsp. paratuberculosis
cgugacgcucggcggc

SEQ ID NO: 832811 - RNA, 13 nt, Mycobacterium avium subsp. paratuberculosis
cgugacgcucggg

SEQ ID NO: 832812 - RNA, 18 nt, Mycobacterium avium subsp. paratuberculosis
cgugacgcucgggcuucg

SEQ ID NO: 832813 - RNA, 19 nt, Mycobacterium avium subsp. paratuberculosis
cgugacgcucgggcuucgg

SEQ ID NO: 832814 - RNA, 17 nt, Mycobacterium avium subsp. paratuberculosis
cgugacgcucggggccg

SEQ ID NO: 832815 - RNA, 18 nt, Mycobacterium avium subsp. paratuberculosis
cgugauagcggccgcgga

SEQ ID NO: 832816 - RNA, 15 nt, Mycobacterium avium subsp. paratuberculosis
cgugauaguggucgu

SEQ ID NO: 832817 - RNA, 19 nt, Mycobacterium avium subsp. paratuberculosis
cgugauaguggucgucguc

SEQ ID NO: 832818 - RNA, 13 nt, Mycobacterium avium subsp. paratuberculosis
cgugaucgcggug

SEQ ID NO: 832819 - RNA, 14 nt, Mycobacterium avium subsp. paratuberculosis
cgugaucgcggugg

SEQ ID NO: 832820 - RNA, 16 nt, Mycobacterium avium subsp. paratuberculosis
cgugaucucgugccgc

SEQ ID NO: 832821 - RNA, 19 nt, Mycobacterium avium subsp. paratuberculosis
cgugaucucgugccgcacc

SEQ ID NO: 832822 - RNA, 21 nt, Mycobacterium avium subsp. paratuberculosis
cgugaucuggugggcgggcac

SEQ ID NO: 832823 - RNA, 14 nt, Mycobacterium avium subsp. paratuberculosis
cgugaucuguucgg

SEQ ID NO: 832824 - RNA, 17 nt, Mycobacterium avium subsp. paratuberculosis
cgugaucuguucggcgg

SEQ ID NO: 832825 - RNA, 18 nt, Mycobacterium avium subsp. paratuberculosis
cgugaucuguucggcggc

SEQ ID NO: 832826 - RNA, 20 nt, Mycobacterium avium subsp. paratuberculosis
cgugaucuguucggcggcga

SEQ ID NO: 832827 - RNA, 21 nt, Mycobacterium avium subsp. paratuberculosis
cgugaucuguucggcggcgau

SEQ ID NO: 832828 - RNA, 22 nt, Mycobacterium avium subsp. paratuberculosis
cgugaucuguucggcggcgauc

SEQ ID NO: 832829 - RNA, 18 nt, Mycobacterium avium subsp. paratuberculosis
cgugaucgccaccaccag

SEQ ID NO: 832830 - RNA, 17 nt, Mycobacterium avium subsp. paratuberculosis
cgugaucgccacggcgg

SEQ ID NO: 832831 - RNA, 19 nt, Mycobacterium avium subsp. paratuberculosis
cgugaucgccacggcggug

SEQ ID NO: 832832 - RNA, 13 nt, Mycobacterium avium subsp. paratuberculosis
cgugaucggcggc

SEQ ID NO: 832833 - RNA, 16 nt, Mycobacterium avium subsp. paratuberculosis
cgugaucggcggccug

SEQ ID NO: 832834 - RNA, 20 nt, Mycobacterium avium subsp. paratuberculosis
cgugaucggcggccugcggc

SEQ ID NO: 832835 - RNA, 22 nt, Mycobacterium avium subsp. paratuberculosis
cgugaugcgcaagcaccggcug

SEQ ID NO: 832836 - RNA, 14 nt, Mycobacterium avium subsp. paratuberculosis
cgugaugcgccggc

SEQ ID NO: 832837 - RNA, 15 nt, Mycobacterium avium subsp. paratuberculosis
cgugaugcgccggcg

SEQ ID NO: 832838 - RNA, 19 nt, Mycobacterium avium subsp. paratuberculosis
cgugaugcgccggcggucc

SEQ ID NO: 832839 - RNA, 19 nt, Mycobacterium avium subsp. paratuberculosis
cgugaugaccagggccucg

SEQ ID NO: 832840 - RNA, 17 nt, Mycobacterium avium subsp. paratuberculosis
cgugaugacggcggcgg

SEQ ID NO: 832841 - RNA, 19 nt, Mycobacterium avium subsp. paratuberculosis
cgugaugacggcggcggug

SEQ ID NO: 832842 - RNA, 20 nt, Mycobacterium avium subsp. paratuberculosis
cgugaugacggcggcggugc

SEQ ID NO: 832843 - RNA, 23 nt, Mycobacterium avium subsp. paratuberculosis
cgugaugacggcggcggugccgc

SEQ ID NO: 832844 - RNA, 23 nt, Mycobacterium avium subsp. paratuberculosis
cgugaugagcgaggacgucgagc

SEQ ID NO: 832845 - RNA, 15 nt, Mycobacterium avium subsp. paratuberculosis
cgugcagcaccucga

SEQ ID NO: 832846 - RNA, 15 nt, Mycobacterium avium subsp. paratuberculosis
cgugcagcacgcccu

SEQ ID NO: 832847 - RNA, 14 nt, Mycobacterium avium subsp. paratuberculosis
cgugcagcacgccg

SEQ ID NO: 832848 - RNA, 21 nt, Mycobacterium avium subsp. paratuberculosis
cgugcagcaguuccggagcgc

SEQ ID NO: 832849 - RNA, 17 nt, Mycobacterium avium subsp. paratuberculosis
cgugcagcaccgccagc

SEQ ID NO: 832850 - RNA, 18 nt, Mycobacterium avium subsp. paratuberculosis
cgugcagcaccgccagca

SEQ ID NO: 832851 - RNA, 19 nt, Mycobacterium avium subsp. paratuberculosis
cgugcagcaccgccagcau

SEQ ID NO: 832852 - RNA, 19 nt, Mycobacterium avium subsp. paratuberculosis
cgugcagccgaagaacugg

SEQ ID NO: 832853 - RNA, 14 nt, Mycobacterium avium subsp. paratuberculosis
cgugcagcgccagc

SEQ ID NO: 832854 - RNA, 15 nt, Mycobacterium avium subsp. paratuberculosis
cgugcagcgccagca

SEQ ID NO: 832855 - RNA, 12 nt, Mycobacterium avium subsp. paratuberculosis
cgugcagcgccc

SEQ ID NO: 832856 - RNA, 15 nt, Mycobacterium avium subsp. paratuberculosis
cgugcagcgcccagc

SEQ ID NO: 832857 - RNA, 18 nt, Mycobacterium avium subsp. paratuberculosis
cgugcagcgcccagccga

SEQ ID NO: 832858 - RNA, 15 nt, Mycobacterium avium subsp. paratuberculosis
cgugcagccggcggc

SEQ ID NO: 832859 - RNA, 18 nt, Mycobacterium avium subsp. paratuberculosis
cgugcagccggcggcgcc

SEQ ID NO: 832860 - RNA, 19 nt, Mycobacterium avium subsp. paratuberculosis
cgugcagccggcggcgccu

SEQ ID NO: 832861 - RNA, 12 nt, Mycobacterium avium subsp. paratuberculosis
cgugcagccggg

SEQ ID NO: 832862 - RNA, 19 nt, Mycobacterium avium subsp. paratuberculosis
cgugcagccgggcggcgcc

SEQ ID NO: 832863 - RNA, 22 nt, Mycobacterium avium subsp. paratuberculosis
cgugcagccgggcggcgccgaa

SEQ ID NO: 832864 - RNA, 13 nt, Mycobacterium avium subsp. paratuberculosis
cgugcagcgcggc

SEQ ID NO: 832865 - RNA, 14 nt, Mycobacterium avium subsp. paratuberculosis
cgugcagcgcggcg

SEQ ID NO: 832866 - RNA, 15 nt, Mycobacterium avium subsp. paratuberculosis
cgugcagcgcggcga

SEQ ID NO: 832867 - RNA, 14 nt, Mycobacterium avium subsp. paratuberculosis
cgugcagcucggug

SEQ ID NO: 832868 - RNA, 15 nt, Mycobacterium avium subsp. paratuberculosis
cgugcagcucggugc

SEQ ID NO: 832869 - RNA, 17 nt, Mycobacterium avium subsp. paratuberculosis
cgugcaggaucggcuug

SEQ ID NO: 832870 - RNA, 15 nt, Mycobacterium avium subsp. paratuberculosis
cgugcgacaccggcg

SEQ ID NO: 832871 - RNA, 15 nt, Mycobacterium avium subsp. paratuberculosis
cgugcggcgccgccc

SEQ ID NO: 832872 - RNA, 14 nt, Mycobacterium avium subsp. paratuberculosis
cgugcgagccgagc

SEQ ID NO: 832873 - RNA, 15 nt, Mycobacterium avium subsp. paratuberculosis
cgugcgagccgagca

SEQ ID NO: 832874 - RNA, 21 nt, Mycobacterium avium subsp. paratuberculosis
cgugcgagccgagcacgcagc

SEQ ID NO: 832875 - RNA, 21 nt, Mycobacterium avium subsp. paratuberculosis
cgugcggcugcgcguucggcg

SEQ ID NO: 832876 - RNA, 23 nt, Mycobacterium avium subsp. paratuberculosis
cgugcggcugcgcguucggcgcc

SEQ ID NO: 832877 - RNA, 15 nt, Mycobacterium avium subsp. paratuberculosis
cgugcggcgcggucg

SEQ ID NO: 832878 - RNA, 18 nt, Mycobacterium avium subsp. paratuberculosis
cgugcggcgcggucgcag

SEQ ID NO: 832879 - RNA, 12 nt, Mycobacterium avium subsp. paratuberculosis
cgugcggcggcg

SEQ ID NO: 832880 - RNA, 13 nt, Mycobacterium avium subsp. paratuberculosis
cgugcggcggcgg

SEQ ID NO: 832881 - RNA, 22 nt, Mycobacterium avium subsp. paratuberculosis
cgugcggcggggccucgaugcg

SEQ ID NO: 832882 - RNA, 18 nt, Mycobacterium avium subsp. paratuberculosis
cgugcggcguucggugcc

SEQ ID NO: 832883 - RNA, 17 nt, Mycobacterium avium subsp. paratuberculosis
cgugcgacucggucacg

SEQ ID NO: 832884 - RNA, 17 nt, Mycobacterium avium subsp. paratuberculosis
cgugccuuacgccgggg

SEQ ID NO: 832885 - RNA, 15 nt, Mycobacterium avium subsp. paratuberculosis
cgugccuugcaccca

SEQ ID NO: 832886 - RNA, 16 nt, Mycobacterium avium subsp. paratuberculosis
cgugccuugcacccag

SEQ ID NO: 832887 - RNA, 17 nt, Mycobacterium avium subsp. paratuberculosis
cgugccuugcacccagc

SEQ ID NO: 832888 - RNA, 20 nt, Mycobacterium avium subsp. paratuberculosis
cgugccuugcacccagcgga

SEQ ID NO: 832889 - RNA, 17 nt, Mycobacterium avium subsp. paratuberculosis
cgugcgggaugccgagc

SEQ ID NO: 832890 - RNA, 18 nt, Mycobacterium avium subsp. paratuberculosis
cgugcgggaugccgagca

SEQ ID NO: 832891 - RNA, 12 nt, Mycobacterium avium subsp. paratuberculosis
cgugcggggccu

SEQ ID NO: 832892 - RNA, 17 nt, Mycobacterium avium subsp. paratuberculosis
cgugcggggccucgucg

SEQ ID NO: 832893 - RNA, 20 nt, Mycobacterium avium subsp. paratuberculosis
cgugcgggcuccgcacgacc

SEQ ID NO: 832894 - RNA, 22 nt, Mycobacterium avium subsp. paratuberculosis
cgugcgggcuccgcacgaccug

SEQ ID NO: 832895 - RNA, 17 nt, Mycobacterium avium subsp. paratuberculosis
cgugcggucgcgggaca

SEQ ID NO: 832896 - RNA, 15 nt, Mycobacterium avium subsp. paratuberculosis
cgugcggguggccgg

SEQ ID NO: 832897 - RNA, 17 nt, Mycobacterium avium subsp. paratuberculosis
cgugcggguggccgggu

SEQ ID NO: 832898 - RNA, 15 nt, Mycobacterium avium subsp. paratuberculosis
cgugcggggugugca

SEQ ID NO: 832899 - RNA, 14 nt, Mycobacterium avium subsp. paratuberculosis
cgugcgucacgcug

SEQ ID NO: 832900 - RNA, 16 nt, Mycobacterium avium subsp. paratuberculosis
cgugcgguuggcccgc

SEQ ID NO: 832901 - RNA, 15 nt, Mycobacterium avium subsp. paratuberculosis
cgugcguagcggccc

SEQ ID NO: 832902 - RNA, 17 nt, Mycobacterium avium subsp. paratuberculosis
cgugcguagcggcccga

SEQ ID NO: 832903 - RNA, 21 nt, Mycobacterium avium subsp. paratuberculosis
cgugcuccagcaggcgcgccg

SEQ ID NO: 832904 - RNA, 23 nt, Mycobacterium avium subsp. paratuberculosis
cgugcuccagcaggcgcgccgag

SEQ ID NO: 832905 - RNA, 14 nt, Mycobacterium avium subsp. paratuberculosis
cgugcucgaucgcg

SEQ ID NO: 832906 - RNA, 21 nt, Mycobacterium avium subsp. paratuberculosis
cgugcucggccacgacgcgcc

SEQ ID NO: 832907 - RNA, 17 nt, Mycobacterium avium subsp. paratuberculosis
cgugcucggcgagcacc

SEQ ID NO: 832908 - RNA, 18 nt, Mycobacterium avium subsp. paratuberculosis
cgugcucggcgagcaccg

SEQ ID NO: 832909 - RNA, 21 nt, Mycobacterium avium subsp. paratuberculosis
cgugcgugcgcucgaccucgg

SEQ ID NO: 832910 - RNA, 14 nt, Mycobacterium avium subsp. paratuberculosis
cgugcgguggucgg

SEQ ID NO: 832911 - RNA, 16 nt, Mycobacterium avium subsp. paratuberculosis
cgugcgguggucggcg

SEQ ID NO: 832912 - RNA, 18 nt, Mycobacterium avium subsp. paratuberculosis
cgugcgguggucggcguc

SEQ ID NO: 832913 - RNA, 17 nt, Mycobacterium avium subsp. paratuberculosis
cgugcgggucgcgcggc

SEQ ID NO: 832914 - RNA, 22 nt, Mycobacterium avium subsp. paratuberculosis
cgugcaggaugaccgcgucggc

SEQ ID NO: 832915 - RNA, 12 nt, Mycobacterium avium subsp. paratuberculosis
cgugcaggccgc

SEQ ID NO: 832916 - RNA, 17 nt, Mycobacterium avium subsp. paratuberculosis
cgugcaggccgcgggug

SEQ ID NO: 832917 - RNA, 16 nt, Mycobacterium avium subsp. paratuberculosis
cgugcagucccagauc

SEQ ID NO: 832918 - RNA, 17 nt, Mycobacterium avium subsp. paratuberculosis
cgugcagugcgaucgcc

SEQ ID NO: 832919 - RNA, 14 nt, Mycobacterium avium subsp. paratuberculosis
cgugcaggugcggc

SEQ ID NO: 832920 - RNA, 17 nt, Mycobacterium avium subsp. paratuberculosis
cgugcaggugcggcacc

SEQ ID NO: 832921 - RNA, 14 nt, Mycobacterium avium subsp. paratuberculosis
cgugccggacaccg

SEQ ID NO: 832922 - RNA, 17 nt, Mycobacterium avium subsp. paratuberculosis
cgugccggacaccggca

SEQ ID NO: 832923 - RNA, 21 nt, Mycobacterium avium subsp. paratuberculosis
cgugccggacaccggcacguc

SEQ ID NO: 832924 - RNA, 24 nt, Mycobacterium avium subsp. paratuberculosis
cgugccggacuccuucaucgaucg

SEQ ID NO: 832925 - RNA, 17 nt, Mycobacterium avium subsp. paratuberculosis
cgugccggaugcggucg

SEQ ID NO: 832926 - RNA, 18 nt, Mycobacterium avium subsp. paratuberculosis
cgugccggaugcggucga

SEQ ID NO: 832927 - RNA, 21 nt, Mycobacterium avium subsp. paratuberculosis
cgugccggaugcggucgauga

SEQ ID NO: 832928 - RNA, 15 nt, Mycobacterium avium subsp. paratuberculosis
cgugccgcgcaccac

SEQ ID NO: 832929 - RNA, 16 nt, Mycobacterium avium subsp. paratuberculosis
cgugccgcgcaccacc

SEQ ID NO: 832930 - RNA, 15 nt, Mycobacterium avium subsp. paratuberculosis
cgugccgcgcggcga

SEQ ID NO: 832931 - RNA, 17 nt, Mycobacterium avium subsp. paratuberculosis
cgugccgcgcggcgaug

SEQ ID NO: 832932 - RNA, 17 nt, Mycobacterium avium subsp. paratuberculosis
cgugccgcgcggcggug

SEQ ID NO: 832933 - RNA, 13 nt, Mycobacterium avium subsp. paratuberculosis
cgugccgcccgga

SEQ ID NO: 832934 - RNA, 17 nt, Mycobacterium avium subsp. paratuberculosis
cgugccgggugaugcag

SEQ ID NO: 832935 - RNA, 14 nt, Mycobacterium avium subsp. paratuberculosis
cgugccgucacgcc

SEQ ID NO: 832936 - RNA, 15 nt, Mycobacterium avium subsp. paratuberculosis
cgugccgucacgccc

SEQ ID NO: 832937 - RNA, 15 nt, Mycobacterium avium subsp. paratuberculosis
cgugccguccagcuc

SEQ ID NO: 832938 - RNA, 23 nt, Mycobacterium avium subsp. paratuberculosis
cgugccguccagcuccgccgaca

SEQ ID NO: 832939 - RNA, 13 nt, Mycobacterium avium subsp. paratuberculosis
cgugccguccggc

SEQ ID NO: 832940 - RNA, 14 nt, Mycobacterium avium subsp. paratuberculosis
cgugccguccggcc

SEQ ID NO: 832941 - RNA, 15 nt, Mycobacterium avium subsp. paratuberculosis
cgugccgucgcgggc

SEQ ID NO: 832942 - RNA, 19 nt, Mycobacterium avium subsp. paratuberculosis
cgugccgucgcgggcgucg

SEQ ID NO: 832943 - RNA, 14 nt, Mycobacterium avium subsp. paratuberculosis
cgugccgucgcugu

SEQ ID NO: 832944 - RNA, 17 nt, Mycobacterium avium subsp. paratuberculosis
cgugccgucggcgucga

SEQ ID NO: 832945 - RNA, 15 nt, Mycobacterium avium subsp. paratuberculosis
cgugccgcugggagc

SEQ ID NO: 832946 - RNA, 18 nt, Mycobacterium avium subsp. paratuberculosis
cgugccguggucggugcc

SEQ ID NO: 832947 - RNA, 13 nt, Mycobacterium avium subsp. paratuberculosis
cgugccgggcggu

SEQ ID NO: 832948 - RNA, 15 nt, Mycobacterium avium subsp. paratuberculosis
cgugccggcucggcg

SEQ ID NO: 832949 - RNA, 16 nt, Mycobacterium avium subsp. paratuberculosis
cgugccggcucggcgg

SEQ ID NO: 832950 - RNA, 16 nt, Mycobacterium avium subsp. paratuberculosis
cgugccggcccggcgg

SEQ ID NO: 832951 - RNA, 12 nt, Mycobacterium avium subsp. paratuberculosis
cgugccggcgau

SEQ ID NO: 832952 - RNA, 13 nt, Mycobacterium avium subsp. paratuberculosis
cgugccggcgaug

SEQ ID NO: 832953 - RNA, 14 nt, Mycobacterium avium subsp. paratuberculosis
cgugccggcgaugg

SEQ ID NO: 832954 - RNA, 16 nt, Mycobacterium avium subsp. paratuberculosis
cgugccggcgauggug

SEQ ID NO: 832955 - RNA, 18 nt, Mycobacterium avium subsp. paratuberculosis
cgugccggcgaugguggc

SEQ ID NO: 832956 - RNA, 23 nt, Mycobacterium avium subsp. paratuberculosis
cgugccggcgaugguggcgcugc

SEQ ID NO: 832957 - RNA, 13 nt, Mycobacterium avium subsp. paratuberculosis
cgugccggcgcug

SEQ ID NO: 832958 - RNA, 22 nt, Mycobacterium avium subsp. paratuberculosis
cgugccggcgcugcccgucgac

SEQ ID NO: 832959 - RNA, 13 nt, Mycobacterium avium subsp. paratuberculosis
cgugccggcggcg

SEQ ID NO: 832960 - RNA, 14 nt, Mycobacterium avium subsp. paratuberculosis
cgugccggcggcgg

SEQ ID NO: 832961 - RNA, 15 nt, Mycobacterium avium subsp. paratuberculosis
cgugccggcggcgga

SEQ ID NO: 832962 - RNA, 22 nt, Mycobacterium avium subsp. paratuberculosis
cgugccggcggcggaccgucgg

SEQ ID NO: 832963 - RNA, 13 nt, Mycobacterium avium subsp. paratuberculosis
cgucgcggcgcgg

SEQ ID NO: 832964 - RNA, 20 nt, Mycobacterium avium subsp. paratuberculosis
cgucgcuaguugcacuuucg

SEQ ID NO: 832965 - RNA, 22 nt, Mycobacterium avium subsp. paratuberculosis
cgucgcggccaacgcccaccac

SEQ ID NO: 832966 - RNA, 15 nt, Mycobacterium avium subsp. paratuberculosis
cgucgcggcgaucgc

SEQ ID NO: 832967 - RNA, 16 nt, Mycobacterium avium subsp. paratuberculosis
cgucgcggcgaucgcg

SEQ ID NO: 832968 - RNA, 20 nt, Mycobacterium avium subsp. paratuberculosis
cgucgcggcgaucgcgagca

SEQ ID NO: 832969 - RNA, 17 nt, Mycobacterium avium subsp. paratuberculosis
cgucgcggcgcacccgg

SEQ ID NO: 832970 - RNA, 14 nt, Mycobacterium avium subsp. paratuberculosis
cgucgcugaucgcg

SEQ ID NO: 832971 - RNA, 22 nt, Mycobacterium avium subsp. paratuberculosis
cgucgcugaucgcgauccgggc

SEQ ID NO: 832972 - RNA, 14 nt, Mycobacterium avium subsp. paratuberculosis
cgucgcugacgccg

SEQ ID NO: 832973 - RNA, 14 nt, Mycobacterium avium subsp. paratuberculosis
cgucgcugaacgcg

SEQ ID NO: 832974 - RNA, 13 nt, Mycobacterium avium subsp. paratuberculosis
cgucgcuggccag

SEQ ID NO: 832975 - RNA, 20 nt, Mycobacterium avium subsp. paratuberculosis
cgucgcugccguagcgcugg

SEQ ID NO: 832976 - RNA, 15 nt, Mycobacterium avium subsp. paratuberculosis
cgucgcuguuggcga

SEQ ID NO: 832977 - RNA, 23 nt, Mycobacterium avium subsp. paratuberculosis
cgucgcuguuggcgacggcgcug

SEQ ID NO: 832978 - RNA, 15 nt, Mycobacterium avium subsp. paratuberculosis
cgucggacaccagca

SEQ ID NO: 832979 - RNA, 15 nt, Mycobacterium avium subsp. paratuberculosis
cgucgcugucggcga

SEQ ID NO: 832980 - RNA, 23 nt, Mycobacterium avium subsp. paratuberculosis
cgucgcuguccucgagcgcgucg

SEQ ID NO: 832981 - RNA, 14 nt, Mycobacterium avium subsp. paratuberculosis
cgucgcugucggcg

SEQ ID NO: 832982 - RNA, 19 nt, Mycobacterium avium subsp. paratuberculosis
cgucgcugggcagccgucc

SEQ ID NO: 832983 - RNA, 21 nt, Mycobacterium avium subsp. paratuberculosis
cgucggacaugccggcgccga

SEQ ID NO: 832984 - RNA, 14 nt, Mycobacterium avium subsp. paratuberculosis
cgucggacgcggcc

SEQ ID NO: 832985 - RNA, 15 nt, Mycobacterium avium subsp. paratuberculosis
cgucggacgcggccg

SEQ ID NO: 832986 - RNA, 23 nt, Mycobacterium avium subsp. paratuberculosis
cgucggaauacagcagcugcguc

SEQ ID NO: 832987 - RNA, 14 nt, Mycobacterium avium subsp. paratuberculosis
cgucggagaucagg

SEQ ID NO: 832988 - RNA, 21 nt, Mycobacterium avium subsp. paratuberculosis
cgucggagaugcgggccaccg

SEQ ID NO: 832989 - RNA, 22 nt, Mycobacterium avium subsp. paratuberculosis
cgucggaggacaacgcgucgaa

SEQ ID NO: 832990 - RNA, 14 nt, Mycobacterium avium subsp. paratuberculosis
cgucggaggcggcg

SEQ ID NO: 832991 - RNA, 16 nt, Mycobacterium avium subsp. paratuberculosis
cgucggaggcggcgua

SEQ ID NO: 832992 - RNA, 16 nt, Mycobacterium avium subsp. paratuberculosis
cgucggaggcgucgac

SEQ ID NO: 832993 - RNA, 17 nt, Mycobacterium avium subsp. paratuberculosis
cgucggaggcgucgacg

SEQ ID NO: 832994 - RNA, 11 nt, Mycobacterium avium subsp. paratuberculosis
cgucggccggc

SEQ ID NO: 832995 - RNA, 20 nt, Mycobacterium avium subsp. paratuberculosis
cgucggccgcgacgaccgcc

SEQ ID NO: 832996 - RNA, 13 nt, Mycobacterium avium subsp. paratuberculosis
cgucggccgccag

SEQ ID NO: 832997 - RNA, 17 nt, Mycobacterium avium subsp. paratuberculosis
cgucggccgccagggcc

SEQ ID NO: 832998 - RNA, 15 nt, Mycobacterium avium subsp. paratuberculosis
cgucggccggcucga

SEQ ID NO: 832999 - RNA, 22 nt, Mycobacterium avium subsp. paratuberculosis
cgucggccggcugcagccgggc

SEQ ID NO: 833000 - RNA, 14 nt, Mycobacterium avium subsp. paratuberculosis
cgucggccgggccg

SEQ ID NO: 833001 - RNA, 15 nt, Mycobacterium avium subsp. paratuberculosis
cgucggccgggccgg

SEQ ID NO: 833002 - RNA, 14 nt, Mycobacterium avium subsp. paratuberculosis
cgucggccgggucg

SEQ ID NO: 833003 - RNA, 15 nt, Mycobacterium avium subsp. paratuberculosis
cgucggccgggucgu

SEQ ID NO: 833004 - RNA, 19 nt, Mycobacterium avium subsp. paratuberculosis
cgucggccgucggcgccgc

SEQ ID NO: 833005 - RNA, 21 nt, Mycobacterium avium subsp. paratuberculosis
cgucggccgucggcgccgccg

SEQ ID NO: 833006 - RNA, 16 nt, Mycobacterium avium subsp. paratuberculosis
cgucggcccacgguga

SEQ ID NO: 833007 - RNA, 20 nt, Mycobacterium avium subsp. paratuberculosis
cgucggcccagacgaugucg

SEQ ID NO: 833008 - RNA, 22 nt, Mycobacterium avium subsp. paratuberculosis
cgucggccaguucaccgcgcuc

SEQ ID NO: 833009 - RNA, 21 nt, Mycobacterium avium subsp. paratuberculosis
cgucggccaguucgccgguga

SEQ ID NO: 833010 - RNA, 16 nt, Mycobacterium avium subsp. paratuberculosis
cgucggccaucagccg

SEQ ID NO: 833011 - RNA, 19 nt, Mycobacterium avium subsp. paratuberculosis
cgucggccaucagccgccg

SEQ ID NO: 833012 - RNA, 22 nt, Mycobacterium avium subsp. paratuberculosis
cgucggccaucagccgccgucg

SEQ ID NO: 833013 - RNA, 11 nt, Mycobacterium avium subsp. paratuberculosis
cgucggcccgc

SEQ ID NO: 833014 - RNA, 12 nt, Mycobacterium avium subsp. paratuberculosis
cgucggcccgcc

SEQ ID NO: 833015 - RNA, 12 nt, Mycobacterium avium subsp. paratuberculosis
cgucggccacgc

SEQ ID NO: 833016 - RNA, 17 nt, Mycobacterium avium subsp. paratuberculosis
cgucggccaggaucucg

SEQ ID NO: 833017 - RNA, 18 nt, Mycobacterium avium subsp. paratuberculosis
cgucggccagcgcgcggg

SEQ ID NO: 833018 - RNA, 20 nt, Mycobacterium avium subsp. paratuberculosis
cgucggccagcgcgugaugg

SEQ ID NO: 833019 - RNA, 13 nt, Mycobacterium avium subsp. paratuberculosis
cgucggccagcgg

SEQ ID NO: 833020 - RNA, 16 nt, Mycobacterium avium subsp. paratuberculosis
cgucggccagcggcag

SEQ ID NO: 833021 - RNA, 11 nt, Mycobacterium avium subsp. paratuberculosis
cgucggccaga

SEQ ID NO: 833022 - RNA, 14 nt, Mycobacterium avium subsp. paratuberculosis
cgucggccagcacc

SEQ ID NO: 833023 - RNA, 15 nt, Mycobacterium avium subsp. paratuberculosis
cgucggccagcacca

SEQ ID NO: 833024 - RNA, 15 nt, Mycobacterium avium subsp. paratuberculosis
cgucggccagcagcg

SEQ ID NO: 833025 - RNA, 16 nt, Mycobacterium avium subsp. paratuberculosis
cgucggccagcagcgc

SEQ ID NO: 833026 - RNA, 18 nt, Mycobacterium avium subsp. paratuberculosis
cgucggccagcagcgcgu

SEQ ID NO: 833027 - RNA, 13 nt, Mycobacterium avium subsp. paratuberculosis
cgucggccacgcc

SEQ ID NO: 833028 - RNA, 17 nt, Mycobacterium avium subsp. paratuberculosis
cgucggccacgccgggc

SEQ ID NO: 833029 - RNA, 16 nt, Mycobacterium avium subsp. paratuberculosis
cgucggccacgcucgc

SEQ ID NO: 833030 - RNA, 15 nt, Mycobacterium avium subsp. paratuberculosis
cgucggccaccgcgc

SEQ ID NO: 833031 - RNA, 12 nt, Mycobacterium avium subsp. paratuberculosis
cgucggccaccg

SEQ ID NO: 833032 - RNA, 13 nt, Mycobacterium avium subsp. paratuberculosis
cgucggccaccgc

SEQ ID NO: 833033 - RNA, 19 nt, Mycobacterium avium subsp. paratuberculosis
cgucggcagcgacgcggug

SEQ ID NO: 833034 - RNA, 19 nt, Mycobacterium avium subsp. paratuberculosis
cgucggcaguugcacuuuc

SEQ ID NO: 833035 - RNA, 16 nt, Mycobacterium avium subsp. paratuberculosis
cgucggcacugcccgc

SEQ ID NO: 833036 - RNA, 20 nt, Mycobacterium avium subsp. paratuberculosis
cgucggcacugcccgcaucg

SEQ ID NO: 833037 - RNA, 17 nt, Mycobacterium avium subsp. paratuberculosis
cgucggcaacgccgggu

SEQ ID NO: 833038 - RNA, 20 nt, Mycobacterium avium subsp. paratuberculosis
cgucggcaacgccgggucca

SEQ ID NO: 833039 - RNA, 22 nt, Mycobacterium avium subsp. paratuberculosis
cgucggcaaugaccggcaccag

SEQ ID NO: 833040 - RNA, 23 nt, Mycobacterium avium subsp. paratuberculosis
cgucggcaaugaccggcaccagc

SEQ ID NO: 833041 - RNA, 24 nt, Mycobacterium avium subsp. paratuberculosis
cgucggcaaugaccggcaccagca

SEQ ID NO: 833042 - RNA, 13 nt, Mycobacterium avium subsp. paratuberculosis
cgucggcaccagc

SEQ ID NO: 833043 - RNA, 15 nt, Mycobacterium avium subsp. paratuberculosis
cgucggcaccagcgg

SEQ ID NO: 833044 - RNA, 22 nt, Mycobacterium avium subsp. paratuberculosis
cgucggcaccagcggcaucgcc

SEQ ID NO: 833045 - RNA, 15 nt, Mycobacterium avium subsp. paratuberculosis
cgucgcaucagcucg

SEQ ID NO: 833046 - RNA, 16 nt, Mycobacterium avium subsp. paratuberculosis
cgucgcaucagcucgg

SEQ ID NO: 833047 - RNA, 18 nt, Mycobacterium avium subsp. paratuberculosis
cgucgcaucagcucggca

SEQ ID NO: 833048 - RNA, 15 nt, Mycobacterium avium subsp. paratuberculosis
cgucgcagugcccgc

SEQ ID NO: 833049 - RNA, 16 nt, Mycobacterium avium subsp. paratuberculosis
cgucgcagugcccgcc

SEQ ID NO: 833050 - RNA, 17 nt, Mycobacterium avium subsp. paratuberculosis
cgucgcagugcccgccc

SEQ ID NO: 833051 - RNA, 14 nt, Mycobacterium avium subsp. paratuberculosis
cgucgcacguggug

SEQ ID NO: 833052 - RNA, 15 nt, Mycobacterium avium subsp. paratuberculosis
cgucgcagcccgggu

SEQ ID NO: 833053 - RNA, 17 nt, Mycobacterium avium subsp. paratuberculosis
cgucgcagaucccgccg

SEQ ID NO: 833054 - RNA, 22 nt, Mycobacterium avium subsp. paratuberculosis
cgucgcagaucccgccggcggc

SEQ ID NO: 833055 - RNA, 16 nt, Mycobacterium avium subsp. paratuberculosis
cgucgccaccaccgcg

SEQ ID NO: 833056 - RNA, 18 nt, Mycobacterium avium subsp. paratuberculosis
cgucgccaccaccgcgcc

SEQ ID NO: 833057 - RNA, 23 nt, Mycobacterium avium subsp. paratuberculosis
cgucgccaccaccuucaucgccg

SEQ ID NO: 833058 - RNA, 20 nt, Mycobacterium avium subsp. paratuberculosis
cgucgccaccagaccggcga

SEQ ID NO: 833059 - RNA, 12 nt, Mycobacterium avium subsp. paratuberculosis
cgucgccaccga

SEQ ID NO: 833060 - RNA, 18 nt, Mycobacterium avium subsp. paratuberculosis
cgucgccaccgagucgcg

SEQ ID NO: 833061 - RNA, 21 nt, Mycobacterium avium subsp. paratuberculosis
cgucgccaccgagucgcgcga

SEQ ID NO: 833062 - RNA, 17 nt, Mycobacterium avium subsp. paratuberculosis
cgucgccaauccggcgg

SEQ ID NO: 833063 - RNA, 18 nt, Mycobacterium avium subsp. paratuberculosis
cgucgccaauccggcggg

SEQ ID NO: 833064 - RNA, 19 nt, Mycobacterium avium subsp. paratuberculosis
cgucgccaauccggcgggc

SEQ ID NO: 833065 - RNA, 15 nt, Mycobacterium avium subsp. paratuberculosis
cgucgccacgaucac

SEQ ID NO: 833066 - RNA, 19 nt, Mycobacterium avium subsp. paratuberculosis
cgucgccacgaucaccacc

SEQ ID NO: 833067 - RNA, 15 nt, Mycobacterium avium subsp. paratuberculosis
cgucgccaccgaugc

SEQ ID NO: 833068 - RNA, 15 nt, Mycobacterium avium subsp. paratuberculosis
cgucgaugaugccgg

SEQ ID NO: 833069 - RNA, 20 nt, Mycobacterium avium subsp. paratuberculosis
cgucgaugaugccggcggac

SEQ ID NO: 833070 - RNA, 14 nt, Mycobacterium avium subsp. paratuberculosis
cgucgaugcacgcc

SEQ ID NO: 833071 - RNA, 16 nt, Mycobacterium avium subsp. paratuberculosis
cgucgaugcacgccgg

SEQ ID NO: 833072 - RNA, 17 nt, Mycobacterium avium subsp. paratuberculosis
cgucgaugcacgccgga

SEQ ID NO: 833073 - RNA, 20 nt, Mycobacterium avium subsp. paratuberculosis
cgucgaugccgaaccgcucc

SEQ ID NO: 833074 - RNA, 17 nt, Mycobacterium avium subsp. paratuberculosis
cgucgcacaaccgggcc

SEQ ID NO: 833075 - RNA, 19 nt, Mycobacterium avium subsp. paratuberculosis
cgucgcacaaccgggccaa

SEQ ID NO: 833076 - RNA, 13 nt, Mycobacterium avium subsp. paratuberculosis
cgucgcacagcgc

SEQ ID NO: 833077 - RNA, 14 nt, Mycobacterium avium subsp. paratuberculosis
cgucgcacagcgcc

SEQ ID NO: 833078 - RNA, 15 nt, Mycobacterium avium subsp. paratuberculosis
cgucgcacagcgccg

SEQ ID NO: 833079 - RNA, 16 nt, Mycobacterium avium subsp. paratuberculosis
cgucgcacagcgccgc

SEQ ID NO: 833080 - RNA, 17 nt, Mycobacterium avium subsp. paratuberculosis
cgucgaugccgaucacg

SEQ ID NO: 833081 - RNA, 24 nt, Mycobacterium avium subsp. paratuberculosis
cgucgaugccgaucacggugaucg

SEQ ID NO: 833082 - RNA, 15 nt, Mycobacterium avium subsp. paratuberculosis
cgucgaugccggcga

SEQ ID NO: 833083 - RNA, 17 nt, Mycobacterium avium subsp. paratuberculosis
cgucgaugccggcgacg

SEQ ID NO: 833084 - RNA, 14 nt, Mycobacterium avium subsp. paratuberculosis
cgucgaugaacauc

SEQ ID NO: 833085 - RNA, 17 nt, Mycobacterium avium subsp. paratuberculosis
cgucgaugaacaucgcc

SEQ ID NO: 833086 - RNA, 17 nt, Mycobacterium avium subsp. paratuberculosis
cgucgaugacguccacc

SEQ ID NO: 833087 - RNA, 23 nt, Mycobacterium avium subsp. paratuberculosis
cgucgaugacguccaccagggug

SEQ ID NO: 833088 - RNA, 16 nt, Mycobacterium avium subsp. paratuberculosis
cgucgaugaccucgcg

SEQ ID NO: 833089 - RNA, 22 nt, Mycobacterium avium subsp. paratuberculosis
cgucgaugacgaugcccggggu

SEQ ID NO: 833090 - RNA, 18 nt, Mycobacterium avium subsp. paratuberculosis
cgucgaucuucgcggcgu

SEQ ID NO: 833091 - RNA, 20 nt, Mycobacterium avium subsp. paratuberculosis
cgucgaucuugucguccagu

SEQ ID NO: 833092 - RNA, 15 nt, Mycobacterium avium subsp. paratuberculosis
cgucgaucucgguga

SEQ ID NO: 833093 - RNA, 17 nt, Mycobacterium avium subsp. paratuberculosis
cgucgaucucggugagc

SEQ ID NO: 833094 - RNA, 18 nt, Mycobacterium avium subsp. paratuberculosis
cgucgaucucggugagcc

SEQ ID NO: 833095 - RNA, 20 nt, Mycobacterium avium subsp. paratuberculosis
cgucgagcuccucggccagc

SEQ ID NO: 833096 - RNA, 22 nt, Mycobacterium avium subsp. paratuberculosis
cgucgagcuccucggccagcgg

SEQ ID NO: 833097 - RNA, 16 nt, Mycobacterium avium subsp. paratuberculosis
cgucgagcgucacgcc

SEQ ID NO: 833098 - RNA, 17 nt, Mycobacterium avium subsp. paratuberculosis
cgucgagcgucacgccg

SEQ ID NO: 833099 - RNA, 23 nt, Mycobacterium avium subsp. paratuberculosis
cgucgagcgucacgccgcgcccg

SEQ ID NO: 833100 - RNA, 16 nt, Mycobacterium avium subsp. paratuberculosis
cgucgagcgucacgcu

SEQ ID NO: 833101 - RNA, 12 nt, Mycobacterium avium subsp. paratuberculosis
cgucgagcgugg

SEQ ID NO: 833102 - RNA, 15 nt, Mycobacterium avium subsp. paratuberculosis
cgucgccgcccccga

SEQ ID NO: 833103 - RNA, 15 nt, Mycobacterium avium subsp. paratuberculosis
cgucgccgccccgag

SEQ ID NO: 833104 - RNA, 13 nt, Mycobacterium avium subsp. paratuberculosis
cgucgccgaucgc

SEQ ID NO: 833105 - RNA, 14 nt, Mycobacterium avium subsp. paratuberculosis
cgucgccgaucgcc

SEQ ID NO: 833106 - RNA, 20 nt, Mycobacterium avium subsp. paratuberculosis
cgucgccgaucgcccgguag

SEQ ID NO: 833107 - RNA, 13 nt, Mycobacterium avium subsp. paratuberculosis
cgucgccgaugcg

SEQ ID NO: 833108 - RNA, 17 nt, Mycobacterium avium subsp. paratuberculosis
cgucgccgaugcgccgc

SEQ ID NO: 833109 - RNA, 23 nt, Mycobacterium avium subsp. paratuberculosis
cgucgccgaugcgccgcaccagu

SEQ ID NO: 833110 - RNA, 14 nt, Mycobacterium avium subsp. paratuberculosis
cgucgccgauggcg

SEQ ID NO: 833111 - RNA, 22 nt, Mycobacterium avium subsp. paratuberculosis
cgucgccgauguaguccagccc

SEQ ID NO: 833112 - RNA, 19 nt, Mycobacterium avium subsp. paratuberculosis
cgucgccgacgggcccagc

SEQ ID NO: 833113 - RNA, 16 nt, Mycobacterium avium subsp. paratuberculosis
cgucgccgacguuguu

SEQ ID NO: 833114 - RNA, 17 nt, Mycobacterium avium subsp. paratuberculosis
cgucgccgaucaccuga

SEQ ID NO: 833115 - RNA, 24 nt, Mycobacterium avium subsp. paratuberculosis
cgucgccgaucaccugacagaccc

SEQ ID NO: 833116 - RNA, 16 nt, Mycobacterium avium subsp. paratuberculosis
cgucgccgaucagcac

SEQ ID NO: 833117 - RNA, 17 nt, Mycobacterium avium subsp. paratuberculosis
cgucgccgaucagcacc

SEQ ID NO: 833118 - RNA, 20 nt, Mycobacterium avium subsp. paratuberculosis
cgucgccgaucagcaccagg

SEQ ID NO: 833119 - RNA, 15 nt, Mycobacterium avium subsp. paratuberculosis
cgucgccagccgccg

SEQ ID NO: 833120 - RNA, 19 nt, Mycobacterium avium subsp. paratuberculosis
cgucgccaguugcacuuuc

SEQ ID NO: 833121 - RNA, 23 nt, Mycobacterium avium subsp. paratuberculosis
cgucgccaguugcacuuucggca

SEQ ID NO: 833122 - RNA, 12 nt, Mycobacterium avium subsp. paratuberculosis
cgucgccgacca

SEQ ID NO: 833123 - RNA, 13 nt, Mycobacterium avium subsp. paratuberculosis
cgucgccgaccag

SEQ ID NO: 833124 - RNA, 23 nt, Mycobacterium avium subsp. paratuberculosis
cgucgccgaccaguucggccacc

SEQ ID NO: 833125 - RNA, 15 nt, Mycobacterium avium subsp. paratuberculosis
cgucgccuuccugcg

SEQ ID NO: 833126 - RNA, 18 nt, Mycobacterium avium subsp. paratuberculosis
cgucgccuccugcuggcg

SEQ ID NO: 833127 - RNA, 19 nt, Mycobacterium avium subsp. paratuberculosis
cgucgccuccugcuggcgc

SEQ ID NO: 833128 - RNA, 23 nt, Mycobacterium avium subsp. paratuberculosis
cgucgccuccugcuggcgcugcc

SEQ ID NO: 833129 - RNA, 17 nt, Mycobacterium avium subsp. paratuberculosis
cgucgccucgcccucgg

SEQ ID NO: 833130 - RNA, 17 nt, Mycobacterium avium subsp. paratuberculosis
cgucgccgguggccgcc

SEQ ID NO: 833131 - RNA, 23 nt, Mycobacterium avium subsp. paratuberculosis
cgucgccgucggggucgcgccgg

SEQ ID NO: 833132 - RNA, 17 nt, Mycobacterium avium subsp. paratuberculosis
cgucgccgugccggacc

SEQ ID NO: 833133 - RNA, 15 nt, Mycobacterium avium subsp. paratuberculosis
cgucgccguggcggc

SEQ ID NO: 833134 - RNA, 18 nt, Mycobacterium avium subsp. paratuberculosis
cgucgccguggcggcccg

SEQ ID NO: 833135 - RNA, 21 nt, Mycobacterium avium subsp. paratuberculosis
cgucgcggaacagccggcuca

SEQ ID NO: 833136 - RNA, 22 nt, Mycobacterium avium subsp. paratuberculosis
cgucgcggaacagccggcucag

SEQ ID NO: 833137 - RNA, 19 nt, Mycobacterium avium subsp. paratuberculosis
cgucgcggaaccguugcag

SEQ ID NO: 833138 - RNA, 18 nt, Mycobacterium avium subsp. paratuberculosis
cgucgcggaacgggucga

SEQ ID NO: 833139 - RNA, 19 nt, Mycobacterium avium subsp. paratuberculosis
cgucgcggacccuggccag

SEQ ID NO: 833140 - RNA, 23 nt, Mycobacterium avium subsp. paratuberculosis
cgucgcggacccuggccagcacc

SEQ ID NO: 833141 - RNA, 17 nt, Mycobacterium avium subsp. paratuberculosis
cgucgcggaggaugccg

SEQ ID NO: 833142 - RNA, 14 nt, Mycobacterium avium subsp. paratuberculosis
cgucgcgcgggguc

SEQ ID NO: 833143 - RNA, 16 nt, Mycobacterium avium subsp. paratuberculosis
cgucgcgcggggucgg

SEQ ID NO: 833144 - RNA, 15 nt, Mycobacterium avium subsp. paratuberculosis
cgucgcgcgggguga

SEQ ID NO: 833145 - RNA, 19 nt, Mycobacterium avium subsp. paratuberculosis
cgucgcgcggggugacgcc

SEQ ID NO: 833146 - RNA, 22 nt, Mycobacterium avium subsp. paratuberculosis
cgucgcgcggggugacgcccgu

SEQ ID NO: 833147 - RNA, 15 nt, Mycobacterium avium subsp. paratuberculosis
cgucgcgacgagcgg

SEQ ID NO: 833148 - RNA, 17 nt, Mycobacterium avium subsp. paratuberculosis
cgucgcgacgagcgggc

SEQ ID NO: 833149 - RNA, 20 nt, Mycobacterium avium subsp. paratuberculosis
cguccuggacgucgucgcug

SEQ ID NO: 833150 - RNA, 14 nt, Mycobacterium avium subsp. paratuberculosis
cguccuggcgcugg

SEQ ID NO: 833151 - RNA, 22 nt, Mycobacterium avium subsp. paratuberculosis
cguccuggcgcuggugcagcag

SEQ ID NO: 833152 - RNA, 12 nt, Mycobacterium avium subsp. paratuberculosis
cguccugggccg

SEQ ID NO: 833153 - RNA, 12 nt, Mycobacterium avium subsp. paratuberculosis
cguccugcgggg

SEQ ID NO: 833154 - RNA, 22 nt, Mycobacterium avium subsp. paratuberculosis
cguccugagguauucgucgagg

SEQ ID NO: 833155 - RNA, 23 nt, Mycobacterium avium subsp. paratuberculosis
cguccugcaggcaggccggcagc

SEQ ID NO: 833156 - RNA, 15 nt, Mycobacterium avium subsp. paratuberculosis
cguccugcagcgccg

SEQ ID NO: 833157 - RNA, 17 nt, Mycobacterium avium subsp. paratuberculosis
cguccuggcgccaguag

SEQ ID NO: 833158 - RNA, 13 nt, Mycobacterium avium subsp. paratuberculosis
cguccuuggccgc

SEQ ID NO: 833159 - RNA, 14 nt, Mycobacterium avium subsp. paratuberculosis
cguccuuggccgcc

SEQ ID NO: 833160 - RNA, 15 nt, Mycobacterium avium subsp. paratuberculosis
cguccuugaccagcu

SEQ ID NO: 833161 - RNA, 16 nt, Mycobacterium avium subsp. paratuberculosis
cguccuugacccggcc

SEQ ID NO: 833162 - RNA, 14 nt, Mycobacterium avium subsp. paratuberculosis
cguccuugagcccc

SEQ ID NO: 833163 - RNA, 23 nt, Mycobacterium avium subsp. paratuberculosis
cguccuugaucagcaugucgccc

SEQ ID NO: 833164 - RNA, 15 nt, Mycobacterium avium subsp. paratuberculosis
cguccuugccgauca

SEQ ID NO: 833165 - RNA, 21 nt, Mycobacterium avium subsp. paratuberculosis
cguccuugccgaucagcguca

SEQ ID NO: 833166 - RNA, 23 nt, Mycobacterium avium subsp. paratuberculosis
cgucgaaguagggccgcagcgca

SEQ ID NO: 833167 - RNA, 17 nt, Mycobacterium avium subsp. paratuberculosis
cgucgaaggauucgggg

SEQ ID NO: 833168 - RNA, 23 nt, Mycobacterium avium subsp. paratuberculosis
cgucgaacacguugcgcaucagc

SEQ ID NO: 833169 - RNA, 15 nt, Mycobacterium avium subsp. paratuberculosis
cgucgaagggucggu

SEQ ID NO: 833170 - RNA, 20 nt, Mycobacterium avium subsp. paratuberculosis
cgucgaagggucggucgagc

SEQ ID NO: 833171 - RNA, 23 nt, Mycobacterium avium subsp. paratuberculosis
cgucgaagggucggucgagccug

SEQ ID NO: 833172 - RNA, 18 nt, Mycobacterium avium subsp. paratuberculosis
cgucgaaggccgggcugg

SEQ ID NO: 833173 - RNA, 19 nt, Mycobacterium avium subsp. paratuberculosis
cgucgaaggccgggcuggu

SEQ ID NO: 833174 - RNA, 14 nt, Mycobacterium avium subsp. paratuberculosis
cgucgaacagccgg

SEQ ID NO: 833175 - RNA, 17 nt, Mycobacterium avium subsp. paratuberculosis
cgucgaacagccgggcc

SEQ ID NO: 833176 - RNA, 18 nt, Mycobacterium avium subsp. paratuberculosis
cgucgaacagccgggccg

SEQ ID NO: 833177 - RNA, 19 nt, Mycobacterium avium subsp. paratuberculosis
cgucgaacagccgggccgc

SEQ ID NO: 833178 - RNA, 21 nt, Mycobacterium avium subsp. paratuberculosis
cgucgaagccgaucaccggcg

SEQ ID NO: 833179 - RNA, 23 nt, Mycobacterium avium subsp. paratuberculosis
cguccuugucgcgcaccgcggcg

SEQ ID NO: 833180 - RNA, 12 nt, Mycobacterium avium subsp. paratuberculosis
cgucgaaaccgu

SEQ ID NO: 833181 - RNA, 20 nt, Mycobacterium avium subsp. paratuberculosis
cgucgaaaaacccggugccg

SEQ ID NO: 833182 - RNA, 19 nt, Mycobacterium avium subsp. paratuberculosis
cgucgaaacggcugcugcg

SEQ ID NO: 833183 - RNA, 18 nt, Mycobacterium avium subsp. paratuberculosis
cgucgaaauagcggcgca

SEQ ID NO: 833184 - RNA, 19 nt, Mycobacterium avium subsp. paratuberculosis
cgucgagaaaggccagcac

SEQ ID NO: 833185 - RNA, 22 nt, Mycobacterium avium subsp. paratuberculosis
cgucgagaaaggccagcacgca

SEQ ID NO: 833186 - RNA, 15 nt, Mycobacterium avium subsp. paratuberculosis
cgucgaccugcucgu

SEQ ID NO: 833187 - RNA, 18 nt, Mycobacterium avium subsp. paratuberculosis
cgucgaccugcucgucgg

SEQ ID NO: 833188 - RNA, 14 nt, Mycobacterium avium subsp. paratuberculosis
cgucgacgucgggc

SEQ ID NO: 833189 - RNA, 15 nt, Mycobacterium avium subsp. paratuberculosis
cgucgacgucgggca

SEQ ID NO: 833190 - RNA, 16 nt, Mycobacterium avium subsp. paratuberculosis
cgucgacgucggggau

SEQ ID NO: 833191 - RNA, 21 nt, Mycobacterium avium subsp. paratuberculosis
cgucgagaaaagcggcgaaau

SEQ ID NO: 833192 - RNA, 16 nt, Mycobacterium avium subsp. paratuberculosis
cgucgacgugcgcggc

SEQ ID NO: 833193 - RNA, 17 nt, Mycobacterium avium subsp. paratuberculosis
cgucgacgugcgcggcg

SEQ ID NO: 833194 - RNA, 15 nt, Mycobacterium avium subsp. paratuberculosis
cgucgacguucgccg

SEQ ID NO: 833195 - RNA, 17 nt, Mycobacterium avium subsp. paratuberculosis
cgucgacguucgccgcc

SEQ ID NO: 833196 - RNA, 20 nt, Mycobacterium avium subsp. paratuberculosis
cgucgacguucgccgccagc

SEQ ID NO: 833197 - RNA, 15 nt, Mycobacterium avium subsp. paratuberculosis
cgucgacucggcggu

SEQ ID NO: 833198 - RNA, 17 nt, Mycobacterium avium subsp. paratuberculosis
cgucgacucggcggugc

SEQ ID NO: 833199 - RNA, 23 nt, Mycobacterium avium subsp. paratuberculosis
cgucgacucggcggugccguccu

SEQ ID NO: 833200 - RNA, 22 nt, Mycobacterium avium subsp. paratuberculosis
cgucgacugaucgacgagccgg

SEQ ID NO: 833201 - RNA, 23 nt, Mycobacterium avium subsp. paratuberculosis
cgucgacugaucgacgagccggg

SEQ ID NO: 833202 - RNA, 16 nt, Mycobacterium avium subsp. paratuberculosis
cgucgacugcaccgac

SEQ ID NO: 833203 - RNA, 17 nt, Mycobacterium avium subsp. paratuberculosis
cgucgagcgcggcccgc

SEQ ID NO: 833204 - RNA, 20 nt, Mycobacterium avium subsp. paratuberculosis
cgucgagcgcggcccgccga

SEQ ID NO: 833205 - RNA, 23 nt, Mycobacterium avium subsp. paratuberculosis
cgucgagcgcggcccgccgaacg

SEQ ID NO: 833206 - RNA, 17 nt, Mycobacterium avium subsp. paratuberculosis
cgucgagccgggcccgg

SEQ ID NO: 833207 - RNA, 13 nt, Mycobacterium avium subsp. paratuberculosis
cgucgagcgcguc

SEQ ID NO: 833208 - RNA, 15 nt, Mycobacterium avium subsp. paratuberculosis
cgucgagcgcgucgu

SEQ ID NO: 833209 - RNA, 15 nt, Mycobacterium avium subsp. paratuberculosis
cgucgagcgcucgcg

SEQ ID NO: 833210 - RNA, 14 nt, Mycobacterium avium subsp. paratuberculosis
cgucgagcggcccg

SEQ ID NO: 833211 - RNA, 17 nt, Mycobacterium avium subsp. paratuberculosis
cgucgagcggcccgucg

SEQ ID NO: 833212 - RNA, 15 nt, Mycobacterium avium subsp. paratuberculosis
cgucgagcggcgccu

SEQ ID NO: 833213 - RNA, 18 nt, Mycobacterium avium subsp. paratuberculosis
cgucgagcggcuugccgc

SEQ ID NO: 833214 - RNA, 19 nt, Mycobacterium avium subsp. paratuberculosis
cgucgagcggcuugccgcc

SEQ ID NO: 833215 - RNA, 20 nt, Mycobacterium avium subsp. paratuberculosis
cgucgagcggcuugccgccg

SEQ ID NO: 833216 - RNA, 23 nt, Mycobacterium avium subsp. paratuberculosis
cgucgagcggcuugccgccgcag

SEQ ID NO: 833217 - RNA, 14 nt, Mycobacterium avium subsp. paratuberculosis
cgucgagccagcgg

SEQ ID NO: 833218 - RNA, 21 nt, Mycobacterium avium subsp. paratuberculosis
cgucgagccgcucgcgcaccg

SEQ ID NO: 833219 - RNA, 15 nt, Mycobacterium avium subsp. paratuberculosis
cgucgagccggccgg

SEQ ID NO: 833220 - RNA, 16 nt, Mycobacterium avium subsp. paratuberculosis
cgucgagccggccgga

SEQ ID NO: 833221 - RNA, 17 nt, Mycobacterium avium subsp. paratuberculosis
cgucgagccggccggac

SEQ ID NO: 833222 - RNA, 12 nt, Mycobacterium avium subsp. paratuberculosis
cgucgagccggg

SEQ ID NO: 833223 - RNA, 16 nt, Mycobacterium avium subsp. paratuberculosis
cgucgacgucaacacc

SEQ ID NO: 833224 - RNA, 20 nt, Mycobacterium avium subsp. paratuberculosis
cgucgacguccacguugaug

SEQ ID NO: 833225 - RNA, 22 nt, Mycobacterium avium subsp. paratuberculosis
cgucgacguccucgcccgggug

SEQ ID NO: 833226 - RNA, 14 nt, Mycobacterium avium subsp. paratuberculosis
cgucgacgucgagg

SEQ ID NO: 833227 - RNA, 16 nt, Mycobacterium avium subsp. paratuberculosis
cgucgacgucggacgc

SEQ ID NO: 833228 - RNA, 21 nt, Mycobacterium avium subsp. paratuberculosis
cgucgacgucggacgcggccg

SEQ ID NO: 833229 - RNA, 18 nt, Mycobacterium avium subsp. paratuberculosis
cgucgaccuugcagcccg

SEQ ID NO: 833230 - RNA, 19 nt, Mycobacterium avium subsp. paratuberculosis
cgucgaccuugcagcccgc

SEQ ID NO: 833231 - RNA, 20 nt, Mycobacterium avium subsp. paratuberculosis
cgucgacggcggcgucccag

SEQ ID NO: 833232 - RNA, 15 nt, Mycobacterium avium subsp. paratuberculosis
cgucgacggcgugga

SEQ ID NO: 833233 - RNA, 20 nt, Mycobacterium avium subsp. paratuberculosis
cgucgaccuccucgaccccg

SEQ ID NO: 833234 - RNA, 20 nt, Mycobacterium avium subsp. paratuberculosis
cgucgaccgucacgcuggcg

SEQ ID NO: 833235 - RNA, 23 nt, Mycobacterium avium subsp. paratuberculosis
cgucgaccgucacgcuggcguga

SEQ ID NO: 833236 - RNA, 15 nt, Mycobacterium avium subsp. paratuberculosis
cgucgaccgucaggu

SEQ ID NO: 833237 - RNA, 15 nt, Mycobacterium avium subsp. paratuberculosis
cgucgaccgcgccgg

SEQ ID NO: 833238 - RNA, 16 nt, Mycobacterium avium subsp. paratuberculosis
cgucgaccgcgccggg

SEQ ID NO: 833239 - RNA, 20 nt, Mycobacterium avium subsp. paratuberculosis
cgucgaccgcgccggggugg

SEQ ID NO: 833240 - RNA, 14 nt, Mycobacterium avium subsp. paratuberculosis
cgucgaccgcgacg

SEQ ID NO: 833241 - RNA, 16 nt, Mycobacterium avium subsp. paratuberculosis
cgucgaccgcgacgac

SEQ ID NO: 833242 - RNA, 13 nt, Mycobacterium avium subsp. paratuberculosis
cgucgaccgcgcc

SEQ ID NO: 833243 - RNA, 14 nt, Mycobacterium avium subsp. paratuberculosis
cgucgaccgccacc

SEQ ID NO: 833244 - RNA, 19 nt, Mycobacterium avium subsp. paratuberculosis
cgucgaccgccaccagauc

SEQ ID NO: 833245 - RNA, 18 nt, Mycobacterium avium subsp. paratuberculosis
cgucgaccgccccgccgg

SEQ ID NO: 833246 - RNA, 23 nt, Mycobacterium avium subsp. paratuberculosis
cgucgaccgccccgccggugucg

SEQ ID NO: 833247 - RNA, 19 nt, Mycobacterium avium subsp. paratuberculosis
cgucgaccgccgcgaacgg

SEQ ID NO: 833248 - RNA, 22 nt, Mycobacterium avium subsp. paratuberculosis
cgucgaccgccgcgaacggguc

SEQ ID NO: 833249 - RNA, 19 nt, Mycobacterium avium subsp. paratuberculosis
cgucgacaccccgcucggc

SEQ ID NO: 833250 - RNA, 16 nt, Mycobacterium avium subsp. paratuberculosis
cgucgacacccgggcg

SEQ ID NO: 833251 - RNA, 22 nt, Mycobacterium avium subsp. paratuberculosis
cgucgacccgcuccccgauccg

SEQ ID NO: 833252 - RNA, 12 nt, Mycobacterium avium subsp. paratuberculosis
cgucgacccggc

SEQ ID NO: 833253 - RNA, 14 nt, Mycobacterium avium subsp. paratuberculosis
cgucgacccggccg

SEQ ID NO: 833254 - RNA, 15 nt, Mycobacterium avium subsp. paratuberculosis
cgucgacccggccgc

SEQ ID NO: 833255 - RNA, 17 nt, Mycobacterium avium subsp. paratuberculosis
cgucgacccggccgcgc

SEQ ID NO: 833256 - RNA, 19 nt, Mycobacterium avium subsp. paratuberculosis
cgucgacccggccgcgccg

SEQ ID NO: 833257 - RNA, 22 nt, Mycobacterium avium subsp. paratuberculosis
cgucgacccguuccccggccga

SEQ ID NO: 833258 - RNA, 20 nt, Mycobacterium avium subsp. paratuberculosis
cguccgaaaaacgcgucgcg

SEQ ID NO: 833259 - RNA, 21 nt, Mycobacterium avium subsp. paratuberculosis
cguccgaaaaacgcgucgcgu

SEQ ID NO: 833260 - RNA, 23 nt, Mycobacterium avium subsp. paratuberculosis
cguccgaacccguucccgacagc

SEQ ID NO: 833261 - RNA, 16 nt, Mycobacterium avium subsp. paratuberculosis
cguccgcgucggcgcc

SEQ ID NO: 833262 - RNA, 19 nt, Mycobacterium avium subsp. paratuberculosis
cguccgcgucggcgccggc

SEQ ID NO: 833263 - RNA, 15 nt, Mycobacterium avium subsp. paratuberculosis
cguccgcgucgucga

SEQ ID NO: 833264 - RNA, 19 nt, Mycobacterium avium subsp. paratuberculosis
cgucccggugucgccgucg

SEQ ID NO: 833265 - RNA, 16 nt, Mycobacterium avium subsp. paratuberculosis
cgucccgguugacccc

SEQ ID NO: 833266 - RNA, 21 nt, Mycobacterium avium subsp. paratuberculosis
cgucccgucacggcugccgac

SEQ ID NO: 833267 - RNA, 22 nt, Mycobacterium avium subsp. paratuberculosis
cgucccguccugggccuggcgc

SEQ ID NO: 833268 - RNA, 12 nt, Mycobacterium avium subsp. paratuberculosis
cgucccgucggc

SEQ ID NO: 833269 - RNA, 13 nt, Mycobacterium avium subsp. paratuberculosis
cgucccgucggcg

SEQ ID NO: 833270 - RNA, 15 nt, Mycobacterium avium subsp. paratuberculosis
cgucccgucggcgcg

SEQ ID NO: 833271 - RNA, 20 nt, Mycobacterium avium subsp. paratuberculosis
cgucccgucggcgcgaggcg

SEQ ID NO: 833272 - RNA, 12 nt, Mycobacterium avium subsp. paratuberculosis
cgucccugcgcg

SEQ ID NO: 833273 - RNA, 14 nt, Mycobacterium avium subsp. paratuberculosis
cgucccugcgcgga

SEQ ID NO: 833274 - RNA, 18 nt, Mycobacterium avium subsp. paratuberculosis
cgucccuguucgcgccgg

SEQ ID NO: 833275 - RNA, 19 nt, Mycobacterium avium subsp. paratuberculosis
cgucccuguucgcgccggu

SEQ ID NO: 833276 - RNA, 12 nt, Mycobacterium avium subsp. paratuberculosis
cguccggcggca

SEQ ID NO: 833277 - RNA, 23 nt, Mycobacterium avium subsp. paratuberculosis
cguccggaggugccggccggucg

SEQ ID NO: 833278 - RNA, 16 nt, Mycobacterium avium subsp. paratuberculosis
cguccggcccggcguc

SEQ ID NO: 833279 - RNA, 17 nt, Mycobacterium avium subsp. paratuberculosis
cguccggcccggcgucc

SEQ ID NO: 833280 - RNA, 12 nt, Mycobacterium avium subsp. paratuberculosis
cguccggccggu

SEQ ID NO: 833281 - RNA, 12 nt, Mycobacterium avium subsp. paratuberculosis
cguccggcgaca

SEQ ID NO: 833282 - RNA, 22 nt, Mycobacterium avium subsp. paratuberculosis
cguccggagaaccgcucgaugg

SEQ ID NO: 833283 - RNA, 20 nt, Mycobacterium avium subsp. paratuberculosis
cguccggauagccgucggcg

SEQ ID NO: 833284 - RNA, 22 nt, Mycobacterium avium subsp. paratuberculosis
cguccggauagccgucggcgga

SEQ ID NO: 833285 - RNA, 14 nt, Mycobacterium avium subsp. paratuberculosis
cguccggaugcggc

SEQ ID NO: 833286 - RNA, 16 nt, Mycobacterium avium subsp. paratuberculosis
cguccggaugcggcgc

SEQ ID NO: 833287 - RNA, 21 nt, Mycobacterium avium subsp. paratuberculosis
cguccggaugcggcgcccaca

SEQ ID NO: 833288 - RNA, 22 nt, Mycobacterium avium subsp. paratuberculosis
cguccgggcacccgacgucgac

SEQ ID NO: 833289 - RNA, 12 nt, Mycobacterium avium subsp. paratuberculosis
cguccgggccgc

SEQ ID NO: 833290 - RNA, 15 nt, Mycobacterium avium subsp. paratuberculosis
cguccgggccgccuc

SEQ ID NO: 833291 - RNA, 14 nt, Mycobacterium avium subsp. paratuberculosis
cguccgggccggcc

SEQ ID NO: 833292 - RNA, 16 nt, Mycobacterium avium subsp. paratuberculosis
cguccgggccggccag

SEQ ID NO: 833293 - RNA, 13 nt, Mycobacterium avium subsp. paratuberculosis
cguccucgacgau

SEQ ID NO: 833294 - RNA, 13 nt, Mycobacterium avium subsp. paratuberculosis
cguccucgacggu

SEQ ID NO: 833295 - RNA, 19 nt, Mycobacterium avium subsp. paratuberculosis
cguccucgaucaccgacag

SEQ ID NO: 833296 - RNA, 20 nt, Mycobacterium avium subsp. paratuberculosis
cguccucgaucaccgacagc

SEQ ID NO: 833297 - RNA, 17 nt, Mycobacterium avium subsp. paratuberculosis
cguccucgaugacgccg

SEQ ID NO: 833298 - RNA, 23 nt, Mycobacterium avium subsp. paratuberculosis
cguccucgaugacgccggacagc

SEQ ID NO: 833299 - RNA, 15 nt, Mycobacterium avium subsp. paratuberculosis
cguccucccggccga

SEQ ID NO: 833300 - RNA, 16 nt, Mycobacterium avium subsp. paratuberculosis
cguccucccggccgac

SEQ ID NO: 833301 - RNA, 20 nt, Mycobacterium avium subsp. paratuberculosis
cguccucccggccgacgaug

SEQ ID NO: 833302 - RNA, 15 nt, Mycobacterium avium subsp. paratuberculosis
cguccucccgguagc

SEQ ID NO: 833303 - RNA, 14 nt, Mycobacterium avium subsp. paratuberculosis
cguccucgaccacc

SEQ ID NO: 833304 - RNA, 23 nt, Mycobacterium avium subsp. paratuberculosis
cguccucgaccacccgcugguca

SEQ ID NO: 833305 - RNA, 22 nt, Mycobacterium avium subsp. paratuberculosis
cguccugauuuuggggacgcug

SEQ ID NO: 833306 - RNA, 17 nt, Mycobacterium avium subsp. paratuberculosis
cguccucgucggcgaag

SEQ ID NO: 833307 - RNA, 18 nt, Mycobacterium avium subsp. paratuberculosis
cguccucgucggcgaagg

SEQ ID NO: 833308 - RNA, 17 nt, Mycobacterium avium subsp. paratuberculosis
cguccucgucgguccag

SEQ ID NO: 833309 - RNA, 11 nt, Mycobacterium avium subsp. paratuberculosis
cguccucgguc

SEQ ID NO: 833310 - RNA, 14 nt, Mycobacterium avium subsp. paratuberculosis
cguccucggucagg

SEQ ID NO: 833311 - RNA, 14 nt, Mycobacterium avium subsp. paratuberculosis
cguccucgucgaug

SEQ ID NO: 833312 - RNA, 17 nt, Mycobacterium avium subsp. paratuberculosis
cguccucguucuggccc

SEQ ID NO: 833313 - RNA, 21 nt, Mycobacterium avium subsp. paratuberculosis
cguccucggccgccaccgcca

SEQ ID NO: 833314 - RNA, 20 nt, Mycobacterium avium subsp. paratuberculosis
cguccucgaugccgaccgac

SEQ ID NO: 833315 - RNA, 22 nt, Mycobacterium avium subsp. paratuberculosis
cguccucgaugccgaccgacag

SEQ ID NO: 833316 - RNA, 16 nt, Mycobacterium avium subsp. paratuberculosis
cguccucgcgccgugg

SEQ ID NO: 833317 - RNA, 19 nt, Mycobacterium avium subsp. paratuberculosis
cguccucgcgccguggccc

SEQ ID NO: 833318 - RNA, 17 nt, Mycobacterium avium subsp. paratuberculosis
cguccauguaguucagc

SEQ ID NO: 833319 - RNA, 15 nt, Mycobacterium avium subsp. paratuberculosis
cguccaugcccgccc

SEQ ID NO: 833320 - RNA, 13 nt, Mycobacterium avium subsp. paratuberculosis
cguccaugcggug

SEQ ID NO: 833321 - RNA, 21 nt, Mycobacterium avium subsp. paratuberculosis
cguccaugcucuugcgggcgg

SEQ ID NO: 833322 - RNA, 21 nt, Mycobacterium avium subsp. paratuberculosis
cguccaugcuggugccgccga

SEQ ID NO: 833323 - RNA, 12 nt, Mycobacterium avium subsp. paratuberculosis
cguccaucguca

SEQ ID NO: 833324 - RNA, 17 nt, Mycobacterium avium subsp. paratuberculosis
cguccaucguccucgcg

SEQ ID NO: 833325 - RNA, 15 nt, Mycobacterium avium subsp. paratuberculosis
cgucaucaucaccgg

SEQ ID NO: 833326 - RNA, 17 nt, Mycobacterium avium subsp. paratuberculosis
cguccaucgccgcgcac

SEQ ID NO: 833327 - RNA, 15 nt, Mycobacterium avium subsp. paratuberculosis
cgucccggcccaugg

SEQ ID NO: 833328 - RNA, 21 nt, Mycobacterium avium subsp. paratuberculosis
cgucccggcccauggcgaaca

SEQ ID NO: 833329 - RNA, 21 nt, Mycobacterium avium subsp. paratuberculosis
cgucccgggccuuggccaacg

SEQ ID NO: 833330 - RNA, 22 nt, Mycobacterium avium subsp. paratuberculosis
cgucccgggccuuggccaacgc

SEQ ID NO: 833331 - RNA, 21 nt, Mycobacterium avium subsp. paratuberculosis
cgucccaggguugccgcacga

SEQ ID NO: 833332 - RNA, 14 nt, Mycobacterium avium subsp. paratuberculosis
cgucccacggcggg

SEQ ID NO: 833333 - RNA, 16 nt, Mycobacterium avium subsp. paratuberculosis
cgucaucacgugcugg

SEQ ID NO: 833334 - RNA, 19 nt, Mycobacterium avium subsp. paratuberculosis
cgucaucacgugcuggcgc

SEQ ID NO: 833335 - RNA, 13 nt, Mycobacterium avium subsp. paratuberculosis
cgucaucaccgcc

SEQ ID NO: 833336 - RNA, 22 nt, Mycobacterium avium subsp. paratuberculosis
cgucagugcgcauucggcgacg

SEQ ID NO: 833337 - RNA, 18 nt, Mycobacterium avium subsp. paratuberculosis
cguaguugcgcgccgaug

SEQ ID NO: 833338 - RNA, 13 nt, Mycobacterium avium subsp. paratuberculosis
cguaguugcggcc

SEQ ID NO: 833339 - RNA, 15 nt, Mycobacterium avium subsp. paratuberculosis
cguaguugcggccgg

SEQ ID NO: 833340 - RNA, 19 nt, Mycobacterium avium subsp. paratuberculosis
cguaguugcggccggcggu

SEQ ID NO: 833341 - RNA, 18 nt, Mycobacterium avium subsp. paratuberculosis
cguagugggucggcggcu

SEQ ID NO: 833342 - RNA, 19 nt, Mycobacterium avium subsp. paratuberculosis
cguagugggucggcggcug

SEQ ID NO: 833343 - RNA, 16 nt, Mycobacterium avium subsp. paratuberculosis
cguaguuggggccggc

SEQ ID NO: 833344 - RNA, 21 nt, Mycobacterium avium subsp. paratuberculosis
cguaguuggggccggccgccc

SEQ ID NO: 833345 - RNA, 20 nt, Mycobacterium avium subsp. paratuberculosis
cguauacgccagaugcgccg

SEQ ID NO: 833346 - RNA, 21 nt, Mycobacterium avium subsp. paratuberculosis
cguauacgccagaugcgccgc

SEQ ID NO: 833347 - RNA, 23 nt, Mycobacterium avium subsp. paratuberculosis
cguaucaacugagcgcccggucg

SEQ ID NO: 833348 - RNA, 15 nt, Mycobacterium avium subsp. paratuberculosis
cguaucgcgccugca

SEQ ID NO: 833349 - RNA, 17 nt, Mycobacterium avium subsp. paratuberculosis
cguaucgcgccugcacc

SEQ ID NO: 833350 - RNA, 21 nt, Mycobacterium avium subsp. paratuberculosis
cguaucgcgccugcaccggcg

SEQ ID NO: 833351 - RNA, 17 nt, Mycobacterium avium subsp. paratuberculosis
cgucacaccgcggccag

SEQ ID NO: 833352 - RNA, 18 nt, Mycobacterium avium subsp. paratuberculosis
cgucacauccgucacgcc

SEQ ID NO: 833353 - RNA, 20 nt, Mycobacterium avium subsp. paratuberculosis
cgucaccaaugcgccggcgg

SEQ ID NO: 833354 - RNA, 21 nt, Mycobacterium avium subsp. paratuberculosis
cgucaccaaugcgccggcggc

SEQ ID NO: 833355 - RNA, 22 nt, Mycobacterium avium subsp. paratuberculosis
cgucaccaaugcgccggcggcc

SEQ ID NO: 833356 - RNA, 19 nt, Mycobacterium avium subsp. paratuberculosis
cguaucuccaccgucgaug

SEQ ID NO: 833357 - RNA, 15 nt, Mycobacterium avium subsp. paratuberculosis
cgucaacucgucggc

SEQ ID NO: 833358 - RNA, 13 nt, Mycobacterium avium subsp. paratuberculosis
cgucacuccucga

SEQ ID NO: 833359 - RNA, 17 nt, Mycobacterium avium subsp. paratuberculosis
cgucacuccucgaucug

SEQ ID NO: 833360 - RNA, 13 nt, Mycobacterium avium subsp. paratuberculosis
cgucacucuggcg

SEQ ID NO: 833361 - RNA, 18 nt, Mycobacterium avium subsp. paratuberculosis
cgucacucuggcgugacg

SEQ ID NO: 833362 - RNA, 17 nt, Mycobacterium avium subsp. paratuberculosis
cgucacgucggccugca

SEQ ID NO: 833363 - RNA, 22 nt, Mycobacterium avium subsp. paratuberculosis
cgucacgucguugagcacaccc

SEQ ID NO: 833364 - RNA, 14 nt, Mycobacterium avium subsp. paratuberculosis
cgucacguucacca

SEQ ID NO: 833365 - RNA, 16 nt, Mycobacterium avium subsp. paratuberculosis
cgucacugucggcgcg

SEQ ID NO: 833366 - RNA, 17 nt, Mycobacterium avium subsp. paratuberculosis
cgucagcgucagcacgu

SEQ ID NO: 833367 - RNA, 19 nt, Mycobacterium avium subsp. paratuberculosis
cgucagcucccccgacacc

SEQ ID NO: 833368 - RNA, 22 nt, Mycobacterium avium subsp. paratuberculosis
cgucagcucccccgacaccgcc

SEQ ID NO: 833369 - RNA, 17 nt, Mycobacterium avium subsp. paratuberculosis
cgucagcgccgcccgca

SEQ ID NO: 833370 - RNA, 22 nt, Mycobacterium avium subsp. paratuberculosis
cgucagaaccggggccagcacg

SEQ ID NO: 833371 - RNA, 15 nt, Mycobacterium avium subsp. paratuberculosis
cgucagcgcgggcca

SEQ ID NO: 833372 - RNA, 16 nt, Mycobacterium avium subsp. paratuberculosis
cgucagcgcgggccag

SEQ ID NO: 833373 - RNA, 14 nt, Mycobacterium avium subsp. paratuberculosis
cgucagcggcgggc

SEQ ID NO: 833374 - RNA, 18 nt, Mycobacterium avium subsp. paratuberculosis
cgucacguagcgcggccg

SEQ ID NO: 833375 - RNA, 21 nt, Mycobacterium avium subsp. paratuberculosis
cgucacguagcgcggccgccc

SEQ ID NO: 833376 - RNA, 14 nt, Mycobacterium avium subsp. paratuberculosis
cgucacgucgacgg

SEQ ID NO: 833377 - RNA, 17 nt, Mycobacterium avium subsp. paratuberculosis
cgucacggcugccgacc

SEQ ID NO: 833378 - RNA, 17 nt, Mycobacterium avium subsp. paratuberculosis
cgucacgggccaggcgc

SEQ ID NO: 833379 - RNA, 20 nt, Mycobacterium avium subsp. paratuberculosis
cgucacgggcugaccgccag

SEQ ID NO: 833380 - RNA, 21 nt, Mycobacterium avium subsp. paratuberculosis
cgucacgggcugaccgccagg

SEQ ID NO: 833381 - RNA, 17 nt, Mycobacterium avium subsp. paratuberculosis
cgucaccuucaccacgg

SEQ ID NO: 833382 - RNA, 23 nt, Mycobacterium avium subsp. paratuberculosis
cgucaccuucaccacggccauca

SEQ ID NO: 833383 - RNA, 23 nt, Mycobacterium avium subsp. paratuberculosis
cgucaccgugggcggcgcgaucg

SEQ ID NO: 833384 - RNA, 14 nt, Mycobacterium avium subsp. paratuberculosis
cgucaccguggcgg

SEQ ID NO: 833385 - RNA, 15 nt, Mycobacterium avium subsp. paratuberculosis
cgucaccgugccguc

SEQ ID NO: 833386 - RNA, 17 nt, Mycobacterium avium subsp. paratuberculosis
cgucaccgugccgucgc

SEQ ID NO: 833387 - RNA, 16 nt, Mycobacterium avium subsp. paratuberculosis
cgucaccggccauccg

SEQ ID NO: 833388 - RNA, 20 nt, Mycobacterium avium subsp. paratuberculosis
cgucaccggccauccgcugc

SEQ ID NO: 833389 - RNA, 21 nt, Mycobacterium avium subsp. paratuberculosis
cgucaccggccauccgcugcg

SEQ ID NO: 833390 - RNA, 18 nt, Mycobacterium avium subsp. paratuberculosis
cgucaccggcugcccgac

SEQ ID NO: 833391 - RNA, 23 nt, Mycobacterium avium subsp. paratuberculosis
cgucaccggcugcccgacccgca

SEQ ID NO: 833392 - RNA, 17 nt, Mycobacterium avium subsp. paratuberculosis
cgucaccaccgggucgu

SEQ ID NO: 833393 - RNA, 23 nt, Mycobacterium avium subsp. paratuberculosis
cgucaccaacaugaucggcgcga

SEQ ID NO: 833394 - RNA, 23 nt, Mycobacterium avium subsp. paratuberculosis
cgucaaugauggucagccgcacc

SEQ ID NO: 833395 - RNA, 19 nt, Mycobacterium avium subsp. paratuberculosis
cgucaccgcgcuugccgcg

SEQ ID NO: 833396 - RNA, 20 nt, Mycobacterium avium subsp. paratuberculosis
cgucaccgcgcuugccgcga

SEQ ID NO: 833397 - RNA, 14 nt, Mycobacterium avium subsp. paratuberculosis
cgucaccgcgggug

SEQ ID NO: 833398 - RNA, 14 nt, Mycobacterium avium subsp. paratuberculosis
cguaguccagcacg

SEQ ID NO: 833399 - RNA, 15 nt, Mycobacterium avium subsp. paratuberculosis
cguaguccagcacgg

SEQ ID NO: 833400 - RNA, 15 nt, Mycobacterium avium subsp. paratuberculosis
cguaguaggugcgcg

SEQ ID NO: 833401 - RNA, 20 nt, Mycobacterium avium subsp. paratuberculosis
cguaguaggugcgcgaggag

SEQ ID NO: 833402 - RNA, 14 nt, Mycobacterium avium subsp. paratuberculosis
cguagucgcucggc

SEQ ID NO: 833403 - RNA, 17 nt, Mycobacterium avium subsp. paratuberculosis
cguagucgcucggcggc

SEQ ID NO: 833404 - RNA, 18 nt, Mycobacterium avium subsp. paratuberculosis
cguagucgcucggcggcg

SEQ ID NO: 833405 - RNA, 21 nt, Mycobacterium avium subsp. paratuberculosis
cguagucgcucggcggcgacg

SEQ ID NO: 833406 - RNA, 15 nt, Mycobacterium avium subsp. paratuberculosis
cguagucgcugagcg

SEQ ID NO: 833407 - RNA, 12 nt, Mycobacterium avium subsp. paratuberculosis
cguaggcgaugu

SEQ ID NO: 833408 - RNA, 18 nt, Mycobacterium avium subsp. paratuberculosis
cguagucgaccgggaucg

SEQ ID NO: 833409 - RNA, 14 nt, Mycobacterium avium subsp. paratuberculosis
cguagugcucggcg

SEQ ID NO: 833410 - RNA, 14 nt, Mycobacterium avium subsp. paratuberculosis
cguagucgccggug

SEQ ID NO: 833411 - RNA, 17 nt, Mycobacterium avium subsp. paratuberculosis
cguagucgccgguguag

SEQ ID NO: 833412 - RNA, 17 nt, Mycobacterium avium subsp. paratuberculosis
cguagucggcgcagcgc

SEQ ID NO: 833413 - RNA, 20 nt, Mycobacterium avium subsp. paratuberculosis
cguagucguugucggcgguc

SEQ ID NO: 833414 - RNA, 14 nt, Mycobacterium avium subsp. paratuberculosis
cguagucggcggcg

SEQ ID NO: 833415 - RNA, 18 nt, Mycobacterium avium subsp. paratuberculosis
cguagucggcgucggcca

SEQ ID NO: 833416 - RNA, 19 nt, Mycobacterium avium subsp. paratuberculosis
cguagucggcgucggccac

SEQ ID NO: 833417 - RNA, 14 nt, Mycobacterium avium subsp. paratuberculosis
cguagucggugcag

SEQ ID NO: 833418 - RNA, 12 nt, Mycobacterium avium subsp. paratuberculosis
cguagucgucga

SEQ ID NO: 833419 - RNA, 14 nt, Mycobacterium avium subsp. paratuberculosis
cguagucgucgauc

SEQ ID NO: 833420 - RNA, 18 nt, Mycobacterium avium subsp. paratuberculosis
cguagucgauggccucgu

SEQ ID NO: 833421 - RNA, 21 nt, Mycobacterium avium subsp. paratuberculosis
cguagucgauggccucgucgc

SEQ ID NO: 833422 - RNA, 16 nt, Mycobacterium avium subsp. paratuberculosis
cguagucggcccgccg

SEQ ID NO: 833423 - RNA, 18 nt, Mycobacterium avium subsp. paratuberculosis
cguagucggcccgccggg

SEQ ID NO: 833424 - RNA, 22 nt, Mycobacterium avium subsp. paratuberculosis
cguagucggcccgccgggccgg

SEQ ID NO: 833425 - RNA, 22 nt, Mycobacterium avium subsp. paratuberculosis
cguaggccuugcugagccggcc

SEQ ID NO: 833426 - RNA, 14 nt, Mycobacterium avium subsp. paratuberculosis
cguaggcgaucagc

SEQ ID NO: 833427 - RNA, 17 nt, Mycobacterium avium subsp. paratuberculosis
cguaggcgaucagcgcg

SEQ ID NO: 833428 - RNA, 13 nt, Mycobacterium avium subsp. paratuberculosis
cguagcccgccga

SEQ ID NO: 833429 - RNA, 15 nt, Mycobacterium avium subsp. paratuberculosis
cguagcccgccgaau

SEQ ID NO: 833430 - RNA, 15 nt, Mycobacterium avium subsp. paratuberculosis
cguagccgccgguug

SEQ ID NO: 833431 - RNA, 23 nt, Mycobacterium avium subsp. paratuberculosis
cguagccgccgguugaucacccg

SEQ ID NO: 833432 - RNA, 18 nt, Mycobacterium avium subsp. paratuberculosis
cguaggacccuucgaacg

SEQ ID NO: 833433 - RNA, 21 nt, Mycobacterium avium subsp. paratuberculosis
cguaggacaccacgguggcgu

SEQ ID NO: 833434 - RNA, 15 nt, Mycobacterium avium subsp. paratuberculosis
cguaggacagcagcc

SEQ ID NO: 833435 - RNA, 18 nt, Mycobacterium avium subsp. paratuberculosis
cguagccgaccaacgggc

SEQ ID NO: 833436 - RNA, 15 nt, Mycobacterium avium subsp. paratuberculosis
cguagcccugcaggu

SEQ ID NO: 833437 - RNA, 15 nt, Mycobacterium avium subsp. paratuberculosis
cguagccgcggguga

SEQ ID NO: 833438 - RNA, 18 nt, Mycobacterium avium subsp. paratuberculosis
cguagccgcgguucggcg

SEQ ID NO: 833439 - RNA, 19 nt, Mycobacterium avium subsp. paratuberculosis
cguagccgcgguucggcgu

SEQ ID NO: 833440 - RNA, 15 nt, Mycobacterium avium subsp. paratuberculosis
cguacauggugacca

SEQ ID NO: 833441 - RNA, 15 nt, Mycobacterium avium subsp. paratuberculosis
cguacagcccgcgga

SEQ ID NO: 833442 - RNA, 20 nt, Mycobacterium avium subsp. paratuberculosis
cguacaucagcucgucagcg

SEQ ID NO: 833443 - RNA, 13 nt, Mycobacterium avium subsp. paratuberculosis
cguaccagcgcca

SEQ ID NO: 833444 - RNA, 14 nt, Mycobacterium avium subsp. paratuberculosis
cguaccagcgccac

SEQ ID NO: 833445 - RNA, 16 nt, Mycobacterium avium subsp. paratuberculosis
cguaccagcgcucgac

SEQ ID NO: 833446 - RNA, 18 nt, Mycobacterium avium subsp. paratuberculosis
cguaccagcugcccacca

SEQ ID NO: 833447 - RNA, 21 nt, Mycobacterium avium subsp. paratuberculosis
cguaccaccaccagucggcgc

SEQ ID NO: 833448 - RNA, 22 nt, Mycobacterium avium subsp. paratuberculosis
cguaccaccaccagucggcgcg

SEQ ID NO: 833449 - RNA, 17 nt, Mycobacterium avium subsp. paratuberculosis
cguacccccgcacgcca

SEQ ID NO: 833450 - RNA, 22 nt, Mycobacterium avium subsp. paratuberculosis
cguacccccgcacgccagcauc

SEQ ID NO: 833451 - RNA, 13 nt, Mycobacterium avium subsp. paratuberculosis
cguacccgcgcgg

SEQ ID NO: 833452 - RNA, 14 nt, Mycobacterium avium subsp. paratuberculosis
cguacccgcgcggc

SEQ ID NO: 833453 - RNA, 15 nt, Mycobacterium avium subsp. paratuberculosis
cguacccgcgcggcg

SEQ ID NO: 833454 - RNA, 18 nt, Mycobacterium avium subsp. paratuberculosis
cguacccgcgcggcgucg

SEQ ID NO: 833455 - RNA, 19 nt, Mycobacterium avium subsp. paratuberculosis
cguacccaggucggcguga

SEQ ID NO: 833456 - RNA, 21 nt, Mycobacterium avium subsp. paratuberculosis
cguacccgcccaugcacgauc

SEQ ID NO: 833457 - RNA, 17 nt, Mycobacterium avium subsp. paratuberculosis
cguagaauccgccguug

SEQ ID NO: 833458 - RNA, 16 nt, Mycobacterium avium subsp. paratuberculosis
cguagaacucgccgug

SEQ ID NO: 833459 - RNA, 19 nt, Mycobacterium avium subsp. paratuberculosis
cguagaagcucagcugcug

SEQ ID NO: 833460 - RNA, 17 nt, Mycobacterium avium subsp. paratuberculosis
cguagaaggcgccgucg

SEQ ID NO: 833461 - RNA, 17 nt, Mycobacterium avium subsp. paratuberculosis
cguagaccagcaucagc

SEQ ID NO: 833462 - RNA, 18 nt, Mycobacterium avium subsp. paratuberculosis
cguagaccagcgacgcca

SEQ ID NO: 833463 - RNA, 16 nt, Mycobacterium avium subsp. paratuberculosis
cguagaacauccacgg

SEQ ID NO: 833464 - RNA, 16 nt, Mycobacterium avium subsp. paratuberculosis
cguaccgauccgcggg

SEQ ID NO: 833465 - RNA, 15 nt, Mycobacterium avium subsp. paratuberculosis
cguagcccagcgcgu

SEQ ID NO: 833466 - RNA, 23 nt, Mycobacterium avium subsp. paratuberculosis
cguagcccagcgcguugcggccg

SEQ ID NO: 833467 - RNA, 12 nt, Mycobacterium avium subsp. paratuberculosis
cguagcagcaga

SEQ ID NO: 833468 - RNA, 20 nt, Mycobacterium avium subsp. paratuberculosis
cguagacccacagcugccgg

SEQ ID NO: 833469 - RNA, 16 nt, Mycobacterium avium subsp. paratuberculosis
cguagacgacgucgac

SEQ ID NO: 833470 - RNA, 20 nt, Mycobacterium avium subsp. paratuberculosis
cguagacgacgucgaccgcg

SEQ ID NO: 833471 - RNA, 22 nt, Mycobacterium avium subsp. paratuberculosis
cguagacgacgucgaccgcgcc

SEQ ID NO: 833472 - RNA, 18 nt, Mycobacterium avium subsp. paratuberculosis
cguagaugcggcccagcc

SEQ ID NO: 833473 - RNA, 22 nt, Mycobacterium avium subsp. paratuberculosis
cguagaugcggcccagcccggc

SEQ ID NO: 833474 - RNA, 15 nt, Mycobacterium avium subsp. paratuberculosis
cggugugggcgaugg

SEQ ID NO: 833475 - RNA, 18 nt, Mycobacterium avium subsp. paratuberculosis
cggugugggcgauggcgg

SEQ ID NO: 833476 - RNA, 15 nt, Mycobacterium avium subsp. paratuberculosis
cgguguuuggccgcg

SEQ ID NO: 833477 - RNA, 14 nt, Mycobacterium avium subsp. paratuberculosis
cgguguuuggccgc

SEQ ID NO: 833478 - RNA, 12 nt, Mycobacterium avium subsp. paratuberculosis
cgguguggccgc

SEQ ID NO: 833479 - RNA, 13 nt, Mycobacterium avium subsp. paratuberculosis
cgguguggccgcg

SEQ ID NO: 833480 - RNA, 18 nt, Mycobacterium avium subsp. paratuberculosis
cggugugcggcagcucgg

SEQ ID NO: 833481 - RNA, 13 nt, Mycobacterium avium subsp. paratuberculosis
cggugugcggguc

SEQ ID NO: 833482 - RNA, 15 nt, Mycobacterium avium subsp. paratuberculosis
cggugugcgggucgg

SEQ ID NO: 833483 - RNA, 20 nt, Mycobacterium avium subsp. paratuberculosis
cggugugcugacccagcgcg

SEQ ID NO: 833484 - RNA, 17 nt, Mycobacterium avium subsp. paratuberculosis
cggugugcuggccagca

SEQ ID NO: 833485 - RNA, 18 nt, Mycobacterium avium subsp. paratuberculosis
cggugugcuggccagcac

SEQ ID NO: 833486 - RNA, 23 nt, Mycobacterium avium subsp. paratuberculosis
cggugugcuggccagcaccagcg

SEQ ID NO: 833487 - RNA, 14 nt, Mycobacterium avium subsp. paratuberculosis
cgguguggaccgcg

SEQ ID NO: 833488 - RNA, 15 nt, Mycobacterium avium subsp. paratuberculosis
cgguguggaccgcgc

SEQ ID NO: 833489 - RNA, 21 nt, Mycobacterium avium subsp. paratuberculosis
cgguguggaccgcgcagucgg

SEQ ID NO: 833490 - RNA, 21 nt, Mycobacterium avium subsp. paratuberculosis
cgguguggagauagugauauc

SEQ ID NO: 833491 - RNA, 14 nt, Mycobacterium avium subsp. paratuberculosis
cggugucgcccagc

SEQ ID NO: 833492 - RNA, 16 nt, Mycobacterium avium subsp. paratuberculosis
cggugucgcccagcug

SEQ ID NO: 833493 - RNA, 17 nt, Mycobacterium avium subsp. paratuberculosis
cggugucgcccagcugg

SEQ ID NO: 833494 - RNA, 23 nt, Mycobacterium avium subsp. paratuberculosis
cggugucgcccucgcgcagggcc

SEQ ID NO: 833495 - RNA, 14 nt, Mycobacterium avium subsp. paratuberculosis
cggugugccgcugc

SEQ ID NO: 833496 - RNA, 17 nt, Mycobacterium avium subsp. paratuberculosis
cggugugccuggcuccc

SEQ ID NO: 833497 - RNA, 14 nt, Mycobacterium avium subsp. paratuberculosis
cggugugcggcagc

SEQ ID NO: 833498 - RNA, 12 nt, Mycobacterium avium subsp. paratuberculosis
cggugugcggcg

SEQ ID NO: 833499 - RNA, 16 nt, Mycobacterium avium subsp. paratuberculosis
cggugucgccgucgcc

SEQ ID NO: 833500 - RNA, 18 nt, Mycobacterium avium subsp. paratuberculosis
cggugucgccgucgccgc

SEQ ID NO: 833501 - RNA, 15 nt, Mycobacterium avium subsp. paratuberculosis
cggugugcagcagcu

SEQ ID NO: 833502 - RNA, 17 nt, Mycobacterium avium subsp. paratuberculosis
cggugugcagcagcucg

SEQ ID NO: 833503 - RNA, 18 nt, Mycobacterium avium subsp. paratuberculosis
cggugugcagcagcucgg

SEQ ID NO: 833504 - RNA, 20 nt, Mycobacterium avium subsp. paratuberculosis
cggugugcagcagcucggcg

SEQ ID NO: 833505 - RNA, 21 nt, Mycobacterium avium subsp. paratuberculosis
cggugugcagccacccgucgg

SEQ ID NO: 833506 - RNA, 19 nt, Mycobacterium avium subsp. paratuberculosis
cggugucgaaguacgccgu

SEQ ID NO: 833507 - RNA, 20 nt, Mycobacterium avium subsp. paratuberculosis
cggugucgaaguacgccguc

SEQ ID NO: 833508 - RNA, 14 nt, Mycobacterium avium subsp. paratuberculosis
cggugucgagccgg

SEQ ID NO: 833509 - RNA, 17 nt, Mycobacterium avium subsp. paratuberculosis
cggugucgagccggugc

SEQ ID NO: 833510 - RNA, 19 nt, Mycobacterium avium subsp. paratuberculosis
cggugucgagccggugccg

SEQ ID NO: 833511 - RNA, 14 nt, Mycobacterium avium subsp. paratuberculosis
cgguucccggcacc

SEQ ID NO: 833512 - RNA, 16 nt, Mycobacterium avium subsp. paratuberculosis
cgguuccgcgacaucg

SEQ ID NO: 833513 - RNA, 14 nt, Mycobacterium avium subsp. paratuberculosis
cgguuccgggcgac

SEQ ID NO: 833514 - RNA, 16 nt, Mycobacterium avium subsp. paratuberculosis
cgguuccgggcgcucu

SEQ ID NO: 833515 - RNA, 13 nt, Mycobacterium avium subsp. paratuberculosis
cgguuccgguggc

SEQ ID NO: 833516 - RNA, 16 nt, Mycobacterium avium subsp. paratuberculosis
cggugucaccgacgcc

SEQ ID NO: 833517 - RNA, 21 nt, Mycobacterium avium subsp. paratuberculosis
cggugucaccgacgccagcgg

SEQ ID NO: 833518 - RNA, 19 nt, Mycobacterium avium subsp. paratuberculosis
cggugucacgcuggcguga

SEQ ID NO: 833519 - RNA, 17 nt, Mycobacterium avium subsp. paratuberculosis
cggugucacguccacgc

SEQ ID NO: 833520 - RNA, 18 nt, Mycobacterium avium subsp. paratuberculosis
cggugucacguccacgcc

SEQ ID NO: 833521 - RNA, 20 nt, Mycobacterium avium subsp. paratuberculosis
cggugucacguccacgccgc

SEQ ID NO: 833522 - RNA, 22 nt, Mycobacterium avium subsp. paratuberculosis
cggugucacguccacgccgcgg

SEQ ID NO: 833523 - RNA, 22 nt, Mycobacterium avium subsp. paratuberculosis
cgguguccacgaugcggugccg

SEQ ID NO: 833524 - RNA, 22 nt, Mycobacterium avium subsp. paratuberculosis
cggugucccaguucccggcggg

SEQ ID NO: 833525 - RNA, 17 nt, Mycobacterium avium subsp. paratuberculosis
cggugucccgcgcccgc

SEQ ID NO: 833526 - RNA, 19 nt, Mycobacterium avium subsp. paratuberculosis
cggugucccgcgcccgcga

SEQ ID NO: 833527 - RNA, 16 nt, Mycobacterium avium subsp. paratuberculosis
cgguguccgcggcguc

SEQ ID NO: 833528 - RNA, 17 nt, Mycobacterium avium subsp. paratuberculosis
cgguguccagccgcacg

SEQ ID NO: 833529 - RNA, 20 nt, Mycobacterium avium subsp. paratuberculosis
cgguguccagccgcacgaac

SEQ ID NO: 833530 - RNA, 22 nt, Mycobacterium avium subsp. paratuberculosis
cggugguuuugcggcccugcag

SEQ ID NO: 833531 - RNA, 21 nt, Mycobacterium avium subsp. paratuberculosis
cggugguguugcgguggucgg

SEQ ID NO: 833532 - RNA, 14 nt, Mycobacterium avium subsp. paratuberculosis
cggugguucgcgcg

SEQ ID NO: 833533 - RNA, 13 nt, Mycobacterium avium subsp. paratuberculosis
cgguguacagcgc

SEQ ID NO: 833534 - RNA, 18 nt, Mycobacterium avium subsp. paratuberculosis
cgguguacagcgccaugu

SEQ ID NO: 833535 - RNA, 14 nt, Mycobacterium avium subsp. paratuberculosis
cgguguacagcgcg

SEQ ID NO: 833536 - RNA, 15 nt, Mycobacterium avium subsp. paratuberculosis
cgguguacagcgcgc

SEQ ID NO: 833537 - RNA, 18 nt, Mycobacterium avium subsp. paratuberculosis
cgguguacagcgcgccgc

SEQ ID NO: 833538 - RNA, 20 nt, Mycobacterium avium subsp. paratuberculosis
cgguguacagcgcgccgcgg

SEQ ID NO: 833539 - RNA, 19 nt, Mycobacterium avium subsp. paratuberculosis
cgguggugucgucgggccg

SEQ ID NO: 833540 - RNA, 22 nt, Mycobacterium avium subsp. paratuberculosis
cgguggugucgucgggccgcag

SEQ ID NO: 833541 - RNA, 12 nt, Mycobacterium avium subsp. paratuberculosis
cgguggugucga

SEQ ID NO: 833542 - RNA, 21 nt, Mycobacterium avium subsp. paratuberculosis
cggugguguggaucuccagca

SEQ ID NO: 833543 - RNA, 22 nt, Mycobacterium avium subsp. paratuberculosis
cggugguguggaucuccagcag

SEQ ID NO: 833544 - RNA, 16 nt, Mycobacterium avium subsp. paratuberculosis
cggugguggccaucgc

SEQ ID NO: 833545 - RNA, 21 nt, Mycobacterium avium subsp. paratuberculosis
cggugguggccaucgcggccc

SEQ ID NO: 833546 - RNA, 17 nt, Mycobacterium avium subsp. paratuberculosis
cggugguggccuugacg

SEQ ID NO: 833547 - RNA, 13 nt, Mycobacterium avium subsp. paratuberculosis
cggugguggcgaa

SEQ ID NO: 833548 - RNA, 15 nt, Mycobacterium avium subsp. paratuberculosis
cggugguggcgaaca

SEQ ID NO: 833549 - RNA, 22 nt, Mycobacterium avium subsp. paratuberculosis
cggugguggcgaacagcggguu

SEQ ID NO: 833550 - RNA, 15 nt, Mycobacterium avium subsp. paratuberculosis
cgguggugggaucca

SEQ ID NO: 833551 - RNA, 17 nt, Mycobacterium avium subsp. paratuberculosis
cgguggugggcgcggug

SEQ ID NO: 833552 - RNA, 19 nt, Mycobacterium avium subsp. paratuberculosis
cggugguggggccggcgaa

SEQ ID NO: 833553 - RNA, 24 nt, Mycobacterium avium subsp. paratuberculosis
cgguggugguggucucgaugcacg

SEQ ID NO: 833554 - RNA, 15 nt, Mycobacterium avium subsp. paratuberculosis
cgguggucagcggcg

SEQ ID NO: 833555 - RNA, 17 nt, Mycobacterium avium subsp. paratuberculosis
cgguggucagcggcgcc

SEQ ID NO: 833556 - RNA, 19 nt, Mycobacterium avium subsp. paratuberculosis
cgguggggugaggcacccg

SEQ ID NO: 833557 - RNA, 22 nt, Mycobacterium avium subsp. paratuberculosis
cgguggggugaggcacccgcug

SEQ ID NO: 833558 - RNA, 22 nt, Mycobacterium avium subsp. paratuberculosis
cgguggggugaugaggucgcga

SEQ ID NO: 833559 - RNA, 13 nt, Mycobacterium avium subsp. paratuberculosis
cggugggcggcgc

SEQ ID NO: 833560 - RNA, 14 nt, Mycobacterium avium subsp. paratuberculosis
cggugggcggcgcc

SEQ ID NO: 833561 - RNA, 15 nt, Mycobacterium avium subsp. paratuberculosis
cggugggcggcgccc

SEQ ID NO: 833562 - RNA, 17 nt, Mycobacterium avium subsp. paratuberculosis
cggugggcggcgcccga

SEQ ID NO: 833563 - RNA, 18 nt, Mycobacterium avium subsp. paratuberculosis
cggugggcggcgcccgac

SEQ ID NO: 833564 - RNA, 14 nt, Mycobacterium avium subsp. paratuberculosis
cggugggcggcggg

SEQ ID NO: 833565 - RNA, 23 nt, Mycobacterium avium subsp. paratuberculosis
cggugggcggcgggagcuaggcg

SEQ ID NO: 833566 - RNA, 17 nt, Mycobacterium avium subsp. paratuberculosis
cggugggcucggccauc

SEQ ID NO: 833567 - RNA, 14 nt, Mycobacterium avium subsp. paratuberculosis
cggugggcucggcg

SEQ ID NO: 833568 - RNA, 18 nt, Mycobacterium avium subsp. paratuberculosis
cggugggcucggcgccga

SEQ ID NO: 833569 - RNA, 20 nt, Mycobacterium avium subsp. paratuberculosis
cggugggcucggcgccgacc

SEQ ID NO: 833570 - RNA, 15 nt, Mycobacterium avium subsp. paratuberculosis
cggugggcucgucga

SEQ ID NO: 833571 - RNA, 16 nt, Mycobacterium avium subsp. paratuberculosis
cggugggcugggcgaa

SEQ ID NO: 833572 - RNA, 21 nt, Mycobacterium avium subsp. paratuberculosis
cgguggggacgugcacgcguu

SEQ ID NO: 833573 - RNA, 17 nt, Mycobacterium avium subsp. paratuberculosis
cgguggggccgaagccg

SEQ ID NO: 833574 - RNA, 19 nt, Mycobacterium avium subsp. paratuberculosis
cgguggggccgaagccgac

SEQ ID NO: 833575 - RNA, 14 nt, Mycobacterium avium subsp. paratuberculosis
cgguggggccgccg

SEQ ID NO: 833576 - RNA, 16 nt, Mycobacterium avium subsp. paratuberculosis
cgguggggcuggccgc

SEQ ID NO: 833577 - RNA, 20 nt, Mycobacterium avium subsp. paratuberculosis
cgguggggcuggccgcacgg

SEQ ID NO: 833578 - RNA, 17 nt, Mycobacterium avium subsp. paratuberculosis
cggugggggccaggcgg

SEQ ID NO: 833579 - RNA, 15 nt, Mycobacterium avium subsp. paratuberculosis
cguacaaggugaugg

SEQ ID NO: 833580 - RNA, 21 nt, Mycobacterium avium subsp. paratuberculosis
cguacaaggugauggcccgcu

SEQ ID NO: 833581 - RNA, 20 nt, Mycobacterium avium subsp. paratuberculosis
cguacaccagggugccgccg

SEQ ID NO: 833582 - RNA, 16 nt, Mycobacterium avium subsp. paratuberculosis
cguacaggucgcacag

SEQ ID NO: 833583 - RNA, 13 nt, Mycobacterium avium subsp. paratuberculosis
cguacaggccguc

SEQ ID NO: 833584 - RNA, 15 nt, Mycobacterium avium subsp. paratuberculosis
cguacaggccgucgg

SEQ ID NO: 833585 - RNA, 16 nt, Mycobacterium avium subsp. paratuberculosis
cguacaggccgucggg

SEQ ID NO: 833586 - RNA, 13 nt, Mycobacterium avium subsp. paratuberculosis
cguacagcggcgg

SEQ ID NO: 833587 - RNA, 20 nt, Mycobacterium avium subsp. paratuberculosis
cguacagcgggucguuggcg

SEQ ID NO: 833588 - RNA, 23 nt, Mycobacterium avium subsp. paratuberculosis
cguacagcgggucguuggcggcg

SEQ ID NO: 833589 - RNA, 15 nt, Mycobacterium avium subsp. paratuberculosis
cguacagcgcccgga

SEQ ID NO: 833590 - RNA, 23 nt, Mycobacterium avium subsp. paratuberculosis
cguacagcagccccugcaccacg

SEQ ID NO: 833591 - RNA, 12 nt, Mycobacterium avium subsp. paratuberculosis
cguacagcagcu

SEQ ID NO: 833592 - RNA, 15 nt, Mycobacterium avium subsp. paratuberculosis
cguacagccagcccg

SEQ ID NO: 833593 - RNA, 16 nt, Mycobacterium avium subsp. paratuberculosis
cguacaccggcugacc

SEQ ID NO: 833594 - RNA, 20 nt, Mycobacterium avium subsp. paratuberculosis
cguacaccggcugaccggcg

SEQ ID NO: 833595 - RNA, 19 nt, Mycobacterium avium subsp. paratuberculosis
cguacaccgggaucggggu

SEQ ID NO: 833596 - RNA, 20 nt, Mycobacterium avium subsp. paratuberculosis
cguacaccgggaucggggug

SEQ ID NO: 833597 - RNA, 21 nt, Mycobacterium avium subsp. paratuberculosis
cguacaccgugcccgagccga

SEQ ID NO: 833598 - RNA, 18 nt, Mycobacterium avium subsp. paratuberculosis
cguacacggcccgcggca

SEQ ID NO: 833599 - RNA, 15 nt, Mycobacterium avium subsp. paratuberculosis
cguacacggcggcga

SEQ ID NO: 833600 - RNA, 21 nt, Mycobacterium avium subsp. paratuberculosis
cgguuuuccgucuucgaccgc

SEQ ID NO: 833601 - RNA, 17 nt, Mycobacterium avium subsp. paratuberculosis
cgguuuuucccagcggc

SEQ ID NO: 833602 - RNA, 18 nt, Mycobacterium avium subsp. paratuberculosis
cgguuuugaugccgccgg

SEQ ID NO: 833603 - RNA, 17 nt, Mycobacterium avium subsp. paratuberculosis
cgguugacguccgcggg

SEQ ID NO: 833604 - RNA, 18 nt, Mycobacterium avium subsp. paratuberculosis
cgguugacguccgcggga

SEQ ID NO: 833605 - RNA, 15 nt, Mycobacterium avium subsp. paratuberculosis
cgguugaccgccgac

SEQ ID NO: 833606 - RNA, 14 nt, Mycobacterium avium subsp. paratuberculosis
cgguugacgcucug

SEQ ID NO: 833607 - RNA, 17 nt, Mycobacterium avium subsp. paratuberculosis
cgguuucgaccugcggg

SEQ ID NO: 833608 - RNA, 18 nt, Mycobacterium avium subsp. paratuberculosis
cgguuuccaguccggcgc

SEQ ID NO: 833609 - RNA, 19 nt, Mycobacterium avium subsp. paratuberculosis
cgguuuccaguccggcgcc

SEQ ID NO: 833610 - RNA, 22 nt, Mycobacterium avium subsp. paratuberculosis
cgguuuccaguccggcgcccgg

SEQ ID NO: 833611 - RNA, 18 nt, Mycobacterium avium subsp. paratuberculosis
cgguuucauucaccgcgg

SEQ ID NO: 833612 - RNA, 17 nt, Mycobacterium avium subsp. paratuberculosis
cgguuugaccacggcgc

SEQ ID NO: 833613 - RNA, 19 nt, Mycobacterium avium subsp. paratuberculosis
cgguuugaccacggcgcgg

SEQ ID NO: 833614 - RNA, 17 nt, Mycobacterium avium subsp. paratuberculosis
cgguuucugccggccgc

SEQ ID NO: 833615 - RNA, 19 nt, Mycobacterium avium subsp. paratuberculosis
cgguuucugccggccgccg

SEQ ID NO: 833616 - RNA, 18 nt, Mycobacterium avium subsp. paratuberculosis
cgguuucggucgcgguga

SEQ ID NO: 833617 - RNA, 21 nt, Mycobacterium avium subsp. paratuberculosis
cgguucgauaccguccgcgcc

SEQ ID NO: 833618 - RNA, 15 nt, Mycobacterium avium subsp. paratuberculosis
cgguucgcuggcggc

SEQ ID NO: 833619 - RNA, 18 nt, Mycobacterium avium subsp. paratuberculosis
cgguucgcuggcggccag

SEQ ID NO: 833620 - RNA, 19 nt, Mycobacterium avium subsp. paratuberculosis
cgguucgcuggcggccagc

SEQ ID NO: 833621 - RNA, 15 nt, Mycobacterium avium subsp. paratuberculosis
cgguucggacacggc

SEQ ID NO: 833622 - RNA, 20 nt, Mycobacterium avium subsp. paratuberculosis
cgguucggacacggcgccgu

SEQ ID NO: 833623 - RNA, 15 nt, Mycobacterium avium subsp. paratuberculosis
cgguucggcggcaua

SEQ ID NO: 833624 - RNA, 16 nt, Mycobacterium avium subsp. paratuberculosis
cgguucggcggcauag

SEQ ID NO: 833625 - RNA, 16 nt, Mycobacterium avium subsp. paratuberculosis
cgguucggccgcucgg

SEQ ID NO: 833626 - RNA, 12 nt, Mycobacterium avium subsp. paratuberculosis
cgguucggcgac

SEQ ID NO: 833627 - RNA, 21 nt, Mycobacterium avium subsp. paratuberculosis
cgguucgaagcgcagcgucuc

SEQ ID NO: 833628 - RNA, 18 nt, Mycobacterium avium subsp. paratuberculosis
cgguugaccccggccccg

SEQ ID NO: 833629 - RNA, 20 nt, Mycobacterium avium subsp. paratuberculosis
cgguucgucgcggcggcccg

SEQ ID NO: 833630 - RNA, 16 nt, Mycobacterium avium subsp. paratuberculosis
cgguucggcgucgguc

SEQ ID NO: 833631 - RNA, 14 nt, Mycobacterium avium subsp. paratuberculosis
cgguucugcagcga

SEQ ID NO: 833632 - RNA, 12 nt, Mycobacterium avium subsp. paratuberculosis
cgguggccagca

SEQ ID NO: 833633 - RNA, 14 nt, Mycobacterium avium subsp. paratuberculosis
cgguggccaccgcg

SEQ ID NO: 833634 - RNA, 19 nt, Mycobacterium avium subsp. paratuberculosis
cgguggccaccgcgacgcc

SEQ ID NO: 833635 - RNA, 20 nt, Mycobacterium avium subsp. paratuberculosis
cgguggccaccgcgacgccc

SEQ ID NO: 833636 - RNA, 22 nt, Mycobacterium avium subsp. paratuberculosis
cgguggccaccuuggacaggcc

SEQ ID NO: 833637 - RNA, 18 nt, Mycobacterium avium subsp. paratuberculosis
cgguggccacggcguuga

SEQ ID NO: 833638 - RNA, 14 nt, Mycobacterium avium subsp. paratuberculosis
cgguggcccagccg

SEQ ID NO: 833639 - RNA, 20 nt, Mycobacterium avium subsp. paratuberculosis
cgguggcccagccggccgac

SEQ ID NO: 833640 - RNA, 21 nt, Mycobacterium avium subsp. paratuberculosis
cgguggcccagccggccgacg

SEQ ID NO: 833641 - RNA, 15 nt, Mycobacterium avium subsp. paratuberculosis
cgguggcccccacca

SEQ ID NO: 833642 - RNA, 16 nt, Mycobacterium avium subsp. paratuberculosis
cgguggcccccaccac

SEQ ID NO: 833643 - RNA, 23 nt, Mycobacterium avium subsp. paratuberculosis
cgguggcccccaccacgaagcug

SEQ ID NO: 833644 - RNA, 16 nt, Mycobacterium avium subsp. paratuberculosis
cgguggccccgggccg

SEQ ID NO: 833645 - RNA, 17 nt, Mycobacterium avium subsp. paratuberculosis
cgguggccccgggccgc

SEQ ID NO: 833646 - RNA, 19 nt, Mycobacterium avium subsp. paratuberculosis
cgguggccccgggccgcag

SEQ ID NO: 833647 - RNA, 22 nt, Mycobacterium avium subsp. paratuberculosis
cgguggccccgggccgcagggu

SEQ ID NO: 833648 - RNA, 22 nt, Mycobacterium avium subsp. paratuberculosis
cgguggcccgguacagcgccgc

SEQ ID NO: 833649 - RNA, 15 nt, Mycobacterium avium subsp. paratuberculosis
cgguggcccggucgu

SEQ ID NO: 833650 - RNA, 18 nt, Mycobacterium avium subsp. paratuberculosis
cgguggcccggucgucga

SEQ ID NO: 833651 - RNA, 19 nt, Mycobacterium avium subsp. paratuberculosis
cgguggcccggucgucgag

SEQ ID NO: 833652 - RNA, 21 nt, Mycobacterium avium subsp. paratuberculosis
cgguggcccggucgucgagca

SEQ ID NO: 833653 - RNA, 21 nt, Mycobacterium avium subsp. paratuberculosis
cgguggccgaaccgcucgucg

SEQ ID NO: 833654 - RNA, 18 nt, Mycobacterium avium subsp. paratuberculosis
cgguggcaccccgcgccg

SEQ ID NO: 833655 - RNA, 19 nt, Mycobacterium avium subsp. paratuberculosis
cgguggcaccccgcgccgg

SEQ ID NO: 833656 - RNA, 21 nt, Mycobacterium avium subsp. paratuberculosis
cgguggcaccccgcgccgggc

SEQ ID NO: 833657 - RNA, 21 nt, Mycobacterium avium subsp. paratuberculosis
cggugcuuaccggccggccgc

SEQ ID NO: 833658 - RNA, 15 nt, Mycobacterium avium subsp. paratuberculosis
cgguggaugggcucg

SEQ ID NO: 833659 - RNA, 12 nt, Mycobacterium avium subsp. paratuberculosis
cgguggccacca

SEQ ID NO: 833660 - RNA, 16 nt, Mycobacterium avium subsp. paratuberculosis
cgguggcagcccggcu

SEQ ID NO: 833661 - RNA, 17 nt, Mycobacterium avium subsp. paratuberculosis
cgguggacuccagcacc

SEQ ID NO: 833662 - RNA, 19 nt, Mycobacterium avium subsp. paratuberculosis
cgguggacuccagcaccag

SEQ ID NO: 833663 - RNA, 20 nt, Mycobacterium avium subsp. paratuberculosis
cgguggacuccagcaccagc

SEQ ID NO: 833664 - RNA, 19 nt, Mycobacterium avium subsp. paratuberculosis
cgguggagauggccagcac

SEQ ID NO: 833665 - RNA, 17 nt, Mycobacterium avium subsp. paratuberculosis
cgguggagcacagcacg

SEQ ID NO: 833666 - RNA, 23 nt, Mycobacterium avium subsp. paratuberculosis
cgguggagcacagcacggcaucg

SEQ ID NO: 833667 - RNA, 12 nt, Mycobacterium avium subsp. paratuberculosis
cgguggacccga

SEQ ID NO: 833668 - RNA, 15 nt, Mycobacterium avium subsp. paratuberculosis
cgguggacgccgcgc

SEQ ID NO: 833669 - RNA, 18 nt, Mycobacterium avium subsp. paratuberculosis
cgguggacgccgcgcacg

SEQ ID NO: 833670 - RNA, 19 nt, Mycobacterium avium subsp. paratuberculosis
cgguggacgccgcgcacga

SEQ ID NO: 833671 - RNA, 15 nt, Mycobacterium avium subsp. paratuberculosis
cgguggacgcggucg

SEQ ID NO: 833672 - RNA, 18 nt, Mycobacterium avium subsp. paratuberculosis
cgguggacgcggucgccg

SEQ ID NO: 833673 - RNA, 19 nt, Mycobacterium avium subsp. paratuberculosis
cgguggacgcggucgccgc

SEQ ID NO: 833674 - RNA, 22 nt, Mycobacterium avium subsp. paratuberculosis
cgguggacgcggucgccgccca

SEQ ID NO: 833675 - RNA, 17 nt, Mycobacterium avium subsp. paratuberculosis
cgguggagcggcccagc

SEQ ID NO: 833676 - RNA, 21 nt, Mycobacterium avium subsp. paratuberculosis
cgguggagcggcccagcucgg

SEQ ID NO: 833677 - RNA, 19 nt, Mycobacterium avium subsp. paratuberculosis
cgguggauauuucgcggcc

SEQ ID NO: 833678 - RNA, 15 nt, Mycobacterium avium subsp. paratuberculosis
cgguggauccgguga

SEQ ID NO: 833679 - RNA, 22 nt, Mycobacterium avium subsp. paratuberculosis
cggugcuggucaugccgucgac

SEQ ID NO: 833680 - RNA, 23 nt, Mycobacterium avium subsp. paratuberculosis
cggugcuggucaugccgucgacg

SEQ ID NO: 833681 - RNA, 20 nt, Mycobacterium avium subsp. paratuberculosis
cgguggaacaguucggugcg

SEQ ID NO: 833682 - RNA, 21 nt, Mycobacterium avium subsp. paratuberculosis
cgguggaacaguucggugcgg

SEQ ID NO: 833683 - RNA, 17 nt, Mycobacterium avium subsp. paratuberculosis
cgguggaacccagcacc

SEQ ID NO: 833684 - RNA, 17 nt, Mycobacterium avium subsp. paratuberculosis
cgguggaauucuggccg

SEQ ID NO: 833685 - RNA, 18 nt, Mycobacterium avium subsp. paratuberculosis
cgguggaauucuggccga

SEQ ID NO: 833686 - RNA, 21 nt, Mycobacterium avium subsp. paratuberculosis
cgguggacagcgcgacgggca

SEQ ID NO: 833687 - RNA, 16 nt, Mycobacterium avium subsp. paratuberculosis
cggugggcgcgggccg

SEQ ID NO: 833688 - RNA, 17 nt, Mycobacterium avium subsp. paratuberculosis
cggugggcgcgggccgc

SEQ ID NO: 833689 - RNA, 18 nt, Mycobacterium avium subsp. paratuberculosis
cggugggcagcucgucgg

SEQ ID NO: 833690 - RNA, 12 nt, Mycobacterium avium subsp. paratuberculosis
cggugggcccgc

SEQ ID NO: 833691 - RNA, 16 nt, Mycobacterium avium subsp. paratuberculosis
cggugggcccgccguc

SEQ ID NO: 833692 - RNA, 22 nt, Mycobacterium avium subsp. paratuberculosis
cggugggccgcaccuggcagca

SEQ ID NO: 833693 - RNA, 23 nt, Mycobacterium avium subsp. paratuberculosis
cggugggauagauguugcggccg

SEQ ID NO: 833694 - RNA, 17 nt, Mycobacterium avium subsp. paratuberculosis
cggugggcaccagcagc

SEQ ID NO: 833695 - RNA, 18 nt, Mycobacterium avium subsp. paratuberculosis
cggugggcaccagcagcg

SEQ ID NO: 833696 - RNA, 17 nt, Mycobacterium avium subsp. paratuberculosis
cgguggcguugcgggcg

SEQ ID NO: 833697 - RNA, 16 nt, Mycobacterium avium subsp. paratuberculosis
cggugggacggcgggu

SEQ ID NO: 833698 - RNA, 22 nt, Mycobacterium avium subsp. paratuberculosis
cgguggcguagcggugaaacgc

SEQ ID NO: 833699 - RNA, 14 nt, Mycobacterium avium subsp. paratuberculosis
cgguggcguccagc

SEQ ID NO: 833700 - RNA, 19 nt, Mycobacterium avium subsp. paratuberculosis
cgguggcguccucgacggu

SEQ ID NO: 833701 - RNA, 18 nt, Mycobacterium avium subsp. paratuberculosis
cgguggcgucggcggccu

SEQ ID NO: 833702 - RNA, 20 nt, Mycobacterium avium subsp. paratuberculosis
cgguggcggccaggccggcg

SEQ ID NO: 833703 - RNA, 22 nt, Mycobacterium avium subsp. paratuberculosis
cgguggcggccaggccggcgac

SEQ ID NO: 833704 - RNA, 24 nt, Mycobacterium avium subsp. paratuberculosis
cgguggcgugcagcgcggcgauga

SEQ ID NO: 833705 - RNA, 14 nt, Mycobacterium avium subsp. paratuberculosis
cgguggcgggccgc

SEQ ID NO: 833706 - RNA, 15 nt, Mycobacterium avium subsp. paratuberculosis
cgguggcgggccgcc

SEQ ID NO: 833707 - RNA, 17 nt, Mycobacterium avium subsp. paratuberculosis
cgguggcgggccgccgg

SEQ ID NO: 833708 - RNA, 15 nt, Mycobacterium avium subsp. paratuberculosis
cgguggcggugccgc

SEQ ID NO: 833709 - RNA, 15 nt, Mycobacterium avium subsp. paratuberculosis
cgguggcggugcggu

SEQ ID NO: 833710 - RNA, 20 nt, Mycobacterium avium subsp. paratuberculosis
cgguggcggugcggucgcgc

SEQ ID NO: 833711 - RNA, 16 nt, Mycobacterium avium subsp. paratuberculosis
cgguggcgguggccac

SEQ ID NO: 833712 - RNA, 18 nt, Mycobacterium avium subsp. paratuberculosis
cgguggcgguggggccga

SEQ ID NO: 833713 - RNA, 13 nt, Mycobacterium avium subsp. paratuberculosis
cgguggcggcgaa

SEQ ID NO: 833714 - RNA, 15 nt, Mycobacterium avium subsp. paratuberculosis
cgguggcggcgaacg

SEQ ID NO: 833715 - RNA, 17 nt, Mycobacterium avium subsp. paratuberculosis
cgguggcggcgaacgcg

SEQ ID NO: 833716 - RNA, 19 nt, Mycobacterium avium subsp. paratuberculosis
cgguggcggcgaacgcgcg

SEQ ID NO: 833717 - RNA, 20 nt, Mycobacterium avium subsp. paratuberculosis
cgguggcggcgaacgcgcgg

SEQ ID NO: 833718 - RNA, 15 nt, Mycobacterium avium subsp. paratuberculosis
cgguggcggcgaugu

SEQ ID NO: 833719 - RNA, 21 nt, Mycobacterium avium subsp. paratuberculosis
cgguggcggcgaugucgucga

SEQ ID NO: 833720 - RNA, 17 nt, Mycobacterium avium subsp. paratuberculosis
cgguggcgccgcgcagc

SEQ ID NO: 833721 - RNA, 14 nt, Mycobacterium avium subsp. paratuberculosis
cgguggcgccgcgg

SEQ ID NO: 833722 - RNA, 18 nt, Mycobacterium avium subsp. paratuberculosis
cgguggcgccgcgggcgg

SEQ ID NO: 833723 - RNA, 22 nt, Mycobacterium avium subsp. paratuberculosis
cgguggcgaacugcaccagcac

SEQ ID NO: 833724 - RNA, 13 nt, Mycobacterium avium subsp. paratuberculosis
cgguggcgaagca

SEQ ID NO: 833725 - RNA, 20 nt, Mycobacterium avium subsp. paratuberculosis
cgguggcgcccagcgagcug

SEQ ID NO: 833726 - RNA, 21 nt, Mycobacterium avium subsp. paratuberculosis
cgguggcgcccagcgagcugc

SEQ ID NO: 833727 - RNA, 21 nt, Mycobacterium avium subsp. paratuberculosis
cgguggcgaugaucaccucgg

SEQ ID NO: 833728 - RNA, 16 nt, Mycobacterium avium subsp. paratuberculosis
cgguggcgauggugcu

SEQ ID NO: 833729 - RNA, 19 nt, Mycobacterium avium subsp. paratuberculosis
cgguggcgauggugcugcc

SEQ ID NO: 833730 - RNA, 17 nt, Mycobacterium avium subsp. paratuberculosis
cgguggcgccggggcgg

SEQ ID NO: 833731 - RNA, 22 nt, Mycobacterium avium subsp. paratuberculosis
cgguggcgcgaaucccggccuc

SEQ ID NO: 833732 - RNA, 14 nt, Mycobacterium avium subsp. paratuberculosis
cgguggcgcgcagu

SEQ ID NO: 833733 - RNA, 17 nt, Mycobacterium avium subsp. paratuberculosis
cgguggcgcgcagucgc

SEQ ID NO: 833734 - RNA, 13 nt, Mycobacterium avium subsp. paratuberculosis
cgguggcgcgggu

SEQ ID NO: 833735 - RNA, 14 nt, Mycobacterium avium subsp. paratuberculosis
cgguggccgccacc

SEQ ID NO: 833736 - RNA, 13 nt, Mycobacterium avium subsp. paratuberculosis
cgguggcggccac

SEQ ID NO: 833737 - RNA, 14 nt, Mycobacterium avium subsp. paratuberculosis
cgguggcggccacg

SEQ ID NO: 833738 - RNA, 14 nt, Mycobacterium avium subsp. paratuberculosis
cgguggcgacaaca

SEQ ID NO: 833739 - RNA, 18 nt, Mycobacterium avium subsp. paratuberculosis
cgguggcgacaacaggcg

SEQ ID NO: 833740 - RNA, 19 nt, Mycobacterium avium subsp. paratuberculosis
cgguggccucggcgcugcc

SEQ ID NO: 833741 - RNA, 22 nt, Mycobacterium avium subsp. paratuberculosis
cgguggccucggcgcugcccgc

SEQ ID NO: 833742 - RNA, 18 nt, Mycobacterium avium subsp. paratuberculosis
cgguggccugcccggcgg

SEQ ID NO: 833743 - RNA, 23 nt, Mycobacterium avium subsp. paratuberculosis
cgguggccugcccggcggugccg

SEQ ID NO: 833744 - RNA, 15 nt, Mycobacterium avium subsp. paratuberculosis
cgguggccuggucgg

SEQ ID NO: 833745 - RNA, 20 nt, Mycobacterium avium subsp. paratuberculosis
cgguggccuggucggcgacc

SEQ ID NO: 833746 - RNA, 18 nt, Mycobacterium avium subsp. paratuberculosis
cgguggccuuggccacca

SEQ ID NO: 833747 - RNA, 18 nt, Mycobacterium avium subsp. paratuberculosis
cgguggccguaaccgccg

SEQ ID NO: 833748 - RNA, 15 nt, Mycobacterium avium subsp. paratuberculosis
cgguggccgcgaacg

SEQ ID NO: 833749 - RNA, 12 nt, Mycobacterium avium subsp. paratuberculosis
cgguggccgcgc

SEQ ID NO: 833750 - RNA, 18 nt, Mycobacterium avium subsp. paratuberculosis
cgguggccgcgucgacca

SEQ ID NO: 833751 - RNA, 12 nt, Mycobacterium avium subsp. paratuberculosis
cgguggccgccg

SEQ ID NO: 833752 - RNA, 12 nt, Mycobacterium avium subsp. paratuberculosis
cgguggccgauc

SEQ ID NO: 833753 - RNA, 20 nt, Mycobacterium avium subsp. paratuberculosis
cggugcucccccggaccugc

SEQ ID NO: 833754 - RNA, 15 nt, Mycobacterium avium subsp. paratuberculosis
cggugcucaucagcg

SEQ ID NO: 833755 - RNA, 20 nt, Mycobacterium avium subsp. paratuberculosis
cggugcucaucagcgacacc

SEQ ID NO: 833756 - RNA, 14 nt, Mycobacterium avium subsp. paratuberculosis
cggugcucgcgccg

SEQ ID NO: 833757 - RNA, 19 nt, Mycobacterium avium subsp. paratuberculosis
cggugcucgcgccgggcgg

SEQ ID NO: 833758 - RNA, 21 nt, Mycobacterium avium subsp. paratuberculosis
cggugcucgcgccgggcggcc

SEQ ID NO: 833759 - RNA, 18 nt, Mycobacterium avium subsp. paratuberculosis
cggugcguuuucggucgu

SEQ ID NO: 833760 - RNA, 16 nt, Mycobacterium avium subsp. paratuberculosis
cggugcgugaugacca

SEQ ID NO: 833761 - RNA, 16 nt, Mycobacterium avium subsp. paratuberculosis
cggugcgugccagcag

SEQ ID NO: 833762 - RNA, 14 nt, Mycobacterium avium subsp. paratuberculosis
cggugcguccgccg

SEQ ID NO: 833763 - RNA, 16 nt, Mycobacterium avium subsp. paratuberculosis
cggugcguccgccggc

SEQ ID NO: 833764 - RNA, 19 nt, Mycobacterium avium subsp. paratuberculosis
cggugcguccgccggcggu

SEQ ID NO: 833765 - RNA, 20 nt, Mycobacterium avium subsp. paratuberculosis
cggugcguccgccggcggug

SEQ ID NO: 833766 - RNA, 23 nt, Mycobacterium avium subsp. paratuberculosis
cggugcguccgccggcggugcgg

SEQ ID NO: 833767 - RNA, 17 nt, Mycobacterium avium subsp. paratuberculosis
cggugcgucgggcgccg

SEQ ID NO: 833768 - RNA, 21 nt, Mycobacterium avium subsp. paratuberculosis
cggugcgucgggcgccggcgc

SEQ ID NO: 833769 - RNA, 16 nt, Mycobacterium avium subsp. paratuberculosis
cggugcucgucgagca

SEQ ID NO: 833770 - RNA, 22 nt, Mycobacterium avium subsp. paratuberculosis
cggugcucgucgagcauccggc

SEQ ID NO: 833771 - RNA, 22 nt, Mycobacterium avium subsp. paratuberculosis
cggugcucucgucgucggcggg

SEQ ID NO: 833772 - RNA, 19 nt, Mycobacterium avium subsp. paratuberculosis
cggugcucuugacggccgc

SEQ ID NO: 833773 - RNA, 20 nt, Mycobacterium avium subsp. paratuberculosis
cggugcucuugacggccgcg

SEQ ID NO: 833774 - RNA, 23 nt, Mycobacterium avium subsp. paratuberculosis
cggugcucuugacggccgcggcg

SEQ ID NO: 833775 - RNA, 20 nt, Mycobacterium avium subsp. paratuberculosis
cggugcugacccggucgcgg

SEQ ID NO: 833776 - RNA, 22 nt, Mycobacterium avium subsp. paratuberculosis
cggugcugacccggucgcggcc

SEQ ID NO: 833777 - RNA, 12 nt, Mycobacterium avium subsp. paratuberculosis
cggugcugcaga

SEQ ID NO: 833778 - RNA, 18 nt, Mycobacterium avium subsp. paratuberculosis
cggugcugcagauccgcu

SEQ ID NO: 833779 - RNA, 20 nt, Mycobacterium avium subsp. paratuberculosis
cggugcugcagauccgcucg

SEQ ID NO: 833780 - RNA, 13 nt, Mycobacterium avium subsp. paratuberculosis
cggugcuggcgau

SEQ ID NO: 833781 - RNA, 15 nt, Mycobacterium avium subsp. paratuberculosis
cggugcuggcgaugu

SEQ ID NO: 833782 - RNA, 13 nt, Mycobacterium avium subsp. paratuberculosis
cggugcgggcugg

SEQ ID NO: 833783 - RNA, 15 nt, Mycobacterium avium subsp. paratuberculosis
cggugcggggccgcg

SEQ ID NO: 833784 - RNA, 16 nt, Mycobacterium avium subsp. paratuberculosis
cggugcggggccgcgg

SEQ ID NO: 833785 - RNA, 17 nt, Mycobacterium avium subsp. paratuberculosis
cggugcggggccgcggc

SEQ ID NO: 833786 - RNA, 19 nt, Mycobacterium avium subsp. paratuberculosis
cggugcggggccgcggccg

SEQ ID NO: 833787 - RNA, 21 nt, Mycobacterium avium subsp. paratuberculosis
cggugcggggccgcggccggc

SEQ ID NO: 833788 - RNA, 17 nt, Mycobacterium avium subsp. paratuberculosis
cggugcgggucacaccc

SEQ ID NO: 833789 - RNA, 21 nt, Mycobacterium avium subsp. paratuberculosis
cggugcgggucacacccucgg

SEQ ID NO: 833790 - RNA, 12 nt, Mycobacterium avium subsp. paratuberculosis
cggugcgggugc

SEQ ID NO: 833791 - RNA, 18 nt, Mycobacterium avium subsp. paratuberculosis
cggugcgguaggugccgg

SEQ ID NO: 833792 - RNA, 23 nt, Mycobacterium avium subsp. paratuberculosis
cggugcgguaggugccggccgcg

SEQ ID NO: 833793 - RNA, 19 nt, Mycobacterium avium subsp. paratuberculosis
cggugcggucgcgcagccg

SEQ ID NO: 833794 - RNA, 20 nt, Mycobacterium avium subsp. paratuberculosis
cggugcggucgcgcagccgg

SEQ ID NO: 833795 - RNA, 14 nt, Mycobacterium avium subsp. paratuberculosis
cggugcggucggcg

SEQ ID NO: 833796 - RNA, 23 nt, Mycobacterium avium subsp. paratuberculosis
cggugcgggugguguggcgucgg

SEQ ID NO: 833797 - RNA, 24 nt, Mycobacterium avium subsp. paratuberculosis
cggugcgggugguguggcgucggc

SEQ ID NO: 833798 - RNA, 16 nt, Mycobacterium avium subsp. paratuberculosis
cggugcggucggcguc

SEQ ID NO: 833799 - RNA, 18 nt, Mycobacterium avium subsp. paratuberculosis
cggugcggucggcgucgu

SEQ ID NO: 833800 - RNA, 15 nt, Mycobacterium avium subsp. paratuberculosis
cggugcggccucgac

SEQ ID NO: 833801 - RNA, 16 nt, Mycobacterium avium subsp. paratuberculosis
cggugcggccucgacg

SEQ ID NO: 833802 - RNA, 12 nt, Mycobacterium avium subsp. paratuberculosis
cggugcggccgc

SEQ ID NO: 833803 - RNA, 14 nt, Mycobacterium avium subsp. paratuberculosis
cggugcggccgcga

SEQ ID NO: 833804 - RNA, 20 nt, Mycobacterium avium subsp. paratuberculosis
cggugcggccgcgaucgcca

SEQ ID NO: 833805 - RNA, 14 nt, Mycobacterium avium subsp. paratuberculosis
cggugcggccgcgc

SEQ ID NO: 833806 - RNA, 17 nt, Mycobacterium avium subsp. paratuberculosis
cggugcggccgcgcagc

SEQ ID NO: 833807 - RNA, 13 nt, Mycobacterium avium subsp. paratuberculosis
cggugcggcgggc

SEQ ID NO: 833808 - RNA, 17 nt, Mycobacterium avium subsp. paratuberculosis
cggugcggcgggcucgg

SEQ ID NO: 833809 - RNA, 22 nt, Mycobacterium avium subsp. paratuberculosis
cggugcggcgggcucggacgac

SEQ ID NO: 833810 - RNA, 23 nt, Mycobacterium avium subsp. paratuberculosis
cggugcggcgggcucggacgacu

SEQ ID NO: 833811 - RNA, 15 nt, Mycobacterium avium subsp. paratuberculosis
cggugcggcucgggc

SEQ ID NO: 833812 - RNA, 18 nt, Mycobacterium avium subsp. paratuberculosis
cggugcggcucgggcggu

SEQ ID NO: 833813 - RNA, 20 nt, Mycobacterium avium subsp. paratuberculosis
cggugcggcuuugcugccaa

SEQ ID NO: 833814 - RNA, 18 nt, Mycobacterium avium subsp. paratuberculosis
cggugcggaaggcccccg

SEQ ID NO: 833815 - RNA, 14 nt, Mycobacterium avium subsp. paratuberculosis
cggugcggacccgu

SEQ ID NO: 833816 - RNA, 17 nt, Mycobacterium avium subsp. paratuberculosis
cggugcggacccguugg

SEQ ID NO: 833817 - RNA, 12 nt, Mycobacterium avium subsp. paratuberculosis
cggugcggcccg

SEQ ID NO: 833818 - RNA, 15 nt, Mycobacterium avium subsp. paratuberculosis
cggugcggcccgcgg

SEQ ID NO: 833819 - RNA, 22 nt, Mycobacterium avium subsp. paratuberculosis
cggugcggcccgcggcaucguc

SEQ ID NO: 833820 - RNA, 22 nt, Mycobacterium avium subsp. paratuberculosis
cggugcgcccgcgaucaacacc

SEQ ID NO: 833821 - RNA, 20 nt, Mycobacterium avium subsp. paratuberculosis
cggugcgcccgucgucgccg

SEQ ID NO: 833822 - RNA, 18 nt, Mycobacterium avium subsp. paratuberculosis
cggugcgccgacagcuga

SEQ ID NO: 833823 - RNA, 21 nt, Mycobacterium avium subsp. paratuberculosis
cggugcgccgacagcugagca

SEQ ID NO: 833824 - RNA, 15 nt, Mycobacterium avium subsp. paratuberculosis
cggugcgccgaccgc

SEQ ID NO: 833825 - RNA, 16 nt, Mycobacterium avium subsp. paratuberculosis
cggugcgccgaccgcg

SEQ ID NO: 833826 - RNA, 21 nt, Mycobacterium avium subsp. paratuberculosis
cggugcgcagucgcuggucga

SEQ ID NO: 833827 - RNA, 13 nt, Mycobacterium avium subsp. paratuberculosis
cggugcgccacgc

SEQ ID NO: 833828 - RNA, 17 nt, Mycobacterium avium subsp. paratuberculosis
cggugcgccacgcccgc

SEQ ID NO: 833829 - RNA, 20 nt, Mycobacterium avium subsp. paratuberculosis
cggugcgccacgcccgcagc

SEQ ID NO: 833830 - RNA, 19 nt, Mycobacterium avium subsp. paratuberculosis
cggugcgccagaucagcgu

SEQ ID NO: 833831 - RNA, 17 nt, Mycobacterium avium subsp. paratuberculosis
cggugcgccagcgccgg

SEQ ID NO: 833832 - RNA, 14 nt, Mycobacterium avium subsp. paratuberculosis
cggugcgacgccgc

SEQ ID NO: 833833 - RNA, 12 nt, Mycobacterium avium subsp. paratuberculosis
cggugcgcagca

SEQ ID NO: 833834 - RNA, 14 nt, Mycobacterium avium subsp. paratuberculosis
cggugcgcagcacg

SEQ ID NO: 833835 - RNA, 21 nt, Mycobacterium avium subsp. paratuberculosis
cggugcgcagccgcugcagcg

SEQ ID NO: 833836 - RNA, 24 nt, Mycobacterium avium subsp. paratuberculosis
cggugcgcagccgcugcagcgccg

SEQ ID NO: 833837 - RNA, 14 nt, Mycobacterium avium subsp. paratuberculosis
cggugcgcaccccg

SEQ ID NO: 833838 - RNA, 23 nt, Mycobacterium avium subsp. paratuberculosis
cggugcgcaccccguugccgccg

SEQ ID NO: 833839 - RNA, 12 nt, Mycobacterium avium subsp. paratuberculosis
cggugcgcaccg

SEQ ID NO: 833840 - RNA, 13 nt, Mycobacterium avium subsp. paratuberculosis
cggugcgcaccga

SEQ ID NO: 833841 - RNA, 16 nt, Mycobacterium avium subsp. paratuberculosis
cggugcgcaccgacau

SEQ ID NO: 833842 - RNA, 18 nt, Mycobacterium avium subsp. paratuberculosis
cggugcgcaccgacauca

SEQ ID NO: 833843 - RNA, 23 nt, Mycobacterium avium subsp. paratuberculosis
cggugcgaugguggucgccgucg

SEQ ID NO: 833844 - RNA, 13 nt, Mycobacterium avium subsp. paratuberculosis
cggugcgcgccgc

SEQ ID NO: 833845 - RNA, 17 nt, Mycobacterium avium subsp. paratuberculosis
cggugcgcgcgcgcucg

SEQ ID NO: 833846 - RNA, 20 nt, Mycobacterium avium subsp. paratuberculosis
cggugcgcucgugaccggcg

SEQ ID NO: 833847 - RNA, 14 nt, Mycobacterium avium subsp. paratuberculosis
cggugcgcggggug

SEQ ID NO: 833848 - RNA, 22 nt, Mycobacterium avium subsp. paratuberculosis
cggugcgcgggguggcgccggc

SEQ ID NO: 833849 - RNA, 18 nt, Mycobacterium avium subsp. paratuberculosis
cggugcgcgucagccguc

SEQ ID NO: 833850 - RNA, 20 nt, Mycobacterium avium subsp. paratuberculosis
cggugcgcgucagccgucgu

SEQ ID NO: 833851 - RNA, 23 nt, Mycobacterium avium subsp. paratuberculosis
cggugcgcgucagccgucgucgu

SEQ ID NO: 833852 - RNA, 13 nt, Mycobacterium avium subsp. paratuberculosis
cggugcgccggua

SEQ ID NO: 833853 - RNA, 23 nt, Mycobacterium avium subsp. paratuberculosis
cggugcgccgguagcgacacgga

SEQ ID NO: 833854 - RNA, 22 nt, Mycobacterium avium subsp. paratuberculosis
cggugcgccgcauuggugccgg

SEQ ID NO: 833855 - RNA, 23 nt, Mycobacterium avium subsp. paratuberculosis
cggugcgccgcauuggugccggc

SEQ ID NO: 833856 - RNA, 16 nt, Mycobacterium avium subsp. paratuberculosis
cggugcgccggcagcg

SEQ ID NO: 833857 - RNA, 17 nt, Mycobacterium avium subsp. paratuberculosis
cggugcgccggcagcgg

SEQ ID NO: 833858 - RNA, 21 nt, Mycobacterium avium subsp. paratuberculosis
cggugcgccggcagcggccgc

SEQ ID NO: 833859 - RNA, 16 nt, Mycobacterium avium subsp. paratuberculosis
cggugccgcguucgga

SEQ ID NO: 833860 - RNA, 15 nt, Mycobacterium avium subsp. paratuberculosis
cggugccggcccagu

SEQ ID NO: 833861 - RNA, 17 nt, Mycobacterium avium subsp. paratuberculosis
cggugccggcccagugg

SEQ ID NO: 833862 - RNA, 16 nt, Mycobacterium avium subsp. paratuberculosis
cggugccggccggguc

SEQ ID NO: 833863 - RNA, 18 nt, Mycobacterium avium subsp. paratuberculosis
cggugccggccgggucga

SEQ ID NO: 833864 - RNA, 13 nt, Mycobacterium avium subsp. paratuberculosis
cggugccgggugc

SEQ ID NO: 833865 - RNA, 16 nt, Mycobacterium avium subsp. paratuberculosis
cggugccgggugcuga

SEQ ID NO: 833866 - RNA, 19 nt, Mycobacterium avium subsp. paratuberculosis
cggugcgaaaauggcugcc

SEQ ID NO: 833867 - RNA, 23 nt, Mycobacterium avium subsp. paratuberculosis
cggugcgaaaauggcugcccggc

SEQ ID NO: 833868 - RNA, 18 nt, Mycobacterium avium subsp. paratuberculosis
cggugccguugaucaggg

SEQ ID NO: 833869 - RNA, 21 nt, Mycobacterium avium subsp. paratuberculosis
cggugccguccucggccgcca

SEQ ID NO: 833870 - RNA, 15 nt, Mycobacterium avium subsp. paratuberculosis
cggugccgucgaucg

SEQ ID NO: 833871 - RNA, 17 nt, Mycobacterium avium subsp. paratuberculosis
cggugccgucgaucgcc

SEQ ID NO: 833872 - RNA, 19 nt, Mycobacterium avium subsp. paratuberculosis
cggugccucuucgucggcc

SEQ ID NO: 833873 - RNA, 15 nt, Mycobacterium avium subsp. paratuberculosis
cggugaugucgacgu

SEQ ID NO: 833874 - RNA, 16 nt, Mycobacterium avium subsp. paratuberculosis
cggugaugucgacguc

SEQ ID NO: 833875 - RNA, 14 nt, Mycobacterium avium subsp. paratuberculosis
cggugaugucgccg

SEQ ID NO: 833876 - RNA, 17 nt, Mycobacterium avium subsp. paratuberculosis
cggugaugucgccggcg

SEQ ID NO: 833877 - RNA, 15 nt, Mycobacterium avium subsp. paratuberculosis
cggugaugcgcgccg

SEQ ID NO: 833878 - RNA, 17 nt, Mycobacterium avium subsp. paratuberculosis
cggugaugcgcgccgac

SEQ ID NO: 833879 - RNA, 16 nt, Mycobacterium avium subsp. paratuberculosis
cggugaugcgcggcga

SEQ ID NO: 833880 - RNA, 16 nt, Mycobacterium avium subsp. paratuberculosis
cggugauggugaucuc

SEQ ID NO: 833881 - RNA, 21 nt, Mycobacterium avium subsp. paratuberculosis
cggugauggugaucucgccgc

SEQ ID NO: 833882 - RNA, 23 nt, Mycobacterium avium subsp. paratuberculosis
cggugauggugaucucgccgcgg

SEQ ID NO: 833883 - RNA, 12 nt, Mycobacterium avium subsp. paratuberculosis
cggugcaccgcg

SEQ ID NO: 833884 - RNA, 15 nt, Mycobacterium avium subsp. paratuberculosis
cggugcaccgcgcgc

SEQ ID NO: 833885 - RNA, 18 nt, Mycobacterium avium subsp. paratuberculosis
cggugcaccgcgcgcacc

SEQ ID NO: 833886 - RNA, 13 nt, Mycobacterium avium subsp. paratuberculosis
cggugcaccgcgg

SEQ ID NO: 833887 - RNA, 19 nt, Mycobacterium avium subsp. paratuberculosis
cggugcaccgcggcgcgca

SEQ ID NO: 833888 - RNA, 14 nt, Mycobacterium avium subsp. paratuberculosis
cggugcacgagcgu

SEQ ID NO: 833889 - RNA, 20 nt, Mycobacterium avium subsp. paratuberculosis
cggugcacgagcgucgugcg

SEQ ID NO: 833890 - RNA, 23 nt, Mycobacterium avium subsp. paratuberculosis
cggugcacgagcgucgugcgggc

SEQ ID NO: 833891 - RNA, 12 nt, Mycobacterium avium subsp. paratuberculosis
cggugcacggcg

SEQ ID NO: 833892 - RNA, 15 nt, Mycobacterium avium subsp. paratuberculosis
cggugcacggcgcca

SEQ ID NO: 833893 - RNA, 17 nt, Mycobacterium avium subsp. paratuberculosis
cggugcacggcgccacc

SEQ ID NO: 833894 - RNA, 18 nt, Mycobacterium avium subsp. paratuberculosis
cggugcacggucagcucg

SEQ ID NO: 833895 - RNA, 20 nt, Mycobacterium avium subsp. paratuberculosis
cggugcacggucagcucgcg

SEQ ID NO: 833896 - RNA, 22 nt, Mycobacterium avium subsp. paratuberculosis
cggugcaccaggacgcgaccgg

SEQ ID NO: 833897 - RNA, 23 nt, Mycobacterium avium subsp. paratuberculosis
cggugcaccaggacgcgaccggc

SEQ ID NO: 833898 - RNA, 16 nt, Mycobacterium avium subsp. paratuberculosis
cggugcaccaccgugc

SEQ ID NO: 833899 - RNA, 18 nt, Mycobacterium avium subsp. paratuberculosis
cggugcaccaccgugccg

SEQ ID NO: 833900 - RNA, 20 nt, Mycobacterium avium subsp. paratuberculosis
cggugcaccaccgugccguc

SEQ ID NO: 833901 - RNA, 15 nt, Mycobacterium avium subsp. paratuberculosis
cggugauguugucga

SEQ ID NO: 833902 - RNA, 22 nt, Mycobacterium avium subsp. paratuberculosis
cggugcaacgccgccgacagca

SEQ ID NO: 833903 - RNA, 23 nt, Mycobacterium avium subsp. paratuberculosis
cggugccacgaugaugcccccga

SEQ ID NO: 833904 - RNA, 15 nt, Mycobacterium avium subsp. paratuberculosis
cggugccacgcggcu

SEQ ID NO: 833905 - RNA, 19 nt, Mycobacterium avium subsp. paratuberculosis
cggugcaugcgcuggcgaa

SEQ ID NO: 833906 - RNA, 15 nt, Mycobacterium avium subsp. paratuberculosis
cggugcaucgucgcg

SEQ ID NO: 833907 - RNA, 20 nt, Mycobacterium avium subsp. paratuberculosis
cggugcaucgucgcggcggu

SEQ ID NO: 833908 - RNA, 21 nt, Mycobacterium avium subsp. paratuberculosis
cggugcaucgucgcggcgguc

SEQ ID NO: 833909 - RNA, 22 nt, Mycobacterium avium subsp. paratuberculosis
cggugcaucgucgcggcgguca

SEQ ID NO: 833910 - RNA, 22 nt, Mycobacterium avium subsp. paratuberculosis
cggugcaguacgcaucggcgcc

SEQ ID NO: 833911 - RNA, 24 nt, Mycobacterium avium subsp. paratuberculosis
cggugcaguacgcaucggcgccgg

SEQ ID NO: 833912 - RNA, 17 nt, Mycobacterium avium subsp. paratuberculosis
cggugcagggucagcag

SEQ ID NO: 833913 - RNA, 18 nt, Mycobacterium avium subsp. paratuberculosis
cggugcagggucagcagc

SEQ ID NO: 833914 - RNA, 14 nt, Mycobacterium avium subsp. paratuberculosis
cggugcaggccgcg

SEQ ID NO: 833915 - RNA, 15 nt, Mycobacterium avium subsp. paratuberculosis
cggugcaggccgcga

SEQ ID NO: 833916 - RNA, 16 nt, Mycobacterium avium subsp. paratuberculosis
cggugcaggccgcgac

SEQ ID NO: 833917 - RNA, 12 nt, Mycobacterium avium subsp. paratuberculosis
cggugcagccgg

SEQ ID NO: 833918 - RNA, 16 nt, Mycobacterium avium subsp. paratuberculosis
cggugcagccgggugc

SEQ ID NO: 833919 - RNA, 19 nt, Mycobacterium avium subsp. paratuberculosis
cggugcagccgggugcggu

SEQ ID NO: 833920 - RNA, 16 nt, Mycobacterium avium subsp. paratuberculosis
cggugcagaccccggc

SEQ ID NO: 833921 - RNA, 17 nt, Mycobacterium avium subsp. paratuberculosis
cggugcagaccccggcg

SEQ ID NO: 833922 - RNA, 19 nt, Mycobacterium avium subsp. paratuberculosis
cggugcagcacgugcgcgg

SEQ ID NO: 833923 - RNA, 13 nt, Mycobacterium avium subsp. paratuberculosis
cggugcagcagcg

SEQ ID NO: 833924 - RNA, 15 nt, Mycobacterium avium subsp. paratuberculosis
cggugcagcagcgcc

SEQ ID NO: 833925 - RNA, 17 nt, Mycobacterium avium subsp. paratuberculosis
cggugcagcagcgccgc

SEQ ID NO: 833926 - RNA, 21 nt, Mycobacterium avium subsp. paratuberculosis
cggugcagcagcgccgcgacg

SEQ ID NO: 833927 - RNA, 22 nt, Mycobacterium avium subsp. paratuberculosis
cggugccaucgugggcgccguc

SEQ ID NO: 833928 - RNA, 15 nt, Mycobacterium avium subsp. paratuberculosis
cggugcccaggucgc

SEQ ID NO: 833929 - RNA, 20 nt, Mycobacterium avium subsp. paratuberculosis
cggugcccagcaccgccggc

SEQ ID NO: 833930 - RNA, 22 nt, Mycobacterium avium subsp. paratuberculosis
cggugcccagcaccgccggcgc

SEQ ID NO: 833931 - RNA, 16 nt, Mycobacterium avium subsp. paratuberculosis
cggugcccagccgcag

SEQ ID NO: 833932 - RNA, 20 nt, Mycobacterium avium subsp. paratuberculosis
cggugcccagccgcaggugc

SEQ ID NO: 833933 - RNA, 15 nt, Mycobacterium avium subsp. paratuberculosis
cggugcccagcgcga

SEQ ID NO: 833934 - RNA, 14 nt, Mycobacterium avium subsp. paratuberculosis
cggugcccgcagca

SEQ ID NO: 833935 - RNA, 13 nt, Mycobacterium avium subsp. paratuberculosis
cggugcccgccgc

SEQ ID NO: 833936 - RNA, 16 nt, Mycobacterium avium subsp. paratuberculosis
cggugcccgccgcgac

SEQ ID NO: 833937 - RNA, 19 nt, Mycobacterium avium subsp. paratuberculosis
cggugcccgccgcgaccgc

SEQ ID NO: 833938 - RNA, 13 nt, Mycobacterium avium subsp. paratuberculosis
cggugcccgcggg

SEQ ID NO: 833939 - RNA, 20 nt, Mycobacterium avium subsp. paratuberculosis
cggugcccggaacggcgggc

SEQ ID NO: 833940 - RNA, 23 nt, Mycobacterium avium subsp. paratuberculosis
cggugcccggaacggcgggcccg

SEQ ID NO: 833941 - RNA, 17 nt, Mycobacterium avium subsp. paratuberculosis
cggugccgaagcgccac

SEQ ID NO: 833942 - RNA, 16 nt, Mycobacterium avium subsp. paratuberculosis
cggugcccgucggcaa

SEQ ID NO: 833943 - RNA, 21 nt, Mycobacterium avium subsp. paratuberculosis
cggugcccgucggcaacgccg

SEQ ID NO: 833944 - RNA, 13 nt, Mycobacterium avium subsp. paratuberculosis
cggugccgaccug

SEQ ID NO: 833945 - RNA, 21 nt, Mycobacterium avium subsp. paratuberculosis
cggugccgaccugggcggcca

SEQ ID NO: 833946 - RNA, 24 nt, Mycobacterium avium subsp. paratuberculosis
cggugccgaccugggcggccaccg

SEQ ID NO: 833947 - RNA, 16 nt, Mycobacterium avium subsp. paratuberculosis
cggugccgacgauccg

SEQ ID NO: 833948 - RNA, 17 nt, Mycobacterium avium subsp. paratuberculosis
cggugccgacgaugagg

SEQ ID NO: 833949 - RNA, 20 nt, Mycobacterium avium subsp. paratuberculosis
cggugccgagcacgcggccg

SEQ ID NO: 833950 - RNA, 21 nt, Mycobacterium avium subsp. paratuberculosis
cggugccgagcacgcggccgc

SEQ ID NO: 833951 - RNA, 23 nt, Mycobacterium avium subsp. paratuberculosis
cggugccgagcacgcggccgcgc

SEQ ID NO: 833952 - RNA, 12 nt, Mycobacterium avium subsp. paratuberculosis
cggugccgccgu

SEQ ID NO: 833953 - RNA, 15 nt, Mycobacterium avium subsp. paratuberculosis
cggugccgccgugcg

SEQ ID NO: 833954 - RNA, 23 nt, Mycobacterium avium subsp. paratuberculosis
cggugccgccgugcgcggcgacc

SEQ ID NO: 833955 - RNA, 12 nt, Mycobacterium avium subsp. paratuberculosis
cggugccgcggc

SEQ ID NO: 833956 - RNA, 14 nt, Mycobacterium avium subsp. paratuberculosis
cggugccgcggcgg

SEQ ID NO: 833957 - RNA, 17 nt, Mycobacterium avium subsp. paratuberculosis
cggugccgcggcggcgc

SEQ ID NO: 833958 - RNA, 18 nt, Mycobacterium avium subsp. paratuberculosis
cggugccgcggcggcgcc

SEQ ID NO: 833959 - RNA, 19 nt, Mycobacterium avium subsp. paratuberculosis
cggugccgcggcggcgccg

SEQ ID NO: 833960 - RNA, 20 nt, Mycobacterium avium subsp. paratuberculosis
cggugccgcggcggcgccga

SEQ ID NO: 833961 - RNA, 21 nt, Mycobacterium avium subsp. paratuberculosis
cggugccgcggcggcgccgac

SEQ ID NO: 833962 - RNA, 23 nt, Mycobacterium avium subsp. paratuberculosis
cggugccgcggcggcgccgacgg

SEQ ID NO: 833963 - RNA, 17 nt, Mycobacterium avium subsp. paratuberculosis
cggugccgagcccgccg

SEQ ID NO: 833964 - RNA, 21 nt, Mycobacterium avium subsp. paratuberculosis
cggugccgaguucgaccucgg

SEQ ID NO: 833965 - RNA, 13 nt, Mycobacterium avium subsp. paratuberculosis
cggugccgauccg

SEQ ID NO: 833966 - RNA, 17 nt, Mycobacterium avium subsp. paratuberculosis
cggugccgauccgcacc

SEQ ID NO: 833967 - RNA, 18 nt, Mycobacterium avium subsp. paratuberculosis
cggugccgauccgcaccg

SEQ ID NO: 833968 - RNA, 12 nt, Mycobacterium avium subsp. paratuberculosis
cggugccgcagc

SEQ ID NO: 833969 - RNA, 14 nt, Mycobacterium avium subsp. paratuberculosis
cggugccgcagccg

SEQ ID NO: 833970 - RNA, 15 nt, Mycobacterium avium subsp. paratuberculosis
cggugccgcagccgu

SEQ ID NO: 833971 - RNA, 23 nt, Mycobacterium avium subsp. paratuberculosis
cggugccgcagcucgaucaccca

SEQ ID NO: 833972 - RNA, 19 nt, Mycobacterium avium subsp. paratuberculosis
cggugccgcagugccggcg

SEQ ID NO: 833973 - RNA, 20 nt, Mycobacterium avium subsp. paratuberculosis
cggugacuccuccucggcca

SEQ ID NO: 833974 - RNA, 13 nt, Mycobacterium avium subsp. paratuberculosis
cggugagcaccgc

SEQ ID NO: 833975 - RNA, 15 nt, Mycobacterium avium subsp. paratuberculosis
cggugagcaccgccg

SEQ ID NO: 833976 - RNA, 16 nt, Mycobacterium avium subsp. paratuberculosis
cggugagcaccgccgu

SEQ ID NO: 833977 - RNA, 17 nt, Mycobacterium avium subsp. paratuberculosis
cggugagcaccgccguc

SEQ ID NO: 833978 - RNA, 14 nt, Mycobacterium avium subsp. paratuberculosis
cggugagcaccggg

SEQ ID NO: 833979 - RNA, 22 nt, Mycobacterium avium subsp. paratuberculosis
cggugagcaccgggaacagcca

SEQ ID NO: 833980 - RNA, 13 nt, Mycobacterium avium subsp. paratuberculosis
cggugagcacgac

SEQ ID NO: 833981 - RNA, 17 nt, Mycobacterium avium subsp. paratuberculosis
cggugagcacgaccgcc

SEQ ID NO: 833982 - RNA, 13 nt, Mycobacterium avium subsp. paratuberculosis
cggugagcggccg

SEQ ID NO: 833983 - RNA, 14 nt, Mycobacterium avium subsp. paratuberculosis
cggugagcggccgc

SEQ ID NO: 833984 - RNA, 20 nt, Mycobacterium avium subsp. paratuberculosis
cggugagcggccgcagcgca

SEQ ID NO: 833985 - RNA, 15 nt, Mycobacterium avium subsp. paratuberculosis
cggugagcgcgccgg

SEQ ID NO: 833986 - RNA, 19 nt, Mycobacterium avium subsp. paratuberculosis
cggugagcgcgccggcccg

SEQ ID NO: 833987 - RNA, 14 nt, Mycobacterium avium subsp. paratuberculosis
cggugagcgugguc

SEQ ID NO: 833988 - RNA, 19 nt, Mycobacterium avium subsp. paratuberculosis
cggugagccgccacagcgc

SEQ ID NO: 833989 - RNA, 21 nt, Mycobacterium avium subsp. paratuberculosis
cggugagccgccacagcgccu

SEQ ID NO: 833990 - RNA, 20 nt, Mycobacterium avium subsp. paratuberculosis
cggugagccucagggcgcgc

SEQ ID NO: 833991 - RNA, 15 nt, Mycobacterium avium subsp. paratuberculosis
cggugagcgccaccc

SEQ ID NO: 833992 - RNA, 18 nt, Mycobacterium avium subsp. paratuberculosis
cggugagcaacaccggca

SEQ ID NO: 833993 - RNA, 19 nt, Mycobacterium avium subsp. paratuberculosis
cggugagcaacaccggcac

SEQ ID NO: 833994 - RNA, 20 nt, Mycobacterium avium subsp. paratuberculosis
cggugagcaacaccggcacg

SEQ ID NO: 833995 - RNA, 23 nt, Mycobacterium avium subsp. paratuberculosis
cggugagcaacaccggcacgauc

SEQ ID NO: 833996 - RNA, 21 nt, Mycobacterium avium subsp. paratuberculosis
cggugagcagcaugccgagca

SEQ ID NO: 833997 - RNA, 15 nt, Mycobacterium avium subsp. paratuberculosis
cggugagcagcucgg

SEQ ID NO: 833998 - RNA, 19 nt, Mycobacterium avium subsp. paratuberculosis
cggugagcagcucggucac

SEQ ID NO: 833999 - RNA, 13 nt, Mycobacterium avium subsp. paratuberculosis
cggugacgcgccg

SEQ ID NO: 834000 - RNA, 17 nt, Mycobacterium avium subsp. paratuberculosis
cggugacgauccggucg

SEQ ID NO: 834001 - RNA, 12 nt, Mycobacterium avium subsp. paratuberculosis
cggugacggcgu

SEQ ID NO: 834002 - RNA, 17 nt, Mycobacterium avium subsp. paratuberculosis
cggugacggcgucggcg

SEQ ID NO: 834003 - RNA, 19 nt, Mycobacterium avium subsp. paratuberculosis
cggugacggcgucggcgau

SEQ ID NO: 834004 - RNA, 13 nt, Mycobacterium avium subsp. paratuberculosis
cggugacgaccgg

SEQ ID NO: 834005 - RNA, 17 nt, Mycobacterium avium subsp. paratuberculosis
cggugacgaccggcagc

SEQ ID NO: 834006 - RNA, 21 nt, Mycobacterium avium subsp. paratuberculosis
cggugacgaugaugucggccg

SEQ ID NO: 834007 - RNA, 23 nt, Mycobacterium avium subsp. paratuberculosis
cggugacgaugaugucggccggc

SEQ ID NO: 834008 - RNA, 12 nt, Mycobacterium avium subsp. paratuberculosis
cggucagcaccg

SEQ ID NO: 834009 - RNA, 16 nt, Mycobacterium avium subsp. paratuberculosis
cggucagcaccgcgcg

SEQ ID NO: 834010 - RNA, 17 nt, Mycobacterium avium subsp. paratuberculosis
cggucagcaccgcgcgg

SEQ ID NO: 834011 - RNA, 20 nt, Mycobacterium avium subsp. paratuberculosis
cggucagcaccgcgcggcgg

SEQ ID NO: 834012 - RNA, 18 nt, Mycobacterium avium subsp. paratuberculosis
cggugaccgccucgucga

SEQ ID NO: 834013 - RNA, 14 nt, Mycobacterium avium subsp. paratuberculosis
cggugaccgcgacg

SEQ ID NO: 834014 - RNA, 15 nt, Mycobacterium avium subsp. paratuberculosis
cggugaccgcgacgc

SEQ ID NO: 834015 - RNA, 15 nt, Mycobacterium avium subsp. paratuberculosis
cggugaccgcgccgc

SEQ ID NO: 834016 - RNA, 22 nt, Mycobacterium avium subsp. paratuberculosis
cggugaccgcggccucgucgag

SEQ ID NO: 834017 - RNA, 19 nt, Mycobacterium avium subsp. paratuberculosis
cggugaccggaucggccag

SEQ ID NO: 834018 - RNA, 21 nt, Mycobacterium avium subsp. paratuberculosis
cggugaccggaucggccagca

SEQ ID NO: 834019 - RNA, 13 nt, Mycobacterium avium subsp. paratuberculosis
cggugaccggcgc

SEQ ID NO: 834020 - RNA, 15 nt, Mycobacterium avium subsp. paratuberculosis
cggugaccggcgcgc

SEQ ID NO: 834021 - RNA, 18 nt, Mycobacterium avium subsp. paratuberculosis
cggugaccggcgcgcccg

SEQ ID NO: 834022 - RNA, 14 nt, Mycobacterium avium subsp. paratuberculosis
cggugaccggcucg

SEQ ID NO: 834023 - RNA, 17 nt, Mycobacterium avium subsp. paratuberculosis
cggugaccggcucgagc

SEQ ID NO: 834024 - RNA, 16 nt, Mycobacterium avium subsp. paratuberculosis
cggugaccgucgccga

SEQ ID NO: 834025 - RNA, 17 nt, Mycobacterium avium subsp. paratuberculosis
cggugaccgucgccgac

SEQ ID NO: 834026 - RNA, 18 nt, Mycobacterium avium subsp. paratuberculosis
cggugaccgucgccgacc

SEQ ID NO: 834027 - RNA, 21 nt, Mycobacterium avium subsp. paratuberculosis
cggugaccgucgccgaccagc

SEQ ID NO: 834028 - RNA, 12 nt, Mycobacterium avium subsp. paratuberculosis
cggugaccucga

SEQ ID NO: 834029 - RNA, 17 nt, Mycobacterium avium subsp. paratuberculosis
cggugaccucgagcacc

SEQ ID NO: 834030 - RNA, 23 nt, Mycobacterium avium subsp. paratuberculosis
cggugaccucgagcaccggcggc

SEQ ID NO: 834031 - RNA, 23 nt, Mycobacterium avium subsp. paratuberculosis
cggugaccucgucgggcgccagc

SEQ ID NO: 834032 - RNA, 18 nt, Mycobacterium avium subsp. paratuberculosis
cggugaccuugcgggcgg

SEQ ID NO: 834033 - RNA, 22 nt, Mycobacterium avium subsp. paratuberculosis
cggugacgaacaucgacgacgg

SEQ ID NO: 834034 - RNA, 20 nt, Mycobacterium avium subsp. paratuberculosis
cggugacgaacccgccgcgg

SEQ ID NO: 834035 - RNA, 15 nt, Mycobacterium avium subsp. paratuberculosis
cggugaguucaucga

SEQ ID NO: 834036 - RNA, 21 nt, Mycobacterium avium subsp. paratuberculosis
cggugaguucaucgacgucga

SEQ ID NO: 834037 - RNA, 17 nt, Mycobacterium avium subsp. paratuberculosis
cggugaggucgggcucg

SEQ ID NO: 834038 - RNA, 22 nt, Mycobacterium avium subsp. paratuberculosis
cggugagguggcguagucgucg

SEQ ID NO: 834039 - RNA, 23 nt, Mycobacterium avium subsp. paratuberculosis
cggugagguggcguagucgucga

SEQ ID NO: 834040 - RNA, 22 nt, Mycobacterium avium subsp. paratuberculosis
cggugagcugaucgcgucgacg

SEQ ID NO: 834041 - RNA, 17 nt, Mycobacterium avium subsp. paratuberculosis
cggugagcuggccgcgc

SEQ ID NO: 834042 - RNA, 18 nt, Mycobacterium avium subsp. paratuberculosis
cggugaggacaccacgau

SEQ ID NO: 834043 - RNA, 23 nt, Mycobacterium avium subsp. paratuberculosis
cggugaggcuggguugcucgccg

SEQ ID NO: 834044 - RNA, 23 nt, Mycobacterium avium subsp. paratuberculosis
cggugaggguuuccacgugcacg

SEQ ID NO: 834045 - RNA, 14 nt, Mycobacterium avium subsp. paratuberculosis
cggugaucagcagc

SEQ ID NO: 834046 - RNA, 19 nt, Mycobacterium avium subsp. paratuberculosis
cggugauccacuccagcac

SEQ ID NO: 834047 - RNA, 20 nt, Mycobacterium avium subsp. paratuberculosis
cggugauccacuccagcacc

SEQ ID NO: 834048 - RNA, 22 nt, Mycobacterium avium subsp. paratuberculosis
cggugaucccaggaacgcgccc

SEQ ID NO: 834049 - RNA, 20 nt, Mycobacterium avium subsp. paratuberculosis
cggugauccgcccggcccgc

SEQ ID NO: 834050 - RNA, 22 nt, Mycobacterium avium subsp. paratuberculosis
cggugauccgcccggcccgcau

SEQ ID NO: 834051 - RNA, 21 nt, Mycobacterium avium subsp. paratuberculosis
cggugaucaggcccucgucgg

SEQ ID NO: 834052 - RNA, 23 nt, Mycobacterium avium subsp. paratuberculosis
cggugaucagggucccggucagc

SEQ ID NO: 834053 - RNA, 13 nt, Mycobacterium avium subsp. paratuberculosis
cggugaucacccg

SEQ ID NO: 834054 - RNA, 15 nt, Mycobacterium avium subsp. paratuberculosis
cggugaucacccgcc

SEQ ID NO: 834055 - RNA, 14 nt, Mycobacterium avium subsp. paratuberculosis
cggugauggccggc

SEQ ID NO: 834056 - RNA, 19 nt, Mycobacterium avium subsp. paratuberculosis
cggugauggccggcuaccg

SEQ ID NO: 834057 - RNA, 15 nt, Mycobacterium avium subsp. paratuberculosis
cggugauggcgaugc

SEQ ID NO: 834058 - RNA, 16 nt, Mycobacterium avium subsp. paratuberculosis
cggugauggcgaugcc

SEQ ID NO: 834059 - RNA, 14 nt, Mycobacterium avium subsp. paratuberculosis
cggugaugccgagc

SEQ ID NO: 834060 - RNA, 16 nt, Mycobacterium avium subsp. paratuberculosis
cggugaugccggacuu

SEQ ID NO: 834061 - RNA, 21 nt, Mycobacterium avium subsp. paratuberculosis
cggugaugccggcauccucgg

SEQ ID NO: 834062 - RNA, 17 nt, Mycobacterium avium subsp. paratuberculosis
cggugaugccggccagc

SEQ ID NO: 834063 - RNA, 14 nt, Mycobacterium avium subsp. paratuberculosis
cggugaugcgggug

SEQ ID NO: 834064 - RNA, 22 nt, Mycobacterium avium subsp. paratuberculosis
cggugauggacaucuccggcac

SEQ ID NO: 834065 - RNA, 16 nt, Mycobacterium avium subsp. paratuberculosis
cggugaugaucgccgg

SEQ ID NO: 834066 - RNA, 17 nt, Mycobacterium avium subsp. paratuberculosis
cggugaugaucgccggg

SEQ ID NO: 834067 - RNA, 20 nt, Mycobacterium avium subsp. paratuberculosis
cggugaugaucgccgggucg

SEQ ID NO: 834068 - RNA, 19 nt, Mycobacterium avium subsp. paratuberculosis
cggugaucucgucggcggc

SEQ ID NO: 834069 - RNA, 15 nt, Mycobacterium avium subsp. paratuberculosis
cggugaucugcacca

SEQ ID NO: 834070 - RNA, 17 nt, Mycobacterium avium subsp. paratuberculosis
cggugaucugcaccagc

SEQ ID NO: 834071 - RNA, 23 nt, Mycobacterium avium subsp. paratuberculosis
cggugaucucaccggcggcggcc

SEQ ID NO: 834072 - RNA, 17 nt, Mycobacterium avium subsp. paratuberculosis
cggugaucucccgugcg

SEQ ID NO: 834073 - RNA, 15 nt, Mycobacterium avium subsp. paratuberculosis
cggugaucucgccga

SEQ ID NO: 834074 - RNA, 13 nt, Mycobacterium avium subsp. paratuberculosis
cggugaucgccgc

SEQ ID NO: 834075 - RNA, 16 nt, Mycobacterium avium subsp. paratuberculosis
cggugaucgccgccca

SEQ ID NO: 834076 - RNA, 20 nt, Mycobacterium avium subsp. paratuberculosis
cggugaucgccgcccacugg

SEQ ID NO: 834077 - RNA, 15 nt, Mycobacterium avium subsp. paratuberculosis
cggugaucgcggcgc

SEQ ID NO: 834078 - RNA, 16 nt, Mycobacterium avium subsp. paratuberculosis
cggugaucgcggcgcu

SEQ ID NO: 834079 - RNA, 18 nt, Mycobacterium avium subsp. paratuberculosis
cggugaucgcggcgcugc

SEQ ID NO: 834080 - RNA, 20 nt, Mycobacterium avium subsp. paratuberculosis
cggugaucgcggcgcugccg

SEQ ID NO: 834081 - RNA, 21 nt, Mycobacterium avium subsp. paratuberculosis
cggugaucgcggcgcugccgc

SEQ ID NO: 834082 - RNA, 14 nt, Mycobacterium avium subsp. paratuberculosis
cgucaacgacccgg

SEQ ID NO: 834083 - RNA, 17 nt, Mycobacterium avium subsp. paratuberculosis
cgucaacaccguggugg

SEQ ID NO: 834084 - RNA, 22 nt, Mycobacterium avium subsp. paratuberculosis
cgucaacccguuccacaucagg

SEQ ID NO: 834085 - RNA, 22 nt, Mycobacterium avium subsp. paratuberculosis
cgucaaagccguucgcgccgag

SEQ ID NO: 834086 - RNA, 23 nt, Mycobacterium avium subsp. paratuberculosis
aacccggugccggccgggucgac

SEQ ID NO: 834087 - RNA, 21 nt, Mycobacterium avium subsp. paratuberculosis
aacccgggacccggaacccgc

SEQ ID NO: 834088 - RNA, 12 nt, Mycobacterium avium subsp. paratuberculosis
aacccgggccgg

SEQ ID NO: 834089 - RNA, 21 nt, Mycobacterium avium subsp. paratuberculosis
aacccgggcgcgcccacccgc

SEQ ID NO: 834090 - RNA, 16 nt, Mycobacterium avium subsp. paratuberculosis
cguauugccgucggcg

SEQ ID NO: 834091 - RNA, 17 nt, Mycobacterium avium subsp. paratuberculosis
cguauucgucgucggcc

SEQ ID NO: 834092 - RNA, 17 nt, Mycobacterium avium subsp. paratuberculosis
cguauucgacggcgacc

SEQ ID NO: 834093 - RNA, 15 nt, Mycobacterium avium subsp. paratuberculosis
cguauuccagcgcca

SEQ ID NO: 834094 - RNA, 15 nt, Mycobacterium avium subsp. paratuberculosis
cguauucggcgcgca

SEQ ID NO: 834095 - RNA, 16 nt, Mycobacterium avium subsp. paratuberculosis
cguaguugcggccggc

SEQ ID NO: 834096 - RNA, 20 nt, Mycobacterium avium subsp. paratuberculosis
cguaguugcggccggcggug

SEQ ID NO: 834097 - RNA, 15 nt, Mycobacterium avium subsp. paratuberculosis
cguaguugcgcgccg

SEQ ID NO: 834098 - RNA, 16 nt, Mycobacterium avium subsp. paratuberculosis
cguaguugcgcgccga

SEQ ID NO: 834099 - RNA, 19 nt, Mycobacterium avium subsp. paratuberculosis
cguaguuggggccggccgc

SEQ ID NO: 834100 - RNA, 20 nt, Mycobacterium avium subsp. paratuberculosis
cguaguuggggccggccgcc

SEQ ID NO: 834101 - RNA, 14 nt, Mycobacterium avium subsp. paratuberculosis
cguaugcgccaacg

SEQ ID NO: 834102 - RNA, 15 nt, Mycobacterium avium subsp. paratuberculosis
cguaggcgcggucga

SEQ ID NO: 834103 - RNA, 14 nt, Mycobacterium avium subsp. paratuberculosis
cguaggcggccagc

SEQ ID NO: 834104 - RNA, 18 nt, Mycobacterium avium subsp. paratuberculosis
cguaggcggccagcagca

SEQ ID NO: 834105 - RNA, 19 nt, Mycobacterium avium subsp. paratuberculosis
cguaaugcgucaugccgga

SEQ ID NO: 834106 - RNA, 16 nt, Mycobacterium avium subsp. paratuberculosis
cguagugggucggcgg

SEQ ID NO: 834107 - RNA, 17 nt, Mycobacterium avium subsp. paratuberculosis
cguagugggucggcggc

SEQ ID NO: 834108 - RNA, 20 nt, Mycobacterium avium subsp. paratuberculosis
cguagugggucggcggcuga

SEQ ID NO: 834109 - RNA, 13 nt, Mycobacterium avium subsp. paratuberculosis
cguaguucgucga

SEQ ID NO: 834110 - RNA, 15 nt, Mycobacterium avium subsp. paratuberculosis
cguaguucgucgaac

SEQ ID NO: 834111 - RNA, 17 nt, Mycobacterium avium subsp. paratuberculosis
cguaggguucgccgaug

SEQ ID NO: 834112 - RNA, 16 nt, Mycobacterium avium subsp. paratuberculosis
cguaggugagcaacgc

SEQ ID NO: 834113 - RNA, 19 nt, Mycobacterium avium subsp. paratuberculosis
cguaggugagcaacgccag

SEQ ID NO: 834114 - RNA, 13 nt, Mycobacterium avium subsp. paratuberculosis
cguagugcucggc

SEQ ID NO: 834115 - RNA, 15 nt, Mycobacterium avium subsp. paratuberculosis
cguagugcucggcgu

SEQ ID NO: 834116 - RNA, 21 nt, Mycobacterium avium subsp. paratuberculosis
cguagugcucggcgucccgcg

SEQ ID NO: 834117 - RNA, 18 nt, Mycobacterium avium subsp. paratuberculosis
cguagggacugcgccggg

SEQ ID NO: 834118 - RNA, 14 nt, Mycobacterium avium subsp. paratuberculosis
cguagggcucggcg

SEQ ID NO: 834119 - RNA, 15 nt, Mycobacterium avium subsp. paratuberculosis
cguagggcucggcgu

SEQ ID NO: 834120 - RNA, 14 nt, Mycobacterium avium subsp. paratuberculosis
cguaggcggcgagc

SEQ ID NO: 834121 - RNA, 16 nt, Mycobacterium avium subsp. paratuberculosis
cgucacaccgcggcca

SEQ ID NO: 834122 - RNA, 22 nt, Mycobacterium avium subsp. paratuberculosis
cgucacaccgcggccagcgcgc

SEQ ID NO: 834123 - RNA, 15 nt, Mycobacterium avium subsp. paratuberculosis
cgucacaggccgccu

SEQ ID NO: 834124 - RNA, 20 nt, Mycobacterium avium subsp. paratuberculosis
cgucacggccguccaggcgc

SEQ ID NO: 834125 - RNA, 15 nt, Mycobacterium avium subsp. paratuberculosis
cgucacggaucgccc

SEQ ID NO: 834126 - RNA, 17 nt, Mycobacterium avium subsp. paratuberculosis
cgucacggaucgcccac

SEQ ID NO: 834127 - RNA, 19 nt, Mycobacterium avium subsp. paratuberculosis
cgucacggaucgcccaccc

SEQ ID NO: 834128 - RNA, 23 nt, Mycobacterium avium subsp. paratuberculosis
cgucacggcgaggauggcgauca

SEQ ID NO: 834129 - RNA, 16 nt, Mycobacterium avium subsp. paratuberculosis
cgucacggcugccgac

SEQ ID NO: 834130 - RNA, 18 nt, Mycobacterium avium subsp. paratuberculosis
cgucacgggccaggcgcg

SEQ ID NO: 834131 - RNA, 23 nt, Mycobacterium avium subsp. paratuberculosis
cgucacguagcgcggccgcccgu

SEQ ID NO: 834132 - RNA, 15 nt, Mycobacterium avium subsp. paratuberculosis
cgucacgucgacggc

SEQ ID NO: 834133 - RNA, 20 nt, Mycobacterium avium subsp. paratuberculosis
cgucacgucgacggccgccg

SEQ ID NO: 834134 - RNA, 22 nt, Mycobacterium avium subsp. paratuberculosis
cgucacgucgacggccgccgcg

SEQ ID NO: 834135 - RNA, 20 nt, Mycobacterium avium subsp. paratuberculosis
cgucacuucgccgggcuggc

SEQ ID NO: 834136 - RNA, 21 nt, Mycobacterium avium subsp. paratuberculosis
cgucacuucgccgggcuggcc

SEQ ID NO: 834137 - RNA, 15 nt, Mycobacterium avium subsp. paratuberculosis
cgucacugucggcgc

SEQ ID NO: 834138 - RNA, 17 nt, Mycobacterium avium subsp. paratuberculosis
cgucacugucggcgcgg

SEQ ID NO: 834139 - RNA, 18 nt, Mycobacterium avium subsp. paratuberculosis
cgucacugucggcgcgga

SEQ ID NO: 834140 - RNA, 19 nt, Mycobacterium avium subsp. paratuberculosis
cgucacugucggcgcggac

SEQ ID NO: 834141 - RNA, 20 nt, Mycobacterium avium subsp. paratuberculosis
cgucacugucggcgcggacg

SEQ ID NO: 834142 - RNA, 19 nt, Mycobacterium avium subsp. paratuberculosis
cgucacucuggcgugacgc

SEQ ID NO: 834143 - RNA, 18 nt, Mycobacterium avium subsp. paratuberculosis
cgucacugcacgcacggc

SEQ ID NO: 834144 - RNA, 12 nt, Mycobacterium avium subsp. paratuberculosis
cgucacgucggc

SEQ ID NO: 834145 - RNA, 14 nt, Mycobacterium avium subsp. paratuberculosis
cgucacgucggccu

SEQ ID NO: 834146 - RNA, 22 nt, Mycobacterium avium subsp. paratuberculosis
cgucacgucggccugcacgaag

SEQ ID NO: 834147 - RNA, 16 nt, Mycobacterium avium subsp. paratuberculosis
cgucacgucguugagc

SEQ ID NO: 834148 - RNA, 17 nt, Mycobacterium avium subsp. paratuberculosis
cgucacguucaccaccg

SEQ ID NO: 834149 - RNA, 18 nt, Mycobacterium avium subsp. paratuberculosis
cgucacguucaccaccgg

SEQ ID NO: 834150 - RNA, 19 nt, Mycobacterium avium subsp. paratuberculosis
cgucacguucaccaccgga

SEQ ID NO: 834151 - RNA, 16 nt, Mycobacterium avium subsp. paratuberculosis
cgucagcagggccucg

SEQ ID NO: 834152 - RNA, 17 nt, Mycobacterium avium subsp. paratuberculosis
cgucagcagggccucgc

SEQ ID NO: 834153 - RNA, 22 nt, Mycobacterium avium subsp. paratuberculosis
cgucagcagggccucgccguug

SEQ ID NO: 834154 - RNA, 11 nt, Mycobacterium avium subsp. paratuberculosis
cgucagcagcg

SEQ ID NO: 834155 - RNA, 14 nt, Mycobacterium avium subsp. paratuberculosis
cgucagcagcgcga

SEQ ID NO: 834156 - RNA, 15 nt, Mycobacterium avium subsp. paratuberculosis
cgucagcagcgcgac

SEQ ID NO: 834157 - RNA, 17 nt, Mycobacterium avium subsp. paratuberculosis
cgucagccccgagucca

SEQ ID NO: 834158 - RNA, 14 nt, Mycobacterium avium subsp. paratuberculosis
cgucagcaucgccg

SEQ ID NO: 834159 - RNA, 17 nt, Mycobacterium avium subsp. paratuberculosis
cgucagcaucgccgucg

SEQ ID NO: 834160 - RNA, 15 nt, Mycobacterium avium subsp. paratuberculosis
cgucagccgggccag

SEQ ID NO: 834161 - RNA, 19 nt, Mycobacterium avium subsp. paratuberculosis
cgucagccgggccagcccg

SEQ ID NO: 834162 - RNA, 19 nt, Mycobacterium avium subsp. paratuberculosis
cgucagccccuuaccggcc

SEQ ID NO: 834163 - RNA, 21 nt, Mycobacterium avium subsp. paratuberculosis
cgucagcaccgcgacggugag

SEQ ID NO: 834164 - RNA, 16 nt, Mycobacterium avium subsp. paratuberculosis
cgucagcgucagcacg

SEQ ID NO: 834165 - RNA, 21 nt, Mycobacterium avium subsp. paratuberculosis
cgucagcuaggaagccagccg

SEQ ID NO: 834166 - RNA, 22 nt, Mycobacterium avium subsp. paratuberculosis
cgucagcuaggaagccagccgu

SEQ ID NO: 834167 - RNA, 20 nt, Mycobacterium avium subsp. paratuberculosis
cgucagcucccccgacaccg

SEQ ID NO: 834168 - RNA, 21 nt, Mycobacterium avium subsp. paratuberculosis
cgucagcucccccgacaccgc

SEQ ID NO: 834169 - RNA, 23 nt, Mycobacterium avium subsp. paratuberculosis
cgucagcucccccgacaccgcca

SEQ ID NO: 834170 - RNA, 20 nt, Mycobacterium avium subsp. paratuberculosis
cgucaggcccagcgaggcgg

SEQ ID NO: 834171 - RNA, 17 nt, Mycobacterium avium subsp. paratuberculosis
cgucaggcgcugggugc

SEQ ID NO: 834172 - RNA, 18 nt, Mycobacterium avium subsp. paratuberculosis
cgucagggguuggcgcgc

SEQ ID NO: 834173 - RNA, 20 nt, Mycobacterium avium subsp. paratuberculosis
cgucagggguuggcgcgcag

SEQ ID NO: 834174 - RNA, 17 nt, Mycobacterium avium subsp. paratuberculosis
cgucaggguggccucgu

SEQ ID NO: 834175 - RNA, 20 nt, Mycobacterium avium subsp. paratuberculosis
cgucaggguggccucgucgg

SEQ ID NO: 834176 - RNA, 22 nt, Mycobacterium avium subsp. paratuberculosis
cgucaggguggccucgucggcg

SEQ ID NO: 834177 - RNA, 16 nt, Mycobacterium avium subsp. paratuberculosis
cgucagguccgcgaac

SEQ ID NO: 834178 - RNA, 16 nt, Mycobacterium avium subsp. paratuberculosis
cgucagguccgcgagu

SEQ ID NO: 834179 - RNA, 19 nt, Mycobacterium avium subsp. paratuberculosis
cgucaggucgaccggcucg

SEQ ID NO: 834180 - RNA, 23 nt, Mycobacterium avium subsp. paratuberculosis
cgucaggucgaccggcucgccgu

SEQ ID NO: 834181 - RNA, 16 nt, Mycobacterium avium subsp. paratuberculosis
cgucaggucgcgguag

SEQ ID NO: 834182 - RNA, 19 nt, Mycobacterium avium subsp. paratuberculosis
cgucaggucuucggucgcg

SEQ ID NO: 834183 - RNA, 23 nt, Mycobacterium avium subsp. paratuberculosis
cgucaggucuucggucgcgaccc

SEQ ID NO: 834184 - RNA, 20 nt, Mycobacterium avium subsp. paratuberculosis
cgucaggaaugcgacgacgu

SEQ ID NO: 834185 - RNA, 23 nt, Mycobacterium avium subsp. paratuberculosis
cgucaggaaugcgacgacgucgu

SEQ ID NO: 834186 - RNA, 16 nt, Mycobacterium avium subsp. paratuberculosis
cgucaggaacgccggc

SEQ ID NO: 834187 - RNA, 19 nt, Mycobacterium avium subsp. paratuberculosis
cgucaggaacgccggcuug

SEQ ID NO: 834188 - RNA, 17 nt, Mycobacterium avium subsp. paratuberculosis
cgucaggagugcucggc

SEQ ID NO: 834189 - RNA, 18 nt, Mycobacterium avium subsp. paratuberculosis
cgucaggagugcucggcg

SEQ ID NO: 834190 - RNA, 20 nt, Mycobacterium avium subsp. paratuberculosis
cgucaggccguagcggcucg

SEQ ID NO: 834191 - RNA, 22 nt, Mycobacterium avium subsp. paratuberculosis
cgucagggcgacuccggcgccg

SEQ ID NO: 834192 - RNA, 21 nt, Mycobacterium avium subsp. paratuberculosis
cgucaggccucgaggaucgcg

SEQ ID NO: 834193 - RNA, 15 nt, Mycobacterium avium subsp. paratuberculosis
cgucaggccgugauc

SEQ ID NO: 834194 - RNA, 21 nt, Mycobacterium avium subsp. paratuberculosis
cgucgaaauccacgaugccgg

SEQ ID NO: 834195 - RNA, 22 nt, Mycobacterium avium subsp. paratuberculosis
cgucgaaauccacgaugccggg

SEQ ID NO: 834196 - RNA, 22 nt, Mycobacterium avium subsp. paratuberculosis
cgucgaaaucggguccagcgcc

SEQ ID NO: 834197 - RNA, 23 nt, Mycobacterium avium subsp. paratuberculosis
cgucgaaaucggguccagcgccg

SEQ ID NO: 834198 - RNA, 16 nt, Mycobacterium avium subsp. paratuberculosis
cgucgaccaccgccgg

SEQ ID NO: 834199 - RNA, 18 nt, Mycobacterium avium subsp. paratuberculosis
cgucgaccaccgccggcc

SEQ ID NO: 834200 - RNA, 13 nt, Mycobacterium avium subsp. paratuberculosis
cgucgaccaacgc

SEQ ID NO: 834201 - RNA, 20 nt, Mycobacterium avium subsp. paratuberculosis
cgucgaccaacgccaugggc

SEQ ID NO: 834202 - RNA, 15 nt, Mycobacterium avium subsp. paratuberculosis
cgucgaccaccacga

SEQ ID NO: 834203 - RNA, 16 nt, Mycobacterium avium subsp. paratuberculosis
cgucgaaauagcggcg

SEQ ID NO: 834204 - RNA, 17 nt, Mycobacterium avium subsp. paratuberculosis
cgucgaaauagcggcgc

SEQ ID NO: 834205 - RNA, 13 nt, Mycobacterium avium subsp. paratuberculosis
cgucgaacacccu

SEQ ID NO: 834206 - RNA, 14 nt, Mycobacterium avium subsp. paratuberculosis
cgucgaccagccgg

SEQ ID NO: 834207 - RNA, 22 nt, Mycobacterium avium subsp. paratuberculosis
cgucgaccagcgggcugucggc

SEQ ID NO: 834208 - RNA, 12 nt, Mycobacterium avium subsp. paratuberculosis
cgucgaccagcu

SEQ ID NO: 834209 - RNA, 13 nt, Mycobacterium avium subsp. paratuberculosis
cgucgaccaggac

SEQ ID NO: 834210 - RNA, 14 nt, Mycobacterium avium subsp. paratuberculosis
cgucgaccaggacg

SEQ ID NO: 834211 - RNA, 15 nt, Mycobacterium avium subsp. paratuberculosis
cgucgaccaggacgu

SEQ ID NO: 834212 - RNA, 18 nt, Mycobacterium avium subsp. paratuberculosis
cgucgaccaggacgucgg

SEQ ID NO: 834213 - RNA, 23 nt, Mycobacterium avium subsp. paratuberculosis
cgucgaccaggacgucggccggc

SEQ ID NO: 834214 - RNA, 23 nt, Mycobacterium avium subsp. paratuberculosis
cgucgaccacgaagggcgccagc

SEQ ID NO: 834215 - RNA, 23 nt, Mycobacterium avium subsp. paratuberculosis
cgucgaccagggcgaucaccgcg

SEQ ID NO: 834216 - RNA, 21 nt, Mycobacterium avium subsp. paratuberculosis
cgucgaccagguaggcgcccu

SEQ ID NO: 834217 - RNA, 21 nt, Mycobacterium avium subsp. paratuberculosis
cgucgacccgcuccccgaucc

SEQ ID NO: 834218 - RNA, 21 nt, Mycobacterium avium subsp. paratuberculosis
cgucgacccggccgcgccgga

SEQ ID NO: 834219 - RNA, 23 nt, Mycobacterium avium subsp. paratuberculosis
cgucgacgauggcccggaccgcc

SEQ ID NO: 834220 - RNA, 14 nt, Mycobacterium avium subsp. paratuberculosis
cgucgaccccgccg

SEQ ID NO: 834221 - RNA, 15 nt, Mycobacterium avium subsp. paratuberculosis
cgucgaccccgccgg

SEQ ID NO: 834222 - RNA, 17 nt, Mycobacterium avium subsp. paratuberculosis
cgucgaccccgccggcc

SEQ ID NO: 834223 - RNA, 21 nt, Mycobacterium avium subsp. paratuberculosis
cgucgaccccgccggcccggu

SEQ ID NO: 834224 - RNA, 20 nt, Mycobacterium avium subsp. paratuberculosis
cguccuggcgcuggugcagc

SEQ ID NO: 834225 - RNA, 16 nt, Mycobacterium avium subsp. paratuberculosis
cguccuggacgucguc

SEQ ID NO: 834226 - RNA, 17 nt, Mycobacterium avium subsp. paratuberculosis
cguccuggacgucgucg

SEQ ID NO: 834227 - RNA, 14 nt, Mycobacterium avium subsp. paratuberculosis
cguccuggaucgcg

SEQ ID NO: 834228 - RNA, 21 nt, Mycobacterium avium subsp. paratuberculosis
cguccuggaucgcgcagguga

SEQ ID NO: 834229 - RNA, 16 nt, Mycobacterium avium subsp. paratuberculosis
cguccuggaugaacag

SEQ ID NO: 834230 - RNA, 20 nt, Mycobacterium avium subsp. paratuberculosis
cguccugccaguugucgauc

SEQ ID NO: 834231 - RNA, 22 nt, Mycobacterium avium subsp. paratuberculosis
cguccugcaggcaggccggcag

SEQ ID NO: 834232 - RNA, 22 nt, Mycobacterium avium subsp. paratuberculosis
cgucgaaaaacccggugccggc

SEQ ID NO: 834233 - RNA, 14 nt, Mycobacterium avium subsp. paratuberculosis
cgucgaaacggcug

SEQ ID NO: 834234 - RNA, 16 nt, Mycobacterium avium subsp. paratuberculosis
cgucgaaacggcugcu

SEQ ID NO: 834235 - RNA, 18 nt, Mycobacterium avium subsp. paratuberculosis
cgucgaaacggcugcugc

SEQ ID NO: 834236 - RNA, 21 nt, Mycobacterium avium subsp. paratuberculosis
cguccuugggcuccucgacca

SEQ ID NO: 834237 - RNA, 16 nt, Mycobacterium avium subsp. paratuberculosis
cguccuugucgcgcac

SEQ ID NO: 834238 - RNA, 16 nt, Mycobacterium avium subsp. paratuberculosis
cguccuugacgaacga

SEQ ID NO: 834239 - RNA, 20 nt, Mycobacterium avium subsp. paratuberculosis
cguccuugacgaacgacgug

SEQ ID NO: 834240 - RNA, 14 nt, Mycobacterium avium subsp. paratuberculosis
cguccuugaucagc

SEQ ID NO: 834241 - RNA, 18 nt, Mycobacterium avium subsp. paratuberculosis
cguccuugccgaucagcg

SEQ ID NO: 834242 - RNA, 15 nt, Mycobacterium avium subsp. paratuberculosis
cguccuuggccgcca

SEQ ID NO: 834243 - RNA, 17 nt, Mycobacterium avium subsp. paratuberculosis
cguccuuggccgccagc

SEQ ID NO: 834244 - RNA, 19 nt, Mycobacterium avium subsp. paratuberculosis
cguccuuggccgccagcac

SEQ ID NO: 834245 - RNA, 16 nt, Mycobacterium avium subsp. paratuberculosis
cguccguagugcucgg

SEQ ID NO: 834246 - RNA, 17 nt, Mycobacterium avium subsp. paratuberculosis
cguccguagugcucggc

SEQ ID NO: 834247 - RNA, 19 nt, Mycobacterium avium subsp. paratuberculosis
cguccguagugcucggcgu

SEQ ID NO: 834248 - RNA, 16 nt, Mycobacterium avium subsp. paratuberculosis
cguccgugccguccgg

SEQ ID NO: 834249 - RNA, 19 nt, Mycobacterium avium subsp. paratuberculosis
cguccgugccguccggccg

SEQ ID NO: 834250 - RNA, 14 nt, Mycobacterium avium subsp. paratuberculosis
cguccgugcugccg

SEQ ID NO: 834251 - RNA, 16 nt, Mycobacterium avium subsp. paratuberculosis
cguccgugcugccggc

SEQ ID NO: 834252 - RNA, 17 nt, Mycobacterium avium subsp. paratuberculosis
cguccgugcugccggcc

SEQ ID NO: 834253 - RNA, 18 nt, Mycobacterium avium subsp. paratuberculosis
cguccgugcugccggccg

SEQ ID NO: 834254 - RNA, 22 nt, Mycobacterium avium subsp. paratuberculosis
cguccgugcugccggccggcag

SEQ ID NO: 834255 - RNA, 19 nt, Mycobacterium avium subsp. paratuberculosis
cguccucguucuggcccgc

SEQ ID NO: 834256 - RNA, 21 nt, Mycobacterium avium subsp. paratuberculosis
cguccucguucuggcccgcca

SEQ ID NO: 834257 - RNA, 13 nt, Mycobacterium avium subsp. paratuberculosis
cguccugcagcag

SEQ ID NO: 834258 - RNA, 16 nt, Mycobacterium avium subsp. paratuberculosis
cguccugcagcagccg

SEQ ID NO: 834259 - RNA, 17 nt, Mycobacterium avium subsp. paratuberculosis
cguccugcagcgccguc

SEQ ID NO: 834260 - RNA, 19 nt, Mycobacterium avium subsp. paratuberculosis
cguccugcagcgccguccg

SEQ ID NO: 834261 - RNA, 15 nt, Mycobacterium avium subsp. paratuberculosis
cguccggucgcuggg

SEQ ID NO: 834262 - RNA, 14 nt, Mycobacterium avium subsp. paratuberculosis
cguccggguccggc

SEQ ID NO: 834263 - RNA, 21 nt, Mycobacterium avium subsp. paratuberculosis
cguccggguccggcuucaccg

SEQ ID NO: 834264 - RNA, 19 nt, Mycobacterium avium subsp. paratuberculosis
cguccgggucgcacagccg

SEQ ID NO: 834265 - RNA, 14 nt, Mycobacterium avium subsp. paratuberculosis
cguccgggugcggg

SEQ ID NO: 834266 - RNA, 21 nt, Mycobacterium avium subsp. paratuberculosis
cguccggguucgacgccucgg

SEQ ID NO: 834267 - RNA, 20 nt, Mycobacterium avium subsp. paratuberculosis
cguccgggguguaggcgucg

SEQ ID NO: 834268 - RNA, 21 nt, Mycobacterium avium subsp. paratuberculosis
cguccgggguguaggcgucgg

SEQ ID NO: 834269 - RNA, 22 nt, Mycobacterium avium subsp. paratuberculosis
cguccgggguguaggcgucggc

SEQ ID NO: 834270 - RNA, 23 nt, Mycobacterium avium subsp. paratuberculosis
cguccgggguguaggcgucggcg

SEQ ID NO: 834271 - RNA, 15 nt, Mycobacterium avium subsp. paratuberculosis
cguccgccuccgacc

SEQ ID NO: 834272 - RNA, 21 nt, Mycobacterium avium subsp. paratuberculosis
cguccgcgaacgggugcggcg

SEQ ID NO: 834273 - RNA, 14 nt, Mycobacterium avium subsp. paratuberculosis
cguccgcgacgcug

SEQ ID NO: 834274 - RNA, 17 nt, Mycobacterium avium subsp. paratuberculosis
cguccgaaucguugagc

SEQ ID NO: 834275 - RNA, 15 nt, Mycobacterium avium subsp. paratuberculosis
cguccgacagcgccu

SEQ ID NO: 834276 - RNA, 19 nt, Mycobacterium avium subsp. paratuberculosis
cguccgacaggaugcuggg

SEQ ID NO: 834277 - RNA, 21 nt, Mycobacterium avium subsp. paratuberculosis
cgucccguuggcgccggucga

SEQ ID NO: 834278 - RNA, 15 nt, Mycobacterium avium subsp. paratuberculosis
cgucccuggcgauga

SEQ ID NO: 834279 - RNA, 17 nt, Mycobacterium avium subsp. paratuberculosis
cguccgacggcugggug

SEQ ID NO: 834280 - RNA, 16 nt, Mycobacterium avium subsp. paratuberculosis
cguccgagcagcagcc

SEQ ID NO: 834281 - RNA, 17 nt, Mycobacterium avium subsp. paratuberculosis
cguccgagcagcagccg

SEQ ID NO: 834282 - RNA, 18 nt, Mycobacterium avium subsp. paratuberculosis
cguccgaggccccgccag

SEQ ID NO: 834283 - RNA, 16 nt, Mycobacterium avium subsp. paratuberculosis
cguccgauaccagccg

SEQ ID NO: 834284 - RNA, 18 nt, Mycobacterium avium subsp. paratuberculosis
cguccgauaccagccgcg

SEQ ID NO: 834285 - RNA, 21 nt, Mycobacterium avium subsp. paratuberculosis
cguccgauaccagccgcggac

SEQ ID NO: 834286 - RNA, 15 nt, Mycobacterium avium subsp. paratuberculosis
cguccgcaaccgccg

SEQ ID NO: 834287 - RNA, 20 nt, Mycobacterium avium subsp. paratuberculosis
cguccgcaaccgccggcagc

SEQ ID NO: 834288 - RNA, 21 nt, Mycobacterium avium subsp. paratuberculosis
cguccgcaaccgccggcagcg

SEQ ID NO: 834289 - RNA, 17 nt, Mycobacterium avium subsp. paratuberculosis
cguccgcaagcaccucg

SEQ ID NO: 834290 - RNA, 22 nt, Mycobacterium avium subsp. paratuberculosis
cguccgcagauagaucgacgcg

SEQ ID NO: 834291 - RNA, 16 nt, Mycobacterium avium subsp. paratuberculosis
cguccgccggcggugc

SEQ ID NO: 834292 - RNA, 20 nt, Mycobacterium avium subsp. paratuberculosis
cguccgccccgcugccggac

SEQ ID NO: 834293 - RNA, 16 nt, Mycobacterium avium subsp. paratuberculosis
cgucaguucguagauc

SEQ ID NO: 834294 - RNA, 23 nt, Mycobacterium avium subsp. paratuberculosis
cgucaguucguagaucacggcgu

SEQ ID NO: 834295 - RNA, 15 nt, Mycobacterium avium subsp. paratuberculosis
cgucaucaccgccga

SEQ ID NO: 834296 - RNA, 16 nt, Mycobacterium avium subsp. paratuberculosis
cgucauccggcugccc

SEQ ID NO: 834297 - RNA, 21 nt, Mycobacterium avium subsp. paratuberculosis
cgucaucgacuugccgccgca

SEQ ID NO: 834298 - RNA, 16 nt, Mycobacterium avium subsp. paratuberculosis
cgucaucccccgcagc

SEQ ID NO: 834299 - RNA, 17 nt, Mycobacterium avium subsp. paratuberculosis
cgucaucccccgcagcu

SEQ ID NO: 834300 - RNA, 16 nt, Mycobacterium avium subsp. paratuberculosis
cgucauccccuggccg

SEQ ID NO: 834301 - RNA, 17 nt, Mycobacterium avium subsp. paratuberculosis
cgucauccccuggccga

SEQ ID NO: 834302 - RNA, 13 nt, Mycobacterium avium subsp. paratuberculosis
cguccacggcggu

SEQ ID NO: 834303 - RNA, 22 nt, Mycobacterium avium subsp. paratuberculosis
cguccacguugaugccgcccag

SEQ ID NO: 834304 - RNA, 21 nt, Mycobacterium avium subsp. paratuberculosis
cguccacuccaauacggcccg

SEQ ID NO: 834305 - RNA, 16 nt, Mycobacterium avium subsp. paratuberculosis
cguccagaccggccgg

SEQ ID NO: 834306 - RNA, 21 nt, Mycobacterium avium subsp. paratuberculosis
cguccagaccggccggggcgg

SEQ ID NO: 834307 - RNA, 15 nt, Mycobacterium avium subsp. paratuberculosis
cguccacgcuggcgg

SEQ ID NO: 834308 - RNA, 14 nt, Mycobacterium avium subsp. paratuberculosis
cguccacgccgcgg

SEQ ID NO: 834309 - RNA, 16 nt, Mycobacterium avium subsp. paratuberculosis
cguccacgccgcggga

SEQ ID NO: 834310 - RNA, 17 nt, Mycobacterium avium subsp. paratuberculosis
cguccacgaccccggcg

SEQ ID NO: 834311 - RNA, 18 nt, Mycobacterium avium subsp. paratuberculosis
cguccacgaccccggcgg

SEQ ID NO: 834312 - RNA, 19 nt, Mycobacterium avium subsp. paratuberculosis
cguccacgaccccggcggc

SEQ ID NO: 834313 - RNA, 14 nt, Mycobacterium avium subsp. paratuberculosis
cguccaccagcucg

SEQ ID NO: 834314 - RNA, 13 nt, Mycobacterium avium subsp. paratuberculosis
cguccaccagcac

SEQ ID NO: 834315 - RNA, 16 nt, Mycobacterium avium subsp. paratuberculosis
cguccaccagcaccag

SEQ ID NO: 834316 - RNA, 22 nt, Mycobacterium avium subsp. paratuberculosis
cguccaccagcaccaggcgggu

SEQ ID NO: 834317 - RNA, 17 nt, Mycobacterium avium subsp. paratuberculosis
cguccaccagcacgccg

SEQ ID NO: 834318 - RNA, 14 nt, Mycobacterium avium subsp. paratuberculosis
cguccacaccggga

SEQ ID NO: 834319 - RNA, 19 nt, Mycobacterium avium subsp. paratuberculosis
cguccacaccguugggggu

SEQ ID NO: 834320 - RNA, 21 nt, Mycobacterium avium subsp. paratuberculosis
cguccacaccguugggggucg

SEQ ID NO: 834321 - RNA, 13 nt, Mycobacterium avium subsp. paratuberculosis
cguccacagccgg

SEQ ID NO: 834322 - RNA, 15 nt, Mycobacterium avium subsp. paratuberculosis
cguccacagccggcg

SEQ ID NO: 834323 - RNA, 17 nt, Mycobacterium avium subsp. paratuberculosis
cguccacagccggcggc

SEQ ID NO: 834324 - RNA, 16 nt, Mycobacterium avium subsp. paratuberculosis
cguccaccaccaaccc

SEQ ID NO: 834325 - RNA, 17 nt, Mycobacterium avium subsp. paratuberculosis
cguccaccaccaacccg

SEQ ID NO: 834326 - RNA, 20 nt, Mycobacterium avium subsp. paratuberculosis
cguccaccaccaacccgguc

SEQ ID NO: 834327 - RNA, 15 nt, Mycobacterium avium subsp. paratuberculosis
cguccacccggccca

SEQ ID NO: 834328 - RNA, 16 nt, Mycobacterium avium subsp. paratuberculosis
cguccacccggcccac

SEQ ID NO: 834329 - RNA, 17 nt, Mycobacterium avium subsp. paratuberculosis
cguccaccgacaggucg

SEQ ID NO: 834330 - RNA, 18 nt, Mycobacterium avium subsp. paratuberculosis
cguccaccgacaggucga

SEQ ID NO: 834331 - RNA, 17 nt, Mycobacterium avium subsp. paratuberculosis
cguccaccggauggcgc

SEQ ID NO: 834332 - RNA, 22 nt, Mycobacterium avium subsp. paratuberculosis
cguccaccggauggcgcccggc

SEQ ID NO: 834333 - RNA, 13 nt, Mycobacterium avium subsp. paratuberculosis
cguccaccggcac

SEQ ID NO: 834334 - RNA, 14 nt, Mycobacterium avium subsp. paratuberculosis
cguccaccggcacg

SEQ ID NO: 834335 - RNA, 16 nt, Mycobacterium avium subsp. paratuberculosis
cguccaccggucgacg

SEQ ID NO: 834336 - RNA, 13 nt, Mycobacterium avium subsp. paratuberculosis
cguccaucgccgc

SEQ ID NO: 834337 - RNA, 14 nt, Mycobacterium avium subsp. paratuberculosis
cguccaucgccgcg

SEQ ID NO: 834338 - RNA, 17 nt, Mycobacterium avium subsp. paratuberculosis
cgucccaggguugccgc

SEQ ID NO: 834339 - RNA, 20 nt, Mycobacterium avium subsp. paratuberculosis
cguccaguugcggcacgccg

SEQ ID NO: 834340 - RNA, 20 nt, Mycobacterium avium subsp. paratuberculosis
cguccaucauggcgcugcgc

SEQ ID NO: 834341 - RNA, 16 nt, Mycobacterium avium subsp. paratuberculosis
cguccaguccggcgug

SEQ ID NO: 834342 - RNA, 22 nt, Mycobacterium avium subsp. paratuberculosis
cguccagucgaugucgguggcg

SEQ ID NO: 834343 - RNA, 14 nt, Mycobacterium avium subsp. paratuberculosis
cguccagugacgcc

SEQ ID NO: 834344 - RNA, 23 nt, Mycobacterium avium subsp. paratuberculosis
cguccagugacgccugcggccca

SEQ ID NO: 834345 - RNA, 15 nt, Mycobacterium avium subsp. paratuberculosis
cguccagugcaugcc

SEQ ID NO: 834346 - RNA, 18 nt, Mycobacterium avium subsp. paratuberculosis
cguccauaccccccacgc

SEQ ID NO: 834347 - RNA, 20 nt, Mycobacterium avium subsp. paratuberculosis
cguccauaccccccacgcuc

SEQ ID NO: 834348 - RNA, 18 nt, Mycobacterium avium subsp. paratuberculosis
cguccacgcccagcgccc

SEQ ID NO: 834349 - RNA, 17 nt, Mycobacterium avium subsp. paratuberculosis
cguccagaucggccagc

SEQ ID NO: 834350 - RNA, 18 nt, Mycobacterium avium subsp. paratuberculosis
cguccagaucggccagcg

SEQ ID NO: 834351 - RNA, 12 nt, Mycobacterium avium subsp. paratuberculosis
cguccagcagca

SEQ ID NO: 834352 - RNA, 16 nt, Mycobacterium avium subsp. paratuberculosis
cguccagcaccugcuc

SEQ ID NO: 834353 - RNA, 18 nt, Mycobacterium avium subsp. paratuberculosis
cguccaggugcacccgcg

SEQ ID NO: 834354 - RNA, 22 nt, Mycobacterium avium subsp. paratuberculosis
cguccaggugcacccgcggcgc

SEQ ID NO: 834355 - RNA, 15 nt, Mycobacterium avium subsp. paratuberculosis
cguccaggugcgccg

SEQ ID NO: 834356 - RNA, 15 nt, Mycobacterium avium subsp. paratuberculosis
cguccagggccaccg

SEQ ID NO: 834357 - RNA, 19 nt, Mycobacterium avium subsp. paratuberculosis
cguccaggguggccagcac

SEQ ID NO: 834358 - RNA, 20 nt, Mycobacterium avium subsp. paratuberculosis
cguccaggguggccagcacg

SEQ ID NO: 834359 - RNA, 15 nt, Mycobacterium avium subsp. paratuberculosis
cguccaggucgcccu

SEQ ID NO: 834360 - RNA, 17 nt, Mycobacterium avium subsp. paratuberculosis
cguccaggucgcccucg

SEQ ID NO: 834361 - RNA, 18 nt, Mycobacterium avium subsp. paratuberculosis
cguccaggucgcccucga

SEQ ID NO: 834362 - RNA, 14 nt, Mycobacterium avium subsp. paratuberculosis
cguccccgugcagc

SEQ ID NO: 834363 - RNA, 17 nt, Mycobacterium avium subsp. paratuberculosis
cguccaggugcgccgcc

SEQ ID NO: 834364 - RNA, 17 nt, Mycobacterium avium subsp. paratuberculosis
cguccccgggcgugccg

SEQ ID NO: 834365 - RNA, 18 nt, Mycobacterium avium subsp. paratuberculosis
cgucccagugcucgacca

SEQ ID NO: 834366 - RNA, 14 nt, Mycobacterium avium subsp. paratuberculosis
cguccccaccaccg

SEQ ID NO: 834367 - RNA, 15 nt, Mycobacterium avium subsp. paratuberculosis
cgucccgcccggcgc

SEQ ID NO: 834368 - RNA, 16 nt, Mycobacterium avium subsp. paratuberculosis
cgucccgcccggcgcc

SEQ ID NO: 834369 - RNA, 20 nt, Mycobacterium avium subsp. paratuberculosis
cgucccgcccggcgccggcc

SEQ ID NO: 834370 - RNA, 12 nt, Mycobacterium avium subsp. paratuberculosis
cgucccgcgcgg

SEQ ID NO: 834371 - RNA, 23 nt, Mycobacterium avium subsp. paratuberculosis
cgucccgcgcgggggccgccgcg

SEQ ID NO: 834372 - RNA, 16 nt, Mycobacterium avium subsp. paratuberculosis
cgucccggacgcugcg

SEQ ID NO: 834373 - RNA, 17 nt, Mycobacterium avium subsp. paratuberculosis
cgucccggacgcugcgg

SEQ ID NO: 834374 - RNA, 20 nt, Mycobacterium avium subsp. paratuberculosis
cgucccggcgccucggcgcc

SEQ ID NO: 834375 - RNA, 19 nt, Mycobacterium avium subsp. paratuberculosis
cgucccgguugaccccggc

SEQ ID NO: 834376 - RNA, 18 nt, Mycobacterium avium subsp. paratuberculosis
cgucccgucacggcugcc

SEQ ID NO: 834377 - RNA, 23 nt, Mycobacterium avium subsp. paratuberculosis
cgucccgucacggcugccgaccu

SEQ ID NO: 834378 - RNA, 16 nt, Mycobacterium avium subsp. paratuberculosis
cgucccguccgacggc

SEQ ID NO: 834379 - RNA, 12 nt, Mycobacterium avium subsp. paratuberculosis
cgucccgucgac

SEQ ID NO: 834380 - RNA, 13 nt, Mycobacterium avium subsp. paratuberculosis
cgucccgucgacc

SEQ ID NO: 834381 - RNA, 13 nt, Mycobacterium avium subsp. paratuberculosis
cgucccgucggcc

SEQ ID NO: 834382 - RNA, 15 nt, Mycobacterium avium subsp. paratuberculosis
cgucccgucggccag

SEQ ID NO: 834383 - RNA, 14 nt, Mycobacterium avium subsp. paratuberculosis
cgucccgucggcgc

SEQ ID NO: 834384 - RNA, 16 nt, Mycobacterium avium subsp. paratuberculosis
cgucccgucggcgcga

SEQ ID NO: 834385 - RNA, 13 nt, Mycobacterium avium subsp. paratuberculosis
cgucuccggcggc

SEQ ID NO: 834386 - RNA, 19 nt, Mycobacterium avium subsp. paratuberculosis
cgucuccuggggcagaucg

SEQ ID NO: 834387 - RNA, 19 nt, Mycobacterium avium subsp. paratuberculosis
cgucucgaccacccggcgg

SEQ ID NO: 834388 - RNA, 15 nt, Mycobacterium avium subsp. paratuberculosis
cgucucgacccgggc

SEQ ID NO: 834389 - RNA, 16 nt, Mycobacterium avium subsp. paratuberculosis
cgucucgacccgggcc

SEQ ID NO: 834390 - RNA, 18 nt, Mycobacterium avium subsp. paratuberculosis
cgucucgacccgggccag

SEQ ID NO: 834391 - RNA, 17 nt, Mycobacterium avium subsp. paratuberculosis
cgucucgaccgcggugg

SEQ ID NO: 834392 - RNA, 19 nt, Mycobacterium avium subsp. paratuberculosis
cgucucgacggcgccgacg

SEQ ID NO: 834393 - RNA, 16 nt, Mycobacterium avium subsp. paratuberculosis
cgucucgagccggcgc

SEQ ID NO: 834394 - RNA, 17 nt, Mycobacterium avium subsp. paratuberculosis
cgucucgagccggcgca

SEQ ID NO: 834395 - RNA, 18 nt, Mycobacterium avium subsp. paratuberculosis
cgucucgagccggcgcac

SEQ ID NO: 834396 - RNA, 18 nt, Mycobacterium avium subsp. paratuberculosis
cgucucgagcuuccgccg

SEQ ID NO: 834397 - RNA, 20 nt, Mycobacterium avium subsp. paratuberculosis
cgucucaggaauuugcggcc

SEQ ID NO: 834398 - RNA, 21 nt, Mycobacterium avium subsp. paratuberculosis
cgucucaggaauuugcggccc

SEQ ID NO: 834399 - RNA, 15 nt, Mycobacterium avium subsp. paratuberculosis
cgucucagucggcca

SEQ ID NO: 834400 - RNA, 16 nt, Mycobacterium avium subsp. paratuberculosis
cgucucagucggccac

SEQ ID NO: 834401 - RNA, 17 nt, Mycobacterium avium subsp. paratuberculosis
cgucucagucggccacc

SEQ ID NO: 834402 - RNA, 16 nt, Mycobacterium avium subsp. paratuberculosis
cgucucccacgaacgg

SEQ ID NO: 834403 - RNA, 17 nt, Mycobacterium avium subsp. paratuberculosis
cgucucccccgaucagc

SEQ ID NO: 834404 - RNA, 21 nt, Mycobacterium avium subsp. paratuberculosis
cgucucccccgaucagcguca

SEQ ID NO: 834405 - RNA, 14 nt, Mycobacterium avium subsp. paratuberculosis
cgucucccgggugc

SEQ ID NO: 834406 - RNA, 19 nt, Mycobacterium avium subsp. paratuberculosis
cgucucccgggugcgcguc

SEQ ID NO: 834407 - RNA, 22 nt, Mycobacterium avium subsp. paratuberculosis
cgucucccgggugcgcgucgcg

SEQ ID NO: 834408 - RNA, 17 nt, Mycobacterium avium subsp. paratuberculosis
cgucgucgugcgcgggc

SEQ ID NO: 834409 - RNA, 20 nt, Mycobacterium avium subsp. paratuberculosis
cgucgucgugcgcgggcgaa

SEQ ID NO: 834410 - RNA, 20 nt, Mycobacterium avium subsp. paratuberculosis
cgucguuguuggcggcggug

SEQ ID NO: 834411 - RNA, 16 nt, Mycobacterium avium subsp. paratuberculosis
cgucguuuuccagccg

SEQ ID NO: 834412 - RNA, 20 nt, Mycobacterium avium subsp. paratuberculosis
cgucguuuuccagccggcgc

SEQ ID NO: 834413 - RNA, 20 nt, Mycobacterium avium subsp. paratuberculosis
cgucgucggacagcagcacc

SEQ ID NO: 834414 - RNA, 23 nt, Mycobacterium avium subsp. paratuberculosis
cgucgucggacagcagcaccggc

SEQ ID NO: 834415 - RNA, 14 nt, Mycobacterium avium subsp. paratuberculosis
cgucgucggagacg

SEQ ID NO: 834416 - RNA, 22 nt, Mycobacterium avium subsp. paratuberculosis
cgucguccgcaaccgccggcag

SEQ ID NO: 834417 - RNA, 15 nt, Mycobacterium avium subsp. paratuberculosis
cgucguccggcgcgc

SEQ ID NO: 834418 - RNA, 16 nt, Mycobacterium avium subsp. paratuberculosis
cgucguccggcgcgca

SEQ ID NO: 834419 - RNA, 16 nt, Mycobacterium avium subsp. paratuberculosis
cgucgucccggugaug

SEQ ID NO: 834420 - RNA, 14 nt, Mycobacterium avium subsp. paratuberculosis
cgucgucccgucgg

SEQ ID NO: 834421 - RNA, 15 nt, Mycobacterium avium subsp. paratuberculosis
cgucgucccgucggc

SEQ ID NO: 834422 - RNA, 19 nt, Mycobacterium avium subsp. paratuberculosis
cgucgucccgucggcgcga

SEQ ID NO: 834423 - RNA, 23 nt, Mycobacterium avium subsp. paratuberculosis
cgucgucccgucggcgcgaggcg

SEQ ID NO: 834424 - RNA, 12 nt, Mycobacterium avium subsp. paratuberculosis
cgucgucggccc

SEQ ID NO: 834425 - RNA, 14 nt, Mycobacterium avium subsp. paratuberculosis
cgucgucggccggc

SEQ ID NO: 834426 - RNA, 19 nt, Mycobacterium avium subsp. paratuberculosis
cgucgucggccucggcggc

SEQ ID NO: 834427 - RNA, 13 nt, Mycobacterium avium subsp. paratuberculosis
cgucgucggcgac

SEQ ID NO: 834428 - RNA, 14 nt, Mycobacterium avium subsp. paratuberculosis
cgucgucggcgacg

SEQ ID NO: 834429 - RNA, 16 nt, Mycobacterium avium subsp. paratuberculosis
cgucgucggcgacgac

SEQ ID NO: 834430 - RNA, 17 nt, Mycobacterium avium subsp. paratuberculosis
cgucgucggcgacgacc

SEQ ID NO: 834431 - RNA, 14 nt, Mycobacterium avium subsp. paratuberculosis
cgucgucggcgccg

SEQ ID NO: 834432 - RNA, 15 nt, Mycobacterium avium subsp. paratuberculosis
cgucgucggcgccgc

SEQ ID NO: 834433 - RNA, 23 nt, Mycobacterium avium subsp. paratuberculosis
cgucgucggcgccgcgccggcac

SEQ ID NO: 834434 - RNA, 13 nt, Mycobacterium avium subsp. paratuberculosis
cgucgucggcggg

SEQ ID NO: 834435 - RNA, 14 nt, Mycobacterium avium subsp. paratuberculosis
cgucgucggcgggg

SEQ ID NO: 834436 - RNA, 15 nt, Mycobacterium avium subsp. paratuberculosis
cgucgucggcgggga

SEQ ID NO: 834437 - RNA, 13 nt, Mycobacterium avium subsp. paratuberculosis
cgucgucggugaa

SEQ ID NO: 834438 - RNA, 15 nt, Mycobacterium avium subsp. paratuberculosis
cgucgucggugaugg

SEQ ID NO: 834439 - RNA, 15 nt, Mycobacterium avium subsp. paratuberculosis
cgucgucgucgcucc

SEQ ID NO: 834440 - RNA, 13 nt, Mycobacterium avium subsp. paratuberculosis
cgucgucgucggc

SEQ ID NO: 834441 - RNA, 20 nt, Mycobacterium avium subsp. paratuberculosis
cgucggugccgaagcgccac

SEQ ID NO: 834442 - RNA, 12 nt, Mycobacterium avium subsp. paratuberculosis
cgucggugccgc

SEQ ID NO: 834443 - RNA, 17 nt, Mycobacterium avium subsp. paratuberculosis
cgucggugcgcgccgca

SEQ ID NO: 834444 - RNA, 15 nt, Mycobacterium avium subsp. paratuberculosis
cgucggugggccgcc

SEQ ID NO: 834445 - RNA, 16 nt, Mycobacterium avium subsp. paratuberculosis
cgucggugggccgccg

SEQ ID NO: 834446 - RNA, 20 nt, Mycobacterium avium subsp. paratuberculosis
cgucggugggccgccgcggc

SEQ ID NO: 834447 - RNA, 12 nt, Mycobacterium avium subsp. paratuberculosis
cgucgguggcgg

SEQ ID NO: 834448 - RNA, 13 nt, Mycobacterium avium subsp. paratuberculosis
cgucgguggcggc

SEQ ID NO: 834449 - RNA, 20 nt, Mycobacterium avium subsp. paratuberculosis
cgucgguggcggcggcgacg

SEQ ID NO: 834450 - RNA, 14 nt, Mycobacterium avium subsp. paratuberculosis
cgucgguggcggug

SEQ ID NO: 834451 - RNA, 20 nt, Mycobacterium avium subsp. paratuberculosis
cgucgguggcgguggggccg

SEQ ID NO: 834452 - RNA, 21 nt, Mycobacterium avium subsp. paratuberculosis
cgucggugguccagucgauag

SEQ ID NO: 834453 - RNA, 19 nt, Mycobacterium avium subsp. paratuberculosis
cgucgguguagcccucccg

SEQ ID NO: 834454 - RNA, 21 nt, Mycobacterium avium subsp. paratuberculosis
cgucgguguagcccucccgga

SEQ ID NO: 834455 - RNA, 20 nt, Mycobacterium avium subsp. paratuberculosis
cgucgguguagcgagugccg

SEQ ID NO: 834456 - RNA, 20 nt, Mycobacterium avium subsp. paratuberculosis
cgucgguguagucggcgauc

SEQ ID NO: 834457 - RNA, 23 nt, Mycobacterium avium subsp. paratuberculosis
cgucgguguagucggcgaucggc

SEQ ID NO: 834458 - RNA, 14 nt, Mycobacterium avium subsp. paratuberculosis
cgucgguguccagg

SEQ ID NO: 834459 - RNA, 23 nt, Mycobacterium avium subsp. paratuberculosis
cgucgguguccaggucguuggag

SEQ ID NO: 834460 - RNA, 20 nt, Mycobacterium avium subsp. paratuberculosis
cgucggugucccgcgcccgc

SEQ ID NO: 834461 - RNA, 16 nt, Mycobacterium avium subsp. paratuberculosis
cgucgguuucggucgc

SEQ ID NO: 834462 - RNA, 17 nt, Mycobacterium avium subsp. paratuberculosis
cgucgguuucggucgcg

SEQ ID NO: 834463 - RNA, 19 nt, Mycobacterium avium subsp. paratuberculosis
cgucggugggggccaggcg

SEQ ID NO: 834464 - RNA, 23 nt, Mycobacterium avium subsp. paratuberculosis
cgucgguggggugaggcacccgc

SEQ ID NO: 834465 - RNA, 19 nt, Mycobacterium avium subsp. paratuberculosis
cgucguacaccucggucgg

SEQ ID NO: 834466 - RNA, 22 nt, Mycobacterium avium subsp. paratuberculosis
cgucguacaccucggucgggga

SEQ ID NO: 834467 - RNA, 18 nt, Mycobacterium avium subsp. paratuberculosis
cgucguacagcagccccu

SEQ ID NO: 834468 - RNA, 23 nt, Mycobacterium avium subsp. paratuberculosis
cgucguacagcagccccugcacc

SEQ ID NO: 834469 - RNA, 18 nt, Mycobacterium avium subsp. paratuberculosis
cgucguacucgaccgcga

SEQ ID NO: 834470 - RNA, 22 nt, Mycobacterium avium subsp. paratuberculosis
cgucguccagcuucucggcguc

SEQ ID NO: 834471 - RNA, 16 nt, Mycobacterium avium subsp. paratuberculosis
cgucguccacgcccag

SEQ ID NO: 834472 - RNA, 20 nt, Mycobacterium avium subsp. paratuberculosis
cgucguccacgcccagcgcc

SEQ ID NO: 834473 - RNA, 21 nt, Mycobacterium avium subsp. paratuberculosis
cgucguccacgcccagcgccc

SEQ ID NO: 834474 - RNA, 17 nt, Mycobacterium avium subsp. paratuberculosis
cgucgucagcaccgugg

SEQ ID NO: 834475 - RNA, 14 nt, Mycobacterium avium subsp. paratuberculosis
cgucgucaccucga

SEQ ID NO: 834476 - RNA, 15 nt, Mycobacterium avium subsp. paratuberculosis
cgucgucagccgggc

SEQ ID NO: 834477 - RNA, 18 nt, Mycobacterium avium subsp. paratuberculosis
cgucgucagccgggccag

SEQ ID NO: 834478 - RNA, 21 nt, Mycobacterium avium subsp. paratuberculosis
cgucgucagccgggccagccc

SEQ ID NO: 834479 - RNA, 20 nt, Mycobacterium avium subsp. paratuberculosis
cgucgucaggccgugaucgg

SEQ ID NO: 834480 - RNA, 15 nt, Mycobacterium avium subsp. paratuberculosis
cgucgucagguccgc

SEQ ID NO: 834481 - RNA, 17 nt, Mycobacterium avium subsp. paratuberculosis
cgucguaguugcggccg

SEQ ID NO: 834482 - RNA, 21 nt, Mycobacterium avium subsp. paratuberculosis
cgucguauucgacggcgacca

SEQ ID NO: 834483 - RNA, 17 nt, Mycobacterium avium subsp. paratuberculosis
cgucguaguaacgcgag

SEQ ID NO: 834484 - RNA, 16 nt, Mycobacterium avium subsp. paratuberculosis
cgucguagccgcgggu

SEQ ID NO: 834485 - RNA, 22 nt, Mycobacterium avium subsp. paratuberculosis
cgucguagagcugacgggaccg

SEQ ID NO: 834486 - RNA, 18 nt, Mycobacterium avium subsp. paratuberculosis
cgucgggcaccacggcgg

SEQ ID NO: 834487 - RNA, 20 nt, Mycobacterium avium subsp. paratuberculosis
cgucgggcaccacggcggca

SEQ ID NO: 834488 - RNA, 22 nt, Mycobacterium avium subsp. paratuberculosis
cgucgggcaccacggcggcaug

SEQ ID NO: 834489 - RNA, 18 nt, Mycobacterium avium subsp. paratuberculosis
cgucgggcaccagcaccg

SEQ ID NO: 834490 - RNA, 20 nt, Mycobacterium avium subsp. paratuberculosis
cgucgggaccgucgcgcagc

SEQ ID NO: 834491 - RNA, 24 nt, Mycobacterium avium subsp. paratuberculosis
cgucgggaccgucgcgcagcccga

SEQ ID NO: 834492 - RNA, 16 nt, Mycobacterium avium subsp. paratuberculosis
cgucggcgucgaacgg

SEQ ID NO: 834493 - RNA, 17 nt, Mycobacterium avium subsp. paratuberculosis
cgucgggaacgccgauc

SEQ ID NO: 834494 - RNA, 22 nt, Mycobacterium avium subsp. paratuberculosis
cgucgggaacgccgaucaccgc

SEQ ID NO: 834495 - RNA, 18 nt, Mycobacterium avium subsp. paratuberculosis
cgucgggaacgcgaaccc

SEQ ID NO: 834496 - RNA, 17 nt, Mycobacterium avium subsp. paratuberculosis
cgucgggaaugucggcg

SEQ ID NO: 834497 - RNA, 18 nt, Mycobacterium avium subsp. paratuberculosis
cgucgggaaugucggcgu

SEQ ID NO: 834498 - RNA, 21 nt, Mycobacterium avium subsp. paratuberculosis
cgucgggaaugucggcguugg

SEQ ID NO: 834499 - RNA, 22 nt, Mycobacterium avium subsp. paratuberculosis
cgucggcucguguccgaugacg

SEQ ID NO: 834500 - RNA, 18 nt, Mycobacterium avium subsp. paratuberculosis
cgucggcuuccuccucgg

SEQ ID NO: 834501 - RNA, 20 nt, Mycobacterium avium subsp. paratuberculosis
cgucggcuuccuccucggcg

SEQ ID NO: 834502 - RNA, 24 nt, Mycobacterium avium subsp. paratuberculosis
cgucggcuuccuccucggcgcgga

SEQ ID NO: 834503 - RNA, 15 nt, Mycobacterium avium subsp. paratuberculosis
cgucggcgucgacga

SEQ ID NO: 834504 - RNA, 15 nt, Mycobacterium avium subsp. paratuberculosis
cgucggcgucgggcg

SEQ ID NO: 834505 - RNA, 16 nt, Mycobacterium avium subsp. paratuberculosis
cgucggcgucgggcgg

SEQ ID NO: 834506 - RNA, 17 nt, Mycobacterium avium subsp. paratuberculosis
cgucggcgugcccgccg

SEQ ID NO: 834507 - RNA, 19 nt, Mycobacterium avium subsp. paratuberculosis
cgucggcgugcccgccgac

SEQ ID NO: 834508 - RNA, 14 nt, Mycobacterium avium subsp. paratuberculosis
cgucggcggugccg

SEQ ID NO: 834509 - RNA, 16 nt, Mycobacterium avium subsp. paratuberculosis
cgucggcggugguccg

SEQ ID NO: 834510 - RNA, 21 nt, Mycobacterium avium subsp. paratuberculosis
cgucggcggugguccgcgcga

SEQ ID NO: 834511 - RNA, 13 nt, Mycobacterium avium subsp. paratuberculosis
cgucggcgguguc

SEQ ID NO: 834512 - RNA, 18 nt, Mycobacterium avium subsp. paratuberculosis
cgucggcggugucgaagg

SEQ ID NO: 834513 - RNA, 23 nt, Mycobacterium avium subsp. paratuberculosis
cgucggcggugucgaaggccggg

SEQ ID NO: 834514 - RNA, 20 nt, Mycobacterium avium subsp. paratuberculosis
cgucggcgguuucggugccg

SEQ ID NO: 834515 - RNA, 14 nt, Mycobacterium avium subsp. paratuberculosis
cgucggcguacugc

SEQ ID NO: 834516 - RNA, 19 nt, Mycobacterium avium subsp. paratuberculosis
cgucggcguacugcgcgac

SEQ ID NO: 834517 - RNA, 15 nt, Mycobacterium avium subsp. paratuberculosis
cgucggcggucgcca

SEQ ID NO: 834518 - RNA, 22 nt, Mycobacterium avium subsp. paratuberculosis
cgucggcggucgccagcgccac

SEQ ID NO: 834519 - RNA, 17 nt, Mycobacterium avium subsp. paratuberculosis
cgucggcggucaacacg

SEQ ID NO: 834520 - RNA, 15 nt, Mycobacterium avium subsp. paratuberculosis
cgucggcguagggca

SEQ ID NO: 834521 - RNA, 21 nt, Mycobacterium avium subsp. paratuberculosis
cgucggcguagggcagcccga

SEQ ID NO: 834522 - RNA, 15 nt, Mycobacterium avium subsp. paratuberculosis
cgucggcgggcaccu

SEQ ID NO: 834523 - RNA, 14 nt, Mycobacterium avium subsp. paratuberculosis
cgucggcggcggcc

SEQ ID NO: 834524 - RNA, 14 nt, Mycobacterium avium subsp. paratuberculosis
cgucggcgggcugc

SEQ ID NO: 834525 - RNA, 17 nt, Mycobacterium avium subsp. paratuberculosis
cgucggcggccuugacg

SEQ ID NO: 834526 - RNA, 14 nt, Mycobacterium avium subsp. paratuberculosis
cgucggcggcgacg

SEQ ID NO: 834527 - RNA, 20 nt, Mycobacterium avium subsp. paratuberculosis
cgucggcggccgacccugcg

SEQ ID NO: 834528 - RNA, 15 nt, Mycobacterium avium subsp. paratuberculosis
cgucggcggccgcga

SEQ ID NO: 834529 - RNA, 14 nt, Mycobacterium avium subsp. paratuberculosis
cgucggcgcuggcc

SEQ ID NO: 834530 - RNA, 22 nt, Mycobacterium avium subsp. paratuberculosis
cgucggcgcuuuccaccucgag

SEQ ID NO: 834531 - RNA, 23 nt, Mycobacterium avium subsp. paratuberculosis
cgucggcgcuuuccaccucgagc

SEQ ID NO: 834532 - RNA, 17 nt, Mycobacterium avium subsp. paratuberculosis
cgucggcgcggucgcag

SEQ ID NO: 834533 - RNA, 19 nt, Mycobacterium avium subsp. paratuberculosis
cgucggcgcgugccaacca

SEQ ID NO: 834534 - RNA, 16 nt, Mycobacterium avium subsp. paratuberculosis
cgucggcgcggccgga

SEQ ID NO: 834535 - RNA, 16 nt, Mycobacterium avium subsp. paratuberculosis
cgucggcgcgggccag

SEQ ID NO: 834536 - RNA, 13 nt, Mycobacterium avium subsp. paratuberculosis
cgucggcgcgcuc

SEQ ID NO: 834537 - RNA, 16 nt, Mycobacterium avium subsp. paratuberculosis
cgucggcgcgcucggu

SEQ ID NO: 834538 - RNA, 16 nt, Mycobacterium avium subsp. paratuberculosis
cgucggcgcgcaccgc

SEQ ID NO: 834539 - RNA, 13 nt, Mycobacterium avium subsp. paratuberculosis
cgucggcgcgcca

SEQ ID NO: 834540 - RNA, 18 nt, Mycobacterium avium subsp. paratuberculosis
cgucggcgcgccacccga

SEQ ID NO: 834541 - RNA, 21 nt, Mycobacterium avium subsp. paratuberculosis
cgucggcgaucgccagcacgg

SEQ ID NO: 834542 - RNA, 13 nt, Mycobacterium avium subsp. paratuberculosis
cgucggcgccguc

SEQ ID NO: 834543 - RNA, 14 nt, Mycobacterium avium subsp. paratuberculosis
cgucggcgccgucg

SEQ ID NO: 834544 - RNA, 15 nt, Mycobacterium avium subsp. paratuberculosis
cgucggcgccgucgc

SEQ ID NO: 834545 - RNA, 19 nt, Mycobacterium avium subsp. paratuberculosis
cgucggcgccgucgcggga

SEQ ID NO: 834546 - RNA, 14 nt, Mycobacterium avium subsp. paratuberculosis
cgucggcgccgccg

SEQ ID NO: 834547 - RNA, 16 nt, Mycobacterium avium subsp. paratuberculosis
cgucggcgccgccgag

SEQ ID NO: 834548 - RNA, 17 nt, Mycobacterium avium subsp. paratuberculosis
cgucggcgccgcgccgg

SEQ ID NO: 834549 - RNA, 13 nt, Mycobacterium avium subsp. paratuberculosis
cgucggcgccgga

SEQ ID NO: 834550 - RNA, 13 nt, Mycobacterium avium subsp. paratuberculosis
cgucggcgccggc

SEQ ID NO: 834551 - RNA, 14 nt, Mycobacterium avium subsp. paratuberculosis
cgucggcgccggcc

SEQ ID NO: 834552 - RNA, 15 nt, Mycobacterium avium subsp. paratuberculosis
cgucggcgccggcca

SEQ ID NO: 834553 - RNA, 18 nt, Mycobacterium avium subsp. paratuberculosis
cgucggcgccggcgcgca

SEQ ID NO: 834554 - RNA, 13 nt, Mycobacterium avium subsp. paratuberculosis
cgucggcgcccgg

SEQ ID NO: 834555 - RNA, 12 nt, Mycobacterium avium subsp. paratuberculosis
cgucggcgaugc

SEQ ID NO: 834556 - RNA, 13 nt, Mycobacterium avium subsp. paratuberculosis
cgucggcgaugcg

SEQ ID NO: 834557 - RNA, 14 nt, Mycobacterium avium subsp. paratuberculosis
cgucggcgauggcg

SEQ ID NO: 834558 - RNA, 21 nt, Mycobacterium avium subsp. paratuberculosis
cgucggcgauggcggcgugca

SEQ ID NO: 834559 - RNA, 15 nt, Mycobacterium avium subsp. paratuberculosis
cgucggucacccggu

SEQ ID NO: 834560 - RNA, 16 nt, Mycobacterium avium subsp. paratuberculosis
cgucggucacccgguu

SEQ ID NO: 834561 - RNA, 20 nt, Mycobacterium avium subsp. paratuberculosis
cgucggguacaccgagccgg

SEQ ID NO: 834562 - RNA, 20 nt, Mycobacterium avium subsp. paratuberculosis
cgucgguaguugcacucucg

SEQ ID NO: 834563 - RNA, 16 nt, Mycobacterium avium subsp. paratuberculosis
cgucggucacggacag

SEQ ID NO: 834564 - RNA, 17 nt, Mycobacterium avium subsp. paratuberculosis
cgucggucagcaggcgc

SEQ ID NO: 834565 - RNA, 20 nt, Mycobacterium avium subsp. paratuberculosis
cgucggucagcgagcgguug

SEQ ID NO: 834566 - RNA, 21 nt, Mycobacterium avium subsp. paratuberculosis
cgucggucagcgagcgguugg

SEQ ID NO: 834567 - RNA, 14 nt, Mycobacterium avium subsp. paratuberculosis
cgucggucagcucg

SEQ ID NO: 834568 - RNA, 19 nt, Mycobacterium avium subsp. paratuberculosis
cgucggucaggaacgcgga

SEQ ID NO: 834569 - RNA, 19 nt, Mycobacterium avium subsp. paratuberculosis
cgucgggugucaggucggc

SEQ ID NO: 834570 - RNA, 20 nt, Mycobacterium avium subsp. paratuberculosis
cgucgggugucaggucggcg

SEQ ID NO: 834571 - RNA, 14 nt, Mycobacterium avium subsp. paratuberculosis
cgucggguucgccg

SEQ ID NO: 834572 - RNA, 23 nt, Mycobacterium avium subsp. paratuberculosis
cgucggguucgccggugaccgcg

SEQ ID NO: 834573 - RNA, 19 nt, Mycobacterium avium subsp. paratuberculosis
cgucggguuggccagggcg

SEQ ID NO: 834574 - RNA, 17 nt, Mycobacterium avium subsp. paratuberculosis
cgucggguagggcgccg

SEQ ID NO: 834575 - RNA, 18 nt, Mycobacterium avium subsp. paratuberculosis
cgucggguagggcgccgu

SEQ ID NO: 834576 - RNA, 21 nt, Mycobacterium avium subsp. paratuberculosis
cgucggguagggcgccgucgg

SEQ ID NO: 834577 - RNA, 15 nt, Mycobacterium avium subsp. paratuberculosis
cgucgguaaucggcg

SEQ ID NO: 834578 - RNA, 18 nt, Mycobacterium avium subsp. paratuberculosis
cgucgguaaucggcggug

SEQ ID NO: 834579 - RNA, 22 nt, Mycobacterium avium subsp. paratuberculosis
cgucgguccaaaacaucccgga

SEQ ID NO: 834580 - RNA, 15 nt, Mycobacterium avium subsp. paratuberculosis
cgucgguccaggugg

SEQ ID NO: 834581 - RNA, 22 nt, Mycobacterium avium subsp. paratuberculosis
cgucggucccgacgcggcgcga

SEQ ID NO: 834582 - RNA, 15 nt, Mycobacterium avium subsp. paratuberculosis
cgucggucucgacgu

SEQ ID NO: 834583 - RNA, 20 nt, Mycobacterium avium subsp. paratuberculosis
cgucggucucgacguuggag

SEQ ID NO: 834584 - RNA, 20 nt, Mycobacterium avium subsp. paratuberculosis
cgucggucucuucgacccgg

SEQ ID NO: 834585 - RNA, 21 nt, Mycobacterium avium subsp. paratuberculosis
cgucggucucuucgacccggu

SEQ ID NO: 834586 - RNA, 15 nt, Mycobacterium avium subsp. paratuberculosis
cgucggucugcaggu

SEQ ID NO: 834587 - RNA, 17 nt, Mycobacterium avium subsp. paratuberculosis
cgucggucugcaggucg

SEQ ID NO: 834588 - RNA, 20 nt, Mycobacterium avium subsp. paratuberculosis
cgucggugaacucguccaug

SEQ ID NO: 834589 - RNA, 21 nt, Mycobacterium avium subsp. paratuberculosis
cgucggugaaguuggcggcgg

SEQ ID NO: 834590 - RNA, 23 nt, Mycobacterium avium subsp. paratuberculosis
cgucggugaaguuggcggcggug

SEQ ID NO: 834591 - RNA, 24 nt, Mycobacterium avium subsp. paratuberculosis
cgucggugacggugugcgggucgg

SEQ ID NO: 834592 - RNA, 19 nt, Mycobacterium avium subsp. paratuberculosis
cgucggugaggauuucgcu

SEQ ID NO: 834593 - RNA, 23 nt, Mycobacterium avium subsp. paratuberculosis
cgucggugauggugaccaaccac

SEQ ID NO: 834594 - RNA, 22 nt, Mycobacterium avium subsp. paratuberculosis
cgucggugaugucggugagcgc

SEQ ID NO: 834595 - RNA, 16 nt, Mycobacterium avium subsp. paratuberculosis
cgucggggucgucgcg

SEQ ID NO: 834596 - RNA, 17 nt, Mycobacterium avium subsp. paratuberculosis
cgucggggugcgccagg

SEQ ID NO: 834597 - RNA, 19 nt, Mycobacterium avium subsp. paratuberculosis
cgucggggugcggucggcg

SEQ ID NO: 834598 - RNA, 23 nt, Mycobacterium avium subsp. paratuberculosis
cgucggggugcggucggcgacgu

SEQ ID NO: 834599 - RNA, 18 nt, Mycobacterium avium subsp. paratuberculosis
cgucgggguggccggcca

SEQ ID NO: 834600 - RNA, 13 nt, Mycobacterium avium subsp. paratuberculosis
cgucggguccgac

SEQ ID NO: 834601 - RNA, 16 nt, Mycobacterium avium subsp. paratuberculosis
cgucggguccgaccag

SEQ ID NO: 834602 - RNA, 14 nt, Mycobacterium avium subsp. paratuberculosis
cgucgggucgaagu

SEQ ID NO: 834603 - RNA, 22 nt, Mycobacterium avium subsp. paratuberculosis
cgucgggucgaagugcucgagc

SEQ ID NO: 834604 - RNA, 16 nt, Mycobacterium avium subsp. paratuberculosis
cgucgggucggcgagc

SEQ ID NO: 834605 - RNA, 22 nt, Mycobacterium avium subsp. paratuberculosis
cgucgggucggcgagcagccgc

SEQ ID NO: 834606 - RNA, 14 nt, Mycobacterium avium subsp. paratuberculosis
cgucggggcccggc

SEQ ID NO: 834607 - RNA, 17 nt, Mycobacterium avium subsp. paratuberculosis
cgucggggcccggcccg

SEQ ID NO: 834608 - RNA, 23 nt, Mycobacterium avium subsp. paratuberculosis
cgucggggcccuccgcggcgccg

SEQ ID NO: 834609 - RNA, 14 nt, Mycobacterium avium subsp. paratuberculosis
cgucggggcgccua

SEQ ID NO: 834610 - RNA, 15 nt, Mycobacterium avium subsp. paratuberculosis
cgucggggcgccuac

SEQ ID NO: 834611 - RNA, 15 nt, Mycobacterium avium subsp. paratuberculosis
cgucggggcgucggc

SEQ ID NO: 834612 - RNA, 14 nt, Mycobacterium avium subsp. paratuberculosis
cgucggggcuggcg

SEQ ID NO: 834613 - RNA, 19 nt, Mycobacterium avium subsp. paratuberculosis
cgucggggcuggcggcgaa

SEQ ID NO: 834614 - RNA, 17 nt, Mycobacterium avium subsp. paratuberculosis
cgucgggcgccagcccg

SEQ ID NO: 834615 - RNA, 18 nt, Mycobacterium avium subsp. paratuberculosis
cgucgggcgccagcccgc

SEQ ID NO: 834616 - RNA, 22 nt, Mycobacterium avium subsp. paratuberculosis
cgucgggcgccagcccgcccag

SEQ ID NO: 834617 - RNA, 13 nt, Mycobacterium avium subsp. paratuberculosis
cgucgggggugcc

SEQ ID NO: 834618 - RNA, 14 nt, Mycobacterium avium subsp. paratuberculosis
cgucggggucgcgc

SEQ ID NO: 834619 - RNA, 15 nt, Mycobacterium avium subsp. paratuberculosis
cgucggggucgcgcc

SEQ ID NO: 834620 - RNA, 16 nt, Mycobacterium avium subsp. paratuberculosis
cgucggggucgcgccg

SEQ ID NO: 834621 - RNA, 18 nt, Mycobacterium avium subsp. paratuberculosis
cgucggggucgcgccggu

SEQ ID NO: 834622 - RNA, 14 nt, Mycobacterium avium subsp. paratuberculosis
cgucgggcgccggc

SEQ ID NO: 834623 - RNA, 15 nt, Mycobacterium avium subsp. paratuberculosis
cgucgggcgccggcg

SEQ ID NO: 834624 - RNA, 17 nt, Mycobacterium avium subsp. paratuberculosis
cgucgggcgccggcgcg

SEQ ID NO: 834625 - RNA, 21 nt, Mycobacterium avium subsp. paratuberculosis
cgucgggcgccggcgcguccg

SEQ ID NO: 834626 - RNA, 15 nt, Mycobacterium avium subsp. paratuberculosis
cgucgggcgccgguu

SEQ ID NO: 834627 - RNA, 15 nt, Mycobacterium avium subsp. paratuberculosis
cgucgggcgcggcgg

SEQ ID NO: 834628 - RNA, 17 nt, Mycobacterium avium subsp. paratuberculosis
cgucgggcgcggcggca

SEQ ID NO: 834629 - RNA, 13 nt, Mycobacterium avium subsp. paratuberculosis
cgucgggcgcggu

SEQ ID NO: 834630 - RNA, 15 nt, Mycobacterium avium subsp. paratuberculosis
cgucgggcgcggugu

SEQ ID NO: 834631 - RNA, 15 nt, Mycobacterium avium subsp. paratuberculosis
cgucgggcggcagga

SEQ ID NO: 834632 - RNA, 13 nt, Mycobacterium avium subsp. paratuberculosis
cgucgggcucgcg

SEQ ID NO: 834633 - RNA, 14 nt, Mycobacterium avium subsp. paratuberculosis
cgucgggcucggcc

SEQ ID NO: 834634 - RNA, 18 nt, Mycobacterium avium subsp. paratuberculosis
cgucgggcucggccgccg

SEQ ID NO: 834635 - RNA, 14 nt, Mycobacterium avium subsp. paratuberculosis
cgucgggcucgucg

SEQ ID NO: 834636 - RNA, 19 nt, Mycobacterium avium subsp. paratuberculosis
cgucgggcugggcgggguu

SEQ ID NO: 834637 - RNA, 20 nt, Mycobacterium avium subsp. paratuberculosis
cgucggggacgaagaccggg

SEQ ID NO: 834638 - RNA, 14 nt, Mycobacterium avium subsp. paratuberculosis
cgucggggaucagc

SEQ ID NO: 834639 - RNA, 15 nt, Mycobacterium avium subsp. paratuberculosis
cgucggggaucagcg

SEQ ID NO: 834640 - RNA, 14 nt, Mycobacterium avium subsp. paratuberculosis
cgucggggaugccg

SEQ ID NO: 834641 - RNA, 13 nt, Mycobacterium avium subsp. paratuberculosis
cgucgggccgggg

SEQ ID NO: 834642 - RNA, 11 nt, Mycobacterium avium subsp. paratuberculosis
cgucgggccgu

SEQ ID NO: 834643 - RNA, 18 nt, Mycobacterium avium subsp. paratuberculosis
cgucgggccguccgccgg

SEQ ID NO: 834644 - RNA, 15 nt, Mycobacterium avium subsp. paratuberculosis
cgucgggcaccgcca

SEQ ID NO: 834645 - RNA, 14 nt, Mycobacterium avium subsp. paratuberculosis
cgucgggcaccuga

SEQ ID NO: 834646 - RNA, 16 nt, Mycobacterium avium subsp. paratuberculosis
cgucgccgucaccucg

SEQ ID NO: 834647 - RNA, 12 nt, Mycobacterium avium subsp. paratuberculosis
cgucgccgucca

SEQ ID NO: 834648 - RNA, 15 nt, Mycobacterium avium subsp. paratuberculosis
cgucgccgucggggu

SEQ ID NO: 834649 - RNA, 13 nt, Mycobacterium avium subsp. paratuberculosis
cgucgccgugauc

SEQ ID NO: 834650 - RNA, 20 nt, Mycobacterium avium subsp. paratuberculosis
cgucgccgugcguccagucg

SEQ ID NO: 834651 - RNA, 14 nt, Mycobacterium avium subsp. paratuberculosis
cgucgccguggcgg

SEQ ID NO: 834652 - RNA, 20 nt, Mycobacterium avium subsp. paratuberculosis
cgucgccguggcggcccgac

SEQ ID NO: 834653 - RNA, 23 nt, Mycobacterium avium subsp. paratuberculosis
cgucgccguggcggcccgaccag

SEQ ID NO: 834654 - RNA, 20 nt, Mycobacterium avium subsp. paratuberculosis
cgucgccggugagcacggug

SEQ ID NO: 834655 - RNA, 21 nt, Mycobacterium avium subsp. paratuberculosis
cgucgccggugagcacgguga

SEQ ID NO: 834656 - RNA, 23 nt, Mycobacterium avium subsp. paratuberculosis
cgucgccuccgagauggacagca

SEQ ID NO: 834657 - RNA, 14 nt, Mycobacterium avium subsp. paratuberculosis
cgucgccgccgggc

SEQ ID NO: 834658 - RNA, 14 nt, Mycobacterium avium subsp. paratuberculosis
cgucgccgccggug

SEQ ID NO: 834659 - RNA, 19 nt, Mycobacterium avium subsp. paratuberculosis
cgucgccgccggugccgac

SEQ ID NO: 834660 - RNA, 19 nt, Mycobacterium avium subsp. paratuberculosis
cgucgccgggcgggguggu

SEQ ID NO: 834661 - RNA, 15 nt, Mycobacterium avium subsp. paratuberculosis
cgucgccgggcucag

SEQ ID NO: 834662 - RNA, 19 nt, Mycobacterium avium subsp. paratuberculosis
cgucgccuucuggcugggg

SEQ ID NO: 834663 - RNA, 13 nt, Mycobacterium avium subsp. paratuberculosis
cgucgcgacgagc

SEQ ID NO: 834664 - RNA, 16 nt, Mycobacterium avium subsp. paratuberculosis
cgucgcgacgagcggg

SEQ ID NO: 834665 - RNA, 13 nt, Mycobacterium avium subsp. paratuberculosis
cgucgcgaucgcg

SEQ ID NO: 834666 - RNA, 17 nt, Mycobacterium avium subsp. paratuberculosis
cgucgcgaucgcggucc

SEQ ID NO: 834667 - RNA, 18 nt, Mycobacterium avium subsp. paratuberculosis
cgucgcgaucgcggucca

SEQ ID NO: 834668 - RNA, 18 nt, Mycobacterium avium subsp. paratuberculosis
cgucgcggcgggggucgg

SEQ ID NO: 834669 - RNA, 14 nt, Mycobacterium avium subsp. paratuberculosis
cgucgcggcgguca

SEQ ID NO: 834670 - RNA, 20 nt, Mycobacterium avium subsp. paratuberculosis
cgucgcggcggucacgcccg

SEQ ID NO: 834671 - RNA, 21 nt, Mycobacterium avium subsp. paratuberculosis
cgucgcggcuucagucccgcg

SEQ ID NO: 834672 - RNA, 18 nt, Mycobacterium avium subsp. paratuberculosis
cgucgcgggaaucccacc

SEQ ID NO: 834673 - RNA, 15 nt, Mycobacterium avium subsp. paratuberculosis
cgucgcgaucacacc

SEQ ID NO: 834674 - RNA, 20 nt, Mycobacterium avium subsp. paratuberculosis
cgucgcgggagagcgcgggc

SEQ ID NO: 834675 - RNA, 22 nt, Mycobacterium avium subsp. paratuberculosis
cgucgcgggagagcgcgggcac

SEQ ID NO: 834676 - RNA, 16 nt, Mycobacterium avium subsp. paratuberculosis
cgucgcgggcccgggc

SEQ ID NO: 834677 - RNA, 17 nt, Mycobacterium avium subsp. paratuberculosis
cgucgcgggcccgggcc

SEQ ID NO: 834678 - RNA, 22 nt, Mycobacterium avium subsp. paratuberculosis
cgucgcgggcccgggccacccg

SEQ ID NO: 834679 - RNA, 12 nt, Mycobacterium avium subsp. paratuberculosis
cgucgcgggcga

SEQ ID NO: 834680 - RNA, 14 nt, Mycobacterium avium subsp. paratuberculosis
cgucgccgccgcaa

SEQ ID NO: 834681 - RNA, 15 nt, Mycobacterium avium subsp. paratuberculosis
cgucgcguucgaccc

SEQ ID NO: 834682 - RNA, 15 nt, Mycobacterium avium subsp. paratuberculosis
cgucgcggucggcgu

SEQ ID NO: 834683 - RNA, 16 nt, Mycobacterium avium subsp. paratuberculosis
cgucgcggucggcguc

SEQ ID NO: 834684 - RNA, 21 nt, Mycobacterium avium subsp. paratuberculosis
cgucgcguggcaauucgaccg

SEQ ID NO: 834685 - RNA, 21 nt, Mycobacterium avium subsp. paratuberculosis
cgucgcggugaaguugccgcc

SEQ ID NO: 834686 - RNA, 16 nt, Mycobacterium avium subsp. paratuberculosis
cgucgcgguggagcac

SEQ ID NO: 834687 - RNA, 19 nt, Mycobacterium avium subsp. paratuberculosis
cgucgcgguggagcacagc

SEQ ID NO: 834688 - RNA, 19 nt, Mycobacterium avium subsp. paratuberculosis
cgucgcgguugaucacacc

SEQ ID NO: 834689 - RNA, 23 nt, Mycobacterium avium subsp. paratuberculosis
cgucgcgguugaucacaccgucg

SEQ ID NO: 834690 - RNA, 14 nt, Mycobacterium avium subsp. paratuberculosis
cgucgcguccgagc

SEQ ID NO: 834691 - RNA, 16 nt, Mycobacterium avium subsp. paratuberculosis
cgucgcguccgagcag

SEQ ID NO: 834692 - RNA, 21 nt, Mycobacterium avium subsp. paratuberculosis
cgucgcguccgagcagcagcc

SEQ ID NO: 834693 - RNA, 22 nt, Mycobacterium avium subsp. paratuberculosis
cgucgcguccgagcagcagccg

SEQ ID NO: 834694 - RNA, 19 nt, Mycobacterium avium subsp. paratuberculosis
cgucgcggucagcucgauc

SEQ ID NO: 834695 - RNA, 17 nt, Mycobacterium avium subsp. paratuberculosis
cgucgcgguccacgccg

SEQ ID NO: 834696 - RNA, 18 nt, Mycobacterium avium subsp. paratuberculosis
cgucgcgguccacgccgg

SEQ ID NO: 834697 - RNA, 17 nt, Mycobacterium avium subsp. paratuberculosis
cgucgcgggcgucgggc

SEQ ID NO: 834698 - RNA, 21 nt, Mycobacterium avium subsp. paratuberculosis
cgucgcgggucagcgucgcca

SEQ ID NO: 834699 - RNA, 16 nt, Mycobacterium avium subsp. paratuberculosis
cgucggacaccagcau

SEQ ID NO: 834700 - RNA, 18 nt, Mycobacterium avium subsp. paratuberculosis
cgucggacaccagcaugg

SEQ ID NO: 834701 - RNA, 16 nt, Mycobacterium avium subsp. paratuberculosis
cgucggacagcagcac

SEQ ID NO: 834702 - RNA, 18 nt, Mycobacterium avium subsp. paratuberculosis
cgucggacagcagcaccg

SEQ ID NO: 834703 - RNA, 22 nt, Mycobacterium avium subsp. paratuberculosis
cgucggacagcagcaccggcac

SEQ ID NO: 834704 - RNA, 14 nt, Mycobacterium avium subsp. paratuberculosis
cgucggacaugccg

SEQ ID NO: 834705 - RNA, 15 nt, Mycobacterium avium subsp. paratuberculosis
cgucggacaugccgg

SEQ ID NO: 834706 - RNA, 20 nt, Mycobacterium avium subsp. paratuberculosis
cgucggacaugccggcgccg

SEQ ID NO: 834707 - RNA, 22 nt, Mycobacterium avium subsp. paratuberculosis
cgucggacaugccggcgccgau

SEQ ID NO: 834708 - RNA, 12 nt, Mycobacterium avium subsp. paratuberculosis
cgucggaccccg

SEQ ID NO: 834709 - RNA, 17 nt, Mycobacterium avium subsp. paratuberculosis
cgucggaccccgaugcg

SEQ ID NO: 834710 - RNA, 21 nt, Mycobacterium avium subsp. paratuberculosis
cgucggaccccgaugcgcuca

SEQ ID NO: 834711 - RNA, 17 nt, Mycobacterium avium subsp. paratuberculosis
cgucgcugggcagccgu

SEQ ID NO: 834712 - RNA, 18 nt, Mycobacterium avium subsp. paratuberculosis
cgucgcugggcagccguc

SEQ ID NO: 834713 - RNA, 21 nt, Mycobacterium avium subsp. paratuberculosis
cgucggaaacuuguucgagau

SEQ ID NO: 834714 - RNA, 18 nt, Mycobacterium avium subsp. paratuberculosis
cgucggcgagcagcagcg

SEQ ID NO: 834715 - RNA, 22 nt, Mycobacterium avium subsp. paratuberculosis
cgucggcgagcagcagcgcggu

SEQ ID NO: 834716 - RNA, 17 nt, Mycobacterium avium subsp. paratuberculosis
cgucggcgagcagcugc

SEQ ID NO: 834717 - RNA, 14 nt, Mycobacterium avium subsp. paratuberculosis
cgucggcgagcggu

SEQ ID NO: 834718 - RNA, 18 nt, Mycobacterium avium subsp. paratuberculosis
cgucggcgagcgguucga

SEQ ID NO: 834719 - RNA, 14 nt, Mycobacterium avium subsp. paratuberculosis
cgucggcgaucgcc

SEQ ID NO: 834720 - RNA, 15 nt, Mycobacterium avium subsp. paratuberculosis
cgucggcgaucgccg

SEQ ID NO: 834721 - RNA, 12 nt, Mycobacterium avium subsp. paratuberculosis
cgucggcgaucu

SEQ ID NO: 834722 - RNA, 11 nt, Mycobacterium avium subsp. paratuberculosis
cgucggcgaug

SEQ ID NO: 834723 - RNA, 16 nt, Mycobacterium avium subsp. paratuberculosis
cgucggccuguccggu

SEQ ID NO: 834724 - RNA, 13 nt, Mycobacterium avium subsp. paratuberculosis
cgucggccuugcg

SEQ ID NO: 834725 - RNA, 17 nt, Mycobacterium avium subsp. paratuberculosis
cgucggccuugcgccac

SEQ ID NO: 834726 - RNA, 18 nt, Mycobacterium avium subsp. paratuberculosis
cgucggccugcgcugcgg

SEQ ID NO: 834727 - RNA, 17 nt, Mycobacterium avium subsp. paratuberculosis
cgucggcgaacggccag

SEQ ID NO: 834728 - RNA, 17 nt, Mycobacterium avium subsp. paratuberculosis
cgucggcgaccgcgcgc

SEQ ID NO: 834729 - RNA, 20 nt, Mycobacterium avium subsp. paratuberculosis
cgucggcgaccgcgcgcggc

SEQ ID NO: 834730 - RNA, 21 nt, Mycobacterium avium subsp. paratuberculosis
cgucggcgaccgcgcgcggcg

SEQ ID NO: 834731 - RNA, 14 nt, Mycobacterium avium subsp. paratuberculosis
cgucggcgacgacc

SEQ ID NO: 834732 - RNA, 13 nt, Mycobacterium avium subsp. paratuberculosis
cgucggcgacggc

SEQ ID NO: 834733 - RNA, 20 nt, Mycobacterium avium subsp. paratuberculosis
cgucggccugcacgucggcg

SEQ ID NO: 834734 - RNA, 15 nt, Mycobacterium avium subsp. paratuberculosis
cgucggccugcacga

SEQ ID NO: 834735 - RNA, 14 nt, Mycobacterium avium subsp. paratuberculosis
cgucggccucggcg

SEQ ID NO: 834736 - RNA, 15 nt, Mycobacterium avium subsp. paratuberculosis
cgucggccgucggcg

SEQ ID NO: 834737 - RNA, 18 nt, Mycobacterium avium subsp. paratuberculosis
cgucggccgucggcgccg

SEQ ID NO: 834738 - RNA, 19 nt, Mycobacterium avium subsp. paratuberculosis
cgucggccucggcggccgg

SEQ ID NO: 834739 - RNA, 21 nt, Mycobacterium avium subsp. paratuberculosis
cgucggccucggcggccggga

SEQ ID NO: 834740 - RNA, 16 nt, Mycobacterium avium subsp. paratuberculosis
cgucggccucggcggu

SEQ ID NO: 834741 - RNA, 16 nt, Mycobacterium avium subsp. paratuberculosis
cgucggccuccagccg

SEQ ID NO: 834742 - RNA, 19 nt, Mycobacterium avium subsp. paratuberculosis
cgucggccuccagccggcg

SEQ ID NO: 834743 - RNA, 21 nt, Mycobacterium avium subsp. paratuberculosis
cgucggccuccagccggcgga

SEQ ID NO: 834744 - RNA, 16 nt, Mycobacterium avium subsp. paratuberculosis
cgucggccgggccggc

SEQ ID NO: 834745 - RNA, 22 nt, Mycobacterium avium subsp. paratuberculosis
cgucggccgggcugcccaccac

SEQ ID NO: 834746 - RNA, 12 nt, Mycobacterium avium subsp. paratuberculosis
cgucggccgggg

SEQ ID NO: 834747 - RNA, 14 nt, Mycobacterium avium subsp. paratuberculosis
cgucggccgggggc

SEQ ID NO: 834748 - RNA, 16 nt, Mycobacterium avium subsp. paratuberculosis
cgucggccgggggcgc

SEQ ID NO: 834749 - RNA, 22 nt, Mycobacterium avium subsp. paratuberculosis
cgucggccgggggcgcgggcgg

SEQ ID NO: 834750 - RNA, 16 nt, Mycobacterium avium subsp. paratuberculosis
cgucggccggcaguug

SEQ ID NO: 834751 - RNA, 22 nt, Mycobacterium avium subsp. paratuberculosis
cgucggccggcaguugcggccg

SEQ ID NO: 834752 - RNA, 11 nt, Mycobacterium avium subsp. paratuberculosis
cgucggccggg

SEQ ID NO: 834753 - RNA, 21 nt, Mycobacterium avium subsp. paratuberculosis
cgucggccgcgcgugcccgcg

SEQ ID NO: 834754 - RNA, 16 nt, Mycobacterium avium subsp. paratuberculosis
cgucggccgcgacgac

SEQ ID NO: 834755 - RNA, 14 nt, Mycobacterium avium subsp. paratuberculosis
cgucggccgccagg

SEQ ID NO: 834756 - RNA, 16 nt, Mycobacterium avium subsp. paratuberculosis
cgucggccgccagggc

SEQ ID NO: 834757 - RNA, 14 nt, Mycobacterium avium subsp. paratuberculosis
cgucggccgccgac

SEQ ID NO: 834758 - RNA, 15 nt, Mycobacterium avium subsp. paratuberculosis
cgucggccgccgacu

SEQ ID NO: 834759 - RNA, 21 nt, Mycobacterium avium subsp. paratuberculosis
cgucggcccaguccagucgcg

SEQ ID NO: 834760 - RNA, 13 nt, Mycobacterium avium subsp. paratuberculosis
cgucggcccgcca

SEQ ID NO: 834761 - RNA, 14 nt, Mycobacterium avium subsp. paratuberculosis
cgucggcccgccaa

SEQ ID NO: 834762 - RNA, 22 nt, Mycobacterium avium subsp. paratuberculosis
cgucggccaggaucucgcgggc

SEQ ID NO: 834763 - RNA, 19 nt, Mycobacterium avium subsp. paratuberculosis
cgucggccaguucaccgcg

SEQ ID NO: 834764 - RNA, 18 nt, Mycobacterium avium subsp. paratuberculosis
cgucggccaguucgccgg

SEQ ID NO: 834765 - RNA, 14 nt, Mycobacterium avium subsp. paratuberculosis
cgucggccagcgcg

SEQ ID NO: 834766 - RNA, 14 nt, Mycobacterium avium subsp. paratuberculosis
cgucggccagcgag

SEQ ID NO: 834767 - RNA, 14 nt, Mycobacterium avium subsp. paratuberculosis
cgucggccaccgcg

SEQ ID NO: 834768 - RNA, 15 nt, Mycobacterium avium subsp. paratuberculosis
cgucggccagcgcgc

SEQ ID NO: 834769 - RNA, 17 nt, Mycobacterium avium subsp. paratuberculosis
cgucggccagcgcgcgg

SEQ ID NO: 834770 - RNA, 19 nt, Mycobacterium avium subsp. paratuberculosis
cgucggccagcgcgcgggc

SEQ ID NO: 834771 - RNA, 21 nt, Mycobacterium avium subsp. paratuberculosis
cgucggccagcgcgcgggcgc

SEQ ID NO: 834772 - RNA, 15 nt, Mycobacterium avium subsp. paratuberculosis
cgucggccagcgcgu

SEQ ID NO: 834773 - RNA, 14 nt, Mycobacterium avium subsp. paratuberculosis
cgucggccagcggc

SEQ ID NO: 834774 - RNA, 15 nt, Mycobacterium avium subsp. paratuberculosis
cgucggccagcggca

SEQ ID NO: 834775 - RNA, 19 nt, Mycobacterium avium subsp. paratuberculosis
cgucggccagcggcagcga

SEQ ID NO: 834776 - RNA, 20 nt, Mycobacterium avium subsp. paratuberculosis
cgucggccagcggcagcgac

SEQ ID NO: 834777 - RNA, 23 nt, Mycobacterium avium subsp. paratuberculosis
cgucggccagcggcagcgacagc

SEQ ID NO: 834778 - RNA, 11 nt, Mycobacterium avium subsp. paratuberculosis
cgucggccagc

SEQ ID NO: 834779 - RNA, 16 nt, Mycobacterium avium subsp. paratuberculosis
cgucggccagcaccac

SEQ ID NO: 834780 - RNA, 20 nt, Mycobacterium avium subsp. paratuberculosis
cgucggccagcaccaccaac

SEQ ID NO: 834781 - RNA, 14 nt, Mycobacterium avium subsp. paratuberculosis
cgucggccacgccg

SEQ ID NO: 834782 - RNA, 15 nt, Mycobacterium avium subsp. paratuberculosis
cgucggccacgccgg

SEQ ID NO: 834783 - RNA, 16 nt, Mycobacterium avium subsp. paratuberculosis
cgucggccacgccggg

SEQ ID NO: 834784 - RNA, 13 nt, Mycobacterium avium subsp. paratuberculosis
cgucggccacgcu

SEQ ID NO: 834785 - RNA, 15 nt, Mycobacterium avium subsp. paratuberculosis
cgucggccacgcucg

SEQ ID NO: 834786 - RNA, 18 nt, Mycobacterium avium subsp. paratuberculosis
cgucggccacgcucgcca

SEQ ID NO: 834787 - RNA, 16 nt, Mycobacterium avium subsp. paratuberculosis
cgucggacgcggccga

SEQ ID NO: 834788 - RNA, 18 nt, Mycobacterium avium subsp. paratuberculosis
cgucggaauacagcagcu

SEQ ID NO: 834789 - RNA, 23 nt, Mycobacterium avium subsp. paratuberculosis
cgucggaggacaacgcgucgaac

SEQ ID NO: 834790 - RNA, 18 nt, Mycobacterium avium subsp. paratuberculosis
cgucggagacguugccgc

SEQ ID NO: 834791 - RNA, 18 nt, Mycobacterium avium subsp. paratuberculosis
cgucggagaucaccggca

SEQ ID NO: 834792 - RNA, 21 nt, Mycobacterium avium subsp. paratuberculosis
cgucggagaucaccggcaccc

SEQ ID NO: 834793 - RNA, 20 nt, Mycobacterium avium subsp. paratuberculosis
cgucggagaucagggugcuc

SEQ ID NO: 834794 - RNA, 18 nt, Mycobacterium avium subsp. paratuberculosis
cgucggagaugcgggcca

SEQ ID NO: 834795 - RNA, 14 nt, Mycobacterium avium subsp. paratuberculosis
cgucgccaccaccg

SEQ ID NO: 834796 - RNA, 15 nt, Mycobacterium avium subsp. paratuberculosis
cgucgccaccaccgc

SEQ ID NO: 834797 - RNA, 21 nt, Mycobacterium avium subsp. paratuberculosis
cgucgccaccaccgcgccguc

SEQ ID NO: 834798 - RNA, 14 nt, Mycobacterium avium subsp. paratuberculosis
cgucgccaccaccu

SEQ ID NO: 834799 - RNA, 22 nt, Mycobacterium avium subsp. paratuberculosis
cgucgccaccaccuucaucgcc

SEQ ID NO: 834800 - RNA, 17 nt, Mycobacterium avium subsp. paratuberculosis
cgucgccaccacggcgc

SEQ ID NO: 834801 - RNA, 17 nt, Mycobacterium avium subsp. paratuberculosis
cgucgcccacgccggug

SEQ ID NO: 834802 - RNA, 20 nt, Mycobacterium avium subsp. paratuberculosis
cgucgcccagcgugucggcg

SEQ ID NO: 834803 - RNA, 22 nt, Mycobacterium avium subsp. paratuberculosis
cgucgcccaucaccagcagacc

SEQ ID NO: 834804 - RNA, 21 nt, Mycobacterium avium subsp. paratuberculosis
cgucgcccgaacucauggcgu

SEQ ID NO: 834805 - RNA, 21 nt, Mycobacterium avium subsp. paratuberculosis
cgucgcccgcccaggccgcca

SEQ ID NO: 834806 - RNA, 13 nt, Mycobacterium avium subsp. paratuberculosis
cgucgcccgccga

SEQ ID NO: 834807 - RNA, 19 nt, Mycobacterium avium subsp. paratuberculosis
cgucgcccgccgacggcug

SEQ ID NO: 834808 - RNA, 13 nt, Mycobacterium avium subsp. paratuberculosis
cgucgcccggcgu

SEQ ID NO: 834809 - RNA, 12 nt, Mycobacterium avium subsp. paratuberculosis
cgucgcagcccg

SEQ ID NO: 834810 - RNA, 17 nt, Mycobacterium avium subsp. paratuberculosis
cgucgcagcccgggugc

SEQ ID NO: 834811 - RNA, 19 nt, Mycobacterium avium subsp. paratuberculosis
cgucgcagaucccgccggc

SEQ ID NO: 834812 - RNA, 21 nt, Mycobacterium avium subsp. paratuberculosis
cgucgcagaucccgccggcgg

SEQ ID NO: 834813 - RNA, 19 nt, Mycobacterium avium subsp. paratuberculosis
cgucgcagugcccgcccag

SEQ ID NO: 834814 - RNA, 22 nt, Mycobacterium avium subsp. paratuberculosis
cgucgcagugcccgcccagcug

SEQ ID NO: 834815 - RNA, 17 nt, Mycobacterium avium subsp. paratuberculosis
cgucgauggccaccagg

SEQ ID NO: 834816 - RNA, 19 nt, Mycobacterium avium subsp. paratuberculosis
cgucgauggccaccagguc

SEQ ID NO: 834817 - RNA, 18 nt, Mycobacterium avium subsp. paratuberculosis
cgucgcacagcgccgcgu

SEQ ID NO: 834818 - RNA, 17 nt, Mycobacterium avium subsp. paratuberculosis
cgucgaugggcucgagc

SEQ ID NO: 834819 - RNA, 17 nt, Mycobacterium avium subsp. paratuberculosis
cgucgcaccggcaguga

SEQ ID NO: 834820 - RNA, 18 nt, Mycobacterium avium subsp. paratuberculosis
cgucgcacuagguccggc

SEQ ID NO: 834821 - RNA, 20 nt, Mycobacterium avium subsp. paratuberculosis
cgucgcacuagguccggcgc

SEQ ID NO: 834822 - RNA, 22 nt, Mycobacterium avium subsp. paratuberculosis
cgucgcacuagguccggcgcga

SEQ ID NO: 834823 - RNA, 14 nt, Mycobacterium avium subsp. paratuberculosis
cgucgccgcccccg

SEQ ID NO: 834824 - RNA, 19 nt, Mycobacterium avium subsp. paratuberculosis
cgucgccgcccccgauagc

SEQ ID NO: 834825 - RNA, 17 nt, Mycobacterium avium subsp. paratuberculosis
cgucgccgaucgcccgg

SEQ ID NO: 834826 - RNA, 18 nt, Mycobacterium avium subsp. paratuberculosis
cgucgccgaugcgccgca

SEQ ID NO: 834827 - RNA, 15 nt, Mycobacterium avium subsp. paratuberculosis
cgucgccgauggcgu

SEQ ID NO: 834828 - RNA, 17 nt, Mycobacterium avium subsp. paratuberculosis
cgucgccgagccgcgcc

SEQ ID NO: 834829 - RNA, 18 nt, Mycobacterium avium subsp. paratuberculosis
cgucgccgagccgcgcca

SEQ ID NO: 834830 - RNA, 19 nt, Mycobacterium avium subsp. paratuberculosis
cgucgccgagccgcgccac

SEQ ID NO: 834831 - RNA, 20 nt, Mycobacterium avium subsp. paratuberculosis
cgucgccgagcucgugaugg

SEQ ID NO: 834832 - RNA, 14 nt, Mycobacterium avium subsp. paratuberculosis
cgucgccgaucagc

SEQ ID NO: 834833 - RNA, 19 nt, Mycobacterium avium subsp. paratuberculosis
cgucgccgaucagcaccag

SEQ ID NO: 834834 - RNA, 20 nt, Mycobacterium avium subsp. paratuberculosis
cgucgcccugacacagcacc

SEQ ID NO: 834835 - RNA, 21 nt, Mycobacterium avium subsp. paratuberculosis
cgucgcccugacacagcaccg

SEQ ID NO: 834836 - RNA, 17 nt, Mycobacterium avium subsp. paratuberculosis
cgucgcccgucucggcg

SEQ ID NO: 834837 - RNA, 14 nt, Mycobacterium avium subsp. paratuberculosis
cgucgccgaccagc

SEQ ID NO: 834838 - RNA, 15 nt, Mycobacterium avium subsp. paratuberculosis
cgucgagugugaacc

SEQ ID NO: 834839 - RNA, 13 nt, Mycobacterium avium subsp. paratuberculosis
cgucgaguuguug

SEQ ID NO: 834840 - RNA, 19 nt, Mycobacterium avium subsp. paratuberculosis
cgucgaguuguugggccga

SEQ ID NO: 834841 - RNA, 14 nt, Mycobacterium avium subsp. paratuberculosis
cgucgaguucgccg

SEQ ID NO: 834842 - RNA, 19 nt, Mycobacterium avium subsp. paratuberculosis
cgucgaguucgccgucgac

SEQ ID NO: 834843 - RNA, 21 nt, Mycobacterium avium subsp. paratuberculosis
cgucgaguucgccgucgacgg

SEQ ID NO: 834844 - RNA, 16 nt, Mycobacterium avium subsp. paratuberculosis
cgucgaguucgcggcg

SEQ ID NO: 834845 - RNA, 17 nt, Mycobacterium avium subsp. paratuberculosis
cgucgaguucgcggcgc

SEQ ID NO: 834846 - RNA, 18 nt, Mycobacterium avium subsp. paratuberculosis
cgucgaguucgcggcgca

SEQ ID NO: 834847 - RNA, 21 nt, Mycobacterium avium subsp. paratuberculosis
cgucgaguucgcggcgcagca

SEQ ID NO: 834848 - RNA, 23 nt, Mycobacterium avium subsp. paratuberculosis
cgucgaguucgcggcgcagcacg

SEQ ID NO: 834849 - RNA, 17 nt, Mycobacterium avium subsp. paratuberculosis
cgucgacggcggcgucc

SEQ ID NO: 834850 - RNA, 12 nt, Mycobacterium avium subsp. paratuberculosis
cgucgacggcgu

SEQ ID NO: 834851 - RNA, 10 nt, Mycobacterium avium subsp. paratuberculosis
cgucgacggg

SEQ ID NO: 834852 - RNA, 17 nt, Mycobacterium avium subsp. paratuberculosis
cgucgacgggccaccag

SEQ ID NO: 834853 - RNA, 18 nt, Mycobacterium avium subsp. paratuberculosis
cgucgacgggccaccagc

SEQ ID NO: 834854 - RNA, 19 nt, Mycobacterium avium subsp. paratuberculosis
cgucgacgggccaccagcg

SEQ ID NO: 834855 - RNA, 20 nt, Mycobacterium avium subsp. paratuberculosis
cgucgaguccguggucaggg

SEQ ID NO: 834856 - RNA, 15 nt, Mycobacterium avium subsp. paratuberculosis
cgucgagucggccac

SEQ ID NO: 834857 - RNA, 16 nt, Mycobacterium avium subsp. paratuberculosis
cgucgacgcccaccug

SEQ ID NO: 834858 - RNA, 23 nt, Mycobacterium avium subsp. paratuberculosis
cgucgacgcgugcgucaucgcgc

SEQ ID NO: 834859 - RNA, 17 nt, Mycobacterium avium subsp. paratuberculosis
cgucgacgcugaccgug

SEQ ID NO: 834860 - RNA, 19 nt, Mycobacterium avium subsp. paratuberculosis
cgucgacgcugaccguggu

SEQ ID NO: 834861 - RNA, 14 nt, Mycobacterium avium subsp. paratuberculosis
cgucgacggcagcg

SEQ ID NO: 834862 - RNA, 12 nt, Mycobacterium avium subsp. paratuberculosis
cgucgacggccg

SEQ ID NO: 834863 - RNA, 13 nt, Mycobacterium avium subsp. paratuberculosis
cgucgacggccgc

SEQ ID NO: 834864 - RNA, 17 nt, Mycobacterium avium subsp. paratuberculosis
cgucgacggccgccgcg

SEQ ID NO: 834865 - RNA, 18 nt, Mycobacterium avium subsp. paratuberculosis
cgucgacggccgccgcga

SEQ ID NO: 834866 - RNA, 15 nt, Mycobacterium avium subsp. paratuberculosis
cgucgacggccgcgc

SEQ ID NO: 834867 - RNA, 18 nt, Mycobacterium avium subsp. paratuberculosis
cgucgacggccgcgccga

SEQ ID NO: 834868 - RNA, 20 nt, Mycobacterium avium subsp. paratuberculosis
cgucgacggccgcgccgaac

SEQ ID NO: 834869 - RNA, 14 nt, Mycobacterium avium subsp. paratuberculosis
cgucgacgccgguc

SEQ ID NO: 834870 - RNA, 14 nt, Mycobacterium avium subsp. paratuberculosis
cgucgacgcggucg

SEQ ID NO: 834871 - RNA, 14 nt, Mycobacterium avium subsp. paratuberculosis
cgucgacgcgguga

SEQ ID NO: 834872 - RNA, 12 nt, Mycobacterium avium subsp. paratuberculosis
cgucgacggcgc

SEQ ID NO: 834873 - RNA, 13 nt, Mycobacterium avium subsp. paratuberculosis
cgucgacggcgcc

SEQ ID NO: 834874 - RNA, 15 nt, Mycobacterium avium subsp. paratuberculosis
cgucgacggcgccgg

SEQ ID NO: 834875 - RNA, 13 nt, Mycobacterium avium subsp. paratuberculosis
cgucgaucaccug

SEQ ID NO: 834876 - RNA, 15 nt, Mycobacterium avium subsp. paratuberculosis
cgucgaucaccugcg

SEQ ID NO: 834877 - RNA, 16 nt, Mycobacterium avium subsp. paratuberculosis
cgucgaucacgccgcc

SEQ ID NO: 834878 - RNA, 17 nt, Mycobacterium avium subsp. paratuberculosis
cgucgaucacgccgccg

SEQ ID NO: 834879 - RNA, 18 nt, Mycobacterium avium subsp. paratuberculosis
cgucgaucacgccgccgg

SEQ ID NO: 834880 - RNA, 18 nt, Mycobacterium avium subsp. paratuberculosis
cgucgaugacguccacca

SEQ ID NO: 834881 - RNA, 19 nt, Mycobacterium avium subsp. paratuberculosis
cgucgaugaugccggcgga

SEQ ID NO: 834882 - RNA, 15 nt, Mycobacterium avium subsp. paratuberculosis
cgucgaugcacgccg

SEQ ID NO: 834883 - RNA, 19 nt, Mycobacterium avium subsp. paratuberculosis
cgucgaugcacgccggaau

SEQ ID NO: 834884 - RNA, 21 nt, Mycobacterium avium subsp. paratuberculosis
cgucgaugcccuagcgguggc

SEQ ID NO: 834885 - RNA, 13 nt, Mycobacterium avium subsp. paratuberculosis
cgucgauggcgcg

SEQ ID NO: 834886 - RNA, 18 nt, Mycobacterium avium subsp. paratuberculosis
cgucgauggcgcggccca

SEQ ID NO: 834887 - RNA, 20 nt, Mycobacterium avium subsp. paratuberculosis
cgucgauggcgcggcccagu

SEQ ID NO: 834888 - RNA, 18 nt, Mycobacterium avium subsp. paratuberculosis
cgucgauggacagggcga

SEQ ID NO: 834889 - RNA, 23 nt, Mycobacterium avium subsp. paratuberculosis
cgucgauggacagggcgacaucg

SEQ ID NO: 834890 - RNA, 23 nt, Mycobacterium avium subsp. paratuberculosis
cgucgaugcggaucucggugccg

SEQ ID NO: 834891 - RNA, 15 nt, Mycobacterium avium subsp. paratuberculosis
cgucgaugcgggccc

SEQ ID NO: 834892 - RNA, 18 nt, Mycobacterium avium subsp. paratuberculosis
cgucgaugcgggcccgca

SEQ ID NO: 834893 - RNA, 15 nt, Mycobacterium avium subsp. paratuberculosis
cgucgaugccgauca

SEQ ID NO: 834894 - RNA, 16 nt, Mycobacterium avium subsp. paratuberculosis
cgucgaugccgaucgg

SEQ ID NO: 834895 - RNA, 15 nt, Mycobacterium avium subsp. paratuberculosis
cgucgaugccggcca

SEQ ID NO: 834896 - RNA, 14 nt, Mycobacterium avium subsp. paratuberculosis
cgucgaugccggcg

SEQ ID NO: 834897 - RNA, 20 nt, Mycobacterium avium subsp. paratuberculosis
cgucgaugccggcgauccgc

SEQ ID NO: 834898 - RNA, 21 nt, Mycobacterium avium subsp. paratuberculosis
cgucgaugccggcgauccgcg

SEQ ID NO: 834899 - RNA, 23 nt, Mycobacterium avium subsp. paratuberculosis
cgucgaugccguagaccagcauc

SEQ ID NO: 834900 - RNA, 15 nt, Mycobacterium avium subsp. paratuberculosis
cgucgaugcgcgcca

SEQ ID NO: 834901 - RNA, 16 nt, Mycobacterium avium subsp. paratuberculosis
cgucgaugcgcgccac

SEQ ID NO: 834902 - RNA, 17 nt, Mycobacterium avium subsp. paratuberculosis
cgucgaugcgcgccacc

SEQ ID NO: 834903 - RNA, 19 nt, Mycobacterium avium subsp. paratuberculosis
cgucgaugcgcgccaccag

SEQ ID NO: 834904 - RNA, 16 nt, Mycobacterium avium subsp. paratuberculosis
cgguuucaccgaggcg

SEQ ID NO: 834905 - RNA, 15 nt, Mycobacterium avium subsp. paratuberculosis
cgguuucaccgccgu

SEQ ID NO: 834906 - RNA, 18 nt, Mycobacterium avium subsp. paratuberculosis
cgguuguugcgguccagg

SEQ ID NO: 834907 - RNA, 14 nt, Mycobacterium avium subsp. paratuberculosis
cgguuuccggcgau

SEQ ID NO: 834908 - RNA, 17 nt, Mycobacterium avium subsp. paratuberculosis
cgguuuccaccaccacc

SEQ ID NO: 834909 - RNA, 14 nt, Mycobacterium avium subsp. paratuberculosis
cgguugggccgccg

SEQ ID NO: 834910 - RNA, 15 nt, Mycobacterium avium subsp. paratuberculosis
cgguugggccgccgg

SEQ ID NO: 834911 - RNA, 18 nt, Mycobacterium avium subsp. paratuberculosis
cgguugggccggcgcccg

SEQ ID NO: 834912 - RNA, 12 nt, Mycobacterium avium subsp. paratuberculosis
cgguuggcggcc

SEQ ID NO: 834913 - RNA, 15 nt, Mycobacterium avium subsp. paratuberculosis
cgguuggcccgcggc

SEQ ID NO: 834914 - RNA, 16 nt, Mycobacterium avium subsp. paratuberculosis
cgguuggcccgcggcg

SEQ ID NO: 834915 - RNA, 20 nt, Mycobacterium avium subsp. paratuberculosis
cgguuggcccgcggcgcccg

SEQ ID NO: 834916 - RNA, 21 nt, Mycobacterium avium subsp. paratuberculosis
cgguuggccggaaucgcggga

SEQ ID NO: 834917 - RNA, 18 nt, Mycobacterium avium subsp. paratuberculosis
cgguuggacaggccggcg

SEQ ID NO: 834918 - RNA, 21 nt, Mycobacterium avium subsp. paratuberculosis
cgguuggacaggccggcgacg

SEQ ID NO: 834919 - RNA, 22 nt, Mycobacterium avium subsp. paratuberculosis
cgguuggacaggccggcgacgg

SEQ ID NO: 834920 - RNA, 24 nt, Mycobacterium avium subsp. paratuberculosis
cgguuggacaggccggcgacggcg

SEQ ID NO: 834921 - RNA, 22 nt, Mycobacterium avium subsp. paratuberculosis
cgguuggacaugaagcccccgu

SEQ ID NO: 834922 - RNA, 19 nt, Mycobacterium avium subsp. paratuberculosis
cgguugcggguggcggccg

SEQ ID NO: 834923 - RNA, 17 nt, Mycobacterium avium subsp. paratuberculosis
cgguugcggcgaacgcg

SEQ ID NO: 834924 - RNA, 16 nt, Mycobacterium avium subsp. paratuberculosis
cgguugcuccggcguc

SEQ ID NO: 834925 - RNA, 18 nt, Mycobacterium avium subsp. paratuberculosis
cgguugcuccggcgucga

SEQ ID NO: 834926 - RNA, 16 nt, Mycobacterium avium subsp. paratuberculosis
cgguugcucgucggcc

SEQ ID NO: 834927 - RNA, 20 nt, Mycobacterium avium subsp. paratuberculosis
cgguugcucgucggccgacu

SEQ ID NO: 834928 - RNA, 16 nt, Mycobacterium avium subsp. paratuberculosis
cgguguuuggccgcgc

SEQ ID NO: 834929 - RNA, 19 nt, Mycobacterium avium subsp. paratuberculosis
cgguguuuggccgcgcagc

SEQ ID NO: 834930 - RNA, 17 nt, Mycobacterium avium subsp. paratuberculosis
cgguguugcgcacccgc

SEQ ID NO: 834931 - RNA, 16 nt, Mycobacterium avium subsp. paratuberculosis
cgguguugcgcagcga

SEQ ID NO: 834932 - RNA, 20 nt, Mycobacterium avium subsp. paratuberculosis
cgguguugcgcagcgaacgu

SEQ ID NO: 834933 - RNA, 18 nt, Mycobacterium avium subsp. paratuberculosis
cgguguuggcggcgucgu

SEQ ID NO: 834934 - RNA, 23 nt, Mycobacterium avium subsp. paratuberculosis
cgguucagguggcgucggcgucg

SEQ ID NO: 834935 - RNA, 17 nt, Mycobacterium avium subsp. paratuberculosis
cgguucauccacucggc

SEQ ID NO: 834936 - RNA, 21 nt, Mycobacterium avium subsp. paratuberculosis
cgguucauccacucggccacc

SEQ ID NO: 834937 - RNA, 16 nt, Mycobacterium avium subsp. paratuberculosis
cgguuccaaccaccgu

SEQ ID NO: 834938 - RNA, 16 nt, Mycobacterium avium subsp. paratuberculosis
cgguuccaccgggccg

SEQ ID NO: 834939 - RNA, 15 nt, Mycobacterium avium subsp. paratuberculosis
cgguuccagaccggc

SEQ ID NO: 834940 - RNA, 17 nt, Mycobacterium avium subsp. paratuberculosis
cgguuccagaccggcgg

SEQ ID NO: 834941 - RNA, 19 nt, Mycobacterium avium subsp. paratuberculosis
cgguuccagaccggcggcg

SEQ ID NO: 834942 - RNA, 20 nt, Mycobacterium avium subsp. paratuberculosis
cgguuccagaccggcggcga

SEQ ID NO: 834943 - RNA, 23 nt, Mycobacterium avium subsp. paratuberculosis
cgguuccagaccggcggcgaucg

SEQ ID NO: 834944 - RNA, 14 nt, Mycobacterium avium subsp. paratuberculosis
cgguuccagcggca

SEQ ID NO: 834945 - RNA, 16 nt, Mycobacterium avium subsp. paratuberculosis
cgguuccagcggcacc

SEQ ID NO: 834946 - RNA, 15 nt, Mycobacterium avium subsp. paratuberculosis
cgguugacguagauc

SEQ ID NO: 834947 - RNA, 14 nt, Mycobacterium avium subsp. paratuberculosis
cgguugaacaggcu

SEQ ID NO: 834948 - RNA, 16 nt, Mycobacterium avium subsp. paratuberculosis
cgguugaaggccgcgc

SEQ ID NO: 834949 - RNA, 19 nt, Mycobacterium avium subsp. paratuberculosis
cgguugaaggccgcgcugu

SEQ ID NO: 834950 - RNA, 19 nt, Mycobacterium avium subsp. paratuberculosis
cgguugaccccggccccgg

SEQ ID NO: 834951 - RNA, 23 nt, Mycobacterium avium subsp. paratuberculosis
cgguugaccccggccccggccgg

SEQ ID NO: 834952 - RNA, 18 nt, Mycobacterium avium subsp. paratuberculosis
cgguugacccucagcagg

SEQ ID NO: 834953 - RNA, 14 nt, Mycobacterium avium subsp. paratuberculosis
cgguugaccgccga

SEQ ID NO: 834954 - RNA, 16 nt, Mycobacterium avium subsp. paratuberculosis
cgguugaccgccgaca

SEQ ID NO: 834955 - RNA, 17 nt, Mycobacterium avium subsp. paratuberculosis
cgguugaccgccgacac

SEQ ID NO: 834956 - RNA, 14 nt, Mycobacterium avium subsp. paratuberculosis
cgguucgucguggc

SEQ ID NO: 834957 - RNA, 20 nt, Mycobacterium avium subsp. paratuberculosis
cgguucgucguggccgacgg

SEQ ID NO: 834958 - RNA, 16 nt, Mycobacterium avium subsp. paratuberculosis
cgguucgucgcggcgg

SEQ ID NO: 834959 - RNA, 18 nt, Mycobacterium avium subsp. paratuberculosis
cgguucgucgcggcggcc

SEQ ID NO: 834960 - RNA, 16 nt, Mycobacterium avium subsp. paratuberculosis
cgguucccgugcuggc

SEQ ID NO: 834961 - RNA, 13 nt, Mycobacterium avium subsp. paratuberculosis
cgguucccggcac

SEQ ID NO: 834962 - RNA, 16 nt, Mycobacterium avium subsp. paratuberculosis
cgguucccggcaccac

SEQ ID NO: 834963 - RNA, 21 nt, Mycobacterium avium subsp. paratuberculosis
cgguuccgcgacaucggugac

SEQ ID NO: 834964 - RNA, 14 nt, Mycobacterium avium subsp. paratuberculosis
cgguuccggcgugc

SEQ ID NO: 834965 - RNA, 14 nt, Mycobacterium avium subsp. paratuberculosis
cgguuccucggcgu

SEQ ID NO: 834966 - RNA, 16 nt, Mycobacterium avium subsp. paratuberculosis
cgguuccucggcgugu

SEQ ID NO: 834967 - RNA, 16 nt, Mycobacterium avium subsp. paratuberculosis
cgguucgaccggcguc

SEQ ID NO: 834968 - RNA, 17 nt, Mycobacterium avium subsp. paratuberculosis
cgguucgaccggcguca

SEQ ID NO: 834969 - RNA, 20 nt, Mycobacterium avium subsp. paratuberculosis
cggugucccaguucccggcg

SEQ ID NO: 834970 - RNA, 12 nt, Mycobacterium avium subsp. paratuberculosis
cggugucgacgu

SEQ ID NO: 834971 - RNA, 13 nt, Mycobacterium avium subsp. paratuberculosis
cggugucgagccg

SEQ ID NO: 834972 - RNA, 16 nt, Mycobacterium avium subsp. paratuberculosis
cggugucgaggucguc

SEQ ID NO: 834973 - RNA, 18 nt, Mycobacterium avium subsp. paratuberculosis
cggugucgaggucgucgg

SEQ ID NO: 834974 - RNA, 23 nt, Mycobacterium avium subsp. paratuberculosis
cggugucccgcgcccgcgaacac

SEQ ID NO: 834975 - RNA, 15 nt, Mycobacterium avium subsp. paratuberculosis
cgguguccgcggcgu

SEQ ID NO: 834976 - RNA, 18 nt, Mycobacterium avium subsp. paratuberculosis
cgguguccgcggcgucgg

SEQ ID NO: 834977 - RNA, 14 nt, Mycobacterium avium subsp. paratuberculosis
cgguguccgcgggc

SEQ ID NO: 834978 - RNA, 23 nt, Mycobacterium avium subsp. paratuberculosis
cggugucgaagaccggugcgcgc

SEQ ID NO: 834979 - RNA, 18 nt, Mycobacterium avium subsp. paratuberculosis
cggugucgaaggccgggg

SEQ ID NO: 834980 - RNA, 12 nt, Mycobacterium avium subsp. paratuberculosis
cggugucgccca

SEQ ID NO: 834981 - RNA, 15 nt, Mycobacterium avium subsp. paratuberculosis
cggugucgccgucgc

SEQ ID NO: 834982 - RNA, 17 nt, Mycobacterium avium subsp. paratuberculosis
cggugucgccgucgccg

SEQ ID NO: 834983 - RNA, 19 nt, Mycobacterium avium subsp. paratuberculosis
cggugucgccgucgccgca

SEQ ID NO: 834984 - RNA, 17 nt, Mycobacterium avium subsp. paratuberculosis
cggugucgcucaucccg

SEQ ID NO: 834985 - RNA, 20 nt, Mycobacterium avium subsp. paratuberculosis
cggugucgcuguaggccagc

SEQ ID NO: 834986 - RNA, 22 nt, Mycobacterium avium subsp. paratuberculosis
cggugucgcuguaggccagccc

SEQ ID NO: 834987 - RNA, 17 nt, Mycobacterium avium subsp. paratuberculosis
cggugugaucgagcacc

SEQ ID NO: 834988 - RNA, 20 nt, Mycobacterium avium subsp. paratuberculosis
cggugugaucgagcaccagc

SEQ ID NO: 834989 - RNA, 21 nt, Mycobacterium avium subsp. paratuberculosis
cggugugcagcagcucggcga

SEQ ID NO: 834990 - RNA, 23 nt, Mycobacterium avium subsp. paratuberculosis
cggugugcagcagcucggcgauc

SEQ ID NO: 834991 - RNA, 16 nt, Mycobacterium avium subsp. paratuberculosis
cggugucggggucguc

SEQ ID NO: 834992 - RNA, 17 nt, Mycobacterium avium subsp. paratuberculosis
cggugucggggucgucg

SEQ ID NO: 834993 - RNA, 20 nt, Mycobacterium avium subsp. paratuberculosis
cggugucggggucgucgacg

SEQ ID NO: 834994 - RNA, 14 nt, Mycobacterium avium subsp. paratuberculosis
cggugucggugccg

SEQ ID NO: 834995 - RNA, 18 nt, Mycobacterium avium subsp. paratuberculosis
cggugucggugccgagca

SEQ ID NO: 834996 - RNA, 19 nt, Mycobacterium avium subsp. paratuberculosis
cggugucggugccgagcac

SEQ ID NO: 834997 - RNA, 20 nt, Mycobacterium avium subsp. paratuberculosis
cggugucguaguugcgcgcc

SEQ ID NO: 834998 - RNA, 18 nt, Mycobacterium avium subsp. paratuberculosis
cggugucugaccucgcgc

SEQ ID NO: 834999 - RNA, 19 nt, Mycobacterium avium subsp. paratuberculosis
cggugucugaccucgcgcc

SEQ ID NO: 835000 - RNA, 15 nt, Mycobacterium avium subsp. paratuberculosis
cggugucggugccca

SEQ ID NO: 835001 - RNA, 20 nt, Mycobacterium avium subsp. paratuberculosis
cggugucggugcccaggucg

SEQ ID NO: 835002 - RNA, 15 nt, Mycobacterium avium subsp. paratuberculosis
cgguguggcccaacc

SEQ ID NO: 835003 - RNA, 14 nt, Mycobacterium avium subsp. paratuberculosis
cgguguggccgcgg

SEQ ID NO: 835004 - RNA, 16 nt, Mycobacterium avium subsp. paratuberculosis
cgguguggccgcggug

SEQ ID NO: 835005 - RNA, 15 nt, Mycobacterium avium subsp. paratuberculosis
cggugugggcagcca

SEQ ID NO: 835006 - RNA, 19 nt, Mycobacterium avium subsp. paratuberculosis
cggugugggcgauggcggc

SEQ ID NO: 835007 - RNA, 18 nt, Mycobacterium avium subsp. paratuberculosis
cggugugggucagcgagg

SEQ ID NO: 835008 - RNA, 20 nt, Mycobacterium avium subsp. paratuberculosis
cggugugggucagcgaggcg

SEQ ID NO: 835009 - RNA, 15 nt, Mycobacterium avium subsp. paratuberculosis
cgguguucggcgcca

SEQ ID NO: 835010 - RNA, 15 nt, Mycobacterium avium subsp. paratuberculosis
cgguguucgggucgg

SEQ ID NO: 835011 - RNA, 18 nt, Mycobacterium avium subsp. paratuberculosis
cgguguucgagggcgcgg

SEQ ID NO: 835012 - RNA, 20 nt, Mycobacterium avium subsp. paratuberculosis
cgguguucuugaacggcgcg

SEQ ID NO: 835013 - RNA, 21 nt, Mycobacterium avium subsp. paratuberculosis
cgguguucuugaacggcgcgu

SEQ ID NO: 835014 - RNA, 15 nt, Mycobacterium avium subsp. paratuberculosis
cgguguugagcgcgu

SEQ ID NO: 835015 - RNA, 16 nt, Mycobacterium avium subsp. paratuberculosis
cgguguugccgacggc

SEQ ID NO: 835016 - RNA, 16 nt, Mycobacterium avium subsp. paratuberculosis
cgguguugcgcacccg

SEQ ID NO: 835017 - RNA, 14 nt, Mycobacterium avium subsp. paratuberculosis
cggugugccgaagg

SEQ ID NO: 835018 - RNA, 17 nt, Mycobacterium avium subsp. paratuberculosis
cggugugccgaagggca

SEQ ID NO: 835019 - RNA, 20 nt, Mycobacterium avium subsp. paratuberculosis
cggugugccuggcuccccgg

SEQ ID NO: 835020 - RNA, 22 nt, Mycobacterium avium subsp. paratuberculosis
cggugugccuggcuccccggcg

SEQ ID NO: 835021 - RNA, 14 nt, Mycobacterium avium subsp. paratuberculosis
cggugugcggcggc

SEQ ID NO: 835022 - RNA, 15 nt, Mycobacterium avium subsp. paratuberculosis
cggugugcggcggcu

SEQ ID NO: 835023 - RNA, 17 nt, Mycobacterium avium subsp. paratuberculosis
cggugugcggcggcucg

SEQ ID NO: 835024 - RNA, 21 nt, Mycobacterium avium subsp. paratuberculosis
cggugugcgguucacgcggcu

SEQ ID NO: 835025 - RNA, 12 nt, Mycobacterium avium subsp. paratuberculosis
cggugugcggca

SEQ ID NO: 835026 - RNA, 22 nt, Mycobacterium avium subsp. paratuberculosis
cggugugcggcagcucggcggc

SEQ ID NO: 835027 - RNA, 16 nt, Mycobacterium avium subsp. paratuberculosis
cgguguggaccgcgca

SEQ ID NO: 835028 - RNA, 18 nt, Mycobacterium avium subsp. paratuberculosis
cgguguggaccgcgcagu

SEQ ID NO: 835029 - RNA, 21 nt, Mycobacterium avium subsp. paratuberculosis
cggugugcugacccagcgcgg

SEQ ID NO: 835030 - RNA, 19 nt, Mycobacterium avium subsp. paratuberculosis
cggugguuuugcggcccug

SEQ ID NO: 835031 - RNA, 14 nt, Mycobacterium avium subsp. paratuberculosis
cgguguacagcgcc

SEQ ID NO: 835032 - RNA, 16 nt, Mycobacterium avium subsp. paratuberculosis
cgguguacagcgcgcc

SEQ ID NO: 835033 - RNA, 15 nt, Mycobacterium avium subsp. paratuberculosis
cgguguagacgcggg

SEQ ID NO: 835034 - RNA, 19 nt, Mycobacterium avium subsp. paratuberculosis
cgguguagacgcgggccgg

SEQ ID NO: 835035 - RNA, 23 nt, Mycobacterium avium subsp. paratuberculosis
cgguguagacgcgggccggcacc

SEQ ID NO: 835036 - RNA, 18 nt, Mycobacterium avium subsp. paratuberculosis
cgguguagagcaccucga

SEQ ID NO: 835037 - RNA, 19 nt, Mycobacterium avium subsp. paratuberculosis
cgguguagaucggcucacc

SEQ ID NO: 835038 - RNA, 15 nt, Mycobacterium avium subsp. paratuberculosis
cgguguagcccuccc

SEQ ID NO: 835039 - RNA, 16 nt, Mycobacterium avium subsp. paratuberculosis
cgguguagucggcgau

SEQ ID NO: 835040 - RNA, 15 nt, Mycobacterium avium subsp. paratuberculosis
cgguguagcgagugc

SEQ ID NO: 835041 - RNA, 19 nt, Mycobacterium avium subsp. paratuberculosis
cgguguagcgagugccggc

SEQ ID NO: 835042 - RNA, 20 nt, Mycobacterium avium subsp. paratuberculosis
cgguguagcgagugccggcc

SEQ ID NO: 835043 - RNA, 22 nt, Mycobacterium avium subsp. paratuberculosis
cgguguagcgagugccggccag

SEQ ID NO: 835044 - RNA, 13 nt, Mycobacterium avium subsp. paratuberculosis
cgguguagcggcg

SEQ ID NO: 835045 - RNA, 16 nt, Mycobacterium avium subsp. paratuberculosis
cgguguaggacgccgu

SEQ ID NO: 835046 - RNA, 17 nt, Mycobacterium avium subsp. paratuberculosis
cgguguaggacgccgug

SEQ ID NO: 835047 - RNA, 20 nt, Mycobacterium avium subsp. paratuberculosis
cgguguaggacgccgugcag

SEQ ID NO: 835048 - RNA, 13 nt, Mycobacterium avium subsp. paratuberculosis
cggugucaccgac

SEQ ID NO: 835049 - RNA, 16 nt, Mycobacterium avium subsp. paratuberculosis
cggugucacgcuggcg

SEQ ID NO: 835050 - RNA, 15 nt, Mycobacterium avium subsp. paratuberculosis
cgguggugucgacgg

SEQ ID NO: 835051 - RNA, 20 nt, Mycobacterium avium subsp. paratuberculosis
cgguguccacgaugcggugc

SEQ ID NO: 835052 - RNA, 17 nt, Mycobacterium avium subsp. paratuberculosis
cgguguccacgucgccc

SEQ ID NO: 835053 - RNA, 18 nt, Mycobacterium avium subsp. paratuberculosis
cgguguccacgucgccca

SEQ ID NO: 835054 - RNA, 14 nt, Mycobacterium avium subsp. paratuberculosis
cgguguccaggucg

SEQ ID NO: 835055 - RNA, 12 nt, Mycobacterium avium subsp. paratuberculosis
cgguggugccgc

SEQ ID NO: 835056 - RNA, 18 nt, Mycobacterium avium subsp. paratuberculosis
cgguggugccgccgucga

SEQ ID NO: 835057 - RNA, 21 nt, Mycobacterium avium subsp. paratuberculosis
cgguggugccgccgucgacga

SEQ ID NO: 835058 - RNA, 16 nt, Mycobacterium avium subsp. paratuberculosis
cgguggugauggacgg

SEQ ID NO: 835059 - RNA, 13 nt, Mycobacterium avium subsp. paratuberculosis
cgguggugacggu

SEQ ID NO: 835060 - RNA, 21 nt, Mycobacterium avium subsp. paratuberculosis
cgguggucagcggcgccaccg

SEQ ID NO: 835061 - RNA, 20 nt, Mycobacterium avium subsp. paratuberculosis
cgguggugucgucgggccgc

SEQ ID NO: 835062 - RNA, 12 nt, Mycobacterium avium subsp. paratuberculosis
cggugguguggc

SEQ ID NO: 835063 - RNA, 22 nt, Mycobacterium avium subsp. paratuberculosis
cggugguguggcagguggcgua

SEQ ID NO: 835064 - RNA, 22 nt, Mycobacterium avium subsp. paratuberculosis
cggugguuaccagcucaccggg

SEQ ID NO: 835065 - RNA, 15 nt, Mycobacterium avium subsp. paratuberculosis
cggugguggggccgg

SEQ ID NO: 835066 - RNA, 16 nt, Mycobacterium avium subsp. paratuberculosis
cggugguggggccggc

SEQ ID NO: 835067 - RNA, 21 nt, Mycobacterium avium subsp. paratuberculosis
cgguggugggguccgcaggcg

SEQ ID NO: 835068 - RNA, 18 nt, Mycobacterium avium subsp. paratuberculosis
cgguggugguggucucga

SEQ ID NO: 835069 - RNA, 18 nt, Mycobacterium avium subsp. paratuberculosis
cgguggugcucgccccgc

SEQ ID NO: 835070 - RNA, 13 nt, Mycobacterium avium subsp. paratuberculosis
cgguggugggcgc

SEQ ID NO: 835071 - RNA, 15 nt, Mycobacterium avium subsp. paratuberculosis
cgguggugggcgcgg

SEQ ID NO: 835072 - RNA, 16 nt, Mycobacterium avium subsp. paratuberculosis
cgguggugggcgcggu

SEQ ID NO: 835073 - RNA, 23 nt, Mycobacterium avium subsp. paratuberculosis
cggugcgccacgcccgcagcgca

SEQ ID NO: 835074 - RNA, 14 nt, Mycobacterium avium subsp. paratuberculosis
cggugcgccggcag

SEQ ID NO: 835075 - RNA, 15 nt, Mycobacterium avium subsp. paratuberculosis
cggugcgccggcagc

SEQ ID NO: 835076 - RNA, 18 nt, Mycobacterium avium subsp. paratuberculosis
cggugcgccggcagcggc

SEQ ID NO: 835077 - RNA, 15 nt, Mycobacterium avium subsp. paratuberculosis
cggugcgcccgucgu

SEQ ID NO: 835078 - RNA, 19 nt, Mycobacterium avium subsp. paratuberculosis
cggugcgcccgucgucgcc

SEQ ID NO: 835079 - RNA, 21 nt, Mycobacterium avium subsp. paratuberculosis
cggugcgcccgucgucgccga

SEQ ID NO: 835080 - RNA, 23 nt, Mycobacterium avium subsp. paratuberculosis
cggugcgcccgucgucgccgaug

SEQ ID NO: 835081 - RNA, 12 nt, Mycobacterium avium subsp. paratuberculosis
cggugcgccgac

SEQ ID NO: 835082 - RNA, 15 nt, Mycobacterium avium subsp. paratuberculosis
cggugcgccgacagc

SEQ ID NO: 835083 - RNA, 16 nt, Mycobacterium avium subsp. paratuberculosis
cggugcgccgacagcu

SEQ ID NO: 835084 - RNA, 17 nt, Mycobacterium avium subsp. paratuberculosis
cggugcgccgacagcug

SEQ ID NO: 835085 - RNA, 13 nt, Mycobacterium avium subsp. paratuberculosis
cggugcgccgacc

SEQ ID NO: 835086 - RNA, 14 nt, Mycobacterium avium subsp. paratuberculosis
cggugcgccgaccg

SEQ ID NO: 835087 - RNA, 17 nt, Mycobacterium avium subsp. paratuberculosis
cggugcgcagccgcugc

SEQ ID NO: 835088 - RNA, 17 nt, Mycobacterium avium subsp. paratuberculosis
cggugcgcagucgcugg

SEQ ID NO: 835089 - RNA, 21 nt, Mycobacterium avium subsp. paratuberculosis
cggugcgccagaucagcgugg

SEQ ID NO: 835090 - RNA, 22 nt, Mycobacterium avium subsp. paratuberculosis
cggugcgccagaucagcguggu

SEQ ID NO: 835091 - RNA, 23 nt, Mycobacterium avium subsp. paratuberculosis
cggugcgccagaucagcgugguc

SEQ ID NO: 835092 - RNA, 13 nt, Mycobacterium avium subsp. paratuberculosis
cggugcgccagcg

SEQ ID NO: 835093 - RNA, 15 nt, Mycobacterium avium subsp. paratuberculosis
cggugcgccagcgcc

SEQ ID NO: 835094 - RNA, 16 nt, Mycobacterium avium subsp. paratuberculosis
cggugcgccagcguga

SEQ ID NO: 835095 - RNA, 23 nt, Mycobacterium avium subsp. paratuberculosis
cggugcgcccagguacuccucgg

SEQ ID NO: 835096 - RNA, 15 nt, Mycobacterium avium subsp. paratuberculosis
cggugcgcagcacgu

SEQ ID NO: 835097 - RNA, 21 nt, Mycobacterium avium subsp. paratuberculosis
cggugccgguguugccgacgg

SEQ ID NO: 835098 - RNA, 20 nt, Mycobacterium avium subsp. paratuberculosis
cggugcgaugguggucgccg

SEQ ID NO: 835099 - RNA, 22 nt, Mycobacterium avium subsp. paratuberculosis
cggugcgaugguggucgccguc

SEQ ID NO: 835100 - RNA, 18 nt, Mycobacterium avium subsp. paratuberculosis
cggugcgggugguguggc

SEQ ID NO: 835101 - RNA, 11 nt, Mycobacterium avium subsp. paratuberculosis
cggugcggguc

SEQ ID NO: 835102 - RNA, 15 nt, Mycobacterium avium subsp. paratuberculosis
cggugcgggugccga

SEQ ID NO: 835103 - RNA, 17 nt, Mycobacterium avium subsp. paratuberculosis
cggugcgggugccgaac

SEQ ID NO: 835104 - RNA, 13 nt, Mycobacterium avium subsp. paratuberculosis
cggugcggcucgg

SEQ ID NO: 835105 - RNA, 21 nt, Mycobacterium avium subsp. paratuberculosis
cggugcggaugaagugcgcca

SEQ ID NO: 835106 - RNA, 23 nt, Mycobacterium avium subsp. paratuberculosis
cggugcggaugaagugcgccagc

SEQ ID NO: 835107 - RNA, 16 nt, Mycobacterium avium subsp. paratuberculosis
cggugcggcccgcggc

SEQ ID NO: 835108 - RNA, 21 nt, Mycobacterium avium subsp. paratuberculosis
cggugcggcccgcggcaucgu

SEQ ID NO: 835109 - RNA, 13 nt, Mycobacterium avium subsp. paratuberculosis
cggugcggccgcg

SEQ ID NO: 835110 - RNA, 16 nt, Mycobacterium avium subsp. paratuberculosis
cggugcggccgcgcag

SEQ ID NO: 835111 - RNA, 21 nt, Mycobacterium avium subsp. paratuberculosis
cggugcggccgcgcagcucga

SEQ ID NO: 835112 - RNA, 12 nt, Mycobacterium avium subsp. paratuberculosis
cggugcggccuc

SEQ ID NO: 835113 - RNA, 14 nt, Mycobacterium avium subsp. paratuberculosis
cggugcggccucga

SEQ ID NO: 835114 - RNA, 21 nt, Mycobacterium avium subsp. paratuberculosis
cggugcgcucgugaccggcgg

SEQ ID NO: 835115 - RNA, 14 nt, Mycobacterium avium subsp. paratuberculosis
cggugcgcuccucg

SEQ ID NO: 835116 - RNA, 17 nt, Mycobacterium avium subsp. paratuberculosis
cggugcgcuccucgacg

SEQ ID NO: 835117 - RNA, 20 nt, Mycobacterium avium subsp. paratuberculosis
cggugcggaaggcccccggc

SEQ ID NO: 835118 - RNA, 19 nt, Mycobacterium avium subsp. paratuberculosis
cggugcgcgaguaggcgaa

SEQ ID NO: 835119 - RNA, 15 nt, Mycobacterium avium subsp. paratuberculosis
cggugcgccgguagc

SEQ ID NO: 835120 - RNA, 16 nt, Mycobacterium avium subsp. paratuberculosis
cggugcgcgcaccagg

SEQ ID NO: 835121 - RNA, 12 nt, Mycobacterium avium subsp. paratuberculosis
cggugcgcgccg

SEQ ID NO: 835122 - RNA, 18 nt, Mycobacterium avium subsp. paratuberculosis
cggugcgcgcgcgcucgg

SEQ ID NO: 835123 - RNA, 13 nt, Mycobacterium avium subsp. paratuberculosis
cggugcgcggcga

SEQ ID NO: 835124 - RNA, 14 nt, Mycobacterium avium subsp. paratuberculosis
cggugcgcggcgaa

SEQ ID NO: 835125 - RNA, 18 nt, Mycobacterium avium subsp. paratuberculosis
cggugcgcgggguggcgc

SEQ ID NO: 835126 - RNA, 20 nt, Mycobacterium avium subsp. paratuberculosis
cggugcgcgggguggcgccg

SEQ ID NO: 835127 - RNA, 21 nt, Mycobacterium avium subsp. paratuberculosis
cggugcgcgggguggcgccgg

SEQ ID NO: 835128 - RNA, 23 nt, Mycobacterium avium subsp. paratuberculosis
cggugcgcgggguggcgccggcc

SEQ ID NO: 835129 - RNA, 16 nt, Mycobacterium avium subsp. paratuberculosis
cggugcucgcgccggg

SEQ ID NO: 835130 - RNA, 20 nt, Mycobacterium avium subsp. paratuberculosis
cggugcucgcgccgggcggc

SEQ ID NO: 835131 - RNA, 21 nt, Mycobacterium avium subsp. paratuberculosis
cggugcuggucaugccgucga

SEQ ID NO: 835132 - RNA, 16 nt, Mycobacterium avium subsp. paratuberculosis
cggugcugacccgguc

SEQ ID NO: 835133 - RNA, 18 nt, Mycobacterium avium subsp. paratuberculosis
cggugcugacccggucgc

SEQ ID NO: 835134 - RNA, 21 nt, Mycobacterium avium subsp. paratuberculosis
cggugcugacccggucgcggc

SEQ ID NO: 835135 - RNA, 23 nt, Mycobacterium avium subsp. paratuberculosis
cggugcugcagauccgcucgccg

SEQ ID NO: 835136 - RNA, 16 nt, Mycobacterium avium subsp. paratuberculosis
cggugcugcagcgcga

SEQ ID NO: 835137 - RNA, 20 nt, Mycobacterium avium subsp. paratuberculosis
cggugcugcagcgcgaggcg

SEQ ID NO: 835138 - RNA, 21 nt, Mycobacterium avium subsp. paratuberculosis
cggugcucuugacggccgcgg

SEQ ID NO: 835139 - RNA, 22 nt, Mycobacterium avium subsp. paratuberculosis
cggugcucuugacggccgcggc

SEQ ID NO: 835140 - RNA, 14 nt, Mycobacterium avium subsp. paratuberculosis
cggugcucggcgcg

SEQ ID NO: 835141 - RNA, 16 nt, Mycobacterium avium subsp. paratuberculosis
cggugcucggcgcgcg

SEQ ID NO: 835142 - RNA, 23 nt, Mycobacterium avium subsp. paratuberculosis
cggugcucggcgcgcggggccgg

SEQ ID NO: 835143 - RNA, 23 nt, Mycobacterium avium subsp. paratuberculosis
cggugcucgucgagcauccggcg

SEQ ID NO: 835144 - RNA, 15 nt, Mycobacterium avium subsp. paratuberculosis
cggugcucucgucgu

SEQ ID NO: 835145 - RNA, 18 nt, Mycobacterium avium subsp. paratuberculosis
cggugcucucgucgucgg

SEQ ID NO: 835146 - RNA, 20 nt, Mycobacterium avium subsp. paratuberculosis
cggugcucucgucgucggcg

SEQ ID NO: 835147 - RNA, 14 nt, Mycobacterium avium subsp. paratuberculosis
cggugcgucgggcg

SEQ ID NO: 835148 - RNA, 15 nt, Mycobacterium avium subsp. paratuberculosis
cggugcgucgggcgc

SEQ ID NO: 835149 - RNA, 18 nt, Mycobacterium avium subsp. paratuberculosis
cggugcgucgggcgccgg

SEQ ID NO: 835150 - RNA, 19 nt, Mycobacterium avium subsp. paratuberculosis
cggugcgucgggcgccggc

SEQ ID NO: 835151 - RNA, 24 nt, Mycobacterium avium subsp. paratuberculosis
cggugcgucgggcgccggcgcguc

SEQ ID NO: 835152 - RNA, 17 nt, Mycobacterium avium subsp. paratuberculosis
cggugcgugccagcagc

SEQ ID NO: 835153 - RNA, 18 nt, Mycobacterium avium subsp. paratuberculosis
cggugcgugccagcagcu

SEQ ID NO: 835154 - RNA, 23 nt, Mycobacterium avium subsp. paratuberculosis
cggugcucccccggaccugccgg

SEQ ID NO: 835155 - RNA, 15 nt, Mycobacterium avium subsp. paratuberculosis
cggugcggugcgccg

SEQ ID NO: 835156 - RNA, 16 nt, Mycobacterium avium subsp. paratuberculosis
cggugcggugcgccgc

SEQ ID NO: 835157 - RNA, 22 nt, Mycobacterium avium subsp. paratuberculosis
cggugcgguaggugccggccgc

SEQ ID NO: 835158 - RNA, 15 nt, Mycobacterium avium subsp. paratuberculosis
cggugcguccgccgg

SEQ ID NO: 835159 - RNA, 17 nt, Mycobacterium avium subsp. paratuberculosis
cggugcguccgccggcg

SEQ ID NO: 835160 - RNA, 16 nt, Mycobacterium avium subsp. paratuberculosis
cggugcuggcgaugug

SEQ ID NO: 835161 - RNA, 23 nt, Mycobacterium avium subsp. paratuberculosis
cggugcuuggcguugaugucggc

SEQ ID NO: 835162 - RNA, 13 nt, Mycobacterium avium subsp. paratuberculosis
cgguggacccgac

SEQ ID NO: 835163 - RNA, 24 nt, Mycobacterium avium subsp. paratuberculosis
cgguggacuccagcaccagcacgg

SEQ ID NO: 835164 - RNA, 13 nt, Mycobacterium avium subsp. paratuberculosis
cgguggacgccgc

SEQ ID NO: 835165 - RNA, 14 nt, Mycobacterium avium subsp. paratuberculosis
cgguggacgcgaug

SEQ ID NO: 835166 - RNA, 20 nt, Mycobacterium avium subsp. paratuberculosis
cgguggacgcggucgccgcc

SEQ ID NO: 835167 - RNA, 21 nt, Mycobacterium avium subsp. paratuberculosis
cgguggaauucuggccgaccg

SEQ ID NO: 835168 - RNA, 12 nt, Mycobacterium avium subsp. paratuberculosis
cgguggacagcg

SEQ ID NO: 835169 - RNA, 13 nt, Mycobacterium avium subsp. paratuberculosis
cgguggacagcgc

SEQ ID NO: 835170 - RNA, 14 nt, Mycobacterium avium subsp. paratuberculosis
cgguggacagcgcg

SEQ ID NO: 835171 - RNA, 18 nt, Mycobacterium avium subsp. paratuberculosis
cgguggacagcgcgacgg

SEQ ID NO: 835172 - RNA, 16 nt, Mycobacterium avium subsp. paratuberculosis
cgguggacagguagcg

SEQ ID NO: 835173 - RNA, 22 nt, Mycobacterium avium subsp. paratuberculosis
cggugcuuaccggccggccgcc

SEQ ID NO: 835174 - RNA, 23 nt, Mycobacterium avium subsp. paratuberculosis
cggugcuuaccggccggccgccu

SEQ ID NO: 835175 - RNA, 15 nt, Mycobacterium avium subsp. paratuberculosis
cggugcuucaucccg

SEQ ID NO: 835176 - RNA, 19 nt, Mycobacterium avium subsp. paratuberculosis
cggugcuucaucccgucgu

SEQ ID NO: 835177 - RNA, 22 nt, Mycobacterium avium subsp. paratuberculosis
cggugcuucaucccgucguuga

SEQ ID NO: 835178 - RNA, 19 nt, Mycobacterium avium subsp. paratuberculosis
cgguggaugggcucgacca

SEQ ID NO: 835179 - RNA, 13 nt, Mycobacterium avium subsp. paratuberculosis
cgguggcaccccg

SEQ ID NO: 835180 - RNA, 14 nt, Mycobacterium avium subsp. paratuberculosis
cgguggcaccccgc

SEQ ID NO: 835181 - RNA, 16 nt, Mycobacterium avium subsp. paratuberculosis
cgguggcaccccgcgc

SEQ ID NO: 835182 - RNA, 20 nt, Mycobacterium avium subsp. paratuberculosis
cgguggauauuucgcggccg

SEQ ID NO: 835183 - RNA, 21 nt, Mycobacterium avium subsp. paratuberculosis
cgguggauauuucgcggccga

SEQ ID NO: 835184 - RNA, 19 nt, Mycobacterium avium subsp. paratuberculosis
cgguggauccggugaccgc

SEQ ID NO: 835185 - RNA, 20 nt, Mycobacterium avium subsp. paratuberculosis
cgguggauccggugaccgcg

SEQ ID NO: 835186 - RNA, 18 nt, Mycobacterium avium subsp. paratuberculosis
cgguggagauggccagca

SEQ ID NO: 835187 - RNA, 20 nt, Mycobacterium avium subsp. paratuberculosis
cgguggagauggccagcacc

SEQ ID NO: 835188 - RNA, 22 nt, Mycobacterium avium subsp. paratuberculosis
cgguggagauggccagcaccac

SEQ ID NO: 835189 - RNA, 14 nt, Mycobacterium avium subsp. paratuberculosis
cgguggagcacagc

SEQ ID NO: 835190 - RNA, 13 nt, Mycobacterium avium subsp. paratuberculosis
cgguggagcgcgg

SEQ ID NO: 835191 - RNA, 17 nt, Mycobacterium avium subsp. paratuberculosis
cgguggagcgcggcaug

SEQ ID NO: 835192 - RNA, 12 nt, Mycobacterium avium subsp. paratuberculosis
cgguggagcggc

SEQ ID NO: 835193 - RNA, 14 nt, Mycobacterium avium subsp. paratuberculosis
cgguggagcggccc

SEQ ID NO: 835194 - RNA, 13 nt, Mycobacterium avium subsp. paratuberculosis
cgguggcgggccg

SEQ ID NO: 835195 - RNA, 16 nt, Mycobacterium avium subsp. paratuberculosis
cgguggcgggccgccg

SEQ ID NO: 835196 - RNA, 18 nt, Mycobacterium avium subsp. paratuberculosis
cgguggcggugccgcggc

SEQ ID NO: 835197 - RNA, 19 nt, Mycobacterium avium subsp. paratuberculosis
cgguggcggugccgcggcg

SEQ ID NO: 835198 - RNA, 23 nt, Mycobacterium avium subsp. paratuberculosis
cgguggcggugccgcggcggcgc

SEQ ID NO: 835199 - RNA, 14 nt, Mycobacterium avium subsp. paratuberculosis
cgguggcggugcgg

SEQ ID NO: 835200 - RNA, 12 nt, Mycobacterium avium subsp. paratuberculosis
cgguggcggugg

SEQ ID NO: 835201 - RNA, 18 nt, Mycobacterium avium subsp. paratuberculosis
cgguggcguccucgacgg

SEQ ID NO: 835202 - RNA, 20 nt, Mycobacterium avium subsp. paratuberculosis
cgguggcguccucgacggug

SEQ ID NO: 835203 - RNA, 13 nt, Mycobacterium avium subsp. paratuberculosis
cgguggcgucggc

SEQ ID NO: 835204 - RNA, 16 nt, Mycobacterium avium subsp. paratuberculosis
cgguggcgucggcggc

SEQ ID NO: 835205 - RNA, 19 nt, Mycobacterium avium subsp. paratuberculosis
cgguggcgucggcggccug

SEQ ID NO: 835206 - RNA, 16 nt, Mycobacterium avium subsp. paratuberculosis
cgguggcgucggugau

SEQ ID NO: 835207 - RNA, 21 nt, Mycobacterium avium subsp. paratuberculosis
cgguggcgucggugaugccgg

SEQ ID NO: 835208 - RNA, 18 nt, Mycobacterium avium subsp. paratuberculosis
cgguggcgugcagcgcgg

SEQ ID NO: 835209 - RNA, 20 nt, Mycobacterium avium subsp. paratuberculosis
cgguggcgugcagcgcggcg

SEQ ID NO: 835210 - RNA, 20 nt, Mycobacterium avium subsp. paratuberculosis
cgguggcuaccgccgggcgg

SEQ ID NO: 835211 - RNA, 18 nt, Mycobacterium avium subsp. paratuberculosis
cggugggcgcgggccgcg

SEQ ID NO: 835212 - RNA, 20 nt, Mycobacterium avium subsp. paratuberculosis
cggugggcgcugguccucgg

SEQ ID NO: 835213 - RNA, 12 nt, Mycobacterium avium subsp. paratuberculosis
cggugggcggcg

SEQ ID NO: 835214 - RNA, 16 nt, Mycobacterium avium subsp. paratuberculosis
cggugggcggcgcccg

SEQ ID NO: 835215 - RNA, 13 nt, Mycobacterium avium subsp. paratuberculosis
cggugggcggcgg

SEQ ID NO: 835216 - RNA, 15 nt, Mycobacterium avium subsp. paratuberculosis
cggugggcggcggga

SEQ ID NO: 835217 - RNA, 19 nt, Mycobacterium avium subsp. paratuberculosis
cggugggcagcucgucggc

SEQ ID NO: 835218 - RNA, 20 nt, Mycobacterium avium subsp. paratuberculosis
cggugggcagcucgucggcg

SEQ ID NO: 835219 - RNA, 22 nt, Mycobacterium avium subsp. paratuberculosis
cggugggcagcucgucggcgcg

SEQ ID NO: 835220 - RNA, 14 nt, Mycobacterium avium subsp. paratuberculosis
cggugggcccgccg

SEQ ID NO: 835221 - RNA, 14 nt, Mycobacterium avium subsp. paratuberculosis
cggugggccgcacc

SEQ ID NO: 835222 - RNA, 12 nt, Mycobacterium avium subsp. paratuberculosis
cggugggccgcc

SEQ ID NO: 835223 - RNA, 13 nt, Mycobacterium avium subsp. paratuberculosis
cggugggccgccg

SEQ ID NO: 835224 - RNA, 16 nt, Mycobacterium avium subsp. paratuberculosis
cggugggccgccgcgg

SEQ ID NO: 835225 - RNA, 16 nt, Mycobacterium avium subsp. paratuberculosis
cgguggcuuccagccc

SEQ ID NO: 835226 - RNA, 17 nt, Mycobacterium avium subsp. paratuberculosis
cgguggcuuccagcccg

SEQ ID NO: 835227 - RNA, 18 nt, Mycobacterium avium subsp. paratuberculosis
cggugggaauccacagcg

SEQ ID NO: 835228 - RNA, 15 nt, Mycobacterium avium subsp. paratuberculosis
cggugggacggcggg

SEQ ID NO: 835229 - RNA, 18 nt, Mycobacterium avium subsp. paratuberculosis
cggugggacugggcgccg

SEQ ID NO: 835230 - RNA, 23 nt, Mycobacterium avium subsp. paratuberculosis
cggugggacugggcgccgccggc

SEQ ID NO: 835231 - RNA, 13 nt, Mycobacterium avium subsp. paratuberculosis
cggugggcaccag

SEQ ID NO: 835232 - RNA, 14 nt, Mycobacterium avium subsp. paratuberculosis
cggugggcaccagc

SEQ ID NO: 835233 - RNA, 16 nt, Mycobacterium avium subsp. paratuberculosis
cggugggcaccagcag

SEQ ID NO: 835234 - RNA, 19 nt, Mycobacterium avium subsp. paratuberculosis
cggugggcaccagcagcgc

SEQ ID NO: 835235 - RNA, 16 nt, Mycobacterium avium subsp. paratuberculosis
cgguggucgaaaucgc

SEQ ID NO: 835236 - RNA, 13 nt, Mycobacterium avium subsp. paratuberculosis
cgguggucgaaca

SEQ ID NO: 835237 - RNA, 21 nt, Mycobacterium avium subsp. paratuberculosis
cgguggucgacgagcccgcgc

SEQ ID NO: 835238 - RNA, 15 nt, Mycobacterium avium subsp. paratuberculosis
cgguggucaacgcgc

SEQ ID NO: 835239 - RNA, 15 nt, Mycobacterium avium subsp. paratuberculosis
cgguggucagcaccg

SEQ ID NO: 835240 - RNA, 13 nt, Mycobacterium avium subsp. paratuberculosis
cgguggggccgcc

SEQ ID NO: 835241 - RNA, 16 nt, Mycobacterium avium subsp. paratuberculosis
cgguggggccgccguc

SEQ ID NO: 835242 - RNA, 17 nt, Mycobacterium avium subsp. paratuberculosis
cggugggcucggcgccg

SEQ ID NO: 835243 - RNA, 19 nt, Mycobacterium avium subsp. paratuberculosis
cggugggcucggcgccgac

SEQ ID NO: 835244 - RNA, 14 nt, Mycobacterium avium subsp. paratuberculosis
cggugggcucgucg

SEQ ID NO: 835245 - RNA, 16 nt, Mycobacterium avium subsp. paratuberculosis
cggugggcucgucgaa

SEQ ID NO: 835246 - RNA, 18 nt, Mycobacterium avium subsp. paratuberculosis
cgguggggcuggccgcac

SEQ ID NO: 835247 - RNA, 19 nt, Mycobacterium avium subsp. paratuberculosis
cgguggggcuggccgcacg

SEQ ID NO: 835248 - RNA, 14 nt, Mycobacterium avium subsp. paratuberculosis
cggugggggccagg

SEQ ID NO: 835249 - RNA, 16 nt, Mycobacterium avium subsp. paratuberculosis
cggugggggccaggcg

SEQ ID NO: 835250 - RNA, 17 nt, Mycobacterium avium subsp. paratuberculosis
cgguggggugaggcacc

SEQ ID NO: 835251 - RNA, 21 nt, Mycobacterium avium subsp. paratuberculosis
cgguggggugaggcacccgcu

SEQ ID NO: 835252 - RNA, 16 nt, Mycobacterium avium subsp. paratuberculosis
cgguggggugaugagg

SEQ ID NO: 835253 - RNA, 19 nt, Mycobacterium avium subsp. paratuberculosis
cggugggguuagggcguca

SEQ ID NO: 835254 - RNA, 22 nt, Mycobacterium avium subsp. paratuberculosis
cggugggucaauugacguaacc

SEQ ID NO: 835255 - RNA, 14 nt, Mycobacterium avium subsp. paratuberculosis
cgguggguccgccg

SEQ ID NO: 835256 - RNA, 19 nt, Mycobacterium avium subsp. paratuberculosis
cgguggguccgccgggcgc

SEQ ID NO: 835257 - RNA, 15 nt, Mycobacterium avium subsp. paratuberculosis
cgguggccaccgcga

SEQ ID NO: 835258 - RNA, 17 nt, Mycobacterium avium subsp. paratuberculosis
cgguggccaccgcgacg

SEQ ID NO: 835259 - RNA, 18 nt, Mycobacterium avium subsp. paratuberculosis
cgguggccaccgcgacgc

SEQ ID NO: 835260 - RNA, 15 nt, Mycobacterium avium subsp. paratuberculosis
cgguggccacggcgu

SEQ ID NO: 835261 - RNA, 17 nt, Mycobacterium avium subsp. paratuberculosis
cgguggccacggcguug

SEQ ID NO: 835262 - RNA, 18 nt, Mycobacterium avium subsp. paratuberculosis
cgguggcccagccggccg

SEQ ID NO: 835263 - RNA, 19 nt, Mycobacterium avium subsp. paratuberculosis
cgguggcccagccggccga

SEQ ID NO: 835264 - RNA, 22 nt, Mycobacterium avium subsp. paratuberculosis
cgguggcccagccggccgacgc

SEQ ID NO: 835265 - RNA, 12 nt, Mycobacterium avium subsp. paratuberculosis
cgguggccccgg

SEQ ID NO: 835266 - RNA, 14 nt, Mycobacterium avium subsp. paratuberculosis
cgguggccccgggc

SEQ ID NO: 835267 - RNA, 18 nt, Mycobacterium avium subsp. paratuberculosis
cgguggccccgggccgca

SEQ ID NO: 835268 - RNA, 18 nt, Mycobacterium avium subsp. paratuberculosis
cgguggcccgguacagcg

SEQ ID NO: 835269 - RNA, 16 nt, Mycobacterium avium subsp. paratuberculosis
cgguggcccggucguc

SEQ ID NO: 835270 - RNA, 13 nt, Mycobacterium avium subsp. paratuberculosis
cgguggccagcag

SEQ ID NO: 835271 - RNA, 14 nt, Mycobacterium avium subsp. paratuberculosis
cgguggccagcagg

SEQ ID NO: 835272 - RNA, 15 nt, Mycobacterium avium subsp. paratuberculosis
cgguggccgcgcugg

SEQ ID NO: 835273 - RNA, 16 nt, Mycobacterium avium subsp. paratuberculosis
cgguggccgcgcuggu

SEQ ID NO: 835274 - RNA, 12 nt, Mycobacterium avium subsp. paratuberculosis
cgguggccgcca

SEQ ID NO: 835275 - RNA, 15 nt, Mycobacterium avium subsp. paratuberculosis
cgguggccgccacca

SEQ ID NO: 835276 - RNA, 17 nt, Mycobacterium avium subsp. paratuberculosis
cgguggccgccaccaac

SEQ ID NO: 835277 - RNA, 15 nt, Mycobacterium avium subsp. paratuberculosis
cgguggccgcgucga

SEQ ID NO: 835278 - RNA, 16 nt, Mycobacterium avium subsp. paratuberculosis
cgguggccgcgucgac

SEQ ID NO: 835279 - RNA, 20 nt, Mycobacterium avium subsp. paratuberculosis
cgguggccgcgucgaccagc

SEQ ID NO: 835280 - RNA, 23 nt, Mycobacterium avium subsp. paratuberculosis
cgguggccgguauacccccggug

SEQ ID NO: 835281 - RNA, 20 nt, Mycobacterium avium subsp. paratuberculosis
cgguggccggugggcggcgc

SEQ ID NO: 835282 - RNA, 13 nt, Mycobacterium avium subsp. paratuberculosis
cgguggccgccgg

SEQ ID NO: 835283 - RNA, 12 nt, Mycobacterium avium subsp. paratuberculosis
cgguggccgcga

SEQ ID NO: 835284 - RNA, 20 nt, Mycobacterium avium subsp. paratuberculosis
cgguggccgaaccgcucguc

SEQ ID NO: 835285 - RNA, 22 nt, Mycobacterium avium subsp. paratuberculosis
cgguggccgaaccgcucgucgg

SEQ ID NO: 835286 - RNA, 20 nt, Mycobacterium avium subsp. paratuberculosis
cgguggccaugcgcgagucg

SEQ ID NO: 835287 - RNA, 17 nt, Mycobacterium avium subsp. paratuberculosis
cgguggccugcccggcg

SEQ ID NO: 835288 - RNA, 19 nt, Mycobacterium avium subsp. paratuberculosis
cgguggccugcccggcggu

SEQ ID NO: 835289 - RNA, 20 nt, Mycobacterium avium subsp. paratuberculosis
cgguggccugcccggcggug

SEQ ID NO: 835290 - RNA, 21 nt, Mycobacterium avium subsp. paratuberculosis
cgguggccugcccggcggugc

SEQ ID NO: 835291 - RNA, 18 nt, Mycobacterium avium subsp. paratuberculosis
cgguggccuggucgaaca

SEQ ID NO: 835292 - RNA, 19 nt, Mycobacterium avium subsp. paratuberculosis
cgguggccuggucggcgac

SEQ ID NO: 835293 - RNA, 18 nt, Mycobacterium avium subsp. paratuberculosis
cgguggccgucucgucgg

SEQ ID NO: 835294 - RNA, 21 nt, Mycobacterium avium subsp. paratuberculosis
cgguggccgucucgucggccg

SEQ ID NO: 835295 - RNA, 21 nt, Mycobacterium avium subsp. paratuberculosis
cgguggccucgcgcaaugccg

SEQ ID NO: 835296 - RNA, 22 nt, Mycobacterium avium subsp. paratuberculosis
cgguggccucgcgcaaugccgc

SEQ ID NO: 835297 - RNA, 14 nt, Mycobacterium avium subsp. paratuberculosis
cgguggccucggcg

SEQ ID NO: 835298 - RNA, 18 nt, Mycobacterium avium subsp. paratuberculosis
cgguggccucggcgcugc

SEQ ID NO: 835299 - RNA, 19 nt, Mycobacterium avium subsp. paratuberculosis
cgguggcgaaguugaucgg

SEQ ID NO: 835300 - RNA, 20 nt, Mycobacterium avium subsp. paratuberculosis
cgguggcgacaacaggcgac

SEQ ID NO: 835301 - RNA, 17 nt, Mycobacterium avium subsp. paratuberculosis
cgguggcgaacugcacc

SEQ ID NO: 835302 - RNA, 19 nt, Mycobacterium avium subsp. paratuberculosis
cgguggcgaacugcaccag

SEQ ID NO: 835303 - RNA, 20 nt, Mycobacterium avium subsp. paratuberculosis
cgguggcgaacugcaccagc

SEQ ID NO: 835304 - RNA, 12 nt, Mycobacterium avium subsp. paratuberculosis
cgguggcgauga

SEQ ID NO: 835305 - RNA, 15 nt, Mycobacterium avium subsp. paratuberculosis
cgguggcgauggugc

SEQ ID NO: 835306 - RNA, 18 nt, Mycobacterium avium subsp. paratuberculosis
cgguggcgcacaacccgg

SEQ ID NO: 835307 - RNA, 23 nt, Mycobacterium avium subsp. paratuberculosis
cgguggcgcacaacccggacagc

SEQ ID NO: 835308 - RNA, 14 nt, Mycobacterium avium subsp. paratuberculosis
cgguggcgcccagc

SEQ ID NO: 835309 - RNA, 12 nt, Mycobacterium avium subsp. paratuberculosis
cgguggcgcccg

SEQ ID NO: 835310 - RNA, 16 nt, Mycobacterium avium subsp. paratuberculosis
cgguggcgcccgcggu

SEQ ID NO: 835311 - RNA, 19 nt, Mycobacterium avium subsp. paratuberculosis
cgguggcgccgcgcagcca

SEQ ID NO: 835312 - RNA, 12 nt, Mycobacterium avium subsp. paratuberculosis
cgguggcgccca

SEQ ID NO: 835313 - RNA, 13 nt, Mycobacterium avium subsp. paratuberculosis
cgguggcgcccag

SEQ ID NO: 835314 - RNA, 13 nt, Mycobacterium avium subsp. paratuberculosis
cgguggcgccggg

SEQ ID NO: 835315 - RNA, 14 nt, Mycobacterium avium subsp. paratuberculosis
cgguggcgccgggg

SEQ ID NO: 835316 - RNA, 15 nt, Mycobacterium avium subsp. paratuberculosis
cgguggcgccggggc

SEQ ID NO: 835317 - RNA, 19 nt, Mycobacterium avium subsp. paratuberculosis
cgguggcgcgaaucccggc

SEQ ID NO: 835318 - RNA, 13 nt, Mycobacterium avium subsp. paratuberculosis
cgguggcgcgcag

SEQ ID NO: 835319 - RNA, 15 nt, Mycobacterium avium subsp. paratuberculosis
cgguggcgcggguga

SEQ ID NO: 835320 - RNA, 12 nt, Mycobacterium avium subsp. paratuberculosis
cgguggcggcca

SEQ ID NO: 835321 - RNA, 19 nt, Mycobacterium avium subsp. paratuberculosis
cgguggcggccacgaucgc

SEQ ID NO: 835322 - RNA, 19 nt, Mycobacterium avium subsp. paratuberculosis
cgguggcggccaggccggc

SEQ ID NO: 835323 - RNA, 23 nt, Mycobacterium avium subsp. paratuberculosis
cgguggcggccaggccggcgacg

SEQ ID NO: 835324 - RNA, 12 nt, Mycobacterium avium subsp. paratuberculosis
cgguggcggcga

SEQ ID NO: 835325 - RNA, 14 nt, Mycobacterium avium subsp. paratuberculosis
cgguggcggcgaca

SEQ ID NO: 835326 - RNA, 14 nt, Mycobacterium avium subsp. paratuberculosis
cgguggcggcgagg

SEQ ID NO: 835327 - RNA, 15 nt, Mycobacterium avium subsp. paratuberculosis
cgguggcggcgagga

SEQ ID NO: 835328 - RNA, 12 nt, Mycobacterium avium subsp. paratuberculosis
cgguggcggcgg

SEQ ID NO: 835329 - RNA, 17 nt, Mycobacterium avium subsp. paratuberculosis
cgguggcggcggcgacg

SEQ ID NO: 835330 - RNA, 18 nt, Mycobacterium avium subsp. paratuberculosis
cggugcaacgccgccgac

SEQ ID NO: 835331 - RNA, 21 nt, Mycobacterium avium subsp. paratuberculosis
cggugcaacgccgccgacagc

SEQ ID NO: 835332 - RNA, 15 nt, Mycobacterium avium subsp. paratuberculosis
cggugcacacgccga

SEQ ID NO: 835333 - RNA, 14 nt, Mycobacterium avium subsp. paratuberculosis
cggugcaccaccgu

SEQ ID NO: 835334 - RNA, 13 nt, Mycobacterium avium subsp. paratuberculosis
cggugcaccgcgc

SEQ ID NO: 835335 - RNA, 14 nt, Mycobacterium avium subsp. paratuberculosis
cggugcaccgcgcg

SEQ ID NO: 835336 - RNA, 17 nt, Mycobacterium avium subsp. paratuberculosis
cggugcaccgcgcgcac

SEQ ID NO: 835337 - RNA, 14 nt, Mycobacterium avium subsp. paratuberculosis
cggugcaccgcggc

SEQ ID NO: 835338 - RNA, 15 nt, Mycobacterium avium subsp. paratuberculosis
cggugcaccgcggcg

SEQ ID NO: 835339 - RNA, 16 nt, Mycobacterium avium subsp. paratuberculosis
cggugcaccgcggcgc

SEQ ID NO: 835340 - RNA, 17 nt, Mycobacterium avium subsp. paratuberculosis
cggugcaccgcggcgcg

SEQ ID NO: 835341 - RNA, 12 nt, Mycobacterium avium subsp. paratuberculosis
cggugcagcacg

SEQ ID NO: 835342 - RNA, 17 nt, Mycobacterium avium subsp. paratuberculosis
cggugcagcacgugcgc

SEQ ID NO: 835343 - RNA, 14 nt, Mycobacterium avium subsp. paratuberculosis
cggugcagcagcgc

SEQ ID NO: 835344 - RNA, 16 nt, Mycobacterium avium subsp. paratuberculosis
cggugcagcagcgccg

SEQ ID NO: 835345 - RNA, 20 nt, Mycobacterium avium subsp. paratuberculosis
cggugcagcagcgccgcgac

SEQ ID NO: 835346 - RNA, 17 nt, Mycobacterium avium subsp. paratuberculosis
cggugcacgagcgucgu

SEQ ID NO: 835347 - RNA, 18 nt, Mycobacterium avium subsp. paratuberculosis
cggugcacggcgccacca

SEQ ID NO: 835348 - RNA, 20 nt, Mycobacterium avium subsp. paratuberculosis
cggugcacggcgccaccagc

SEQ ID NO: 835349 - RNA, 15 nt, Mycobacterium avium subsp. paratuberculosis
cggugcacggucagc

SEQ ID NO: 835350 - RNA, 19 nt, Mycobacterium avium subsp. paratuberculosis
cggugcacggucagcucgc

SEQ ID NO: 835351 - RNA, 24 nt, Mycobacterium avium subsp. paratuberculosis
cggugcacggucagcucgcgcccg

SEQ ID NO: 835352 - RNA, 19 nt, Mycobacterium avium subsp. paratuberculosis
cggugcagaccccggcguc

SEQ ID NO: 835353 - RNA, 21 nt, Mycobacterium avium subsp. paratuberculosis
cggugcagaccccggcgucca

SEQ ID NO: 835354 - RNA, 15 nt, Mycobacterium avium subsp. paratuberculosis
cggugcagccggggg

SEQ ID NO: 835355 - RNA, 16 nt, Mycobacterium avium subsp. paratuberculosis
cggugcagccgggggc

SEQ ID NO: 835356 - RNA, 16 nt, Mycobacterium avium subsp. paratuberculosis
cggugcagggucagca

SEQ ID NO: 835357 - RNA, 20 nt, Mycobacterium avium subsp. paratuberculosis
cggugcaguacgcaucggcg

SEQ ID NO: 835358 - RNA, 23 nt, Mycobacterium avium subsp. paratuberculosis
cggugcaguacgcaucggcgccg

SEQ ID NO: 835359 - RNA, 13 nt, Mycobacterium avium subsp. paratuberculosis
cggugcaucgucg

SEQ ID NO: 835360 - RNA, 14 nt, Mycobacterium avium subsp. paratuberculosis
cggugcaucgucgc

SEQ ID NO: 835361 - RNA, 16 nt, Mycobacterium avium subsp. paratuberculosis
cggugcaucgucgcgg

SEQ ID NO: 835362 - RNA, 17 nt, Mycobacterium avium subsp. paratuberculosis
cggugcaucgucgcggc

SEQ ID NO: 835363 - RNA, 19 nt, Mycobacterium avium subsp. paratuberculosis
cggugcaucgucgcggcgg

SEQ ID NO: 835364 - RNA, 16 nt, Mycobacterium avium subsp. paratuberculosis
cggugccaucgugggc

SEQ ID NO: 835365 - RNA, 17 nt, Mycobacterium avium subsp. paratuberculosis
cggugccaucgugggcg

SEQ ID NO: 835366 - RNA, 18 nt, Mycobacterium avium subsp. paratuberculosis
cggugccaucgugggcgc

SEQ ID NO: 835367 - RNA, 20 nt, Mycobacterium avium subsp. paratuberculosis
cggugccaucgugggcgccg

SEQ ID NO: 835368 - RNA, 17 nt, Mycobacterium avium subsp. paratuberculosis
cggugcaggccgcgacg

SEQ ID NO: 835369 - RNA, 18 nt, Mycobacterium avium subsp. paratuberculosis
cggugcaggccgcgacgg

SEQ ID NO: 835370 - RNA, 16 nt, Mycobacterium avium subsp. paratuberculosis
cggugcaugcgcuggc

SEQ ID NO: 835371 - RNA, 14 nt, Mycobacterium avium subsp. paratuberculosis
cggugccacgcggc

SEQ ID NO: 835372 - RNA, 20 nt, Mycobacterium avium subsp. paratuberculosis
cggugcccagccaggccgcc

SEQ ID NO: 835373 - RNA, 21 nt, Mycobacterium avium subsp. paratuberculosis
cggugcccagccaggccgccg

SEQ ID NO: 835374 - RNA, 22 nt, Mycobacterium avium subsp. paratuberculosis
cggugcccagccaggccgccgg

SEQ ID NO: 835375 - RNA, 14 nt, Mycobacterium avium subsp. paratuberculosis
cggugcccagccgc

SEQ ID NO: 835376 - RNA, 14 nt, Mycobacterium avium subsp. paratuberculosis
cggugcccagcgcg

SEQ ID NO: 835377 - RNA, 23 nt, Mycobacterium avium subsp. paratuberculosis
cggugcccagcgcgaggucgacg

SEQ ID NO: 835378 - RNA, 19 nt, Mycobacterium avium subsp. paratuberculosis
cggugcccaggucgcccag

SEQ ID NO: 835379 - RNA, 13 nt, Mycobacterium avium subsp. paratuberculosis
cggugcccgcagc

SEQ ID NO: 835380 - RNA, 13 nt, Mycobacterium avium subsp. paratuberculosis
cggugcccgccga

SEQ ID NO: 835381 - RNA, 17 nt, Mycobacterium avium subsp. paratuberculosis
cggugcccgccgcgacc

SEQ ID NO: 835382 - RNA, 21 nt, Mycobacterium avium subsp. paratuberculosis
cggugcccgccgcgaccgcga

SEQ ID NO: 835383 - RNA, 21 nt, Mycobacterium avium subsp. paratuberculosis
cggugcccgggguccaccggc

SEQ ID NO: 835384 - RNA, 22 nt, Mycobacterium avium subsp. paratuberculosis
cggugcccgggguccaccggcc

SEQ ID NO: 835385 - RNA, 14 nt, Mycobacterium avium subsp. paratuberculosis
cggugcccgucggc

SEQ ID NO: 835386 - RNA, 18 nt, Mycobacterium avium subsp. paratuberculosis
cggugcccgucggcaacg

SEQ ID NO: 835387 - RNA, 16 nt, Mycobacterium avium subsp. paratuberculosis
cggugccgaagcgcca

SEQ ID NO: 835388 - RNA, 18 nt, Mycobacterium avium subsp. paratuberculosis
cggugccgaagcgccacg

SEQ ID NO: 835389 - RNA, 19 nt, Mycobacterium avium subsp. paratuberculosis
cggugccgaagcgccacgg

SEQ ID NO: 835390 - RNA, 23 nt, Mycobacterium avium subsp. paratuberculosis
cggugccgaagcgccacggggcg

SEQ ID NO: 835391 - RNA, 22 nt, Mycobacterium avium subsp. paratuberculosis
cggugccgcggcggcgccgacg

SEQ ID NO: 835392 - RNA, 15 nt, Mycobacterium avium subsp. paratuberculosis
cggugccgcguucgg

SEQ ID NO: 835393 - RNA, 14 nt, Mycobacterium avium subsp. paratuberculosis
cggugccgccgugc

SEQ ID NO: 835394 - RNA, 16 nt, Mycobacterium avium subsp. paratuberculosis
cggugccgccgugcgc

SEQ ID NO: 835395 - RNA, 18 nt, Mycobacterium avium subsp. paratuberculosis
cggugccgccgugcgcgg

SEQ ID NO: 835396 - RNA, 19 nt, Mycobacterium avium subsp. paratuberculosis
cggugccgccgugcgcggc

SEQ ID NO: 835397 - RNA, 20 nt, Mycobacterium avium subsp. paratuberculosis
cggugccgccgugcgcggcg

SEQ ID NO: 835398 - RNA, 12 nt, Mycobacterium avium subsp. paratuberculosis
cggugccgcugg

SEQ ID NO: 835399 - RNA, 22 nt, Mycobacterium avium subsp. paratuberculosis
cggugccgcuggauuccaccgu

SEQ ID NO: 835400 - RNA, 22 nt, Mycobacterium avium subsp. paratuberculosis
cggugccggccagaucgacgcc

SEQ ID NO: 835401 - RNA, 23 nt, Mycobacterium avium subsp. paratuberculosis
cggugccggccagaucgacgccg

SEQ ID NO: 835402 - RNA, 13 nt, Mycobacterium avium subsp. paratuberculosis
cggugccggccgg

SEQ ID NO: 835403 - RNA, 17 nt, Mycobacterium avium subsp. paratuberculosis
cggugccggccgggucg

SEQ ID NO: 835404 - RNA, 21 nt, Mycobacterium avium subsp. paratuberculosis
cggugccggccgggucgaccg

SEQ ID NO: 835405 - RNA, 20 nt, Mycobacterium avium subsp. paratuberculosis
cggugccguugaucagggcg

SEQ ID NO: 835406 - RNA, 17 nt, Mycobacterium avium subsp. paratuberculosis
cggugccucuucgucgg

SEQ ID NO: 835407 - RNA, 20 nt, Mycobacterium avium subsp. paratuberculosis
cggugccucuucgucggccg

SEQ ID NO: 835408 - RNA, 21 nt, Mycobacterium avium subsp. paratuberculosis
cggugccucuucgucggccgg

SEQ ID NO: 835409 - RNA, 22 nt, Mycobacterium avium subsp. paratuberculosis
cggugccucuucgucggccggc

SEQ ID NO: 835410 - RNA, 15 nt, Mycobacterium avium subsp. paratuberculosis
cggugccguccucgg

SEQ ID NO: 835411 - RNA, 20 nt, Mycobacterium avium subsp. paratuberculosis
cggugccguccucggccgcc

SEQ ID NO: 835412 - RNA, 22 nt, Mycobacterium avium subsp. paratuberculosis
cggugccguccucggccgccac

SEQ ID NO: 835413 - RNA, 14 nt, Mycobacterium avium subsp. paratuberculosis
cggugccgucgauc

SEQ ID NO: 835414 - RNA, 14 nt, Mycobacterium avium subsp. paratuberculosis
cggugccgcccgga

SEQ ID NO: 835415 - RNA, 18 nt, Mycobacterium avium subsp. paratuberculosis
cggugccgagcccgccgg

SEQ ID NO: 835416 - RNA, 19 nt, Mycobacterium avium subsp. paratuberculosis
cggugccgagcccgccggc

SEQ ID NO: 835417 - RNA, 22 nt, Mycobacterium avium subsp. paratuberculosis
cggugccgagcccgccggcggc

SEQ ID NO: 835418 - RNA, 23 nt, Mycobacterium avium subsp. paratuberculosis
cggugccgaccugggcggccacc

SEQ ID NO: 835419 - RNA, 14 nt, Mycobacterium avium subsp. paratuberculosis
cggugccgacgaug

SEQ ID NO: 835420 - RNA, 15 nt, Mycobacterium avium subsp. paratuberculosis
cggugccgacggugc

SEQ ID NO: 835421 - RNA, 15 nt, Mycobacterium avium subsp. paratuberculosis
cggugccgagcgcgc

SEQ ID NO: 835422 - RNA, 14 nt, Mycobacterium avium subsp. paratuberculosis
cggugccgaguucg

SEQ ID NO: 835423 - RNA, 18 nt, Mycobacterium avium subsp. paratuberculosis
cggugccgaguucgaccu

SEQ ID NO: 835424 - RNA, 20 nt, Mycobacterium avium subsp. paratuberculosis
cggugccgaguucgaccucg

SEQ ID NO: 835425 - RNA, 16 nt, Mycobacterium avium subsp. paratuberculosis
cggugccgcagcucga

SEQ ID NO: 835426 - RNA, 20 nt, Mycobacterium avium subsp. paratuberculosis
cggugccgcagugccggcgc

SEQ ID NO: 835427 - RNA, 13 nt, Mycobacterium avium subsp. paratuberculosis
cggugccgccggc

SEQ ID NO: 835428 - RNA, 18 nt, Mycobacterium avium subsp. paratuberculosis
cggugccgccggcgcauc

SEQ ID NO: 835429 - RNA, 15 nt, Mycobacterium avium subsp. paratuberculosis
cggugccgccggcgc

SEQ ID NO: 835430 - RNA, 15 nt, Mycobacterium avium subsp. paratuberculosis
cggugaccugcagcg

SEQ ID NO: 835431 - RNA, 17 nt, Mycobacterium avium subsp. paratuberculosis
cggugaccugcagcgcc

SEQ ID NO: 835432 - RNA, 18 nt, Mycobacterium avium subsp. paratuberculosis
cggugaccugcagcgccu

SEQ ID NO: 835433 - RNA, 17 nt, Mycobacterium avium subsp. paratuberculosis
cggugaccuugcgggcg

SEQ ID NO: 835434 - RNA, 19 nt, Mycobacterium avium subsp. paratuberculosis
cggugaccuugcgggcggu

SEQ ID NO: 835435 - RNA, 20 nt, Mycobacterium avium subsp. paratuberculosis
cggugacgaaaugcaacgca

SEQ ID NO: 835436 - RNA, 15 nt, Mycobacterium avium subsp. paratuberculosis
cggugacgaacccgc

SEQ ID NO: 835437 - RNA, 18 nt, Mycobacterium avium subsp. paratuberculosis
cggugacgaacccgccgc

SEQ ID NO: 835438 - RNA, 13 nt, Mycobacterium avium subsp. paratuberculosis
cggugaccgcgcc

SEQ ID NO: 835439 - RNA, 14 nt, Mycobacterium avium subsp. paratuberculosis
cggugaccgcgccg

SEQ ID NO: 835440 - RNA, 18 nt, Mycobacterium avium subsp. paratuberculosis
cggugaccgcgccgcggg

SEQ ID NO: 835441 - RNA, 15 nt, Mycobacterium avium subsp. paratuberculosis
cggugaccgcggccu

SEQ ID NO: 835442 - RNA, 16 nt, Mycobacterium avium subsp. paratuberculosis
cggugaccgcggccuc

SEQ ID NO: 835443 - RNA, 19 nt, Mycobacterium avium subsp. paratuberculosis
cggugaccgcggccucguc

SEQ ID NO: 835444 - RNA, 21 nt, Mycobacterium avium subsp. paratuberculosis
cggugaccgcggccucgucga

SEQ ID NO: 835445 - RNA, 22 nt, Mycobacterium avium subsp. paratuberculosis
cggugaccggaucggccagcag

SEQ ID NO: 835446 - RNA, 23 nt, Mycobacterium avium subsp. paratuberculosis
cggugaccggaucggccagcagg

SEQ ID NO: 835447 - RNA, 14 nt, Mycobacterium avium subsp. paratuberculosis
cggugaccggcgcg

SEQ ID NO: 835448 - RNA, 13 nt, Mycobacterium avium subsp. paratuberculosis
cggugaccggcuc

SEQ ID NO: 835449 - RNA, 15 nt, Mycobacterium avium subsp. paratuberculosis
cggugaccggcucga

SEQ ID NO: 835450 - RNA, 14 nt, Mycobacterium avium subsp. paratuberculosis
cggugaccgucgcc

SEQ ID NO: 835451 - RNA, 19 nt, Mycobacterium avium subsp. paratuberculosis
cggugaccgucgccgacca

SEQ ID NO: 835452 - RNA, 15 nt, Mycobacterium avium subsp. paratuberculosis
cggugaccucgagca

SEQ ID NO: 835453 - RNA, 16 nt, Mycobacterium avium subsp. paratuberculosis
cggugaccucgagcac

SEQ ID NO: 835454 - RNA, 20 nt, Mycobacterium avium subsp. paratuberculosis
cggugaccucgagcaccggc

SEQ ID NO: 835455 - RNA, 12 nt, Mycobacterium avium subsp. paratuberculosis
cggugacgaccg

SEQ ID NO: 835456 - RNA, 14 nt, Mycobacterium avium subsp. paratuberculosis
cggugacgaccggc

SEQ ID NO: 835457 - RNA, 19 nt, Mycobacterium avium subsp. paratuberculosis
cggugacgaccggcagccg

SEQ ID NO: 835458 - RNA, 18 nt, Mycobacterium avium subsp. paratuberculosis
cggugacgauccggucga

SEQ ID NO: 835459 - RNA, 19 nt, Mycobacterium avium subsp. paratuberculosis
cggugacgaugaugucggc

SEQ ID NO: 835460 - RNA, 22 nt, Mycobacterium avium subsp. paratuberculosis
cggugacgaugaugucggccgg

SEQ ID NO: 835461 - RNA, 17 nt, Mycobacterium avium subsp. paratuberculosis
cggugacgaugucgaug

SEQ ID NO: 835462 - RNA, 21 nt, Mycobacterium avium subsp. paratuberculosis
cggugacgcccuuguccucga

SEQ ID NO: 835463 - RNA, 12 nt, Mycobacterium avium subsp. paratuberculosis
cggugacgccgg

SEQ ID NO: 835464 - RNA, 14 nt, Mycobacterium avium subsp. paratuberculosis
cggugacgcgccgg

SEQ ID NO: 835465 - RNA, 15 nt, Mycobacterium avium subsp. paratuberculosis
cggugacgcgccggc

SEQ ID NO: 835466 - RNA, 16 nt, Mycobacterium avium subsp. paratuberculosis
cggugacgcgccggcc

SEQ ID NO: 835467 - RNA, 18 nt, Mycobacterium avium subsp. paratuberculosis
cggugacgcgccggccca

SEQ ID NO: 835468 - RNA, 18 nt, Mycobacterium avium subsp. paratuberculosis
cggugaggcuggguugcu

SEQ ID NO: 835469 - RNA, 16 nt, Mycobacterium avium subsp. paratuberculosis
cggugagcuggccgcg

SEQ ID NO: 835470 - RNA, 21 nt, Mycobacterium avium subsp. paratuberculosis
cggugagcuggccgcgcagcg

SEQ ID NO: 835471 - RNA, 17 nt, Mycobacterium avium subsp. paratuberculosis
cggugaggacaccacga

SEQ ID NO: 835472 - RNA, 22 nt, Mycobacterium avium subsp. paratuberculosis
cggugaggacaccacgaucagc

SEQ ID NO: 835473 - RNA, 17 nt, Mycobacterium avium subsp. paratuberculosis
cggugaggugggcggga

SEQ ID NO: 835474 - RNA, 22 nt, Mycobacterium avium subsp. paratuberculosis
cggugagccucagggcgcgcug

SEQ ID NO: 835475 - RNA, 12 nt, Mycobacterium avium subsp. paratuberculosis
cggugagcgcca

SEQ ID NO: 835476 - RNA, 14 nt, Mycobacterium avium subsp. paratuberculosis
cggugagcgccacc

SEQ ID NO: 835477 - RNA, 17 nt, Mycobacterium avium subsp. paratuberculosis
cggugagcgcgccggcc

SEQ ID NO: 835478 - RNA, 20 nt, Mycobacterium avium subsp. paratuberculosis
cggugagcgcgccggcccga

SEQ ID NO: 835479 - RNA, 14 nt, Mycobacterium avium subsp. paratuberculosis
cggugagcgcgucg

SEQ ID NO: 835480 - RNA, 19 nt, Mycobacterium avium subsp. paratuberculosis
cggugagcggauuggucgg

SEQ ID NO: 835481 - RNA, 17 nt, Mycobacterium avium subsp. paratuberculosis
cggugagcggccgcagc

SEQ ID NO: 835482 - RNA, 22 nt, Mycobacterium avium subsp. paratuberculosis
cggugagcguggucucguugug

SEQ ID NO: 835483 - RNA, 17 nt, Mycobacterium avium subsp. paratuberculosis
cggugagcaccgggaac

SEQ ID NO: 835484 - RNA, 20 nt, Mycobacterium avium subsp. paratuberculosis
cggugagcacgaccgccagc

SEQ ID NO: 835485 - RNA, 22 nt, Mycobacterium avium subsp. paratuberculosis
cggugagcacgaccgccagcag

SEQ ID NO: 835486 - RNA, 15 nt, Mycobacterium avium subsp. paratuberculosis
cggugagcagcaugc

SEQ ID NO: 835487 - RNA, 18 nt, Mycobacterium avium subsp. paratuberculosis
cggugagcagcaugccga

SEQ ID NO: 835488 - RNA, 20 nt, Mycobacterium avium subsp. paratuberculosis
cggugagcagcaugccgagc

SEQ ID NO: 835489 - RNA, 22 nt, Mycobacterium avium subsp. paratuberculosis
cggugagcagcaugccgagcac

SEQ ID NO: 835490 - RNA, 18 nt, Mycobacterium avium subsp. paratuberculosis
cggugagccgccacagcg

SEQ ID NO: 835491 - RNA, 19 nt, Mycobacterium avium subsp. paratuberculosis
cggugagccgcuggauguc

SEQ ID NO: 835492 - RNA, 14 nt, Mycobacterium avium subsp. paratuberculosis
cggugacggcgucg

SEQ ID NO: 835493 - RNA, 15 nt, Mycobacterium avium subsp. paratuberculosis
cggugacggcgucgg

SEQ ID NO: 835494 - RNA, 21 nt, Mycobacterium avium subsp. paratuberculosis
cggugacggcgucggcgaucu

SEQ ID NO: 835495 - RNA, 20 nt, Mycobacterium avium subsp. paratuberculosis
cggugacggugugcgggucg

SEQ ID NO: 835496 - RNA, 22 nt, Mycobacterium avium subsp. paratuberculosis
cggugacuccuccucggccagc

SEQ ID NO: 835497 - RNA, 21 nt, Mycobacterium avium subsp. paratuberculosis
cggugagcaacaccggcacga

SEQ ID NO: 835498 - RNA, 18 nt, Mycobacterium avium subsp. paratuberculosis
cggugaguucaucgacgu

SEQ ID NO: 835499 - RNA, 14 nt, Mycobacterium avium subsp. paratuberculosis
cggugaucaccaug

SEQ ID NO: 835500 - RNA, 20 nt, Mycobacterium avium subsp. paratuberculosis
cggugaucaccaugaucagc

SEQ ID NO: 835501 - RNA, 14 nt, Mycobacterium avium subsp. paratuberculosis
cggugaucacccgc

SEQ ID NO: 835502 - RNA, 17 nt, Mycobacterium avium subsp. paratuberculosis
cggugaucacccgccgg

SEQ ID NO: 835503 - RNA, 18 nt, Mycobacterium avium subsp. paratuberculosis
cggugaucacccgccggg

SEQ ID NO: 835504 - RNA, 21 nt, Mycobacterium avium subsp. paratuberculosis
cggugauccacuccagcaccg

SEQ ID NO: 835505 - RNA, 15 nt, Mycobacterium avium subsp. paratuberculosis
cggugaucagcagca

SEQ ID NO: 835506 - RNA, 16 nt, Mycobacterium avium subsp. paratuberculosis
cggugaucagcagcag

SEQ ID NO: 835507 - RNA, 12 nt, Mycobacterium avium subsp. paratuberculosis
cggugaucgccg

SEQ ID NO: 835508 - RNA, 19 nt, Mycobacterium avium subsp. paratuberculosis
cggugauccgcccggcccg

SEQ ID NO: 835509 - RNA, 21 nt, Mycobacterium avium subsp. paratuberculosis
cggugaucgacauagucgagg

SEQ ID NO: 835510 - RNA, 13 nt, Mycobacterium avium subsp. paratuberculosis
cggugaucgccgg

SEQ ID NO: 835511 - RNA, 14 nt, Mycobacterium avium subsp. paratuberculosis
cggugaucgccgga

SEQ ID NO: 835512 - RNA, 17 nt, Mycobacterium avium subsp. paratuberculosis
cggugaucgcggcgcug

SEQ ID NO: 835513 - RNA, 15 nt, Mycobacterium avium subsp. paratuberculosis
cggugaucucaccgg

SEQ ID NO: 835514 - RNA, 17 nt, Mycobacterium avium subsp. paratuberculosis
cggugaucucaccggcg

SEQ ID NO: 835515 - RNA, 18 nt, Mycobacterium avium subsp. paratuberculosis
cggugaucucaccggcgg

SEQ ID NO: 835516 - RNA, 19 nt, Mycobacterium avium subsp. paratuberculosis
cggugaucucaccggcggc

SEQ ID NO: 835517 - RNA, 21 nt, Mycobacterium avium subsp. paratuberculosis
cggugaucucaccggcggcgg

SEQ ID NO: 835518 - RNA, 22 nt, Mycobacterium avium subsp. paratuberculosis
cggugaucucaccggcggcggc

SEQ ID NO: 835519 - RNA, 20 nt, Mycobacterium avium subsp. paratuberculosis
cggugaucucccgugcgguc

SEQ ID NO: 835520 - RNA, 19 nt, Mycobacterium avium subsp. paratuberculosis
cggugaucucgccgagcac

SEQ ID NO: 835521 - RNA, 17 nt, Mycobacterium avium subsp. paratuberculosis
cggugaucucgucggcg

SEQ ID NO: 835522 - RNA, 18 nt, Mycobacterium avium subsp. paratuberculosis
cggugaucucgucggcgg

SEQ ID NO: 835523 - RNA, 21 nt, Mycobacterium avium subsp. paratuberculosis
cggugaucucgucggcggcgg

SEQ ID NO: 835524 - RNA, 22 nt, Mycobacterium avium subsp. paratuberculosis
cggugaucucgucggcggcggc

SEQ ID NO: 835525 - RNA, 23 nt, Mycobacterium avium subsp. paratuberculosis
cggugaucucgucggcggcggcc

SEQ ID NO: 835526 - RNA, 16 nt, Mycobacterium avium subsp. paratuberculosis
cggugaucugcaccag

SEQ ID NO: 835527 - RNA, 18 nt, Mycobacterium avium subsp. paratuberculosis
cggugaucugcaccagcg

SEQ ID NO: 835528 - RNA, 21 nt, Mycobacterium avium subsp. paratuberculosis
cggugaucugcaccagcgugg

SEQ ID NO: 835529 - RNA, 15 nt, Mycobacterium avium subsp. paratuberculosis
cggugaugucgguga

SEQ ID NO: 835530 - RNA, 20 nt, Mycobacterium avium subsp. paratuberculosis
cggugauguugucgaacagc

SEQ ID NO: 835531 - RNA, 16 nt, Mycobacterium avium subsp. paratuberculosis
cggugauuccggcacc

SEQ ID NO: 835532 - RNA, 17 nt, Mycobacterium avium subsp. paratuberculosis
cggugauuccggcaccc

SEQ ID NO: 835533 - RNA, 20 nt, Mycobacterium avium subsp. paratuberculosis
cggugauuccggcacccgcc

SEQ ID NO: 835534 - RNA, 23 nt, Mycobacterium avium subsp. paratuberculosis
cggugauuccggcacccgccagc

SEQ ID NO: 835535 - RNA, 23 nt, Mycobacterium avium subsp. paratuberculosis
cggugauucgugcagugcgaucg

SEQ ID NO: 835536 - RNA, 14 nt, Mycobacterium avium subsp. paratuberculosis
cggugaugucgacg

SEQ ID NO: 835537 - RNA, 18 nt, Mycobacterium avium subsp. paratuberculosis
cggugaugucgacgucgu

SEQ ID NO: 835538 - RNA, 21 nt, Mycobacterium avium subsp. paratuberculosis
cggugaugucgacgucgucga

SEQ ID NO: 835539 - RNA, 16 nt, Mycobacterium avium subsp. paratuberculosis
cggugaugucgccggc

SEQ ID NO: 835540 - RNA, 19 nt, Mycobacterium avium subsp. paratuberculosis
cggugaugucgccggcggc

SEQ ID NO: 835541 - RNA, 18 nt, Mycobacterium avium subsp. paratuberculosis
cggugauggccggcuacc

SEQ ID NO: 835542 - RNA, 18 nt, Mycobacterium avium subsp. paratuberculosis
cggugaugcgcgccgacg

SEQ ID NO: 835543 - RNA, 22 nt, Mycobacterium avium subsp. paratuberculosis
cggugaugcgcgccgacgacca

SEQ ID NO: 835544 - RNA, 14 nt, Mycobacterium avium subsp. paratuberculosis
cggugaugcgcggc

SEQ ID NO: 835545 - RNA, 15 nt, Mycobacterium avium subsp. paratuberculosis
cggugaugcgcggcg

SEQ ID NO: 835546 - RNA, 18 nt, Mycobacterium avium subsp. paratuberculosis
cggugaugcgcggcgacg

SEQ ID NO: 835547 - RNA, 19 nt, Mycobacterium avium subsp. paratuberculosis
cggugaugcgcggcgacgg

SEQ ID NO: 835548 - RNA, 16 nt, Mycobacterium avium subsp. paratuberculosis
cggugaugccgagcgc

SEQ ID NO: 835549 - RNA, 17 nt, Mycobacterium avium subsp. paratuberculosis
cggugaugccgagcgcc

SEQ ID NO: 835550 - RNA, 19 nt, Mycobacterium avium subsp. paratuberculosis
cggugaugccgagcgccgc

SEQ ID NO: 835551 - RNA, 15 nt, Mycobacterium avium subsp. paratuberculosis
cggugaugccggcca

SEQ ID NO: 835552 - RNA, 19 nt, Mycobacterium avium subsp. paratuberculosis
cggugaugccggccagccg

SEQ ID NO: 835553 - RNA, 21 nt, Mycobacterium avium subsp. paratuberculosis
cggugaugccggccagccgcg

SEQ ID NO: 835554 - RNA, 22 nt, Mycobacterium avium subsp. paratuberculosis
cggugaugccggccagccgcgc

SEQ ID NO: 835555 - RNA, 14 nt, Mycobacterium avium subsp. paratuberculosis
cggugaugaucgcc

SEQ ID NO: 835556 - RNA, 18 nt, Mycobacterium avium subsp. paratuberculosis
cggugaugaucgccgggu

SEQ ID NO: 835557 - RNA, 24 nt, Mycobacterium avium subsp. paratuberculosis
cggugaugaucgccgggucgcacg

SEQ ID NO: 835558 - RNA, 16 nt, Mycobacterium avium subsp. paratuberculosis
cggugaugaacgcgcc

SEQ ID NO: 835559 - RNA, 17 nt, Mycobacterium avium subsp. paratuberculosis
cggugaugaacgcgccg

SEQ ID NO: 835560 - RNA, 18 nt, Mycobacterium avium subsp. paratuberculosis
cggugaugaacgcgccgu

SEQ ID NO: 835561 - RNA, 19 nt, Mycobacterium avium subsp. paratuberculosis
cggugaugaacgcgccguc

SEQ ID NO: 835562 - RNA, 21 nt, Mycobacterium avium subsp. paratuberculosis
cggugaugaacgcgccgucgu

SEQ ID NO: 835563 - RNA, 13 nt, Mycobacterium avium subsp. paratuberculosis
cggucgccgcgcc

SEQ ID NO: 835564 - RNA, 15 nt, Mycobacterium avium subsp. paratuberculosis
cggguacggcggccg

SEQ ID NO: 835565 - RNA, 22 nt, Mycobacterium avium subsp. paratuberculosis
cggguagaaccagcccggcccg

SEQ ID NO: 835566 - RNA, 15 nt, Mycobacterium avium subsp. paratuberculosis
cggguacaccgacuu

SEQ ID NO: 835567 - RNA, 17 nt, Mycobacterium avium subsp. paratuberculosis
cggguacaccgagccgg

SEQ ID NO: 835568 - RNA, 14 nt, Mycobacterium avium subsp. paratuberculosis
cggguacaccggcu

SEQ ID NO: 835569 - RNA, 16 nt, Mycobacterium avium subsp. paratuberculosis
cggguacaccggcucg

SEQ ID NO: 835570 - RNA, 11 nt, Mycobacterium avium subsp. paratuberculosis
cggucgcgacc

SEQ ID NO: 835571 - RNA, 12 nt, Mycobacterium avium subsp. paratuberculosis
cggucgcgaccc

SEQ ID NO: 835572 - RNA, 13 nt, Mycobacterium avium subsp. paratuberculosis
cggucgcgcagcc

SEQ ID NO: 835573 - RNA, 14 nt, Mycobacterium avium subsp. paratuberculosis
cggucgcgcagccg

SEQ ID NO: 835574 - RNA, 16 nt, Mycobacterium avium subsp. paratuberculosis
cggucgcgcagccgcc

SEQ ID NO: 835575 - RNA, 15 nt, Mycobacterium avium subsp. paratuberculosis
cggucgcgcagccgg

SEQ ID NO: 835576 - RNA, 19 nt, Mycobacterium avium subsp. paratuberculosis
cggucgcgcagccgggcgg

SEQ ID NO: 835577 - RNA, 20 nt, Mycobacterium avium subsp. paratuberculosis
cggucgcgcagccgggcggc

SEQ ID NO: 835578 - RNA, 15 nt, Mycobacterium avium subsp. paratuberculosis
cggucgcgcaucgcc

SEQ ID NO: 835579 - RNA, 21 nt, Mycobacterium avium subsp. paratuberculosis
cggucgcgcaucgccucggcg

SEQ ID NO: 835580 - RNA, 14 nt, Mycobacterium avium subsp. paratuberculosis
cggucgccgggccg

SEQ ID NO: 835581 - RNA, 24 nt, Mycobacterium avium subsp. paratuberculosis
cggucgcguugaaagccgcgaacg

SEQ ID NO: 835582 - RNA, 18 nt, Mycobacterium avium subsp. paratuberculosis
cggucgcggaaccggccg

SEQ ID NO: 835583 - RNA, 19 nt, Mycobacterium avium subsp. paratuberculosis
cggucgcggaaccggccgg

SEQ ID NO: 835584 - RNA, 12 nt, Mycobacterium avium subsp. paratuberculosis
cggucgcggccg

SEQ ID NO: 835585 - RNA, 13 nt, Mycobacterium avium subsp. paratuberculosis
cggucgcggcgcc

SEQ ID NO: 835586 - RNA, 15 nt, Mycobacterium avium subsp. paratuberculosis
cggucgcggcgccgg

SEQ ID NO: 835587 - RNA, 17 nt, Mycobacterium avium subsp. paratuberculosis
cggucgcggcgucgcgg

SEQ ID NO: 835588 - RNA, 16 nt, Mycobacterium avium subsp. paratuberculosis
cggucgcugaccccgc

SEQ ID NO: 835589 - RNA, 20 nt, Mycobacterium avium subsp. paratuberculosis
cggucgcugaccccgcucgg

SEQ ID NO: 835590 - RNA, 14 nt, Mycobacterium avium subsp. paratuberculosis
cggucgcugacccg

SEQ ID NO: 835591 - RNA, 17 nt, Mycobacterium avium subsp. paratuberculosis
cggucgcugacccgccg

SEQ ID NO: 835592 - RNA, 18 nt, Mycobacterium avium subsp. paratuberculosis
cggucgcugacccgccgc

SEQ ID NO: 835593 - RNA, 21 nt, Mycobacterium avium subsp. paratuberculosis
cggucgcugacccgccgcaac

SEQ ID NO: 835594 - RNA, 23 nt, Mycobacterium avium subsp. paratuberculosis
cggucgcugcagcggcggccagu

SEQ ID NO: 835595 - RNA, 22 nt, Mycobacterium avium subsp. paratuberculosis
cggucgcugggcucgagugccg

SEQ ID NO: 835596 - RNA, 13 nt, Mycobacterium avium subsp. paratuberculosis
cggucgccggugu

SEQ ID NO: 835597 - RNA, 15 nt, Mycobacterium avium subsp. paratuberculosis
cggucgcgcgccggc

SEQ ID NO: 835598 - RNA, 17 nt, Mycobacterium avium subsp. paratuberculosis
cggucgcgcgccggcgc

SEQ ID NO: 835599 - RNA, 21 nt, Mycobacterium avium subsp. paratuberculosis
cggucgcgcgccggcgcagcg

SEQ ID NO: 835600 - RNA, 20 nt, Mycobacterium avium subsp. paratuberculosis
cggucgcgccgaccuggucg

SEQ ID NO: 835601 - RNA, 21 nt, Mycobacterium avium subsp. paratuberculosis
cggucgcgccgaccuggucgc

SEQ ID NO: 835602 - RNA, 17 nt, Mycobacterium avium subsp. paratuberculosis
cggucgcggucggcgcc

SEQ ID NO: 835603 - RNA, 15 nt, Mycobacterium avium subsp. paratuberculosis
cggucgcggugccca

SEQ ID NO: 835604 - RNA, 20 nt, Mycobacterium avium subsp. paratuberculosis
cggucgcggugcccagccgc

SEQ ID NO: 835605 - RNA, 19 nt, Mycobacterium avium subsp. paratuberculosis
cggucgcggugucggcguc

SEQ ID NO: 835606 - RNA, 20 nt, Mycobacterium avium subsp. paratuberculosis
cggucgcggugucggcgucg

SEQ ID NO: 835607 - RNA, 21 nt, Mycobacterium avium subsp. paratuberculosis
cggucgcggugucggcgucga

SEQ ID NO: 835608 - RNA, 24 nt, Mycobacterium avium subsp. paratuberculosis
cggucgcggugucggcgucgaucg

SEQ ID NO: 835609 - RNA, 12 nt, Mycobacterium avium subsp. paratuberculosis
cggucgcgucgu

SEQ ID NO: 835610 - RNA, 13 nt, Mycobacterium avium subsp. paratuberculosis
cggucgcgucguc

SEQ ID NO: 835611 - RNA, 14 nt, Mycobacterium avium subsp. paratuberculosis
cggucgcgucgucg

SEQ ID NO: 835612 - RNA, 19 nt, Mycobacterium avium subsp. paratuberculosis
cggucgcgucgucggcggg

SEQ ID NO: 835613 - RNA, 19 nt, Mycobacterium avium subsp. paratuberculosis
cggucgcgucgugcggccg

SEQ ID NO: 835614 - RNA, 20 nt, Mycobacterium avium subsp. paratuberculosis
cggucgcgucgugcggccgg

SEQ ID NO: 835615 - RNA, 21 nt, Mycobacterium avium subsp. paratuberculosis
cggucgcgucgugcggccggc

SEQ ID NO: 835616 - RNA, 23 nt, Mycobacterium avium subsp. paratuberculosis
cggucgcgucgugcggccggcgc

SEQ ID NO: 835617 - RNA, 21 nt, Mycobacterium avium subsp. paratuberculosis
cggucgcgugaccggcggugc

SEQ ID NO: 835618 - RNA, 19 nt, Mycobacterium avium subsp. paratuberculosis
cggucgucuucuuggccgc

SEQ ID NO: 835619 - RNA, 22 nt, Mycobacterium avium subsp. paratuberculosis
cggucgucuucuuggccgcggc

SEQ ID NO: 835620 - RNA, 19 nt, Mycobacterium avium subsp. paratuberculosis
cggucgucgagcaccggcu

SEQ ID NO: 835621 - RNA, 18 nt, Mycobacterium avium subsp. paratuberculosis
cggucgucgcccaccgac

SEQ ID NO: 835622 - RNA, 13 nt, Mycobacterium avium subsp. paratuberculosis
cggucgucgcccg

SEQ ID NO: 835623 - RNA, 17 nt, Mycobacterium avium subsp. paratuberculosis
cggucguaguaggugcg

SEQ ID NO: 835624 - RNA, 16 nt, Mycobacterium avium subsp. paratuberculosis
cggucguagucggccc

SEQ ID NO: 835625 - RNA, 17 nt, Mycobacterium avium subsp. paratuberculosis
cggucguagucggcccg

SEQ ID NO: 835626 - RNA, 18 nt, Mycobacterium avium subsp. paratuberculosis
cggucguagucggcccgc

SEQ ID NO: 835627 - RNA, 19 nt, Mycobacterium avium subsp. paratuberculosis
cggucggugagcuggccgc

SEQ ID NO: 835628 - RNA, 13 nt, Mycobacterium avium subsp. paratuberculosis
cggucggugcgca

SEQ ID NO: 835629 - RNA, 13 nt, Mycobacterium avium subsp. paratuberculosis
cggucguacacau

SEQ ID NO: 835630 - RNA, 21 nt, Mycobacterium avium subsp. paratuberculosis
cggucguacgucuugcgcacc

SEQ ID NO: 835631 - RNA, 18 nt, Mycobacterium avium subsp. paratuberculosis
cggucgggauggcggcgu

SEQ ID NO: 835632 - RNA, 12 nt, Mycobacterium avium subsp. paratuberculosis
cggucgggccca

SEQ ID NO: 835633 - RNA, 24 nt, Mycobacterium avium subsp. paratuberculosis
cggucggggaauuccggcgcgauc

SEQ ID NO: 835634 - RNA, 12 nt, Mycobacterium avium subsp. paratuberculosis
cggucggcgucc

SEQ ID NO: 835635 - RNA, 16 nt, Mycobacterium avium subsp. paratuberculosis
cggucggcgucgaagg

SEQ ID NO: 835636 - RNA, 15 nt, Mycobacterium avium subsp. paratuberculosis
cggucggcgucgcuc

SEQ ID NO: 835637 - RNA, 13 nt, Mycobacterium avium subsp. paratuberculosis
cggucggcgucgu

SEQ ID NO: 835638 - RNA, 17 nt, Mycobacterium avium subsp. paratuberculosis
cggucggcgucguacag

SEQ ID NO: 835639 - RNA, 12 nt, Mycobacterium avium subsp. paratuberculosis
cggucggcgggu

SEQ ID NO: 835640 - RNA, 14 nt, Mycobacterium avium subsp. paratuberculosis
cggucgggugcgcu

SEQ ID NO: 835641 - RNA, 16 nt, Mycobacterium avium subsp. paratuberculosis
cggucgggugcgcuca

SEQ ID NO: 835642 - RNA, 19 nt, Mycobacterium avium subsp. paratuberculosis
cggucgggugcgcucaccg

SEQ ID NO: 835643 - RNA, 18 nt, Mycobacterium avium subsp. paratuberculosis
cggucggguugcgcggaa

SEQ ID NO: 835644 - RNA, 19 nt, Mycobacterium avium subsp. paratuberculosis
cggucggggcggcgggcga

SEQ ID NO: 835645 - RNA, 21 nt, Mycobacterium avium subsp. paratuberculosis
cggucgggucccggcaacacc

SEQ ID NO: 835646 - RNA, 15 nt, Mycobacterium avium subsp. paratuberculosis
cggucggucggccgc

SEQ ID NO: 835647 - RNA, 18 nt, Mycobacterium avium subsp. paratuberculosis
cggucgguggcggugccg

SEQ ID NO: 835648 - RNA, 20 nt, Mycobacterium avium subsp. paratuberculosis
cggucgguggcggugccgcg

SEQ ID NO: 835649 - RNA, 21 nt, Mycobacterium avium subsp. paratuberculosis
cggucgguggcggugccgcgg

SEQ ID NO: 835650 - RNA, 23 nt, Mycobacterium avium subsp. paratuberculosis
cggucgguggcggugccgcggcg

SEQ ID NO: 835651 - RNA, 21 nt, Mycobacterium avium subsp. paratuberculosis
cggucgguucauccacucggc

SEQ ID NO: 835652 - RNA, 17 nt, Mycobacterium avium subsp. paratuberculosis
cggucggcaggaaagcg

SEQ ID NO: 835653 - RNA, 15 nt, Mycobacterium avium subsp. paratuberculosis
cggucggcauagcgc

SEQ ID NO: 835654 - RNA, 18 nt, Mycobacterium avium subsp. paratuberculosis
cggucggcauagcgccgc

SEQ ID NO: 835655 - RNA, 23 nt, Mycobacterium avium subsp. paratuberculosis
cggucggcaacccgaccucgucg

SEQ ID NO: 835656 - RNA, 13 nt, Mycobacterium avium subsp. paratuberculosis
cggucggacgcgg

SEQ ID NO: 835657 - RNA, 14 nt, Mycobacterium avium subsp. paratuberculosis
cggucggacgcggg

SEQ ID NO: 835658 - RNA, 13 nt, Mycobacterium avium subsp. paratuberculosis
cggucggagccca

SEQ ID NO: 835659 - RNA, 22 nt, Mycobacterium avium subsp. paratuberculosis
cggucggaggccuuggugaugg

SEQ ID NO: 835660 - RNA, 13 nt, Mycobacterium avium subsp. paratuberculosis
cggucggaucgag

SEQ ID NO: 835661 - RNA, 12 nt, Mycobacterium avium subsp. paratuberculosis
cggucggcgccg

SEQ ID NO: 835662 - RNA, 16 nt, Mycobacterium avium subsp. paratuberculosis
cggucggcgccgauca

SEQ ID NO: 835663 - RNA, 17 nt, Mycobacterium avium subsp. paratuberculosis
cggucggcgcggggcca

SEQ ID NO: 835664 - RNA, 15 nt, Mycobacterium avium subsp. paratuberculosis
cggucggccgcgugc

SEQ ID NO: 835665 - RNA, 18 nt, Mycobacterium avium subsp. paratuberculosis
cggucggccgcgugcacc

SEQ ID NO: 835666 - RNA, 15 nt, Mycobacterium avium subsp. paratuberculosis
cggucggccccgcgc

SEQ ID NO: 835667 - RNA, 15 nt, Mycobacterium avium subsp. paratuberculosis
cggucggcccgcugc

SEQ ID NO: 835668 - RNA, 18 nt, Mycobacterium avium subsp. paratuberculosis
cggucggcccgcugcggc

SEQ ID NO: 835669 - RNA, 21 nt, Mycobacterium avium subsp. paratuberculosis
cggucggcccgcugcggcugg

SEQ ID NO: 835670 - RNA, 16 nt, Mycobacterium avium subsp. paratuberculosis
cggugacaucgccacc

SEQ ID NO: 835671 - RNA, 17 nt, Mycobacterium avium subsp. paratuberculosis
cggugacaucgccaccu

SEQ ID NO: 835672 - RNA, 19 nt, Mycobacterium avium subsp. paratuberculosis
cggugacaucgccaccugg

SEQ ID NO: 835673 - RNA, 23 nt, Mycobacterium avium subsp. paratuberculosis
cggugacaucgccaccuggaagc

SEQ ID NO: 835674 - RNA, 20 nt, Mycobacterium avium subsp. paratuberculosis
cggugacaugcccgggcucg

SEQ ID NO: 835675 - RNA, 20 nt, Mycobacterium avium subsp. paratuberculosis
cggugacaaagaucacagcg

SEQ ID NO: 835676 - RNA, 21 nt, Mycobacterium avium subsp. paratuberculosis
cggugacaaagaucacagcgc

SEQ ID NO: 835677 - RNA, 16 nt, Mycobacterium avium subsp. paratuberculosis
cggugaagccgacgcc

SEQ ID NO: 835678 - RNA, 18 nt, Mycobacterium avium subsp. paratuberculosis
cggugaagucggugccca

SEQ ID NO: 835679 - RNA, 20 nt, Mycobacterium avium subsp. paratuberculosis
cggugaagucggugcccagc

SEQ ID NO: 835680 - RNA, 23 nt, Mycobacterium avium subsp. paratuberculosis
cggugaagucggugcccagcgcg

SEQ ID NO: 835681 - RNA, 17 nt, Mycobacterium avium subsp. paratuberculosis
cggugaagugccggcug

SEQ ID NO: 835682 - RNA, 18 nt, Mycobacterium avium subsp. paratuberculosis
cggugaaguugccgccgc

SEQ ID NO: 835683 - RNA, 22 nt, Mycobacterium avium subsp. paratuberculosis
cggugaaguugccgccgccggg

SEQ ID NO: 835684 - RNA, 15 nt, Mycobacterium avium subsp. paratuberculosis
cggugaaguuggcgg

SEQ ID NO: 835685 - RNA, 20 nt, Mycobacterium avium subsp. paratuberculosis
cggugaaguuggcggcggug

SEQ ID NO: 835686 - RNA, 15 nt, Mycobacterium avium subsp. paratuberculosis
cggugaaugucguga

SEQ ID NO: 835687 - RNA, 15 nt, Mycobacterium avium subsp. paratuberculosis
cggugaccgccgcca

SEQ ID NO: 835688 - RNA, 22 nt, Mycobacterium avium subsp. paratuberculosis
cggugaccgccgccauccgcgc

SEQ ID NO: 835689 - RNA, 21 nt, Mycobacterium avium subsp. paratuberculosis
cggugaccgccucgucgaagg

SEQ ID NO: 835690 - RNA, 16 nt, Mycobacterium avium subsp. paratuberculosis
cggugaccaucacgca

SEQ ID NO: 835691 - RNA, 17 nt, Mycobacterium avium subsp. paratuberculosis
cggugaccgcgacgcug

SEQ ID NO: 835692 - RNA, 18 nt, Mycobacterium avium subsp. paratuberculosis
cggugaccgcgacgcugc

SEQ ID NO: 835693 - RNA, 19 nt, Mycobacterium avium subsp. paratuberculosis
cggugaccacgccgugccc

SEQ ID NO: 835694 - RNA, 19 nt, Mycobacterium avium subsp. paratuberculosis
cggugaccacggucggcgg

SEQ ID NO: 835695 - RNA, 14 nt, Mycobacterium avium subsp. paratuberculosis
cggugaacacgaac

SEQ ID NO: 835696 - RNA, 14 nt, Mycobacterium avium subsp. paratuberculosis
cggugaaaccggcg

SEQ ID NO: 835697 - RNA, 15 nt, Mycobacterium avium subsp. paratuberculosis
cggugaaaccggcgc

SEQ ID NO: 835698 - RNA, 17 nt, Mycobacterium avium subsp. paratuberculosis
cggugaaaccggcgccg

SEQ ID NO: 835699 - RNA, 18 nt, Mycobacterium avium subsp. paratuberculosis
cggugaaaccggcgccga

SEQ ID NO: 835700 - RNA, 16 nt, Mycobacterium avium subsp. paratuberculosis
cggucuuggcggccag

SEQ ID NO: 835701 - RNA, 20 nt, Mycobacterium avium subsp. paratuberculosis
cggucuuggcggccagcgcc

SEQ ID NO: 835702 - RNA, 14 nt, Mycobacterium avium subsp. paratuberculosis
cggucuugggcucg

SEQ ID NO: 835703 - RNA, 22 nt, Mycobacterium avium subsp. paratuberculosis
cggucuugggcucggcgcggga

SEQ ID NO: 835704 - RNA, 18 nt, Mycobacterium avium subsp. paratuberculosis
cggucuuguagucgacca

SEQ ID NO: 835705 - RNA, 23 nt, Mycobacterium avium subsp. paratuberculosis
cggucuuguagucgaccacccgc

SEQ ID NO: 835706 - RNA, 20 nt, Mycobacterium avium subsp. paratuberculosis
cggucuuguugugcugcacc

SEQ ID NO: 835707 - RNA, 21 nt, Mycobacterium avium subsp. paratuberculosis
cggucuuguugugcugcaccg

SEQ ID NO: 835708 - RNA, 19 nt, Mycobacterium avium subsp. paratuberculosis
cggucuuugccaucccggu

SEQ ID NO: 835709 - RNA, 19 nt, Mycobacterium avium subsp. paratuberculosis
cggucuuugccggccauga

SEQ ID NO: 835710 - RNA, 14 nt, Mycobacterium avium subsp. paratuberculosis
cggucuuuggcgua

SEQ ID NO: 835711 - RNA, 13 nt, Mycobacterium avium subsp. paratuberculosis
cggugaacccgcc

SEQ ID NO: 835712 - RNA, 16 nt, Mycobacterium avium subsp. paratuberculosis
cggugaacgcgguacc

SEQ ID NO: 835713 - RNA, 21 nt, Mycobacterium avium subsp. paratuberculosis
cggugaacuccgggcccacca

SEQ ID NO: 835714 - RNA, 15 nt, Mycobacterium avium subsp. paratuberculosis
cggugaacugcagcc

SEQ ID NO: 835715 - RNA, 14 nt, Mycobacterium avium subsp. paratuberculosis
cggugaagaucagc

SEQ ID NO: 835716 - RNA, 17 nt, Mycobacterium avium subsp. paratuberculosis
cggugaagaucagcgcg

SEQ ID NO: 835717 - RNA, 18 nt, Mycobacterium avium subsp. paratuberculosis
cggugaagaucagcgcgu

SEQ ID NO: 835718 - RNA, 20 nt, Mycobacterium avium subsp. paratuberculosis
cggugaagaucagcgcgucg

SEQ ID NO: 835719 - RNA, 21 nt, Mycobacterium avium subsp. paratuberculosis
cggugaagaucagcgcgucgg

SEQ ID NO: 835720 - RNA, 16 nt, Mycobacterium avium subsp. paratuberculosis
cggugaagaucgcccg

SEQ ID NO: 835721 - RNA, 18 nt, Mycobacterium avium subsp. paratuberculosis
cggugaagaucgcccgcc

SEQ ID NO: 835722 - RNA, 14 nt, Mycobacterium avium subsp. paratuberculosis
cggugaagccgcgg

SEQ ID NO: 835723 - RNA, 15 nt, Mycobacterium avium subsp. paratuberculosis
cggugaagcggcgcg

SEQ ID NO: 835724 - RNA, 18 nt, Mycobacterium avium subsp. paratuberculosis
cggugaagcgggacagca

SEQ ID NO: 835725 - RNA, 19 nt, Mycobacterium avium subsp. paratuberculosis
cggucguuggccuccucgg

SEQ ID NO: 835726 - RNA, 22 nt, Mycobacterium avium subsp. paratuberculosis
cggucguucgauccgccggugc

SEQ ID NO: 835727 - RNA, 21 nt, Mycobacterium avium subsp. paratuberculosis
cggucguuacgacucggccuc

SEQ ID NO: 835728 - RNA, 13 nt, Mycobacterium avium subsp. paratuberculosis
cggucgugcggcu

SEQ ID NO: 835729 - RNA, 20 nt, Mycobacterium avium subsp. paratuberculosis
cggucguuucggccggcccc

SEQ ID NO: 835730 - RNA, 22 nt, Mycobacterium avium subsp. paratuberculosis
cggucguuucggccggccccgc

SEQ ID NO: 835731 - RNA, 23 nt, Mycobacterium avium subsp. paratuberculosis
cggucucgaacacgccgucgugg

SEQ ID NO: 835732 - RNA, 20 nt, Mycobacterium avium subsp. paratuberculosis
cggucuccaugucgucggcg

SEQ ID NO: 835733 - RNA, 24 nt, Mycobacterium avium subsp. paratuberculosis
cggucuccaugucgucggcggacu

SEQ ID NO: 835734 - RNA, 15 nt, Mycobacterium avium subsp. paratuberculosis
cggucucggcggcgc

SEQ ID NO: 835735 - RNA, 16 nt, Mycobacterium avium subsp. paratuberculosis
cggucucggcggcgcc

SEQ ID NO: 835736 - RNA, 18 nt, Mycobacterium avium subsp. paratuberculosis
cggucucggcggcgccca

SEQ ID NO: 835737 - RNA, 19 nt, Mycobacterium avium subsp. paratuberculosis
cggucucggcggcgcccag

SEQ ID NO: 835738 - RNA, 16 nt, Mycobacterium avium subsp. paratuberculosis
cggucucggucgcggc

SEQ ID NO: 835739 - RNA, 14 nt, Mycobacterium avium subsp. paratuberculosis
cggucucgguggag

SEQ ID NO: 835740 - RNA, 13 nt, Mycobacterium avium subsp. paratuberculosis
cggucucuggccu

SEQ ID NO: 835741 - RNA, 13 nt, Mycobacterium avium subsp. paratuberculosis
cggucucuucgac

SEQ ID NO: 835742 - RNA, 21 nt, Mycobacterium avium subsp. paratuberculosis
cggucucuucgacccgguagc

SEQ ID NO: 835743 - RNA, 15 nt, Mycobacterium avium subsp. paratuberculosis
cggucucgaccgcgg

SEQ ID NO: 835744 - RNA, 16 nt, Mycobacterium avium subsp. paratuberculosis
cggucucgaccgcggc

SEQ ID NO: 835745 - RNA, 19 nt, Mycobacterium avium subsp. paratuberculosis
cggucucgaccgcggcgcc

SEQ ID NO: 835746 - RNA, 20 nt, Mycobacterium avium subsp. paratuberculosis
cggucucgaccgcggcgccg

SEQ ID NO: 835747 - RNA, 14 nt, Mycobacterium avium subsp. paratuberculosis
cggucucgacaccg

SEQ ID NO: 835748 - RNA, 17 nt, Mycobacterium avium subsp. paratuberculosis
cggucucgacaccggcg

SEQ ID NO: 835749 - RNA, 18 nt, Mycobacterium avium subsp. paratuberculosis
cggucucgacaccggcgg

SEQ ID NO: 835750 - RNA, 19 nt, Mycobacterium avium subsp. paratuberculosis
cggucucgacaccggcggu

SEQ ID NO: 835751 - RNA, 17 nt, Mycobacterium avium subsp. paratuberculosis
cggucucgaccgacugc

SEQ ID NO: 835752 - RNA, 20 nt, Mycobacterium avium subsp. paratuberculosis
cggucucgaucugcaccagc

SEQ ID NO: 835753 - RNA, 22 nt, Mycobacterium avium subsp. paratuberculosis
cggucucgaucugcaccagcgc

SEQ ID NO: 835754 - RNA, 22 nt, Mycobacterium avium subsp. paratuberculosis
cggucugguggcagcggacccg

SEQ ID NO: 835755 - RNA, 16 nt, Mycobacterium avium subsp. paratuberculosis
cggucuucucggccag

SEQ ID NO: 835756 - RNA, 18 nt, Mycobacterium avium subsp. paratuberculosis
cggucuucucggccaggc

SEQ ID NO: 835757 - RNA, 16 nt, Mycobacterium avium subsp. paratuberculosis
cggucuucuuggccgc

SEQ ID NO: 835758 - RNA, 17 nt, Mycobacterium avium subsp. paratuberculosis
cggucuucuuggccgcg

SEQ ID NO: 835759 - RNA, 18 nt, Mycobacterium avium subsp. paratuberculosis
cggucuucuuggccgcgc

SEQ ID NO: 835760 - RNA, 20 nt, Mycobacterium avium subsp. paratuberculosis
cggucuucuuggccgcgccg

SEQ ID NO: 835761 - RNA, 21 nt, Mycobacterium avium subsp. paratuberculosis
cggucuucuuggccgcgccgc

SEQ ID NO: 835762 - RNA, 14 nt, Mycobacterium avium subsp. paratuberculosis
cggucuugcggccg

SEQ ID NO: 835763 - RNA, 16 nt, Mycobacterium avium subsp. paratuberculosis
cggucuugcggccguc

SEQ ID NO: 835764 - RNA, 17 nt, Mycobacterium avium subsp. paratuberculosis
cggucuugcggccguca

SEQ ID NO: 835765 - RNA, 18 nt, Mycobacterium avium subsp. paratuberculosis
cggucuuggacagcagca

SEQ ID NO: 835766 - RNA, 21 nt, Mycobacterium avium subsp. paratuberculosis
cggucuuggacagcagcagcu

SEQ ID NO: 835767 - RNA, 23 nt, Mycobacterium avium subsp. paratuberculosis
cggucuuggacagcagcagcucc

SEQ ID NO: 835768 - RNA, 20 nt, Mycobacterium avium subsp. paratuberculosis
cggucugaucgcccagcacc

SEQ ID NO: 835769 - RNA, 15 nt, Mycobacterium avium subsp. paratuberculosis
cggucugcaccggga

SEQ ID NO: 835770 - RNA, 13 nt, Mycobacterium avium subsp. paratuberculosis
cggucugcggccg

SEQ ID NO: 835771 - RNA, 16 nt, Mycobacterium avium subsp. paratuberculosis
cggucugcggccgcga

SEQ ID NO: 835772 - RNA, 17 nt, Mycobacterium avium subsp. paratuberculosis
cggucugcgccagcucc

SEQ ID NO: 835773 - RNA, 16 nt, Mycobacterium avium subsp. paratuberculosis
cggucugcgcccgauc

SEQ ID NO: 835774 - RNA, 18 nt, Mycobacterium avium subsp. paratuberculosis
cggucugcgcccgaucgg

SEQ ID NO: 835775 - RNA, 23 nt, Mycobacterium avium subsp. paratuberculosis
cggucugcgcccgaucggcguga

SEQ ID NO: 835776 - RNA, 16 nt, Mycobacterium avium subsp. paratuberculosis
cggucuggcuggugac

SEQ ID NO: 835777 - RNA, 18 nt, Mycobacterium avium subsp. paratuberculosis
cggucugggaggcggcgg

SEQ ID NO: 835778 - RNA, 18 nt, Mycobacterium avium subsp. paratuberculosis
cggucugggcgaccaugc

SEQ ID NO: 835779 - RNA, 22 nt, Mycobacterium avium subsp. paratuberculosis
cggucugggcgaccaugccgcg

SEQ ID NO: 835780 - RNA, 13 nt, Mycobacterium avium subsp. paratuberculosis
cggucugcggugc

SEQ ID NO: 835781 - RNA, 16 nt, Mycobacterium avium subsp. paratuberculosis
cggucugcgguguggg

SEQ ID NO: 835782 - RNA, 20 nt, Mycobacterium avium subsp. paratuberculosis
cggucugcuccccguugauc

SEQ ID NO: 835783 - RNA, 23 nt, Mycobacterium avium subsp. paratuberculosis
cuaaaccccacggccgcaacggc

SEQ ID NO: 835784 - RNA, 22 nt, Mycobacterium avium subsp. paratuberculosis
cuaaccgcgggcaucgccguca

SEQ ID NO: 835785 - RNA, 21 nt, Mycobacterium avium subsp. paratuberculosis
cguuuuccagccggcgcacca

SEQ ID NO: 835786 - RNA, 16 nt, Mycobacterium avium subsp. paratuberculosis
cguuuggcgccgccca

SEQ ID NO: 835787 - RNA, 16 nt, Mycobacterium avium subsp. paratuberculosis
cguuugaugccguccg

SEQ ID NO: 835788 - RNA, 16 nt, Mycobacterium avium subsp. paratuberculosis
cguuucagcagcgcgu

SEQ ID NO: 835789 - RNA, 21 nt, Mycobacterium avium subsp. paratuberculosis
cguuguuguugccggucggga

SEQ ID NO: 835790 - RNA, 13 nt, Mycobacterium avium subsp. paratuberculosis
cguuguggccacc

SEQ ID NO: 835791 - RNA, 18 nt, Mycobacterium avium subsp. paratuberculosis
cguuguucaggucgaugg

SEQ ID NO: 835792 - RNA, 21 nt, Mycobacterium avium subsp. paratuberculosis
cguuguuccacgugucggcgu

SEQ ID NO: 835793 - RNA, 14 nt, Mycobacterium avium subsp. paratuberculosis
cguuguugcgcggg

SEQ ID NO: 835794 - RNA, 17 nt, Mycobacterium avium subsp. paratuberculosis
cguuguugcucggcggc

SEQ ID NO: 835795 - RNA, 22 nt, Mycobacterium avium subsp. paratuberculosis
cguuguugagcagauccugcag

SEQ ID NO: 835796 - RNA, 23 nt, Mycobacterium avium subsp. paratuberculosis
cguugugcaccggcacgucgagc

SEQ ID NO: 835797 - RNA, 16 nt, Mycobacterium avium subsp. paratuberculosis
cguugugccaccgccg

SEQ ID NO: 835798 - RNA, 19 nt, Mycobacterium avium subsp. paratuberculosis
cguugugccaccgccgaug

SEQ ID NO: 835799 - RNA, 20 nt, Mycobacterium avium subsp. paratuberculosis
cguugugccaccgccgaugg

SEQ ID NO: 835800 - RNA, 17 nt, Mycobacterium avium subsp. paratuberculosis
cguugucgucgccggcc

SEQ ID NO: 835801 - RNA, 12 nt, Mycobacterium avium subsp. paratuberculosis
cguugucgucgg

SEQ ID NO: 835802 - RNA, 19 nt, Mycobacterium avium subsp. paratuberculosis
cguugucgucggggcuggc

SEQ ID NO: 835803 - RNA, 16 nt, Mycobacterium avium subsp. paratuberculosis
cguugucucggcgccg

SEQ ID NO: 835804 - RNA, 18 nt, Mycobacterium avium subsp. paratuberculosis
cguugucucggcgccguc

SEQ ID NO: 835805 - RNA, 23 nt, Mycobacterium avium subsp. paratuberculosis
cguugugaauccagccgugcggc

SEQ ID NO: 835806 - RNA, 15 nt, Mycobacterium avium subsp. paratuberculosis
cguugugacccgcuc

SEQ ID NO: 835807 - RNA, 15 nt, Mycobacterium avium subsp. paratuberculosis
cguuguccacccccg

SEQ ID NO: 835808 - RNA, 22 nt, Mycobacterium avium subsp. paratuberculosis
cguuguccacccccgcggugag

SEQ ID NO: 835809 - RNA, 13 nt, Mycobacterium avium subsp. paratuberculosis
cguugucgagcga

SEQ ID NO: 835810 - RNA, 23 nt, Mycobacterium avium subsp. paratuberculosis
cguugucgaggucggugaggcug

SEQ ID NO: 835811 - RNA, 23 nt, Mycobacterium avium subsp. paratuberculosis
cguuguccagcagcgccggcagc

SEQ ID NO: 835812 - RNA, 13 nt, Mycobacterium avium subsp. paratuberculosis
cguugucgcccgg

SEQ ID NO: 835813 - RNA, 14 nt, Mycobacterium avium subsp. paratuberculosis
cguugucggcgacg

SEQ ID NO: 835814 - RNA, 16 nt, Mycobacterium avium subsp. paratuberculosis
cguugucggcgacggc

SEQ ID NO: 835815 - RNA, 16 nt, Mycobacterium avium subsp. paratuberculosis
cguugguggucugcca

SEQ ID NO: 835816 - RNA, 14 nt, Mycobacterium avium subsp. paratuberculosis
cguuggugaucgcc

SEQ ID NO: 835817 - RNA, 18 nt, Mycobacterium avium subsp. paratuberculosis
cguuggugaucgccgacg

SEQ ID NO: 835818 - RNA, 20 nt, Mycobacterium avium subsp. paratuberculosis
cguuggugaugcggucggcg

SEQ ID NO: 835819 - RNA, 22 nt, Mycobacterium avium subsp. paratuberculosis
cguuggugaugcggucggcgcg

SEQ ID NO: 835820 - RNA, 17 nt, Mycobacterium avium subsp. paratuberculosis
cguuggugcgcaccagc

SEQ ID NO: 835821 - RNA, 15 nt, Mycobacterium avium subsp. paratuberculosis
cguugguggucgacg

SEQ ID NO: 835822 - RNA, 16 nt, Mycobacterium avium subsp. paratuberculosis
cguugguggucgacgc

SEQ ID NO: 835823 - RNA, 21 nt, Mycobacterium avium subsp. paratuberculosis
cguugguggucgacgcgccgc

SEQ ID NO: 835824 - RNA, 15 nt, Mycobacterium avium subsp. paratuberculosis
cguuguaguagaccu

SEQ ID NO: 835825 - RNA, 17 nt, Mycobacterium avium subsp. paratuberculosis
cguugggcagcucggcg

SEQ ID NO: 835826 - RNA, 18 nt, Mycobacterium avium subsp. paratuberculosis
cguugggggcgccgcggc

SEQ ID NO: 835827 - RNA, 15 nt, Mycobacterium avium subsp. paratuberculosis
cguugggggucgacu

SEQ ID NO: 835828 - RNA, 21 nt, Mycobacterium avium subsp. paratuberculosis
cguugggucucaucccgccga

SEQ ID NO: 835829 - RNA, 19 nt, Mycobacterium avium subsp. paratuberculosis
cguuggcuuccucgcugac

SEQ ID NO: 835830 - RNA, 14 nt, Mycobacterium avium subsp. paratuberculosis
cguugggccagaac

SEQ ID NO: 835831 - RNA, 15 nt, Mycobacterium avium subsp. paratuberculosis
cguugggccagcggc

SEQ ID NO: 835832 - RNA, 21 nt, Mycobacterium avium subsp. paratuberculosis
cguugggccagcggcgccggg

SEQ ID NO: 835833 - RNA, 14 nt, Mycobacterium avium subsp. paratuberculosis
cguuggcggccagc

SEQ ID NO: 835834 - RNA, 16 nt, Mycobacterium avium subsp. paratuberculosis
cguuggcggccagcgc

SEQ ID NO: 835835 - RNA, 23 nt, Mycobacterium avium subsp. paratuberculosis
cguuggcggccagcgcgccgccg

SEQ ID NO: 835836 - RNA, 14 nt, Mycobacterium avium subsp. paratuberculosis
cguuggcgccgacg

SEQ ID NO: 835837 - RNA, 19 nt, Mycobacterium avium subsp. paratuberculosis
cguuggcgccggucgacgc

SEQ ID NO: 835838 - RNA, 19 nt, Mycobacterium avium subsp. paratuberculosis
cguuggcgccguccgcggc

SEQ ID NO: 835839 - RNA, 14 nt, Mycobacterium avium subsp. paratuberculosis
cguuggcggcggug

SEQ ID NO: 835840 - RNA, 23 nt, Mycobacterium avium subsp. paratuberculosis
cguuggcggcggugggcugggcg

SEQ ID NO: 835841 - RNA, 15 nt, Mycobacterium avium subsp. paratuberculosis
cguuggcguggaugg

SEQ ID NO: 835842 - RNA, 22 nt, Mycobacterium avium subsp. paratuberculosis
cguuggccagguugcgccgucc

SEQ ID NO: 835843 - RNA, 15 nt, Mycobacterium avium subsp. paratuberculosis
cguuggccgccgccu

SEQ ID NO: 835844 - RNA, 13 nt, Mycobacterium avium subsp. paratuberculosis
cguuggcccgcac

SEQ ID NO: 835845 - RNA, 17 nt, Mycobacterium avium subsp. paratuberculosis
cguuggcccgcacccgc

SEQ ID NO: 835846 - RNA, 21 nt, Mycobacterium avium subsp. paratuberculosis
cguuggcccgcacccgccgcc

SEQ ID NO: 835847 - RNA, 15 nt, Mycobacterium avium subsp. paratuberculosis
cguuggcccgccgcg

SEQ ID NO: 835848 - RNA, 16 nt, Mycobacterium avium subsp. paratuberculosis
cguuggcccgccgcgg

SEQ ID NO: 835849 - RNA, 19 nt, Mycobacterium avium subsp. paratuberculosis
cguuggcccgugucgcggc

SEQ ID NO: 835850 - RNA, 15 nt, Mycobacterium avium subsp. paratuberculosis
cguuggccgagcagc

SEQ ID NO: 835851 - RNA, 21 nt, Mycobacterium avium subsp. paratuberculosis
cguuggccgagcagccgggcc

SEQ ID NO: 835852 - RNA, 15 nt, Mycobacterium avium subsp. paratuberculosis
cguuggccggcugga

SEQ ID NO: 835853 - RNA, 14 nt, Mycobacterium avium subsp. paratuberculosis
cuaaggccgcugcc

SEQ ID NO: 835854 - RNA, 24 nt, Mycobacterium avium subsp. paratuberculosis
cuaagccggcgucgggaccgucgc

SEQ ID NO: 835855 - RNA, 19 nt, Mycobacterium avium subsp. paratuberculosis
cuacacagcccccacgcuc

SEQ ID NO: 835856 - RNA, 15 nt, Mycobacterium avium subsp. paratuberculosis
cuacaggugccggcg

SEQ ID NO: 835857 - RNA, 17 nt, Mycobacterium avium subsp. paratuberculosis
cuacaggugccggcggc

SEQ ID NO: 835858 - RNA, 20 nt, Mycobacterium avium subsp. paratuberculosis
cuaccaggcgugcacccggu

SEQ ID NO: 835859 - RNA, 22 nt, Mycobacterium avium subsp. paratuberculosis
cuacggacgcauccacggccgg

SEQ ID NO: 835860 - RNA, 19 nt, Mycobacterium avium subsp. paratuberculosis
cuacgccguggccugcgac

SEQ ID NO: 835861 - RNA, 15 nt, Mycobacterium avium subsp. paratuberculosis
cuaccugaccagcgg

SEQ ID NO: 835862 - RNA, 16 nt, Mycobacterium avium subsp. paratuberculosis
cuaccugaccagcggc

SEQ ID NO: 835863 - RNA, 18 nt, Mycobacterium avium subsp. paratuberculosis
cuaccugguugacgcccc

SEQ ID NO: 835864 - RNA, 23 nt, Mycobacterium avium subsp. paratuberculosis
cuacgccggcucggucuccucca

SEQ ID NO: 835865 - RNA, 19 nt, Mycobacterium avium subsp. paratuberculosis
cuacgacauccugcgcauc

SEQ ID NO: 835866 - RNA, 14 nt, Mycobacterium avium subsp. paratuberculosis
cuaccgccgggcgg

SEQ ID NO: 835867 - RNA, 16 nt, Mycobacterium avium subsp. paratuberculosis
cuaccgccgggcgggc

SEQ ID NO: 835868 - RNA, 17 nt, Mycobacterium avium subsp. paratuberculosis
cuaccggcucggcccgg

SEQ ID NO: 835869 - RNA, 16 nt, Mycobacterium avium subsp. paratuberculosis
cuaccuaggcgucguc

SEQ ID NO: 835870 - RNA, 22 nt, Mycobacterium avium subsp. paratuberculosis
cuaccuaggcgucgucggccca

SEQ ID NO: 835871 - RNA, 23 nt, Mycobacterium avium subsp. paratuberculosis
cuaccggguggccagcaccagcc

SEQ ID NO: 835872 - RNA, 14 nt, Mycobacterium avium subsp. paratuberculosis
cuaccgccucgcca

SEQ ID NO: 835873 - RNA, 15 nt, Mycobacterium avium subsp. paratuberculosis
cuaccgccucgccag

SEQ ID NO: 835874 - RNA, 16 nt, Mycobacterium avium subsp. paratuberculosis
cuaccgccucgccagc

SEQ ID NO: 835875 - RNA, 18 nt, Mycobacterium avium subsp. paratuberculosis
cuacccggcgaaccggga

SEQ ID NO: 835876 - RNA, 14 nt, Mycobacterium avium subsp. paratuberculosis
cuacccguccagcg

SEQ ID NO: 835877 - RNA, 16 nt, Mycobacterium avium subsp. paratuberculosis
cuacccguccagcgcg

SEQ ID NO: 835878 - RNA, 16 nt, Mycobacterium avium subsp. paratuberculosis
cuagacgcgcaccagg

SEQ ID NO: 835879 - RNA, 23 nt, Mycobacterium avium subsp. paratuberculosis
cuagacgcgcaccagggccgcga

SEQ ID NO: 835880 - RNA, 22 nt, Mycobacterium avium subsp. paratuberculosis
cuagcgagcgggcacgccgccg

SEQ ID NO: 835881 - RNA, 14 nt, Mycobacterium avium subsp. paratuberculosis
cuacuugcggccgc

SEQ ID NO: 835882 - RNA, 22 nt, Mycobacterium avium subsp. paratuberculosis
cuacuugcguugcgcggcggcc

SEQ ID NO: 835883 - RNA, 13 nt, Mycobacterium avium subsp. paratuberculosis
cuacggcgccggu

SEQ ID NO: 835884 - RNA, 21 nt, Mycobacterium avium subsp. paratuberculosis
cuacugcugcgggugcggcca

SEQ ID NO: 835885 - RNA, 22 nt, Mycobacterium avium subsp. paratuberculosis
cuagcgugacagucgaccucgc

SEQ ID NO: 835886 - RNA, 20 nt, Mycobacterium avium subsp. paratuberculosis
cuagcgugacgcucgcgugg

SEQ ID NO: 835887 - RNA, 21 nt, Mycobacterium avium subsp. paratuberculosis
cuagcggccuaggacgccgcc

SEQ ID NO: 835888 - RNA, 21 nt, Mycobacterium avium subsp. paratuberculosis
cuagcucggccggggcgacca

SEQ ID NO: 835889 - RNA, 19 nt, Mycobacterium avium subsp. paratuberculosis
cuagcgcgaaaagacgcga

SEQ ID NO: 835890 - RNA, 20 nt, Mycobacterium avium subsp. paratuberculosis
cuagcggcugacccgcccgg

SEQ ID NO: 835891 - RNA, 13 nt, Mycobacterium avium subsp. paratuberculosis
cuagcgggcgcgc

SEQ ID NO: 835892 - RNA, 15 nt, Mycobacterium avium subsp. paratuberculosis
cuagcgggcgcgcag

SEQ ID NO: 835893 - RNA, 15 nt, Mycobacterium avium subsp. paratuberculosis
cuagcuucacgcucg

SEQ ID NO: 835894 - RNA, 18 nt, Mycobacterium avium subsp. paratuberculosis
cuagcuucacgcucggca

SEQ ID NO: 835895 - RNA, 18 nt, Mycobacterium avium subsp. paratuberculosis
cuagcuucacgcucggcg

SEQ ID NO: 835896 - RNA, 17 nt, Mycobacterium avium subsp. paratuberculosis
cuagcuucacguucggc

SEQ ID NO: 835897 - RNA, 19 nt, Mycobacterium avium subsp. paratuberculosis
cuagcuucacguucggcga

SEQ ID NO: 835898 - RNA, 13 nt, Mycobacterium avium subsp. paratuberculosis
cuaggaccccggc

SEQ ID NO: 835899 - RNA, 16 nt, Mycobacterium avium subsp. paratuberculosis
cuaggaccccggcugc

SEQ ID NO: 835900 - RNA, 14 nt, Mycobacterium avium subsp. paratuberculosis
cuaggcggccgggc

SEQ ID NO: 835901 - RNA, 15 nt, Mycobacterium avium subsp. paratuberculosis
cuaggcggccgggcg

SEQ ID NO: 835902 - RNA, 16 nt, Mycobacterium avium subsp. paratuberculosis
cuaggcggccgggcgg

SEQ ID NO: 835903 - RNA, 14 nt, Mycobacterium avium subsp. paratuberculosis
cuaggcgucgucgg

SEQ ID NO: 835904 - RNA, 19 nt, Mycobacterium avium subsp. paratuberculosis
cuaggcgucgucggcccag

SEQ ID NO: 835905 - RNA, 14 nt, Mycobacterium avium subsp. paratuberculosis
cuaggcucggcagc

SEQ ID NO: 835906 - RNA, 18 nt, Mycobacterium avium subsp. paratuberculosis
cuaggccagcagcgcggc

SEQ ID NO: 835907 - RNA, 16 nt, Mycobacterium avium subsp. paratuberculosis
cgugcuuggccagcuc

SEQ ID NO: 835908 - RNA, 19 nt, Mycobacterium avium subsp. paratuberculosis
cgugcuuggccagcucggc

SEQ ID NO: 835909 - RNA, 23 nt, Mycobacterium avium subsp. paratuberculosis
cgugcuuggccagcucggcggcc

SEQ ID NO: 835910 - RNA, 15 nt, Mycobacterium avium subsp. paratuberculosis
cguggaucaucccga

SEQ ID NO: 835911 - RNA, 23 nt, Mycobacterium avium subsp. paratuberculosis
cguggaucaucccgaccagcuga

SEQ ID NO: 835912 - RNA, 21 nt, Mycobacterium avium subsp. paratuberculosis
cguggagucgaagcggugcac

SEQ ID NO: 835913 - RNA, 23 nt, Mycobacterium avium subsp. paratuberculosis
cguggauggacgcccagaacugg

SEQ ID NO: 835914 - RNA, 16 nt, Mycobacterium avium subsp. paratuberculosis
cguggaucucgaacgg

SEQ ID NO: 835915 - RNA, 21 nt, Mycobacterium avium subsp. paratuberculosis
cguggaucucgaacggcccgg

SEQ ID NO: 835916 - RNA, 17 nt, Mycobacterium avium subsp. paratuberculosis
cgugcuugaacgccgcc

SEQ ID NO: 835917 - RNA, 17 nt, Mycobacterium avium subsp. paratuberculosis
cgugcuguugcaggugc

SEQ ID NO: 835918 - RNA, 23 nt, Mycobacterium avium subsp. paratuberculosis
cgugcugugagcuuccugccaac

SEQ ID NO: 835919 - RNA, 19 nt, Mycobacterium avium subsp. paratuberculosis
cgugcugugcgggcggugc

SEQ ID NO: 835920 - RNA, 19 nt, Mycobacterium avium subsp. paratuberculosis
cgugcugugcugccugccg

SEQ ID NO: 835921 - RNA, 17 nt, Mycobacterium avium subsp. paratuberculosis
cgugcugggccgggcgg

SEQ ID NO: 835922 - RNA, 18 nt, Mycobacterium avium subsp. paratuberculosis
cgugcugggccgggcggu

SEQ ID NO: 835923 - RNA, 16 nt, Mycobacterium avium subsp. paratuberculosis
cgugcuggccggguug

SEQ ID NO: 835924 - RNA, 22 nt, Mycobacterium avium subsp. paratuberculosis
cguggcagggccagcagcccgg

SEQ ID NO: 835925 - RNA, 16 nt, Mycobacterium avium subsp. paratuberculosis
cguggcaggucgggcu

SEQ ID NO: 835926 - RNA, 19 nt, Mycobacterium avium subsp. paratuberculosis
cguggcacccgggcgcgac

SEQ ID NO: 835927 - RNA, 15 nt, Mycobacterium avium subsp. paratuberculosis
cguggccagcaccgu

SEQ ID NO: 835928 - RNA, 19 nt, Mycobacterium avium subsp. paratuberculosis
cguggccagcaccgucagc

SEQ ID NO: 835929 - RNA, 13 nt, Mycobacterium avium subsp. paratuberculosis
cguggccagcgcc

SEQ ID NO: 835930 - RNA, 20 nt, Mycobacterium avium subsp. paratuberculosis
cguggccagcgccagcgcca

SEQ ID NO: 835931 - RNA, 14 nt, Mycobacterium avium subsp. paratuberculosis
cguggcccacggga

SEQ ID NO: 835932 - RNA, 17 nt, Mycobacterium avium subsp. paratuberculosis
cguggauggccggccgg

SEQ ID NO: 835933 - RNA, 19 nt, Mycobacterium avium subsp. paratuberculosis
cguggauggccggccgggu

SEQ ID NO: 835934 - RNA, 13 nt, Mycobacterium avium subsp. paratuberculosis
cguggcaccgggu

SEQ ID NO: 835935 - RNA, 22 nt, Mycobacterium avium subsp. paratuberculosis
cguggcaccgggugggccgacc

SEQ ID NO: 835936 - RNA, 16 nt, Mycobacterium avium subsp. paratuberculosis
cguggcagcggucggc

SEQ ID NO: 835937 - RNA, 19 nt, Mycobacterium avium subsp. paratuberculosis
cguggcagcggucggcggc

SEQ ID NO: 835938 - RNA, 21 nt, Mycobacterium avium subsp. paratuberculosis
cguggcagcggucggcggcug

SEQ ID NO: 835939 - RNA, 16 nt, Mycobacterium avium subsp. paratuberculosis
cguggcaggcacgagc

SEQ ID NO: 835940 - RNA, 23 nt, Mycobacterium avium subsp. paratuberculosis
cguggcaggccaucagcccggcg

SEQ ID NO: 835941 - RNA, 22 nt, Mycobacterium avium subsp. paratuberculosis
cguggcaggcgauggcgucggc

SEQ ID NO: 835942 - RNA, 17 nt, Mycobacterium avium subsp. paratuberculosis
cguggcaggcgauggug

SEQ ID NO: 835943 - RNA, 15 nt, Mycobacterium avium subsp. paratuberculosis
cgugcuccagcaggc

SEQ ID NO: 835944 - RNA, 22 nt, Mycobacterium avium subsp. paratuberculosis
cgugcuccagcaggcgcgccga

SEQ ID NO: 835945 - RNA, 16 nt, Mycobacterium avium subsp. paratuberculosis
cgugcucccgccgaga

SEQ ID NO: 835946 - RNA, 19 nt, Mycobacterium avium subsp. paratuberculosis
cgugcucaucuacgucguc

SEQ ID NO: 835947 - RNA, 20 nt, Mycobacterium avium subsp. paratuberculosis
cgugcucaucuacgucgucg

SEQ ID NO: 835948 - RNA, 22 nt, Mycobacterium avium subsp. paratuberculosis
cgugcucaucuacgucgucgcc

SEQ ID NO: 835949 - RNA, 16 nt, Mycobacterium avium subsp. paratuberculosis
cgugcgugcgcucgac

SEQ ID NO: 835950 - RNA, 13 nt, Mycobacterium avium subsp. paratuberculosis
cgugcgucacgcu

SEQ ID NO: 835951 - RNA, 15 nt, Mycobacterium avium subsp. paratuberculosis
cgugcgucacgcugg

SEQ ID NO: 835952 - RNA, 17 nt, Mycobacterium avium subsp. paratuberculosis
cgugcgucacgcuggug

SEQ ID NO: 835953 - RNA, 20 nt, Mycobacterium avium subsp. paratuberculosis
cgugcgucacgcuggugacg

SEQ ID NO: 835954 - RNA, 17 nt, Mycobacterium avium subsp. paratuberculosis
cgugcguccaggacucg

SEQ ID NO: 835955 - RNA, 19 nt, Mycobacterium avium subsp. paratuberculosis
cgugcgguuggcccgcggc

SEQ ID NO: 835956 - RNA, 20 nt, Mycobacterium avium subsp. paratuberculosis
cgugcgguuggcccgcggcg

SEQ ID NO: 835957 - RNA, 21 nt, Mycobacterium avium subsp. paratuberculosis
cgugcgguuggcccgcggcgc

SEQ ID NO: 835958 - RNA, 23 nt, Mycobacterium avium subsp. paratuberculosis
cgugcguacuucgcguuccgcca

SEQ ID NO: 835959 - RNA, 16 nt, Mycobacterium avium subsp. paratuberculosis
cgugcggucgcaccaa

SEQ ID NO: 835960 - RNA, 15 nt, Mycobacterium avium subsp. paratuberculosis
cgugcggucgcggga

SEQ ID NO: 835961 - RNA, 23 nt, Mycobacterium avium subsp. paratuberculosis
cgugcggguuggcgccggugaag

SEQ ID NO: 835962 - RNA, 18 nt, Mycobacterium avium subsp. paratuberculosis
cgugcggauggccccggc

SEQ ID NO: 835963 - RNA, 14 nt, Mycobacterium avium subsp. paratuberculosis
cgugcgcgcuggug

SEQ ID NO: 835964 - RNA, 14 nt, Mycobacterium avium subsp. paratuberculosis
cgugcgcggcgacc

SEQ ID NO: 835965 - RNA, 15 nt, Mycobacterium avium subsp. paratuberculosis
cgugcgcggcgacca

SEQ ID NO: 835966 - RNA, 21 nt, Mycobacterium avium subsp. paratuberculosis
cgugcgcggcgaccaccucgg

SEQ ID NO: 835967 - RNA, 13 nt, Mycobacterium avium subsp. paratuberculosis
cgugcgcggcgcg

SEQ ID NO: 835968 - RNA, 12 nt, Mycobacterium avium subsp. paratuberculosis
cgugcgcgucga

SEQ ID NO: 835969 - RNA, 13 nt, Mycobacterium avium subsp. paratuberculosis
cgugcgcgucgac

SEQ ID NO: 835970 - RNA, 19 nt, Mycobacterium avium subsp. paratuberculosis
cgugcgcgucgacaccccg

SEQ ID NO: 835971 - RNA, 23 nt, Mycobacterium avium subsp. paratuberculosis
cgugcgcgucgacaccccgcucg

SEQ ID NO: 835972 - RNA, 16 nt, Mycobacterium avium subsp. paratuberculosis
cgugcgcggccgccca

SEQ ID NO: 835973 - RNA, 21 nt, Mycobacterium avium subsp. paratuberculosis
cgugcgcucgaccucggcggc

SEQ ID NO: 835974 - RNA, 23 nt, Mycobacterium avium subsp. paratuberculosis
cgugcgcucgaccucggcggcca

SEQ ID NO: 835975 - RNA, 23 nt, Mycobacterium avium subsp. paratuberculosis
cgugcgcgcgcaccugaaccgcg

SEQ ID NO: 835976 - RNA, 15 nt, Mycobacterium avium subsp. paratuberculosis
cgucucggccagccg

SEQ ID NO: 835977 - RNA, 17 nt, Mycobacterium avium subsp. paratuberculosis
cgucucggccagccggu

SEQ ID NO: 835978 - RNA, 16 nt, Mycobacterium avium subsp. paratuberculosis
cgucucggccgcggug

SEQ ID NO: 835979 - RNA, 18 nt, Mycobacterium avium subsp. paratuberculosis
cgucucggccgcggugcg

SEQ ID NO: 835980 - RNA, 23 nt, Mycobacterium avium subsp. paratuberculosis
cgucucgcgggaguggccggcgu

SEQ ID NO: 835981 - RNA, 18 nt, Mycobacterium avium subsp. paratuberculosis
cgucucgaaccgucuagc

SEQ ID NO: 835982 - RNA, 15 nt, Mycobacterium avium subsp. paratuberculosis
cgucucgccggggaa

SEQ ID NO: 835983 - RNA, 23 nt, Mycobacterium avium subsp. paratuberculosis
cgucucgccggggaacaccggcg

SEQ ID NO: 835984 - RNA, 16 nt, Mycobacterium avium subsp. paratuberculosis
cgucucggagcggugu

SEQ ID NO: 835985 - RNA, 19 nt, Mycobacterium avium subsp. paratuberculosis
cgucucggagcggugucgc

SEQ ID NO: 835986 - RNA, 12 nt, Mycobacterium avium subsp. paratuberculosis
cgucucggcgau

SEQ ID NO: 835987 - RNA, 16 nt, Mycobacterium avium subsp. paratuberculosis
cgucucggcgaucagc

SEQ ID NO: 835988 - RNA, 13 nt, Mycobacterium avium subsp. paratuberculosis
cgucucggcggcc

SEQ ID NO: 835989 - RNA, 14 nt, Mycobacterium avium subsp. paratuberculosis
cgucucggcggccg

SEQ ID NO: 835990 - RNA, 18 nt, Mycobacterium avium subsp. paratuberculosis
cgucucggcgucucggcc

SEQ ID NO: 835991 - RNA, 19 nt, Mycobacterium avium subsp. paratuberculosis
cgucucggcgucucggccc

SEQ ID NO: 835992 - RNA, 20 nt, Mycobacterium avium subsp. paratuberculosis
cgucucggcgucucggcccg

SEQ ID NO: 835993 - RNA, 17 nt, Mycobacterium avium subsp. paratuberculosis
cgugguaccggcgccag

SEQ ID NO: 835994 - RNA, 19 nt, Mycobacterium avium subsp. paratuberculosis
cgugguaccggcgccaggc

SEQ ID NO: 835995 - RNA, 17 nt, Mycobacterium avium subsp. paratuberculosis
cguggucaacggcaccg

SEQ ID NO: 835996 - RNA, 22 nt, Mycobacterium avium subsp. paratuberculosis
cguggucacccgcagcccgacc

SEQ ID NO: 835997 - RNA, 19 nt, Mycobacterium avium subsp. paratuberculosis
cguggucagcgucucgccg

SEQ ID NO: 835998 - RNA, 22 nt, Mycobacterium avium subsp. paratuberculosis
cguggucagcgucucgccgggg

SEQ ID NO: 835999 - RNA, 20 nt, Mycobacterium avium subsp. paratuberculosis
cgugguugcguucgccggcg

SEQ ID NO: 836000 - RNA, 15 nt, Mycobacterium avium subsp. paratuberculosis
cgugguuggcgauca

SEQ ID NO: 836001 - RNA, 22 nt, Mycobacterium avium subsp. paratuberculosis
cguggucgaugaacucgcgggc

SEQ ID NO: 836002 - RNA, 20 nt, Mycobacterium avium subsp. paratuberculosis
cgugguccagcacgugccca

SEQ ID NO: 836003 - RNA, 22 nt, Mycobacterium avium subsp. paratuberculosis
cgugguccagcacgugcccagc

SEQ ID NO: 836004 - RNA, 15 nt, Mycobacterium avium subsp. paratuberculosis
cguggucccaggacc

SEQ ID NO: 836005 - RNA, 12 nt, Mycobacterium avium subsp. paratuberculosis
cguggucgacgc

SEQ ID NO: 836006 - RNA, 18 nt, Mycobacterium avium subsp. paratuberculosis
cguggucgacgccguggu

SEQ ID NO: 836007 - RNA, 17 nt, Mycobacterium avium subsp. paratuberculosis
cgugucgcccguggccc

SEQ ID NO: 836008 - RNA, 23 nt, Mycobacterium avium subsp. paratuberculosis
cgugucgagcacgucgacgccgg

SEQ ID NO: 836009 - RNA, 16 nt, Mycobacterium avium subsp. paratuberculosis
cguguccgcgccggcg

SEQ ID NO: 836010 - RNA, 15 nt, Mycobacterium avium subsp. paratuberculosis
cguguccgucgccgg

SEQ ID NO: 836011 - RNA, 16 nt, Mycobacterium avium subsp. paratuberculosis
cguguccgucgccgga

SEQ ID NO: 836012 - RNA, 13 nt, Mycobacterium avium subsp. paratuberculosis
cgugucccggcgc

SEQ ID NO: 836013 - RNA, 16 nt, Mycobacterium avium subsp. paratuberculosis
cgugucccugcggcug

SEQ ID NO: 836014 - RNA, 21 nt, Mycobacterium avium subsp. paratuberculosis
cgugucccugcggcugcauca

SEQ ID NO: 836015 - RNA, 14 nt, Mycobacterium avium subsp. paratuberculosis
cguguccgacgccg

SEQ ID NO: 836016 - RNA, 17 nt, Mycobacterium avium subsp. paratuberculosis
cguguccgacgccgucg

SEQ ID NO: 836017 - RNA, 14 nt, Mycobacterium avium subsp. paratuberculosis
cguguccgaugacg

SEQ ID NO: 836018 - RNA, 18 nt, Mycobacterium avium subsp. paratuberculosis
cguguccgaugacgagca

SEQ ID NO: 836019 - RNA, 14 nt, Mycobacterium avium subsp. paratuberculosis
cguguaguacaggc

SEQ ID NO: 836020 - RNA, 20 nt, Mycobacterium avium subsp. paratuberculosis
cgugucacuacccgcgaugg

SEQ ID NO: 836021 - RNA, 16 nt, Mycobacterium avium subsp. paratuberculosis
cguguacucggcgucg

SEQ ID NO: 836022 - RNA, 17 nt, Mycobacterium avium subsp. paratuberculosis
cguguacucggcgucgc

SEQ ID NO: 836023 - RNA, 15 nt, Mycobacterium avium subsp. paratuberculosis
cguguagccugcggc

SEQ ID NO: 836024 - RNA, 16 nt, Mycobacterium avium subsp. paratuberculosis
cguguagccugcggcc

SEQ ID NO: 836025 - RNA, 16 nt, Mycobacterium avium subsp. paratuberculosis
cguguaggccgcgcug

SEQ ID NO: 836026 - RNA, 18 nt, Mycobacterium avium subsp. paratuberculosis
cgugggguucccggccgg

SEQ ID NO: 836027 - RNA, 24 nt, Mycobacterium avium subsp. paratuberculosis
cgugggguucccggccgguggccg

SEQ ID NO: 836028 - RNA, 23 nt, Mycobacterium avium subsp. paratuberculosis
cgugggguuuucggcgcgcgccg

SEQ ID NO: 836029 - RNA, 14 nt, Mycobacterium avium subsp. paratuberculosis
cgugggcggcgcga

SEQ ID NO: 836030 - RNA, 20 nt, Mycobacterium avium subsp. paratuberculosis
cgugggcggcgcgaucgucg

SEQ ID NO: 836031 - RNA, 18 nt, Mycobacterium avium subsp. paratuberculosis
cgugggcgccgucgccgc

SEQ ID NO: 836032 - RNA, 18 nt, Mycobacterium avium subsp. paratuberculosis
cguggguauccgccgcca

SEQ ID NO: 836033 - RNA, 17 nt, Mycobacterium avium subsp. paratuberculosis
cgugggucaaccgguag

SEQ ID NO: 836034 - RNA, 13 nt, Mycobacterium avium subsp. paratuberculosis
cgugggugacccg

SEQ ID NO: 836035 - RNA, 23 nt, Mycobacterium avium subsp. paratuberculosis
cguggguggugaccaggcuugcc

SEQ ID NO: 836036 - RNA, 15 nt, Mycobacterium avium subsp. paratuberculosis
cgugggugucggcga

SEQ ID NO: 836037 - RNA, 12 nt, Mycobacterium avium subsp. paratuberculosis
cgugggugccga

SEQ ID NO: 836038 - RNA, 15 nt, Mycobacterium avium subsp. paratuberculosis
cguggcugaccgacg

SEQ ID NO: 836039 - RNA, 21 nt, Mycobacterium avium subsp. paratuberculosis
cguggcugaccgacggcgacc

SEQ ID NO: 836040 - RNA, 15 nt, Mycobacterium avium subsp. paratuberculosis
cguggcugaggccgc

SEQ ID NO: 836041 - RNA, 17 nt, Mycobacterium avium subsp. paratuberculosis
cguggcgugccgggcgg

SEQ ID NO: 836042 - RNA, 16 nt, Mycobacterium avium subsp. paratuberculosis
cguggcucagcggcag

SEQ ID NO: 836043 - RNA, 19 nt, Mycobacterium avium subsp. paratuberculosis
cguggcucagcggcaggug

SEQ ID NO: 836044 - RNA, 15 nt, Mycobacterium avium subsp. paratuberculosis
cguggcucggcccgc

SEQ ID NO: 836045 - RNA, 17 nt, Mycobacterium avium subsp. paratuberculosis
cguggcucggcccgccg

SEQ ID NO: 836046 - RNA, 20 nt, Mycobacterium avium subsp. paratuberculosis
cguggcucggcccgccgggc

SEQ ID NO: 836047 - RNA, 18 nt, Mycobacterium avium subsp. paratuberculosis
cguggcugaacagcgcgc

SEQ ID NO: 836048 - RNA, 20 nt, Mycobacterium avium subsp. paratuberculosis
cguggcugaacagcgcgccg

SEQ ID NO: 836049 - RNA, 21 nt, Mycobacterium avium subsp. paratuberculosis
cguggcugaacagcgcgccga

SEQ ID NO: 836050 - RNA, 12 nt, Mycobacterium avium subsp. paratuberculosis
cguggcgucggc

SEQ ID NO: 836051 - RNA, 14 nt, Mycobacterium avium subsp. paratuberculosis
cguggcgucggcgc

SEQ ID NO: 836052 - RNA, 19 nt, Mycobacterium avium subsp. paratuberculosis
cguggcgggggagccgugc

SEQ ID NO: 836053 - RNA, 21 nt, Mycobacterium avium subsp. paratuberculosis
cguggcgggggagccgugcag

SEQ ID NO: 836054 - RNA, 22 nt, Mycobacterium avium subsp. paratuberculosis
cguggcgggggagccgugcagc

SEQ ID NO: 836055 - RNA, 12 nt, Mycobacterium avium subsp. paratuberculosis
cguggccugcga

SEQ ID NO: 836056 - RNA, 16 nt, Mycobacterium avium subsp. paratuberculosis
cguggccugcgacuuc

SEQ ID NO: 836057 - RNA, 23 nt, Mycobacterium avium subsp. paratuberculosis
cguggccugcgacuucuacggcg

SEQ ID NO: 836058 - RNA, 21 nt, Mycobacterium avium subsp. paratuberculosis
cguggccgugugcgcaucggc

SEQ ID NO: 836059 - RNA, 16 nt, Mycobacterium avium subsp. paratuberculosis
cguggccgucacgcug

SEQ ID NO: 836060 - RNA, 17 nt, Mycobacterium avium subsp. paratuberculosis
cguggccgucacgcugg

SEQ ID NO: 836061 - RNA, 18 nt, Mycobacterium avium subsp. paratuberculosis
cguggccgucacgcuggc

SEQ ID NO: 836062 - RNA, 13 nt, Mycobacterium avium subsp. paratuberculosis
cguggccggcagg

SEQ ID NO: 836063 - RNA, 14 nt, Mycobacterium avium subsp. paratuberculosis
cguggccggcaggu

SEQ ID NO: 836064 - RNA, 20 nt, Mycobacterium avium subsp. paratuberculosis
cguggcccggauggccgggc

SEQ ID NO: 836065 - RNA, 14 nt, Mycobacterium avium subsp. paratuberculosis
cguggcccagccgg

SEQ ID NO: 836066 - RNA, 17 nt, Mycobacterium avium subsp. paratuberculosis
cguggccccagccaccg

SEQ ID NO: 836067 - RNA, 17 nt, Mycobacterium avium subsp. paratuberculosis
cguggccgaacggcaug

SEQ ID NO: 836068 - RNA, 16 nt, Mycobacterium avium subsp. paratuberculosis
cguggccgacgggaua

SEQ ID NO: 836069 - RNA, 12 nt, Mycobacterium avium subsp. paratuberculosis
cguggccgagga

SEQ ID NO: 836070 - RNA, 23 nt, Mycobacterium avium subsp. paratuberculosis
cguggccgaucagcugcucggcc

SEQ ID NO: 836071 - RNA, 19 nt, Mycobacterium avium subsp. paratuberculosis
cguugaucagcgccaggug

SEQ ID NO: 836072 - RNA, 13 nt, Mycobacterium avium subsp. paratuberculosis
cguugaucagggc

SEQ ID NO: 836073 - RNA, 18 nt, Mycobacterium avium subsp. paratuberculosis
cguugaucagggcggcgc

SEQ ID NO: 836074 - RNA, 17 nt, Mycobacterium avium subsp. paratuberculosis
cguugaucaggugcagc

SEQ ID NO: 836075 - RNA, 22 nt, Mycobacterium avium subsp. paratuberculosis
cguugagugcgcuguggugacg

SEQ ID NO: 836076 - RNA, 20 nt, Mycobacterium avium subsp. paratuberculosis
cguugaucaccgugaucgcc

SEQ ID NO: 836077 - RNA, 13 nt, Mycobacterium avium subsp. paratuberculosis
cguugaucgagca

SEQ ID NO: 836078 - RNA, 20 nt, Mycobacterium avium subsp. paratuberculosis
cguugaucgagcaccgggcg

SEQ ID NO: 836079 - RNA, 19 nt, Mycobacterium avium subsp. paratuberculosis
cguugagucccucggcgag

SEQ ID NO: 836080 - RNA, 15 nt, Mycobacterium avium subsp. paratuberculosis
cguugagcgucgcca

SEQ ID NO: 836081 - RNA, 22 nt, Mycobacterium avium subsp. paratuberculosis
cguugaggcggcggcgggccag

SEQ ID NO: 836082 - RNA, 14 nt, Mycobacterium avium subsp. paratuberculosis
cguugcacggcagc

SEQ ID NO: 836083 - RNA, 13 nt, Mycobacterium avium subsp. paratuberculosis
cguugcagcgccg

SEQ ID NO: 836084 - RNA, 14 nt, Mycobacterium avium subsp. paratuberculosis
cguugcagcgccgc

SEQ ID NO: 836085 - RNA, 19 nt, Mycobacterium avium subsp. paratuberculosis
cguugcagcgccgcggcgc

SEQ ID NO: 836086 - RNA, 12 nt, Mycobacterium avium subsp. paratuberculosis
cguugcaccgcg

SEQ ID NO: 836087 - RNA, 16 nt, Mycobacterium avium subsp. paratuberculosis
cguugcaccgcgggca

SEQ ID NO: 836088 - RNA, 20 nt, Mycobacterium avium subsp. paratuberculosis
cguucgugagcgguggccac

SEQ ID NO: 836089 - RNA, 19 nt, Mycobacterium avium subsp. paratuberculosis
cguucuccaccgcgcgcgg

SEQ ID NO: 836090 - RNA, 15 nt, Mycobacterium avium subsp. paratuberculosis
cguucuccagcaccc

SEQ ID NO: 836091 - RNA, 18 nt, Mycobacterium avium subsp. paratuberculosis
cguucggccagcaccagg

SEQ ID NO: 836092 - RNA, 14 nt, Mycobacterium avium subsp. paratuberculosis
cguucgcguugagc

SEQ ID NO: 836093 - RNA, 15 nt, Mycobacterium avium subsp. paratuberculosis
cguucucggcgaaca

SEQ ID NO: 836094 - RNA, 22 nt, Mycobacterium avium subsp. paratuberculosis
cguucucgggaaaugcgucgcc

SEQ ID NO: 836095 - RNA, 19 nt, Mycobacterium avium subsp. paratuberculosis
cguucucgggggcgggcac

SEQ ID NO: 836096 - RNA, 16 nt, Mycobacterium avium subsp. paratuberculosis
cguucuccauccgggc

SEQ ID NO: 836097 - RNA, 18 nt, Mycobacterium avium subsp. paratuberculosis
cguucuccauccgggcgg

SEQ ID NO: 836098 - RNA, 21 nt, Mycobacterium avium subsp. paratuberculosis
cguucuccauccgggcggcca

SEQ ID NO: 836099 - RNA, 14 nt, Mycobacterium avium subsp. paratuberculosis
cguucuccccgccg

SEQ ID NO: 836100 - RNA, 15 nt, Mycobacterium avium subsp. paratuberculosis
cguucuccccgccgg

SEQ ID NO: 836101 - RNA, 19 nt, Mycobacterium avium subsp. paratuberculosis
cguucuccgaggcguccuc

SEQ ID NO: 836102 - RNA, 13 nt, Mycobacterium avium subsp. paratuberculosis
cguugagcccgga

SEQ ID NO: 836103 - RNA, 15 nt, Mycobacterium avium subsp. paratuberculosis
cguugagcccggacc

SEQ ID NO: 836104 - RNA, 22 nt, Mycobacterium avium subsp. paratuberculosis
cguugagcccggaccggccgug

SEQ ID NO: 836105 - RNA, 15 nt, Mycobacterium avium subsp. paratuberculosis
cguugagcacgcccg

SEQ ID NO: 836106 - RNA, 17 nt, Mycobacterium avium subsp. paratuberculosis
cguugagcacgcccgcg

SEQ ID NO: 836107 - RNA, 20 nt, Mycobacterium avium subsp. paratuberculosis
cguugagcacgcccgcgauc

SEQ ID NO: 836108 - RNA, 13 nt, Mycobacterium avium subsp. paratuberculosis
cguugcggugacg

SEQ ID NO: 836109 - RNA, 15 nt, Mycobacterium avium subsp. paratuberculosis
cguugcggugacgau

SEQ ID NO: 836110 - RNA, 20 nt, Mycobacterium avium subsp. paratuberculosis
cguugcggugcucgucgagc

SEQ ID NO: 836111 - RNA, 15 nt, Mycobacterium avium subsp. paratuberculosis
cguugcgucccgcgc

SEQ ID NO: 836112 - RNA, 18 nt, Mycobacterium avium subsp. paratuberculosis
cguugcgucccgcgccgg

SEQ ID NO: 836113 - RNA, 20 nt, Mycobacterium avium subsp. paratuberculosis
cguugcgucccgcgccggag

SEQ ID NO: 836114 - RNA, 15 nt, Mycobacterium avium subsp. paratuberculosis
cguugcgggucggcg

SEQ ID NO: 836115 - RNA, 16 nt, Mycobacterium avium subsp. paratuberculosis
cguugcgggucggcgu

SEQ ID NO: 836116 - RNA, 18 nt, Mycobacterium avium subsp. paratuberculosis
cguugcgggugucgccgg

SEQ ID NO: 836117 - RNA, 19 nt, Mycobacterium avium subsp. paratuberculosis
cguugcgggccaggucgag

SEQ ID NO: 836118 - RNA, 20 nt, Mycobacterium avium subsp. paratuberculosis
cguugcgggccaggucgagc

SEQ ID NO: 836119 - RNA, 20 nt, Mycobacterium avium subsp. paratuberculosis
cguugcgggcggcgcggcgc

SEQ ID NO: 836120 - RNA, 17 nt, Mycobacterium avium subsp. paratuberculosis
cguugcggccguccagc

SEQ ID NO: 836121 - RNA, 21 nt, Mycobacterium avium subsp. paratuberculosis
cguugcggccguccagcgucu

SEQ ID NO: 836122 - RNA, 17 nt, Mycobacterium avium subsp. paratuberculosis
cguugcggaucgaacgg

SEQ ID NO: 836123 - RNA, 12 nt, Mycobacterium avium subsp. paratuberculosis
cguugcggaucu

SEQ ID NO: 836124 - RNA, 21 nt, Mycobacterium avium subsp. paratuberculosis
cguugcggcacaggcgaaucg

SEQ ID NO: 836125 - RNA, 13 nt, Mycobacterium avium subsp. paratuberculosis
cguugcgcggcgg

SEQ ID NO: 836126 - RNA, 21 nt, Mycobacterium avium subsp. paratuberculosis
cguugcgcucuguuggccguc

SEQ ID NO: 836127 - RNA, 15 nt, Mycobacterium avium subsp. paratuberculosis
cguugcgccgcgagc

SEQ ID NO: 836128 - RNA, 23 nt, Mycobacterium avium subsp. paratuberculosis
cguugcagcacagcgggauccca

SEQ ID NO: 836129 - RNA, 18 nt, Mycobacterium avium subsp. paratuberculosis
cguugccaggccgcgagc

SEQ ID NO: 836130 - RNA, 22 nt, Mycobacterium avium subsp. paratuberculosis
cguugcccaggaaguagccggc

SEQ ID NO: 836131 - RNA, 17 nt, Mycobacterium avium subsp. paratuberculosis
cguuggacagcucgacg

SEQ ID NO: 836132 - RNA, 19 nt, Mycobacterium avium subsp. paratuberculosis
cguugcugcguucggcgau

SEQ ID NO: 836133 - RNA, 20 nt, Mycobacterium avium subsp. paratuberculosis
cguugcugcguucggcgauc

SEQ ID NO: 836134 - RNA, 21 nt, Mycobacterium avium subsp. paratuberculosis
cguuggaggugaucgccagcc

SEQ ID NO: 836135 - RNA, 15 nt, Mycobacterium avium subsp. paratuberculosis
cguuggacuccaccg

SEQ ID NO: 836136 - RNA, 16 nt, Mycobacterium avium subsp. paratuberculosis
cguuggacuccaccgc

SEQ ID NO: 836137 - RNA, 15 nt, Mycobacterium avium subsp. paratuberculosis
cguuggagccgacca

SEQ ID NO: 836138 - RNA, 17 nt, Mycobacterium avium subsp. paratuberculosis
cguuggagccgaccagc

SEQ ID NO: 836139 - RNA, 17 nt, Mycobacterium avium subsp. paratuberculosis
cguuggccagcucggcc

SEQ ID NO: 836140 - RNA, 21 nt, Mycobacterium avium subsp. paratuberculosis
cguuggcacccgaccgacgcc

SEQ ID NO: 836141 - RNA, 20 nt, Mycobacterium avium subsp. paratuberculosis
cguuggccagaugcccgccc

SEQ ID NO: 836142 - RNA, 13 nt, Mycobacterium avium subsp. paratuberculosis
cguuggccagcac

SEQ ID NO: 836143 - RNA, 14 nt, Mycobacterium avium subsp. paratuberculosis
cguuggccagcacc

SEQ ID NO: 836144 - RNA, 15 nt, Mycobacterium avium subsp. paratuberculosis
cguuggccagcaccg

SEQ ID NO: 836145 - RNA, 16 nt, Mycobacterium avium subsp. paratuberculosis
cguuggccagcaccgc

SEQ ID NO: 836146 - RNA, 17 nt, Mycobacterium avium subsp. paratuberculosis
cguuggccagcaccgcg

SEQ ID NO: 836147 - RNA, 14 nt, Mycobacterium avium subsp. paratuberculosis
cguucgccgacagc

SEQ ID NO: 836148 - RNA, 21 nt, Mycobacterium avium subsp. paratuberculosis
cguucgaguucgucgaccagc

SEQ ID NO: 836149 - RNA, 20 nt, Mycobacterium avium subsp. paratuberculosis
cguucgauccgccggugccg

SEQ ID NO: 836150 - RNA, 16 nt, Mycobacterium avium subsp. paratuberculosis
cguucgaugucggcca

SEQ ID NO: 836151 - RNA, 17 nt, Mycobacterium avium subsp. paratuberculosis
cguucgauugcaccacc

SEQ ID NO: 836152 - RNA, 18 nt, Mycobacterium avium subsp. paratuberculosis
cguucgauugcaccaccg

SEQ ID NO: 836153 - RNA, 15 nt, Mycobacterium avium subsp. paratuberculosis
cguucgagcgccgga

SEQ ID NO: 836154 - RNA, 21 nt, Mycobacterium avium subsp. paratuberculosis
cguucgaauuguggcggccca

SEQ ID NO: 836155 - RNA, 21 nt, Mycobacterium avium subsp. paratuberculosis
cguucgcggugggcucgucga

SEQ ID NO: 836156 - RNA, 23 nt, Mycobacterium avium subsp. paratuberculosis
cguucgcggugggcucgucgaac

SEQ ID NO: 836157 - RNA, 15 nt, Mycobacterium avium subsp. paratuberculosis
cguucgcggucgagc

SEQ ID NO: 836158 - RNA, 15 nt, Mycobacterium avium subsp. paratuberculosis
cguucgcgcacggcg

SEQ ID NO: 836159 - RNA, 14 nt, Mycobacterium avium subsp. paratuberculosis
cguucgcucucgcg

SEQ ID NO: 836160 - RNA, 22 nt, Mycobacterium avium subsp. paratuberculosis
cguucgcugcccaacgucgacu

SEQ ID NO: 836161 - RNA, 16 nt, Mycobacterium avium subsp. paratuberculosis
cguucgcuuucgccgg

SEQ ID NO: 836162 - RNA, 21 nt, Mycobacterium avium subsp. paratuberculosis
cguucgcuuucgccgggcguc

SEQ ID NO: 836163 - RNA, 20 nt, Mycobacterium avium subsp. paratuberculosis
cguucgccggcgacggccag

SEQ ID NO: 836164 - RNA, 15 nt, Mycobacterium avium subsp. paratuberculosis
cguucgccgguaccg

SEQ ID NO: 836165 - RNA, 18 nt, Mycobacterium avium subsp. paratuberculosis
cguuccuggugggcgaau

SEQ ID NO: 836166 - RNA, 15 nt, Mycobacterium avium subsp. paratuberculosis
cguucccaccggcuu

SEQ ID NO: 836167 - RNA, 16 nt, Mycobacterium avium subsp. paratuberculosis
cguuccaucagcgccc

SEQ ID NO: 836168 - RNA, 21 nt, Mycobacterium avium subsp. paratuberculosis
cguuccagcgcacacaccgua

SEQ ID NO: 836169 - RNA, 14 nt, Mycobacterium avium subsp. paratuberculosis
cguucaugaucggc

SEQ ID NO: 836170 - RNA, 22 nt, Mycobacterium avium subsp. paratuberculosis
cgugucgucgcugacgccgagc

SEQ ID NO: 836171 - RNA, 20 nt, Mycobacterium avium subsp. paratuberculosis
cgugucgucgucgccgccgg

SEQ ID NO: 836172 - RNA, 23 nt, Mycobacterium avium subsp. paratuberculosis
cgugucgucgucgccgccgguga

SEQ ID NO: 836173 - RNA, 18 nt, Mycobacterium avium subsp. paratuberculosis
cgugucgugugcgugacg

SEQ ID NO: 836174 - RNA, 19 nt, Mycobacterium avium subsp. paratuberculosis
cgugucggggucggcgccg

SEQ ID NO: 836175 - RNA, 13 nt, Mycobacterium avium subsp. paratuberculosis
cgugucggcgggc

SEQ ID NO: 836176 - RNA, 14 nt, Mycobacterium avium subsp. paratuberculosis
cgugucggcgggcg

SEQ ID NO: 836177 - RNA, 13 nt, Mycobacterium avium subsp. paratuberculosis
cgugucggcgauc

SEQ ID NO: 836178 - RNA, 16 nt, Mycobacterium avium subsp. paratuberculosis
cgugucggcgaucgcg

SEQ ID NO: 836179 - RNA, 20 nt, Mycobacterium avium subsp. paratuberculosis
cgugucggcgaucgcgcgca

SEQ ID NO: 836180 - RNA, 13 nt, Mycobacterium avium subsp. paratuberculosis
cgugucggcgcca

SEQ ID NO: 836181 - RNA, 19 nt, Mycobacterium avium subsp. paratuberculosis
cgugugcaccugagucugg

SEQ ID NO: 836182 - RNA, 13 nt, Mycobacterium avium subsp. paratuberculosis
cgugugccagccc

SEQ ID NO: 836183 - RNA, 19 nt, Mycobacterium avium subsp. paratuberculosis
cgugugcgcaucggcgacg

SEQ ID NO: 836184 - RNA, 21 nt, Mycobacterium avium subsp. paratuberculosis
cgugugcccagcacgacgccg

SEQ ID NO: 836185 - RNA, 19 nt, Mycobacterium avium subsp. paratuberculosis
cguguggcgugugggcucg

SEQ ID NO: 836186 - RNA, 19 nt, Mycobacterium avium subsp. paratuberculosis
cguguggcccugcgucauc

SEQ ID NO: 836187 - RNA, 22 nt, Mycobacterium avium subsp. paratuberculosis
cguguggccgcccucgcugccg

SEQ ID NO: 836188 - RNA, 21 nt, Mycobacterium avium subsp. paratuberculosis
cgugugguacagcgccagcgg

SEQ ID NO: 836189 - RNA, 22 nt, Mycobacterium avium subsp. paratuberculosis
cguguguaccauugcgccgguc

SEQ ID NO: 836190 - RNA, 16 nt, Mycobacterium avium subsp. paratuberculosis
cguguucaccagcggg

SEQ ID NO: 836191 - RNA, 17 nt, Mycobacterium avium subsp. paratuberculosis
cuagugccgggggccga

SEQ ID NO: 836192 - RNA, 24 nt, Mycobacterium avium subsp. paratuberculosis
cucagcgauugcggccgccggcca

SEQ ID NO: 836193 - RNA, 20 nt, Mycobacterium avium subsp. paratuberculosis
cucagccggcggugcgucga

SEQ ID NO: 836194 - RNA, 22 nt, Mycobacterium avium subsp. paratuberculosis
cucagccguucgcugcccucgg

SEQ ID NO: 836195 - RNA, 13 nt, Mycobacterium avium subsp. paratuberculosis
cucagcgggcggc

SEQ ID NO: 836196 - RNA, 20 nt, Mycobacterium avium subsp. paratuberculosis
cucagcgggcggccagccgc

SEQ ID NO: 836197 - RNA, 22 nt, Mycobacterium avium subsp. paratuberculosis
cucagcgggaagccgaggucgc

SEQ ID NO: 836198 - RNA, 18 nt, Mycobacterium avium subsp. paratuberculosis
cucagggcgcgcugucga

SEQ ID NO: 836199 - RNA, 18 nt, Mycobacterium avium subsp. paratuberculosis
cucagcgcggcgggccag

SEQ ID NO: 836200 - RNA, 23 nt, Mycobacterium avium subsp. paratuberculosis
cucagcgcugucgcgggcccgcg

SEQ ID NO: 836201 - RNA, 20 nt, Mycobacterium avium subsp. paratuberculosis
cucagcggcagcgucgccag

SEQ ID NO: 836202 - RNA, 14 nt, Mycobacterium avium subsp. paratuberculosis
cucauacagcggcg

SEQ ID NO: 836203 - RNA, 16 nt, Mycobacterium avium subsp. paratuberculosis
cucauacagcggcgcg

SEQ ID NO: 836204 - RNA, 22 nt, Mycobacterium avium subsp. paratuberculosis
cucauacagcggcgcgcgccgc

SEQ ID NO: 836205 - RNA, 15 nt, Mycobacterium avium subsp. paratuberculosis
cucauacggcggcuc

SEQ ID NO: 836206 - RNA, 14 nt, Mycobacterium avium subsp. paratuberculosis
cucaucaccggcgc

SEQ ID NO: 836207 - RNA, 15 nt, Mycobacterium avium subsp. paratuberculosis
cucaucaccggcgcg

SEQ ID NO: 836208 - RNA, 16 nt, Mycobacterium avium subsp. paratuberculosis
cucaucaccggcgcgc

SEQ ID NO: 836209 - RNA, 17 nt, Mycobacterium avium subsp. paratuberculosis
cucaucaggcggccggc

SEQ ID NO: 836210 - RNA, 20 nt, Mycobacterium avium subsp. paratuberculosis
cucagugcacgcucggcgcg

SEQ ID NO: 836211 - RNA, 13 nt, Mycobacterium avium subsp. paratuberculosis
cucagucggccac

SEQ ID NO: 836212 - RNA, 14 nt, Mycobacterium avium subsp. paratuberculosis
cucagucggccacc

SEQ ID NO: 836213 - RNA, 20 nt, Mycobacterium avium subsp. paratuberculosis
cucagugucacugcgguaga

SEQ ID NO: 836214 - RNA, 21 nt, Mycobacterium avium subsp. paratuberculosis
cucagugucguggcgacaucg

SEQ ID NO: 836215 - RNA, 17 nt, Mycobacterium avium subsp. paratuberculosis
cucaguccgacgcgacg

SEQ ID NO: 836216 - RNA, 18 nt, Mycobacterium avium subsp. paratuberculosis
cucaguccucgccgagaa

SEQ ID NO: 836217 - RNA, 16 nt, Mycobacterium avium subsp. paratuberculosis
cucaggucggccgcgg

SEQ ID NO: 836218 - RNA, 17 nt, Mycobacterium avium subsp. paratuberculosis
cucaggucggccgcggc

SEQ ID NO: 836219 - RNA, 21 nt, Mycobacterium avium subsp. paratuberculosis
cucagggugcgcuggccgacc

SEQ ID NO: 836220 - RNA, 19 nt, Mycobacterium avium subsp. paratuberculosis
cucaucgcccagccggcgg

SEQ ID NO: 836221 - RNA, 16 nt, Mycobacterium avium subsp. paratuberculosis
cucaucuacgucgucg

SEQ ID NO: 836222 - RNA, 19 nt, Mycobacterium avium subsp. paratuberculosis
cucaugcccgccacggcca

SEQ ID NO: 836223 - RNA, 20 nt, Mycobacterium avium subsp. paratuberculosis
cucaugcccgccacggccag

SEQ ID NO: 836224 - RNA, 20 nt, Mycobacterium avium subsp. paratuberculosis
cucaugccagacgcgcaccg

SEQ ID NO: 836225 - RNA, 22 nt, Mycobacterium avium subsp. paratuberculosis
cuccaccgaaaagcccgccgcc

SEQ ID NO: 836226 - RNA, 23 nt, Mycobacterium avium subsp. paratuberculosis
cuccaccgaaaagcccgccgccu

SEQ ID NO: 836227 - RNA, 20 nt, Mycobacterium avium subsp. paratuberculosis
cuccaccgagugcggcgcgg

SEQ ID NO: 836228 - RNA, 22 nt, Mycobacterium avium subsp. paratuberculosis
cuccaccgagugcggcgcggug

SEQ ID NO: 836229 - RNA, 13 nt, Mycobacterium avium subsp. paratuberculosis
cuccaccgccacc

SEQ ID NO: 836230 - RNA, 15 nt, Mycobacterium avium subsp. paratuberculosis
cuccaccgcgccggc

SEQ ID NO: 836231 - RNA, 18 nt, Mycobacterium avium subsp. paratuberculosis
cuccaccgcgccggcggc

SEQ ID NO: 836232 - RNA, 16 nt, Mycobacterium avium subsp. paratuberculosis
cuccaccgcgccgucg

SEQ ID NO: 836233 - RNA, 16 nt, Mycobacterium avium subsp. paratuberculosis
cuccaccaccuggccg

SEQ ID NO: 836234 - RNA, 18 nt, Mycobacterium avium subsp. paratuberculosis
cuccaccaccuggccggc

SEQ ID NO: 836235 - RNA, 14 nt, Mycobacterium avium subsp. paratuberculosis
cuccaccagcgcgg

SEQ ID NO: 836236 - RNA, 23 nt, Mycobacterium avium subsp. paratuberculosis
cucaugguguuccaccagcggcc

SEQ ID NO: 836237 - RNA, 20 nt, Mycobacterium avium subsp. paratuberculosis
cucaugucguacgggcgcag

SEQ ID NO: 836238 - RNA, 19 nt, Mycobacterium avium subsp. paratuberculosis
cuccacacggcaggcggcc

SEQ ID NO: 836239 - RNA, 14 nt, Mycobacterium avium subsp. paratuberculosis
cuccaccaccggcc

SEQ ID NO: 836240 - RNA, 18 nt, Mycobacterium avium subsp. paratuberculosis
cuccaccaccggccgcgc

SEQ ID NO: 836241 - RNA, 14 nt, Mycobacterium avium subsp. paratuberculosis
cucccgcgccgcgg

SEQ ID NO: 836242 - RNA, 16 nt, Mycobacterium avium subsp. paratuberculosis
cucccgcgccgcggcc

SEQ ID NO: 836243 - RNA, 17 nt, Mycobacterium avium subsp. paratuberculosis
cucccgcgccgcggcca

SEQ ID NO: 836244 - RNA, 19 nt, Mycobacterium avium subsp. paratuberculosis
cucccgcggcagccgggcg

SEQ ID NO: 836245 - RNA, 20 nt, Mycobacterium avium subsp. paratuberculosis
cucccgcggcagccgggcga

SEQ ID NO: 836246 - RNA, 22 nt, Mycobacterium avium subsp. paratuberculosis
cucccgcggcagccgggcgauc

SEQ ID NO: 836247 - RNA, 23 nt, Mycobacterium avium subsp. paratuberculosis
cucccgcggcagccgggcgauca

SEQ ID NO: 836248 - RNA, 15 nt, Mycobacterium avium subsp. paratuberculosis
cucccggaccaccag

SEQ ID NO: 836249 - RNA, 17 nt, Mycobacterium avium subsp. paratuberculosis
cucccggaccaccagga

SEQ ID NO: 836250 - RNA, 17 nt, Mycobacterium avium subsp. paratuberculosis
cucccgcuccauggcgg

SEQ ID NO: 836251 - RNA, 22 nt, Mycobacterium avium subsp. paratuberculosis
cucccgcuccauggcggcgacc

SEQ ID NO: 836252 - RNA, 12 nt, Mycobacterium avium subsp. paratuberculosis
cucccgcgccgc

SEQ ID NO: 836253 - RNA, 11 nt, Mycobacterium avium subsp. paratuberculosis
cucccgcagcg

SEQ ID NO: 836254 - RNA, 13 nt, Mycobacterium avium subsp. paratuberculosis
cucccgcagcgcc

SEQ ID NO: 836255 - RNA, 14 nt, Mycobacterium avium subsp. paratuberculosis
cucccgcagcgcca

SEQ ID NO: 836256 - RNA, 13 nt, Mycobacterium avium subsp. paratuberculosis
cucccgucgcgac

SEQ ID NO: 836257 - RNA, 15 nt, Mycobacterium avium subsp. paratuberculosis
cucccggcgccgccg

SEQ ID NO: 836258 - RNA, 18 nt, Mycobacterium avium subsp. paratuberculosis
cucccggcgccgccguuc

SEQ ID NO: 836259 - RNA, 21 nt, Mycobacterium avium subsp. paratuberculosis
cucccugagcuuuucgucggu

SEQ ID NO: 836260 - RNA, 21 nt, Mycobacterium avium subsp. paratuberculosis
cucccuguuagggcgaccacc

SEQ ID NO: 836261 - RNA, 13 nt, Mycobacterium avium subsp. paratuberculosis
cucccggccgacg

SEQ ID NO: 836262 - RNA, 15 nt, Mycobacterium avium subsp. paratuberculosis
cucccggccgacgau

SEQ ID NO: 836263 - RNA, 13 nt, Mycobacterium avium subsp. paratuberculosis
cucccggcgccac

SEQ ID NO: 836264 - RNA, 20 nt, Mycobacterium avium subsp. paratuberculosis
cucccggcgccacgccgcga

SEQ ID NO: 836265 - RNA, 21 nt, Mycobacterium avium subsp. paratuberculosis
cucccggcgccacgccgcgau

SEQ ID NO: 836266 - RNA, 14 nt, Mycobacterium avium subsp. paratuberculosis
cucccgggcggcgc

SEQ ID NO: 836267 - RNA, 16 nt, Mycobacterium avium subsp. paratuberculosis
cucccgggcggcgccg

SEQ ID NO: 836268 - RNA, 17 nt, Mycobacterium avium subsp. paratuberculosis
cucccgggcggcgccga

SEQ ID NO: 836269 - RNA, 15 nt, Mycobacterium avium subsp. paratuberculosis
cucccgggcggucgc

SEQ ID NO: 836270 - RNA, 21 nt, Mycobacterium avium subsp. paratuberculosis
cucccgggcggucgcgucguc

SEQ ID NO: 836271 - RNA, 16 nt, Mycobacterium avium subsp. paratuberculosis
cucccgggugcgcguc

SEQ ID NO: 836272 - RNA, 17 nt, Mycobacterium avium subsp. paratuberculosis
cucccggguggccuccg

SEQ ID NO: 836273 - RNA, 19 nt, Mycobacterium avium subsp. paratuberculosis
cucccgguagagcggcacc

SEQ ID NO: 836274 - RNA, 22 nt, Mycobacterium avium subsp. paratuberculosis
cucccgguagagcggcaccagg

SEQ ID NO: 836275 - RNA, 19 nt, Mycobacterium avium subsp. paratuberculosis
cucccgguaggcggcgaga

SEQ ID NO: 836276 - RNA, 15 nt, Mycobacterium avium subsp. paratuberculosis
cuccgagccggugga

SEQ ID NO: 836277 - RNA, 14 nt, Mycobacterium avium subsp. paratuberculosis
cuccgagcggcgca

SEQ ID NO: 836278 - RNA, 21 nt, Mycobacterium avium subsp. paratuberculosis
cuccgagcggcgcaggccggu

SEQ ID NO: 836279 - RNA, 14 nt, Mycobacterium avium subsp. paratuberculosis
cuccgagucggcgu

SEQ ID NO: 836280 - RNA, 15 nt, Mycobacterium avium subsp. paratuberculosis
cuccgagucggcguc

SEQ ID NO: 836281 - RNA, 16 nt, Mycobacterium avium subsp. paratuberculosis
cuccgagucggcgucg

SEQ ID NO: 836282 - RNA, 17 nt, Mycobacterium avium subsp. paratuberculosis
cuccgagucggcgucgg

SEQ ID NO: 836283 - RNA, 17 nt, Mycobacterium avium subsp. paratuberculosis
cuccgcaugcccgggcg

SEQ ID NO: 836284 - RNA, 14 nt, Mycobacterium avium subsp. paratuberculosis
cuccgacgcggugg

SEQ ID NO: 836285 - RNA, 13 nt, Mycobacterium avium subsp. paratuberculosis
cuccgaccagccg

SEQ ID NO: 836286 - RNA, 14 nt, Mycobacterium avium subsp. paratuberculosis
cuccgaccagccgg

SEQ ID NO: 836287 - RNA, 17 nt, Mycobacterium avium subsp. paratuberculosis
cuccgaauccagcgcgc

SEQ ID NO: 836288 - RNA, 18 nt, Mycobacterium avium subsp. paratuberculosis
cuccgaauccagcgcgcc

SEQ ID NO: 836289 - RNA, 13 nt, Mycobacterium avium subsp. paratuberculosis
cuccgacagcccc

SEQ ID NO: 836290 - RNA, 16 nt, Mycobacterium avium subsp. paratuberculosis
cuccgacagcccccgc

SEQ ID NO: 836291 - RNA, 13 nt, Mycobacterium avium subsp. paratuberculosis
cuccgacagccgc

SEQ ID NO: 836292 - RNA, 15 nt, Mycobacterium avium subsp. paratuberculosis
cuccagccgcuccgc

SEQ ID NO: 836293 - RNA, 12 nt, Mycobacterium avium subsp. paratuberculosis
cuccagccgccg

SEQ ID NO: 836294 - RNA, 14 nt, Mycobacterium avium subsp. paratuberculosis
cuccagccgccggu

SEQ ID NO: 836295 - RNA, 18 nt, Mycobacterium avium subsp. paratuberculosis
cuccagccgcgcggccgc

SEQ ID NO: 836296 - RNA, 14 nt, Mycobacterium avium subsp. paratuberculosis
cuccagcgcccgcc

SEQ ID NO: 836297 - RNA, 12 nt, Mycobacterium avium subsp. paratuberculosis
cucccgcacccg

SEQ ID NO: 836298 - RNA, 23 nt, Mycobacterium avium subsp. paratuberculosis
cucccgcacccguucggcgucga

SEQ ID NO: 836299 - RNA, 20 nt, Mycobacterium avium subsp. paratuberculosis
cucccgagcaucgccgagcg

SEQ ID NO: 836300 - RNA, 13 nt, Mycobacterium avium subsp. paratuberculosis
cuccccggcgauc

SEQ ID NO: 836301 - RNA, 14 nt, Mycobacterium avium subsp. paratuberculosis
cuccccggcgaucu

SEQ ID NO: 836302 - RNA, 17 nt, Mycobacterium avium subsp. paratuberculosis
cuccccauccgcggcca

SEQ ID NO: 836303 - RNA, 21 nt, Mycobacterium avium subsp. paratuberculosis
cucccccgacaccgccagcag

SEQ ID NO: 836304 - RNA, 23 nt, Mycobacterium avium subsp. paratuberculosis
cucccccgacgccgacaccagcg

SEQ ID NO: 836305 - RNA, 18 nt, Mycobacterium avium subsp. paratuberculosis
cucccccgaucagcguca

SEQ ID NO: 836306 - RNA, 18 nt, Mycobacterium avium subsp. paratuberculosis
cucccccggcgugagcga

SEQ ID NO: 836307 - RNA, 20 nt, Mycobacterium avium subsp. paratuberculosis
cucccccgucgggccguccg

SEQ ID NO: 836308 - RNA, 16 nt, Mycobacterium avium subsp. paratuberculosis
cuccccgagcacgucg

SEQ ID NO: 836309 - RNA, 20 nt, Mycobacterium avium subsp. paratuberculosis
cuccagcagcgccagcaccg

SEQ ID NO: 836310 - RNA, 15 nt, Mycobacterium avium subsp. paratuberculosis
cuccagcagcgccuu

SEQ ID NO: 836311 - RNA, 12 nt, Mycobacterium avium subsp. paratuberculosis
cuccagcagcgg

SEQ ID NO: 836312 - RNA, 15 nt, Mycobacterium avium subsp. paratuberculosis
cuccagcaggcgcgc

SEQ ID NO: 836313 - RNA, 16 nt, Mycobacterium avium subsp. paratuberculosis
cuccagcaggcuggcg

SEQ ID NO: 836314 - RNA, 17 nt, Mycobacterium avium subsp. paratuberculosis
cuccagccacuccacca

SEQ ID NO: 836315 - RNA, 15 nt, Mycobacterium avium subsp. paratuberculosis
cuccagccagcgcgc

SEQ ID NO: 836316 - RNA, 17 nt, Mycobacterium avium subsp. paratuberculosis
cuccagcaccgucggcg

SEQ ID NO: 836317 - RNA, 16 nt, Mycobacterium avium subsp. paratuberculosis
cuccagcaccagcacg

SEQ ID NO: 836318 - RNA, 14 nt, Mycobacterium avium subsp. paratuberculosis
cuccaccgucgaug

SEQ ID NO: 836319 - RNA, 12 nt, Mycobacterium avium subsp. paratuberculosis
cuccagcaccag

SEQ ID NO: 836320 - RNA, 14 nt, Mycobacterium avium subsp. paratuberculosis
cuccagcaccagca

SEQ ID NO: 836321 - RNA, 19 nt, Mycobacterium avium subsp. paratuberculosis
cucgacgaucagcacgucg

SEQ ID NO: 836322 - RNA, 14 nt, Mycobacterium avium subsp. paratuberculosis
cucgacgccgcgca

SEQ ID NO: 836323 - RNA, 20 nt, Mycobacterium avium subsp. paratuberculosis
cucgaccaggcuuggcccgc

SEQ ID NO: 836324 - RNA, 21 nt, Mycobacterium avium subsp. paratuberculosis
cucgacgaguuccucgugcgu

SEQ ID NO: 836325 - RNA, 15 nt, Mycobacterium avium subsp. paratuberculosis
cucgacgaucagcac

SEQ ID NO: 836326 - RNA, 17 nt, Mycobacterium avium subsp. paratuberculosis
cucgacgaugucgacgc

SEQ ID NO: 836327 - RNA, 22 nt, Mycobacterium avium subsp. paratuberculosis
cucgacgauugucggggccgca

SEQ ID NO: 836328 - RNA, 23 nt, Mycobacterium avium subsp. paratuberculosis
cucgacgauugucggggccgcac

SEQ ID NO: 836329 - RNA, 17 nt, Mycobacterium avium subsp. paratuberculosis
cucgagcacucgcggga

SEQ ID NO: 836330 - RNA, 14 nt, Mycobacterium avium subsp. paratuberculosis
cucgagcaccggcg

SEQ ID NO: 836331 - RNA, 18 nt, Mycobacterium avium subsp. paratuberculosis
cucgagcaccggcggcag

SEQ ID NO: 836332 - RNA, 21 nt, Mycobacterium avium subsp. paratuberculosis
cucgagcagugcaucgcugcc

SEQ ID NO: 836333 - RNA, 22 nt, Mycobacterium avium subsp. paratuberculosis
cucgagcagugcaucgcugccg

SEQ ID NO: 836334 - RNA, 19 nt, Mycobacterium avium subsp. paratuberculosis
cucgagcauccggugccga

SEQ ID NO: 836335 - RNA, 19 nt, Mycobacterium avium subsp. paratuberculosis
cucgagcaucuccagccgg

SEQ ID NO: 836336 - RNA, 22 nt, Mycobacterium avium subsp. paratuberculosis
cucgagcaucuccagccggcga

SEQ ID NO: 836337 - RNA, 20 nt, Mycobacterium avium subsp. paratuberculosis
cucgagcaucucggugccgu

SEQ ID NO: 836338 - RNA, 23 nt, Mycobacterium avium subsp. paratuberculosis
cucgagcaucucggugccgucga

SEQ ID NO: 836339 - RNA, 19 nt, Mycobacterium avium subsp. paratuberculosis
cucgagcaaccgcaccuug

SEQ ID NO: 836340 - RNA, 23 nt, Mycobacterium avium subsp. paratuberculosis
cucgagcaacggccgcagcgacu

SEQ ID NO: 836341 - RNA, 13 nt, Mycobacterium avium subsp. paratuberculosis
cucgagcaccacg

SEQ ID NO: 836342 - RNA, 16 nt, Mycobacterium avium subsp. paratuberculosis
cucgagcaccacggcc

SEQ ID NO: 836343 - RNA, 19 nt, Mycobacterium avium subsp. paratuberculosis
cucgagcaccacggcccgc

SEQ ID NO: 836344 - RNA, 19 nt, Mycobacterium avium subsp. paratuberculosis
cucgagagucgcuggcgcg

SEQ ID NO: 836345 - RNA, 20 nt, Mycobacterium avium subsp. paratuberculosis
cucgagagucgcuggcgcgc

SEQ ID NO: 836346 - RNA, 17 nt, Mycobacterium avium subsp. paratuberculosis
cucgagauucugcagcc

SEQ ID NO: 836347 - RNA, 22 nt, Mycobacterium avium subsp. paratuberculosis
cucgacgaacuccgcgcgcggc

SEQ ID NO: 836348 - RNA, 14 nt, Mycobacterium avium subsp. paratuberculosis
cucgacgaggcggg

SEQ ID NO: 836349 - RNA, 15 nt, Mycobacterium avium subsp. paratuberculosis
cucgacgaggcgggc

SEQ ID NO: 836350 - RNA, 17 nt, Mycobacterium avium subsp. paratuberculosis
cucgacgaggcgggcga

SEQ ID NO: 836351 - RNA, 13 nt, Mycobacterium avium subsp. paratuberculosis
cucgaccagcgcc

SEQ ID NO: 836352 - RNA, 16 nt, Mycobacterium avium subsp. paratuberculosis
cucgaccagcgcgccg

SEQ ID NO: 836353 - RNA, 19 nt, Mycobacterium avium subsp. paratuberculosis
cucgaccagcgcgccgccc

SEQ ID NO: 836354 - RNA, 16 nt, Mycobacterium avium subsp. paratuberculosis
cucgaccuucgagccg

SEQ ID NO: 836355 - RNA, 18 nt, Mycobacterium avium subsp. paratuberculosis
cucgaccuucgagccgcc

SEQ ID NO: 836356 - RNA, 19 nt, Mycobacterium avium subsp. paratuberculosis
cucgaccuucgagccgccg

SEQ ID NO: 836357 - RNA, 20 nt, Mycobacterium avium subsp. paratuberculosis
cucgaccuucgagccgccgc

SEQ ID NO: 836358 - RNA, 22 nt, Mycobacterium avium subsp. paratuberculosis
cucgaccuucgagccgccgccg

SEQ ID NO: 836359 - RNA, 14 nt, Mycobacterium avium subsp. paratuberculosis
cucgaccagccggu

SEQ ID NO: 836360 - RNA, 15 nt, Mycobacterium avium subsp. paratuberculosis
cucgaccagcgccga

SEQ ID NO: 836361 - RNA, 22 nt, Mycobacterium avium subsp. paratuberculosis
cucgaccaccucuucgcggucc

SEQ ID NO: 836362 - RNA, 24 nt, Mycobacterium avium subsp. paratuberculosis
cucgaccacgcacaccaccgacgc

SEQ ID NO: 836363 - RNA, 13 nt, Mycobacterium avium subsp. paratuberculosis
cucgaccacccgg

SEQ ID NO: 836364 - RNA, 20 nt, Mycobacterium avium subsp. paratuberculosis
cucgaccagauugcggcacc

SEQ ID NO: 836365 - RNA, 16 nt, Mycobacterium avium subsp. paratuberculosis
cucgaccagcaccgca

SEQ ID NO: 836366 - RNA, 18 nt, Mycobacterium avium subsp. paratuberculosis
cucgacaggcagcccggc

SEQ ID NO: 836367 - RNA, 22 nt, Mycobacterium avium subsp. paratuberculosis
cucgaucaucaccaccgccgcc

SEQ ID NO: 836368 - RNA, 23 nt, Mycobacterium avium subsp. paratuberculosis
cucgaucaucaccaccgccgccg

SEQ ID NO: 836369 - RNA, 20 nt, Mycobacterium avium subsp. paratuberculosis
cucgaucagagcgggccgac

SEQ ID NO: 836370 - RNA, 23 nt, Mycobacterium avium subsp. paratuberculosis
cucgaucagagcgggccgaccgu

SEQ ID NO: 836371 - RNA, 15 nt, Mycobacterium avium subsp. paratuberculosis
cucgaugcacggucg

SEQ ID NO: 836372 - RNA, 22 nt, Mycobacterium avium subsp. paratuberculosis
cucgaugcacggucggccccgc

SEQ ID NO: 836373 - RNA, 17 nt, Mycobacterium avium subsp. paratuberculosis
cucgaucaacgccgggu

SEQ ID NO: 836374 - RNA, 22 nt, Mycobacterium avium subsp. paratuberculosis
cucgaucaacgccgggucgacg

SEQ ID NO: 836375 - RNA, 23 nt, Mycobacterium avium subsp. paratuberculosis
cucgaucaacgccgggucgacgc

SEQ ID NO: 836376 - RNA, 13 nt, Mycobacterium avium subsp. paratuberculosis
cucgaucaccgac

SEQ ID NO: 836377 - RNA, 17 nt, Mycobacterium avium subsp. paratuberculosis
cucgaucagcaccgcca

SEQ ID NO: 836378 - RNA, 19 nt, Mycobacterium avium subsp. paratuberculosis
cucgaucagccacaccgcc

SEQ ID NO: 836379 - RNA, 20 nt, Mycobacterium avium subsp. paratuberculosis
cucgaucagccacaccgccg

SEQ ID NO: 836380 - RNA, 22 nt, Mycobacterium avium subsp. paratuberculosis
cucgaucagccacaccgccggc

SEQ ID NO: 836381 - RNA, 14 nt, Mycobacterium avium subsp. paratuberculosis
cucgagccggcgca

SEQ ID NO: 836382 - RNA, 15 nt, Mycobacterium avium subsp. paratuberculosis
cucgagccggcgcac

SEQ ID NO: 836383 - RNA, 16 nt, Mycobacterium avium subsp. paratuberculosis
cucgagccggcgcacu

SEQ ID NO: 836384 - RNA, 15 nt, Mycobacterium avium subsp. paratuberculosis
cucgagugccggcag

SEQ ID NO: 836385 - RNA, 19 nt, Mycobacterium avium subsp. paratuberculosis
cucgagugccugcgcccac

SEQ ID NO: 836386 - RNA, 16 nt, Mycobacterium avium subsp. paratuberculosis
cucgaguggcgaacgg

SEQ ID NO: 836387 - RNA, 20 nt, Mycobacterium avium subsp. paratuberculosis
cucgaguuuggccagcucgg

SEQ ID NO: 836388 - RNA, 19 nt, Mycobacterium avium subsp. paratuberculosis
cucgauaauggcggccgcc

SEQ ID NO: 836389 - RNA, 23 nt, Mycobacterium avium subsp. paratuberculosis
cucgaugggggugccgcagcggc

SEQ ID NO: 836390 - RNA, 15 nt, Mycobacterium avium subsp. paratuberculosis
cucgauggucgccuu

SEQ ID NO: 836391 - RNA, 15 nt, Mycobacterium avium subsp. paratuberculosis
cucgauggucgucgg

SEQ ID NO: 836392 - RNA, 12 nt, Mycobacterium avium subsp. paratuberculosis
cucgauggcggc

SEQ ID NO: 836393 - RNA, 14 nt, Mycobacterium avium subsp. paratuberculosis
cucgauggcggcga

SEQ ID NO: 836394 - RNA, 17 nt, Mycobacterium avium subsp. paratuberculosis
cucgauggcggcggcug

SEQ ID NO: 836395 - RNA, 15 nt, Mycobacterium avium subsp. paratuberculosis
cucgauggugccguc

SEQ ID NO: 836396 - RNA, 17 nt, Mycobacterium avium subsp. paratuberculosis
cucgauguagccgggcu

SEQ ID NO: 836397 - RNA, 13 nt, Mycobacterium avium subsp. paratuberculosis
cucgaugucgucg

SEQ ID NO: 836398 - RNA, 14 nt, Mycobacterium avium subsp. paratuberculosis
cucgaugucgucga

SEQ ID NO: 836399 - RNA, 19 nt, Mycobacterium avium subsp. paratuberculosis
cucgauggccucgucgaug

SEQ ID NO: 836400 - RNA, 13 nt, Mycobacterium avium subsp. paratuberculosis
cucgauggcccgc

SEQ ID NO: 836401 - RNA, 14 nt, Mycobacterium avium subsp. paratuberculosis
cucgauggccacgc

SEQ ID NO: 836402 - RNA, 15 nt, Mycobacterium avium subsp. paratuberculosis
cucgauggccacgcu

SEQ ID NO: 836403 - RNA, 16 nt, Mycobacterium avium subsp. paratuberculosis
cucgauggccacgcuc

SEQ ID NO: 836404 - RNA, 16 nt, Mycobacterium avium subsp. paratuberculosis
cucgauggccagcgcg

SEQ ID NO: 836405 - RNA, 22 nt, Mycobacterium avium subsp. paratuberculosis
cucgauggaccggguggugggc

SEQ ID NO: 836406 - RNA, 23 nt, Mycobacterium avium subsp. paratuberculosis
cucgaugcgcgccagcagcgcgc

SEQ ID NO: 836407 - RNA, 14 nt, Mycobacterium avium subsp. paratuberculosis
cucgaugccgaccg

SEQ ID NO: 836408 - RNA, 16 nt, Mycobacterium avium subsp. paratuberculosis
cucgaugccgaccgac

SEQ ID NO: 836409 - RNA, 14 nt, Mycobacterium avium subsp. paratuberculosis
cucgaugcgcaccg

SEQ ID NO: 836410 - RNA, 17 nt, Mycobacterium avium subsp. paratuberculosis
cucgaugcgcaccgugc

SEQ ID NO: 836411 - RNA, 16 nt, Mycobacterium avium subsp. paratuberculosis
cucgaugccgugccgg

SEQ ID NO: 836412 - RNA, 20 nt, Mycobacterium avium subsp. paratuberculosis
cucgaugccgugccggugga

SEQ ID NO: 836413 - RNA, 19 nt, Mycobacterium avium subsp. paratuberculosis
cucgaugccguucgcgccg

SEQ ID NO: 836414 - RNA, 20 nt, Mycobacterium avium subsp. paratuberculosis
cucgaugccguucgcgccgu

SEQ ID NO: 836415 - RNA, 19 nt, Mycobacterium avium subsp. paratuberculosis
cucgaugcgacgcaccucg

SEQ ID NO: 836416 - RNA, 20 nt, Mycobacterium avium subsp. paratuberculosis
cucgaugcgacgcaccucgg

SEQ ID NO: 836417 - RNA, 21 nt, Mycobacterium avium subsp. paratuberculosis
cucgaugcgacgcaccucggc

SEQ ID NO: 836418 - RNA, 13 nt, Mycobacterium avium subsp. paratuberculosis
cuccgcggcgaug

SEQ ID NO: 836419 - RNA, 14 nt, Mycobacterium avium subsp. paratuberculosis
cuccgcgcugacca

SEQ ID NO: 836420 - RNA, 22 nt, Mycobacterium avium subsp. paratuberculosis
cuccgcggccagcucggucgcg

SEQ ID NO: 836421 - RNA, 14 nt, Mycobacterium avium subsp. paratuberculosis
cuccgcggccgcgc

SEQ ID NO: 836422 - RNA, 15 nt, Mycobacterium avium subsp. paratuberculosis
cuccgcggccgcgcg

SEQ ID NO: 836423 - RNA, 16 nt, Mycobacterium avium subsp. paratuberculosis
cuccgcggcgggcgug

SEQ ID NO: 836424 - RNA, 18 nt, Mycobacterium avium subsp. paratuberculosis
cuccgcgggcagcgagca

SEQ ID NO: 836425 - RNA, 14 nt, Mycobacterium avium subsp. paratuberculosis
cuccgcggugcugc

SEQ ID NO: 836426 - RNA, 14 nt, Mycobacterium avium subsp. paratuberculosis
cuccgcggcgccgu

SEQ ID NO: 836427 - RNA, 16 nt, Mycobacterium avium subsp. paratuberculosis
cuccgcgcgcggcacg

SEQ ID NO: 836428 - RNA, 17 nt, Mycobacterium avium subsp. paratuberculosis
cuccgcgacaucggcgc

SEQ ID NO: 836429 - RNA, 19 nt, Mycobacterium avium subsp. paratuberculosis
cuccgcgacaucggcgccg

SEQ ID NO: 836430 - RNA, 22 nt, Mycobacterium avium subsp. paratuberculosis
cuccgcgacaucggcgccgacg

SEQ ID NO: 836431 - RNA, 23 nt, Mycobacterium avium subsp. paratuberculosis
cuccgacugugaauuccgacgug

SEQ ID NO: 836432 - RNA, 22 nt, Mycobacterium avium subsp. paratuberculosis
cuccgccacccugcgcaccgcg

SEQ ID NO: 836433 - RNA, 12 nt, Mycobacterium avium subsp. paratuberculosis
cuccgccgggcu

SEQ ID NO: 836434 - RNA, 13 nt, Mycobacterium avium subsp. paratuberculosis
cuccggcgacacg

SEQ ID NO: 836435 - RNA, 17 nt, Mycobacterium avium subsp. paratuberculosis
cuccggccggugaucgg

SEQ ID NO: 836436 - RNA, 21 nt, Mycobacterium avium subsp. paratuberculosis
cuccggcaguacgcgccggcc

SEQ ID NO: 836437 - RNA, 16 nt, Mycobacterium avium subsp. paratuberculosis
cuccggcccgaucgcg

SEQ ID NO: 836438 - RNA, 21 nt, Mycobacterium avium subsp. paratuberculosis
cuccggcccgaucgcggcgag

SEQ ID NO: 836439 - RNA, 13 nt, Mycobacterium avium subsp. paratuberculosis
cuccggcccgcuc

SEQ ID NO: 836440 - RNA, 15 nt, Mycobacterium avium subsp. paratuberculosis
cuccggcccgcucgg

SEQ ID NO: 836441 - RNA, 16 nt, Mycobacterium avium subsp. paratuberculosis
cuccggcccgcucggc

SEQ ID NO: 836442 - RNA, 17 nt, Mycobacterium avium subsp. paratuberculosis
cuccggcccgcucggcg

SEQ ID NO: 836443 - RNA, 14 nt, Mycobacterium avium subsp. paratuberculosis
cuccggcccggcgu

SEQ ID NO: 836444 - RNA, 13 nt, Mycobacterium avium subsp. paratuberculosis
cuccggcaggccg

SEQ ID NO: 836445 - RNA, 15 nt, Mycobacterium avium subsp. paratuberculosis
cuccggccgcgccgg

SEQ ID NO: 836446 - RNA, 18 nt, Mycobacterium avium subsp. paratuberculosis
cuccggccgcgccggccu

SEQ ID NO: 836447 - RNA, 23 nt, Mycobacterium avium subsp. paratuberculosis
cuccggugauucgugcagugcga

SEQ ID NO: 836448 - RNA, 14 nt, Mycobacterium avium subsp. paratuberculosis
cuccgguccgggcu

SEQ ID NO: 836449 - RNA, 16 nt, Mycobacterium avium subsp. paratuberculosis
cuccgguccgggcugc

SEQ ID NO: 836450 - RNA, 12 nt, Mycobacterium avium subsp. paratuberculosis
cuccggugaacc

SEQ ID NO: 836451 - RNA, 13 nt, Mycobacterium avium subsp. paratuberculosis
cucgacaccggcg

SEQ ID NO: 836452 - RNA, 12 nt, Mycobacterium avium subsp. paratuberculosis
cucgaacggccc

SEQ ID NO: 836453 - RNA, 23 nt, Mycobacterium avium subsp. paratuberculosis
cucgaaccgcuugcccagccccu

SEQ ID NO: 836454 - RNA, 12 nt, Mycobacterium avium subsp. paratuberculosis
cucgaaccgggc

SEQ ID NO: 836455 - RNA, 15 nt, Mycobacterium avium subsp. paratuberculosis
cucgaaccgggcggu

SEQ ID NO: 836456 - RNA, 13 nt, Mycobacterium avium subsp. paratuberculosis
cucgaaccggggc

SEQ ID NO: 836457 - RNA, 14 nt, Mycobacterium avium subsp. paratuberculosis
cucgaacgcgccga

SEQ ID NO: 836458 - RNA, 15 nt, Mycobacterium avium subsp. paratuberculosis
cucgaacgcgccgau

SEQ ID NO: 836459 - RNA, 18 nt, Mycobacterium avium subsp. paratuberculosis
cucgaacaucggcacgug

SEQ ID NO: 836460 - RNA, 14 nt, Mycobacterium avium subsp. paratuberculosis
cucgaacaccgucg

SEQ ID NO: 836461 - RNA, 16 nt, Mycobacterium avium subsp. paratuberculosis
cucgaacacgccgucg

SEQ ID NO: 836462 - RNA, 17 nt, Mycobacterium avium subsp. paratuberculosis
cuccugccguucggcca

SEQ ID NO: 836463 - RNA, 21 nt, Mycobacterium avium subsp. paratuberculosis
cuccugccguucggccagcgc

SEQ ID NO: 836464 - RNA, 17 nt, Mycobacterium avium subsp. paratuberculosis
cuccuugggagacugcg

SEQ ID NO: 836465 - RNA, 14 nt, Mycobacterium avium subsp. paratuberculosis
cuccugcaggccga

SEQ ID NO: 836466 - RNA, 18 nt, Mycobacterium avium subsp. paratuberculosis
cuccugcaggccgagccg

SEQ ID NO: 836467 - RNA, 22 nt, Mycobacterium avium subsp. paratuberculosis
cuccuuggggcugaccucgccg

SEQ ID NO: 836468 - RNA, 19 nt, Mycobacterium avium subsp. paratuberculosis
cuccuuggguucggcggcg

SEQ ID NO: 836469 - RNA, 20 nt, Mycobacterium avium subsp. paratuberculosis
cucgaacaacccggccgcga

SEQ ID NO: 836470 - RNA, 20 nt, Mycobacterium avium subsp. paratuberculosis
cuccgucgagucggccaccg

SEQ ID NO: 836471 - RNA, 14 nt, Mycobacterium avium subsp. paratuberculosis
cuccgucgcgauca

SEQ ID NO: 836472 - RNA, 16 nt, Mycobacterium avium subsp. paratuberculosis
cuccgucagcgccgcc

SEQ ID NO: 836473 - RNA, 17 nt, Mycobacterium avium subsp. paratuberculosis
cuccucgauggucgucg

SEQ ID NO: 836474 - RNA, 17 nt, Mycobacterium avium subsp. paratuberculosis
cuccgugcuggccgggu

SEQ ID NO: 836475 - RNA, 16 nt, Mycobacterium avium subsp. paratuberculosis
cuccguggacggcgag

SEQ ID NO: 836476 - RNA, 14 nt, Mycobacterium avium subsp. paratuberculosis
cuccugacgcaccu

SEQ ID NO: 836477 - RNA, 14 nt, Mycobacterium avium subsp. paratuberculosis
cuccucggccagca

SEQ ID NO: 836478 - RNA, 14 nt, Mycobacterium avium subsp. paratuberculosis
cuccucgcgccgcc

SEQ ID NO: 836479 - RNA, 23 nt, Mycobacterium avium subsp. paratuberculosis
cuccucgcgccgccacgcggcgc

SEQ ID NO: 836480 - RNA, 13 nt, Mycobacterium avium subsp. paratuberculosis
cuccucgcugccg

SEQ ID NO: 836481 - RNA, 13 nt, Mycobacterium avium subsp. paratuberculosis
cuccucggacccg

SEQ ID NO: 836482 - RNA, 22 nt, Mycobacterium avium subsp. paratuberculosis
cucgcaaacgaaucgagccgcc

SEQ ID NO: 836483 - RNA, 19 nt, Mycobacterium avium subsp. paratuberculosis
cucgcacaacccgcccggg

SEQ ID NO: 836484 - RNA, 19 nt, Mycobacterium avium subsp. paratuberculosis
cucgauguugaucgccaug

SEQ ID NO: 836485 - RNA, 22 nt, Mycobacterium avium subsp. paratuberculosis
cucgauguugaucgccaugcug

SEQ ID NO: 836486 - RNA, 23 nt, Mycobacterium avium subsp. paratuberculosis
cucgccaugcgaccacgaccggg

SEQ ID NO: 836487 - RNA, 24 nt, Mycobacterium avium subsp. paratuberculosis
cucgccaggauguacccgcaggcc

SEQ ID NO: 836488 - RNA, 13 nt, Mycobacterium avium subsp. paratuberculosis
cucgccaccucgg

SEQ ID NO: 836489 - RNA, 15 nt, Mycobacterium avium subsp. paratuberculosis
cucgccagaccgguu

SEQ ID NO: 836490 - RNA, 20 nt, Mycobacterium avium subsp. paratuberculosis
cucgccagacucacggcggc

SEQ ID NO: 836491 - RNA, 22 nt, Mycobacterium avium subsp. paratuberculosis
cucgccagacucacggcggcag

SEQ ID NO: 836492 - RNA, 13 nt, Mycobacterium avium subsp. paratuberculosis
cucgccagccguc

SEQ ID NO: 836493 - RNA, 22 nt, Mycobacterium avium subsp. paratuberculosis
cucgccagccguccuggucguc

SEQ ID NO: 836494 - RNA, 13 nt, Mycobacterium avium subsp. paratuberculosis
cucgcgccguggc

SEQ ID NO: 836495 - RNA, 14 nt, Mycobacterium avium subsp. paratuberculosis
cucgcgccguggcc

SEQ ID NO: 836496 - RNA, 14 nt, Mycobacterium avium subsp. paratuberculosis
cucgcgcaccgcgg

SEQ ID NO: 836497 - RNA, 12 nt, Mycobacterium avium subsp. paratuberculosis
cucgcgauggcg

SEQ ID NO: 836498 - RNA, 18 nt, Mycobacterium avium subsp. paratuberculosis
cucgcgcaaugccgccgc

SEQ ID NO: 836499 - RNA, 22 nt, Mycobacterium avium subsp. paratuberculosis
cucgcgcaaugccgccgcgacg

SEQ ID NO: 836500 - RNA, 13 nt, Mycobacterium avium subsp. paratuberculosis
cucgcgcacccgu

SEQ ID NO: 836501 - RNA, 21 nt, Mycobacterium avium subsp. paratuberculosis
cucgcccagcgcggcggccac

SEQ ID NO: 836502 - RNA, 13 nt, Mycobacterium avium subsp. paratuberculosis
cucgcccagcgcc

SEQ ID NO: 836503 - RNA, 14 nt, Mycobacterium avium subsp. paratuberculosis
cucgcccagcgccg

SEQ ID NO: 836504 - RNA, 22 nt, Mycobacterium avium subsp. paratuberculosis
cucgcccagcgccgcggcgaaa

SEQ ID NO: 836505 - RNA, 16 nt, Mycobacterium avium subsp. paratuberculosis
cucgcgaagaucggag

SEQ ID NO: 836506 - RNA, 19 nt, Mycobacterium avium subsp. paratuberculosis
cucgcgaagaucggagccg

SEQ ID NO: 836507 - RNA, 17 nt, Mycobacterium avium subsp. paratuberculosis
cucgcgaagcgcgaugc

SEQ ID NO: 836508 - RNA, 14 nt, Mycobacterium avium subsp. paratuberculosis
cucgcgacgcggcu

SEQ ID NO: 836509 - RNA, 14 nt, Mycobacterium avium subsp. paratuberculosis
cucgcgaggccgcc

SEQ ID NO: 836510 - RNA, 15 nt, Mycobacterium avium subsp. paratuberculosis
cucgcgaggccgcca

SEQ ID NO: 836511 - RNA, 16 nt, Mycobacterium avium subsp. paratuberculosis
cucgcgaggccgccau

SEQ ID NO: 836512 - RNA, 20 nt, Mycobacterium avium subsp. paratuberculosis
cucgcgguugggccgccggc

SEQ ID NO: 836513 - RNA, 15 nt, Mycobacterium avium subsp. paratuberculosis
cucgcguagcgaggu

SEQ ID NO: 836514 - RNA, 18 nt, Mycobacterium avium subsp. paratuberculosis
cucgcguagcgaggugug

SEQ ID NO: 836515 - RNA, 20 nt, Mycobacterium avium subsp. paratuberculosis
cucgcguccccgcgccgggc

SEQ ID NO: 836516 - RNA, 12 nt, Mycobacterium avium subsp. paratuberculosis
cucgcgucgacg

SEQ ID NO: 836517 - RNA, 15 nt, Mycobacterium avium subsp. paratuberculosis
cucgcgucgacgucg

SEQ ID NO: 836518 - RNA, 16 nt, Mycobacterium avium subsp. paratuberculosis
cucgcgucgacgucgg

SEQ ID NO: 836519 - RNA, 15 nt, Mycobacterium avium subsp. paratuberculosis
cucgcgucgcgcggu

SEQ ID NO: 836520 - RNA, 13 nt, Mycobacterium avium subsp. paratuberculosis
cucgcggucgacg

SEQ ID NO: 836521 - RNA, 14 nt, Mycobacterium avium subsp. paratuberculosis
cucgcggucgacgg

SEQ ID NO: 836522 - RNA, 17 nt, Mycobacterium avium subsp. paratuberculosis
cucgcggucuucgaaca

SEQ ID NO: 836523 - RNA, 14 nt, Mycobacterium avium subsp. paratuberculosis
cucgcgggugcggc

SEQ ID NO: 836524 - RNA, 18 nt, Mycobacterium avium subsp. paratuberculosis
cucgcgggugcggcgcug

SEQ ID NO: 836525 - RNA, 14 nt, Mycobacterium avium subsp. paratuberculosis
cucgcggucgaagg

SEQ ID NO: 836526 - RNA, 14 nt, Mycobacterium avium subsp. paratuberculosis
cucgcgcuggcggc

SEQ ID NO: 836527 - RNA, 14 nt, Mycobacterium avium subsp. paratuberculosis
cucgcggauccgca

SEQ ID NO: 836528 - RNA, 18 nt, Mycobacterium avium subsp. paratuberculosis
cucgcggauguccgaccg

SEQ ID NO: 836529 - RNA, 15 nt, Mycobacterium avium subsp. paratuberculosis
cucgcggcaaggcgc

SEQ ID NO: 836530 - RNA, 17 nt, Mycobacterium avium subsp. paratuberculosis
cucgcggcaaggcgcag

SEQ ID NO: 836531 - RNA, 22 nt, Mycobacterium avium subsp. paratuberculosis
cucgcgcugccgcgcgccgaca

SEQ ID NO: 836532 - RNA, 23 nt, Mycobacterium avium subsp. paratuberculosis
cucgcgcugccgcgcgccgacag

SEQ ID NO: 836533 - RNA, 19 nt, Mycobacterium avium subsp. paratuberculosis
cucgcgcucccggcgccgc

SEQ ID NO: 836534 - RNA, 20 nt, Mycobacterium avium subsp. paratuberculosis
cucgcgcucccggcgccgcc

SEQ ID NO: 836535 - RNA, 21 nt, Mycobacterium avium subsp. paratuberculosis
cucgcgcucccggcgccgccg

SEQ ID NO: 836536 - RNA, 15 nt, Mycobacterium avium subsp. paratuberculosis
cucgcgcgucacgcu

SEQ ID NO: 836537 - RNA, 19 nt, Mycobacterium avium subsp. paratuberculosis
cucgcgcggggcggccgcc

SEQ ID NO: 836538 - RNA, 18 nt, Mycobacterium avium subsp. paratuberculosis
cucgcugagcgggacgcg

SEQ ID NO: 836539 - RNA, 16 nt, Mycobacterium avium subsp. paratuberculosis
cucgcucccgcgcggg

SEQ ID NO: 836540 - RNA, 17 nt, Mycobacterium avium subsp. paratuberculosis
cucgcucccgcgcgggc

SEQ ID NO: 836541 - RNA, 15 nt, Mycobacterium avium subsp. paratuberculosis
cucgcugcggcgcag

SEQ ID NO: 836542 - RNA, 18 nt, Mycobacterium avium subsp. paratuberculosis
cucgcugcucugcgcgcg

SEQ ID NO: 836543 - RNA, 16 nt, Mycobacterium avium subsp. paratuberculosis
cucgcugaucucgacg

SEQ ID NO: 836544 - RNA, 12 nt, Mycobacterium avium subsp. paratuberculosis
cucgcugccgcc

SEQ ID NO: 836545 - RNA, 14 nt, Mycobacterium avium subsp. paratuberculosis
cucgcugccgcccc

SEQ ID NO: 836546 - RNA, 14 nt, Mycobacterium avium subsp. paratuberculosis
cucgcugccggccg

SEQ ID NO: 836547 - RNA, 22 nt, Mycobacterium avium subsp. paratuberculosis
cucgcugccggccggggcggcg

SEQ ID NO: 836548 - RNA, 20 nt, Mycobacterium avium subsp. paratuberculosis
cucgcuauaucgcaccggcg

SEQ ID NO: 836549 - RNA, 22 nt, Mycobacterium avium subsp. paratuberculosis
cucgcuauaucgcaccggcgcc

SEQ ID NO: 836550 - RNA, 16 nt, Mycobacterium avium subsp. paratuberculosis
cucgcgguugcgggug

SEQ ID NO: 836551 - RNA, 17 nt, Mycobacterium avium subsp. paratuberculosis
cucgcgguugcgggugg

SEQ ID NO: 836552 - RNA, 16 nt, Mycobacterium avium subsp. paratuberculosis
cucgcuaaucgccgcg

SEQ ID NO: 836553 - RNA, 17 nt, Mycobacterium avium subsp. paratuberculosis
cucgcuaaucgccgcgc

SEQ ID NO: 836554 - RNA, 14 nt, Mycobacterium avium subsp. paratuberculosis
cucggcgggccgcc

SEQ ID NO: 836555 - RNA, 18 nt, Mycobacterium avium subsp. paratuberculosis
cucggcgggccgcccggc

SEQ ID NO: 836556 - RNA, 19 nt, Mycobacterium avium subsp. paratuberculosis
cucggcggguugcugagcc

SEQ ID NO: 836557 - RNA, 20 nt, Mycobacterium avium subsp. paratuberculosis
cucggcgggaucggaccgca

SEQ ID NO: 836558 - RNA, 19 nt, Mycobacterium avium subsp. paratuberculosis
cucggcguguuccuugcgg

SEQ ID NO: 836559 - RNA, 18 nt, Mycobacterium avium subsp. paratuberculosis
cucggcguugagccggcg

SEQ ID NO: 836560 - RNA, 20 nt, Mycobacterium avium subsp. paratuberculosis
cucggcguugagccggcgca

SEQ ID NO: 836561 - RNA, 21 nt, Mycobacterium avium subsp. paratuberculosis
cucggcguugagccggcgcac

SEQ ID NO: 836562 - RNA, 21 nt, Mycobacterium avium subsp. paratuberculosis
cucggcgggcucccucgucgc

SEQ ID NO: 836563 - RNA, 15 nt, Mycobacterium avium subsp. paratuberculosis
cucggcgggcucgcg

SEQ ID NO: 836564 - RNA, 15 nt, Mycobacterium avium subsp. paratuberculosis
cucggcggcgcgcag

SEQ ID NO: 836565 - RNA, 19 nt, Mycobacterium avium subsp. paratuberculosis
cucggcgcgcggggccggc

SEQ ID NO: 836566 - RNA, 22 nt, Mycobacterium avium subsp. paratuberculosis
cucggcgcgcggggccggcgcg

SEQ ID NO: 836567 - RNA, 12 nt, Mycobacterium avium subsp. paratuberculosis
cucggcgcgucg

SEQ ID NO: 836568 - RNA, 15 nt, Mycobacterium avium subsp. paratuberculosis
cucggcgcgucgucc

SEQ ID NO: 836569 - RNA, 13 nt, Mycobacterium avium subsp. paratuberculosis
cucggcggcgacg

SEQ ID NO: 836570 - RNA, 14 nt, Mycobacterium avium subsp. paratuberculosis
cucggcggcgacgg

SEQ ID NO: 836571 - RNA, 17 nt, Mycobacterium avium subsp. paratuberculosis
cucggcggcgacggugu

SEQ ID NO: 836572 - RNA, 17 nt, Mycobacterium avium subsp. paratuberculosis
cucggcggccgucggau

SEQ ID NO: 836573 - RNA, 19 nt, Mycobacterium avium subsp. paratuberculosis
cucggcggccgucggaucg

SEQ ID NO: 836574 - RNA, 19 nt, Mycobacterium avium subsp. paratuberculosis
cucggcggccucgccgucg

SEQ ID NO: 836575 - RNA, 16 nt, Mycobacterium avium subsp. paratuberculosis
cucggcggcgcaggcg

SEQ ID NO: 836576 - RNA, 23 nt, Mycobacterium avium subsp. paratuberculosis
cucggcggcgcaggcgcgcacca

SEQ ID NO: 836577 - RNA, 15 nt, Mycobacterium avium subsp. paratuberculosis
cucggcggcgccguc

SEQ ID NO: 836578 - RNA, 16 nt, Mycobacterium avium subsp. paratuberculosis
cucggcggcgccgucg

SEQ ID NO: 836579 - RNA, 13 nt, Mycobacterium avium subsp. paratuberculosis
cucggcggcggcg

SEQ ID NO: 836580 - RNA, 13 nt, Mycobacterium avium subsp. paratuberculosis
cucggcggcgggc

SEQ ID NO: 836581 - RNA, 15 nt, Mycobacterium avium subsp. paratuberculosis
cucggcggcgggcag

SEQ ID NO: 836582 - RNA, 22 nt, Mycobacterium avium subsp. paratuberculosis
cucggggcguggcggaagcgcg

SEQ ID NO: 836583 - RNA, 12 nt, Mycobacterium avium subsp. paratuberculosis
cucggggcucgc

SEQ ID NO: 836584 - RNA, 17 nt, Mycobacterium avium subsp. paratuberculosis
cucggggaucagcagau

SEQ ID NO: 836585 - RNA, 18 nt, Mycobacterium avium subsp. paratuberculosis
cucgggcgguggcgccgg

SEQ ID NO: 836586 - RNA, 20 nt, Mycobacterium avium subsp. paratuberculosis
cucgggguaguucagcgcgc

SEQ ID NO: 836587 - RNA, 23 nt, Mycobacterium avium subsp. paratuberculosis
cucgggguaguucagcgcgcggg

SEQ ID NO: 836588 - RNA, 15 nt, Mycobacterium avium subsp. paratuberculosis
cucgggcggccgcgg

SEQ ID NO: 836589 - RNA, 18 nt, Mycobacterium avium subsp. paratuberculosis
cucgggccggcagccggc

SEQ ID NO: 836590 - RNA, 19 nt, Mycobacterium avium subsp. paratuberculosis
cucgggcgcgaacagcgcc

SEQ ID NO: 836591 - RNA, 21 nt, Mycobacterium avium subsp. paratuberculosis
cucgggcgcgaacagcgccga

SEQ ID NO: 836592 - RNA, 20 nt, Mycobacterium avium subsp. paratuberculosis
cucgggcauuggcagcucgg

SEQ ID NO: 836593 - RNA, 12 nt, Mycobacterium avium subsp. paratuberculosis
cucgggccagcc

SEQ ID NO: 836594 - RNA, 17 nt, Mycobacterium avium subsp. paratuberculosis
cucgggcccgcgcaccg

SEQ ID NO: 836595 - RNA, 22 nt, Mycobacterium avium subsp. paratuberculosis
cucgggcagcagcaccagcgcc

SEQ ID NO: 836596 - RNA, 19 nt, Mycobacterium avium subsp. paratuberculosis
cucgggcagcccgccgacc

SEQ ID NO: 836597 - RNA, 14 nt, Mycobacterium avium subsp. paratuberculosis
cucgggcaggaugg

SEQ ID NO: 836598 - RNA, 16 nt, Mycobacterium avium subsp. paratuberculosis
cucgggauuggacagc

SEQ ID NO: 836599 - RNA, 20 nt, Mycobacterium avium subsp. paratuberculosis
cucgggauuggacagcggcg

SEQ ID NO: 836600 - RNA, 19 nt, Mycobacterium avium subsp. paratuberculosis
cucgggcaacgcgccggcg

SEQ ID NO: 836601 - RNA, 20 nt, Mycobacterium avium subsp. paratuberculosis
cucgggcaacgcgccggcgg

SEQ ID NO: 836602 - RNA, 12 nt, Mycobacterium avium subsp. paratuberculosis
cucggcucggcc

SEQ ID NO: 836603 - RNA, 15 nt, Mycobacterium avium subsp. paratuberculosis
cucggcucggccggc

SEQ ID NO: 836604 - RNA, 17 nt, Mycobacterium avium subsp. paratuberculosis
cucggcucggccggccg

SEQ ID NO: 836605 - RNA, 16 nt, Mycobacterium avium subsp. paratuberculosis
cucggcuuccgagccg

SEQ ID NO: 836606 - RNA, 16 nt, Mycobacterium avium subsp. paratuberculosis
cucggcuucgucgggu

SEQ ID NO: 836607 - RNA, 23 nt, Mycobacterium avium subsp. paratuberculosis
cucgggaacggucagccgcggcu

SEQ ID NO: 836608 - RNA, 13 nt, Mycobacterium avium subsp. paratuberculosis
cucgcuggcggcg

SEQ ID NO: 836609 - RNA, 15 nt, Mycobacterium avium subsp. paratuberculosis
cucgcuggcggcgcg

SEQ ID NO: 836610 - RNA, 17 nt, Mycobacterium avium subsp. paratuberculosis
cucggccaaccgggcag

SEQ ID NO: 836611 - RNA, 16 nt, Mycobacterium avium subsp. paratuberculosis
cucggccaccagcgcc

SEQ ID NO: 836612 - RNA, 15 nt, Mycobacterium avium subsp. paratuberculosis
cucggccaccuugcg

SEQ ID NO: 836613 - RNA, 13 nt, Mycobacterium avium subsp. paratuberculosis
cucggccacgacg

SEQ ID NO: 836614 - RNA, 17 nt, Mycobacterium avium subsp. paratuberculosis
cucggccacgacgcgcc

SEQ ID NO: 836615 - RNA, 19 nt, Mycobacterium avium subsp. paratuberculosis
cucggccacgacgcgccac

SEQ ID NO: 836616 - RNA, 13 nt, Mycobacterium avium subsp. paratuberculosis
cucggccaccacc

SEQ ID NO: 836617 - RNA, 15 nt, Mycobacterium avium subsp. paratuberculosis
cucggccaccaccuc

SEQ ID NO: 836618 - RNA, 16 nt, Mycobacterium avium subsp. paratuberculosis
cucggccaccaccucg

SEQ ID NO: 836619 - RNA, 19 nt, Mycobacterium avium subsp. paratuberculosis
cucggccaccaugucggcg

SEQ ID NO: 836620 - RNA, 22 nt, Mycobacterium avium subsp. paratuberculosis
cucggccaccaugucggcgucg

SEQ ID NO: 836621 - RNA, 13 nt, Mycobacterium avium subsp. paratuberculosis
cucggccaccgcg

SEQ ID NO: 836622 - RNA, 17 nt, Mycobacterium avium subsp. paratuberculosis
cucggccaccgcgcggu

SEQ ID NO: 836623 - RNA, 19 nt, Mycobacterium avium subsp. paratuberculosis
cucggccaccgcgcggugc

SEQ ID NO: 836624 - RNA, 14 nt, Mycobacterium avium subsp. paratuberculosis
cucggccaccguca

SEQ ID NO: 836625 - RNA, 17 nt, Mycobacterium avium subsp. paratuberculosis
cucggcgaccgccggug

SEQ ID NO: 836626 - RNA, 20 nt, Mycobacterium avium subsp. paratuberculosis
cucggccagcgcagcgaccu

SEQ ID NO: 836627 - RNA, 13 nt, Mycobacterium avium subsp. paratuberculosis
cucggcgaccacg

SEQ ID NO: 836628 - RNA, 19 nt, Mycobacterium avium subsp. paratuberculosis
cucggccagcgccgcgcgc

SEQ ID NO: 836629 - RNA, 20 nt, Mycobacterium avium subsp. paratuberculosis
cucggcgacaacagcgccga

SEQ ID NO: 836630 - RNA, 21 nt, Mycobacterium avium subsp. paratuberculosis
cucggcgacaacagcgccgag

SEQ ID NO: 836631 - RNA, 15 nt, Mycobacterium avium subsp. paratuberculosis
cucggccagcgccgc

SEQ ID NO: 836632 - RNA, 16 nt, Mycobacterium avium subsp. paratuberculosis
cucggccagccaggcc

SEQ ID NO: 836633 - RNA, 18 nt, Mycobacterium avium subsp. paratuberculosis
cucggccagccaggccgu

SEQ ID NO: 836634 - RNA, 13 nt, Mycobacterium avium subsp. paratuberculosis
cucggccagcccc

SEQ ID NO: 836635 - RNA, 18 nt, Mycobacterium avium subsp. paratuberculosis
cucggccagccccaccac

SEQ ID NO: 836636 - RNA, 19 nt, Mycobacterium avium subsp. paratuberculosis
cucggccagccccaccacc

SEQ ID NO: 836637 - RNA, 20 nt, Mycobacterium avium subsp. paratuberculosis
cucggccagcaccagcagcc

SEQ ID NO: 836638 - RNA, 21 nt, Mycobacterium avium subsp. paratuberculosis
cucggccagcaccagcagccg

SEQ ID NO: 836639 - RNA, 17 nt, Mycobacterium avium subsp. paratuberculosis
cucggccagcagcacca

SEQ ID NO: 836640 - RNA, 13 nt, Mycobacterium avium subsp. paratuberculosis
cucggccagcagu

SEQ ID NO: 836641 - RNA, 21 nt, Mycobacterium avium subsp. paratuberculosis
cucggcgaugccguugaucac

SEQ ID NO: 836642 - RNA, 17 nt, Mycobacterium avium subsp. paratuberculosis
cucggcgccgaccucgg

SEQ ID NO: 836643 - RNA, 21 nt, Mycobacterium avium subsp. paratuberculosis
cucggcgccgaccucggccag

SEQ ID NO: 836644 - RNA, 13 nt, Mycobacterium avium subsp. paratuberculosis
cucggcgccgagc

SEQ ID NO: 836645 - RNA, 15 nt, Mycobacterium avium subsp. paratuberculosis
cucggcgccgccggu

SEQ ID NO: 836646 - RNA, 14 nt, Mycobacterium avium subsp. paratuberculosis
cucggcgccggccg

SEQ ID NO: 836647 - RNA, 21 nt, Mycobacterium avium subsp. paratuberculosis
cucggcgccggccgucacgcu

SEQ ID NO: 836648 - RNA, 22 nt, Mycobacterium avium subsp. paratuberculosis
cucggcgccgguggugucgacg

SEQ ID NO: 836649 - RNA, 21 nt, Mycobacterium avium subsp. paratuberculosis
cucggcgccguccagcucgcg

SEQ ID NO: 836650 - RNA, 14 nt, Mycobacterium avium subsp. paratuberculosis
cucggcgccgucgc

SEQ ID NO: 836651 - RNA, 17 nt, Mycobacterium avium subsp. paratuberculosis
cucggcgccgucgccgg

SEQ ID NO: 836652 - RNA, 18 nt, Mycobacterium avium subsp. paratuberculosis
cucggcgccgucgccgga

SEQ ID NO: 836653 - RNA, 17 nt, Mycobacterium avium subsp. paratuberculosis
cucggcgagcaccgugc

SEQ ID NO: 836654 - RNA, 22 nt, Mycobacterium avium subsp. paratuberculosis
cucggcgacgaugaagacccgc

SEQ ID NO: 836655 - RNA, 23 nt, Mycobacterium avium subsp. paratuberculosis
cucggcgacgauggccaggccca

SEQ ID NO: 836656 - RNA, 17 nt, Mycobacterium avium subsp. paratuberculosis
cucggcgaggucgucga

SEQ ID NO: 836657 - RNA, 18 nt, Mycobacterium avium subsp. paratuberculosis
cucggcgaggucguucga

SEQ ID NO: 836658 - RNA, 19 nt, Mycobacterium avium subsp. paratuberculosis
cucggcgaucuggcgguug

SEQ ID NO: 836659 - RNA, 23 nt, Mycobacterium avium subsp. paratuberculosis
cucggcgauggugaugugcggcg

SEQ ID NO: 836660 - RNA, 18 nt, Mycobacterium avium subsp. paratuberculosis
cucgggguugacccggcc

SEQ ID NO: 836661 - RNA, 21 nt, Mycobacterium avium subsp. paratuberculosis
cucgggguugacccggccggu

SEQ ID NO: 836662 - RNA, 19 nt, Mycobacterium avium subsp. paratuberculosis
cucgggugucgccgagccg

SEQ ID NO: 836663 - RNA, 16 nt, Mycobacterium avium subsp. paratuberculosis
cucggguuugccgacg

SEQ ID NO: 836664 - RNA, 19 nt, Mycobacterium avium subsp. paratuberculosis
cucgguacccccgccgggg

SEQ ID NO: 836665 - RNA, 17 nt, Mycobacterium avium subsp. paratuberculosis
cucgguaugcggcgacg

SEQ ID NO: 836666 - RNA, 21 nt, Mycobacterium avium subsp. paratuberculosis
cucgguaugcggcgacgaucg

SEQ ID NO: 836667 - RNA, 17 nt, Mycobacterium avium subsp. paratuberculosis
cucggucaagccggcca

SEQ ID NO: 836668 - RNA, 18 nt, Mycobacterium avium subsp. paratuberculosis
cucggucaagccggccag

SEQ ID NO: 836669 - RNA, 20 nt, Mycobacterium avium subsp. paratuberculosis
cucggucaaguccgcgagga

SEQ ID NO: 836670 - RNA, 17 nt, Mycobacterium avium subsp. paratuberculosis
cucggucaccagcggcc

SEQ ID NO: 836671 - RNA, 18 nt, Mycobacterium avium subsp. paratuberculosis
cucggucaccgagcggcc

SEQ ID NO: 836672 - RNA, 21 nt, Mycobacterium avium subsp. paratuberculosis
cucggucaccggugucacgcu

SEQ ID NO: 836673 - RNA, 13 nt, Mycobacterium avium subsp. paratuberculosis
cucggucaccucg

SEQ ID NO: 836674 - RNA, 18 nt, Mycobacterium avium subsp. paratuberculosis
cucggucacggucuggcu

SEQ ID NO: 836675 - RNA, 22 nt, Mycobacterium avium subsp. paratuberculosis
cucggucacggucuggcuggug

SEQ ID NO: 836676 - RNA, 12 nt, Mycobacterium avium subsp. paratuberculosis
cucggucagcac

SEQ ID NO: 836677 - RNA, 14 nt, Mycobacterium avium subsp. paratuberculosis
cucggucagcaccg

SEQ ID NO: 836678 - RNA, 16 nt, Mycobacterium avium subsp. paratuberculosis
cucggucagccgggcg

SEQ ID NO: 836679 - RNA, 19 nt, Mycobacterium avium subsp. paratuberculosis
cucggucaggaucgacucc

SEQ ID NO: 836680 - RNA, 14 nt, Mycobacterium avium subsp. paratuberculosis
cucggucaggccca

SEQ ID NO: 836681 - RNA, 17 nt, Mycobacterium avium subsp. paratuberculosis
cucggucagcggcgugc

SEQ ID NO: 836682 - RNA, 13 nt, Mycobacterium avium subsp. paratuberculosis
cucggucagcucg

SEQ ID NO: 836683 - RNA, 16 nt, Mycobacterium avium subsp. paratuberculosis
cucggucagguagccg

SEQ ID NO: 836684 - RNA, 20 nt, Mycobacterium avium subsp. paratuberculosis
cucggucgccgaauccggcg

SEQ ID NO: 836685 - RNA, 23 nt, Mycobacterium avium subsp. paratuberculosis
cucggucgccgaauccggcgggg

SEQ ID NO: 836686 - RNA, 15 nt, Mycobacterium avium subsp. paratuberculosis
cucggucgcggcgau

SEQ ID NO: 836687 - RNA, 18 nt, Mycobacterium avium subsp. paratuberculosis
cucggucgcgugaccggc

SEQ ID NO: 836688 - RNA, 14 nt, Mycobacterium avium subsp. paratuberculosis
cucgguggccaccu

SEQ ID NO: 836689 - RNA, 15 nt, Mycobacterium avium subsp. paratuberculosis
cucgguggccgguau

SEQ ID NO: 836690 - RNA, 13 nt, Mycobacterium avium subsp. paratuberculosis
cucgguggccucg

SEQ ID NO: 836691 - RNA, 14 nt, Mycobacterium avium subsp. paratuberculosis
cucgguggccucgc

SEQ ID NO: 836692 - RNA, 20 nt, Mycobacterium avium subsp. paratuberculosis
cucgguggacagguagcggu

SEQ ID NO: 836693 - RNA, 16 nt, Mycobacterium avium subsp. paratuberculosis
cucgguggacgccgcg

SEQ ID NO: 836694 - RNA, 17 nt, Mycobacterium avium subsp. paratuberculosis
cucgguggacgccgcgc

SEQ ID NO: 836695 - RNA, 23 nt, Mycobacterium avium subsp. paratuberculosis
cucgguggacgccgcgcacgacg

SEQ ID NO: 836696 - RNA, 21 nt, Mycobacterium avium subsp. paratuberculosis
cucgguggcgguggccacggc

SEQ ID NO: 836697 - RNA, 14 nt, Mycobacterium avium subsp. paratuberculosis
cucgguggucgcgu

SEQ ID NO: 836698 - RNA, 19 nt, Mycobacterium avium subsp. paratuberculosis
cucggugcucuugacggcc

SEQ ID NO: 836699 - RNA, 12 nt, Mycobacterium avium subsp. paratuberculosis
cucggugccgcg

SEQ ID NO: 836700 - RNA, 19 nt, Mycobacterium avium subsp. paratuberculosis
cucggugcggaacaccgcc

SEQ ID NO: 836701 - RNA, 15 nt, Mycobacterium avium subsp. paratuberculosis
cucggugaugccgag

SEQ ID NO: 836702 - RNA, 22 nt, Mycobacterium avium subsp. paratuberculosis
cucggugaugccggccagccgc

SEQ ID NO: 836703 - RNA, 16 nt, Mycobacterium avium subsp. paratuberculosis
cucggugaugucgacg

SEQ ID NO: 836704 - RNA, 17 nt, Mycobacterium avium subsp. paratuberculosis
cucggugaugucgacgu

SEQ ID NO: 836705 - RNA, 13 nt, Mycobacterium avium subsp. paratuberculosis
cucggugcagacc

SEQ ID NO: 836706 - RNA, 17 nt, Mycobacterium avium subsp. paratuberculosis
cucggugaucacccgcc

SEQ ID NO: 836707 - RNA, 21 nt, Mycobacterium avium subsp. paratuberculosis
cucggugaucacccgccgggu

SEQ ID NO: 836708 - RNA, 14 nt, Mycobacterium avium subsp. paratuberculosis
cucggugaucucac

SEQ ID NO: 836709 - RNA, 16 nt, Mycobacterium avium subsp. paratuberculosis
cucggugaugaucgcc

SEQ ID NO: 836710 - RNA, 19 nt, Mycobacterium avium subsp. paratuberculosis
cucggucuugaucaggucg

SEQ ID NO: 836711 - RNA, 16 nt, Mycobacterium avium subsp. paratuberculosis
cucggugagcagcucg

SEQ ID NO: 836712 - RNA, 16 nt, Mycobacterium avium subsp. paratuberculosis
cucgucccacggcggg

SEQ ID NO: 836713 - RNA, 17 nt, Mycobacterium avium subsp. paratuberculosis
cucgucccacggcgggg

SEQ ID NO: 836714 - RNA, 23 nt, Mycobacterium avium subsp. paratuberculosis
cucgucccagcgcaacggcgucg

SEQ ID NO: 836715 - RNA, 14 nt, Mycobacterium avium subsp. paratuberculosis
cucguccgcgcugg

SEQ ID NO: 836716 - RNA, 15 nt, Mycobacterium avium subsp. paratuberculosis
cucguccgcggcggc

SEQ ID NO: 836717 - RNA, 16 nt, Mycobacterium avium subsp. paratuberculosis
cucguccgcggcggcg

SEQ ID NO: 836718 - RNA, 19 nt, Mycobacterium avium subsp. paratuberculosis
cucguccaggugcacccgc

SEQ ID NO: 836719 - RNA, 20 nt, Mycobacterium avium subsp. paratuberculosis
cucguccaggugcacccgcg

SEQ ID NO: 836720 - RNA, 15 nt, Mycobacterium avium subsp. paratuberculosis
cucgucgaccgcggc

SEQ ID NO: 836721 - RNA, 17 nt, Mycobacterium avium subsp. paratuberculosis
cucgucgaccgcggccu

SEQ ID NO: 836722 - RNA, 15 nt, Mycobacterium avium subsp. paratuberculosis
cucgucgacgauggc

SEQ ID NO: 836723 - RNA, 14 nt, Mycobacterium avium subsp. paratuberculosis
cucgucgacgccca

SEQ ID NO: 836724 - RNA, 21 nt, Mycobacterium avium subsp. paratuberculosis
cucgucgaccagggcgaucac

SEQ ID NO: 836725 - RNA, 23 nt, Mycobacterium avium subsp. paratuberculosis
cucgucgaccagggcgaucaccg

SEQ ID NO: 836726 - RNA, 22 nt, Mycobacterium avium subsp. paratuberculosis
cucguccugauuuuggggacgc

SEQ ID NO: 836727 - RNA, 13 nt, Mycobacterium avium subsp. paratuberculosis
cucguccuggcgc

SEQ ID NO: 836728 - RNA, 15 nt, Mycobacterium avium subsp. paratuberculosis
cucguccuggcgcug

SEQ ID NO: 836729 - RNA, 16 nt, Mycobacterium avium subsp. paratuberculosis
cucgucgaagccgauc

SEQ ID NO: 836730 - RNA, 17 nt, Mycobacterium avium subsp. paratuberculosis
cucgucgaagccgauca

SEQ ID NO: 836731 - RNA, 21 nt, Mycobacterium avium subsp. paratuberculosis
cucgucgaagccgaucaccgg

SEQ ID NO: 836732 - RNA, 23 nt, Mycobacterium avium subsp. paratuberculosis
cucgucgacgcugaccguggugu

SEQ ID NO: 836733 - RNA, 18 nt, Mycobacterium avium subsp. paratuberculosis
cucgucgacggcggcguc

SEQ ID NO: 836734 - RNA, 15 nt, Mycobacterium avium subsp. paratuberculosis
cucgucgacgucggg

SEQ ID NO: 836735 - RNA, 20 nt, Mycobacterium avium subsp. paratuberculosis
cucgucgagcagcgcccggc

SEQ ID NO: 836736 - RNA, 21 nt, Mycobacterium avium subsp. paratuberculosis
cucgucgagcauccggcgcac

SEQ ID NO: 836737 - RNA, 15 nt, Mycobacterium avium subsp. paratuberculosis
cucgucgagccggcc

SEQ ID NO: 836738 - RNA, 15 nt, Mycobacterium avium subsp. paratuberculosis
cucgucgagccgggc

SEQ ID NO: 836739 - RNA, 17 nt, Mycobacterium avium subsp. paratuberculosis
cucguccaugcuggugc

SEQ ID NO: 836740 - RNA, 20 nt, Mycobacterium avium subsp. paratuberculosis
cucgucgauccccacgucgc

SEQ ID NO: 836741 - RNA, 19 nt, Mycobacterium avium subsp. paratuberculosis
cucgucgaucgacgccgac

SEQ ID NO: 836742 - RNA, 11 nt, Mycobacterium avium subsp. paratuberculosis
cucgucgaugg

SEQ ID NO: 836743 - RNA, 13 nt, Mycobacterium avium subsp. paratuberculosis
cucgucgauguag

SEQ ID NO: 836744 - RNA, 15 nt, Mycobacterium avium subsp. paratuberculosis
cucgucgaugucggc

SEQ ID NO: 836745 - RNA, 17 nt, Mycobacterium avium subsp. paratuberculosis
cucgucgaugucggcgg

SEQ ID NO: 836746 - RNA, 18 nt, Mycobacterium avium subsp. paratuberculosis
cucgucgaugucggcggc

SEQ ID NO: 836747 - RNA, 19 nt, Mycobacterium avium subsp. paratuberculosis
cucgucgaugucggcggcc

SEQ ID NO: 836748 - RNA, 21 nt, Mycobacterium avium subsp. paratuberculosis
cucgucgaugucggcggcccg

SEQ ID NO: 836749 - RNA, 18 nt, Mycobacterium avium subsp. paratuberculosis
cucguccagcccggucac

SEQ ID NO: 836750 - RNA, 17 nt, Mycobacterium avium subsp. paratuberculosis
cucguccagcgucgcgg

SEQ ID NO: 836751 - RNA, 15 nt, Mycobacterium avium subsp. paratuberculosis
cucgucagcgcgggc

SEQ ID NO: 836752 - RNA, 20 nt, Mycobacterium avium subsp. paratuberculosis
cucgucagcgcgggccagca

SEQ ID NO: 836753 - RNA, 19 nt, Mycobacterium avium subsp. paratuberculosis
cucguagguggccagcacg

SEQ ID NO: 836754 - RNA, 14 nt, Mycobacterium avium subsp. paratuberculosis
cucggugucgucga

SEQ ID NO: 836755 - RNA, 14 nt, Mycobacterium avium subsp. paratuberculosis
cucggugguggcca

SEQ ID NO: 836756 - RNA, 16 nt, Mycobacterium avium subsp. paratuberculosis
cucgguguacagcgcc

SEQ ID NO: 836757 - RNA, 17 nt, Mycobacterium avium subsp. paratuberculosis
cucgguguacagcgcca

SEQ ID NO: 836758 - RNA, 15 nt, Mycobacterium avium subsp. paratuberculosis
cucggugucgagguc

SEQ ID NO: 836759 - RNA, 23 nt, Mycobacterium avium subsp. paratuberculosis
cucggugucggacuugucgccgu

SEQ ID NO: 836760 - RNA, 22 nt, Mycobacterium avium subsp. paratuberculosis
cucggugugcugacccagcgcg

SEQ ID NO: 836761 - RNA, 18 nt, Mycobacterium avium subsp. paratuberculosis
cucguaacgccacggcgg

SEQ ID NO: 836762 - RNA, 14 nt, Mycobacterium avium subsp. paratuberculosis
cucguacaagguga

SEQ ID NO: 836763 - RNA, 16 nt, Mycobacterium avium subsp. paratuberculosis
cucguagcggccgcac

SEQ ID NO: 836764 - RNA, 20 nt, Mycobacterium avium subsp. paratuberculosis
cucguagcggccgcacgcga

SEQ ID NO: 836765 - RNA, 16 nt, Mycobacterium avium subsp. paratuberculosis
cucgugaugguccagc

SEQ ID NO: 836766 - RNA, 14 nt, Mycobacterium avium subsp. paratuberculosis
cucgugcagccggc

SEQ ID NO: 836767 - RNA, 17 nt, Mycobacterium avium subsp. paratuberculosis
cucgugcagccggcggc

SEQ ID NO: 836768 - RNA, 22 nt, Mycobacterium avium subsp. paratuberculosis
cucgucgucggugaacgccggu

SEQ ID NO: 836769 - RNA, 14 nt, Mycobacterium avium subsp. paratuberculosis
cucgucgucgucga

SEQ ID NO: 836770 - RNA, 14 nt, Mycobacterium avium subsp. paratuberculosis
cucgucuccggcgg

SEQ ID NO: 836771 - RNA, 17 nt, Mycobacterium avium subsp. paratuberculosis
cucgucuccggcggcag

SEQ ID NO: 836772 - RNA, 15 nt, Mycobacterium avium subsp. paratuberculosis
cucgucuuccgcggc

SEQ ID NO: 836773 - RNA, 17 nt, Mycobacterium avium subsp. paratuberculosis
cucgucguugcgcagcg

SEQ ID NO: 836774 - RNA, 23 nt, Mycobacterium avium subsp. paratuberculosis
cucgugaccggcggugucggugc

SEQ ID NO: 836775 - RNA, 15 nt, Mycobacterium avium subsp. paratuberculosis
cucgugauccggcac

SEQ ID NO: 836776 - RNA, 14 nt, Mycobacterium avium subsp. paratuberculosis
cucgugcggcgccg

SEQ ID NO: 836777 - RNA, 16 nt, Mycobacterium avium subsp. paratuberculosis
cucgugcggcgccgcc

SEQ ID NO: 836778 - RNA, 18 nt, Mycobacterium avium subsp. paratuberculosis
cucgugcggcgccgcccg

SEQ ID NO: 836779 - RNA, 18 nt, Mycobacterium avium subsp. paratuberculosis
cucgugggaaugcggcug

SEQ ID NO: 836780 - RNA, 20 nt, Mycobacterium avium subsp. paratuberculosis
cucguggaacaccgcgcuga

SEQ ID NO: 836781 - RNA, 15 nt, Mycobacterium avium subsp. paratuberculosis
cucgugggccaccac

SEQ ID NO: 836782 - RNA, 22 nt, Mycobacterium avium subsp. paratuberculosis
cucgugguucuccgcgacaucg

SEQ ID NO: 836783 - RNA, 15 nt, Mycobacterium avium subsp. paratuberculosis
cucguguccgaugac

SEQ ID NO: 836784 - RNA, 22 nt, Mycobacterium avium subsp. paratuberculosis
cucguguccgaugacgagcagc

SEQ ID NO: 836785 - RNA, 16 nt, Mycobacterium avium subsp. paratuberculosis
cucgucguagucgagg

SEQ ID NO: 836786 - RNA, 14 nt, Mycobacterium avium subsp. paratuberculosis
cucgucggugacgg

SEQ ID NO: 836787 - RNA, 14 nt, Mycobacterium avium subsp. paratuberculosis
cucgucgggcgcca

SEQ ID NO: 836788 - RNA, 16 nt, Mycobacterium avium subsp. paratuberculosis
cucgucgggcgccagc

SEQ ID NO: 836789 - RNA, 20 nt, Mycobacterium avium subsp. paratuberculosis
cucgucgggcgccagcccgc

SEQ ID NO: 836790 - RNA, 21 nt, Mycobacterium avium subsp. paratuberculosis
cucgucgggcgccagcccgcc

SEQ ID NO: 836791 - RNA, 18 nt, Mycobacterium avium subsp. paratuberculosis
cucgucggggcagccguc

SEQ ID NO: 836792 - RNA, 22 nt, Mycobacterium avium subsp. paratuberculosis
cucgucggggcagccgucgaug

SEQ ID NO: 836793 - RNA, 20 nt, Mycobacterium avium subsp. paratuberculosis
cucgucgggaacgccgauca

SEQ ID NO: 836794 - RNA, 23 nt, Mycobacterium avium subsp. paratuberculosis
cucgucgggugucaggucggcga

SEQ ID NO: 836795 - RNA, 11 nt, Mycobacterium avium subsp. paratuberculosis
cucgucggccg

SEQ ID NO: 836796 - RNA, 13 nt, Mycobacterium avium subsp. paratuberculosis
cucgucggcgagc

SEQ ID NO: 836797 - RNA, 16 nt, Mycobacterium avium subsp. paratuberculosis
cucgucggcgagcagc

SEQ ID NO: 836798 - RNA, 14 nt, Mycobacterium avium subsp. paratuberculosis
cucgucggcgccgu

SEQ ID NO: 836799 - RNA, 17 nt, Mycobacterium avium subsp. paratuberculosis
cucgucggcgccgucgc

SEQ ID NO: 836800 - RNA, 14 nt, Mycobacterium avium subsp. paratuberculosis
cucgucggcgcggg

SEQ ID NO: 836801 - RNA, 15 nt, Mycobacterium avium subsp. paratuberculosis
cucgucggcgcgggc

SEQ ID NO: 836802 - RNA, 12 nt, Mycobacterium avium subsp. paratuberculosis
cucgucggcggc

SEQ ID NO: 836803 - RNA, 13 nt, Mycobacterium avium subsp. paratuberculosis
cucgucggcggcg

SEQ ID NO: 836804 - RNA, 22 nt, Mycobacterium avium subsp. paratuberculosis
cucgucggcggcgacggcgacc

SEQ ID NO: 836805 - RNA, 16 nt, Mycobacterium avium subsp. paratuberculosis
cucgucggcggcggcc

SEQ ID NO: 836806 - RNA, 17 nt, Mycobacterium avium subsp. paratuberculosis
cucgucggcggcggccu

SEQ ID NO: 836807 - RNA, 21 nt, Mycobacterium avium subsp. paratuberculosis
cucgucggcggcggccugcac

SEQ ID NO: 836808 - RNA, 13 nt, Mycobacterium avium subsp. paratuberculosis
cucgucggcgggc

SEQ ID NO: 836809 - RNA, 13 nt, Mycobacterium avium subsp. paratuberculosis
cucgucggcggug

SEQ ID NO: 836810 - RNA, 22 nt, Mycobacterium avium subsp. paratuberculosis
cucgucgccgucggggucgcgc

SEQ ID NO: 836811 - RNA, 14 nt, Mycobacterium avium subsp. paratuberculosis
cucgucgccgcggu

SEQ ID NO: 836812 - RNA, 14 nt, Mycobacterium avium subsp. paratuberculosis
cucgucgcgcagcu

SEQ ID NO: 836813 - RNA, 12 nt, Mycobacterium avium subsp. paratuberculosis
cucgucgcggag

SEQ ID NO: 836814 - RNA, 13 nt, Mycobacterium avium subsp. paratuberculosis
cucgucgcccggc

SEQ ID NO: 836815 - RNA, 14 nt, Mycobacterium avium subsp. paratuberculosis
cucgucgcggcugc

SEQ ID NO: 836816 - RNA, 12 nt, Mycobacterium avium subsp. paratuberculosis
cucgucgcgggc

SEQ ID NO: 836817 - RNA, 17 nt, Mycobacterium avium subsp. paratuberculosis
cucgucgcgggcgccga

SEQ ID NO: 836818 - RNA, 22 nt, Mycobacterium avium subsp. paratuberculosis
cucgucgcgguugaucacaccg

SEQ ID NO: 836819 - RNA, 20 nt, Mycobacterium avium subsp. paratuberculosis
cucgucggaggcgucgacgc

SEQ ID NO: 836820 - RNA, 22 nt, Mycobacterium avium subsp. paratuberculosis
cucgucggaggcgucgacgcgc

SEQ ID NO: 836821 - RNA, 14 nt, Mycobacterium avium subsp. paratuberculosis
cucgucggccagcg

SEQ ID NO: 836822 - RNA, 15 nt, Mycobacterium avium subsp. paratuberculosis
cucgucggccgcgac

SEQ ID NO: 836823 - RNA, 16 nt, Mycobacterium avium subsp. paratuberculosis
cucgucggcgaacucc

SEQ ID NO: 836824 - RNA, 20 nt, Mycobacterium avium subsp. paratuberculosis
cucguucgaguaggcgacca

SEQ ID NO: 836825 - RNA, 16 nt, Mycobacterium avium subsp. paratuberculosis
cucguugugcaccggc

SEQ ID NO: 836826 - RNA, 21 nt, Mycobacterium avium subsp. paratuberculosis
cucguugugcaccggcacguc

SEQ ID NO: 836827 - RNA, 23 nt, Mycobacterium avium subsp. paratuberculosis
cucguugugcauguggccgucgc

SEQ ID NO: 836828 - RNA, 16 nt, Mycobacterium avium subsp. paratuberculosis
cucguuggccagcucg

SEQ ID NO: 836829 - RNA, 17 nt, Mycobacterium avium subsp. paratuberculosis
cucguuggccggcucca

SEQ ID NO: 836830 - RNA, 20 nt, Mycobacterium avium subsp. paratuberculosis
cucguugcaguagacguugc

SEQ ID NO: 836831 - RNA, 15 nt, Mycobacterium avium subsp. paratuberculosis
cucguugccagccgg

SEQ ID NO: 836832 - RNA, 22 nt, Mycobacterium avium subsp. paratuberculosis
cucucgccggucagcacgucgg

SEQ ID NO: 836833 - RNA, 22 nt, Mycobacterium avium subsp. paratuberculosis
cucucguccucgaacaggcucu

SEQ ID NO: 836834 - RNA, 16 nt, Mycobacterium avium subsp. paratuberculosis
cucucgucgacgaugg

SEQ ID NO: 836835 - RNA, 17 nt, Mycobacterium avium subsp. paratuberculosis
cucucgucgucggcggg

SEQ ID NO: 836836 - RNA, 15 nt, Mycobacterium avium subsp. paratuberculosis
cucuuccucgggcag

SEQ ID NO: 836837 - RNA, 14 nt, Mycobacterium avium subsp. paratuberculosis
cucuucggcgccgg

SEQ ID NO: 836838 - RNA, 17 nt, Mycobacterium avium subsp. paratuberculosis
cucuucggcgcgccggc

SEQ ID NO: 836839 - RNA, 15 nt, Mycobacterium avium subsp. paratuberculosis
cucuucgcugccgcc

SEQ ID NO: 836840 - RNA, 13 nt, Mycobacterium avium subsp. paratuberculosis
cucuucgaugccg

SEQ ID NO: 836841 - RNA, 15 nt, Mycobacterium avium subsp. paratuberculosis
cucuucgcggcgggg

SEQ ID NO: 836842 - RNA, 13 nt, Mycobacterium avium subsp. paratuberculosis
cucuucgggcugc

SEQ ID NO: 836843 - RNA, 12 nt, Mycobacterium avium subsp. paratuberculosis
cucuucgguggu

SEQ ID NO: 836844 - RNA, 22 nt, Mycobacterium avium subsp. paratuberculosis
aacgacagcaggaucuccggcc

SEQ ID NO: 836845 - RNA, 16 nt, Mycobacterium avium subsp. paratuberculosis
gacaggaugcguucgg

SEQ ID NO: 836846 - RNA, 15 nt, Mycobacterium avium subsp. paratuberculosis
gacaggaugcugggg

SEQ ID NO: 836847 - RNA, 23 nt, Mycobacterium avium subsp. paratuberculosis
gacaggaugcuggggucggccag

SEQ ID NO: 836848 - RNA, 20 nt, Mycobacterium avium subsp. paratuberculosis
gacagcgcgguggucagcgg

SEQ ID NO: 836849 - RNA, 15 nt, Mycobacterium avium subsp. paratuberculosis
gacagcgcgucggcc

SEQ ID NO: 836850 - RNA, 19 nt, Mycobacterium avium subsp. paratuberculosis
gacagcgcgucggccagcg

SEQ ID NO: 836851 - RNA, 22 nt, Mycobacterium avium subsp. paratuberculosis
gacagcgcgucggccagcgcgc

SEQ ID NO: 836852 - RNA, 19 nt, Mycobacterium avium subsp. paratuberculosis
gacagcgcgucggcgaugu

SEQ ID NO: 836853 - RNA, 22 nt, Mycobacterium avium subsp. paratuberculosis
gacaggaggguuuucggggcgu

SEQ ID NO: 836854 - RNA, 23 nt, Mycobacterium avium subsp. paratuberculosis
gacaggaggguuuucggggcgug

SEQ ID NO: 836855 - RNA, 17 nt, Mycobacterium avium subsp. paratuberculosis
gacagggcggcgaccuu

SEQ ID NO: 836856 - RNA, 16 nt, Mycobacterium avium subsp. paratuberculosis
gacaggggcagcagca

SEQ ID NO: 836857 - RNA, 16 nt, Mycobacterium avium subsp. paratuberculosis
gacagggagccgacga

SEQ ID NO: 836858 - RNA, 19 nt, Mycobacterium avium subsp. paratuberculosis
gacagggaggacagcaccg

SEQ ID NO: 836859 - RNA, 23 nt, Mycobacterium avium subsp. paratuberculosis
gacagggaggacagcaccgccau

SEQ ID NO: 836860 - RNA, 15 nt, Mycobacterium avium subsp. paratuberculosis
gacagggccagcgcc

SEQ ID NO: 836861 - RNA, 22 nt, Mycobacterium avium subsp. paratuberculosis
aacgacauccagaugcccagca

SEQ ID NO: 836862 - RNA, 14 nt, Mycobacterium avium subsp. paratuberculosis
aacgacagcgacgg

SEQ ID NO: 836863 - RNA, 21 nt, Mycobacterium avium subsp. paratuberculosis
aacgacagcgacgggccgggc

SEQ ID NO: 836864 - RNA, 13 nt, Mycobacterium avium subsp. paratuberculosis
gacagcgccugcc

SEQ ID NO: 836865 - RNA, 16 nt, Mycobacterium avium subsp. paratuberculosis
gacagcgccugcccgg

SEQ ID NO: 836866 - RNA, 17 nt, Mycobacterium avium subsp. paratuberculosis
gacagcgccugcccgga

SEQ ID NO: 836867 - RNA, 14 nt, Mycobacterium avium subsp. paratuberculosis
gacagcgcgacgca

SEQ ID NO: 836868 - RNA, 16 nt, Mycobacterium avium subsp. paratuberculosis
gacagcgcgacgcacg

SEQ ID NO: 836869 - RNA, 21 nt, Mycobacterium avium subsp. paratuberculosis
gacagcgcgacgcacgccggc

SEQ ID NO: 836870 - RNA, 14 nt, Mycobacterium avium subsp. paratuberculosis
gacagccaccgugc

SEQ ID NO: 836871 - RNA, 16 nt, Mycobacterium avium subsp. paratuberculosis
gacaggcacucgccca

SEQ ID NO: 836872 - RNA, 16 nt, Mycobacterium avium subsp. paratuberculosis
gacaggcagcccggcu

SEQ ID NO: 836873 - RNA, 19 nt, Mycobacterium avium subsp. paratuberculosis
gacaggcagcccggcugcg

SEQ ID NO: 836874 - RNA, 13 nt, Mycobacterium avium subsp. paratuberculosis
gacagcgaaccga

SEQ ID NO: 836875 - RNA, 15 nt, Mycobacterium avium subsp. paratuberculosis
gacagcgaaccgaca

SEQ ID NO: 836876 - RNA, 18 nt, Mycobacterium avium subsp. paratuberculosis
gacagcgacgggccgggc

SEQ ID NO: 836877 - RNA, 19 nt, Mycobacterium avium subsp. paratuberculosis
gacagcgacgggccgggca

SEQ ID NO: 836878 - RNA, 20 nt, Mycobacterium avium subsp. paratuberculosis
gacagcgagaagucgccgac

SEQ ID NO: 836879 - RNA, 13 nt, Mycobacterium avium subsp. paratuberculosis
gacagccgcgccg

SEQ ID NO: 836880 - RNA, 15 nt, Mycobacterium avium subsp. paratuberculosis
gacagccgcgccgac

SEQ ID NO: 836881 - RNA, 18 nt, Mycobacterium avium subsp. paratuberculosis
gacagccgagauggcaac

SEQ ID NO: 836882 - RNA, 21 nt, Mycobacterium avium subsp. paratuberculosis
gacagccggggcagcugcugg

SEQ ID NO: 836883 - RNA, 17 nt, Mycobacterium avium subsp. paratuberculosis
gacagccggucgacgaa

SEQ ID NO: 836884 - RNA, 20 nt, Mycobacterium avium subsp. paratuberculosis
gacagccggucgacgaagaa

SEQ ID NO: 836885 - RNA, 15 nt, Mycobacterium avium subsp. paratuberculosis
gacagccggucgcgc

SEQ ID NO: 836886 - RNA, 19 nt, Mycobacterium avium subsp. paratuberculosis
gacagccggucgcgcaucg

SEQ ID NO: 836887 - RNA, 16 nt, Mycobacterium avium subsp. paratuberculosis
gaauuccucagcgccc

SEQ ID NO: 836888 - RNA, 18 nt, Mycobacterium avium subsp. paratuberculosis
gaauuccuggccggugcg

SEQ ID NO: 836889 - RNA, 16 nt, Mycobacterium avium subsp. paratuberculosis
gaauuccaugucgucg

SEQ ID NO: 836890 - RNA, 18 nt, Mycobacterium avium subsp. paratuberculosis
gaauuccaugucgucgag

SEQ ID NO: 836891 - RNA, 22 nt, Mycobacterium avium subsp. paratuberculosis
gaauuccaugucgucgagcucg

SEQ ID NO: 836892 - RNA, 14 nt, Mycobacterium avium subsp. paratuberculosis
gaauucgaccacgg

SEQ ID NO: 836893 - RNA, 20 nt, Mycobacterium avium subsp. paratuberculosis
gaauucgcgggugcgcucga

SEQ ID NO: 836894 - RNA, 13 nt, Mycobacterium avium subsp. paratuberculosis
gacagccgcacca

SEQ ID NO: 836895 - RNA, 15 nt, Mycobacterium avium subsp. paratuberculosis
gacagccgcaccggc

SEQ ID NO: 836896 - RNA, 16 nt, Mycobacterium avium subsp. paratuberculosis
gacagccgcaccggcg

SEQ ID NO: 836897 - RNA, 18 nt, Mycobacterium avium subsp. paratuberculosis
gacagccgcaccggcgcc

SEQ ID NO: 836898 - RNA, 14 nt, Mycobacterium avium subsp. paratuberculosis
gacagccgcccggc

SEQ ID NO: 836899 - RNA, 20 nt, Mycobacterium avium subsp. paratuberculosis
gacagccgcccggcgccccg

SEQ ID NO: 836900 - RNA, 16 nt, Mycobacterium avium subsp. paratuberculosis
gacagcccccgcagcc

SEQ ID NO: 836901 - RNA, 18 nt, Mycobacterium avium subsp. paratuberculosis
gacagcccccgcagcccg

SEQ ID NO: 836902 - RNA, 15 nt, Mycobacterium avium subsp. paratuberculosis
gacagccccgagccg

SEQ ID NO: 836903 - RNA, 20 nt, Mycobacterium avium subsp. paratuberculosis
gacagccccgagccgcggau

SEQ ID NO: 836904 - RNA, 14 nt, Mycobacterium avium subsp. paratuberculosis
gaaugucgcgcagc

SEQ ID NO: 836905 - RNA, 20 nt, Mycobacterium avium subsp. paratuberculosis
gaaugucgcgcagcauccgc

SEQ ID NO: 836906 - RNA, 13 nt, Mycobacterium avium subsp. paratuberculosis
gaaugucggcguu

SEQ ID NO: 836907 - RNA, 22 nt, Mycobacterium avium subsp. paratuberculosis
gaaugucauuugagcggccgac

SEQ ID NO: 836908 - RNA, 22 nt, Mycobacterium avium subsp. paratuberculosis
gaauggccgcgccguagcggcc

SEQ ID NO: 836909 - RNA, 15 nt, Mycobacterium avium subsp. paratuberculosis
gaccaagccccgcag

SEQ ID NO: 836910 - RNA, 21 nt, Mycobacterium avium subsp. paratuberculosis
gaccaagaaccaacugagcgc

SEQ ID NO: 836911 - RNA, 13 nt, Mycobacterium avium subsp. paratuberculosis
gaccaaggccgac

SEQ ID NO: 836912 - RNA, 19 nt, Mycobacterium avium subsp. paratuberculosis
gaccaauugcgagcaggcc

SEQ ID NO: 836913 - RNA, 13 nt, Mycobacterium avium subsp. paratuberculosis
gaccacaccgccg

SEQ ID NO: 836914 - RNA, 15 nt, Mycobacterium avium subsp. paratuberculosis
gaccacaccgccggc

SEQ ID NO: 836915 - RNA, 19 nt, Mycobacterium avium subsp. paratuberculosis
gaccacaccgccggccacg

SEQ ID NO: 836916 - RNA, 12 nt, Mycobacterium avium subsp. paratuberculosis
gaccacaccggc

SEQ ID NO: 836917 - RNA, 17 nt, Mycobacterium avium subsp. paratuberculosis
gaccacaccggcgcugc

SEQ ID NO: 836918 - RNA, 22 nt, Mycobacterium avium subsp. paratuberculosis
gaccacaccggcgcugcccgcg

SEQ ID NO: 836919 - RNA, 18 nt, Mycobacterium avium subsp. paratuberculosis
gaccacaccgucgacgac

SEQ ID NO: 836920 - RNA, 16 nt, Mycobacterium avium subsp. paratuberculosis
aacgagaaggcggcgu

SEQ ID NO: 836921 - RNA, 17 nt, Mycobacterium avium subsp. paratuberculosis
aacgaggcccggacggc

SEQ ID NO: 836922 - RNA, 21 nt, Mycobacterium avium subsp. paratuberculosis
aacgaggccgcgccgugcgcc

SEQ ID NO: 836923 - RNA, 22 nt, Mycobacterium avium subsp. paratuberculosis
aacgaggccgcgccgugcgcca

SEQ ID NO: 836924 - RNA, 23 nt, Mycobacterium avium subsp. paratuberculosis
aacgaggccgcgccgugcgccag

SEQ ID NO: 836925 - RNA, 24 nt, Mycobacterium avium subsp. paratuberculosis
aacgaguugccccguguggugucg

SEQ ID NO: 836926 - RNA, 16 nt, Mycobacterium avium subsp. paratuberculosis
aacgacgucgccacca

SEQ ID NO: 836927 - RNA, 19 nt, Mycobacterium avium subsp. paratuberculosis
aacgacguguucaacgcgc

SEQ ID NO: 836928 - RNA, 14 nt, Mycobacterium avium subsp. paratuberculosis
aacgacgucggcgu

SEQ ID NO: 836929 - RNA, 16 nt, Mycobacterium avium subsp. paratuberculosis
gaccaacuccaccgcc

SEQ ID NO: 836930 - RNA, 17 nt, Mycobacterium avium subsp. paratuberculosis
gaccaacuccaccgccc

SEQ ID NO: 836931 - RNA, 20 nt, Mycobacterium avium subsp. paratuberculosis
gaccaacuccaccgcccgga

SEQ ID NO: 836932 - RNA, 22 nt, Mycobacterium avium subsp. paratuberculosis
gaccaacgccgccuccgacagc

SEQ ID NO: 836933 - RNA, 17 nt, Mycobacterium avium subsp. paratuberculosis
gaccaacacccccgcgc

SEQ ID NO: 836934 - RNA, 20 nt, Mycobacterium avium subsp. paratuberculosis
gaccaacacccccgcgcugc

SEQ ID NO: 836935 - RNA, 16 nt, Mycobacterium avium subsp. paratuberculosis
gacauucacgaggccg

SEQ ID NO: 836936 - RNA, 16 nt, Mycobacterium avium subsp. paratuberculosis
gacaugcgcagcgccc

SEQ ID NO: 836937 - RNA, 13 nt, Mycobacterium avium subsp. paratuberculosis
gacaugcugggcu

SEQ ID NO: 836938 - RNA, 13 nt, Mycobacterium avium subsp. paratuberculosis
gacauggacgcgg

SEQ ID NO: 836939 - RNA, 15 nt, Mycobacterium avium subsp. paratuberculosis
gacauggacgcggcc

SEQ ID NO: 836940 - RNA, 21 nt, Mycobacterium avium subsp. paratuberculosis
gacauggucgggcgcaccacg

SEQ ID NO: 836941 - RNA, 15 nt, Mycobacterium avium subsp. paratuberculosis
gacaguucggcgcgc

SEQ ID NO: 836942 - RNA, 18 nt, Mycobacterium avium subsp. paratuberculosis
gacaguucgguggggccg

SEQ ID NO: 836943 - RNA, 14 nt, Mycobacterium avium subsp. paratuberculosis
gacaugccggcgcc

SEQ ID NO: 836944 - RNA, 15 nt, Mycobacterium avium subsp. paratuberculosis
gacaguccgaccgcg

SEQ ID NO: 836945 - RNA, 16 nt, Mycobacterium avium subsp. paratuberculosis
gacaguccgaccgcgu

SEQ ID NO: 836946 - RNA, 16 nt, Mycobacterium avium subsp. paratuberculosis
gacagucgcgggcagc

SEQ ID NO: 836947 - RNA, 18 nt, Mycobacterium avium subsp. paratuberculosis
gacagucgcgggcagccg

SEQ ID NO: 836948 - RNA, 21 nt, Mycobacterium avium subsp. paratuberculosis
gacagucgcgggcagccggcg

SEQ ID NO: 836949 - RNA, 24 nt, Mycobacterium avium subsp. paratuberculosis
gacagucgcgggcgagccgacagu

SEQ ID NO: 836950 - RNA, 22 nt, Mycobacterium avium subsp. paratuberculosis
gacagucgcgggcggggcgccg

SEQ ID NO: 836951 - RNA, 23 nt, Mycobacterium avium subsp. paratuberculosis
gacagucgcgggcggggcgccga

SEQ ID NO: 836952 - RNA, 19 nt, Mycobacterium avium subsp. paratuberculosis
gacagguucuuggcggccu

SEQ ID NO: 836953 - RNA, 20 nt, Mycobacterium avium subsp. paratuberculosis
gacagguucuuggcggccug

SEQ ID NO: 836954 - RNA, 20 nt, Mycobacterium avium subsp. paratuberculosis
gacaggucgagggugacccg

SEQ ID NO: 836955 - RNA, 23 nt, Mycobacterium avium subsp. paratuberculosis
gacagggugccgaacagcgacgu

SEQ ID NO: 836956 - RNA, 19 nt, Mycobacterium avium subsp. paratuberculosis
gacagguagcggugcucga

SEQ ID NO: 836957 - RNA, 21 nt, Mycobacterium avium subsp. paratuberculosis
gacaggucgaagggcaucggg

SEQ ID NO: 836958 - RNA, 16 nt, Mycobacterium avium subsp. paratuberculosis
gacaggugcauccagu

SEQ ID NO: 836959 - RNA, 23 nt, Mycobacterium avium subsp. paratuberculosis
gacaggugcauccagucggcgcc

SEQ ID NO: 836960 - RNA, 19 nt, Mycobacterium avium subsp. paratuberculosis
gacagguggccgaucagcg

SEQ ID NO: 836961 - RNA, 22 nt, Mycobacterium avium subsp. paratuberculosis
gacagguggccgaucagcggcg

SEQ ID NO: 836962 - RNA, 23 nt, Mycobacterium avium subsp. paratuberculosis
gacagguggccgaucagcggcgg

SEQ ID NO: 836963 - RNA, 19 nt, Mycobacterium avium subsp. paratuberculosis
gacagguggggcaccagaa

SEQ ID NO: 836964 - RNA, 15 nt, Mycobacterium avium subsp. paratuberculosis
aacgcaaugcgucgc

SEQ ID NO: 836965 - RNA, 18 nt, Mycobacterium avium subsp. paratuberculosis
aacgcaacagcgagucgg

SEQ ID NO: 836966 - RNA, 18 nt, Mycobacterium avium subsp. paratuberculosis
aacgcaacagggccaccg

SEQ ID NO: 836967 - RNA, 20 nt, Mycobacterium avium subsp. paratuberculosis
gaccacgaucgucuggccgu

SEQ ID NO: 836968 - RNA, 21 nt, Mycobacterium avium subsp. paratuberculosis
gaccacgcacaccaccgacgc

SEQ ID NO: 836969 - RNA, 16 nt, Mycobacterium avium subsp. paratuberculosis
gaccaccaccgcccac

SEQ ID NO: 836970 - RNA, 20 nt, Mycobacterium avium subsp. paratuberculosis
gaccaccaccgcccacagca

SEQ ID NO: 836971 - RNA, 13 nt, Mycobacterium avium subsp. paratuberculosis
gaccaccaccgcc

SEQ ID NO: 836972 - RNA, 15 nt, Mycobacterium avium subsp. paratuberculosis
gaccaccacggccgc

SEQ ID NO: 836973 - RNA, 14 nt, Mycobacterium avium subsp. paratuberculosis
gaccaccagccgca

SEQ ID NO: 836974 - RNA, 14 nt, Mycobacterium avium subsp. paratuberculosis
gaccaccagcgugc

SEQ ID NO: 836975 - RNA, 17 nt, Mycobacterium avium subsp. paratuberculosis
gaccaccagcgugcugc

SEQ ID NO: 836976 - RNA, 17 nt, Mycobacterium avium subsp. paratuberculosis
gaccaccaggagcaccu

SEQ ID NO: 836977 - RNA, 21 nt, Mycobacterium avium subsp. paratuberculosis
gaccaccaggagcaccugcgc

SEQ ID NO: 836978 - RNA, 23 nt, Mycobacterium avium subsp. paratuberculosis
gaccaccaggagcaccugcgcga

SEQ ID NO: 836979 - RNA, 21 nt, Mycobacterium avium subsp. paratuberculosis
gaccaccaugauguagcggcg

SEQ ID NO: 836980 - RNA, 16 nt, Mycobacterium avium subsp. paratuberculosis
gaccaccugcaccugc

SEQ ID NO: 836981 - RNA, 19 nt, Mycobacterium avium subsp. paratuberculosis
gaccaccugcaccugcggc

SEQ ID NO: 836982 - RNA, 16 nt, Mycobacterium avium subsp. paratuberculosis
gaccaccucgaugacc

SEQ ID NO: 836983 - RNA, 14 nt, Mycobacterium avium subsp. paratuberculosis
gaccacccccagcc

SEQ ID NO: 836984 - RNA, 21 nt, Mycobacterium avium subsp. paratuberculosis
gaccaccucgguggacgccgc

SEQ ID NO: 836985 - RNA, 20 nt, Mycobacterium avium subsp. paratuberculosis
gaccaccuugcgcagcagca

SEQ ID NO: 836986 - RNA, 17 nt, Mycobacterium avium subsp. paratuberculosis
gaccaccuuggccggug

SEQ ID NO: 836987 - RNA, 16 nt, Mycobacterium avium subsp. paratuberculosis
gaccacgaacaccggc

SEQ ID NO: 836988 - RNA, 22 nt, Mycobacterium avium subsp. paratuberculosis
gaccacgaacaccggcgcgacc

SEQ ID NO: 836989 - RNA, 19 nt, Mycobacterium avium subsp. paratuberculosis
aacgccggugagguggcgu

SEQ ID NO: 836990 - RNA, 14 nt, Mycobacterium avium subsp. paratuberculosis
aacgccgggucgac

SEQ ID NO: 836991 - RNA, 17 nt, Mycobacterium avium subsp. paratuberculosis
gaccagauaggccagcg

SEQ ID NO: 836992 - RNA, 18 nt, Mycobacterium avium subsp. paratuberculosis
gaccagauaggccagcgc

SEQ ID NO: 836993 - RNA, 19 nt, Mycobacterium avium subsp. paratuberculosis
gaccagauaggccagcgcg

SEQ ID NO: 836994 - RNA, 14 nt, Mycobacterium avium subsp. paratuberculosis
gaccagauccucga

SEQ ID NO: 836995 - RNA, 18 nt, Mycobacterium avium subsp. paratuberculosis
gaccagauugcggcacca

SEQ ID NO: 836996 - RNA, 15 nt, Mycobacterium avium subsp. paratuberculosis
aacgccucgucgacc

SEQ ID NO: 836997 - RNA, 20 nt, Mycobacterium avium subsp. paratuberculosis
aacgccucgucgaccgcggc

SEQ ID NO: 836998 - RNA, 15 nt, Mycobacterium avium subsp. paratuberculosis
aacgccugccggcgc

SEQ ID NO: 836999 - RNA, 19 nt, Mycobacterium avium subsp. paratuberculosis
aacgccugcgccgccguag

SEQ ID NO: 837000 - RNA, 21 nt, Mycobacterium avium subsp. paratuberculosis
gaccacuccuggguuccggug

SEQ ID NO: 837001 - RNA, 17 nt, Mycobacterium avium subsp. paratuberculosis
aacgccggccccggcga

SEQ ID NO: 837002 - RNA, 18 nt, Mycobacterium avium subsp. paratuberculosis
aacgccggccccggcgac

SEQ ID NO: 837003 - RNA, 21 nt, Mycobacterium avium subsp. paratuberculosis
gaccacggucacagccgcgau

SEQ ID NO: 837004 - RNA, 14 nt, Mycobacterium avium subsp. paratuberculosis
gaccacggccgguc

SEQ ID NO: 837005 - RNA, 17 nt, Mycobacterium avium subsp. paratuberculosis
aacgccgaggaggccgc

SEQ ID NO: 837006 - RNA, 20 nt, Mycobacterium avium subsp. paratuberculosis
aacgccgaggaggccgcggc

SEQ ID NO: 837007 - RNA, 23 nt, Mycobacterium avium subsp. paratuberculosis
aacgccgaggaggccgcggcgac

SEQ ID NO: 837008 - RNA, 15 nt, Mycobacterium avium subsp. paratuberculosis
aacgccgaggugcaa

SEQ ID NO: 837009 - RNA, 16 nt, Mycobacterium avium subsp. paratuberculosis
aacgccgaucaccgcg

SEQ ID NO: 837010 - RNA, 16 nt, Mycobacterium avium subsp. paratuberculosis
aacgccgaucaccggc

SEQ ID NO: 837011 - RNA, 21 nt, Mycobacterium avium subsp. paratuberculosis
gaccacgcuccagaugcggug

SEQ ID NO: 837012 - RNA, 20 nt, Mycobacterium avium subsp. paratuberculosis
gaccaggaacacggcucggg

SEQ ID NO: 837013 - RNA, 21 nt, Mycobacterium avium subsp. paratuberculosis
gaccaggaaguacaccaccgc

SEQ ID NO: 837014 - RNA, 22 nt, Mycobacterium avium subsp. paratuberculosis
gaccaggaaguacaccaccgcg

SEQ ID NO: 837015 - RNA, 23 nt, Mycobacterium avium subsp. paratuberculosis
gaccaggaaguacaccaccgcgg

SEQ ID NO: 837016 - RNA, 19 nt, Mycobacterium avium subsp. paratuberculosis
gaccagcuugaagcccucg

SEQ ID NO: 837017 - RNA, 22 nt, Mycobacterium avium subsp. paratuberculosis
gaccagccgaaguuggcgucgg

SEQ ID NO: 837018 - RNA, 23 nt, Mycobacterium avium subsp. paratuberculosis
gaccagccgaaguuggcgucggg

SEQ ID NO: 837019 - RNA, 16 nt, Mycobacterium avium subsp. paratuberculosis
gaccagcggcagcagc

SEQ ID NO: 837020 - RNA, 16 nt, Mycobacterium avium subsp. paratuberculosis
gaccagcggcccaccg

SEQ ID NO: 837021 - RNA, 14 nt, Mycobacterium avium subsp. paratuberculosis
gaccagcggcgcgc

SEQ ID NO: 837022 - RNA, 21 nt, Mycobacterium avium subsp. paratuberculosis
gaccagcgggucgauggcgac

SEQ ID NO: 837023 - RNA, 15 nt, Mycobacterium avium subsp. paratuberculosis
gaccagcgguuugga

SEQ ID NO: 837024 - RNA, 22 nt, Mycobacterium avium subsp. paratuberculosis
gaccagcgguuuggauggcccg

SEQ ID NO: 837025 - RNA, 22 nt, Mycobacterium avium subsp. paratuberculosis
gaccagcgugaccucgacggug

SEQ ID NO: 837026 - RNA, 17 nt, Mycobacterium avium subsp. paratuberculosis
gaccagcgugacgcuga

SEQ ID NO: 837027 - RNA, 17 nt, Mycobacterium avium subsp. paratuberculosis
gaccagcgugucgccgg

SEQ ID NO: 837028 - RNA, 16 nt, Mycobacterium avium subsp. paratuberculosis
gaccaggugggcggcc

SEQ ID NO: 837029 - RNA, 17 nt, Mycobacterium avium subsp. paratuberculosis
gaccaggugggcggcca

SEQ ID NO: 837030 - RNA, 19 nt, Mycobacterium avium subsp. paratuberculosis
gaccaggugggcggccacc

SEQ ID NO: 837031 - RNA, 19 nt, Mycobacterium avium subsp. paratuberculosis
gaccagguccgguucgacc

SEQ ID NO: 837032 - RNA, 21 nt, Mycobacterium avium subsp. paratuberculosis
gaccagguccgguucgaccgg

SEQ ID NO: 837033 - RNA, 22 nt, Mycobacterium avium subsp. paratuberculosis
gaccagguccgguucgaccggc

SEQ ID NO: 837034 - RNA, 14 nt, Mycobacterium avium subsp. paratuberculosis
gaccaggucgccgg

SEQ ID NO: 837035 - RNA, 15 nt, Mycobacterium avium subsp. paratuberculosis
gaccaggucgccggc

SEQ ID NO: 837036 - RNA, 19 nt, Mycobacterium avium subsp. paratuberculosis
gaccaggucgccggcggcc

SEQ ID NO: 837037 - RNA, 18 nt, Mycobacterium avium subsp. paratuberculosis
gaccaggguggucagcgu

SEQ ID NO: 837038 - RNA, 20 nt, Mycobacterium avium subsp. paratuberculosis
gaccaggguggucagcgucu

SEQ ID NO: 837039 - RNA, 23 nt, Mycobacterium avium subsp. paratuberculosis
gaccaggguggucagcgucucgg

SEQ ID NO: 837040 - RNA, 17 nt, Mycobacterium avium subsp. paratuberculosis
gaccaggacgucggccg

SEQ ID NO: 837041 - RNA, 19 nt, Mycobacterium avium subsp. paratuberculosis
gaccaggacgucggccggc

SEQ ID NO: 837042 - RNA, 17 nt, Mycobacterium avium subsp. paratuberculosis
aacgcgcgcgacggcgc

SEQ ID NO: 837043 - RNA, 17 nt, Mycobacterium avium subsp. paratuberculosis
gaccagcccggccgccg

SEQ ID NO: 837044 - RNA, 20 nt, Mycobacterium avium subsp. paratuberculosis
gaccagcccggccgccgagg

SEQ ID NO: 837045 - RNA, 15 nt, Mycobacterium avium subsp. paratuberculosis
aacgcgcccggcggg

SEQ ID NO: 837046 - RNA, 14 nt, Mycobacterium avium subsp. paratuberculosis
aacgcgccgccgag

SEQ ID NO: 837047 - RNA, 14 nt, Mycobacterium avium subsp. paratuberculosis
aacgcgccggcgca

SEQ ID NO: 837048 - RNA, 18 nt, Mycobacterium avium subsp. paratuberculosis
aacgcgccggcggucgac

SEQ ID NO: 837049 - RNA, 21 nt, Mycobacterium avium subsp. paratuberculosis
aacgcgccgggcaacagcgcg

SEQ ID NO: 837050 - RNA, 22 nt, Mycobacterium avium subsp. paratuberculosis
aacgcgccggugaccccgucga

SEQ ID NO: 837051 - RNA, 15 nt, Mycobacterium avium subsp. paratuberculosis
aacgccuuggugccg

SEQ ID NO: 837052 - RNA, 16 nt, Mycobacterium avium subsp. paratuberculosis
aacgcgaacggguagc

SEQ ID NO: 837053 - RNA, 16 nt, Mycobacterium avium subsp. paratuberculosis
aacgcgcacaucacgg

SEQ ID NO: 837054 - RNA, 19 nt, Mycobacterium avium subsp. paratuberculosis
aacgcgacgaagcggucgc

SEQ ID NO: 837055 - RNA, 21 nt, Mycobacterium avium subsp. paratuberculosis
aacgcgacgaucagcagccgg

SEQ ID NO: 837056 - RNA, 19 nt, Mycobacterium avium subsp. paratuberculosis
aacgcgacgguggcggcga

SEQ ID NO: 837057 - RNA, 21 nt, Mycobacterium avium subsp. paratuberculosis
aacgcgacgguggcggcgaug

SEQ ID NO: 837058 - RNA, 21 nt, Mycobacterium avium subsp. paratuberculosis
aacgcgaugugccacuucgac

SEQ ID NO: 837059 - RNA, 15 nt, Mycobacterium avium subsp. paratuberculosis
gaccagugguggccg

SEQ ID NO: 837060 - RNA, 18 nt, Mycobacterium avium subsp. paratuberculosis
gaccaguucgcccuggcc

SEQ ID NO: 837061 - RNA, 19 nt, Mycobacterium avium subsp. paratuberculosis
gaccaguucggccaccgcg

SEQ ID NO: 837062 - RNA, 23 nt, Mycobacterium avium subsp. paratuberculosis
gaccaguucuucgaugacggccg

SEQ ID NO: 837063 - RNA, 15 nt, Mycobacterium avium subsp. paratuberculosis
gaccagugcccggcc

SEQ ID NO: 837064 - RNA, 21 nt, Mycobacterium avium subsp. paratuberculosis
gaccaguagaaguggccgacc

SEQ ID NO: 837065 - RNA, 20 nt, Mycobacterium avium subsp. paratuberculosis
gaccaguaggccagcaucuc

SEQ ID NO: 837066 - RNA, 15 nt, Mycobacterium avium subsp. paratuberculosis
gaccagucggcgucu

SEQ ID NO: 837067 - RNA, 18 nt, Mycobacterium avium subsp. paratuberculosis
gaccagugcaccucgacg

SEQ ID NO: 837068 - RNA, 19 nt, Mycobacterium avium subsp. paratuberculosis
gaccagugcaccucgacga

SEQ ID NO: 837069 - RNA, 13 nt, Mycobacterium avium subsp. paratuberculosis
gaccaucagcccg

SEQ ID NO: 837070 - RNA, 16 nt, Mycobacterium avium subsp. paratuberculosis
gaccaucagccugcgg

SEQ ID NO: 837071 - RNA, 15 nt, Mycobacterium avium subsp. paratuberculosis
gaccaucagcgcccg

SEQ ID NO: 837072 - RNA, 21 nt, Mycobacterium avium subsp. paratuberculosis
gaccaucagcgcccggguggg

SEQ ID NO: 837073 - RNA, 21 nt, Mycobacterium avium subsp. paratuberculosis
gaccauccacucgggccagcc

SEQ ID NO: 837074 - RNA, 21 nt, Mycobacterium avium subsp. paratuberculosis
gaccaucgggucgucggcguc

SEQ ID NO: 837075 - RNA, 17 nt, Mycobacterium avium subsp. paratuberculosis
gacccauucgucggcgg

SEQ ID NO: 837076 - RNA, 18 nt, Mycobacterium avium subsp. paratuberculosis
gacccauucgucggcggu

SEQ ID NO: 837077 - RNA, 14 nt, Mycobacterium avium subsp. paratuberculosis
gaccccacagcgcg

SEQ ID NO: 837078 - RNA, 16 nt, Mycobacterium avium subsp. paratuberculosis
gaccccacagcgcgcc

SEQ ID NO: 837079 - RNA, 19 nt, Mycobacterium avium subsp. paratuberculosis
gaccccacagcgcgcccca

SEQ ID NO: 837080 - RNA, 20 nt, Mycobacterium avium subsp. paratuberculosis
gaccccacaccuucgcgguc

SEQ ID NO: 837081 - RNA, 15 nt, Mycobacterium avium subsp. paratuberculosis
gaccccagcgugacg

SEQ ID NO: 837082 - RNA, 14 nt, Mycobacterium avium subsp. paratuberculosis
gacccccucggggc

SEQ ID NO: 837083 - RNA, 14 nt, Mycobacterium avium subsp. paratuberculosis
gacccccgccgcgu

SEQ ID NO: 837084 - RNA, 22 nt, Mycobacterium avium subsp. paratuberculosis
gacccccgccgcgucggucagc

SEQ ID NO: 837085 - RNA, 16 nt, Mycobacterium avium subsp. paratuberculosis
gaccccgacggcgccg

SEQ ID NO: 837086 - RNA, 19 nt, Mycobacterium avium subsp. paratuberculosis
gaccccgacggcgccgcgg

SEQ ID NO: 837087 - RNA, 13 nt, Mycobacterium avium subsp. paratuberculosis
gaccccgccagca

SEQ ID NO: 837088 - RNA, 16 nt, Mycobacterium avium subsp. paratuberculosis
gaccccgccagcaccg

SEQ ID NO: 837089 - RNA, 20 nt, Mycobacterium avium subsp. paratuberculosis
gaccccgccagcaccgacag

SEQ ID NO: 837090 - RNA, 15 nt, Mycobacterium avium subsp. paratuberculosis
gaccccgcccagcga

SEQ ID NO: 837091 - RNA, 15 nt, Mycobacterium avium subsp. paratuberculosis
gaccccgcucggcgu

SEQ ID NO: 837092 - RNA, 19 nt, Mycobacterium avium subsp. paratuberculosis
gaccccgcucggcguggcg

SEQ ID NO: 837093 - RNA, 17 nt, Mycobacterium avium subsp. paratuberculosis
gaccccggccccggccg

SEQ ID NO: 837094 - RNA, 18 nt, Mycobacterium avium subsp. paratuberculosis
gaccccggccccggccgg

SEQ ID NO: 837095 - RNA, 19 nt, Mycobacterium avium subsp. paratuberculosis
gaccccggccccggccggc

SEQ ID NO: 837096 - RNA, 18 nt, Mycobacterium avium subsp. paratuberculosis
gaccccggcgaccagcag

SEQ ID NO: 837097 - RNA, 18 nt, Mycobacterium avium subsp. paratuberculosis
gaccccggcggcaccgcc

SEQ ID NO: 837098 - RNA, 18 nt, Mycobacterium avium subsp. paratuberculosis
gaccuugucgggccgcgg

SEQ ID NO: 837099 - RNA, 16 nt, Mycobacterium avium subsp. paratuberculosis
gaccuuuugcccggcg

SEQ ID NO: 837100 - RNA, 15 nt, Mycobacterium avium subsp. paratuberculosis
gacgaaaaugcccag

SEQ ID NO: 837101 - RNA, 16 nt, Mycobacterium avium subsp. paratuberculosis
gacgaaacccggcgga

SEQ ID NO: 837102 - RNA, 13 nt, Mycobacterium avium subsp. paratuberculosis
gacgaaaccgcca

SEQ ID NO: 837103 - RNA, 14 nt, Mycobacterium avium subsp. paratuberculosis
gaccugggugcgcc

SEQ ID NO: 837104 - RNA, 14 nt, Mycobacterium avium subsp. paratuberculosis
gaccuuguccggcg

SEQ ID NO: 837105 - RNA, 14 nt, Mycobacterium avium subsp. paratuberculosis
gaccuggcgggcca

SEQ ID NO: 837106 - RNA, 16 nt, Mycobacterium avium subsp. paratuberculosis
gaccugggcggccacc

SEQ ID NO: 837107 - RNA, 15 nt, Mycobacterium avium subsp. paratuberculosis
gaccuggacgccgca

SEQ ID NO: 837108 - RNA, 18 nt, Mycobacterium avium subsp. paratuberculosis
gaccuggacgccgcacgc

SEQ ID NO: 837109 - RNA, 22 nt, Mycobacterium avium subsp. paratuberculosis
gaccugcugggcgggcagccgc

SEQ ID NO: 837110 - RNA, 23 nt, Mycobacterium avium subsp. paratuberculosis
gaccugcugggcgggcagccgcu

SEQ ID NO: 837111 - RNA, 19 nt, Mycobacterium avium subsp. paratuberculosis
gaccuggaugcgccgugcc

SEQ ID NO: 837112 - RNA, 16 nt, Mycobacterium avium subsp. paratuberculosis
gaccugcuugagcccg

SEQ ID NO: 837113 - RNA, 21 nt, Mycobacterium avium subsp. paratuberculosis
gaccugcuugagcccgucgac

SEQ ID NO: 837114 - RNA, 23 nt, Mycobacterium avium subsp. paratuberculosis
gaccugcuugagcccgucgacgu

SEQ ID NO: 837115 - RNA, 16 nt, Mycobacterium avium subsp. paratuberculosis
gaccugcuuggcggcc

SEQ ID NO: 837116 - RNA, 17 nt, Mycobacterium avium subsp. paratuberculosis
gaccugcuuggcggccu

SEQ ID NO: 837117 - RNA, 18 nt, Mycobacterium avium subsp. paratuberculosis
gaccugcuuggcggccug

SEQ ID NO: 837118 - RNA, 14 nt, Mycobacterium avium subsp. paratuberculosis
gaccuggccggccu

SEQ ID NO: 837119 - RNA, 14 nt, Mycobacterium avium subsp. paratuberculosis
gacgaacagcaccg

SEQ ID NO: 837120 - RNA, 17 nt, Mycobacterium avium subsp. paratuberculosis
gacgaacagcaccgcca

SEQ ID NO: 837121 - RNA, 18 nt, Mycobacterium avium subsp. paratuberculosis
gacgaacagcaccgccac

SEQ ID NO: 837122 - RNA, 16 nt, Mycobacterium avium subsp. paratuberculosis
gacgaacaucgacgac

SEQ ID NO: 837123 - RNA, 17 nt, Mycobacterium avium subsp. paratuberculosis
gacgaacaugcugccgc

SEQ ID NO: 837124 - RNA, 19 nt, Mycobacterium avium subsp. paratuberculosis
gacgaacaugcugccgccg

SEQ ID NO: 837125 - RNA, 21 nt, Mycobacterium avium subsp. paratuberculosis
gacgaacaugcugccgccggc

SEQ ID NO: 837126 - RNA, 22 nt, Mycobacterium avium subsp. paratuberculosis
gacgaacaugcugccgccggcg

SEQ ID NO: 837127 - RNA, 23 nt, Mycobacterium avium subsp. paratuberculosis
gacgaacaugcugccgccggcga

SEQ ID NO: 837128 - RNA, 17 nt, Mycobacterium avium subsp. paratuberculosis
gacgaacaccaccggca

SEQ ID NO: 837129 - RNA, 18 nt, Mycobacterium avium subsp. paratuberculosis
gacgaacaccaccggcaa

SEQ ID NO: 837130 - RNA, 17 nt, Mycobacterium avium subsp. paratuberculosis
gacgaaccgccacacgu

SEQ ID NO: 837131 - RNA, 20 nt, Mycobacterium avium subsp. paratuberculosis
gacgaaccgugcacgaucgc

SEQ ID NO: 837132 - RNA, 17 nt, Mycobacterium avium subsp. paratuberculosis
gacgaacgccaccacgg

SEQ ID NO: 837133 - RNA, 23 nt, Mycobacterium avium subsp. paratuberculosis
gacgaacgccggcaucagcgaga

SEQ ID NO: 837134 - RNA, 17 nt, Mycobacterium avium subsp. paratuberculosis
gacgaacgcgccgccca

SEQ ID NO: 837135 - RNA, 18 nt, Mycobacterium avium subsp. paratuberculosis
gacgaacgcgccgcccac

SEQ ID NO: 837136 - RNA, 14 nt, Mycobacterium avium subsp. paratuberculosis
gacgaacgcggccg

SEQ ID NO: 837137 - RNA, 15 nt, Mycobacterium avium subsp. paratuberculosis
gacgaacgcggccgc

SEQ ID NO: 837138 - RNA, 14 nt, Mycobacterium avium subsp. paratuberculosis
gacgaacgcggcga

SEQ ID NO: 837139 - RNA, 16 nt, Mycobacterium avium subsp. paratuberculosis
gacgaacgcggcggag

SEQ ID NO: 837140 - RNA, 22 nt, Mycobacterium avium subsp. paratuberculosis
gacgaacgcggcggaggccugc

SEQ ID NO: 837141 - RNA, 12 nt, Mycobacterium avium subsp. paratuberculosis
gacgaacgcggu

SEQ ID NO: 837142 - RNA, 13 nt, Mycobacterium avium subsp. paratuberculosis
gacgaacgcggug

SEQ ID NO: 837143 - RNA, 16 nt, Mycobacterium avium subsp. paratuberculosis
gacgaacgcggugagc

SEQ ID NO: 837144 - RNA, 17 nt, Mycobacterium avium subsp. paratuberculosis
gacgaacgcggugagcg

SEQ ID NO: 837145 - RNA, 23 nt, Mycobacterium avium subsp. paratuberculosis
gacgaacgcuuccagcaccaccc

SEQ ID NO: 837146 - RNA, 16 nt, Mycobacterium avium subsp. paratuberculosis
gacgaacggguaggug

SEQ ID NO: 837147 - RNA, 16 nt, Mycobacterium avium subsp. paratuberculosis
gacgaacuccgcgcgc

SEQ ID NO: 837148 - RNA, 22 nt, Mycobacterium avium subsp. paratuberculosis
gacgaacuccugcucgcgggcc

SEQ ID NO: 837149 - RNA, 23 nt, Mycobacterium avium subsp. paratuberculosis
gacgaacuccugcucgcgggcca

SEQ ID NO: 837150 - RNA, 14 nt, Mycobacterium avium subsp. paratuberculosis
gaccugaucuucga

SEQ ID NO: 837151 - RNA, 15 nt, Mycobacterium avium subsp. paratuberculosis
gaccucgucgacggc

SEQ ID NO: 837152 - RNA, 19 nt, Mycobacterium avium subsp. paratuberculosis
gaccucuucgcuggacagc

SEQ ID NO: 837153 - RNA, 16 nt, Mycobacterium avium subsp. paratuberculosis
gaccucggcggccagc

SEQ ID NO: 837154 - RNA, 17 nt, Mycobacterium avium subsp. paratuberculosis
gaccucggcggccagcg

SEQ ID NO: 837155 - RNA, 18 nt, Mycobacterium avium subsp. paratuberculosis
gaccucggcggccagcgc

SEQ ID NO: 837156 - RNA, 19 nt, Mycobacterium avium subsp. paratuberculosis
gaccucggcggccagcgcg

SEQ ID NO: 837157 - RNA, 23 nt, Mycobacterium avium subsp. paratuberculosis
gaccucggccaccaccucgcggg

SEQ ID NO: 837158 - RNA, 16 nt, Mycobacterium avium subsp. paratuberculosis
gaccucggccagcgug

SEQ ID NO: 837159 - RNA, 18 nt, Mycobacterium avium subsp. paratuberculosis
gaccucggcgaccagcga

SEQ ID NO: 837160 - RNA, 23 nt, Mycobacterium avium subsp. paratuberculosis
gaccucggcgaccagcgacggca

SEQ ID NO: 837161 - RNA, 16 nt, Mycobacterium avium subsp. paratuberculosis
gaccucggggaugucg

SEQ ID NO: 837162 - RNA, 23 nt, Mycobacterium avium subsp. paratuberculosis
gaccucggguguaggcccgauca

SEQ ID NO: 837163 - RNA, 13 nt, Mycobacterium avium subsp. paratuberculosis
gaccucggugaug

SEQ ID NO: 837164 - RNA, 19 nt, Mycobacterium avium subsp. paratuberculosis
gaccucggugucgaggucg

SEQ ID NO: 837165 - RNA, 15 nt, Mycobacterium avium subsp. paratuberculosis
gaccucgucggcggc

SEQ ID NO: 837166 - RNA, 16 nt, Mycobacterium avium subsp. paratuberculosis
gaccucgucggcggcg

SEQ ID NO: 837167 - RNA, 18 nt, Mycobacterium avium subsp. paratuberculosis
gaccucgucggcggugcc

SEQ ID NO: 837168 - RNA, 17 nt, Mycobacterium avium subsp. paratuberculosis
gaccucgucgggcgcca

SEQ ID NO: 837169 - RNA, 19 nt, Mycobacterium avium subsp. paratuberculosis
gaccucgucgggcgccagc

SEQ ID NO: 837170 - RNA, 22 nt, Mycobacterium avium subsp. paratuberculosis
gaccucgucgggcgccagcccg

SEQ ID NO: 837171 - RNA, 16 nt, Mycobacterium avium subsp. paratuberculosis
gaccucgcgcaccggc

SEQ ID NO: 837172 - RNA, 13 nt, Mycobacterium avium subsp. paratuberculosis
gaccucgcgcagc

SEQ ID NO: 837173 - RNA, 23 nt, Mycobacterium avium subsp. paratuberculosis
gaccucgcgcagcccccggacca

SEQ ID NO: 837174 - RNA, 14 nt, Mycobacterium avium subsp. paratuberculosis
gaccucgcgcccgg

SEQ ID NO: 837175 - RNA, 15 nt, Mycobacterium avium subsp. paratuberculosis
gaccucgcgcccggc

SEQ ID NO: 837176 - RNA, 16 nt, Mycobacterium avium subsp. paratuberculosis
gaccucgcgcccggcg

SEQ ID NO: 837177 - RNA, 14 nt, Mycobacterium avium subsp. paratuberculosis
gaccucgcgccgcg

SEQ ID NO: 837178 - RNA, 19 nt, Mycobacterium avium subsp. paratuberculosis
gaccucgcgccgcgaucuc

SEQ ID NO: 837179 - RNA, 15 nt, Mycobacterium avium subsp. paratuberculosis
gaccucgcgcgucac

SEQ ID NO: 837180 - RNA, 18 nt, Mycobacterium avium subsp. paratuberculosis
gaccucgcgcgucacgcu

SEQ ID NO: 837181 - RNA, 16 nt, Mycobacterium avium subsp. paratuberculosis
gaccucgcccgccgcg

SEQ ID NO: 837182 - RNA, 17 nt, Mycobacterium avium subsp. paratuberculosis
gaccucgcccgccgcga

SEQ ID NO: 837183 - RNA, 13 nt, Mycobacterium avium subsp. paratuberculosis
gaccucgccgacg

SEQ ID NO: 837184 - RNA, 16 nt, Mycobacterium avium subsp. paratuberculosis
gaccucgccgagcagc

SEQ ID NO: 837185 - RNA, 22 nt, Mycobacterium avium subsp. paratuberculosis
gaccucgccgagcagccggucc

SEQ ID NO: 837186 - RNA, 21 nt, Mycobacterium avium subsp. paratuberculosis
gaccucgauggcgacgcacga

SEQ ID NO: 837187 - RNA, 15 nt, Mycobacterium avium subsp. paratuberculosis
gaccucgcgcaccgg

SEQ ID NO: 837188 - RNA, 15 nt, Mycobacterium avium subsp. paratuberculosis
gaccucgagcagcgc

SEQ ID NO: 837189 - RNA, 17 nt, Mycobacterium avium subsp. paratuberculosis
gaccucgagcagcgcgc

SEQ ID NO: 837190 - RNA, 19 nt, Mycobacterium avium subsp. paratuberculosis
gaccucgagcagcgcgcgc

SEQ ID NO: 837191 - RNA, 18 nt, Mycobacterium avium subsp. paratuberculosis
gaccucgacggugcugcc

SEQ ID NO: 837192 - RNA, 15 nt, Mycobacterium avium subsp. paratuberculosis
gaccucgagcgucac

SEQ ID NO: 837193 - RNA, 18 nt, Mycobacterium avium subsp. paratuberculosis
gaccucgagcgucacgcu

SEQ ID NO: 837194 - RNA, 14 nt, Mycobacterium avium subsp. paratuberculosis
gaccucgaggccga

SEQ ID NO: 837195 - RNA, 19 nt, Mycobacterium avium subsp. paratuberculosis
gaccucgaggccgaggucg

SEQ ID NO: 837196 - RNA, 14 nt, Mycobacterium avium subsp. paratuberculosis
gaccuccgugccga

SEQ ID NO: 837197 - RNA, 23 nt, Mycobacterium avium subsp. paratuberculosis
gaccuccgugccgauggccaccg

SEQ ID NO: 837198 - RNA, 17 nt, Mycobacterium avium subsp. paratuberculosis
gaccuccucgaccccga

SEQ ID NO: 837199 - RNA, 21 nt, Mycobacterium avium subsp. paratuberculosis
gaccuccucgaccccgaaggc

SEQ ID NO: 837200 - RNA, 23 nt, Mycobacterium avium subsp. paratuberculosis
gaccuccugcuggcguucgccga

SEQ ID NO: 837201 - RNA, 23 nt, Mycobacterium avium subsp. paratuberculosis
gaccucgaagauggucgcgccgc

SEQ ID NO: 837202 - RNA, 16 nt, Mycobacterium avium subsp. paratuberculosis
gaccucccccgacgcc

SEQ ID NO: 837203 - RNA, 19 nt, Mycobacterium avium subsp. paratuberculosis
gaccucgacacgggccgcg

SEQ ID NO: 837204 - RNA, 21 nt, Mycobacterium avium subsp. paratuberculosis
gaccucgacacgggccgcgcc

SEQ ID NO: 837205 - RNA, 16 nt, Mycobacterium avium subsp. paratuberculosis
gaccucgaccagccgg

SEQ ID NO: 837206 - RNA, 14 nt, Mycobacterium avium subsp. paratuberculosis
aacggucagccgcg

SEQ ID NO: 837207 - RNA, 19 nt, Mycobacterium avium subsp. paratuberculosis
aacggguucggucucggcg

SEQ ID NO: 837208 - RNA, 23 nt, Mycobacterium avium subsp. paratuberculosis
aacggguucggucucggcggcgc

SEQ ID NO: 837209 - RNA, 22 nt, Mycobacterium avium subsp. paratuberculosis
aacgggucgagggucgccaggc

SEQ ID NO: 837210 - RNA, 19 nt, Mycobacterium avium subsp. paratuberculosis
aacgggugcggcgcucggu

SEQ ID NO: 837211 - RNA, 18 nt, Mycobacterium avium subsp. paratuberculosis
aacggguccuugccggcg

SEQ ID NO: 837212 - RNA, 18 nt, Mycobacterium avium subsp. paratuberculosis
aacgguacgugcgccggc

SEQ ID NO: 837213 - RNA, 12 nt, Mycobacterium avium subsp. paratuberculosis
aacgggccggcg

SEQ ID NO: 837214 - RNA, 12 nt, Mycobacterium avium subsp. paratuberculosis
aacgggccgggc

SEQ ID NO: 837215 - RNA, 13 nt, Mycobacterium avium subsp. paratuberculosis
aacgggccgggca

SEQ ID NO: 837216 - RNA, 18 nt, Mycobacterium avium subsp. paratuberculosis
aacgggccgggcaccgcg

SEQ ID NO: 837217 - RNA, 18 nt, Mycobacterium avium subsp. paratuberculosis
aacggcuugcgcucggcc

SEQ ID NO: 837218 - RNA, 17 nt, Mycobacterium avium subsp. paratuberculosis
gaccguggugucggaga

SEQ ID NO: 837219 - RNA, 20 nt, Mycobacterium avium subsp. paratuberculosis
gaccguggugucggagaucg

SEQ ID NO: 837220 - RNA, 16 nt, Mycobacterium avium subsp. paratuberculosis
gaccgugugccagccc

SEQ ID NO: 837221 - RNA, 17 nt, Mycobacterium avium subsp. paratuberculosis
gaccgugugccagcccg

SEQ ID NO: 837222 - RNA, 13 nt, Mycobacterium avium subsp. paratuberculosis
gaccuccacccgc

SEQ ID NO: 837223 - RNA, 20 nt, Mycobacterium avium subsp. paratuberculosis
gaccuccacccgcuccucgc

SEQ ID NO: 837224 - RNA, 20 nt, Mycobacterium avium subsp. paratuberculosis
gaccuccacgagccggucgg

SEQ ID NO: 837225 - RNA, 14 nt, Mycobacterium avium subsp. paratuberculosis
gaccucccggcgcc

SEQ ID NO: 837226 - RNA, 17 nt, Mycobacterium avium subsp. paratuberculosis
gaccucccggcgccacg

SEQ ID NO: 837227 - RNA, 22 nt, Mycobacterium avium subsp. paratuberculosis
gaccucaccccgcuugcgcagc

SEQ ID NO: 837228 - RNA, 16 nt, Mycobacterium avium subsp. paratuberculosis
gaccucacggucggcg

SEQ ID NO: 837229 - RNA, 17 nt, Mycobacterium avium subsp. paratuberculosis
gaccgugaggcccggcg

SEQ ID NO: 837230 - RNA, 21 nt, Mycobacterium avium subsp. paratuberculosis
gaccgucggugcggggcgggu

SEQ ID NO: 837231 - RNA, 19 nt, Mycobacterium avium subsp. paratuberculosis
gaccguggaggacgaggcc

SEQ ID NO: 837232 - RNA, 24 nt, Mycobacterium avium subsp. paratuberculosis
gaccguggaggcguagugcgccca

SEQ ID NO: 837233 - RNA, 18 nt, Mycobacterium avium subsp. paratuberculosis
gaccgugcccaccagccg

SEQ ID NO: 837234 - RNA, 21 nt, Mycobacterium avium subsp. paratuberculosis
gaccgugcccaccagccggcc

SEQ ID NO: 837235 - RNA, 22 nt, Mycobacterium avium subsp. paratuberculosis
gaccgugcccaccagccggccg

SEQ ID NO: 837236 - RNA, 22 nt, Mycobacterium avium subsp. paratuberculosis
aacggcucccaggcccaucgcg

SEQ ID NO: 837237 - RNA, 13 nt, Mycobacterium avium subsp. paratuberculosis
aacggcucgccgc

SEQ ID NO: 837238 - RNA, 12 nt, Mycobacterium avium subsp. paratuberculosis
aacggcgucgac

SEQ ID NO: 837239 - RNA, 16 nt, Mycobacterium avium subsp. paratuberculosis
aacggcgucuggccgg

SEQ ID NO: 837240 - RNA, 15 nt, Mycobacterium avium subsp. paratuberculosis
gaccgguugcccgga

SEQ ID NO: 837241 - RNA, 21 nt, Mycobacterium avium subsp. paratuberculosis
gaccgguugcccggaagccgc

SEQ ID NO: 837242 - RNA, 17 nt, Mycobacterium avium subsp. paratuberculosis
gaccguacucgugggcc

SEQ ID NO: 837243 - RNA, 18 nt, Mycobacterium avium subsp. paratuberculosis
gaccguacucgugggcca

SEQ ID NO: 837244 - RNA, 21 nt, Mycobacterium avium subsp. paratuberculosis
gaccguacucgugggccacca

SEQ ID NO: 837245 - RNA, 20 nt, Mycobacterium avium subsp. paratuberculosis
gaccgucacgcuggcgugac

SEQ ID NO: 837246 - RNA, 21 nt, Mycobacterium avium subsp. paratuberculosis
gaccgucacgcuggcgugaca

SEQ ID NO: 837247 - RNA, 20 nt, Mycobacterium avium subsp. paratuberculosis
gaccgucagcagggccucgc

SEQ ID NO: 837248 - RNA, 20 nt, Mycobacterium avium subsp. paratuberculosis
gaccguccgguucggcggca

SEQ ID NO: 837249 - RNA, 19 nt, Mycobacterium avium subsp. paratuberculosis
gaccgucgccgaccagccg

SEQ ID NO: 837250 - RNA, 20 nt, Mycobacterium avium subsp. paratuberculosis
gaccgucgccgaccagccga

SEQ ID NO: 837251 - RNA, 21 nt, Mycobacterium avium subsp. paratuberculosis
gaccgucgccgaccagccgag

SEQ ID NO: 837252 - RNA, 13 nt, Mycobacterium avium subsp. paratuberculosis
gaccgucgcgcag

SEQ ID NO: 837253 - RNA, 17 nt, Mycobacterium avium subsp. paratuberculosis
gaccgcagcaggcggac

SEQ ID NO: 837254 - RNA, 18 nt, Mycobacterium avium subsp. paratuberculosis
gaccgcagcaggcggacg

SEQ ID NO: 837255 - RNA, 22 nt, Mycobacterium avium subsp. paratuberculosis
gaccgcagcaggcggacggcga

SEQ ID NO: 837256 - RNA, 23 nt, Mycobacterium avium subsp. paratuberculosis
gaccgcagcaggcggacggcgac

SEQ ID NO: 837257 - RNA, 20 nt, Mycobacterium avium subsp. paratuberculosis
gaccgcagccuucuucgccg

SEQ ID NO: 837258 - RNA, 23 nt, Mycobacterium avium subsp. paratuberculosis
gaccgcagccuucuucgccgggg

SEQ ID NO: 837259 - RNA, 20 nt, Mycobacterium avium subsp. paratuberculosis
gaccgcacaauccggucagc

SEQ ID NO: 837260 - RNA, 19 nt, Mycobacterium avium subsp. paratuberculosis
gaccgcacccccagcucga

SEQ ID NO: 837261 - RNA, 22 nt, Mycobacterium avium subsp. paratuberculosis
gaccgcacccccagcucgacga

SEQ ID NO: 837262 - RNA, 23 nt, Mycobacterium avium subsp. paratuberculosis
gaccgagaugaagacccggccgu

SEQ ID NO: 837263 - RNA, 15 nt, Mycobacterium avium subsp. paratuberculosis
gaccgagcagcgggg

SEQ ID NO: 837264 - RNA, 17 nt, Mycobacterium avium subsp. paratuberculosis
gaccgagcagcggggug

SEQ ID NO: 837265 - RNA, 14 nt, Mycobacterium avium subsp. paratuberculosis
gaccgauggcggcg

SEQ ID NO: 837266 - RNA, 19 nt, Mycobacterium avium subsp. paratuberculosis
gaccgauggcggcggcccg

SEQ ID NO: 837267 - RNA, 15 nt, Mycobacterium avium subsp. paratuberculosis
gaccgacggcgacca

SEQ ID NO: 837268 - RNA, 16 nt, Mycobacterium avium subsp. paratuberculosis
gaccgacgccuccaca

SEQ ID NO: 837269 - RNA, 16 nt, Mycobacterium avium subsp. paratuberculosis
gaccgacgcggucacc

SEQ ID NO: 837270 - RNA, 16 nt, Mycobacterium avium subsp. paratuberculosis
gaccgacgacgugacg

SEQ ID NO: 837271 - RNA, 15 nt, Mycobacterium avium subsp. paratuberculosis
gaccgacgcccggcu

SEQ ID NO: 837272 - RNA, 16 nt, Mycobacterium avium subsp. paratuberculosis
gaccgcaggucgaugg

SEQ ID NO: 837273 - RNA, 22 nt, Mycobacterium avium subsp. paratuberculosis
gaccgcaggucgauggcguagc

SEQ ID NO: 837274 - RNA, 15 nt, Mycobacterium avium subsp. paratuberculosis
gaccgccaccucgag

SEQ ID NO: 837275 - RNA, 13 nt, Mycobacterium avium subsp. paratuberculosis
gaccgccagcacc

SEQ ID NO: 837276 - RNA, 14 nt, Mycobacterium avium subsp. paratuberculosis
gaccgccagcaccg

SEQ ID NO: 837277 - RNA, 16 nt, Mycobacterium avium subsp. paratuberculosis
gaccgccagcaccgcg

SEQ ID NO: 837278 - RNA, 13 nt, Mycobacterium avium subsp. paratuberculosis
gaccgccagcagc

SEQ ID NO: 837279 - RNA, 16 nt, Mycobacterium avium subsp. paratuberculosis
gaccgccagcagcagc

SEQ ID NO: 837280 - RNA, 23 nt, Mycobacterium avium subsp. paratuberculosis
gaccgccagcagcagccgcgccg

SEQ ID NO: 837281 - RNA, 20 nt, Mycobacterium avium subsp. paratuberculosis
gaccgacaguucggcgcgca

SEQ ID NO: 837282 - RNA, 22 nt, Mycobacterium avium subsp. paratuberculosis
gacccuuccggaacgacgcguc

SEQ ID NO: 837283 - RNA, 15 nt, Mycobacterium avium subsp. paratuberculosis
gacccuucgaacgcg

SEQ ID NO: 837284 - RNA, 15 nt, Mycobacterium avium subsp. paratuberculosis
gaccgaacccgggcg

SEQ ID NO: 837285 - RNA, 21 nt, Mycobacterium avium subsp. paratuberculosis
gacccguccagcagcaugucg

SEQ ID NO: 837286 - RNA, 15 nt, Mycobacterium avium subsp. paratuberculosis
gacccguccagcgug

SEQ ID NO: 837287 - RNA, 18 nt, Mycobacterium avium subsp. paratuberculosis
aacgcuggucgaacgcca

SEQ ID NO: 837288 - RNA, 14 nt, Mycobacterium avium subsp. paratuberculosis
aacgcugggcgccg

SEQ ID NO: 837289 - RNA, 17 nt, Mycobacterium avium subsp. paratuberculosis
aacgcugaccgcaggaa

SEQ ID NO: 837290 - RNA, 13 nt, Mycobacterium avium subsp. paratuberculosis
gacccgcaacucg

SEQ ID NO: 837291 - RNA, 17 nt, Mycobacterium avium subsp. paratuberculosis
gacccgaagucgacgca

SEQ ID NO: 837292 - RNA, 22 nt, Mycobacterium avium subsp. paratuberculosis
gacccgacggucgggcccaggu

SEQ ID NO: 837293 - RNA, 21 nt, Mycobacterium avium subsp. paratuberculosis
gacccgaacuucagcgcgucg

SEQ ID NO: 837294 - RNA, 17 nt, Mycobacterium avium subsp. paratuberculosis
gaccccguucgccgaca

SEQ ID NO: 837295 - RNA, 19 nt, Mycobacterium avium subsp. paratuberculosis
gaccccuccaacggccgca

SEQ ID NO: 837296 - RNA, 22 nt, Mycobacterium avium subsp. paratuberculosis
gaccccuccaacggccgcacgu

SEQ ID NO: 837297 - RNA, 16 nt, Mycobacterium avium subsp. paratuberculosis
gaccccucggcggccg

SEQ ID NO: 837298 - RNA, 19 nt, Mycobacterium avium subsp. paratuberculosis
gaccccucggcggccgucg

SEQ ID NO: 837299 - RNA, 12 nt, Mycobacterium avium subsp. paratuberculosis
gaccgguccgcc

SEQ ID NO: 837300 - RNA, 16 nt, Mycobacterium avium subsp. paratuberculosis
gaccgguccgccgccg

SEQ ID NO: 837301 - RNA, 14 nt, Mycobacterium avium subsp. paratuberculosis
gaccgguccgcggu

SEQ ID NO: 837302 - RNA, 16 nt, Mycobacterium avium subsp. paratuberculosis
gaccgguccgugccac

SEQ ID NO: 837303 - RNA, 21 nt, Mycobacterium avium subsp. paratuberculosis
gaccgguccgugccacggccg

SEQ ID NO: 837304 - RNA, 15 nt, Mycobacterium avium subsp. paratuberculosis
gaccggucucgaccg

SEQ ID NO: 837305 - RNA, 18 nt, Mycobacterium avium subsp. paratuberculosis
gaccggucucgaccgcgg

SEQ ID NO: 837306 - RNA, 12 nt, Mycobacterium avium subsp. paratuberculosis
gaccggugcgcc

SEQ ID NO: 837307 - RNA, 17 nt, Mycobacterium avium subsp. paratuberculosis
gaccggugcgcccgcga

SEQ ID NO: 837308 - RNA, 22 nt, Mycobacterium avium subsp. paratuberculosis
gaccggugcgcgcaccaggccg

SEQ ID NO: 837309 - RNA, 16 nt, Mycobacterium avium subsp. paratuberculosis
gaccggugcggucccg

SEQ ID NO: 837310 - RNA, 18 nt, Mycobacterium avium subsp. paratuberculosis
gaccgggugaccggcgcg

SEQ ID NO: 837311 - RNA, 19 nt, Mycobacterium avium subsp. paratuberculosis
gaccgguaggcgcaccgcc

SEQ ID NO: 837312 - RNA, 20 nt, Mycobacterium avium subsp. paratuberculosis
gaccgguaggcgcaccgccg

SEQ ID NO: 837313 - RNA, 17 nt, Mycobacterium avium subsp. paratuberculosis
gaccgggucguagccga

SEQ ID NO: 837314 - RNA, 21 nt, Mycobacterium avium subsp. paratuberculosis
gaccggggucggcgcccucgg

SEQ ID NO: 837315 - RNA, 20 nt, Mycobacterium avium subsp. paratuberculosis
gaccgggcuccagcgggucc

SEQ ID NO: 837316 - RNA, 18 nt, Mycobacterium avium subsp. paratuberculosis
gaccggggcgccccgcug

SEQ ID NO: 837317 - RNA, 14 nt, Mycobacterium avium subsp. paratuberculosis
gaccgggcgcuccg

SEQ ID NO: 837318 - RNA, 13 nt, Mycobacterium avium subsp. paratuberculosis
gaccggcucgagc

SEQ ID NO: 837319 - RNA, 16 nt, Mycobacterium avium subsp. paratuberculosis
gaccgggcccggcgcc

SEQ ID NO: 837320 - RNA, 14 nt, Mycobacterium avium subsp. paratuberculosis
gaccgggcgggcug

SEQ ID NO: 837321 - RNA, 23 nt, Mycobacterium avium subsp. paratuberculosis
gaccgggcgggcugcgggcaucg

SEQ ID NO: 837322 - RNA, 21 nt, Mycobacterium avium subsp. paratuberculosis
gaccgggaucguguggccgcc

SEQ ID NO: 837323 - RNA, 14 nt, Mycobacterium avium subsp. paratuberculosis
gaccgggcccggcg

SEQ ID NO: 837324 - RNA, 14 nt, Mycobacterium avium subsp. paratuberculosis
gaccgggacgacgg

SEQ ID NO: 837325 - RNA, 15 nt, Mycobacterium avium subsp. paratuberculosis
gaccgggacgacggc

SEQ ID NO: 837326 - RNA, 14 nt, Mycobacterium avium subsp. paratuberculosis
gaccggcugcucgc

SEQ ID NO: 837327 - RNA, 21 nt, Mycobacterium avium subsp. paratuberculosis
aacggccgcgcagaucgccag

SEQ ID NO: 837328 - RNA, 20 nt, Mycobacterium avium subsp. paratuberculosis
aacggccggcgccgccgggg

SEQ ID NO: 837329 - RNA, 21 nt, Mycobacterium avium subsp. paratuberculosis
aacggccggcgccgccggggc

SEQ ID NO: 837330 - RNA, 17 nt, Mycobacterium avium subsp. paratuberculosis
gaccggccugcagcgcg

SEQ ID NO: 837331 - RNA, 18 nt, Mycobacterium avium subsp. paratuberculosis
gaccggccaucuccugca

SEQ ID NO: 837332 - RNA, 22 nt, Mycobacterium avium subsp. paratuberculosis
aacggcgccaucguggccgcgu

SEQ ID NO: 837333 - RNA, 13 nt, Mycobacterium avium subsp. paratuberculosis
gaccggcucgccg

SEQ ID NO: 837334 - RNA, 15 nt, Mycobacterium avium subsp. paratuberculosis
gaccggcucgccggc

SEQ ID NO: 837335 - RNA, 14 nt, Mycobacterium avium subsp. paratuberculosis
gaccggcucgccgu

SEQ ID NO: 837336 - RNA, 15 nt, Mycobacterium avium subsp. paratuberculosis
gaccggcucagcccg

SEQ ID NO: 837337 - RNA, 18 nt, Mycobacterium avium subsp. paratuberculosis
gaccggcucagcccggcg

SEQ ID NO: 837338 - RNA, 19 nt, Mycobacterium avium subsp. paratuberculosis
gaccggcucagcccggcgc

SEQ ID NO: 837339 - RNA, 22 nt, Mycobacterium avium subsp. paratuberculosis
gaccggcucagcccggcgcuca

SEQ ID NO: 837340 - RNA, 19 nt, Mycobacterium avium subsp. paratuberculosis
gaccggcggcgaucggcgc

SEQ ID NO: 837341 - RNA, 20 nt, Mycobacterium avium subsp. paratuberculosis
gaccggaagccuguuggcca

SEQ ID NO: 837342 - RNA, 17 nt, Mycobacterium avium subsp. paratuberculosis
gaccgcuugacgccgcc

SEQ ID NO: 837343 - RNA, 18 nt, Mycobacterium avium subsp. paratuberculosis
gaccgcuugacgccgccg

SEQ ID NO: 837344 - RNA, 14 nt, Mycobacterium avium subsp. paratuberculosis
gaccggaucggcca

SEQ ID NO: 837345 - RNA, 15 nt, Mycobacterium avium subsp. paratuberculosis
gaccggaucggccag

SEQ ID NO: 837346 - RNA, 21 nt, Mycobacterium avium subsp. paratuberculosis
gaccggaucggccagcagguc

SEQ ID NO: 837347 - RNA, 22 nt, Mycobacterium avium subsp. paratuberculosis
gaccggaugaaggacuggccca

SEQ ID NO: 837348 - RNA, 23 nt, Mycobacterium avium subsp. paratuberculosis
gaccggauccaccaauucgcgcu

SEQ ID NO: 837349 - RNA, 14 nt, Mycobacterium avium subsp. paratuberculosis
gaccggcaccagca

SEQ ID NO: 837350 - RNA, 15 nt, Mycobacterium avium subsp. paratuberculosis
gaccggcaccagcag

SEQ ID NO: 837351 - RNA, 12 nt, Mycobacterium avium subsp. paratuberculosis
gaccggccagca

SEQ ID NO: 837352 - RNA, 15 nt, Mycobacterium avium subsp. paratuberculosis
gaccggccagcagcc

SEQ ID NO: 837353 - RNA, 16 nt, Mycobacterium avium subsp. paratuberculosis
gaccggccagcagccg

SEQ ID NO: 837354 - RNA, 18 nt, Mycobacterium avium subsp. paratuberculosis
gaccggccagcagccgcu

SEQ ID NO: 837355 - RNA, 17 nt, Mycobacterium avium subsp. paratuberculosis
gaccggcccggcggccg

SEQ ID NO: 837356 - RNA, 19 nt, Mycobacterium avium subsp. paratuberculosis
gaccggcccggcggccggc

SEQ ID NO: 837357 - RNA, 20 nt, Mycobacterium avium subsp. paratuberculosis
gaccggcccggcggccggcc

SEQ ID NO: 837358 - RNA, 21 nt, Mycobacterium avium subsp. paratuberculosis
gaccggcccggcggccggccg

SEQ ID NO: 837359 - RNA, 23 nt, Mycobacterium avium subsp. paratuberculosis
gaccggcccggcggccggccgcg

SEQ ID NO: 837360 - RNA, 16 nt, Mycobacterium avium subsp. paratuberculosis
gaccggcagcaccggc

SEQ ID NO: 837361 - RNA, 17 nt, Mycobacterium avium subsp. paratuberculosis
gaccggccaccucgucg

SEQ ID NO: 837362 - RNA, 14 nt, Mycobacterium avium subsp. paratuberculosis
gaccgccugcuuga

SEQ ID NO: 837363 - RNA, 17 nt, Mycobacterium avium subsp. paratuberculosis
gaccgccuuggcgcgcu

SEQ ID NO: 837364 - RNA, 20 nt, Mycobacterium avium subsp. paratuberculosis
gaccgccuuggcgcgcucgg

SEQ ID NO: 837365 - RNA, 21 nt, Mycobacterium avium subsp. paratuberculosis
gaccgccuuggcgcgcucggu

SEQ ID NO: 837366 - RNA, 14 nt, Mycobacterium avium subsp. paratuberculosis
gaccgccucgucgg

SEQ ID NO: 837367 - RNA, 15 nt, Mycobacterium avium subsp. paratuberculosis
gaccgccugcggcag

SEQ ID NO: 837368 - RNA, 20 nt, Mycobacterium avium subsp. paratuberculosis
gaccgccucgauggcccgcu

SEQ ID NO: 837369 - RNA, 24 nt, Mycobacterium avium subsp. paratuberculosis
gaccgccucgauggcccgcucggu

SEQ ID NO: 837370 - RNA, 20 nt, Mycobacterium avium subsp. paratuberculosis
gaccgccucggauuccgcgg

SEQ ID NO: 837371 - RNA, 15 nt, Mycobacterium avium subsp. paratuberculosis
gaccgccggugcgca

SEQ ID NO: 837372 - RNA, 16 nt, Mycobacterium avium subsp. paratuberculosis
gaccgccggugcgcag

SEQ ID NO: 837373 - RNA, 17 nt, Mycobacterium avium subsp. paratuberculosis
gaccgccggugcgcagc

SEQ ID NO: 837374 - RNA, 14 nt, Mycobacterium avium subsp. paratuberculosis
gaccgcccgcucga

SEQ ID NO: 837375 - RNA, 12 nt, Mycobacterium avium subsp. paratuberculosis
gaccgccggaca

SEQ ID NO: 837376 - RNA, 21 nt, Mycobacterium avium subsp. paratuberculosis
gaccgccggacaccaccgcgg

SEQ ID NO: 837377 - RNA, 20 nt, Mycobacterium avium subsp. paratuberculosis
gaccgcccgggccaggcgcg

SEQ ID NO: 837378 - RNA, 24 nt, Mycobacterium avium subsp. paratuberculosis
gaccgcccgggccaggcgcgcgua

SEQ ID NO: 837379 - RNA, 15 nt, Mycobacterium avium subsp. paratuberculosis
gaccgccgcggccgc

SEQ ID NO: 837380 - RNA, 16 nt, Mycobacterium avium subsp. paratuberculosis
gaccgccgcggccgcc

SEQ ID NO: 837381 - RNA, 16 nt, Mycobacterium avium subsp. paratuberculosis
gaccgccgcggcgccc

SEQ ID NO: 837382 - RNA, 18 nt, Mycobacterium avium subsp. paratuberculosis
gaccgccgcggcgcccgg

SEQ ID NO: 837383 - RNA, 18 nt, Mycobacterium avium subsp. paratuberculosis
gaccgccgcggcggccug

SEQ ID NO: 837384 - RNA, 23 nt, Mycobacterium avium subsp. paratuberculosis
gaccgccgcguacagccagcccg

SEQ ID NO: 837385 - RNA, 14 nt, Mycobacterium avium subsp. paratuberculosis
gaccgccgcuaggu

SEQ ID NO: 837386 - RNA, 20 nt, Mycobacterium avium subsp. paratuberculosis
gaccgccgcucagcgauugc

SEQ ID NO: 837387 - RNA, 16 nt, Mycobacterium avium subsp. paratuberculosis
gaauacccuucggccg

SEQ ID NO: 837388 - RNA, 13 nt, Mycobacterium avium subsp. paratuberculosis
gaauaggccgcgu

SEQ ID NO: 837389 - RNA, 16 nt, Mycobacterium avium subsp. paratuberculosis
gaauaccaucaacccg

SEQ ID NO: 837390 - RNA, 19 nt, Mycobacterium avium subsp. paratuberculosis
gaauaccaucaacccgagc

SEQ ID NO: 837391 - RNA, 23 nt, Mycobacterium avium subsp. paratuberculosis
gaauaccaucaacccgagcaccg

SEQ ID NO: 837392 - RNA, 15 nt, Mycobacterium avium subsp. paratuberculosis
gaagugccuuucggc

SEQ ID NO: 837393 - RNA, 17 nt, Mycobacterium avium subsp. paratuberculosis
gaagugccuuucggccu

SEQ ID NO: 837394 - RNA, 18 nt, Mycobacterium avium subsp. paratuberculosis
gaagugcacgccgaggcg

SEQ ID NO: 837395 - RNA, 22 nt, Mycobacterium avium subsp. paratuberculosis
gaagugcacgccgaggcgugcc

SEQ ID NO: 837396 - RNA, 17 nt, Mycobacterium avium subsp. paratuberculosis
gaagugcacucggcgau

SEQ ID NO: 837397 - RNA, 18 nt, Mycobacterium avium subsp. paratuberculosis
gaagugcccggcgccgga

SEQ ID NO: 837398 - RNA, 14 nt, Mycobacterium avium subsp. paratuberculosis
gaagugccggcgaa

SEQ ID NO: 837399 - RNA, 20 nt, Mycobacterium avium subsp. paratuberculosis
gaagugccggcgaaccucac

SEQ ID NO: 837400 - RNA, 12 nt, Mycobacterium avium subsp. paratuberculosis
gaagugccggcu

SEQ ID NO: 837401 - RNA, 14 nt, Mycobacterium avium subsp. paratuberculosis
gaagucuucggcca

SEQ ID NO: 837402 - RNA, 16 nt, Mycobacterium avium subsp. paratuberculosis
gaagucuucggccauc

SEQ ID NO: 837403 - RNA, 19 nt, Mycobacterium avium subsp. paratuberculosis
gaagucguucagcugcagc

SEQ ID NO: 837404 - RNA, 22 nt, Mycobacterium avium subsp. paratuberculosis
gaagucggucagcgucgccgcc

SEQ ID NO: 837405 - RNA, 20 nt, Mycobacterium avium subsp. paratuberculosis
gaagucggucugcggagaac

SEQ ID NO: 837406 - RNA, 13 nt, Mycobacterium avium subsp. paratuberculosis
gaaucgucggcga

SEQ ID NO: 837407 - RNA, 15 nt, Mycobacterium avium subsp. paratuberculosis
gaaucgucccgucga

SEQ ID NO: 837408 - RNA, 17 nt, Mycobacterium avium subsp. paratuberculosis
gaaucgucccgucgacc

SEQ ID NO: 837409 - RNA, 15 nt, Mycobacterium avium subsp. paratuberculosis
gaaucgguccggcga

SEQ ID NO: 837410 - RNA, 16 nt, Mycobacterium avium subsp. paratuberculosis
gaaucgguucggccag

SEQ ID NO: 837411 - RNA, 23 nt, Mycobacterium avium subsp. paratuberculosis
gaaucgcggaucgaacagggcgg

SEQ ID NO: 837412 - RNA, 19 nt, Mycobacterium avium subsp. paratuberculosis
gaaucgcggcaggcgaccc

SEQ ID NO: 837413 - RNA, 17 nt, Mycobacterium avium subsp. paratuberculosis
gaauccacacaggacca

SEQ ID NO: 837414 - RNA, 16 nt, Mycobacterium avium subsp. paratuberculosis
gaaugcagcggcuccg

SEQ ID NO: 837415 - RNA, 14 nt, Mycobacterium avium subsp. paratuberculosis
gaaugcccagcggg

SEQ ID NO: 837416 - RNA, 18 nt, Mycobacterium avium subsp. paratuberculosis
gaauggcaaggccagcaa

SEQ ID NO: 837417 - RNA, 15 nt, Mycobacterium avium subsp. paratuberculosis
gaauggcagcagccg

SEQ ID NO: 837418 - RNA, 16 nt, Mycobacterium avium subsp. paratuberculosis
gaaucguugagcacca

SEQ ID NO: 837419 - RNA, 22 nt, Mycobacterium avium subsp. paratuberculosis
gaaucucgugguaccggcgcca

SEQ ID NO: 837420 - RNA, 22 nt, Mycobacterium avium subsp. paratuberculosis
gaagggcuccccggacagccac

SEQ ID NO: 837421 - RNA, 21 nt, Mycobacterium avium subsp. paratuberculosis
gaaggcguuggacuccaccgc

SEQ ID NO: 837422 - RNA, 20 nt, Mycobacterium avium subsp. paratuberculosis
gaaggcguuggagccgacca

SEQ ID NO: 837423 - RNA, 22 nt, Mycobacterium avium subsp. paratuberculosis
gaaggcguuggagccgaccagc

SEQ ID NO: 837424 - RNA, 17 nt, Mycobacterium avium subsp. paratuberculosis
gaaggcuccgccgaugu

SEQ ID NO: 837425 - RNA, 17 nt, Mycobacterium avium subsp. paratuberculosis
gaaggcgugcgacucgg

SEQ ID NO: 837426 - RNA, 13 nt, Mycobacterium avium subsp. paratuberculosis
gaaggcggccgcg

SEQ ID NO: 837427 - RNA, 19 nt, Mycobacterium avium subsp. paratuberculosis
gaaggccaggugcacgccg

SEQ ID NO: 837428 - RNA, 22 nt, Mycobacterium avium subsp. paratuberculosis
gaaggcgaacaccagcccggcc

SEQ ID NO: 837429 - RNA, 13 nt, Mycobacterium avium subsp. paratuberculosis
gaaggcggccacc

SEQ ID NO: 837430 - RNA, 15 nt, Mycobacterium avium subsp. paratuberculosis
gaaggcggccaccgc

SEQ ID NO: 837431 - RNA, 23 nt, Mycobacterium avium subsp. paratuberculosis
gaaggcggccaccgcggccagcu

SEQ ID NO: 837432 - RNA, 14 nt, Mycobacterium avium subsp. paratuberculosis
gaaggcggcgucga

SEQ ID NO: 837433 - RNA, 20 nt, Mycobacterium avium subsp. paratuberculosis
gaaggcgacgucggucggca

SEQ ID NO: 837434 - RNA, 18 nt, Mycobacterium avium subsp. paratuberculosis
gaaggcgcgcagggcgaa

SEQ ID NO: 837435 - RNA, 15 nt, Mycobacterium avium subsp. paratuberculosis
gaaggcgccggcgcg

SEQ ID NO: 837436 - RNA, 13 nt, Mycobacterium avium subsp. paratuberculosis
gaaggcgccgucg

SEQ ID NO: 837437 - RNA, 14 nt, Mycobacterium avium subsp. paratuberculosis
gaaggcgccgucgg

SEQ ID NO: 837438 - RNA, 14 nt, Mycobacterium avium subsp. paratuberculosis
gaaguauucgccgu

SEQ ID NO: 837439 - RNA, 17 nt, Mycobacterium avium subsp. paratuberculosis
gaaguauucgccgucgu

SEQ ID NO: 837440 - RNA, 16 nt, Mycobacterium avium subsp. paratuberculosis
gaagucagcgcgugac

SEQ ID NO: 837441 - RNA, 22 nt, Mycobacterium avium subsp. paratuberculosis
gaagucagcgcgugaccccggc

SEQ ID NO: 837442 - RNA, 20 nt, Mycobacterium avium subsp. paratuberculosis
gaagucaucaccggggauca

SEQ ID NO: 837443 - RNA, 20 nt, Mycobacterium avium subsp. paratuberculosis
gaaguagagccgcugcacgc

SEQ ID NO: 837444 - RNA, 17 nt, Mycobacterium avium subsp. paratuberculosis
gaaguagccggccagcg

SEQ ID NO: 837445 - RNA, 18 nt, Mycobacterium avium subsp. paratuberculosis
gaaguagcgggcguuggc

SEQ ID NO: 837446 - RNA, 23 nt, Mycobacterium avium subsp. paratuberculosis
gaaguaguagcuguuggccagcu

SEQ ID NO: 837447 - RNA, 19 nt, Mycobacterium avium subsp. paratuberculosis
gaagucgauugccgcggcc

SEQ ID NO: 837448 - RNA, 20 nt, Mycobacterium avium subsp. paratuberculosis
gaagucgauugccgcggccg

SEQ ID NO: 837449 - RNA, 20 nt, Mycobacterium avium subsp. paratuberculosis
gaagucgcccgcguugcggc

SEQ ID NO: 837450 - RNA, 15 nt, Mycobacterium avium subsp. paratuberculosis
gaagucgccgacgcc

SEQ ID NO: 837451 - RNA, 23 nt, Mycobacterium avium subsp. paratuberculosis
gaagucgccgcccgggccgcgcc

SEQ ID NO: 837452 - RNA, 19 nt, Mycobacterium avium subsp. paratuberculosis
gaagucgccguccggggcc

SEQ ID NO: 837453 - RNA, 13 nt, Mycobacterium avium subsp. paratuberculosis
gaaguccugcgcc

SEQ ID NO: 837454 - RNA, 15 nt, Mycobacterium avium subsp. paratuberculosis
gaaguccugcgccgc

SEQ ID NO: 837455 - RNA, 14 nt, Mycobacterium avium subsp. paratuberculosis
gaaguccuuguucg

SEQ ID NO: 837456 - RNA, 20 nt, Mycobacterium avium subsp. paratuberculosis
gaaguccuuguucgccgggu

SEQ ID NO: 837457 - RNA, 12 nt, Mycobacterium avium subsp. paratuberculosis
gaagucgaccgc

SEQ ID NO: 837458 - RNA, 15 nt, Mycobacterium avium subsp. paratuberculosis
gaagucgaccgcggc

SEQ ID NO: 837459 - RNA, 14 nt, Mycobacterium avium subsp. paratuberculosis
gaagucgacgcacc

SEQ ID NO: 837460 - RNA, 15 nt, Mycobacterium avium subsp. paratuberculosis
gaaguccggcggucg

SEQ ID NO: 837461 - RNA, 22 nt, Mycobacterium avium subsp. paratuberculosis
gaaguccggcggucgcugcagc

SEQ ID NO: 837462 - RNA, 14 nt, Mycobacterium avium subsp. paratuberculosis
gaaggugcgcacga

SEQ ID NO: 837463 - RNA, 15 nt, Mycobacterium avium subsp. paratuberculosis
gaaggugaucuuguu

SEQ ID NO: 837464 - RNA, 16 nt, Mycobacterium avium subsp. paratuberculosis
gaaggugcccgcaucg

SEQ ID NO: 837465 - RNA, 19 nt, Mycobacterium avium subsp. paratuberculosis
gaaggugcccuccucgccg

SEQ ID NO: 837466 - RNA, 20 nt, Mycobacterium avium subsp. paratuberculosis
gaaggugcccuccucgccgg

SEQ ID NO: 837467 - RNA, 17 nt, Mycobacterium avium subsp. paratuberculosis
gaaggugccgcgaugcc

SEQ ID NO: 837468 - RNA, 21 nt, Mycobacterium avium subsp. paratuberculosis
gaaggucuuucgucgcuuggu

SEQ ID NO: 837469 - RNA, 15 nt, Mycobacterium avium subsp. paratuberculosis
gaaggucgcggacug

SEQ ID NO: 837470 - RNA, 14 nt, Mycobacterium avium subsp. paratuberculosis
gaaggugucggccg

SEQ ID NO: 837471 - RNA, 15 nt, Mycobacterium avium subsp. paratuberculosis
gaagguggcgccggu

SEQ ID NO: 837472 - RNA, 15 nt, Mycobacterium avium subsp. paratuberculosis
gaaggugggcagcgc

SEQ ID NO: 837473 - RNA, 17 nt, Mycobacterium avium subsp. paratuberculosis
gaaggugggcagcgcca

SEQ ID NO: 837474 - RNA, 13 nt, Mycobacterium avium subsp. paratuberculosis
gaaggugguggcg

SEQ ID NO: 837475 - RNA, 22 nt, Mycobacterium avium subsp. paratuberculosis
gaaggugguggcguuggcgauc

SEQ ID NO: 837476 - RNA, 20 nt, Mycobacterium avium subsp. paratuberculosis
gaagguguuggugcgggguu

SEQ ID NO: 837477 - RNA, 17 nt, Mycobacterium avium subsp. paratuberculosis
gaagccgugcacgccgu

SEQ ID NO: 837478 - RNA, 18 nt, Mycobacterium avium subsp. paratuberculosis
gaagccuggcacgacgcc

SEQ ID NO: 837479 - RNA, 22 nt, Mycobacterium avium subsp. paratuberculosis
gaagccgugggugccgacgagc

SEQ ID NO: 837480 - RNA, 23 nt, Mycobacterium avium subsp. paratuberculosis
gaagccgugggugccgacgagcu

SEQ ID NO: 837481 - RNA, 21 nt, Mycobacterium avium subsp. paratuberculosis
gaagccguugaugcgcaccgc

SEQ ID NO: 837482 - RNA, 23 nt, Mycobacterium avium subsp. paratuberculosis
gaagccguugaugcgcaccgcgg

SEQ ID NO: 837483 - RNA, 16 nt, Mycobacterium avium subsp. paratuberculosis
gaagccguugccgccg

SEQ ID NO: 837484 - RNA, 21 nt, Mycobacterium avium subsp. paratuberculosis
gaagccguugccgccgcgcgc

SEQ ID NO: 837485 - RNA, 23 nt, Mycobacterium avium subsp. paratuberculosis
gaagccguugccgccgcgcgcgg

SEQ ID NO: 837486 - RNA, 13 nt, Mycobacterium avium subsp. paratuberculosis
gaagccggugccc

SEQ ID NO: 837487 - RNA, 21 nt, Mycobacterium avium subsp. paratuberculosis
gaagccgucgaccccgccggc

SEQ ID NO: 837488 - RNA, 17 nt, Mycobacterium avium subsp. paratuberculosis
gaagccgucggugcgcu

SEQ ID NO: 837489 - RNA, 20 nt, Mycobacterium avium subsp. paratuberculosis
gaagccgugacccgccguga

SEQ ID NO: 837490 - RNA, 17 nt, Mycobacterium avium subsp. paratuberculosis
gaagcgcaucgccggcg

SEQ ID NO: 837491 - RNA, 18 nt, Mycobacterium avium subsp. paratuberculosis
gaagcgcaucgccggcgc

SEQ ID NO: 837492 - RNA, 13 nt, Mycobacterium avium subsp. paratuberculosis
gaagcgcagcagc

SEQ ID NO: 837493 - RNA, 16 nt, Mycobacterium avium subsp. paratuberculosis
gaagcgcagcagcucg

SEQ ID NO: 837494 - RNA, 22 nt, Mycobacterium avium subsp. paratuberculosis
gaagcgaauccgggugucgacg

SEQ ID NO: 837495 - RNA, 20 nt, Mycobacterium avium subsp. paratuberculosis
gaagcgcgaccccuacgggc

SEQ ID NO: 837496 - RNA, 13 nt, Mycobacterium avium subsp. paratuberculosis
gaagcgcccgcgc

SEQ ID NO: 837497 - RNA, 18 nt, Mycobacterium avium subsp. paratuberculosis
gaagcgcccgcgcgcucg

SEQ ID NO: 837498 - RNA, 19 nt, Mycobacterium avium subsp. paratuberculosis
gaagcgcuuucccugcucg

SEQ ID NO: 837499 - RNA, 14 nt, Mycobacterium avium subsp. paratuberculosis
gaagcggcgcacgc

SEQ ID NO: 837500 - RNA, 22 nt, Mycobacterium avium subsp. paratuberculosis
gaagcggcgcacgcagugccgc

SEQ ID NO: 837501 - RNA, 16 nt, Mycobacterium avium subsp. paratuberculosis
gaagcggcgcgggucg

SEQ ID NO: 837502 - RNA, 14 nt, Mycobacterium avium subsp. paratuberculosis
gaagcgggacagca

SEQ ID NO: 837503 - RNA, 23 nt, Mycobacterium avium subsp. paratuberculosis
gaagcggccggggaguucgcggu

SEQ ID NO: 837504 - RNA, 14 nt, Mycobacterium avium subsp. paratuberculosis
gaagcggcccgaga

SEQ ID NO: 837505 - RNA, 22 nt, Mycobacterium avium subsp. paratuberculosis
gaagcggcccuguucgccgucg

SEQ ID NO: 837506 - RNA, 14 nt, Mycobacterium avium subsp. paratuberculosis
gaagcugucgccga

SEQ ID NO: 837507 - RNA, 16 nt, Mycobacterium avium subsp. paratuberculosis
gaagcugucgccgagg

SEQ ID NO: 837508 - RNA, 15 nt, Mycobacterium avium subsp. paratuberculosis
gaaggaggcggucga

SEQ ID NO: 837509 - RNA, 23 nt, Mycobacterium avium subsp. paratuberculosis
gaaggacgucaggccggucagcg

SEQ ID NO: 837510 - RNA, 23 nt, Mycobacterium avium subsp. paratuberculosis
gaaggccagcuccucggggauga

SEQ ID NO: 837511 - RNA, 12 nt, Mycobacterium avium subsp. paratuberculosis
gaaggcaacucg

SEQ ID NO: 837512 - RNA, 21 nt, Mycobacterium avium subsp. paratuberculosis
gaaggcaugggcgugccggcc

SEQ ID NO: 837513 - RNA, 18 nt, Mycobacterium avium subsp. paratuberculosis
gaagcuggccaccgcauc

SEQ ID NO: 837514 - RNA, 17 nt, Mycobacterium avium subsp. paratuberculosis
gaagcugggcgcccaga

SEQ ID NO: 837515 - RNA, 23 nt, Mycobacterium avium subsp. paratuberculosis
gaagcugggguaguucugcucga

SEQ ID NO: 837516 - RNA, 22 nt, Mycobacterium avium subsp. paratuberculosis
gaagcugguggugaucggccag

SEQ ID NO: 837517 - RNA, 24 nt, Mycobacterium avium subsp. paratuberculosis
gaagcugguggugaucggccaggc

SEQ ID NO: 837518 - RNA, 13 nt, Mycobacterium avium subsp. paratuberculosis
gaagcugccgacc

SEQ ID NO: 837519 - RNA, 17 nt, Mycobacterium avium subsp. paratuberculosis
gaagcugcgcagccgug

SEQ ID NO: 837520 - RNA, 16 nt, Mycobacterium avium subsp. paratuberculosis
gaagcugcgccacaac

SEQ ID NO: 837521 - RNA, 18 nt, Mycobacterium avium subsp. paratuberculosis
gaagcugaagcggcccug

SEQ ID NO: 837522 - RNA, 18 nt, Mycobacterium avium subsp. paratuberculosis
gaagcuccacgccgccgg

SEQ ID NO: 837523 - RNA, 20 nt, Mycobacterium avium subsp. paratuberculosis
gaagcuccacgccgccggga

SEQ ID NO: 837524 - RNA, 22 nt, Mycobacterium avium subsp. paratuberculosis
gaagcguacccaggucggcgug

SEQ ID NO: 837525 - RNA, 16 nt, Mycobacterium avium subsp. paratuberculosis
gaagcguaugccggug

SEQ ID NO: 837526 - RNA, 18 nt, Mycobacterium avium subsp. paratuberculosis
gaagcguaugccgguggc

SEQ ID NO: 837527 - RNA, 16 nt, Mycobacterium avium subsp. paratuberculosis
gaagcggucgcggaac

SEQ ID NO: 837528 - RNA, 18 nt, Mycobacterium avium subsp. paratuberculosis
gaagcggucgcggaaccg

SEQ ID NO: 837529 - RNA, 19 nt, Mycobacterium avium subsp. paratuberculosis
gaagcggugauggcgaugc

SEQ ID NO: 837530 - RNA, 20 nt, Mycobacterium avium subsp. paratuberculosis
gaagcggugcaccaccgugc

SEQ ID NO: 837531 - RNA, 16 nt, Mycobacterium avium subsp. paratuberculosis
gaagcguuccgccguc

SEQ ID NO: 837532 - RNA, 20 nt, Mycobacterium avium subsp. paratuberculosis
gaagcuaguuucacgcucgg

SEQ ID NO: 837533 - RNA, 23 nt, Mycobacterium avium subsp. paratuberculosis
gaagcuaguuucacgcucggcgg

SEQ ID NO: 837534 - RNA, 15 nt, Mycobacterium avium subsp. paratuberculosis
gaagagggcgugacg

SEQ ID NO: 837535 - RNA, 23 nt, Mycobacterium avium subsp. paratuberculosis
gaagagcguuccuuacgccgacg

SEQ ID NO: 837536 - RNA, 19 nt, Mycobacterium avium subsp. paratuberculosis
gaagaguuuucacgaagaa

SEQ ID NO: 837537 - RNA, 16 nt, Mycobacterium avium subsp. paratuberculosis
gaagaucaccgcgacg

SEQ ID NO: 837538 - RNA, 17 nt, Mycobacterium avium subsp. paratuberculosis
gaagaucaccgcgucgg

SEQ ID NO: 837539 - RNA, 14 nt, Mycobacterium avium subsp. paratuberculosis
gaagaucagcaccg

SEQ ID NO: 837540 - RNA, 23 nt, Mycobacterium avium subsp. paratuberculosis
gaagaucagcaggcuggcggcga

SEQ ID NO: 837541 - RNA, 13 nt, Mycobacterium avium subsp. paratuberculosis
gaagaucagcgcg

SEQ ID NO: 837542 - RNA, 14 nt, Mycobacterium avium subsp. paratuberculosis
gaagaucgacgcca

SEQ ID NO: 837543 - RNA, 18 nt, Mycobacterium avium subsp. paratuberculosis
gaagaucgcccgccgcga

SEQ ID NO: 837544 - RNA, 16 nt, Mycobacterium avium subsp. paratuberculosis
gaagaugaucagcgcg

SEQ ID NO: 837545 - RNA, 17 nt, Mycobacterium avium subsp. paratuberculosis
gaagaugaucucgccga

SEQ ID NO: 837546 - RNA, 22 nt, Mycobacterium avium subsp. paratuberculosis
gaagaugaucucgccgagcggg

SEQ ID NO: 837547 - RNA, 17 nt, Mycobacterium avium subsp. paratuberculosis
gaagaugggcgccgagu

SEQ ID NO: 837548 - RNA, 18 nt, Mycobacterium avium subsp. paratuberculosis
gaagaugucggugccgau

SEQ ID NO: 837549 - RNA, 22 nt, Mycobacterium avium subsp. paratuberculosis
gaagaugcgccggguccagccg

SEQ ID NO: 837550 - RNA, 21 nt, Mycobacterium avium subsp. paratuberculosis
gaagcagccuucuuggcgggc

SEQ ID NO: 837551 - RNA, 22 nt, Mycobacterium avium subsp. paratuberculosis
gaagcacaccguucccaccggc

SEQ ID NO: 837552 - RNA, 22 nt, Mycobacterium avium subsp. paratuberculosis
gaagcagaacuucuccgccggc

SEQ ID NO: 837553 - RNA, 20 nt, Mycobacterium avium subsp. paratuberculosis
gaagcacgaccacacccgca

SEQ ID NO: 837554 - RNA, 12 nt, Mycobacterium avium subsp. paratuberculosis
gaagccgcgacg

SEQ ID NO: 837555 - RNA, 13 nt, Mycobacterium avium subsp. paratuberculosis
gaagccgccgacg

SEQ ID NO: 837556 - RNA, 12 nt, Mycobacterium avium subsp. paratuberculosis
gaagccgccgcc

SEQ ID NO: 837557 - RNA, 13 nt, Mycobacterium avium subsp. paratuberculosis
gaagccgccgccc

SEQ ID NO: 837558 - RNA, 16 nt, Mycobacterium avium subsp. paratuberculosis
gaagccgccgcccugc

SEQ ID NO: 837559 - RNA, 20 nt, Mycobacterium avium subsp. paratuberculosis
gaagccggccaguucccggg

SEQ ID NO: 837560 - RNA, 21 nt, Mycobacterium avium subsp. paratuberculosis
gaagccggccaguucccgggc

SEQ ID NO: 837561 - RNA, 16 nt, Mycobacterium avium subsp. paratuberculosis
gaagccggcgacgacc

SEQ ID NO: 837562 - RNA, 15 nt, Mycobacterium avium subsp. paratuberculosis
gaagccgcggacggc

SEQ ID NO: 837563 - RNA, 16 nt, Mycobacterium avium subsp. paratuberculosis
gaagccgaucaccggc

SEQ ID NO: 837564 - RNA, 14 nt, Mycobacterium avium subsp. paratuberculosis
gaagccgacgccgu

SEQ ID NO: 837565 - RNA, 22 nt, Mycobacterium avium subsp. paratuberculosis
gaagccgagcgguccaacgggc

SEQ ID NO: 837566 - RNA, 17 nt, Mycobacterium avium subsp. paratuberculosis
gaagccgaggucgccga

SEQ ID NO: 837567 - RNA, 22 nt, Mycobacterium avium subsp. paratuberculosis
gaagccgaggucgccgacgccg

SEQ ID NO: 837568 - RNA, 20 nt, Mycobacterium avium subsp. paratuberculosis
gaagccgaggucgcggcggc

SEQ ID NO: 837569 - RNA, 22 nt, Mycobacterium avium subsp. paratuberculosis
gaagccgaggucgcggcggccg

SEQ ID NO: 837570 - RNA, 22 nt, Mycobacterium avium subsp. paratuberculosis
gaagccgaguuuggcgucgaug

SEQ ID NO: 837571 - RNA, 20 nt, Mycobacterium avium subsp. paratuberculosis
gaagccgaacgacagcagga

SEQ ID NO: 837572 - RNA, 13 nt, Mycobacterium avium subsp. paratuberculosis
gaagcccaccgcc

SEQ ID NO: 837573 - RNA, 14 nt, Mycobacterium avium subsp. paratuberculosis
gaagcccaccgcgg

SEQ ID NO: 837574 - RNA, 14 nt, Mycobacterium avium subsp. paratuberculosis
gaagcccagcaccc

SEQ ID NO: 837575 - RNA, 18 nt, Mycobacterium avium subsp. paratuberculosis
gaagcccgugccgaugcc

SEQ ID NO: 837576 - RNA, 19 nt, Mycobacterium avium subsp. paratuberculosis
gaagcccgugccgaugccg

SEQ ID NO: 837577 - RNA, 22 nt, Mycobacterium avium subsp. paratuberculosis
gaagcccgugccgaugccggcc

SEQ ID NO: 837578 - RNA, 18 nt, Mycobacterium avium subsp. paratuberculosis
gaagcccgugcgacggcu

SEQ ID NO: 837579 - RNA, 16 nt, Mycobacterium avium subsp. paratuberculosis
gaagcccgagcgucac

SEQ ID NO: 837580 - RNA, 22 nt, Mycobacterium avium subsp. paratuberculosis
gaagcccgacaucugccgggcg

SEQ ID NO: 837581 - RNA, 23 nt, Mycobacterium avium subsp. paratuberculosis
gaagccccgguuccaaccaccgu

SEQ ID NO: 837582 - RNA, 22 nt, Mycobacterium avium subsp. paratuberculosis
gaagcccaugccgaugcccauc

SEQ ID NO: 837583 - RNA, 20 nt, Mycobacterium avium subsp. paratuberculosis
gaacgccaccuucaccgcgc

SEQ ID NO: 837584 - RNA, 13 nt, Mycobacterium avium subsp. paratuberculosis
gaacgccagcagc

SEQ ID NO: 837585 - RNA, 15 nt, Mycobacterium avium subsp. paratuberculosis
gaacgcaaucgccca

SEQ ID NO: 837586 - RNA, 17 nt, Mycobacterium avium subsp. paratuberculosis
gaacgcaaucgcccagu

SEQ ID NO: 837587 - RNA, 15 nt, Mycobacterium avium subsp. paratuberculosis
gaacgaucggcucca

SEQ ID NO: 837588 - RNA, 18 nt, Mycobacterium avium subsp. paratuberculosis
gaacgaucggcuccagcg

SEQ ID NO: 837589 - RNA, 11 nt, Mycobacterium avium subsp. paratuberculosis
gaacgauggug

SEQ ID NO: 837590 - RNA, 19 nt, Mycobacterium avium subsp. paratuberculosis
gaacgccgaggaggccgcg

SEQ ID NO: 837591 - RNA, 22 nt, Mycobacterium avium subsp. paratuberculosis
gaacgccgaggaggccgcggcg

SEQ ID NO: 837592 - RNA, 22 nt, Mycobacterium avium subsp. paratuberculosis
gaacgccaccaccuccucgcgg

SEQ ID NO: 837593 - RNA, 20 nt, Mycobacterium avium subsp. paratuberculosis
gaacgccaucaccagcgcgu

SEQ ID NO: 837594 - RNA, 14 nt, Mycobacterium avium subsp. paratuberculosis
gaacgccagcgccg

SEQ ID NO: 837595 - RNA, 20 nt, Mycobacterium avium subsp. paratuberculosis
gaacgccagcgccgcaacgg

SEQ ID NO: 837596 - RNA, 15 nt, Mycobacterium avium subsp. paratuberculosis
gaacgccagcagccg

SEQ ID NO: 837597 - RNA, 17 nt, Mycobacterium avium subsp. paratuberculosis
gaacgccagcagccgca

SEQ ID NO: 837598 - RNA, 18 nt, Mycobacterium avium subsp. paratuberculosis
gaacgccagcagccgcag

SEQ ID NO: 837599 - RNA, 20 nt, Mycobacterium avium subsp. paratuberculosis
gaacgccccguggaucaucc

SEQ ID NO: 837600 - RNA, 16 nt, Mycobacterium avium subsp. paratuberculosis
gaacgcccgcaacucc

SEQ ID NO: 837601 - RNA, 12 nt, Mycobacterium avium subsp. paratuberculosis
gaacgcccgcac

SEQ ID NO: 837602 - RNA, 14 nt, Mycobacterium avium subsp. paratuberculosis
gaacgcccgcacca

SEQ ID NO: 837603 - RNA, 15 nt, Mycobacterium avium subsp. paratuberculosis
gaacgcccgcaccac

SEQ ID NO: 837604 - RNA, 17 nt, Mycobacterium avium subsp. paratuberculosis
gaacgccucgagcgccc

SEQ ID NO: 837605 - RNA, 12 nt, Mycobacterium avium subsp. paratuberculosis
gaacgccgguga

SEQ ID NO: 837606 - RNA, 20 nt, Mycobacterium avium subsp. paratuberculosis
gaacgccggauuggcgucgg

SEQ ID NO: 837607 - RNA, 18 nt, Mycobacterium avium subsp. paratuberculosis
gaacgccgcguccucguc

SEQ ID NO: 837608 - RNA, 19 nt, Mycobacterium avium subsp. paratuberculosis
gaacgccgcguccucgucg

SEQ ID NO: 837609 - RNA, 22 nt, Mycobacterium avium subsp. paratuberculosis
gaacgccgcguccucgucgaug

SEQ ID NO: 837610 - RNA, 16 nt, Mycobacterium avium subsp. paratuberculosis
gaacgcguccgacggc

SEQ ID NO: 837611 - RNA, 19 nt, Mycobacterium avium subsp. paratuberculosis
gaacgcgucgaccgccgcg

SEQ ID NO: 837612 - RNA, 20 nt, Mycobacterium avium subsp. paratuberculosis
gaacgcgucgaccgccgcga

SEQ ID NO: 837613 - RNA, 14 nt, Mycobacterium avium subsp. paratuberculosis
gaacgcgucgccca

SEQ ID NO: 837614 - RNA, 20 nt, Mycobacterium avium subsp. paratuberculosis
gaacgcgguaccgaugacca

SEQ ID NO: 837615 - RNA, 19 nt, Mycobacterium avium subsp. paratuberculosis
gaacgcggugagcgugccg

SEQ ID NO: 837616 - RNA, 12 nt, Mycobacterium avium subsp. paratuberculosis
gaacgcgguggg

SEQ ID NO: 837617 - RNA, 19 nt, Mycobacterium avium subsp. paratuberculosis
gaacgcggugggcaccagc

SEQ ID NO: 837618 - RNA, 21 nt, Mycobacterium avium subsp. paratuberculosis
gaacgcggugggcaccagcag

SEQ ID NO: 837619 - RNA, 23 nt, Mycobacterium avium subsp. paratuberculosis
gaacgcggugggcaccagcagcg

SEQ ID NO: 837620 - RNA, 20 nt, Mycobacterium avium subsp. paratuberculosis
gaacgcgguuuugaugccgc

SEQ ID NO: 837621 - RNA, 16 nt, Mycobacterium avium subsp. paratuberculosis
gaacgcguacagcgcc

SEQ ID NO: 837622 - RNA, 13 nt, Mycobacterium avium subsp. paratuberculosis
gaacgcggccgcc

SEQ ID NO: 837623 - RNA, 22 nt, Mycobacterium avium subsp. paratuberculosis
gaacgcggcggaggccugcgcg

SEQ ID NO: 837624 - RNA, 19 nt, Mycobacterium avium subsp. paratuberculosis
gaacgcggcugaucagccg

SEQ ID NO: 837625 - RNA, 20 nt, Mycobacterium avium subsp. paratuberculosis
gaacgcggcugaucagccgg

SEQ ID NO: 837626 - RNA, 11 nt, Mycobacterium avium subsp. paratuberculosis
gaacgcgcggg

SEQ ID NO: 837627 - RNA, 14 nt, Mycobacterium avium subsp. paratuberculosis
gaacgcgcgggugc

SEQ ID NO: 837628 - RNA, 19 nt, Mycobacterium avium subsp. paratuberculosis
gaacgcgcgggugcgggcg

SEQ ID NO: 837629 - RNA, 20 nt, Mycobacterium avium subsp. paratuberculosis
gaacgcgcggucgucgcccg

SEQ ID NO: 837630 - RNA, 13 nt, Mycobacterium avium subsp. paratuberculosis
gaacgcgcgucgg

SEQ ID NO: 837631 - RNA, 14 nt, Mycobacterium avium subsp. paratuberculosis
gaacgaaucgucgc

SEQ ID NO: 837632 - RNA, 14 nt, Mycobacterium avium subsp. paratuberculosis
gaaccugcugggcg

SEQ ID NO: 837633 - RNA, 15 nt, Mycobacterium avium subsp. paratuberculosis
gaaccuggagggagc

SEQ ID NO: 837634 - RNA, 17 nt, Mycobacterium avium subsp. paratuberculosis
gaaccuggccaccagca

SEQ ID NO: 837635 - RNA, 15 nt, Mycobacterium avium subsp. paratuberculosis
gaaccuggcugccug

SEQ ID NO: 837636 - RNA, 13 nt, Mycobacterium avium subsp. paratuberculosis
gaaccguucgucg

SEQ ID NO: 837637 - RNA, 18 nt, Mycobacterium avium subsp. paratuberculosis
gaaccguucgucgucgcg

SEQ ID NO: 837638 - RNA, 20 nt, Mycobacterium avium subsp. paratuberculosis
gaaccguucgucgucgcgca

SEQ ID NO: 837639 - RNA, 16 nt, Mycobacterium avium subsp. paratuberculosis
gaaccgugcacgaucg

SEQ ID NO: 837640 - RNA, 20 nt, Mycobacterium avium subsp. paratuberculosis
gaaccgugcacgaucgcggu

SEQ ID NO: 837641 - RNA, 23 nt, Mycobacterium avium subsp. paratuberculosis
gaaccgcguccacgaccccggcg

SEQ ID NO: 837642 - RNA, 19 nt, Mycobacterium avium subsp. paratuberculosis
gaaccgcucgucgggaacg

SEQ ID NO: 837643 - RNA, 23 nt, Mycobacterium avium subsp. paratuberculosis
gaaccgcucgucgggaacgccga

SEQ ID NO: 837644 - RNA, 16 nt, Mycobacterium avium subsp. paratuberculosis
gaaccgcugcaaccgg

SEQ ID NO: 837645 - RNA, 24 nt, Mycobacterium avium subsp. paratuberculosis
gaaccgcugcggauaaccguccac

SEQ ID NO: 837646 - RNA, 14 nt, Mycobacterium avium subsp. paratuberculosis
gaaccgcugcuccg

SEQ ID NO: 837647 - RNA, 22 nt, Mycobacterium avium subsp. paratuberculosis
gaaccgcugcuccggguccgcg

SEQ ID NO: 837648 - RNA, 22 nt, Mycobacterium avium subsp. paratuberculosis
gaaccgcggcggcagcagcccg

SEQ ID NO: 837649 - RNA, 21 nt, Mycobacterium avium subsp. paratuberculosis
gaaccgcugcugcucggccgc

SEQ ID NO: 837650 - RNA, 19 nt, Mycobacterium avium subsp. paratuberculosis
gaaccgcuugcccagcccc

SEQ ID NO: 837651 - RNA, 23 nt, Mycobacterium avium subsp. paratuberculosis
gaacaucuuggucagccgcggcg

SEQ ID NO: 837652 - RNA, 12 nt, Mycobacterium avium subsp. paratuberculosis
gaaccaacgcgg

SEQ ID NO: 837653 - RNA, 19 nt, Mycobacterium avium subsp. paratuberculosis
gaacaugcugccgccggcg

SEQ ID NO: 837654 - RNA, 18 nt, Mycobacterium avium subsp. paratuberculosis
gaaccaacugagcgcggc

SEQ ID NO: 837655 - RNA, 14 nt, Mycobacterium avium subsp. paratuberculosis
gaaccgcuccccga

SEQ ID NO: 837656 - RNA, 20 nt, Mycobacterium avium subsp. paratuberculosis
gaaccgcucgaacacccggc

SEQ ID NO: 837657 - RNA, 20 nt, Mycobacterium avium subsp. paratuberculosis
gaaccgcucgauggcgccga

SEQ ID NO: 837658 - RNA, 14 nt, Mycobacterium avium subsp. paratuberculosis
gaaccgcucggcgg

SEQ ID NO: 837659 - RNA, 15 nt, Mycobacterium avium subsp. paratuberculosis
gaaccgcgcacucga

SEQ ID NO: 837660 - RNA, 23 nt, Mycobacterium avium subsp. paratuberculosis
gaaccgcgccuucgacccggugg

SEQ ID NO: 837661 - RNA, 13 nt, Mycobacterium avium subsp. paratuberculosis
gaaccacaccccg

SEQ ID NO: 837662 - RNA, 15 nt, Mycobacterium avium subsp. paratuberculosis
gaaccacaccccggc

SEQ ID NO: 837663 - RNA, 16 nt, Mycobacterium avium subsp. paratuberculosis
gaaccacaccccggcc

SEQ ID NO: 837664 - RNA, 14 nt, Mycobacterium avium subsp. paratuberculosis
gaaccgcgacgcga

SEQ ID NO: 837665 - RNA, 16 nt, Mycobacterium avium subsp. paratuberculosis
gaaccgcgacgcgauc

SEQ ID NO: 837666 - RNA, 14 nt, Mycobacterium avium subsp. paratuberculosis
gaaccgccgcaccc

SEQ ID NO: 837667 - RNA, 19 nt, Mycobacterium avium subsp. paratuberculosis
gaaccgccgcacccagcgg

SEQ ID NO: 837668 - RNA, 15 nt, Mycobacterium avium subsp. paratuberculosis
gaaccgccgcgcucg

SEQ ID NO: 837669 - RNA, 23 nt, Mycobacterium avium subsp. paratuberculosis
gaaccgccgcgcucgcaccagcg

SEQ ID NO: 837670 - RNA, 15 nt, Mycobacterium avium subsp. paratuberculosis
gaacggcccgccgcc

SEQ ID NO: 837671 - RNA, 19 nt, Mycobacterium avium subsp. paratuberculosis
gaacggccaguccaggccg

SEQ ID NO: 837672 - RNA, 21 nt, Mycobacterium avium subsp. paratuberculosis
gaacggccaguccaggccgcc

SEQ ID NO: 837673 - RNA, 15 nt, Mycobacterium avium subsp. paratuberculosis
gaacggcggcagcga

SEQ ID NO: 837674 - RNA, 14 nt, Mycobacterium avium subsp. paratuberculosis
gaacggcgggcccg

SEQ ID NO: 837675 - RNA, 20 nt, Mycobacterium avium subsp. paratuberculosis
gaacggcgggcccgucgccg

SEQ ID NO: 837676 - RNA, 17 nt, Mycobacterium avium subsp. paratuberculosis
gaacggcagcucgucga

SEQ ID NO: 837677 - RNA, 20 nt, Mycobacterium avium subsp. paratuberculosis
gaacggcagcucgucgacgu

SEQ ID NO: 837678 - RNA, 22 nt, Mycobacterium avium subsp. paratuberculosis
gaacgcgucguugucgucgccg

SEQ ID NO: 837679 - RNA, 21 nt, Mycobacterium avium subsp. paratuberculosis
gaacgcggcgaaggccagcga

SEQ ID NO: 837680 - RNA, 15 nt, Mycobacterium avium subsp. paratuberculosis
gaacgcgucgccgug

SEQ ID NO: 837681 - RNA, 15 nt, Mycobacterium avium subsp. paratuberculosis
gaacgcgucgcgcca

SEQ ID NO: 837682 - RNA, 17 nt, Mycobacterium avium subsp. paratuberculosis
gaacgcgucgcgccagc

SEQ ID NO: 837683 - RNA, 18 nt, Mycobacterium avium subsp. paratuberculosis
gaacgcgucgcgccagcg

SEQ ID NO: 837684 - RNA, 15 nt, Mycobacterium avium subsp. paratuberculosis
gaacggccgcgcaga

SEQ ID NO: 837685 - RNA, 17 nt, Mycobacterium avium subsp. paratuberculosis
gaacggccgcgcagauc

SEQ ID NO: 837686 - RNA, 13 nt, Mycobacterium avium subsp. paratuberculosis
gaacgcggccagc

SEQ ID NO: 837687 - RNA, 22 nt, Mycobacterium avium subsp. paratuberculosis
gaacggcggggccuccaccagc

SEQ ID NO: 837688 - RNA, 21 nt, Mycobacterium avium subsp. paratuberculosis
gaacucgaucugcagccggcg

SEQ ID NO: 837689 - RNA, 22 nt, Mycobacterium avium subsp. paratuberculosis
gaacgggaugaacucgugcggc

SEQ ID NO: 837690 - RNA, 14 nt, Mycobacterium avium subsp. paratuberculosis
gaacgggauggagc

SEQ ID NO: 837691 - RNA, 19 nt, Mycobacterium avium subsp. paratuberculosis
gaacucgugcggcgccgcc

SEQ ID NO: 837692 - RNA, 20 nt, Mycobacterium avium subsp. paratuberculosis
gaacucgugcggcgccgccc

SEQ ID NO: 837693 - RNA, 19 nt, Mycobacterium avium subsp. paratuberculosis
gaacucguggauguugucg

SEQ ID NO: 837694 - RNA, 20 nt, Mycobacterium avium subsp. paratuberculosis
gaacugguuguagucgucga

SEQ ID NO: 837695 - RNA, 19 nt, Mycobacterium avium subsp. paratuberculosis
gaacuggucgaacagcgcg

SEQ ID NO: 837696 - RNA, 14 nt, Mycobacterium avium subsp. paratuberculosis
gaacucggcgccgc

SEQ ID NO: 837697 - RNA, 15 nt, Mycobacterium avium subsp. paratuberculosis
gaacucggcgccgcc

SEQ ID NO: 837698 - RNA, 16 nt, Mycobacterium avium subsp. paratuberculosis
gaacucgcgggcgagc

SEQ ID NO: 837699 - RNA, 23 nt, Mycobacterium avium subsp. paratuberculosis
gaacucgggauuggacagcggcg

SEQ ID NO: 837700 - RNA, 15 nt, Mycobacterium avium subsp. paratuberculosis
gaacucgggcccgag

SEQ ID NO: 837701 - RNA, 16 nt, Mycobacterium avium subsp. paratuberculosis
gaacucggugaugccg

SEQ ID NO: 837702 - RNA, 18 nt, Mycobacterium avium subsp. paratuberculosis
gaacucggugaugccggc

SEQ ID NO: 837703 - RNA, 21 nt, Mycobacterium avium subsp. paratuberculosis
gaacucguccaugcuggugcc

SEQ ID NO: 837704 - RNA, 11 nt, Mycobacterium avium subsp. paratuberculosis
gaacucgucga

SEQ ID NO: 837705 - RNA, 13 nt, Mycobacterium avium subsp. paratuberculosis
gaacucgucgacg

SEQ ID NO: 837706 - RNA, 19 nt, Mycobacterium avium subsp. paratuberculosis
gaacucgucgacgcccacc

SEQ ID NO: 837707 - RNA, 17 nt, Mycobacterium avium subsp. paratuberculosis
gaacucgucgccaccga

SEQ ID NO: 837708 - RNA, 19 nt, Mycobacterium avium subsp. paratuberculosis
gaacuucaccgucugcugg

SEQ ID NO: 837709 - RNA, 20 nt, Mycobacterium avium subsp. paratuberculosis
gaacuucaccgucugcuggc

SEQ ID NO: 837710 - RNA, 20 nt, Mycobacterium avium subsp. paratuberculosis
gaacuuaacuucacgcucgg

SEQ ID NO: 837711 - RNA, 17 nt, Mycobacterium avium subsp. paratuberculosis
gaacuugcgccgggugg

SEQ ID NO: 837712 - RNA, 20 nt, Mycobacterium avium subsp. paratuberculosis
gaacuugucgucgucggcga

SEQ ID NO: 837713 - RNA, 16 nt, Mycobacterium avium subsp. paratuberculosis
gaacuucgccagcggg

SEQ ID NO: 837714 - RNA, 15 nt, Mycobacterium avium subsp. paratuberculosis
gaacuugaucaccgc

SEQ ID NO: 837715 - RNA, 20 nt, Mycobacterium avium subsp. paratuberculosis
gaacuugccgaucaccucga

SEQ ID NO: 837716 - RNA, 14 nt, Mycobacterium avium subsp. paratuberculosis
gaagaaccgggaau

SEQ ID NO: 837717 - RNA, 13 nt, Mycobacterium avium subsp. paratuberculosis
gaagaacgacgcc

SEQ ID NO: 837718 - RNA, 14 nt, Mycobacterium avium subsp. paratuberculosis
gaagaacgacgcca

SEQ ID NO: 837719 - RNA, 23 nt, Mycobacterium avium subsp. paratuberculosis
gaagaacccggcgugcuccagca

SEQ ID NO: 837720 - RNA, 20 nt, Mycobacterium avium subsp. paratuberculosis
gaagaacuggcugagcaccg

SEQ ID NO: 837721 - RNA, 18 nt, Mycobacterium avium subsp. paratuberculosis
gaagaagagggcgugacg

SEQ ID NO: 837722 - RNA, 23 nt, Mycobacterium avium subsp. paratuberculosis
gaagacgaugaaaccccagccgg

SEQ ID NO: 837723 - RNA, 20 nt, Mycobacterium avium subsp. paratuberculosis
gaagaccuggccggccucga

SEQ ID NO: 837724 - RNA, 14 nt, Mycobacterium avium subsp. paratuberculosis
gaagaccguugacg

SEQ ID NO: 837725 - RNA, 16 nt, Mycobacterium avium subsp. paratuberculosis
gaagacccgccggaac

SEQ ID NO: 837726 - RNA, 20 nt, Mycobacterium avium subsp. paratuberculosis
gaagaauuccaugucgucga

SEQ ID NO: 837727 - RNA, 21 nt, Mycobacterium avium subsp. paratuberculosis
gaagaauuccaugucgucgag

SEQ ID NO: 837728 - RNA, 22 nt, Mycobacterium avium subsp. paratuberculosis
gaagaaggacgccucgcgcagc

SEQ ID NO: 837729 - RNA, 18 nt, Mycobacterium avium subsp. paratuberculosis
gaagaaggcuccgccgau

SEQ ID NO: 837730 - RNA, 19 nt, Mycobacterium avium subsp. paratuberculosis
gaagaaguucucgcacccg

SEQ ID NO: 837731 - RNA, 20 nt, Mycobacterium avium subsp. paratuberculosis
gaaacuaguuucacguucgg

SEQ ID NO: 837732 - RNA, 23 nt, Mycobacterium avium subsp. paratuberculosis
gaaacuaguuucacguucggcgg

SEQ ID NO: 837733 - RNA, 13 nt, Mycobacterium avium subsp. paratuberculosis
gaaacgcccggcu

SEQ ID NO: 837734 - RNA, 15 nt, Mycobacterium avium subsp. paratuberculosis
gaaacgcccggcuca

SEQ ID NO: 837735 - RNA, 23 nt, Mycobacterium avium subsp. paratuberculosis
gaaacugaccuucucccgcggca

SEQ ID NO: 837736 - RNA, 20 nt, Mycobacterium avium subsp. paratuberculosis
gaaacucguugccagccggu

SEQ ID NO: 837737 - RNA, 21 nt, Mycobacterium avium subsp. paratuberculosis
gaaacucguugccagccggug

SEQ ID NO: 837738 - RNA, 14 nt, Mycobacterium avium subsp. paratuberculosis
gaaacucaccgcgu

SEQ ID NO: 837739 - RNA, 19 nt, Mycobacterium avium subsp. paratuberculosis
gaaaccguuuucacagcuc

SEQ ID NO: 837740 - RNA, 17 nt, Mycobacterium avium subsp. paratuberculosis
gaaacgcaacagcgagu

SEQ ID NO: 837741 - RNA, 13 nt, Mycobacterium avium subsp. paratuberculosis
gaaaccgucggcc

SEQ ID NO: 837742 - RNA, 17 nt, Mycobacterium avium subsp. paratuberculosis
gaaaccgucggcccgcc

SEQ ID NO: 837743 - RNA, 21 nt, Mycobacterium avium subsp. paratuberculosis
gaaaccguggaagucgccguc

SEQ ID NO: 837744 - RNA, 19 nt, Mycobacterium avium subsp. paratuberculosis
gaaaccguuggccugcgcg

SEQ ID NO: 837745 - RNA, 14 nt, Mycobacterium avium subsp. paratuberculosis
cuuguggucgaucc

SEQ ID NO: 837746 - RNA, 17 nt, Mycobacterium avium subsp. paratuberculosis
cuuguaggucaucagcg

SEQ ID NO: 837747 - RNA, 22 nt, Mycobacterium avium subsp. paratuberculosis
gaaaccggccagcagcagcccg

SEQ ID NO: 837748 - RNA, 20 nt, Mycobacterium avium subsp. paratuberculosis
cuuguugagggugacggugg

SEQ ID NO: 837749 - RNA, 17 nt, Mycobacterium avium subsp. paratuberculosis
gaaacuccuggccccga

SEQ ID NO: 837750 - RNA, 23 nt, Mycobacterium avium subsp. paratuberculosis
gaaacuuguggaaggcgccggcg

SEQ ID NO: 837751 - RNA, 17 nt, Mycobacterium avium subsp. paratuberculosis
gaaagccgcugucugcg

SEQ ID NO: 837752 - RNA, 22 nt, Mycobacterium avium subsp. paratuberculosis
gaaagccguaccgcaacaccga

SEQ ID NO: 837753 - RNA, 13 nt, Mycobacterium avium subsp. paratuberculosis
gaaagccacccgc

SEQ ID NO: 837754 - RNA, 15 nt, Mycobacterium avium subsp. paratuberculosis
gaaaguccgccgaca

SEQ ID NO: 837755 - RNA, 23 nt, Mycobacterium avium subsp. paratuberculosis
gaaaguccuugcugcccagggcg

SEQ ID NO: 837756 - RNA, 19 nt, Mycobacterium avium subsp. paratuberculosis
gaaagcgcgagggcucaac

SEQ ID NO: 837757 - RNA, 20 nt, Mycobacterium avium subsp. paratuberculosis
gaaagcgcuugucgcagacc

SEQ ID NO: 837758 - RNA, 20 nt, Mycobacterium avium subsp. paratuberculosis
gaaagcgggugaccgacagc

SEQ ID NO: 837759 - RNA, 12 nt, Mycobacterium avium subsp. paratuberculosis
gaaagcgucggc

SEQ ID NO: 837760 - RNA, 14 nt, Mycobacterium avium subsp. paratuberculosis
gaaaggcagcagcc

SEQ ID NO: 837761 - RNA, 14 nt, Mycobacterium avium subsp. paratuberculosis
gaaaggccagcacg

SEQ ID NO: 837762 - RNA, 16 nt, Mycobacterium avium subsp. paratuberculosis
gaaagcucgcgucgac

SEQ ID NO: 837763 - RNA, 13 nt, Mycobacterium avium subsp. paratuberculosis
gaaaggaaggcgc

SEQ ID NO: 837764 - RNA, 18 nt, Mycobacterium avium subsp. paratuberculosis
gaacaguucggugcgggu

SEQ ID NO: 837765 - RNA, 16 nt, Mycobacterium avium subsp. paratuberculosis
gaacaucacccggcgg

SEQ ID NO: 837766 - RNA, 23 nt, Mycobacterium avium subsp. paratuberculosis
gaacaguucgacguagcccgccg

SEQ ID NO: 837767 - RNA, 14 nt, Mycobacterium avium subsp. paratuberculosis
gaacaucgccagca

SEQ ID NO: 837768 - RNA, 19 nt, Mycobacterium avium subsp. paratuberculosis
gaacaucgccucggccgcg

SEQ ID NO: 837769 - RNA, 14 nt, Mycobacterium avium subsp. paratuberculosis
gaacaucggccggg

SEQ ID NO: 837770 - RNA, 16 nt, Mycobacterium avium subsp. paratuberculosis
gaacaucuccagcgcg

SEQ ID NO: 837771 - RNA, 18 nt, Mycobacterium avium subsp. paratuberculosis
gaacaucuccagcgcggu

SEQ ID NO: 837772 - RNA, 19 nt, Mycobacterium avium subsp. paratuberculosis
gaacauccacggcauggug

SEQ ID NO: 837773 - RNA, 17 nt, Mycobacterium avium subsp. paratuberculosis
gaacaucgagcccaccg

SEQ ID NO: 837774 - RNA, 20 nt, Mycobacterium avium subsp. paratuberculosis
gaacaucgagcccaccgcgc

SEQ ID NO: 837775 - RNA, 17 nt, Mycobacterium avium subsp. paratuberculosis
gaacagggcgacggcgg

SEQ ID NO: 837776 - RNA, 19 nt, Mycobacterium avium subsp. paratuberculosis
gaacagggcgacggcggcg

SEQ ID NO: 837777 - RNA, 18 nt, Mycobacterium avium subsp. paratuberculosis
gaacagggcggcgggccc

SEQ ID NO: 837778 - RNA, 22 nt, Mycobacterium avium subsp. paratuberculosis
gaacagggcggcgggcccggcg

SEQ ID NO: 837779 - RNA, 23 nt, Mycobacterium avium subsp. paratuberculosis
gaacagggcggcgggcccggcga

SEQ ID NO: 837780 - RNA, 19 nt, Mycobacterium avium subsp. paratuberculosis
gaacagguaggacaccgaa

SEQ ID NO: 837781 - RNA, 19 nt, Mycobacterium avium subsp. paratuberculosis
gaacagguaggcggcgccg

SEQ ID NO: 837782 - RNA, 22 nt, Mycobacterium avium subsp. paratuberculosis
gaacagguaggcggcgccgucg

SEQ ID NO: 837783 - RNA, 20 nt, Mycobacterium avium subsp. paratuberculosis
gaacagguaguagcgcgccg

SEQ ID NO: 837784 - RNA, 14 nt, Mycobacterium avium subsp. paratuberculosis
gaacagguccgcga

SEQ ID NO: 837785 - RNA, 17 nt, Mycobacterium avium subsp. paratuberculosis
gaacagguccuugccca

SEQ ID NO: 837786 - RNA, 20 nt, Mycobacterium avium subsp. paratuberculosis
gaacagugcacugccgaccc

SEQ ID NO: 837787 - RNA, 15 nt, Mycobacterium avium subsp. paratuberculosis
gaacagucggccggc

SEQ ID NO: 837788 - RNA, 17 nt, Mycobacterium avium subsp. paratuberculosis
gaacagucggccggcgu

SEQ ID NO: 837789 - RNA, 18 nt, Mycobacterium avium subsp. paratuberculosis
gaacagucggccggcguu

SEQ ID NO: 837790 - RNA, 17 nt, Mycobacterium avium subsp. paratuberculosis
gaacagcuggucccaca

SEQ ID NO: 837791 - RNA, 21 nt, Mycobacterium avium subsp. paratuberculosis
gaacagcuggucccacagcgg

SEQ ID NO: 837792 - RNA, 17 nt, Mycobacterium avium subsp. paratuberculosis
gaacagccagucgaaga

SEQ ID NO: 837793 - RNA, 14 nt, Mycobacterium avium subsp. paratuberculosis
gaacagcccgagca

SEQ ID NO: 837794 - RNA, 17 nt, Mycobacterium avium subsp. paratuberculosis
gaacagcccgagcacgu

SEQ ID NO: 837795 - RNA, 19 nt, Mycobacterium avium subsp. paratuberculosis
gaacagcaggcccaggccg

SEQ ID NO: 837796 - RNA, 22 nt, Mycobacterium avium subsp. paratuberculosis
gaacagcagcagcagcggcagc

SEQ ID NO: 837797 - RNA, 14 nt, Mycobacterium avium subsp. paratuberculosis
gaacagcagccacg

SEQ ID NO: 837798 - RNA, 16 nt, Mycobacterium avium subsp. paratuberculosis
gaacagcagcgaaccc

SEQ ID NO: 837799 - RNA, 20 nt, Mycobacterium avium subsp. paratuberculosis
gaacagcagcgcgccgacca

SEQ ID NO: 837800 - RNA, 13 nt, Mycobacterium avium subsp. paratuberculosis
gaacagcuuggcg

SEQ ID NO: 837801 - RNA, 16 nt, Mycobacterium avium subsp. paratuberculosis
gaacaggcuggccagc

SEQ ID NO: 837802 - RNA, 16 nt, Mycobacterium avium subsp. paratuberculosis
gaacaggaugcagccg

SEQ ID NO: 837803 - RNA, 19 nt, Mycobacterium avium subsp. paratuberculosis
gaaaucguagaagcguacc

SEQ ID NO: 837804 - RNA, 14 nt, Mycobacterium avium subsp. paratuberculosis
gaacaccaccggca

SEQ ID NO: 837805 - RNA, 22 nt, Mycobacterium avium subsp. paratuberculosis
gaacaccaccggcaaccgccac

SEQ ID NO: 837806 - RNA, 20 nt, Mycobacterium avium subsp. paratuberculosis
gaaauccacgaugccgggca

SEQ ID NO: 837807 - RNA, 12 nt, Mycobacterium avium subsp. paratuberculosis
gaaauccgggcg

SEQ ID NO: 837808 - RNA, 16 nt, Mycobacterium avium subsp. paratuberculosis
gaaauccgggcgcgga

SEQ ID NO: 837809 - RNA, 18 nt, Mycobacterium avium subsp. paratuberculosis
gaaaucggacccagcccg

SEQ ID NO: 837810 - RNA, 14 nt, Mycobacterium avium subsp. paratuberculosis
gaacaccacgccga

SEQ ID NO: 837811 - RNA, 14 nt, Mycobacterium avium subsp. paratuberculosis
gaacaccacggugu

SEQ ID NO: 837812 - RNA, 15 nt, Mycobacterium avium subsp. paratuberculosis
gaacaccagcaccca

SEQ ID NO: 837813 - RNA, 17 nt, Mycobacterium avium subsp. paratuberculosis
gaacaccagcacccagc

SEQ ID NO: 837814 - RNA, 13 nt, Mycobacterium avium subsp. paratuberculosis
gaacaccagcccg

SEQ ID NO: 837815 - RNA, 13 nt, Mycobacterium avium subsp. paratuberculosis
gaacaccagcgca

SEQ ID NO: 837816 - RNA, 20 nt, Mycobacterium avium subsp. paratuberculosis
gaacacccggcuucgcugcg

SEQ ID NO: 837817 - RNA, 23 nt, Mycobacterium avium subsp. paratuberculosis
gaacacccggcuucgcugcgccg

SEQ ID NO: 837818 - RNA, 15 nt, Mycobacterium avium subsp. paratuberculosis
gaacaccgagccggc

SEQ ID NO: 837819 - RNA, 17 nt, Mycobacterium avium subsp. paratuberculosis
gaacaccgagccggcgg

SEQ ID NO: 837820 - RNA, 14 nt, Mycobacterium avium subsp. paratuberculosis
gaacaccccgcggg

SEQ ID NO: 837821 - RNA, 15 nt, Mycobacterium avium subsp. paratuberculosis
gaacaccgcaccggu

SEQ ID NO: 837822 - RNA, 14 nt, Mycobacterium avium subsp. paratuberculosis
gaacaccgcgcuga

SEQ ID NO: 837823 - RNA, 20 nt, Mycobacterium avium subsp. paratuberculosis
gaacaccgcguuggccgcca

SEQ ID NO: 837824 - RNA, 12 nt, Mycobacterium avium subsp. paratuberculosis
gaacaccggcag

SEQ ID NO: 837825 - RNA, 17 nt, Mycobacterium avium subsp. paratuberculosis
gaacaccggcagcgcca

SEQ ID NO: 837826 - RNA, 18 nt, Mycobacterium avium subsp. paratuberculosis
gaacaccggcagcgccac

SEQ ID NO: 837827 - RNA, 16 nt, Mycobacterium avium subsp. paratuberculosis
gaacagacucagcccg

SEQ ID NO: 837828 - RNA, 17 nt, Mycobacterium avium subsp. paratuberculosis
gaacaccggcgcgacca

SEQ ID NO: 837829 - RNA, 11 nt, Mycobacterium avium subsp. paratuberculosis
gaacagcagca

SEQ ID NO: 837830 - RNA, 15 nt, Mycobacterium avium subsp. paratuberculosis
gaacagcacgccggc

SEQ ID NO: 837831 - RNA, 16 nt, Mycobacterium avium subsp. paratuberculosis
gaacagcacgccggcc

SEQ ID NO: 837832 - RNA, 19 nt, Mycobacterium avium subsp. paratuberculosis
gaacagcacgccggccggc

SEQ ID NO: 837833 - RNA, 22 nt, Mycobacterium avium subsp. paratuberculosis
gaacagcacccccucggcgccg

SEQ ID NO: 837834 - RNA, 14 nt, Mycobacterium avium subsp. paratuberculosis
gaacagcaccgcca

SEQ ID NO: 837835 - RNA, 16 nt, Mycobacterium avium subsp. paratuberculosis
gaacagcaccgccacg

SEQ ID NO: 837836 - RNA, 20 nt, Mycobacterium avium subsp. paratuberculosis
gaacagcaccgccacggcga

SEQ ID NO: 837837 - RNA, 21 nt, Mycobacterium avium subsp. paratuberculosis
cuggauucgucgcuggccagg

SEQ ID NO: 837838 - RNA, 15 nt, Mycobacterium avium subsp. paratuberculosis
cuggcagccggccgg

SEQ ID NO: 837839 - RNA, 14 nt, Mycobacterium avium subsp. paratuberculosis
cuggcagcugccga

SEQ ID NO: 837840 - RNA, 15 nt, Mycobacterium avium subsp. paratuberculosis
cuggcaggucgcgcc

SEQ ID NO: 837841 - RNA, 16 nt, Mycobacterium avium subsp. paratuberculosis
cuggcaggucgcgccg

SEQ ID NO: 837842 - RNA, 18 nt, Mycobacterium avium subsp. paratuberculosis
cuggcaggugagccgggu

SEQ ID NO: 837843 - RNA, 22 nt, Mycobacterium avium subsp. paratuberculosis
cuggaugaucgucucggccgcg

SEQ ID NO: 837844 - RNA, 23 nt, Mycobacterium avium subsp. paratuberculosis
cuggaugaucgucucggccgcgg

SEQ ID NO: 837845 - RNA, 14 nt, Mycobacterium avium subsp. paratuberculosis
cuggaugaacagca

SEQ ID NO: 837846 - RNA, 23 nt, Mycobacterium avium subsp. paratuberculosis
cuggaugaacagcacgugcccgc

SEQ ID NO: 837847 - RNA, 16 nt, Mycobacterium avium subsp. paratuberculosis
cuggaugaaggucgcg

SEQ ID NO: 837848 - RNA, 17 nt, Mycobacterium avium subsp. paratuberculosis
cuggaugaaggucgcgg

SEQ ID NO: 837849 - RNA, 15 nt, Mycobacterium avium subsp. paratuberculosis
cuggaugcgccgugc

SEQ ID NO: 837850 - RNA, 14 nt, Mycobacterium avium subsp. paratuberculosis
cuggaugcggucgu

SEQ ID NO: 837851 - RNA, 16 nt, Mycobacterium avium subsp. paratuberculosis
cuggaugcggucgucg

SEQ ID NO: 837852 - RNA, 17 nt, Mycobacterium avium subsp. paratuberculosis
cuggaugcggucgucgc

SEQ ID NO: 837853 - RNA, 14 nt, Mycobacterium avium subsp. paratuberculosis
cuggacgccgugga

SEQ ID NO: 837854 - RNA, 14 nt, Mycobacterium avium subsp. paratuberculosis
cuggacggcccgac

SEQ ID NO: 837855 - RNA, 19 nt, Mycobacterium avium subsp. paratuberculosis
cuggacgguuucaccgccg

SEQ ID NO: 837856 - RNA, 14 nt, Mycobacterium avium subsp. paratuberculosis
cuggacgucgucgc

SEQ ID NO: 837857 - RNA, 17 nt, Mycobacterium avium subsp. paratuberculosis
cuggacgucgucgcugu

SEQ ID NO: 837858 - RNA, 16 nt, Mycobacterium avium subsp. paratuberculosis
cuggacuugcgucgcg

SEQ ID NO: 837859 - RNA, 18 nt, Mycobacterium avium subsp. paratuberculosis
cuggacuugcgucgcgau

SEQ ID NO: 837860 - RNA, 15 nt, Mycobacterium avium subsp. paratuberculosis
cuggagaggcccggc

SEQ ID NO: 837861 - RNA, 17 nt, Mycobacterium avium subsp. paratuberculosis
cuggacgccgcacgcga

SEQ ID NO: 837862 - RNA, 14 nt, Mycobacterium avium subsp. paratuberculosis
cuggacgaucggcu

SEQ ID NO: 837863 - RNA, 22 nt, Mycobacterium avium subsp. paratuberculosis
cuggacauucacgaggccgggc

SEQ ID NO: 837864 - RNA, 16 nt, Mycobacterium avium subsp. paratuberculosis
cuggaccaccaugaug

SEQ ID NO: 837865 - RNA, 16 nt, Mycobacterium avium subsp. paratuberculosis
cuggccaucgccgagc

SEQ ID NO: 837866 - RNA, 13 nt, Mycobacterium avium subsp. paratuberculosis
cuggccagcgcga

SEQ ID NO: 837867 - RNA, 20 nt, Mycobacterium avium subsp. paratuberculosis
cuggccagguauucgcggga

SEQ ID NO: 837868 - RNA, 19 nt, Mycobacterium avium subsp. paratuberculosis
cuggccagcgucagggcga

SEQ ID NO: 837869 - RNA, 20 nt, Mycobacterium avium subsp. paratuberculosis
cuggccgguauuggccacgc

SEQ ID NO: 837870 - RNA, 17 nt, Mycobacterium avium subsp. paratuberculosis
cuggccgccggccgcgc

SEQ ID NO: 837871 - RNA, 16 nt, Mycobacterium avium subsp. paratuberculosis
cuggccgaggccucca

SEQ ID NO: 837872 - RNA, 23 nt, Mycobacterium avium subsp. paratuberculosis
cuggccgaucccggccacgucga

SEQ ID NO: 837873 - RNA, 14 nt, Mycobacterium avium subsp. paratuberculosis
cuggccgcccacca

SEQ ID NO: 837874 - RNA, 18 nt, Mycobacterium avium subsp. paratuberculosis
cuggccgcccaccacgaa

SEQ ID NO: 837875 - RNA, 17 nt, Mycobacterium avium subsp. paratuberculosis
cuggccgcacggugcag

SEQ ID NO: 837876 - RNA, 18 nt, Mycobacterium avium subsp. paratuberculosis
cuggccgcacggugcagc

SEQ ID NO: 837877 - RNA, 16 nt, Mycobacterium avium subsp. paratuberculosis
cuggccgagcggcugc

SEQ ID NO: 837878 - RNA, 18 nt, Mycobacterium avium subsp. paratuberculosis
cuggccgaccccgaugcg

SEQ ID NO: 837879 - RNA, 13 nt, Mycobacterium avium subsp. paratuberculosis
cuggccgaccgcc

SEQ ID NO: 837880 - RNA, 17 nt, Mycobacterium avium subsp. paratuberculosis
cuggccgaccgccgcca

SEQ ID NO: 837881 - RNA, 16 nt, Mycobacterium avium subsp. paratuberculosis
cuggcccacgcagccg

SEQ ID NO: 837882 - RNA, 20 nt, Mycobacterium avium subsp. paratuberculosis
cuggcccacgcagccgucga

SEQ ID NO: 837883 - RNA, 19 nt, Mycobacterium avium subsp. paratuberculosis
cuggcccagacaggccggc

SEQ ID NO: 837884 - RNA, 20 nt, Mycobacterium avium subsp. paratuberculosis
cuggcccagacaggccggcc

SEQ ID NO: 837885 - RNA, 13 nt, Mycobacterium avium subsp. paratuberculosis
cugcuugaccgcg

SEQ ID NO: 837886 - RNA, 15 nt, Mycobacterium avium subsp. paratuberculosis
cugcuucgucgccgg

SEQ ID NO: 837887 - RNA, 21 nt, Mycobacterium avium subsp. paratuberculosis
cugcuugaugaugccggccgc

SEQ ID NO: 837888 - RNA, 15 nt, Mycobacterium avium subsp. paratuberculosis
cugcuucucgccguc

SEQ ID NO: 837889 - RNA, 19 nt, Mycobacterium avium subsp. paratuberculosis
cugcuuggcggccugcgcc

SEQ ID NO: 837890 - RNA, 22 nt, Mycobacterium avium subsp. paratuberculosis
cugcuugggcgccucgccgacc

SEQ ID NO: 837891 - RNA, 22 nt, Mycobacterium avium subsp. paratuberculosis
cugcuuggucgccugcacgaaa

SEQ ID NO: 837892 - RNA, 20 nt, Mycobacterium avium subsp. paratuberculosis
cugcuuggucuccggccccg

SEQ ID NO: 837893 - RNA, 18 nt, Mycobacterium avium subsp. paratuberculosis
cuggaacaccacggccgg

SEQ ID NO: 837894 - RNA, 18 nt, Mycobacterium avium subsp. paratuberculosis
cuggaacagcgggccggc

SEQ ID NO: 837895 - RNA, 19 nt, Mycobacterium avium subsp. paratuberculosis
cuggaacagguaguagcgc

SEQ ID NO: 837896 - RNA, 21 nt, Mycobacterium avium subsp. paratuberculosis
cuggaaccgaaucggucgacc

SEQ ID NO: 837897 - RNA, 19 nt, Mycobacterium avium subsp. paratuberculosis
cuggacagccacagcucgg

SEQ ID NO: 837898 - RNA, 22 nt, Mycobacterium avium subsp. paratuberculosis
cuggacagggucguucagcuga

SEQ ID NO: 837899 - RNA, 19 nt, Mycobacterium avium subsp. paratuberculosis
cuggacaccacgucgucgg

SEQ ID NO: 837900 - RNA, 20 nt, Mycobacterium avium subsp. paratuberculosis
cuggaagaagucggugucga

SEQ ID NO: 837901 - RNA, 21 nt, Mycobacterium avium subsp. paratuberculosis
cugcugcuucuggguguaggu

SEQ ID NO: 837902 - RNA, 14 nt, Mycobacterium avium subsp. paratuberculosis
cugcugggcgggca

SEQ ID NO: 837903 - RNA, 16 nt, Mycobacterium avium subsp. paratuberculosis
cugcugggcgggcagc

SEQ ID NO: 837904 - RNA, 20 nt, Mycobacterium avium subsp. paratuberculosis
cugcugggcguugccggucu

SEQ ID NO: 837905 - RNA, 16 nt, Mycobacterium avium subsp. paratuberculosis
cugcugggagcggccc

SEQ ID NO: 837906 - RNA, 17 nt, Mycobacterium avium subsp. paratuberculosis
cugcugggagcggccca

SEQ ID NO: 837907 - RNA, 17 nt, Mycobacterium avium subsp. paratuberculosis
cugcuggcguucgccga

SEQ ID NO: 837908 - RNA, 15 nt, Mycobacterium avium subsp. paratuberculosis
cugcugggcggcacc

SEQ ID NO: 837909 - RNA, 16 nt, Mycobacterium avium subsp. paratuberculosis
cugcuggucgacguca

SEQ ID NO: 837910 - RNA, 20 nt, Mycobacterium avium subsp. paratuberculosis
cugcuguucguccgugcugc

SEQ ID NO: 837911 - RNA, 18 nt, Mycobacterium avium subsp. paratuberculosis
aaccgcugcugcucggcc

SEQ ID NO: 837912 - RNA, 18 nt, Mycobacterium avium subsp. paratuberculosis
aaccgcugcggcacacca

SEQ ID NO: 837913 - RNA, 19 nt, Mycobacterium avium subsp. paratuberculosis
aaccgcugcuccggguccg

SEQ ID NO: 837914 - RNA, 13 nt, Mycobacterium avium subsp. paratuberculosis
aaccgcucggcga

SEQ ID NO: 837915 - RNA, 16 nt, Mycobacterium avium subsp. paratuberculosis
aaccgcucggcggcgc

SEQ ID NO: 837916 - RNA, 18 nt, Mycobacterium avium subsp. paratuberculosis
aaccgcucggcggcgccg

SEQ ID NO: 837917 - RNA, 17 nt, Mycobacterium avium subsp. paratuberculosis
cugcucgaaccgcgaga

SEQ ID NO: 837918 - RNA, 18 nt, Mycobacterium avium subsp. paratuberculosis
cugcucgaaccgcgagac

SEQ ID NO: 837919 - RNA, 21 nt, Mycobacterium avium subsp. paratuberculosis
cugcucgaaggcaacucgcga

SEQ ID NO: 837920 - RNA, 13 nt, Mycobacterium avium subsp. paratuberculosis
cugcucgaccagc

SEQ ID NO: 837921 - RNA, 15 nt, Mycobacterium avium subsp. paratuberculosis
cugcucgaccagcgc

SEQ ID NO: 837922 - RNA, 16 nt, Mycobacterium avium subsp. paratuberculosis
cugcucgaccagcgcc

SEQ ID NO: 837923 - RNA, 14 nt, Mycobacterium avium subsp. paratuberculosis
aaccggaugaugcc

SEQ ID NO: 837924 - RNA, 23 nt, Mycobacterium avium subsp. paratuberculosis
cugcucgaccucggcgaccagcg

SEQ ID NO: 837925 - RNA, 12 nt, Mycobacterium avium subsp. paratuberculosis
cugcucgacgua

SEQ ID NO: 837926 - RNA, 20 nt, Mycobacterium avium subsp. paratuberculosis
cugcucgacguagucgcgca

SEQ ID NO: 837927 - RNA, 22 nt, Mycobacterium avium subsp. paratuberculosis
cugcucgagcaucuccagccgg

SEQ ID NO: 837928 - RNA, 17 nt, Mycobacterium avium subsp. paratuberculosis
cugcucgccggcuaccg

SEQ ID NO: 837929 - RNA, 14 nt, Mycobacterium avium subsp. paratuberculosis
cugcucgcgcugcc

SEQ ID NO: 837930 - RNA, 20 nt, Mycobacterium avium subsp. paratuberculosis
cugcucgcgguuccugcgcu

SEQ ID NO: 837931 - RNA, 18 nt, Mycobacterium avium subsp. paratuberculosis
cugcucgcuugccagccg

SEQ ID NO: 837932 - RNA, 21 nt, Mycobacterium avium subsp. paratuberculosis
cugcucgaucucggccaccgu

SEQ ID NO: 837933 - RNA, 22 nt, Mycobacterium avium subsp. paratuberculosis
cugcucgagggccuccaccacc

SEQ ID NO: 837934 - RNA, 13 nt, Mycobacterium avium subsp. paratuberculosis
cugcucgccagac

SEQ ID NO: 837935 - RNA, 22 nt, Mycobacterium avium subsp. paratuberculosis
cugcucgccagacucacggcgg

SEQ ID NO: 837936 - RNA, 16 nt, Mycobacterium avium subsp. paratuberculosis
cugcucggcgacgcug

SEQ ID NO: 837937 - RNA, 23 nt, Mycobacterium avium subsp. paratuberculosis
cugcucggcgacgcugugcucgg

SEQ ID NO: 837938 - RNA, 15 nt, Mycobacterium avium subsp. paratuberculosis
cugcucggcggcuca

SEQ ID NO: 837939 - RNA, 13 nt, Mycobacterium avium subsp. paratuberculosis
cugcucggcgggc

SEQ ID NO: 837940 - RNA, 20 nt, Mycobacterium avium subsp. paratuberculosis
cugcucggcgggcucgcgcu

SEQ ID NO: 837941 - RNA, 20 nt, Mycobacterium avium subsp. paratuberculosis
cugcucggccaccgcgcggu

SEQ ID NO: 837942 - RNA, 24 nt, Mycobacterium avium subsp. paratuberculosis
cugcucggccaccgcgcggugcac

SEQ ID NO: 837943 - RNA, 16 nt, Mycobacterium avium subsp. paratuberculosis
cugcugcacgacgacc

SEQ ID NO: 837944 - RNA, 17 nt, Mycobacterium avium subsp. paratuberculosis
cugcugcacgacgaccg

SEQ ID NO: 837945 - RNA, 22 nt, Mycobacterium avium subsp. paratuberculosis
cugcugcacgacgaccgcgacg

SEQ ID NO: 837946 - RNA, 16 nt, Mycobacterium avium subsp. paratuberculosis
cugcugcacgucgccg

SEQ ID NO: 837947 - RNA, 17 nt, Mycobacterium avium subsp. paratuberculosis
cugcugcccgacuugcc

SEQ ID NO: 837948 - RNA, 20 nt, Mycobacterium avium subsp. paratuberculosis
cugcugccgccgcagcagcc

SEQ ID NO: 837949 - RNA, 16 nt, Mycobacterium avium subsp. paratuberculosis
cugcugcccgcgacgg

SEQ ID NO: 837950 - RNA, 16 nt, Mycobacterium avium subsp. paratuberculosis
cugcugcgggugcggc

SEQ ID NO: 837951 - RNA, 16 nt, Mycobacterium avium subsp. paratuberculosis
cugcugcucggccgca

SEQ ID NO: 837952 - RNA, 16 nt, Mycobacterium avium subsp. paratuberculosis
cugcugcucgucgcgg

SEQ ID NO: 837953 - RNA, 22 nt, Mycobacterium avium subsp. paratuberculosis
cugcugcucgucgcgggcgccg

SEQ ID NO: 837954 - RNA, 23 nt, Mycobacterium avium subsp. paratuberculosis
cugcugcucgucgcgggcgccga

SEQ ID NO: 837955 - RNA, 21 nt, Mycobacterium avium subsp. paratuberculosis
cugcugcgcggcacgggccgu

SEQ ID NO: 837956 - RNA, 19 nt, Mycobacterium avium subsp. paratuberculosis
cugcucggugaugccgagc

SEQ ID NO: 837957 - RNA, 20 nt, Mycobacterium avium subsp. paratuberculosis
cugcucggugaugccgagcg

SEQ ID NO: 837958 - RNA, 23 nt, Mycobacterium avium subsp. paratuberculosis
cugcucggugaugccgagcgccg

SEQ ID NO: 837959 - RNA, 17 nt, Mycobacterium avium subsp. paratuberculosis
cugcucggcgucgcacg

SEQ ID NO: 837960 - RNA, 14 nt, Mycobacterium avium subsp. paratuberculosis
cugcucgucgguga

SEQ ID NO: 837961 - RNA, 17 nt, Mycobacterium avium subsp. paratuberculosis
cugcucgucgacgcuga

SEQ ID NO: 837962 - RNA, 14 nt, Mycobacterium avium subsp. paratuberculosis
cugcucgucgcggg

SEQ ID NO: 837963 - RNA, 15 nt, Mycobacterium avium subsp. paratuberculosis
cugcucgucgcgggc

SEQ ID NO: 837964 - RNA, 14 nt, Mycobacterium avium subsp. paratuberculosis
cugcucgucggacu

SEQ ID NO: 837965 - RNA, 20 nt, Mycobacterium avium subsp. paratuberculosis
cugcucuucgguggugugga

SEQ ID NO: 837966 - RNA, 23 nt, Mycobacterium avium subsp. paratuberculosis
cugcucguucgucaugacgaaca

SEQ ID NO: 837967 - RNA, 17 nt, Mycobacterium avium subsp. paratuberculosis
cugcugaugcggacacc

SEQ ID NO: 837968 - RNA, 12 nt, Mycobacterium avium subsp. paratuberculosis
cugcgggcgggc

SEQ ID NO: 837969 - RNA, 19 nt, Mycobacterium avium subsp. paratuberculosis
cugcgggcgggccgccagg

SEQ ID NO: 837970 - RNA, 20 nt, Mycobacterium avium subsp. paratuberculosis
cugcgggcgggccgccaggu

SEQ ID NO: 837971 - RNA, 17 nt, Mycobacterium avium subsp. paratuberculosis
cugcggguucuggccgu

SEQ ID NO: 837972 - RNA, 22 nt, Mycobacterium avium subsp. paratuberculosis
cugcgggugcaacgugaugccg

SEQ ID NO: 837973 - RNA, 16 nt, Mycobacterium avium subsp. paratuberculosis
cugcgggugcggccag

SEQ ID NO: 837974 - RNA, 18 nt, Mycobacterium avium subsp. paratuberculosis
cugcgggugcggccagcg

SEQ ID NO: 837975 - RNA, 20 nt, Mycobacterium avium subsp. paratuberculosis
cugcgggugcggccagcgca

SEQ ID NO: 837976 - RNA, 20 nt, Mycobacterium avium subsp. paratuberculosis
cugcgguuggccggccgggc

SEQ ID NO: 837977 - RNA, 16 nt, Mycobacterium avium subsp. paratuberculosis
cugcgguucgggcccc

SEQ ID NO: 837978 - RNA, 18 nt, Mycobacterium avium subsp. paratuberculosis
cugcgguucgggccccau

SEQ ID NO: 837979 - RNA, 17 nt, Mycobacterium avium subsp. paratuberculosis
cugcgguucgucgcggc

SEQ ID NO: 837980 - RNA, 15 nt, Mycobacterium avium subsp. paratuberculosis
cugcggugagcguag

SEQ ID NO: 837981 - RNA, 23 nt, Mycobacterium avium subsp. paratuberculosis
cugcguccgauaccagccgcgga

SEQ ID NO: 837982 - RNA, 17 nt, Mycobacterium avium subsp. paratuberculosis
cugcguccggcccggcg

SEQ ID NO: 837983 - RNA, 17 nt, Mycobacterium avium subsp. paratuberculosis
cugcgucggcaccagcg

SEQ ID NO: 837984 - RNA, 16 nt, Mycobacterium avium subsp. paratuberculosis
cugcgucaucggcucg

SEQ ID NO: 837985 - RNA, 14 nt, Mycobacterium avium subsp. paratuberculosis
cugcgucaugccgu

SEQ ID NO: 837986 - RNA, 21 nt, Mycobacterium avium subsp. paratuberculosis
cugcgucauggagaucaccgc

SEQ ID NO: 837987 - RNA, 22 nt, Mycobacterium avium subsp. paratuberculosis
cugcgucauggagaucaccgcg

SEQ ID NO: 837988 - RNA, 23 nt, Mycobacterium avium subsp. paratuberculosis
cugcuccucggucagcggcgugc

SEQ ID NO: 837989 - RNA, 13 nt, Mycobacterium avium subsp. paratuberculosis
cugcucagcggcc

SEQ ID NO: 837990 - RNA, 18 nt, Mycobacterium avium subsp. paratuberculosis
cugcuccgggggcaccgc

SEQ ID NO: 837991 - RNA, 14 nt, Mycobacterium avium subsp. paratuberculosis
cugcuccggggugg

SEQ ID NO: 837992 - RNA, 23 nt, Mycobacterium avium subsp. paratuberculosis
cugcuccggguccgcggugaugc

SEQ ID NO: 837993 - RNA, 23 nt, Mycobacterium avium subsp. paratuberculosis
cugcuccggugaaccgcugacca

SEQ ID NO: 837994 - RNA, 18 nt, Mycobacterium avium subsp. paratuberculosis
cugcucaugagcccucca

SEQ ID NO: 837995 - RNA, 17 nt, Mycobacterium avium subsp. paratuberculosis
cugcucccaggacggcg

SEQ ID NO: 837996 - RNA, 20 nt, Mycobacterium avium subsp. paratuberculosis
cugcucccaggacggcgcgg

SEQ ID NO: 837997 - RNA, 21 nt, Mycobacterium avium subsp. paratuberculosis
cugcucccaggacggcgcggu

SEQ ID NO: 837998 - RNA, 23 nt, Mycobacterium avium subsp. paratuberculosis
cugcucccaggacggcgcggugg

SEQ ID NO: 837999 - RNA, 19 nt, Mycobacterium avium subsp. paratuberculosis
cugcucccaggcgucgucg

SEQ ID NO: 838000 - RNA, 17 nt, Mycobacterium avium subsp. paratuberculosis
cugcgugaaugggugua

SEQ ID NO: 838001 - RNA, 16 nt, Mycobacterium avium subsp. paratuberculosis
cugcguguggcgcacg

SEQ ID NO: 838002 - RNA, 14 nt, Mycobacterium avium subsp. paratuberculosis
cugcgugcgggugg

SEQ ID NO: 838003 - RNA, 20 nt, Mycobacterium avium subsp. paratuberculosis
cugcgugcggguggccgggu

SEQ ID NO: 838004 - RNA, 15 nt, Mycobacterium avium subsp. paratuberculosis
cugcguucggcgauc

SEQ ID NO: 838005 - RNA, 15 nt, Mycobacterium avium subsp. paratuberculosis
cugcguugcggcaca

SEQ ID NO: 838006 - RNA, 17 nt, Mycobacterium avium subsp. paratuberculosis
cugaaagcucgcgucga

SEQ ID NO: 838007 - RNA, 17 nt, Mycobacterium avium subsp. paratuberculosis
cugaaagccgaggcgca

SEQ ID NO: 838008 - RNA, 17 nt, Mycobacterium avium subsp. paratuberculosis
cugaaaugccgggccgg

SEQ ID NO: 838009 - RNA, 13 nt, Mycobacterium avium subsp. paratuberculosis
cugccgagcaccu

SEQ ID NO: 838010 - RNA, 16 nt, Mycobacterium avium subsp. paratuberculosis
cugccgccgcccaggc

SEQ ID NO: 838011 - RNA, 17 nt, Mycobacterium avium subsp. paratuberculosis
cugccgccgcccaggcc

SEQ ID NO: 838012 - RNA, 19 nt, Mycobacterium avium subsp. paratuberculosis
cugccgccgcccaggccga

SEQ ID NO: 838013 - RNA, 22 nt, Mycobacterium avium subsp. paratuberculosis
cugccgccgccgcugucgaugg

SEQ ID NO: 838014 - RNA, 12 nt, Mycobacterium avium subsp. paratuberculosis
cugccgccaccg

SEQ ID NO: 838015 - RNA, 13 nt, Mycobacterium avium subsp. paratuberculosis
cugccgccaccgc

SEQ ID NO: 838016 - RNA, 16 nt, Mycobacterium avium subsp. paratuberculosis
cugccgccaccgcgaa

SEQ ID NO: 838017 - RNA, 20 nt, Mycobacterium avium subsp. paratuberculosis
cugccgaugcugagcggguc

SEQ ID NO: 838018 - RNA, 20 nt, Mycobacterium avium subsp. paratuberculosis
cugccgcaacgggccgcagc

SEQ ID NO: 838019 - RNA, 13 nt, Mycobacterium avium subsp. paratuberculosis
cugccggacaccc

SEQ ID NO: 838020 - RNA, 15 nt, Mycobacterium avium subsp. paratuberculosis
cugccggacaccccg

SEQ ID NO: 838021 - RNA, 16 nt, Mycobacterium avium subsp. paratuberculosis
cugccggacaccccgg

SEQ ID NO: 838022 - RNA, 17 nt, Mycobacterium avium subsp. paratuberculosis
cugccggacaccccggc

SEQ ID NO: 838023 - RNA, 20 nt, Mycobacterium avium subsp. paratuberculosis
cugccggacaccccggccag

SEQ ID NO: 838024 - RNA, 19 nt, Mycobacterium avium subsp. paratuberculosis
cugccggaccucgaccagc

SEQ ID NO: 838025 - RNA, 21 nt, Mycobacterium avium subsp. paratuberculosis
cugccggaugccgcgcggcgc

SEQ ID NO: 838026 - RNA, 23 nt, Mycobacterium avium subsp. paratuberculosis
cugccggaugccgcgcggcgcca

SEQ ID NO: 838027 - RNA, 24 nt, Mycobacterium avium subsp. paratuberculosis
cugccggaugccgcgcggcgccag

SEQ ID NO: 838028 - RNA, 16 nt, Mycobacterium avium subsp. paratuberculosis
cugccgcuggcgucga

SEQ ID NO: 838029 - RNA, 19 nt, Mycobacterium avium subsp. paratuberculosis
cugccgcuggcgucgaucg

SEQ ID NO: 838030 - RNA, 18 nt, Mycobacterium avium subsp. paratuberculosis
cugccgcgcgccgacaga

SEQ ID NO: 838031 - RNA, 23 nt, Mycobacterium avium subsp. paratuberculosis
cugccgcgccccgagcagcgggu

SEQ ID NO: 838032 - RNA, 13 nt, Mycobacterium avium subsp. paratuberculosis
cugccgcgccgcc

SEQ ID NO: 838033 - RNA, 16 nt, Mycobacterium avium subsp. paratuberculosis
cugccggggcgcagcu

SEQ ID NO: 838034 - RNA, 22 nt, Mycobacterium avium subsp. paratuberculosis
cugccggggcgcagcugcagcu

SEQ ID NO: 838035 - RNA, 14 nt, Mycobacterium avium subsp. paratuberculosis
cugccggggugcag

SEQ ID NO: 838036 - RNA, 13 nt, Mycobacterium avium subsp. paratuberculosis
cugccggcggccg

SEQ ID NO: 838037 - RNA, 16 nt, Mycobacterium avium subsp. paratuberculosis
cugccggcggccgccg

SEQ ID NO: 838038 - RNA, 12 nt, Mycobacterium avium subsp. paratuberculosis
cugccggccguu

SEQ ID NO: 838039 - RNA, 14 nt, Mycobacterium avium subsp. paratuberculosis
cugccggcgccgga

SEQ ID NO: 838040 - RNA, 14 nt, Mycobacterium avium subsp. paratuberculosis
cugccggccggcag

SEQ ID NO: 838041 - RNA, 15 nt, Mycobacterium avium subsp. paratuberculosis
cugccggccggcagc

SEQ ID NO: 838042 - RNA, 19 nt, Mycobacterium avium subsp. paratuberculosis
cugccggccggcagcugcc

SEQ ID NO: 838043 - RNA, 15 nt, Mycobacterium avium subsp. paratuberculosis
cugccggcgaccagc

SEQ ID NO: 838044 - RNA, 16 nt, Mycobacterium avium subsp. paratuberculosis
cugccggcgaccagcc

SEQ ID NO: 838045 - RNA, 15 nt, Mycobacterium avium subsp. paratuberculosis
cugccggcgcacccg

SEQ ID NO: 838046 - RNA, 13 nt, Mycobacterium avium subsp. paratuberculosis
cugccggccgccg

SEQ ID NO: 838047 - RNA, 14 nt, Mycobacterium avium subsp. paratuberculosis
cugccggccgccgu

SEQ ID NO: 838048 - RNA, 23 nt, Mycobacterium avium subsp. paratuberculosis
cugccggcauaggccagcaccag

SEQ ID NO: 838049 - RNA, 21 nt, Mycobacterium avium subsp. paratuberculosis
cugccuggcgaacucgcgcag

SEQ ID NO: 838050 - RNA, 17 nt, Mycobacterium avium subsp. paratuberculosis
cugccuacuugcggccg

SEQ ID NO: 838051 - RNA, 18 nt, Mycobacterium avium subsp. paratuberculosis
cugccuacuugcggccgc

SEQ ID NO: 838052 - RNA, 20 nt, Mycobacterium avium subsp. paratuberculosis
cugccuacuugcggccgcga

SEQ ID NO: 838053 - RNA, 23 nt, Mycobacterium avium subsp. paratuberculosis
cugccuacuugcggccgcgacgc

SEQ ID NO: 838054 - RNA, 19 nt, Mycobacterium avium subsp. paratuberculosis
cugccguugcgccagcggg

SEQ ID NO: 838055 - RNA, 19 nt, Mycobacterium avium subsp. paratuberculosis
cugccguugggcacggugu

SEQ ID NO: 838056 - RNA, 21 nt, Mycobacterium avium subsp. paratuberculosis
cugccguugggcacgguguag

SEQ ID NO: 838057 - RNA, 22 nt, Mycobacterium avium subsp. paratuberculosis
cugccguugauugaccauccgg

SEQ ID NO: 838058 - RNA, 15 nt, Mycobacterium avium subsp. paratuberculosis
cugccguucgccggu

SEQ ID NO: 838059 - RNA, 14 nt, Mycobacterium avium subsp. paratuberculosis
cugccguucggcca

SEQ ID NO: 838060 - RNA, 14 nt, Mycobacterium avium subsp. paratuberculosis
cugccgugccgauu

SEQ ID NO: 838061 - RNA, 15 nt, Mycobacterium avium subsp. paratuberculosis
cugccguccacccgg

SEQ ID NO: 838062 - RNA, 16 nt, Mycobacterium avium subsp. paratuberculosis
cugccguccacccggc

SEQ ID NO: 838063 - RNA, 19 nt, Mycobacterium avium subsp. paratuberculosis
cugccguccggguccggcu

SEQ ID NO: 838064 - RNA, 19 nt, Mycobacterium avium subsp. paratuberculosis
cugccgucgacgaccacca

SEQ ID NO: 838065 - RNA, 14 nt, Mycobacterium avium subsp. paratuberculosis
cugccgggcggcga

SEQ ID NO: 838066 - RNA, 16 nt, Mycobacterium avium subsp. paratuberculosis
cugccgggcggcgacg

SEQ ID NO: 838067 - RNA, 16 nt, Mycobacterium avium subsp. paratuberculosis
cugccgggcgucgacg

SEQ ID NO: 838068 - RNA, 14 nt, Mycobacterium avium subsp. paratuberculosis
cugccggucgaugu

SEQ ID NO: 838069 - RNA, 15 nt, Mycobacterium avium subsp. paratuberculosis
cugccggugccgccg

SEQ ID NO: 838070 - RNA, 16 nt, Mycobacterium avium subsp. paratuberculosis
cugccggugccgccgg

SEQ ID NO: 838071 - RNA, 17 nt, Mycobacterium avium subsp. paratuberculosis
cugccggugccgccggc

SEQ ID NO: 838072 - RNA, 13 nt, Mycobacterium avium subsp. paratuberculosis
cugccgguggccu

SEQ ID NO: 838073 - RNA, 17 nt, Mycobacterium avium subsp. paratuberculosis
cugccgguggucccggu

SEQ ID NO: 838074 - RNA, 17 nt, Mycobacterium avium subsp. paratuberculosis
cugccguagaaccgcuc

SEQ ID NO: 838075 - RNA, 14 nt, Mycobacterium avium subsp. paratuberculosis
cugccguagcgcug

SEQ ID NO: 838076 - RNA, 16 nt, Mycobacterium avium subsp. paratuberculosis
cugccguagcgcuggg

SEQ ID NO: 838077 - RNA, 17 nt, Mycobacterium avium subsp. paratuberculosis
cugcgaaucgucggcga

SEQ ID NO: 838078 - RNA, 20 nt, Mycobacterium avium subsp. paratuberculosis
cugcgaaucgucggcgaugg

SEQ ID NO: 838079 - RNA, 20 nt, Mycobacterium avium subsp. paratuberculosis
cugcgacagcacgggcgggc

SEQ ID NO: 838080 - RNA, 15 nt, Mycobacterium avium subsp. paratuberculosis
cugcgacaggucggc

SEQ ID NO: 838081 - RNA, 19 nt, Mycobacterium avium subsp. paratuberculosis
cugcgauugguggcccggu

SEQ ID NO: 838082 - RNA, 14 nt, Mycobacterium avium subsp. paratuberculosis
cugcgaucgccgac

SEQ ID NO: 838083 - RNA, 15 nt, Mycobacterium avium subsp. paratuberculosis
cugcgaucgccgacg

SEQ ID NO: 838084 - RNA, 23 nt, Mycobacterium avium subsp. paratuberculosis
cugcgaucgccgacgccagcacg

SEQ ID NO: 838085 - RNA, 13 nt, Mycobacterium avium subsp. paratuberculosis
cugcgagcccggc

SEQ ID NO: 838086 - RNA, 17 nt, Mycobacterium avium subsp. paratuberculosis
cugcgagaugcccaccc

SEQ ID NO: 838087 - RNA, 14 nt, Mycobacterium avium subsp. paratuberculosis
cugcgaccgccgcc

SEQ ID NO: 838088 - RNA, 15 nt, Mycobacterium avium subsp. paratuberculosis
cugcgaccgccgccg

SEQ ID NO: 838089 - RNA, 16 nt, Mycobacterium avium subsp. paratuberculosis
cugcgaccacccggac

SEQ ID NO: 838090 - RNA, 16 nt, Mycobacterium avium subsp. paratuberculosis
cugcgacccaccgucg

SEQ ID NO: 838091 - RNA, 21 nt, Mycobacterium avium subsp. paratuberculosis
cugcgacggaucugcucgugc

SEQ ID NO: 838092 - RNA, 20 nt, Mycobacterium avium subsp. paratuberculosis
cugcgcaacaccucggcgac

SEQ ID NO: 838093 - RNA, 22 nt, Mycobacterium avium subsp. paratuberculosis
cugcgcaacaccucggcgacgu

SEQ ID NO: 838094 - RNA, 14 nt, Mycobacterium avium subsp. paratuberculosis
cugcgcacccgguc

SEQ ID NO: 838095 - RNA, 13 nt, Mycobacterium avium subsp. paratuberculosis
cugcgcaccgcca

SEQ ID NO: 838096 - RNA, 21 nt, Mycobacterium avium subsp. paratuberculosis
cugcgcaccgccagcaccgac

SEQ ID NO: 838097 - RNA, 13 nt, Mycobacterium avium subsp. paratuberculosis
cugcgcacguagc

SEQ ID NO: 838098 - RNA, 18 nt, Mycobacterium avium subsp. paratuberculosis
cugcgcacguagcccagc

SEQ ID NO: 838099 - RNA, 13 nt, Mycobacterium avium subsp. paratuberculosis
cugcgcagcaccg

SEQ ID NO: 838100 - RNA, 15 nt, Mycobacterium avium subsp. paratuberculosis
cugcgcagcagcgcc

SEQ ID NO: 838101 - RNA, 16 nt, Mycobacterium avium subsp. paratuberculosis
cugcgcagcagcgcca

SEQ ID NO: 838102 - RNA, 21 nt, Mycobacterium avium subsp. paratuberculosis
cugcgcagcagcgccagcagc

SEQ ID NO: 838103 - RNA, 12 nt, Mycobacterium avium subsp. paratuberculosis
cugcgccacaac

SEQ ID NO: 838104 - RNA, 22 nt, Mycobacterium avium subsp. paratuberculosis
cugcgccacaacuggccgggau

SEQ ID NO: 838105 - RNA, 21 nt, Mycobacterium avium subsp. paratuberculosis
cugcgccagcagcagcgcggc

SEQ ID NO: 838106 - RNA, 22 nt, Mycobacterium avium subsp. paratuberculosis
cugcgccagcagcagcgcggca

SEQ ID NO: 838107 - RNA, 16 nt, Mycobacterium avium subsp. paratuberculosis
cugcgccagcuccagc

SEQ ID NO: 838108 - RNA, 16 nt, Mycobacterium avium subsp. paratuberculosis
cugcgcaucgagcugc

SEQ ID NO: 838109 - RNA, 15 nt, Mycobacterium avium subsp. paratuberculosis
cugcgcccgccgcca

SEQ ID NO: 838110 - RNA, 14 nt, Mycobacterium avium subsp. paratuberculosis
cugcgccccggcgu

SEQ ID NO: 838111 - RNA, 17 nt, Mycobacterium avium subsp. paratuberculosis
cugcgccccggcgucga

SEQ ID NO: 838112 - RNA, 19 nt, Mycobacterium avium subsp. paratuberculosis
cugcgcccgaucggcguga

SEQ ID NO: 838113 - RNA, 15 nt, Mycobacterium avium subsp. paratuberculosis
cugcgcccagcgcgc

SEQ ID NO: 838114 - RNA, 14 nt, Mycobacterium avium subsp. paratuberculosis
cugcgccagccguc

SEQ ID NO: 838115 - RNA, 16 nt, Mycobacterium avium subsp. paratuberculosis
cugcgccaggauccgc

SEQ ID NO: 838116 - RNA, 23 nt, Mycobacterium avium subsp. paratuberculosis
cugcgccgacuugaucgcggcgu

SEQ ID NO: 838117 - RNA, 16 nt, Mycobacterium avium subsp. paratuberculosis
cugcgccggcgcggcc

SEQ ID NO: 838118 - RNA, 13 nt, Mycobacterium avium subsp. paratuberculosis
cugcgccgcggug

SEQ ID NO: 838119 - RNA, 14 nt, Mycobacterium avium subsp. paratuberculosis
cugcgccgcggugc

SEQ ID NO: 838120 - RNA, 15 nt, Mycobacterium avium subsp. paratuberculosis
cugcgccgcggugcg

SEQ ID NO: 838121 - RNA, 16 nt, Mycobacterium avium subsp. paratuberculosis
cugcgccgcgucgacg

SEQ ID NO: 838122 - RNA, 16 nt, Mycobacterium avium subsp. paratuberculosis
cugcgccgucaccggc

SEQ ID NO: 838123 - RNA, 18 nt, Mycobacterium avium subsp. paratuberculosis
cugcgccgucaccggcug

SEQ ID NO: 838124 - RNA, 20 nt, Mycobacterium avium subsp. paratuberculosis
cugcgccgucaccggcugcc

SEQ ID NO: 838125 - RNA, 14 nt, Mycobacterium avium subsp. paratuberculosis
cugcgccggggccg

SEQ ID NO: 838126 - RNA, 18 nt, Mycobacterium avium subsp. paratuberculosis
cugcgccggggccgcggc

SEQ ID NO: 838127 - RNA, 17 nt, Mycobacterium avium subsp. paratuberculosis
cugcgccucgaucagcg

SEQ ID NO: 838128 - RNA, 20 nt, Mycobacterium avium subsp. paratuberculosis
cugcgccucgaucagcgcga

SEQ ID NO: 838129 - RNA, 16 nt, Mycobacterium avium subsp. paratuberculosis
cugcgcgccggcggcc

SEQ ID NO: 838130 - RNA, 18 nt, Mycobacterium avium subsp. paratuberculosis
cugcgcgccggcggccgc

SEQ ID NO: 838131 - RNA, 14 nt, Mycobacterium avium subsp. paratuberculosis
cugcgcgccgucgg

SEQ ID NO: 838132 - RNA, 22 nt, Mycobacterium avium subsp. paratuberculosis
cugcgcgccgcccucgccgaac

SEQ ID NO: 838133 - RNA, 15 nt, Mycobacterium avium subsp. paratuberculosis
cugcgcgccgauccg

SEQ ID NO: 838134 - RNA, 23 nt, Mycobacterium avium subsp. paratuberculosis
cugcgcgccgauguggccggcga

SEQ ID NO: 838135 - RNA, 13 nt, Mycobacterium avium subsp. paratuberculosis
cugcgcgaucgcc

SEQ ID NO: 838136 - RNA, 17 nt, Mycobacterium avium subsp. paratuberculosis
cugcgcgaucgccggau

SEQ ID NO: 838137 - RNA, 20 nt, Mycobacterium avium subsp. paratuberculosis
cugcgcgaucgccggaucgg

SEQ ID NO: 838138 - RNA, 16 nt, Mycobacterium avium subsp. paratuberculosis
cugcgcgaugucgacg

SEQ ID NO: 838139 - RNA, 17 nt, Mycobacterium avium subsp. paratuberculosis
cugcgcgaugucgacgg

SEQ ID NO: 838140 - RNA, 14 nt, Mycobacterium avium subsp. paratuberculosis
cugcgcgccccggc

SEQ ID NO: 838141 - RNA, 18 nt, Mycobacterium avium subsp. paratuberculosis
cugcgcgccccggcccgg

SEQ ID NO: 838142 - RNA, 12 nt, Mycobacterium avium subsp. paratuberculosis
cugcgcgcccga

SEQ ID NO: 838143 - RNA, 14 nt, Mycobacterium avium subsp. paratuberculosis
cugcgcgcccgagc

SEQ ID NO: 838144 - RNA, 19 nt, Mycobacterium avium subsp. paratuberculosis
cugcgcgacgcugauggcg

SEQ ID NO: 838145 - RNA, 20 nt, Mycobacterium avium subsp. paratuberculosis
cugcgcgacgcugauggcga

SEQ ID NO: 838146 - RNA, 13 nt, Mycobacterium avium subsp. paratuberculosis
cugcgcgacggcg

SEQ ID NO: 838147 - RNA, 20 nt, Mycobacterium avium subsp. paratuberculosis
cugcgcgaaaggcccaccgc

SEQ ID NO: 838148 - RNA, 16 nt, Mycobacterium avium subsp. paratuberculosis
cugcgcgaacagcgaa

SEQ ID NO: 838149 - RNA, 23 nt, Mycobacterium avium subsp. paratuberculosis
cugcgcgaacagcgaagccacgg

SEQ ID NO: 838150 - RNA, 12 nt, Mycobacterium avium subsp. paratuberculosis
cugcggaucgcg

SEQ ID NO: 838151 - RNA, 19 nt, Mycobacterium avium subsp. paratuberculosis
cugcggaucgcgggcgacc

SEQ ID NO: 838152 - RNA, 15 nt, Mycobacterium avium subsp. paratuberculosis
cugcggauccgacga

SEQ ID NO: 838153 - RNA, 16 nt, Mycobacterium avium subsp. paratuberculosis
cugcggauccgacgaa

SEQ ID NO: 838154 - RNA, 18 nt, Mycobacterium avium subsp. paratuberculosis
cugcggauccgacgaacc

SEQ ID NO: 838155 - RNA, 16 nt, Mycobacterium avium subsp. paratuberculosis
cugcggcaacagcacc

SEQ ID NO: 838156 - RNA, 16 nt, Mycobacterium avium subsp. paratuberculosis
cugcggcacaccagcg

SEQ ID NO: 838157 - RNA, 19 nt, Mycobacterium avium subsp. paratuberculosis
cugcggcagaccgguggcg

SEQ ID NO: 838158 - RNA, 20 nt, Mycobacterium avium subsp. paratuberculosis
cugcggcagaccgguggcga

SEQ ID NO: 838159 - RNA, 14 nt, Mycobacterium avium subsp. paratuberculosis
cugcggcaaugccg

SEQ ID NO: 838160 - RNA, 13 nt, Mycobacterium avium subsp. paratuberculosis
cugcggccgcgac

SEQ ID NO: 838161 - RNA, 16 nt, Mycobacterium avium subsp. paratuberculosis
cugcggccgcgacugc

SEQ ID NO: 838162 - RNA, 16 nt, Mycobacterium avium subsp. paratuberculosis
cugcggcccgucgccg

SEQ ID NO: 838163 - RNA, 12 nt, Mycobacterium avium subsp. paratuberculosis
cugcggccgcga

SEQ ID NO: 838164 - RNA, 13 nt, Mycobacterium avium subsp. paratuberculosis
cugcggccggggc

SEQ ID NO: 838165 - RNA, 21 nt, Mycobacterium avium subsp. paratuberculosis
cugcggcaggucggccagcgc

SEQ ID NO: 838166 - RNA, 23 nt, Mycobacterium avium subsp. paratuberculosis
cugcggcaggucggccagcgccg

SEQ ID NO: 838167 - RNA, 18 nt, Mycobacterium avium subsp. paratuberculosis
cugcggccagugccgggc

SEQ ID NO: 838168 - RNA, 20 nt, Mycobacterium avium subsp. paratuberculosis
cugcggccagugccgggcca

SEQ ID NO: 838169 - RNA, 21 nt, Mycobacterium avium subsp. paratuberculosis
cugcggccagugccgggccag

SEQ ID NO: 838170 - RNA, 23 nt, Mycobacterium avium subsp. paratuberculosis
cugcggcugcaucaugccgccca

SEQ ID NO: 838171 - RNA, 12 nt, Mycobacterium avium subsp. paratuberculosis
cugcggcucggc

SEQ ID NO: 838172 - RNA, 16 nt, Mycobacterium avium subsp. paratuberculosis
cugcggcucggcgcug

SEQ ID NO: 838173 - RNA, 13 nt, Mycobacterium avium subsp. paratuberculosis
cugcggcucgucg

SEQ ID NO: 838174 - RNA, 14 nt, Mycobacterium avium subsp. paratuberculosis
cugcggcucgucgg

SEQ ID NO: 838175 - RNA, 17 nt, Mycobacterium avium subsp. paratuberculosis
cugcggcucgucggcga

SEQ ID NO: 838176 - RNA, 21 nt, Mycobacterium avium subsp. paratuberculosis
cugcggcucgucggcgaacag

SEQ ID NO: 838177 - RNA, 19 nt, Mycobacterium avium subsp. paratuberculosis
cugcgggcccagcucggug

SEQ ID NO: 838178 - RNA, 13 nt, Mycobacterium avium subsp. paratuberculosis
cugcgggccagcg

SEQ ID NO: 838179 - RNA, 19 nt, Mycobacterium avium subsp. paratuberculosis
cugcgggccaggcgggacg

SEQ ID NO: 838180 - RNA, 18 nt, Mycobacterium avium subsp. paratuberculosis
cugcgggccaucgacucc

SEQ ID NO: 838181 - RNA, 17 nt, Mycobacterium avium subsp. paratuberculosis
cugcgggaagcccaccg

SEQ ID NO: 838182 - RNA, 18 nt, Mycobacterium avium subsp. paratuberculosis
cugcgggaagcccaccgc

SEQ ID NO: 838183 - RNA, 16 nt, Mycobacterium avium subsp. paratuberculosis
cugcgggaccagcgcc

SEQ ID NO: 838184 - RNA, 20 nt, Mycobacterium avium subsp. paratuberculosis
cugcgggaccagcgccucgg

SEQ ID NO: 838185 - RNA, 13 nt, Mycobacterium avium subsp. paratuberculosis
cugcgggacgccg

SEQ ID NO: 838186 - RNA, 17 nt, Mycobacterium avium subsp. paratuberculosis
cugcggcggccgcagcg

SEQ ID NO: 838187 - RNA, 12 nt, Mycobacterium avium subsp. paratuberculosis
cugcggcgcggc

SEQ ID NO: 838188 - RNA, 21 nt, Mycobacterium avium subsp. paratuberculosis
cugcggcgcggccaccccggu

SEQ ID NO: 838189 - RNA, 15 nt, Mycobacterium avium subsp. paratuberculosis
cugcggcgccgggca

SEQ ID NO: 838190 - RNA, 18 nt, Mycobacterium avium subsp. paratuberculosis
cugcggauaaccguccac

SEQ ID NO: 838191 - RNA, 17 nt, Mycobacterium avium subsp. paratuberculosis
cugcggaaaugcccgcg

SEQ ID NO: 838192 - RNA, 23 nt, Mycobacterium avium subsp. paratuberculosis
cugcggaaaugcccgcgccccgg

SEQ ID NO: 838193 - RNA, 21 nt, Mycobacterium avium subsp. paratuberculosis
cugcggaaucacuuccgcggc

SEQ ID NO: 838194 - RNA, 22 nt, Mycobacterium avium subsp. paratuberculosis
cugcggaaucacuuccgcggca

SEQ ID NO: 838195 - RNA, 14 nt, Mycobacterium avium subsp. paratuberculosis
cugcgcuugcggcg

SEQ ID NO: 838196 - RNA, 17 nt, Mycobacterium avium subsp. paratuberculosis
cugcgcuugcggcgcag

SEQ ID NO: 838197 - RNA, 18 nt, Mycobacterium avium subsp. paratuberculosis
cugcgcuugcggcgcagc

SEQ ID NO: 838198 - RNA, 22 nt, Mycobacterium avium subsp. paratuberculosis
cugcgcuugcggcgcagccagc

SEQ ID NO: 838199 - RNA, 13 nt, Mycobacterium avium subsp. paratuberculosis
cugcgcgcggugc

SEQ ID NO: 838200 - RNA, 13 nt, Mycobacterium avium subsp. paratuberculosis
cugcgcggcggcg

SEQ ID NO: 838201 - RNA, 14 nt, Mycobacterium avium subsp. paratuberculosis
cugcgcggcggcgu

SEQ ID NO: 838202 - RNA, 20 nt, Mycobacterium avium subsp. paratuberculosis
cugcgcgcgcgaucgguguc

SEQ ID NO: 838203 - RNA, 14 nt, Mycobacterium avium subsp. paratuberculosis
cugcgcggccgaac

SEQ ID NO: 838204 - RNA, 15 nt, Mycobacterium avium subsp. paratuberculosis
cugcgcggccgcguc

SEQ ID NO: 838205 - RNA, 13 nt, Mycobacterium avium subsp. paratuberculosis
cugcgcggccggc

SEQ ID NO: 838206 - RNA, 15 nt, Mycobacterium avium subsp. paratuberculosis
cugcgcggccggcgu

SEQ ID NO: 838207 - RNA, 17 nt, Mycobacterium avium subsp. paratuberculosis
cugcgcggccggcgugu

SEQ ID NO: 838208 - RNA, 16 nt, Mycobacterium avium subsp. paratuberculosis
cugcgcggccugcagc

SEQ ID NO: 838209 - RNA, 22 nt, Mycobacterium avium subsp. paratuberculosis
cugcgcggccugcagcaccgaa

SEQ ID NO: 838210 - RNA, 17 nt, Mycobacterium avium subsp. paratuberculosis
cugcgcguucggcgcca

SEQ ID NO: 838211 - RNA, 13 nt, Mycobacterium avium subsp. paratuberculosis
cugcgcgucgagc

SEQ ID NO: 838212 - RNA, 23 nt, Mycobacterium avium subsp. paratuberculosis
cugcgcgucgagcagcaccaccc

SEQ ID NO: 838213 - RNA, 14 nt, Mycobacterium avium subsp. paratuberculosis
cugcgcgucggccg

SEQ ID NO: 838214 - RNA, 19 nt, Mycobacterium avium subsp. paratuberculosis
cugcgcgggucggcgccgg

SEQ ID NO: 838215 - RNA, 13 nt, Mycobacterium avium subsp. paratuberculosis
cugcgcgguggcg

SEQ ID NO: 838216 - RNA, 17 nt, Mycobacterium avium subsp. paratuberculosis
cugcgcgguggcgcggg

SEQ ID NO: 838217 - RNA, 18 nt, Mycobacterium avium subsp. paratuberculosis
cugcgcgguggcgcgggu

SEQ ID NO: 838218 - RNA, 11 nt, Mycobacterium avium subsp. paratuberculosis
cugcgcgucga

SEQ ID NO: 838219 - RNA, 17 nt, Mycobacterium avium subsp. paratuberculosis
cugcgcgggcgcggaca

SEQ ID NO: 838220 - RNA, 17 nt, Mycobacterium avium subsp. paratuberculosis
cugcgcgggcgcggcca

SEQ ID NO: 838221 - RNA, 22 nt, Mycobacterium avium subsp. paratuberculosis
cugcgcgggcgcggccagcgcg

SEQ ID NO: 838222 - RNA, 23 nt, Mycobacterium avium subsp. paratuberculosis
cugcgcgggcgcggccagcgcga

SEQ ID NO: 838223 - RNA, 16 nt, Mycobacterium avium subsp. paratuberculosis
cuucacgugcgcggcg

SEQ ID NO: 838224 - RNA, 14 nt, Mycobacterium avium subsp. paratuberculosis
cuuccaucacgccc

SEQ ID NO: 838225 - RNA, 14 nt, Mycobacterium avium subsp. paratuberculosis
cuuccaucgacgcu

SEQ ID NO: 838226 - RNA, 21 nt, Mycobacterium avium subsp. paratuberculosis
cuucccaaccccgggcggcuc

SEQ ID NO: 838227 - RNA, 13 nt, Mycobacterium avium subsp. paratuberculosis
cuuccccggcggc

SEQ ID NO: 838228 - RNA, 14 nt, Mycobacterium avium subsp. paratuberculosis
cuuccccggcggcc

SEQ ID NO: 838229 - RNA, 20 nt, Mycobacterium avium subsp. paratuberculosis
cuuccgaucaacggcagcga

SEQ ID NO: 838230 - RNA, 17 nt, Mycobacterium avium subsp. paratuberculosis
cuuccgagccggugaug

SEQ ID NO: 838231 - RNA, 20 nt, Mycobacterium avium subsp. paratuberculosis
cuuccgugcuugcccgacga

SEQ ID NO: 838232 - RNA, 13 nt, Mycobacterium avium subsp. paratuberculosis
cuucccgccgccg

SEQ ID NO: 838233 - RNA, 18 nt, Mycobacterium avium subsp. paratuberculosis
cuuccgaaccgcacgagc

SEQ ID NO: 838234 - RNA, 23 nt, Mycobacterium avium subsp. paratuberculosis
cuuccugggacagccggucgacg

SEQ ID NO: 838235 - RNA, 15 nt, Mycobacterium avium subsp. paratuberculosis
cuuccuccucggcgc

SEQ ID NO: 838236 - RNA, 18 nt, Mycobacterium avium subsp. paratuberculosis
cuuccucggcgcucgccg

SEQ ID NO: 838237 - RNA, 22 nt, Mycobacterium avium subsp. paratuberculosis
cuucgccgccgcaccggccggc

SEQ ID NO: 838238 - RNA, 13 nt, Mycobacterium avium subsp. paratuberculosis
cuucgccgcacgu

SEQ ID NO: 838239 - RNA, 14 nt, Mycobacterium avium subsp. paratuberculosis
cuucgccgcagccu

SEQ ID NO: 838240 - RNA, 19 nt, Mycobacterium avium subsp. paratuberculosis
cuucgauggccaucgucga

SEQ ID NO: 838241 - RNA, 17 nt, Mycobacterium avium subsp. paratuberculosis
cuucgaugacggccgua

SEQ ID NO: 838242 - RNA, 18 nt, Mycobacterium avium subsp. paratuberculosis
cuucgaugacggccguac

SEQ ID NO: 838243 - RNA, 17 nt, Mycobacterium avium subsp. paratuberculosis
cuucgagacacgcgccg

SEQ ID NO: 838244 - RNA, 22 nt, Mycobacterium avium subsp. paratuberculosis
cuucgacccgguggcccggucg

SEQ ID NO: 838245 - RNA, 22 nt, Mycobacterium avium subsp. paratuberculosis
cuucgacgauguuggcgacgac

SEQ ID NO: 838246 - RNA, 16 nt, Mycobacterium avium subsp. paratuberculosis
cuucgagccgccgccg

SEQ ID NO: 838247 - RNA, 14 nt, Mycobacterium avium subsp. paratuberculosis
cuucgagccgggcg

SEQ ID NO: 838248 - RNA, 21 nt, Mycobacterium avium subsp. paratuberculosis
cuucgaggugcacgcccagac

SEQ ID NO: 838249 - RNA, 20 nt, Mycobacterium avium subsp. paratuberculosis
cuucgcggcguacugcgcga

SEQ ID NO: 838250 - RNA, 14 nt, Mycobacterium avium subsp. paratuberculosis
cuucggccagcgcg

SEQ ID NO: 838251 - RNA, 15 nt, Mycobacterium avium subsp. paratuberculosis
cuucggccagcgcgu

SEQ ID NO: 838252 - RNA, 17 nt, Mycobacterium avium subsp. paratuberculosis
cuucggccagcgcgucg

SEQ ID NO: 838253 - RNA, 21 nt, Mycobacterium avium subsp. paratuberculosis
cuucggccagcgcgucggcca

SEQ ID NO: 838254 - RNA, 22 nt, Mycobacterium avium subsp. paratuberculosis
cuucggccaucgacuccaccac

SEQ ID NO: 838255 - RNA, 15 nt, Mycobacterium avium subsp. paratuberculosis
cuucgcgcgcggcgu

SEQ ID NO: 838256 - RNA, 21 nt, Mycobacterium avium subsp. paratuberculosis
cuucgccggcgcuuugccguc

SEQ ID NO: 838257 - RNA, 13 nt, Mycobacterium avium subsp. paratuberculosis
cuucgccgcgcuu

SEQ ID NO: 838258 - RNA, 17 nt, Mycobacterium avium subsp. paratuberculosis
cuucgccggacagccgg

SEQ ID NO: 838259 - RNA, 15 nt, Mycobacterium avium subsp. paratuberculosis
cuucggcgcgccggc

SEQ ID NO: 838260 - RNA, 18 nt, Mycobacterium avium subsp. paratuberculosis
cuucggcgcgccggcgau

SEQ ID NO: 838261 - RNA, 22 nt, Mycobacterium avium subsp. paratuberculosis
cuucggcgcccgcuccggcgga

SEQ ID NO: 838262 - RNA, 23 nt, Mycobacterium avium subsp. paratuberculosis
cuucggcgcccgcuccggcggac

SEQ ID NO: 838263 - RNA, 15 nt, Mycobacterium avium subsp. paratuberculosis
cuucggcgccgagca

SEQ ID NO: 838264 - RNA, 22 nt, Mycobacterium avium subsp. paratuberculosis
cuucggccggcagcggugccgc

SEQ ID NO: 838265 - RNA, 16 nt, Mycobacterium avium subsp. paratuberculosis
cuucuacggcgggccg

SEQ ID NO: 838266 - RNA, 17 nt, Mycobacterium avium subsp. paratuberculosis
cuucuccacgccgacga

SEQ ID NO: 838267 - RNA, 19 nt, Mycobacterium avium subsp. paratuberculosis
cuucucccgcggcagccgg

SEQ ID NO: 838268 - RNA, 12 nt, Mycobacterium avium subsp. paratuberculosis
cuucuccgccgg

SEQ ID NO: 838269 - RNA, 16 nt, Mycobacterium avium subsp. paratuberculosis
cuucuccgccggcagu

SEQ ID NO: 838270 - RNA, 22 nt, Mycobacterium avium subsp. paratuberculosis
cuucucgaaccggggcaccacg

SEQ ID NO: 838271 - RNA, 12 nt, Mycobacterium avium subsp. paratuberculosis
cuucucggccag

SEQ ID NO: 838272 - RNA, 22 nt, Mycobacterium avium subsp. paratuberculosis
cuucuggucaugaaggcgacgu

SEQ ID NO: 838273 - RNA, 18 nt, Mycobacterium avium subsp. paratuberculosis
cuucucggcguccccggc

SEQ ID NO: 838274 - RNA, 16 nt, Mycobacterium avium subsp. paratuberculosis
cuucucggcgugcccg

SEQ ID NO: 838275 - RNA, 21 nt, Mycobacterium avium subsp. paratuberculosis
cuucucggugaucacccgccg

SEQ ID NO: 838276 - RNA, 17 nt, Mycobacterium avium subsp. paratuberculosis
cuucucggugucgucga

SEQ ID NO: 838277 - RNA, 14 nt, Mycobacterium avium subsp. paratuberculosis
cuucuuggccgcgc

SEQ ID NO: 838278 - RNA, 19 nt, Mycobacterium avium subsp. paratuberculosis
cuucuuggccgcgccgccg

SEQ ID NO: 838279 - RNA, 18 nt, Mycobacterium avium subsp. paratuberculosis
cuucuuggccgcggccuu

SEQ ID NO: 838280 - RNA, 17 nt, Mycobacterium avium subsp. paratuberculosis
cuucuugaacagcgccg

SEQ ID NO: 838281 - RNA, 13 nt, Mycobacterium avium subsp. paratuberculosis
cuucuuggcggcg

SEQ ID NO: 838282 - RNA, 14 nt, Mycobacterium avium subsp. paratuberculosis
cuugaagaaccggg

SEQ ID NO: 838283 - RNA, 15 nt, Mycobacterium avium subsp. paratuberculosis
cuugaagaaccggga

SEQ ID NO: 838284 - RNA, 13 nt, Mycobacterium avium subsp. paratuberculosis
cuugaacgccgcc

SEQ ID NO: 838285 - RNA, 14 nt, Mycobacterium avium subsp. paratuberculosis
cuugaacgccgccc

SEQ ID NO: 838286 - RNA, 19 nt, Mycobacterium avium subsp. paratuberculosis
cuugaaucgguucggccag

SEQ ID NO: 838287 - RNA, 19 nt, Mycobacterium avium subsp. paratuberculosis
cuugaccaccgaccggcuc

SEQ ID NO: 838288 - RNA, 19 nt, Mycobacterium avium subsp. paratuberculosis
cuugaccaccgagccgggc

SEQ ID NO: 838289 - RNA, 22 nt, Mycobacterium avium subsp. paratuberculosis
cuugaccaggaugucuccgcgc

SEQ ID NO: 838290 - RNA, 22 nt, Mycobacterium avium subsp. paratuberculosis
cuugaccaugaguugcgggucc

SEQ ID NO: 838291 - RNA, 20 nt, Mycobacterium avium subsp. paratuberculosis
cuugaaggaggcggucgacu

SEQ ID NO: 838292 - RNA, 20 nt, Mycobacterium avium subsp. paratuberculosis
cuugaacggcgcgucguagu

SEQ ID NO: 838293 - RNA, 19 nt, Mycobacterium avium subsp. paratuberculosis
cuugacccgcuccagcggc

SEQ ID NO: 838294 - RNA, 20 nt, Mycobacterium avium subsp. paratuberculosis
cuugacccgcuccagcggcc

SEQ ID NO: 838295 - RNA, 23 nt, Mycobacterium avium subsp. paratuberculosis
cuugacccggcccaucaccggac

SEQ ID NO: 838296 - RNA, 15 nt, Mycobacterium avium subsp. paratuberculosis
cuugacccggccgca

SEQ ID NO: 838297 - RNA, 20 nt, Mycobacterium avium subsp. paratuberculosis
cuugacgacggccaccgcga

SEQ ID NO: 838298 - RNA, 19 nt, Mycobacterium avium subsp. paratuberculosis
cuugacgaguuccaccucg

SEQ ID NO: 838299 - RNA, 13 nt, Mycobacterium avium subsp. paratuberculosis
cuugaccgugacg

SEQ ID NO: 838300 - RNA, 17 nt, Mycobacterium avium subsp. paratuberculosis
cuugaccucgccgagca

SEQ ID NO: 838301 - RNA, 20 nt, Mycobacterium avium subsp. paratuberculosis
cuuggugauuucgcgcacca

SEQ ID NO: 838302 - RNA, 14 nt, Mycobacterium avium subsp. paratuberculosis
cuuggugcggucga

SEQ ID NO: 838303 - RNA, 22 nt, Mycobacterium avium subsp. paratuberculosis
cuuggugcggucgaugacgccg

SEQ ID NO: 838304 - RNA, 23 nt, Mycobacterium avium subsp. paratuberculosis
cuugguggccagcaccacguccg

SEQ ID NO: 838305 - RNA, 20 nt, Mycobacterium avium subsp. paratuberculosis
cuugguggccgcggccgccu

SEQ ID NO: 838306 - RNA, 17 nt, Mycobacterium avium subsp. paratuberculosis
cuuggugguggucgucg

SEQ ID NO: 838307 - RNA, 18 nt, Mycobacterium avium subsp. paratuberculosis
cuuggugguggucgucga

SEQ ID NO: 838308 - RNA, 19 nt, Mycobacterium avium subsp. paratuberculosis
cuuggugugugcgucggca

SEQ ID NO: 838309 - RNA, 16 nt, Mycobacterium avium subsp. paratuberculosis
cuuguacaggucgacc

SEQ ID NO: 838310 - RNA, 17 nt, Mycobacterium avium subsp. paratuberculosis
cuuguacaugucgucgc

SEQ ID NO: 838311 - RNA, 17 nt, Mycobacterium avium subsp. paratuberculosis
cuuggcgaagucgcagu

SEQ ID NO: 838312 - RNA, 21 nt, Mycobacterium avium subsp. paratuberculosis
cuuggcgagcugaccggccac

SEQ ID NO: 838313 - RNA, 14 nt, Mycobacterium avium subsp. paratuberculosis
cuuggcccaccgaa

SEQ ID NO: 838314 - RNA, 17 nt, Mycobacterium avium subsp. paratuberculosis
cuuggccuccgugcugg

SEQ ID NO: 838315 - RNA, 21 nt, Mycobacterium avium subsp. paratuberculosis
cuuggccguaggucgggucga

SEQ ID NO: 838316 - RNA, 16 nt, Mycobacterium avium subsp. paratuberculosis
cuugcggaaccgcugc

SEQ ID NO: 838317 - RNA, 14 nt, Mycobacterium avium subsp. paratuberculosis
cuugcgggcggcag

SEQ ID NO: 838318 - RNA, 15 nt, Mycobacterium avium subsp. paratuberculosis
cuugcggcgcgaugc

SEQ ID NO: 838319 - RNA, 14 nt, Mycobacterium avium subsp. paratuberculosis
cuugcgcggcgcga

SEQ ID NO: 838320 - RNA, 14 nt, Mycobacterium avium subsp. paratuberculosis
cuugcggccgccga

SEQ ID NO: 838321 - RNA, 12 nt, Mycobacterium avium subsp. paratuberculosis
cuugcggccgcc

SEQ ID NO: 838322 - RNA, 20 nt, Mycobacterium avium subsp. paratuberculosis
cuuggccaggcgggccacca

SEQ ID NO: 838323 - RNA, 14 nt, Mycobacterium avium subsp. paratuberculosis
cuuggccgcggccu

SEQ ID NO: 838324 - RNA, 15 nt, Mycobacterium avium subsp. paratuberculosis
cuuggccgcggccuu

SEQ ID NO: 838325 - RNA, 12 nt, Mycobacterium avium subsp. paratuberculosis
cuuggccgggcg

SEQ ID NO: 838326 - RNA, 13 nt, Mycobacterium avium subsp. paratuberculosis
cuuggccgacacg

SEQ ID NO: 838327 - RNA, 17 nt, Mycobacterium avium subsp. paratuberculosis
cuuggccgacacguagg

SEQ ID NO: 838328 - RNA, 14 nt, Mycobacterium avium subsp. paratuberculosis
cuuggcccgcgcgg

SEQ ID NO: 838329 - RNA, 15 nt, Mycobacterium avium subsp. paratuberculosis
cuugcgaucgccgcg

SEQ ID NO: 838330 - RNA, 16 nt, Mycobacterium avium subsp. paratuberculosis
cuugcgaucgccgcgc

SEQ ID NO: 838331 - RNA, 19 nt, Mycobacterium avium subsp. paratuberculosis
cuugcgcaccacgucgggu

SEQ ID NO: 838332 - RNA, 24 nt, Mycobacterium avium subsp. paratuberculosis
cuugcgcaccggagccuuggucgc

SEQ ID NO: 838333 - RNA, 17 nt, Mycobacterium avium subsp. paratuberculosis
cuugcgcaacagcgugc

SEQ ID NO: 838334 - RNA, 17 nt, Mycobacterium avium subsp. paratuberculosis
cuugcgcagccggcagc

SEQ ID NO: 838335 - RNA, 16 nt, Mycobacterium avium subsp. paratuberculosis
cuugcgccacuugucc

SEQ ID NO: 838336 - RNA, 14 nt, Mycobacterium avium subsp. paratuberculosis
cuugcgcagcaccu

SEQ ID NO: 838337 - RNA, 15 nt, Mycobacterium avium subsp. paratuberculosis
cuugcgccccggcgg

SEQ ID NO: 838338 - RNA, 17 nt, Mycobacterium avium subsp. paratuberculosis
cuugcgccccggcgggc

SEQ ID NO: 838339 - RNA, 15 nt, Mycobacterium avium subsp. paratuberculosis
cuugcgcgacgccgu

SEQ ID NO: 838340 - RNA, 21 nt, Mycobacterium avium subsp. paratuberculosis
cuugcgccggguggccggggc

SEQ ID NO: 838341 - RNA, 15 nt, Mycobacterium avium subsp. paratuberculosis
cuugcgcgccgcgac

SEQ ID NO: 838342 - RNA, 16 nt, Mycobacterium avium subsp. paratuberculosis
cuugcgcgccgugacg

SEQ ID NO: 838343 - RNA, 11 nt, Mycobacterium avium subsp. paratuberculosis
cuugcgcgccg

SEQ ID NO: 838344 - RNA, 16 nt, Mycobacterium avium subsp. paratuberculosis
cuugccgucggccgcc

SEQ ID NO: 838345 - RNA, 23 nt, Mycobacterium avium subsp. paratuberculosis
cuugccgucguugacgcccuccu

SEQ ID NO: 838346 - RNA, 15 nt, Mycobacterium avium subsp. paratuberculosis
cuugccgccgcagcg

SEQ ID NO: 838347 - RNA, 17 nt, Mycobacterium avium subsp. paratuberculosis
cuugccgugcagcaguu

SEQ ID NO: 838348 - RNA, 20 nt, Mycobacterium avium subsp. paratuberculosis
cuugccgcugaaauccgggg

SEQ ID NO: 838349 - RNA, 22 nt, Mycobacterium avium subsp. paratuberculosis
cuugccggauugcgagccgguc

SEQ ID NO: 838350 - RNA, 14 nt, Mycobacterium avium subsp. paratuberculosis
cuugccgccgcgga

SEQ ID NO: 838351 - RNA, 21 nt, Mycobacterium avium subsp. paratuberculosis
cuugccgcugugauagcggcg

SEQ ID NO: 838352 - RNA, 15 nt, Mycobacterium avium subsp. paratuberculosis
cuugccggcggcggg

SEQ ID NO: 838353 - RNA, 16 nt, Mycobacterium avium subsp. paratuberculosis
cuugccggcggcgggc

SEQ ID NO: 838354 - RNA, 14 nt, Mycobacterium avium subsp. paratuberculosis
cuugcagcacaccg

SEQ ID NO: 838355 - RNA, 23 nt, Mycobacterium avium subsp. paratuberculosis
cuugccaacgguuuccaccacca

SEQ ID NO: 838356 - RNA, 19 nt, Mycobacterium avium subsp. paratuberculosis
cuugcccgaauugcgcugc

SEQ ID NO: 838357 - RNA, 19 nt, Mycobacterium avium subsp. paratuberculosis
cuugcccaggugcagaccg

SEQ ID NO: 838358 - RNA, 13 nt, Mycobacterium avium subsp. paratuberculosis
cuugccccaccac

SEQ ID NO: 838359 - RNA, 14 nt, Mycobacterium avium subsp. paratuberculosis
cuugcccagcgggg

SEQ ID NO: 838360 - RNA, 20 nt, Mycobacterium avium subsp. paratuberculosis
cuugccagccgggccgagcg

SEQ ID NO: 838361 - RNA, 22 nt, Mycobacterium avium subsp. paratuberculosis
cuugcccucguagaaggaccgg

SEQ ID NO: 838362 - RNA, 13 nt, Mycobacterium avium subsp. paratuberculosis
cuugcccggcgag

SEQ ID NO: 838363 - RNA, 17 nt, Mycobacterium avium subsp. paratuberculosis
cuugcccggcucggugc

SEQ ID NO: 838364 - RNA, 15 nt, Mycobacterium avium subsp. paratuberculosis
cuugccgaacaggcg

SEQ ID NO: 838365 - RNA, 22 nt, Mycobacterium avium subsp. paratuberculosis
cuugccgaagaugucggugccg

SEQ ID NO: 838366 - RNA, 17 nt, Mycobacterium avium subsp. paratuberculosis
cuugccgaucagcguca

SEQ ID NO: 838367 - RNA, 18 nt, Mycobacterium avium subsp. paratuberculosis
cuugaugcagcgccucgg

SEQ ID NO: 838368 - RNA, 16 nt, Mycobacterium avium subsp. paratuberculosis
cuugauggcggcgcgg

SEQ ID NO: 838369 - RNA, 17 nt, Mycobacterium avium subsp. paratuberculosis
cuugaugaacgccucga

SEQ ID NO: 838370 - RNA, 16 nt, Mycobacterium avium subsp. paratuberculosis
cuugaugcugcccggc

SEQ ID NO: 838371 - RNA, 18 nt, Mycobacterium avium subsp. paratuberculosis
cuugaugcugcccggcgc

SEQ ID NO: 838372 - RNA, 23 nt, Mycobacterium avium subsp. paratuberculosis
cuugaucagguccuugcgcgccg

SEQ ID NO: 838373 - RNA, 23 nt, Mycobacterium avium subsp. paratuberculosis
cuugaucaggucgccgauccagc

SEQ ID NO: 838374 - RNA, 14 nt, Mycobacterium avium subsp. paratuberculosis
cuugauccggccgc

SEQ ID NO: 838375 - RNA, 15 nt, Mycobacterium avium subsp. paratuberculosis
cuugauccggccgcg

SEQ ID NO: 838376 - RNA, 19 nt, Mycobacterium avium subsp. paratuberculosis
cuugaucgccggggcgcug

SEQ ID NO: 838377 - RNA, 16 nt, Mycobacterium avium subsp. paratuberculosis
cuugaucucggcggcg

SEQ ID NO: 838378 - RNA, 22 nt, Mycobacterium avium subsp. paratuberculosis
cuugagcccccaccugaucgcg

SEQ ID NO: 838379 - RNA, 16 nt, Mycobacterium avium subsp. paratuberculosis
cuugagccccgccggg

SEQ ID NO: 838380 - RNA, 13 nt, Mycobacterium avium subsp. paratuberculosis
cuugagccggucc

SEQ ID NO: 838381 - RNA, 17 nt, Mycobacterium avium subsp. paratuberculosis
cuugagcgccagcgcgg

SEQ ID NO: 838382 - RNA, 17 nt, Mycobacterium avium subsp. paratuberculosis
cuugagcgcgucgucgc

SEQ ID NO: 838383 - RNA, 18 nt, Mycobacterium avium subsp. paratuberculosis
cuugacguacuggcgccg

SEQ ID NO: 838384 - RNA, 19 nt, Mycobacterium avium subsp. paratuberculosis
cuugagcacggugaucagc

SEQ ID NO: 838385 - RNA, 16 nt, Mycobacterium avium subsp. paratuberculosis
cuugacgucggucagc

SEQ ID NO: 838386 - RNA, 15 nt, Mycobacterium avium subsp. paratuberculosis
cuugacuaccgcgcc

SEQ ID NO: 838387 - RNA, 15 nt, Mycobacterium avium subsp. paratuberculosis
cuugacggccgggcc

SEQ ID NO: 838388 - RNA, 18 nt, Mycobacterium avium subsp. paratuberculosis
cuugacgaacgccaccac

SEQ ID NO: 838389 - RNA, 22 nt, Mycobacterium avium subsp. paratuberculosis
cuugacgaacuccugcucgcgg

SEQ ID NO: 838390 - RNA, 12 nt, Mycobacterium avium subsp. paratuberculosis
cuugacgccgau

SEQ ID NO: 838391 - RNA, 13 nt, Mycobacterium avium subsp. paratuberculosis
cuguuggccagcu

SEQ ID NO: 838392 - RNA, 19 nt, Mycobacterium avium subsp. paratuberculosis
cuguuggcgacggcgcugu

SEQ ID NO: 838393 - RNA, 18 nt, Mycobacterium avium subsp. paratuberculosis
cuguucgcggcuggccgc

SEQ ID NO: 838394 - RNA, 17 nt, Mycobacterium avium subsp. paratuberculosis
cuguugaccacggccug

SEQ ID NO: 838395 - RNA, 14 nt, Mycobacterium avium subsp. paratuberculosis
cuguugacgggccg

SEQ ID NO: 838396 - RNA, 15 nt, Mycobacterium avium subsp. paratuberculosis
cuguugacgggccgc

SEQ ID NO: 838397 - RNA, 23 nt, Mycobacterium avium subsp. paratuberculosis
cuguugacgggccgcggccagcu

SEQ ID NO: 838398 - RNA, 13 nt, Mycobacterium avium subsp. paratuberculosis
cuguugucccgga

SEQ ID NO: 838399 - RNA, 17 nt, Mycobacterium avium subsp. paratuberculosis
cuguugucggcucgccg

SEQ ID NO: 838400 - RNA, 15 nt, Mycobacterium avium subsp. paratuberculosis
cuuagcccggccgcg

SEQ ID NO: 838401 - RNA, 17 nt, Mycobacterium avium subsp. paratuberculosis
cuuagcccggccgcggc

SEQ ID NO: 838402 - RNA, 18 nt, Mycobacterium avium subsp. paratuberculosis
cuuaccggcgggcggcgg

SEQ ID NO: 838403 - RNA, 19 nt, Mycobacterium avium subsp. paratuberculosis
aaccggucaacggcucggu

SEQ ID NO: 838404 - RNA, 15 nt, Mycobacterium avium subsp. paratuberculosis
aaccgguacaggccc

SEQ ID NO: 838405 - RNA, 19 nt, Mycobacterium avium subsp. paratuberculosis
cuucacgaccggcagcacc

SEQ ID NO: 838406 - RNA, 16 nt, Mycobacterium avium subsp. paratuberculosis
cuucacgaagugcccg

SEQ ID NO: 838407 - RNA, 18 nt, Mycobacterium avium subsp. paratuberculosis
cuucacgaagugcccggc

SEQ ID NO: 838408 - RNA, 18 nt, Mycobacterium avium subsp. paratuberculosis
cuucacgcucgcaggcga

SEQ ID NO: 838409 - RNA, 24 nt, Mycobacterium avium subsp. paratuberculosis
cuucacgcucgcgugcgaacguga

SEQ ID NO: 838410 - RNA, 15 nt, Mycobacterium avium subsp. paratuberculosis
cuucacgcucggcag

SEQ ID NO: 838411 - RNA, 17 nt, Mycobacterium avium subsp. paratuberculosis
cuucacgcucggcgagc

SEQ ID NO: 838412 - RNA, 19 nt, Mycobacterium avium subsp. paratuberculosis
cuucacgcucggcgccgag

SEQ ID NO: 838413 - RNA, 15 nt, Mycobacterium avium subsp. paratuberculosis
cuucaccgaccagcu

SEQ ID NO: 838414 - RNA, 17 nt, Mycobacterium avium subsp. paratuberculosis
cuucaccgaccagcugu

SEQ ID NO: 838415 - RNA, 19 nt, Mycobacterium avium subsp. paratuberculosis
cugguuuuacacaccagcg

SEQ ID NO: 838416 - RNA, 23 nt, Mycobacterium avium subsp. paratuberculosis
cugguuuuacacaccagcggucg

SEQ ID NO: 838417 - RNA, 22 nt, Mycobacterium avium subsp. paratuberculosis
cuguccacaucggugaucacga

SEQ ID NO: 838418 - RNA, 17 nt, Mycobacterium avium subsp. paratuberculosis
cuguccaccugcaccug

SEQ ID NO: 838419 - RNA, 13 nt, Mycobacterium avium subsp. paratuberculosis
cuguccagcagcg

SEQ ID NO: 838420 - RNA, 19 nt, Mycobacterium avium subsp. paratuberculosis
cuguccucgagcgcgucga

SEQ ID NO: 838421 - RNA, 18 nt, Mycobacterium avium subsp. paratuberculosis
cuguccugccgggcgucg

SEQ ID NO: 838422 - RNA, 13 nt, Mycobacterium avium subsp. paratuberculosis
cugucgucgcccu

SEQ ID NO: 838423 - RNA, 22 nt, Mycobacterium avium subsp. paratuberculosis
cugucgucgcccugacacagca

SEQ ID NO: 838424 - RNA, 13 nt, Mycobacterium avium subsp. paratuberculosis
cugucgauggcgg

SEQ ID NO: 838425 - RNA, 16 nt, Mycobacterium avium subsp. paratuberculosis
cugucgcccucgaucg

SEQ ID NO: 838426 - RNA, 22 nt, Mycobacterium avium subsp. paratuberculosis
cugucggugugagcggugaccu

SEQ ID NO: 838427 - RNA, 16 nt, Mycobacterium avium subsp. paratuberculosis
cugucguagcggccca

SEQ ID NO: 838428 - RNA, 19 nt, Mycobacterium avium subsp. paratuberculosis
cugucguagcggcccaggu

SEQ ID NO: 838429 - RNA, 15 nt, Mycobacterium avium subsp. paratuberculosis
cuguucgccgucgcg

SEQ ID NO: 838430 - RNA, 16 nt, Mycobacterium avium subsp. paratuberculosis
cuguucgccgucgcgg

SEQ ID NO: 838431 - RNA, 23 nt, Mycobacterium avium subsp. paratuberculosis
cuguucgggcagauggucgccga

SEQ ID NO: 838432 - RNA, 21 nt, Mycobacterium avium subsp. paratuberculosis
cuguucggguagacgaucacc

SEQ ID NO: 838433 - RNA, 18 nt, Mycobacterium avium subsp. paratuberculosis
cuguucggcggcgauccg

SEQ ID NO: 838434 - RNA, 23 nt, Mycobacterium avium subsp. paratuberculosis
cuguucguccgugcugccggccg

SEQ ID NO: 838435 - RNA, 14 nt, Mycobacterium avium subsp. paratuberculosis
cuguuccccggcgg

SEQ ID NO: 838436 - RNA, 22 nt, Mycobacterium avium subsp. paratuberculosis
cuguucacuacuuuuccgguua

SEQ ID NO: 838437 - RNA, 16 nt, Mycobacterium avium subsp. paratuberculosis
cuggugaagcugccga

SEQ ID NO: 838438 - RNA, 22 nt, Mycobacterium avium subsp. paratuberculosis
cuggugacgugcaccugcagcc

SEQ ID NO: 838439 - RNA, 22 nt, Mycobacterium avium subsp. paratuberculosis
cuggugauggccaucuggccgc

SEQ ID NO: 838440 - RNA, 16 nt, Mycobacterium avium subsp. paratuberculosis
cuggugaggucgcgca

SEQ ID NO: 838441 - RNA, 23 nt, Mycobacterium avium subsp. paratuberculosis
cuggucgucccaggguuggucgg

SEQ ID NO: 838442 - RNA, 18 nt, Mycobacterium avium subsp. paratuberculosis
cuggucgugcucgucggc

SEQ ID NO: 838443 - RNA, 20 nt, Mycobacterium avium subsp. paratuberculosis
cuggucgugcucgucggcgg

SEQ ID NO: 838444 - RNA, 16 nt, Mycobacterium avium subsp. paratuberculosis
cuggucgugcuggagc

SEQ ID NO: 838445 - RNA, 16 nt, Mycobacterium avium subsp. paratuberculosis
cuggucgugcagcacc

SEQ ID NO: 838446 - RNA, 21 nt, Mycobacterium avium subsp. paratuberculosis
cuggucucgggcaccacgccg

SEQ ID NO: 838447 - RNA, 17 nt, Mycobacterium avium subsp. paratuberculosis
cuggucggucagcucga

SEQ ID NO: 838448 - RNA, 17 nt, Mycobacterium avium subsp. paratuberculosis
cuggucggccuggccca

SEQ ID NO: 838449 - RNA, 14 nt, Mycobacterium avium subsp. paratuberculosis
cuggucggcgaacc

SEQ ID NO: 838450 - RNA, 23 nt, Mycobacterium avium subsp. paratuberculosis
cuggucggcggguaugucggcga

SEQ ID NO: 838451 - RNA, 13 nt, Mycobacterium avium subsp. paratuberculosis
cuggucggccagc

SEQ ID NO: 838452 - RNA, 19 nt, Mycobacterium avium subsp. paratuberculosis
cuggucgcccaccacgacg

SEQ ID NO: 838453 - RNA, 21 nt, Mycobacterium avium subsp. paratuberculosis
cuggucgccgaacgugcgcgg

SEQ ID NO: 838454 - RNA, 13 nt, Mycobacterium avium subsp. paratuberculosis
cuggucgccgccg

SEQ ID NO: 838455 - RNA, 16 nt, Mycobacterium avium subsp. paratuberculosis
cuggucgccgccgucc

SEQ ID NO: 838456 - RNA, 14 nt, Mycobacterium avium subsp. paratuberculosis
cugguaggcggccg

SEQ ID NO: 838457 - RNA, 17 nt, Mycobacterium avium subsp. paratuberculosis
cugguaggcggccggga

SEQ ID NO: 838458 - RNA, 22 nt, Mycobacterium avium subsp. paratuberculosis
cugguaggcggcgcagccagcg

SEQ ID NO: 838459 - RNA, 12 nt, Mycobacterium avium subsp. paratuberculosis
cuggugccgccg

SEQ ID NO: 838460 - RNA, 14 nt, Mycobacterium avium subsp. paratuberculosis
cuggugccgccgau

SEQ ID NO: 838461 - RNA, 18 nt, Mycobacterium avium subsp. paratuberculosis
cuggugcgcagcccgccg

SEQ ID NO: 838462 - RNA, 16 nt, Mycobacterium avium subsp. paratuberculosis
cuggugcgggccagca

SEQ ID NO: 838463 - RNA, 13 nt, Mycobacterium avium subsp. paratuberculosis
cuggugcgcgccg

SEQ ID NO: 838464 - RNA, 19 nt, Mycobacterium avium subsp. paratuberculosis
cuggugcgcgccggcgucg

SEQ ID NO: 838465 - RNA, 20 nt, Mycobacterium avium subsp. paratuberculosis
cuggugcgcgccggcgucgg

SEQ ID NO: 838466 - RNA, 12 nt, Mycobacterium avium subsp. paratuberculosis
cuggugcgcgcg

SEQ ID NO: 838467 - RNA, 13 nt, Mycobacterium avium subsp. paratuberculosis
cuggugcgcgcgc

SEQ ID NO: 838468 - RNA, 16 nt, Mycobacterium avium subsp. paratuberculosis
cugguggccgacgugc

SEQ ID NO: 838469 - RNA, 22 nt, Mycobacterium avium subsp. paratuberculosis
cuggugcugcugccccucgacg

SEQ ID NO: 838470 - RNA, 15 nt, Mycobacterium avium subsp. paratuberculosis
cugguggcagcggac

SEQ ID NO: 838471 - RNA, 13 nt, Mycobacterium avium subsp. paratuberculosis
cuggugggcgggc

SEQ ID NO: 838472 - RNA, 14 nt, Mycobacterium avium subsp. paratuberculosis
cuggugggugugcg

SEQ ID NO: 838473 - RNA, 20 nt, Mycobacterium avium subsp. paratuberculosis
cugguggugaucacccagcc

SEQ ID NO: 838474 - RNA, 15 nt, Mycobacterium avium subsp. paratuberculosis
cugguggugaucggc

SEQ ID NO: 838475 - RNA, 16 nt, Mycobacterium avium subsp. paratuberculosis
cuggugucccgcgugg

SEQ ID NO: 838476 - RNA, 15 nt, Mycobacterium avium subsp. paratuberculosis
cuggugugacgcucg

SEQ ID NO: 838477 - RNA, 17 nt, Mycobacterium avium subsp. paratuberculosis
cugguugauccagcggc

SEQ ID NO: 838478 - RNA, 18 nt, Mycobacterium avium subsp. paratuberculosis
cugguugauccagcggcg

SEQ ID NO: 838479 - RNA, 22 nt, Mycobacterium avium subsp. paratuberculosis
cugguugauccagcggcgcacc

SEQ ID NO: 838480 - RNA, 23 nt, Mycobacterium avium subsp. paratuberculosis
cugguugauccagcggcgcaccg

SEQ ID NO: 838481 - RNA, 20 nt, Mycobacterium avium subsp. paratuberculosis
cugguuguagucgucgaccg

SEQ ID NO: 838482 - RNA, 13 nt, Mycobacterium avium subsp. paratuberculosis
cugguugucgacg

SEQ ID NO: 838483 - RNA, 15 nt, Mycobacterium avium subsp. paratuberculosis
cugggccgccagccg

SEQ ID NO: 838484 - RNA, 17 nt, Mycobacterium avium subsp. paratuberculosis
cugggccccuccagccg

SEQ ID NO: 838485 - RNA, 18 nt, Mycobacterium avium subsp. paratuberculosis
cugggccccuccagccgc

SEQ ID NO: 838486 - RNA, 19 nt, Mycobacterium avium subsp. paratuberculosis
cugggccccuccagccgcc

SEQ ID NO: 838487 - RNA, 21 nt, Mycobacterium avium subsp. paratuberculosis
cugggccccuccagccgccgg

SEQ ID NO: 838488 - RNA, 22 nt, Mycobacterium avium subsp. paratuberculosis
cugggccccuccagccgccggu

SEQ ID NO: 838489 - RNA, 23 nt, Mycobacterium avium subsp. paratuberculosis
cugggccacgauccgcgcggcca

SEQ ID NO: 838490 - RNA, 20 nt, Mycobacterium avium subsp. paratuberculosis
cugggccagcgcgguggcca

SEQ ID NO: 838491 - RNA, 12 nt, Mycobacterium avium subsp. paratuberculosis
cugggcagccgu

SEQ ID NO: 838492 - RNA, 21 nt, Mycobacterium avium subsp. paratuberculosis
cugggcaucaucggcacgccg

SEQ ID NO: 838493 - RNA, 17 nt, Mycobacterium avium subsp. paratuberculosis
cugggauugccgggcac

SEQ ID NO: 838494 - RNA, 16 nt, Mycobacterium avium subsp. paratuberculosis
cugggcaauggccgcg

SEQ ID NO: 838495 - RNA, 17 nt, Mycobacterium avium subsp. paratuberculosis
cugggcaauggccgcga

SEQ ID NO: 838496 - RNA, 19 nt, Mycobacterium avium subsp. paratuberculosis
cugggcaauggccgcgacu

SEQ ID NO: 838497 - RNA, 14 nt, Mycobacterium avium subsp. paratuberculosis
cugggaucggugcg

SEQ ID NO: 838498 - RNA, 19 nt, Mycobacterium avium subsp. paratuberculosis
cugggaucggugcgcggcg

SEQ ID NO: 838499 - RNA, 19 nt, Mycobacterium avium subsp. paratuberculosis
cugggaugucuagccgccg

SEQ ID NO: 838500 - RNA, 17 nt, Mycobacterium avium subsp. paratuberculosis
cuggccgucgcggcgcg

SEQ ID NO: 838501 - RNA, 22 nt, Mycobacterium avium subsp. paratuberculosis
cuggccguccggauagccgucg

SEQ ID NO: 838502 - RNA, 24 nt, Mycobacterium avium subsp. paratuberculosis
cuggccguccggauagccgucggc

SEQ ID NO: 838503 - RNA, 14 nt, Mycobacterium avium subsp. paratuberculosis
cuggccgucggcga

SEQ ID NO: 838504 - RNA, 17 nt, Mycobacterium avium subsp. paratuberculosis
cuggccgucggcgaugg

SEQ ID NO: 838505 - RNA, 14 nt, Mycobacterium avium subsp. paratuberculosis
cuggccgucggugg

SEQ ID NO: 838506 - RNA, 17 nt, Mycobacterium avium subsp. paratuberculosis
cuggccgucgguggccg

SEQ ID NO: 838507 - RNA, 16 nt, Mycobacterium avium subsp. paratuberculosis
cuggccgucgucgagg

SEQ ID NO: 838508 - RNA, 22 nt, Mycobacterium avium subsp. paratuberculosis
cuggccgucgucgaggccgaac

SEQ ID NO: 838509 - RNA, 14 nt, Mycobacterium avium subsp. paratuberculosis
cuggccgugcaccg

SEQ ID NO: 838510 - RNA, 17 nt, Mycobacterium avium subsp. paratuberculosis
cuggccgugcaccgucg

SEQ ID NO: 838511 - RNA, 23 nt, Mycobacterium avium subsp. paratuberculosis
cuggccguucaggucgaucagcg

SEQ ID NO: 838512 - RNA, 18 nt, Mycobacterium avium subsp. paratuberculosis
cuggguaagccaggucac

SEQ ID NO: 838513 - RNA, 15 nt, Mycobacterium avium subsp. paratuberculosis
cuggggugcccacca

SEQ ID NO: 838514 - RNA, 21 nt, Mycobacterium avium subsp. paratuberculosis
cugggguaguucugcucgauc

SEQ ID NO: 838515 - RNA, 18 nt, Mycobacterium avium subsp. paratuberculosis
cuggggguggcgucgacg

SEQ ID NO: 838516 - RNA, 19 nt, Mycobacterium avium subsp. paratuberculosis
cuggggguggcgucgacgg

SEQ ID NO: 838517 - RNA, 13 nt, Mycobacterium avium subsp. paratuberculosis
cugggcguacagc

SEQ ID NO: 838518 - RNA, 18 nt, Mycobacterium avium subsp. paratuberculosis
cugguaaccgcccgagca

SEQ ID NO: 838519 - RNA, 22 nt, Mycobacterium avium subsp. paratuberculosis
cugggucaaaacaacgcgcagc

SEQ ID NO: 838520 - RNA, 14 nt, Mycobacterium avium subsp. paratuberculosis
cugguacagcaccg

SEQ ID NO: 838521 - RNA, 15 nt, Mycobacterium avium subsp. paratuberculosis
cugguacagcaccgc

SEQ ID NO: 838522 - RNA, 20 nt, Mycobacterium avium subsp. paratuberculosis
cugguacagcaccgccgcgg

SEQ ID NO: 838523 - RNA, 13 nt, Mycobacterium avium subsp. paratuberculosis
cuggggcgcaccg

SEQ ID NO: 838524 - RNA, 22 nt, Mycobacterium avium subsp. paratuberculosis
cugggcgggcucgagccccagu

SEQ ID NO: 838525 - RNA, 15 nt, Mycobacterium avium subsp. paratuberculosis
cugggcgggcagccg

SEQ ID NO: 838526 - RNA, 20 nt, Mycobacterium avium subsp. paratuberculosis
cugggcggcgacaucgccga

SEQ ID NO: 838527 - RNA, 14 nt, Mycobacterium avium subsp. paratuberculosis
cugggcggcgcggc

SEQ ID NO: 838528 - RNA, 15 nt, Mycobacterium avium subsp. paratuberculosis
cugggcggcgcggcg

SEQ ID NO: 838529 - RNA, 19 nt, Mycobacterium avium subsp. paratuberculosis
cugggcggcgcggcggucg

SEQ ID NO: 838530 - RNA, 16 nt, Mycobacterium avium subsp. paratuberculosis
cugggcggcggcggga

SEQ ID NO: 838531 - RNA, 17 nt, Mycobacterium avium subsp. paratuberculosis
cugggcggcggcgggaa

SEQ ID NO: 838532 - RNA, 14 nt, Mycobacterium avium subsp. paratuberculosis
cugggcggacggga

SEQ ID NO: 838533 - RNA, 23 nt, Mycobacterium avium subsp. paratuberculosis
cugggcggccaccgcgccccggc

SEQ ID NO: 838534 - RNA, 23 nt, Mycobacterium avium subsp. paratuberculosis
cugggcgcuagcugcgccggcuu

SEQ ID NO: 838535 - RNA, 17 nt, Mycobacterium avium subsp. paratuberculosis
cugggcgccgucgccga

SEQ ID NO: 838536 - RNA, 22 nt, Mycobacterium avium subsp. paratuberculosis
cugggcgccgccggcgucgacg

SEQ ID NO: 838537 - RNA, 16 nt, Mycobacterium avium subsp. paratuberculosis
cugggccgcggcgccg

SEQ ID NO: 838538 - RNA, 14 nt, Mycobacterium avium subsp. paratuberculosis
cugggccgccgagc

SEQ ID NO: 838539 - RNA, 17 nt, Mycobacterium avium subsp. paratuberculosis
gauucuguugccggaca

SEQ ID NO: 838540 - RNA, 23 nt, Mycobacterium avium subsp. paratuberculosis
gauugaccauccgguccagaucg

SEQ ID NO: 838541 - RNA, 24 nt, Mycobacterium avium subsp. paratuberculosis
gauugcggccgccggccagcuccg

SEQ ID NO: 838542 - RNA, 19 nt, Mycobacterium avium subsp. paratuberculosis
gauugcgugcccggccagc

SEQ ID NO: 838543 - RNA, 20 nt, Mycobacterium avium subsp. paratuberculosis
gauuggauuuaucucggcga

SEQ ID NO: 838544 - RNA, 14 nt, Mycobacterium avium subsp. paratuberculosis
gauuucggccagcc

SEQ ID NO: 838545 - RNA, 15 nt, Mycobacterium avium subsp. paratuberculosis
gauuucggccagccg

SEQ ID NO: 838546 - RNA, 18 nt, Mycobacterium avium subsp. paratuberculosis
gauuggucagagcccgaa

SEQ ID NO: 838547 - RNA, 15 nt, Mycobacterium avium subsp. paratuberculosis
gauuggaagagggcc

SEQ ID NO: 838548 - RNA, 17 nt, Mycobacterium avium subsp. paratuberculosis
gauugguggcccggucg

SEQ ID NO: 838549 - RNA, 19 nt, Mycobacterium avium subsp. paratuberculosis
gauuggcgccacugccgcc

SEQ ID NO: 838550 - RNA, 23 nt, Mycobacterium avium subsp. paratuberculosis
gauuucgcuguagagcaguucga

SEQ ID NO: 838551 - RNA, 17 nt, Mycobacterium avium subsp. paratuberculosis
gauuccgucggcggccg

SEQ ID NO: 838552 - RNA, 18 nt, Mycobacterium avium subsp. paratuberculosis
gauucucgcugcggcgca

SEQ ID NO: 838553 - RNA, 20 nt, Mycobacterium avium subsp. paratuberculosis
gauucgggucagaccgcggc

SEQ ID NO: 838554 - RNA, 14 nt, Mycobacterium avium subsp. paratuberculosis
gauuccgccgggcg

SEQ ID NO: 838555 - RNA, 15 nt, Mycobacterium avium subsp. paratuberculosis
gauuccgccgggcgg

SEQ ID NO: 838556 - RNA, 20 nt, Mycobacterium avium subsp. paratuberculosis
gauuccgcgucuugcgccga

SEQ ID NO: 838557 - RNA, 13 nt, Mycobacterium avium subsp. paratuberculosis
gauuccggcaucg

SEQ ID NO: 838558 - RNA, 14 nt, Mycobacterium avium subsp. paratuberculosis
gauuccggccggcc

SEQ ID NO: 838559 - RNA, 23 nt, Mycobacterium avium subsp. paratuberculosis
gauuccggccggccgccggcggc

SEQ ID NO: 838560 - RNA, 23 nt, Mycobacterium avium subsp. paratuberculosis
gauucccgaccccgccagcaccg

SEQ ID NO: 838561 - RNA, 14 nt, Mycobacterium avium subsp. paratuberculosis
gauucccgccggau

SEQ ID NO: 838562 - RNA, 23 nt, Mycobacterium avium subsp. paratuberculosis
gauuccagcgcguagucggcguc

SEQ ID NO: 838563 - RNA, 14 nt, Mycobacterium avium subsp. paratuberculosis
gauuccauccggga

SEQ ID NO: 838564 - RNA, 23 nt, Mycobacterium avium subsp. paratuberculosis
gauuacucgccggcggcgccgga

SEQ ID NO: 838565 - RNA, 19 nt, Mycobacterium avium subsp. paratuberculosis
gaugugccuggcccagaca

SEQ ID NO: 838566 - RNA, 15 nt, Mycobacterium avium subsp. paratuberculosis
gaugugaucgcggcc

SEQ ID NO: 838567 - RNA, 12 nt, Mycobacterium avium subsp. paratuberculosis
gaugugaucggc

SEQ ID NO: 838568 - RNA, 18 nt, Mycobacterium avium subsp. paratuberculosis
gcaaaaacgcgcgaucgg

SEQ ID NO: 838569 - RNA, 20 nt, Mycobacterium avium subsp. paratuberculosis
gauuuuuuggggcggggcgu

SEQ ID NO: 838570 - RNA, 16 nt, Mycobacterium avium subsp. paratuberculosis
gcaaaaccccgccguu

SEQ ID NO: 838571 - RNA, 13 nt, Mycobacterium avium subsp. paratuberculosis
gcaaaagcauccg

SEQ ID NO: 838572 - RNA, 16 nt, Mycobacterium avium subsp. paratuberculosis
gcaaaauagcugcgac

SEQ ID NO: 838573 - RNA, 19 nt, Mycobacterium avium subsp. paratuberculosis
gcaaagaucaaggaaccgg

SEQ ID NO: 838574 - RNA, 20 nt, Mycobacterium avium subsp. paratuberculosis
gcaaagaucaaggaaccggc

SEQ ID NO: 838575 - RNA, 14 nt, Mycobacterium avium subsp. paratuberculosis
gcaaagcaccgcga

SEQ ID NO: 838576 - RNA, 17 nt, Mycobacterium avium subsp. paratuberculosis
gcaacacaugguccugc

SEQ ID NO: 838577 - RNA, 20 nt, Mycobacterium avium subsp. paratuberculosis
gcaacacaugguccugcacc

SEQ ID NO: 838578 - RNA, 12 nt, Mycobacterium avium subsp. paratuberculosis
gcaacaccagcu

SEQ ID NO: 838579 - RNA, 21 nt, Mycobacterium avium subsp. paratuberculosis
gcaacaccagggugcgcagcg

SEQ ID NO: 838580 - RNA, 19 nt, Mycobacterium avium subsp. paratuberculosis
gcaacaugauuccgccggg

SEQ ID NO: 838581 - RNA, 20 nt, Mycobacterium avium subsp. paratuberculosis
gcaacaugauuccgccgggc

SEQ ID NO: 838582 - RNA, 21 nt, Mycobacterium avium subsp. paratuberculosis
gcaacaugauuccgccgggcg

SEQ ID NO: 838583 - RNA, 22 nt, Mycobacterium avium subsp. paratuberculosis
gcaacaccgaaagccgacaccu

SEQ ID NO: 838584 - RNA, 17 nt, Mycobacterium avium subsp. paratuberculosis
gcaacaccgaacgccga

SEQ ID NO: 838585 - RNA, 19 nt, Mycobacterium avium subsp. paratuberculosis
gcaacaccgaacgccgagg

SEQ ID NO: 838586 - RNA, 15 nt, Mycobacterium avium subsp. paratuberculosis
gcaaccccgcggugc

SEQ ID NO: 838587 - RNA, 18 nt, Mycobacterium avium subsp. paratuberculosis
gcaacccgaaagccccca

SEQ ID NO: 838588 - RNA, 18 nt, Mycobacterium avium subsp. paratuberculosis
gaugguauccgaucgcgg

SEQ ID NO: 838589 - RNA, 23 nt, Mycobacterium avium subsp. paratuberculosis
gauggucaccgugucggcgggcg

SEQ ID NO: 838590 - RNA, 18 nt, Mycobacterium avium subsp. paratuberculosis
gaugggugggcagcucgg

SEQ ID NO: 838591 - RNA, 21 nt, Mycobacterium avium subsp. paratuberculosis
gaugggugggcagcucggugg

SEQ ID NO: 838592 - RNA, 17 nt, Mycobacterium avium subsp. paratuberculosis
gauggguguggcgucga

SEQ ID NO: 838593 - RNA, 17 nt, Mycobacterium avium subsp. paratuberculosis
gauggguuggccgucgc

SEQ ID NO: 838594 - RNA, 12 nt, Mycobacterium avium subsp. paratuberculosis
gaugggugagcg

SEQ ID NO: 838595 - RNA, 20 nt, Mycobacterium avium subsp. paratuberculosis
gaugggggugccgcagcggc

SEQ ID NO: 838596 - RNA, 16 nt, Mycobacterium avium subsp. paratuberculosis
gauggcgucggccagc

SEQ ID NO: 838597 - RNA, 20 nt, Mycobacterium avium subsp. paratuberculosis
gauggcgugccacagcauga

SEQ ID NO: 838598 - RNA, 15 nt, Mycobacterium avium subsp. paratuberculosis
gauggcgugccggcg

SEQ ID NO: 838599 - RNA, 18 nt, Mycobacterium avium subsp. paratuberculosis
gauggcguucaucgucca

SEQ ID NO: 838600 - RNA, 16 nt, Mycobacterium avium subsp. paratuberculosis
gauggcgauggccugc

SEQ ID NO: 838601 - RNA, 22 nt, Mycobacterium avium subsp. paratuberculosis
gauggcgaucagaugcucgucg

SEQ ID NO: 838602 - RNA, 23 nt, Mycobacterium avium subsp. paratuberculosis
gauggcgaucagaugcucgucgg

SEQ ID NO: 838603 - RNA, 13 nt, Mycobacterium avium subsp. paratuberculosis
gauggcgaccgcg

SEQ ID NO: 838604 - RNA, 15 nt, Mycobacterium avium subsp. paratuberculosis
gauggcgaccgcgca

SEQ ID NO: 838605 - RNA, 15 nt, Mycobacterium avium subsp. paratuberculosis
gauggcgacgcacga

SEQ ID NO: 838606 - RNA, 13 nt, Mycobacterium avium subsp. paratuberculosis
gauggcgacggcg

SEQ ID NO: 838607 - RNA, 20 nt, Mycobacterium avium subsp. paratuberculosis
gauggcgaggaaguccggcg

SEQ ID NO: 838608 - RNA, 16 nt, Mycobacterium avium subsp. paratuberculosis
gauggcgccgucgagg

SEQ ID NO: 838609 - RNA, 20 nt, Mycobacterium avium subsp. paratuberculosis
gauggcgcccagcccgagca

SEQ ID NO: 838610 - RNA, 13 nt, Mycobacterium avium subsp. paratuberculosis
gauggcgcccggc

SEQ ID NO: 838611 - RNA, 19 nt, Mycobacterium avium subsp. paratuberculosis
gauggcgguccaccaccac

SEQ ID NO: 838612 - RNA, 20 nt, Mycobacterium avium subsp. paratuberculosis
gauggcgguccaccaccaca

SEQ ID NO: 838613 - RNA, 14 nt, Mycobacterium avium subsp. paratuberculosis
gauggcggucgcgc

SEQ ID NO: 838614 - RNA, 23 nt, Mycobacterium avium subsp. paratuberculosis
gauggcggucgcgccagacgucc

SEQ ID NO: 838615 - RNA, 19 nt, Mycobacterium avium subsp. paratuberculosis
gauggcggguuggugucga

SEQ ID NO: 838616 - RNA, 22 nt, Mycobacterium avium subsp. paratuberculosis
gauggcggguuggugucgaaca

SEQ ID NO: 838617 - RNA, 14 nt, Mycobacterium avium subsp. paratuberculosis
gauggcgccgaucg

SEQ ID NO: 838618 - RNA, 22 nt, Mycobacterium avium subsp. paratuberculosis
gauggcgccgaucgcgcgcagg

SEQ ID NO: 838619 - RNA, 16 nt, Mycobacterium avium subsp. paratuberculosis
gauggcgggcgcgccg

SEQ ID NO: 838620 - RNA, 12 nt, Mycobacterium avium subsp. paratuberculosis
gauggcggcguc

SEQ ID NO: 838621 - RNA, 18 nt, Mycobacterium avium subsp. paratuberculosis
gauggcggcgucgaguuc

SEQ ID NO: 838622 - RNA, 16 nt, Mycobacterium avium subsp. paratuberculosis
gauggcggcguugcgg

SEQ ID NO: 838623 - RNA, 12 nt, Mycobacterium avium subsp. paratuberculosis
gauggcggcggc

SEQ ID NO: 838624 - RNA, 19 nt, Mycobacterium avium subsp. paratuberculosis
gauggcggcggcccgccgc

SEQ ID NO: 838625 - RNA, 20 nt, Mycobacterium avium subsp. paratuberculosis
gauggcggcggcccgccgcg

SEQ ID NO: 838626 - RNA, 21 nt, Mycobacterium avium subsp. paratuberculosis
gauggcggcggcccgccgcgc

SEQ ID NO: 838627 - RNA, 18 nt, Mycobacterium avium subsp. paratuberculosis
gaugguggccgucggccu

SEQ ID NO: 838628 - RNA, 18 nt, Mycobacterium avium subsp. paratuberculosis
gauggugggcaccgcgaa

SEQ ID NO: 838629 - RNA, 16 nt, Mycobacterium avium subsp. paratuberculosis
gauggugguaccgacc

SEQ ID NO: 838630 - RNA, 17 nt, Mycobacterium avium subsp. paratuberculosis
gauggugguaccgaccu

SEQ ID NO: 838631 - RNA, 17 nt, Mycobacterium avium subsp. paratuberculosis
gaugguguacacgucgc

SEQ ID NO: 838632 - RNA, 19 nt, Mycobacterium avium subsp. paratuberculosis
gaugguguacacgucgcgg

SEQ ID NO: 838633 - RNA, 15 nt, Mycobacterium avium subsp. paratuberculosis
gauggugccgucggc

SEQ ID NO: 838634 - RNA, 17 nt, Mycobacterium avium subsp. paratuberculosis
gauggugccgucggcgg

SEQ ID NO: 838635 - RNA, 17 nt, Mycobacterium avium subsp. paratuberculosis
gauggugccgccgguga

SEQ ID NO: 838636 - RNA, 17 nt, Mycobacterium avium subsp. paratuberculosis
gauggugcgccgggucg

SEQ ID NO: 838637 - RNA, 20 nt, Mycobacterium avium subsp. paratuberculosis
gauggugcgccgggucgcgg

SEQ ID NO: 838638 - RNA, 23 nt, Mycobacterium avium subsp. paratuberculosis
gauggugcgccgggucgcggugg

SEQ ID NO: 838639 - RNA, 23 nt, Mycobacterium avium subsp. paratuberculosis
gaugguguggaucgcuucggcca

SEQ ID NO: 838640 - RNA, 23 nt, Mycobacterium avium subsp. paratuberculosis
gaugguguugcucuggccgaucu

SEQ ID NO: 838641 - RNA, 19 nt, Mycobacterium avium subsp. paratuberculosis
gaugucccauugcacaucc

SEQ ID NO: 838642 - RNA, 19 nt, Mycobacterium avium subsp. paratuberculosis
gauguccccgcgggugacg

SEQ ID NO: 838643 - RNA, 21 nt, Mycobacterium avium subsp. paratuberculosis
gauguccaggccgucgaggcg

SEQ ID NO: 838644 - RNA, 13 nt, Mycobacterium avium subsp. paratuberculosis
gaugucgucgacg

SEQ ID NO: 838645 - RNA, 15 nt, Mycobacterium avium subsp. paratuberculosis
gaugucgucgccggu

SEQ ID NO: 838646 - RNA, 16 nt, Mycobacterium avium subsp. paratuberculosis
gaugucgucgucgacg

SEQ ID NO: 838647 - RNA, 17 nt, Mycobacterium avium subsp. paratuberculosis
gaugucgaaacccagga

SEQ ID NO: 838648 - RNA, 22 nt, Mycobacterium avium subsp. paratuberculosis
gaugucggugguggggccggcg

SEQ ID NO: 838649 - RNA, 22 nt, Mycobacterium avium subsp. paratuberculosis
gaugucgguguggaccgcgcag

SEQ ID NO: 838650 - RNA, 23 nt, Mycobacterium avium subsp. paratuberculosis
gaugucgguguggaccgcgcagu

SEQ ID NO: 838651 - RNA, 17 nt, Mycobacterium avium subsp. paratuberculosis
gaugucguuggugucga

SEQ ID NO: 838652 - RNA, 14 nt, Mycobacterium avium subsp. paratuberculosis
gaugucuccgcgca

SEQ ID NO: 838653 - RNA, 16 nt, Mycobacterium avium subsp. paratuberculosis
gaugucuccgcgcagc

SEQ ID NO: 838654 - RNA, 15 nt, Mycobacterium avium subsp. paratuberculosis
gauguccuacggcgg

SEQ ID NO: 838655 - RNA, 13 nt, Mycobacterium avium subsp. paratuberculosis
gaugucgacccgc

SEQ ID NO: 838656 - RNA, 15 nt, Mycobacterium avium subsp. paratuberculosis
gaugucgacccgcgg

SEQ ID NO: 838657 - RNA, 17 nt, Mycobacterium avium subsp. paratuberculosis
gaugucgacccgcggcg

SEQ ID NO: 838658 - RNA, 21 nt, Mycobacterium avium subsp. paratuberculosis
gaugucgacccgcggcgccgc

SEQ ID NO: 838659 - RNA, 23 nt, Mycobacterium avium subsp. paratuberculosis
gaugucgacccgcggcgccgcgg

SEQ ID NO: 838660 - RNA, 22 nt, Mycobacterium avium subsp. paratuberculosis
gaugucgacgucgucgacccgc

SEQ ID NO: 838661 - RNA, 15 nt, Mycobacterium avium subsp. paratuberculosis
gauguccgacagccc

SEQ ID NO: 838662 - RNA, 16 nt, Mycobacterium avium subsp. paratuberculosis
gauguccgacagcccg

SEQ ID NO: 838663 - RNA, 14 nt, Mycobacterium avium subsp. paratuberculosis
gauguccgccggcc

SEQ ID NO: 838664 - RNA, 15 nt, Mycobacterium avium subsp. paratuberculosis
gauguccgccggccg

SEQ ID NO: 838665 - RNA, 17 nt, Mycobacterium avium subsp. paratuberculosis
gauguccgccggccggu

SEQ ID NO: 838666 - RNA, 13 nt, Mycobacterium avium subsp. paratuberculosis
gaugcgggccaca

SEQ ID NO: 838667 - RNA, 16 nt, Mycobacterium avium subsp. paratuberculosis
gaugcgggccacacac

SEQ ID NO: 838668 - RNA, 14 nt, Mycobacterium avium subsp. paratuberculosis
gaugcggggccggc

SEQ ID NO: 838669 - RNA, 16 nt, Mycobacterium avium subsp. paratuberculosis
gaugcggggccggcgg

SEQ ID NO: 838670 - RNA, 18 nt, Mycobacterium avium subsp. paratuberculosis
gaugcggguguugcgcag

SEQ ID NO: 838671 - RNA, 16 nt, Mycobacterium avium subsp. paratuberculosis
gaugcggggcggcggg

SEQ ID NO: 838672 - RNA, 12 nt, Mycobacterium avium subsp. paratuberculosis
gaugcggcuccc

SEQ ID NO: 838673 - RNA, 14 nt, Mycobacterium avium subsp. paratuberculosis
gaugcggcgcccac

SEQ ID NO: 838674 - RNA, 15 nt, Mycobacterium avium subsp. paratuberculosis
gaugcggcgcccaca

SEQ ID NO: 838675 - RNA, 12 nt, Mycobacterium avium subsp. paratuberculosis
gaucugcucggc

SEQ ID NO: 838676 - RNA, 19 nt, Mycobacterium avium subsp. paratuberculosis
gaucuggccggugagcgga

SEQ ID NO: 838677 - RNA, 17 nt, Mycobacterium avium subsp. paratuberculosis
gaucugcgccgccuccg

SEQ ID NO: 838678 - RNA, 18 nt, Mycobacterium avium subsp. paratuberculosis
gaucugcuccgggguggc

SEQ ID NO: 838679 - RNA, 22 nt, Mycobacterium avium subsp. paratuberculosis
gaucugcuccucggucagcggc

SEQ ID NO: 838680 - RNA, 14 nt, Mycobacterium avium subsp. paratuberculosis
gaucucggccaccg

SEQ ID NO: 838681 - RNA, 22 nt, Mycobacterium avium subsp. paratuberculosis
gaucucgucgcacaaccgggcc

SEQ ID NO: 838682 - RNA, 16 nt, Mycobacterium avium subsp. paratuberculosis
gaucucgucgcgcagc

SEQ ID NO: 838683 - RNA, 17 nt, Mycobacterium avium subsp. paratuberculosis
gaucucgucgcgcagcu

SEQ ID NO: 838684 - RNA, 15 nt, Mycobacterium avium subsp. paratuberculosis
gaucucgucgcggcu

SEQ ID NO: 838685 - RNA, 17 nt, Mycobacterium avium subsp. paratuberculosis
gaucucgucgcggcugc

SEQ ID NO: 838686 - RNA, 16 nt, Mycobacterium avium subsp. paratuberculosis
gaucucguagguggcc

SEQ ID NO: 838687 - RNA, 21 nt, Mycobacterium avium subsp. paratuberculosis
gaucucgucccacggcggggu

SEQ ID NO: 838688 - RNA, 19 nt, Mycobacterium avium subsp. paratuberculosis
gaugcguuccaggugugcc

SEQ ID NO: 838689 - RNA, 22 nt, Mycobacterium avium subsp. paratuberculosis
gaugcguuccaggugugccgcu

SEQ ID NO: 838690 - RNA, 16 nt, Mycobacterium avium subsp. paratuberculosis
gaugcggugccgggcc

SEQ ID NO: 838691 - RNA, 19 nt, Mycobacterium avium subsp. paratuberculosis
gaugcggucggcgcggggc

SEQ ID NO: 838692 - RNA, 21 nt, Mycobacterium avium subsp. paratuberculosis
gauggaauucgucggcggugu

SEQ ID NO: 838693 - RNA, 21 nt, Mycobacterium avium subsp. paratuberculosis
gaugcuucccauuucggcgaa

SEQ ID NO: 838694 - RNA, 22 nt, Mycobacterium avium subsp. paratuberculosis
gaugcuggggucggccagcgaa

SEQ ID NO: 838695 - RNA, 20 nt, Mycobacterium avium subsp. paratuberculosis
gaugcuggccaucgccgagc

SEQ ID NO: 838696 - RNA, 22 nt, Mycobacterium avium subsp. paratuberculosis
gaugcugucgcgggucuggcuc

SEQ ID NO: 838697 - RNA, 16 nt, Mycobacterium avium subsp. paratuberculosis
gaugcugugcgcuugg

SEQ ID NO: 838698 - RNA, 16 nt, Mycobacterium avium subsp. paratuberculosis
gauggcgaaccagcgc

SEQ ID NO: 838699 - RNA, 20 nt, Mycobacterium avium subsp. paratuberculosis
gauggcgaaccagcgcccgc

SEQ ID NO: 838700 - RNA, 21 nt, Mycobacterium avium subsp. paratuberculosis
gauggcgaaccagcgcccgcu

SEQ ID NO: 838701 - RNA, 12 nt, Mycobacterium avium subsp. paratuberculosis
gauggccgcccg

SEQ ID NO: 838702 - RNA, 14 nt, Mycobacterium avium subsp. paratuberculosis
gauggccgcccgca

SEQ ID NO: 838703 - RNA, 14 nt, Mycobacterium avium subsp. paratuberculosis
gauggccgacaaca

SEQ ID NO: 838704 - RNA, 23 nt, Mycobacterium avium subsp. paratuberculosis
gauggccgacaacauccgcgacg

SEQ ID NO: 838705 - RNA, 15 nt, Mycobacterium avium subsp. paratuberculosis
gauggcccgcugcgc

SEQ ID NO: 838706 - RNA, 20 nt, Mycobacterium avium subsp. paratuberculosis
gauggcccgcugcgccgacu

SEQ ID NO: 838707 - RNA, 18 nt, Mycobacterium avium subsp. paratuberculosis
gauggcccaggccgcggu

SEQ ID NO: 838708 - RNA, 16 nt, Mycobacterium avium subsp. paratuberculosis
gauggccaucuggccg

SEQ ID NO: 838709 - RNA, 13 nt, Mycobacterium avium subsp. paratuberculosis
gauggccagcacc

SEQ ID NO: 838710 - RNA, 16 nt, Mycobacterium avium subsp. paratuberculosis
gauggccagcaccacc

SEQ ID NO: 838711 - RNA, 14 nt, Mycobacterium avium subsp. paratuberculosis
gauggccagcaggu

SEQ ID NO: 838712 - RNA, 14 nt, Mycobacterium avium subsp. paratuberculosis
gauggccagcgcgu

SEQ ID NO: 838713 - RNA, 20 nt, Mycobacterium avium subsp. paratuberculosis
gauggccagcgcgucgcaca

SEQ ID NO: 838714 - RNA, 15 nt, Mycobacterium avium subsp. paratuberculosis
gauggccagcgcggc

SEQ ID NO: 838715 - RNA, 16 nt, Mycobacterium avium subsp. paratuberculosis
gauggccagcgcggcg

SEQ ID NO: 838716 - RNA, 22 nt, Mycobacterium avium subsp. paratuberculosis
gauggacagggcgacaucggca

SEQ ID NO: 838717 - RNA, 17 nt, Mycobacterium avium subsp. paratuberculosis
gauggacaucuccggca

SEQ ID NO: 838718 - RNA, 19 nt, Mycobacterium avium subsp. paratuberculosis
gauggacaucuccggcacg

SEQ ID NO: 838719 - RNA, 23 nt, Mycobacterium avium subsp. paratuberculosis
gauggccacgcucucgccgguca

SEQ ID NO: 838720 - RNA, 13 nt, Mycobacterium avium subsp. paratuberculosis
gcaauacaccgcg

SEQ ID NO: 838721 - RNA, 22 nt, Mycobacterium avium subsp. paratuberculosis
gcaauacaccgcgaacucgucg

SEQ ID NO: 838722 - RNA, 22 nt, Mycobacterium avium subsp. paratuberculosis
gcaagucgucggugggccgccg

SEQ ID NO: 838723 - RNA, 13 nt, Mycobacterium avium subsp. paratuberculosis
gcaagucgaacgg

SEQ ID NO: 838724 - RNA, 20 nt, Mycobacterium avium subsp. paratuberculosis
gcaagggccgacaucgucgg

SEQ ID NO: 838725 - RNA, 13 nt, Mycobacterium avium subsp. paratuberculosis
gcaaggucgucgc

SEQ ID NO: 838726 - RNA, 15 nt, Mycobacterium avium subsp. paratuberculosis
gcaaggucgucgcgg

SEQ ID NO: 838727 - RNA, 16 nt, Mycobacterium avium subsp. paratuberculosis
gcaaggccagcaaccg

SEQ ID NO: 838728 - RNA, 12 nt, Mycobacterium avium subsp. paratuberculosis
gcaaggccgcca

SEQ ID NO: 838729 - RNA, 17 nt, Mycobacterium avium subsp. paratuberculosis
gcaaggcccccgccucg

SEQ ID NO: 838730 - RNA, 14 nt, Mycobacterium avium subsp. paratuberculosis
gcaaggccugcgcc

SEQ ID NO: 838731 - RNA, 18 nt, Mycobacterium avium subsp. paratuberculosis
gcaauacggugcccgccg

SEQ ID NO: 838732 - RNA, 13 nt, Mycobacterium avium subsp. paratuberculosis
gcaauaccggcag

SEQ ID NO: 838733 - RNA, 20 nt, Mycobacterium avium subsp. paratuberculosis
gcaauccugcccggucugcg

SEQ ID NO: 838734 - RNA, 21 nt, Mycobacterium avium subsp. paratuberculosis
gcaauccgcugaacgggcagc

SEQ ID NO: 838735 - RNA, 14 nt, Mycobacterium avium subsp. paratuberculosis
gcaaucgagcgggc

SEQ ID NO: 838736 - RNA, 16 nt, Mycobacterium avium subsp. paratuberculosis
gcaaucgagcgggcgg

SEQ ID NO: 838737 - RNA, 19 nt, Mycobacterium avium subsp. paratuberculosis
gcaauccuguuccccggcg

SEQ ID NO: 838738 - RNA, 21 nt, Mycobacterium avium subsp. paratuberculosis
gcacaacagccaugccggugg

SEQ ID NO: 838739 - RNA, 20 nt, Mycobacterium avium subsp. paratuberculosis
gcacaacccgcccgggucgu

SEQ ID NO: 838740 - RNA, 23 nt, Mycobacterium avium subsp. paratuberculosis
gcacaacccgcccgggucgucgg

SEQ ID NO: 838741 - RNA, 22 nt, Mycobacterium avium subsp. paratuberculosis
gcacaacgaggcccggacggcc

SEQ ID NO: 838742 - RNA, 14 nt, Mycobacterium avium subsp. paratuberculosis
gcacaccgagcgag

SEQ ID NO: 838743 - RNA, 22 nt, Mycobacterium avium subsp. paratuberculosis
gcacacccucaccccgcccagc

SEQ ID NO: 838744 - RNA, 17 nt, Mycobacterium avium subsp. paratuberculosis
gcacaccagcacggcgg

SEQ ID NO: 838745 - RNA, 18 nt, Mycobacterium avium subsp. paratuberculosis
gcacacccgcagcgaccg

SEQ ID NO: 838746 - RNA, 19 nt, Mycobacterium avium subsp. paratuberculosis
gcacacccgcagcgaccgc

SEQ ID NO: 838747 - RNA, 13 nt, Mycobacterium avium subsp. paratuberculosis
gcacacccggugc

SEQ ID NO: 838748 - RNA, 16 nt, Mycobacterium avium subsp. paratuberculosis
gcacacccggugcgcc

SEQ ID NO: 838749 - RNA, 18 nt, Mycobacterium avium subsp. paratuberculosis
gcacacccggugcgccgg

SEQ ID NO: 838750 - RNA, 17 nt, Mycobacterium avium subsp. paratuberculosis
gcacaccagcguucguc

SEQ ID NO: 838751 - RNA, 20 nt, Mycobacterium avium subsp. paratuberculosis
gcacaccagcguucgucgcc

SEQ ID NO: 838752 - RNA, 22 nt, Mycobacterium avium subsp. paratuberculosis
gcacaccagguaggcgguggcg

SEQ ID NO: 838753 - RNA, 16 nt, Mycobacterium avium subsp. paratuberculosis
gcacacccagcgagcc

SEQ ID NO: 838754 - RNA, 16 nt, Mycobacterium avium subsp. paratuberculosis
gcacacccucgacccg

SEQ ID NO: 838755 - RNA, 17 nt, Mycobacterium avium subsp. paratuberculosis
gcacacccucgacccgu

SEQ ID NO: 838756 - RNA, 14 nt, Mycobacterium avium subsp. paratuberculosis
gcacaccgcgcaga

SEQ ID NO: 838757 - RNA, 14 nt, Mycobacterium avium subsp. paratuberculosis
gcacaccgcggcgg

SEQ ID NO: 838758 - RNA, 20 nt, Mycobacterium avium subsp. paratuberculosis
gcacaccgcggcggcgucgg

SEQ ID NO: 838759 - RNA, 19 nt, Mycobacterium avium subsp. paratuberculosis
gcacaccggaucggcugcg

SEQ ID NO: 838760 - RNA, 18 nt, Mycobacterium avium subsp. paratuberculosis
gcaaucggggccgacccg

SEQ ID NO: 838761 - RNA, 20 nt, Mycobacterium avium subsp. paratuberculosis
gcaaugguugcggcgggccg

SEQ ID NO: 838762 - RNA, 14 nt, Mycobacterium avium subsp. paratuberculosis
gcaaugcgucgcgg

SEQ ID NO: 838763 - RNA, 19 nt, Mycobacterium avium subsp. paratuberculosis
gcaaugcgucgcggcggcg

SEQ ID NO: 838764 - RNA, 18 nt, Mycobacterium avium subsp. paratuberculosis
gcaacuugcccgacggcg

SEQ ID NO: 838765 - RNA, 16 nt, Mycobacterium avium subsp. paratuberculosis
gcaacuguucgcggcu

SEQ ID NO: 838766 - RNA, 22 nt, Mycobacterium avium subsp. paratuberculosis
gcaacugcucgaccagcccccg

SEQ ID NO: 838767 - RNA, 16 nt, Mycobacterium avium subsp. paratuberculosis
gcaacuggcaacgcgu

SEQ ID NO: 838768 - RNA, 16 nt, Mycobacterium avium subsp. paratuberculosis
gcaacugggcggccug

SEQ ID NO: 838769 - RNA, 18 nt, Mycobacterium avium subsp. paratuberculosis
gcaacugggcggccugca

SEQ ID NO: 838770 - RNA, 20 nt, Mycobacterium avium subsp. paratuberculosis
gcaacugggcggccugcacc

SEQ ID NO: 838771 - RNA, 15 nt, Mycobacterium avium subsp. paratuberculosis
gcaacuccaccucgg

SEQ ID NO: 838772 - RNA, 20 nt, Mycobacterium avium subsp. paratuberculosis
gcaacuccacaaccagcgau

SEQ ID NO: 838773 - RNA, 16 nt, Mycobacterium avium subsp. paratuberculosis
gcaacuagcgacggcc

SEQ ID NO: 838774 - RNA, 17 nt, Mycobacterium avium subsp. paratuberculosis
gcaacuagcgacggccg

SEQ ID NO: 838775 - RNA, 13 nt, Mycobacterium avium subsp. paratuberculosis
gcaacucccgcgc

SEQ ID NO: 838776 - RNA, 14 nt, Mycobacterium avium subsp. paratuberculosis
gcaacucccgcgcc

SEQ ID NO: 838777 - RNA, 13 nt, Mycobacterium avium subsp. paratuberculosis
gcaacucgcgcuc

SEQ ID NO: 838778 - RNA, 14 nt, Mycobacterium avium subsp. paratuberculosis
gcaacugccgacgg

SEQ ID NO: 838779 - RNA, 13 nt, Mycobacterium avium subsp. paratuberculosis
gcaacugaccgau

SEQ ID NO: 838780 - RNA, 19 nt, Mycobacterium avium subsp. paratuberculosis
gcaacugaccgaucuggcg

SEQ ID NO: 838781 - RNA, 19 nt, Mycobacterium avium subsp. paratuberculosis
gcaacucguccagcgucgc

SEQ ID NO: 838782 - RNA, 22 nt, Mycobacterium avium subsp. paratuberculosis
gcaacucguccagcgucgcggc

SEQ ID NO: 838783 - RNA, 18 nt, Mycobacterium avium subsp. paratuberculosis
gcaacucguccaccagcu

SEQ ID NO: 838784 - RNA, 23 nt, Mycobacterium avium subsp. paratuberculosis
gcaagcaccggcuggccgagcgg

SEQ ID NO: 838785 - RNA, 22 nt, Mycobacterium avium subsp. paratuberculosis
gcaagaugugggcgucgucgau

SEQ ID NO: 838786 - RNA, 14 nt, Mycobacterium avium subsp. paratuberculosis
gcaacgccagccag

SEQ ID NO: 838787 - RNA, 14 nt, Mycobacterium avium subsp. paratuberculosis
gcaacgccagcgcg

SEQ ID NO: 838788 - RNA, 19 nt, Mycobacterium avium subsp. paratuberculosis
gcaacgccagcgcgacccg

SEQ ID NO: 838789 - RNA, 20 nt, Mycobacterium avium subsp. paratuberculosis
gcaacgccagcgcgacccgc

SEQ ID NO: 838790 - RNA, 13 nt, Mycobacterium avium subsp. paratuberculosis
gcaacgccggucu

SEQ ID NO: 838791 - RNA, 13 nt, Mycobacterium avium subsp. paratuberculosis
gcaacgcgccggc

SEQ ID NO: 838792 - RNA, 14 nt, Mycobacterium avium subsp. paratuberculosis
gcaacgcgccggcg

SEQ ID NO: 838793 - RNA, 15 nt, Mycobacterium avium subsp. paratuberculosis
gcaacgcgccggcgg

SEQ ID NO: 838794 - RNA, 18 nt, Mycobacterium avium subsp. paratuberculosis
gcaacgcgccggcggucg

SEQ ID NO: 838795 - RNA, 13 nt, Mycobacterium avium subsp. paratuberculosis
gcaacgccggcgu

SEQ ID NO: 838796 - RNA, 12 nt, Mycobacterium avium subsp. paratuberculosis
gcaacgccggcg

SEQ ID NO: 838797 - RNA, 16 nt, Mycobacterium avium subsp. paratuberculosis
gcaacgcgcgcgacgg

SEQ ID NO: 838798 - RNA, 21 nt, Mycobacterium avium subsp. paratuberculosis
gcaacgcgcgcgacggcgcgu

SEQ ID NO: 838799 - RNA, 23 nt, Mycobacterium avium subsp. paratuberculosis
gcaacgcggcggugacgaacccg

SEQ ID NO: 838800 - RNA, 15 nt, Mycobacterium avium subsp. paratuberculosis
gcaacgcgucggcgc

SEQ ID NO: 838801 - RNA, 17 nt, Mycobacterium avium subsp. paratuberculosis
gcaacgcgucggcgccg

SEQ ID NO: 838802 - RNA, 16 nt, Mycobacterium avium subsp. paratuberculosis
gcaacggcuggcgcag

SEQ ID NO: 838803 - RNA, 13 nt, Mycobacterium avium subsp. paratuberculosis
gcaacggcggucg

SEQ ID NO: 838804 - RNA, 15 nt, Mycobacterium avium subsp. paratuberculosis
gcaacggcggucgug

SEQ ID NO: 838805 - RNA, 16 nt, Mycobacterium avium subsp. paratuberculosis
gcaacggcggucgugc

SEQ ID NO: 838806 - RNA, 17 nt, Mycobacterium avium subsp. paratuberculosis
gcaacggcggucgugcg

SEQ ID NO: 838807 - RNA, 19 nt, Mycobacterium avium subsp. paratuberculosis
gcaacggcgucgacacccg

SEQ ID NO: 838808 - RNA, 20 nt, Mycobacterium avium subsp. paratuberculosis
gcaacggauuggucagagcc

SEQ ID NO: 838809 - RNA, 21 nt, Mycobacterium avium subsp. paratuberculosis
gcaacgcuuucgggucgacga

SEQ ID NO: 838810 - RNA, 13 nt, Mycobacterium avium subsp. paratuberculosis
gcaacggcggcgg

SEQ ID NO: 838811 - RNA, 14 nt, Mycobacterium avium subsp. paratuberculosis
gcaacggcggcggc

SEQ ID NO: 838812 - RNA, 17 nt, Mycobacterium avium subsp. paratuberculosis
gcaacguguacucggcg

SEQ ID NO: 838813 - RNA, 21 nt, Mycobacterium avium subsp. paratuberculosis
gcaacguguacucggcgucgc

SEQ ID NO: 838814 - RNA, 18 nt, Mycobacterium avium subsp. paratuberculosis
gcaacgugaugccguggu

SEQ ID NO: 838815 - RNA, 12 nt, Mycobacterium avium subsp. paratuberculosis
gcaacguuguuc

SEQ ID NO: 838816 - RNA, 13 nt, Mycobacterium avium subsp. paratuberculosis
gcaacguccucga

SEQ ID NO: 838817 - RNA, 19 nt, Mycobacterium avium subsp. paratuberculosis
gcaacgguacgugcgccgg

SEQ ID NO: 838818 - RNA, 21 nt, Mycobacterium avium subsp. paratuberculosis
gcaacgguacgugcgccggcg

SEQ ID NO: 838819 - RNA, 13 nt, Mycobacterium avium subsp. paratuberculosis
gcaaccgccggca

SEQ ID NO: 838820 - RNA, 14 nt, Mycobacterium avium subsp. paratuberculosis
gcaaccgccggcag

SEQ ID NO: 838821 - RNA, 20 nt, Mycobacterium avium subsp. paratuberculosis
gcaaccgccggcagcggcug

SEQ ID NO: 838822 - RNA, 15 nt, Mycobacterium avium subsp. paratuberculosis
gcaacccggugcccg

SEQ ID NO: 838823 - RNA, 15 nt, Mycobacterium avium subsp. paratuberculosis
gcaacccgccgagcg

SEQ ID NO: 838824 - RNA, 14 nt, Mycobacterium avium subsp. paratuberculosis
gcaaccggcggcug

SEQ ID NO: 838825 - RNA, 23 nt, Mycobacterium avium subsp. paratuberculosis
gcaaccggcggcugggcagccgc

SEQ ID NO: 838826 - RNA, 20 nt, Mycobacterium avium subsp. paratuberculosis
gcaaccgcggcggcggcccg

SEQ ID NO: 838827 - RNA, 21 nt, Mycobacterium avium subsp. paratuberculosis
gcaaccgcggcggcggcccgu

SEQ ID NO: 838828 - RNA, 22 nt, Mycobacterium avium subsp. paratuberculosis
gcaaccgggauaccgcgaccgc

SEQ ID NO: 838829 - RNA, 16 nt, Mycobacterium avium subsp. paratuberculosis
gcaaccgggccgcacc

SEQ ID NO: 838830 - RNA, 19 nt, Mycobacterium avium subsp. paratuberculosis
gcaaccgguccaguccggc

SEQ ID NO: 838831 - RNA, 17 nt, Mycobacterium avium subsp. paratuberculosis
gcaaccgguccgccguc

SEQ ID NO: 838832 - RNA, 18 nt, Mycobacterium avium subsp. paratuberculosis
gcaaccgguccgccgucg

SEQ ID NO: 838833 - RNA, 21 nt, Mycobacterium avium subsp. paratuberculosis
gcaaccuucuuggccggagcc

SEQ ID NO: 838834 - RNA, 15 nt, Mycobacterium avium subsp. paratuberculosis
gcaacgaacgcggcg

SEQ ID NO: 838835 - RNA, 13 nt, Mycobacterium avium subsp. paratuberculosis
gcaaccgguucgg

SEQ ID NO: 838836 - RNA, 22 nt, Mycobacterium avium subsp. paratuberculosis
gcaaccgguucggacacggcgc

SEQ ID NO: 838837 - RNA, 13 nt, Mycobacterium avium subsp. paratuberculosis
gcaacgacccggc

SEQ ID NO: 838838 - RNA, 14 nt, Mycobacterium avium subsp. paratuberculosis
gcaacgacccggcc

SEQ ID NO: 838839 - RNA, 23 nt, Mycobacterium avium subsp. paratuberculosis
gcaacgacccggccaccgccgcc

SEQ ID NO: 838840 - RNA, 15 nt, Mycobacterium avium subsp. paratuberculosis
gcaacgaggcggugg

SEQ ID NO: 838841 - RNA, 23 nt, Mycobacterium avium subsp. paratuberculosis
gcaacgaggcgguggugauggac

SEQ ID NO: 838842 - RNA, 17 nt, Mycobacterium avium subsp. paratuberculosis
gcaacgauucacccagc

SEQ ID NO: 838843 - RNA, 20 nt, Mycobacterium avium subsp. paratuberculosis
gcagaucaucgagggcgucc

SEQ ID NO: 838844 - RNA, 16 nt, Mycobacterium avium subsp. paratuberculosis
gcagaucaccacggug

SEQ ID NO: 838845 - RNA, 20 nt, Mycobacterium avium subsp. paratuberculosis
gcagaucaccacgguggccg

SEQ ID NO: 838846 - RNA, 18 nt, Mycobacterium avium subsp. paratuberculosis
gcagacgcaaaaaccccc

SEQ ID NO: 838847 - RNA, 17 nt, Mycobacterium avium subsp. paratuberculosis
gcagacgcaaaagcccc

SEQ ID NO: 838848 - RNA, 19 nt, Mycobacterium avium subsp. paratuberculosis
gcagacgcaaaagccccca

SEQ ID NO: 838849 - RNA, 18 nt, Mycobacterium avium subsp. paratuberculosis
gcagacgcaaaagccccg

SEQ ID NO: 838850 - RNA, 20 nt, Mycobacterium avium subsp. paratuberculosis
gcagacgcaaaagccccgcg

SEQ ID NO: 838851 - RNA, 21 nt, Mycobacterium avium subsp. paratuberculosis
gcagacgcaaaagccccgcga

SEQ ID NO: 838852 - RNA, 20 nt, Mycobacterium avium subsp. paratuberculosis
gcagacgcgaaagcacccga

SEQ ID NO: 838853 - RNA, 20 nt, Mycobacterium avium subsp. paratuberculosis
gcagacgguaugcccgccgc

SEQ ID NO: 838854 - RNA, 21 nt, Mycobacterium avium subsp. paratuberculosis
gcagacgguaugcccgccgcg

SEQ ID NO: 838855 - RNA, 17 nt, Mycobacterium avium subsp. paratuberculosis
gcagacggacacccgcg

SEQ ID NO: 838856 - RNA, 23 nt, Mycobacterium avium subsp. paratuberculosis
gcagacggacacccgcgcggugc

SEQ ID NO: 838857 - RNA, 15 nt, Mycobacterium avium subsp. paratuberculosis
gcacguuggcggcca

SEQ ID NO: 838858 - RNA, 21 nt, Mycobacterium avium subsp. paratuberculosis
gcacguugacguagacgacgg

SEQ ID NO: 838859 - RNA, 20 nt, Mycobacterium avium subsp. paratuberculosis
gcacgugggucaaccgguag

SEQ ID NO: 838860 - RNA, 19 nt, Mycobacterium avium subsp. paratuberculosis
gcacguguucgggaucggc

SEQ ID NO: 838861 - RNA, 18 nt, Mycobacterium avium subsp. paratuberculosis
gcacguguucucacggcg

SEQ ID NO: 838862 - RNA, 18 nt, Mycobacterium avium subsp. paratuberculosis
gcacgucgaggucggacg

SEQ ID NO: 838863 - RNA, 20 nt, Mycobacterium avium subsp. paratuberculosis
gcacgucgaggucggacgcc

SEQ ID NO: 838864 - RNA, 13 nt, Mycobacterium avium subsp. paratuberculosis
gcacgugcggguu

SEQ ID NO: 838865 - RNA, 22 nt, Mycobacterium avium subsp. paratuberculosis
gcacgugcggguuggcgccggu

SEQ ID NO: 838866 - RNA, 19 nt, Mycobacterium avium subsp. paratuberculosis
gcacguggcugaccgacgg

SEQ ID NO: 838867 - RNA, 15 nt, Mycobacterium avium subsp. paratuberculosis
gcacguugugcucgu

SEQ ID NO: 838868 - RNA, 19 nt, Mycobacterium avium subsp. paratuberculosis
gcacguugugcucgucgau

SEQ ID NO: 838869 - RNA, 21 nt, Mycobacterium avium subsp. paratuberculosis
gcacguugugcucgucgaugu

SEQ ID NO: 838870 - RNA, 20 nt, Mycobacterium avium subsp. paratuberculosis
gcacguugugggcgggcgcg

SEQ ID NO: 838871 - RNA, 21 nt, Mycobacterium avium subsp. paratuberculosis
gcacguugugggcgggcgcgu

SEQ ID NO: 838872 - RNA, 22 nt, Mycobacterium avium subsp. paratuberculosis
gcacguuguucaggucgauggu

SEQ ID NO: 838873 - RNA, 17 nt, Mycobacterium avium subsp. paratuberculosis
gcagaacuucuccgccg

SEQ ID NO: 838874 - RNA, 19 nt, Mycobacterium avium subsp. paratuberculosis
gcagaacuucuccgccggc

SEQ ID NO: 838875 - RNA, 20 nt, Mycobacterium avium subsp. paratuberculosis
gcagaacuucuccgccggca

SEQ ID NO: 838876 - RNA, 22 nt, Mycobacterium avium subsp. paratuberculosis
gcagaacuccauggaguugucg

SEQ ID NO: 838877 - RNA, 14 nt, Mycobacterium avium subsp. paratuberculosis
gcagaacucgucgc

SEQ ID NO: 838878 - RNA, 16 nt, Mycobacterium avium subsp. paratuberculosis
gcagaacucgucgcca

SEQ ID NO: 838879 - RNA, 19 nt, Mycobacterium avium subsp. paratuberculosis
gcagaagcuaacgccagcu

SEQ ID NO: 838880 - RNA, 17 nt, Mycobacterium avium subsp. paratuberculosis
gcagaagcuccacgccg

SEQ ID NO: 838881 - RNA, 16 nt, Mycobacterium avium subsp. paratuberculosis
gcagaaguugacgguc

SEQ ID NO: 838882 - RNA, 14 nt, Mycobacterium avium subsp. paratuberculosis
gcagaccggugagc

SEQ ID NO: 838883 - RNA, 20 nt, Mycobacterium avium subsp. paratuberculosis
gcagaccguccgguucggcg

SEQ ID NO: 838884 - RNA, 20 nt, Mycobacterium avium subsp. paratuberculosis
gcagaccggugagcaccggg

SEQ ID NO: 838885 - RNA, 20 nt, Mycobacterium avium subsp. paratuberculosis
gcagaccgccggugcgcagc

SEQ ID NO: 838886 - RNA, 21 nt, Mycobacterium avium subsp. paratuberculosis
gcagaccgccggugcgcagcu

SEQ ID NO: 838887 - RNA, 18 nt, Mycobacterium avium subsp. paratuberculosis
gcagaccgcgaucagccc

SEQ ID NO: 838888 - RNA, 20 nt, Mycobacterium avium subsp. paratuberculosis
gcagaccggacagcugggcg

SEQ ID NO: 838889 - RNA, 15 nt, Mycobacterium avium subsp. paratuberculosis
gcagacccgguggcc

SEQ ID NO: 838890 - RNA, 16 nt, Mycobacterium avium subsp. paratuberculosis
gcagacccgguggccg

SEQ ID NO: 838891 - RNA, 19 nt, Mycobacterium avium subsp. paratuberculosis
gcagaucugcaggguuucc

SEQ ID NO: 838892 - RNA, 16 nt, Mycobacterium avium subsp. paratuberculosis
gcagaugaccggccug

SEQ ID NO: 838893 - RNA, 15 nt, Mycobacterium avium subsp. paratuberculosis
gcagaugccgcccag

SEQ ID NO: 838894 - RNA, 16 nt, Mycobacterium avium subsp. paratuberculosis
gcagaugaugccguca

SEQ ID NO: 838895 - RNA, 14 nt, Mycobacterium avium subsp. paratuberculosis
gcagaucggguccc

SEQ ID NO: 838896 - RNA, 17 nt, Mycobacterium avium subsp. paratuberculosis
gcagaucguccaucgcg

SEQ ID NO: 838897 - RNA, 21 nt, Mycobacterium avium subsp. paratuberculosis
gcagaucguccaucgcgucgu

SEQ ID NO: 838898 - RNA, 16 nt, Mycobacterium avium subsp. paratuberculosis
gcagaucgucgaacuc

SEQ ID NO: 838899 - RNA, 12 nt, Mycobacterium avium subsp. paratuberculosis
gcagaucgucgg

SEQ ID NO: 838900 - RNA, 14 nt, Mycobacterium avium subsp. paratuberculosis
gcagaucguugggc

SEQ ID NO: 838901 - RNA, 17 nt, Mycobacterium avium subsp. paratuberculosis
gcagauccgcucgccgu

SEQ ID NO: 838902 - RNA, 14 nt, Mycobacterium avium subsp. paratuberculosis
gcagaucccgccgg

SEQ ID NO: 838903 - RNA, 15 nt, Mycobacterium avium subsp. paratuberculosis
gcagaucccgccggc

SEQ ID NO: 838904 - RNA, 18 nt, Mycobacterium avium subsp. paratuberculosis
gcagaucccgccggcggc

SEQ ID NO: 838905 - RNA, 19 nt, Mycobacterium avium subsp. paratuberculosis
gcagaucgcgcaucacccg

SEQ ID NO: 838906 - RNA, 22 nt, Mycobacterium avium subsp. paratuberculosis
gcagaucgcgcaucacccggcg

SEQ ID NO: 838907 - RNA, 19 nt, Mycobacterium avium subsp. paratuberculosis
gcagaucgccagcaccggc

SEQ ID NO: 838908 - RNA, 20 nt, Mycobacterium avium subsp. paratuberculosis
gcagaucgccagcaccggcg

SEQ ID NO: 838909 - RNA, 16 nt, Mycobacterium avium subsp. paratuberculosis
gcagaucgagaucagg

SEQ ID NO: 838910 - RNA, 18 nt, Mycobacterium avium subsp. paratuberculosis
gcagaucgagaucagggc

SEQ ID NO: 838911 - RNA, 19 nt, Mycobacterium avium subsp. paratuberculosis
gcagaucgagaucagggcg

SEQ ID NO: 838912 - RNA, 18 nt, Mycobacterium avium subsp. paratuberculosis
gcagcaccuugccggucg

SEQ ID NO: 838913 - RNA, 21 nt, Mycobacterium avium subsp. paratuberculosis
gcagcacgaucgagccggugg

SEQ ID NO: 838914 - RNA, 14 nt, Mycobacterium avium subsp. paratuberculosis
gcagcaccagggcg

SEQ ID NO: 838915 - RNA, 15 nt, Mycobacterium avium subsp. paratuberculosis
gcagcaccagggcgu

SEQ ID NO: 838916 - RNA, 15 nt, Mycobacterium avium subsp. paratuberculosis
gcagcaccauccgcg

SEQ ID NO: 838917 - RNA, 16 nt, Mycobacterium avium subsp. paratuberculosis
gcagcaccauccgcgc

SEQ ID NO: 838918 - RNA, 17 nt, Mycobacterium avium subsp. paratuberculosis
gcagcaccccgaucgcg

SEQ ID NO: 838919 - RNA, 18 nt, Mycobacterium avium subsp. paratuberculosis
gcagcacccgacuucggc

SEQ ID NO: 838920 - RNA, 16 nt, Mycobacterium avium subsp. paratuberculosis
gcagcacccgcaccgu

SEQ ID NO: 838921 - RNA, 17 nt, Mycobacterium avium subsp. paratuberculosis
gcagcacccgcaccgug

SEQ ID NO: 838922 - RNA, 13 nt, Mycobacterium avium subsp. paratuberculosis
gcagcaccacccg

SEQ ID NO: 838923 - RNA, 16 nt, Mycobacterium avium subsp. paratuberculosis
gcagcaccacccgcac

SEQ ID NO: 838924 - RNA, 22 nt, Mycobacterium avium subsp. paratuberculosis
gcagcaccacccgcaccucgcc

SEQ ID NO: 838925 - RNA, 12 nt, Mycobacterium avium subsp. paratuberculosis
gcagcaccaggc

SEQ ID NO: 838926 - RNA, 15 nt, Mycobacterium avium subsp. paratuberculosis
gcagcaccaggcuga

SEQ ID NO: 838927 - RNA, 21 nt, Mycobacterium avium subsp. paratuberculosis
gcagcaccaggcugaccagcg

SEQ ID NO: 838928 - RNA, 21 nt, Mycobacterium avium subsp. paratuberculosis
gcagcaccagaugcaccucgc

SEQ ID NO: 838929 - RNA, 22 nt, Mycobacterium avium subsp. paratuberculosis
gcagcaccagaugcaccucgcc

SEQ ID NO: 838930 - RNA, 14 nt, Mycobacterium avium subsp. paratuberculosis
gcagcaccagcgcc

SEQ ID NO: 838931 - RNA, 15 nt, Mycobacterium avium subsp. paratuberculosis
gcagcaccagcgccg

SEQ ID NO: 838932 - RNA, 19 nt, Mycobacterium avium subsp. paratuberculosis
gcagcaccagcgccgcgau

SEQ ID NO: 838933 - RNA, 22 nt, Mycobacterium avium subsp. paratuberculosis
gcagcaccagcgccgcgaugau

SEQ ID NO: 838934 - RNA, 13 nt, Mycobacterium avium subsp. paratuberculosis
gcagcaccagcgg

SEQ ID NO: 838935 - RNA, 20 nt, Mycobacterium avium subsp. paratuberculosis
gcagcaccagcggcaccagg

SEQ ID NO: 838936 - RNA, 22 nt, Mycobacterium avium subsp. paratuberculosis
gcagcaccagcguggccggcag

SEQ ID NO: 838937 - RNA, 17 nt, Mycobacterium avium subsp. paratuberculosis
gcagauggucgccgacg

SEQ ID NO: 838938 - RNA, 20 nt, Mycobacterium avium subsp. paratuberculosis
gcagcacaccuuccaccacc

SEQ ID NO: 838939 - RNA, 16 nt, Mycobacterium avium subsp. paratuberculosis
gcagcacagcgggauc

SEQ ID NO: 838940 - RNA, 22 nt, Mycobacterium avium subsp. paratuberculosis
gcagcacauccgguugcaccgc

SEQ ID NO: 838941 - RNA, 23 nt, Mycobacterium avium subsp. paratuberculosis
gcagaugcgugcgguggucggcg

SEQ ID NO: 838942 - RNA, 14 nt, Mycobacterium avium subsp. paratuberculosis
gcagcagcaucggu

SEQ ID NO: 838943 - RNA, 18 nt, Mycobacterium avium subsp. paratuberculosis
gcagcagcaucgguccca

SEQ ID NO: 838944 - RNA, 17 nt, Mycobacterium avium subsp. paratuberculosis
gcagcagccacgccagc

SEQ ID NO: 838945 - RNA, 19 nt, Mycobacterium avium subsp. paratuberculosis
gcagcagccacgccagcca

SEQ ID NO: 838946 - RNA, 23 nt, Mycobacterium avium subsp. paratuberculosis
gcagcagccacgccagccaggcg

SEQ ID NO: 838947 - RNA, 23 nt, Mycobacterium avium subsp. paratuberculosis
gcagcagcccgaacagccgggcg

SEQ ID NO: 838948 - RNA, 22 nt, Mycobacterium avium subsp. paratuberculosis
gcagcagcccgaucacccccga

SEQ ID NO: 838949 - RNA, 12 nt, Mycobacterium avium subsp. paratuberculosis
gcagcagcccgc

SEQ ID NO: 838950 - RNA, 23 nt, Mycobacterium avium subsp. paratuberculosis
gcagcagaucggcgucacugccc

SEQ ID NO: 838951 - RNA, 19 nt, Mycobacterium avium subsp. paratuberculosis
gcagcagaugcgccucgau

SEQ ID NO: 838952 - RNA, 12 nt, Mycobacterium avium subsp. paratuberculosis
gcagcagcacca

SEQ ID NO: 838953 - RNA, 14 nt, Mycobacterium avium subsp. paratuberculosis
gcagcagcaccagg

SEQ ID NO: 838954 - RNA, 14 nt, Mycobacterium avium subsp. paratuberculosis
gcagcagaccgccg

SEQ ID NO: 838955 - RNA, 23 nt, Mycobacterium avium subsp. paratuberculosis
gcagcagaccgcgaucagcccca

SEQ ID NO: 838956 - RNA, 13 nt, Mycobacterium avium subsp. paratuberculosis
gcagcagccggaa

SEQ ID NO: 838957 - RNA, 14 nt, Mycobacterium avium subsp. paratuberculosis
gcagcagccggacc

SEQ ID NO: 838958 - RNA, 14 nt, Mycobacterium avium subsp. paratuberculosis
gcagcagccgccgg

SEQ ID NO: 838959 - RNA, 16 nt, Mycobacterium avium subsp. paratuberculosis
gcagcagccgccgggc

SEQ ID NO: 838960 - RNA, 14 nt, Mycobacterium avium subsp. paratuberculosis
gcagcagccgcgcc

SEQ ID NO: 838961 - RNA, 21 nt, Mycobacterium avium subsp. paratuberculosis
gcagcagccgcgccaccgcgg

SEQ ID NO: 838962 - RNA, 12 nt, Mycobacterium avium subsp. paratuberculosis
gcagcagcgccc

SEQ ID NO: 838963 - RNA, 14 nt, Mycobacterium avium subsp. paratuberculosis
gcagcagcgcccac

SEQ ID NO: 838964 - RNA, 15 nt, Mycobacterium avium subsp. paratuberculosis
gcagcagcgcccacc

SEQ ID NO: 838965 - RNA, 14 nt, Mycobacterium avium subsp. paratuberculosis
gcagcagcgccagc

SEQ ID NO: 838966 - RNA, 15 nt, Mycobacterium avium subsp. paratuberculosis
gcagcagcgccagca

SEQ ID NO: 838967 - RNA, 14 nt, Mycobacterium avium subsp. paratuberculosis
gcagcagcgccgcc

SEQ ID NO: 838968 - RNA, 15 nt, Mycobacterium avium subsp. paratuberculosis
gcagcagcgccgcca

SEQ ID NO: 838969 - RNA, 15 nt, Mycobacterium avium subsp. paratuberculosis
gcagcagcgcgcggu

SEQ ID NO: 838970 - RNA, 12 nt, Mycobacterium avium subsp. paratuberculosis
gcagcagcgcgg

SEQ ID NO: 838971 - RNA, 16 nt, Mycobacterium avium subsp. paratuberculosis
gcagcagcgcggugcc

SEQ ID NO: 838972 - RNA, 12 nt, Mycobacterium avium subsp. paratuberculosis
gcagcagcgcgu

SEQ ID NO: 838973 - RNA, 16 nt, Mycobacterium avium subsp. paratuberculosis
gcagcagcgcgucgug

SEQ ID NO: 838974 - RNA, 23 nt, Mycobacterium avium subsp. paratuberculosis
gcagcacguguucgggaucggcg

SEQ ID NO: 838975 - RNA, 16 nt, Mycobacterium avium subsp. paratuberculosis
gcagcacgcccagauc

SEQ ID NO: 838976 - RNA, 15 nt, Mycobacterium avium subsp. paratuberculosis
gcagcagaaccagca

SEQ ID NO: 838977 - RNA, 16 nt, Mycobacterium avium subsp. paratuberculosis
gcagcagaaccagcac

SEQ ID NO: 838978 - RNA, 18 nt, Mycobacterium avium subsp. paratuberculosis
gcagcagaaccagcaccg

SEQ ID NO: 838979 - RNA, 14 nt, Mycobacterium avium subsp. paratuberculosis
gcagcacgccgcgg

SEQ ID NO: 838980 - RNA, 16 nt, Mycobacterium avium subsp. paratuberculosis
gcagcacgccgcggaa

SEQ ID NO: 838981 - RNA, 19 nt, Mycobacterium avium subsp. paratuberculosis
gcagcacgcccagcccgcg

SEQ ID NO: 838982 - RNA, 20 nt, Mycobacterium avium subsp. paratuberculosis
gcagcacgaugaucccgagg

SEQ ID NO: 838983 - RNA, 23 nt, Mycobacterium avium subsp. paratuberculosis
gcagcaccuccgacagcccccgc

SEQ ID NO: 838984 - RNA, 14 nt, Mycobacterium avium subsp. paratuberculosis
gcagcagcggcagc

SEQ ID NO: 838985 - RNA, 14 nt, Mycobacterium avium subsp. paratuberculosis
gcagcagcggcuug

SEQ ID NO: 838986 - RNA, 14 nt, Mycobacterium avium subsp. paratuberculosis
gcagcagcucggcg

SEQ ID NO: 838987 - RNA, 15 nt, Mycobacterium avium subsp. paratuberculosis
gcagcagcucggcga

SEQ ID NO: 838988 - RNA, 16 nt, Mycobacterium avium subsp. paratuberculosis
gcagcagcugcacccg

SEQ ID NO: 838989 - RNA, 21 nt, Mycobacterium avium subsp. paratuberculosis
gcagcagcugcgucggcacca

SEQ ID NO: 838990 - RNA, 19 nt, Mycobacterium avium subsp. paratuberculosis
gcagcaggaacucccgcgc

SEQ ID NO: 838991 - RNA, 23 nt, Mycobacterium avium subsp. paratuberculosis
gcagcaggaacucccgcgccgca

SEQ ID NO: 838992 - RNA, 17 nt, Mycobacterium avium subsp. paratuberculosis
gcagcagggcgcgcauc

SEQ ID NO: 838993 - RNA, 21 nt, Mycobacterium avium subsp. paratuberculosis
gcagcagggcgcgcaucugcu

SEQ ID NO: 838994 - RNA, 14 nt, Mycobacterium avium subsp. paratuberculosis
gcagcaggcggacg

SEQ ID NO: 838995 - RNA, 15 nt, Mycobacterium avium subsp. paratuberculosis
gcagcaggcgccggu

SEQ ID NO: 838996 - RNA, 16 nt, Mycobacterium avium subsp. paratuberculosis
gcagcaucacgucggc

SEQ ID NO: 838997 - RNA, 18 nt, Mycobacterium avium subsp. paratuberculosis
gcagcaucacgucggcga

SEQ ID NO: 838998 - RNA, 17 nt, Mycobacterium avium subsp. paratuberculosis
gcagcauccagguggcg

SEQ ID NO: 838999 - RNA, 13 nt, Mycobacterium avium subsp. paratuberculosis
gcagcauccgcac

SEQ ID NO: 839000 - RNA, 14 nt, Mycobacterium avium subsp. paratuberculosis
gcagcauccgccga

SEQ ID NO: 839001 - RNA, 23 nt, Mycobacterium avium subsp. paratuberculosis
gcagcaucggcagaucguugggc

SEQ ID NO: 839002 - RNA, 23 nt, Mycobacterium avium subsp. paratuberculosis
gcagcaucgggacgccugccgcc

SEQ ID NO: 839003 - RNA, 16 nt, Mycobacterium avium subsp. paratuberculosis
gcagcaucuccgaguc

SEQ ID NO: 839004 - RNA, 20 nt, Mycobacterium avium subsp. paratuberculosis
gcagcaucuccgagucggcg

SEQ ID NO: 839005 - RNA, 18 nt, Mycobacterium avium subsp. paratuberculosis
gcagcaggugcaccaccc

SEQ ID NO: 839006 - RNA, 23 nt, Mycobacterium avium subsp. paratuberculosis
gcagcaggugcaucgaccggcgg

SEQ ID NO: 839007 - RNA, 19 nt, Mycobacterium avium subsp. paratuberculosis
gcagcaggugcaucgccac

SEQ ID NO: 839008 - RNA, 21 nt, Mycobacterium avium subsp. paratuberculosis
gcagcaggugcaucgccaccg

SEQ ID NO: 839009 - RNA, 14 nt, Mycobacterium avium subsp. paratuberculosis
gcagcagggugccg

SEQ ID NO: 839010 - RNA, 19 nt, Mycobacterium avium subsp. paratuberculosis
gcagcagggugccgccgcc

SEQ ID NO: 839011 - RNA, 19 nt, Mycobacterium avium subsp. paratuberculosis
gcagcagguaaaccagcag

SEQ ID NO: 839012 - RNA, 14 nt, Mycobacterium avium subsp. paratuberculosis
gcagcaggucggcc

SEQ ID NO: 839013 - RNA, 14 nt, Mycobacterium avium subsp. paratuberculosis
gcagcagguugcgg

SEQ ID NO: 839014 - RNA, 21 nt, Mycobacterium avium subsp. paratuberculosis
gcagcaguuccggagcgcggu

SEQ ID NO: 839015 - RNA, 16 nt, Mycobacterium avium subsp. paratuberculosis
gcagcaugccgagcac

SEQ ID NO: 839016 - RNA, 18 nt, Mycobacterium avium subsp. paratuberculosis
gcagcaucuuggccacgg

SEQ ID NO: 839017 - RNA, 19 nt, Mycobacterium avium subsp. paratuberculosis
gcagcauucgccggggucg

SEQ ID NO: 839018 - RNA, 17 nt, Mycobacterium avium subsp. paratuberculosis
gcagcauuuccgagcga

SEQ ID NO: 839019 - RNA, 20 nt, Mycobacterium avium subsp. paratuberculosis
gcagcauuuccgagcgacga

SEQ ID NO: 839020 - RNA, 15 nt, Mycobacterium avium subsp. paratuberculosis
gcagccacggcagcu

SEQ ID NO: 839021 - RNA, 13 nt, Mycobacterium avium subsp. paratuberculosis
gcagccacgcgca

SEQ ID NO: 839022 - RNA, 15 nt, Mycobacterium avium subsp. paratuberculosis
gcagccagaccucgc

SEQ ID NO: 839023 - RNA, 20 nt, Mycobacterium avium subsp. paratuberculosis
gcagccagaccucgccgacg

SEQ ID NO: 839024 - RNA, 21 nt, Mycobacterium avium subsp. paratuberculosis
gcagccagaccucgccgacgg

SEQ ID NO: 839025 - RNA, 20 nt, Mycobacterium avium subsp. paratuberculosis
gcagccacaucugguugcgg

SEQ ID NO: 839026 - RNA, 16 nt, Mycobacterium avium subsp. paratuberculosis
gcagccacccgucggu

SEQ ID NO: 839027 - RNA, 18 nt, Mycobacterium avium subsp. paratuberculosis
gcagccacgacaccagcg

SEQ ID NO: 839028 - RNA, 18 nt, Mycobacterium avium subsp. paratuberculosis
gcagccacgagcccagcc

SEQ ID NO: 839029 - RNA, 13 nt, Mycobacterium avium subsp. paratuberculosis
gcagccaccgccc

SEQ ID NO: 839030 - RNA, 16 nt, Mycobacterium avium subsp. paratuberculosis
gcagccaccgcccgaa

SEQ ID NO: 839031 - RNA, 15 nt, Mycobacterium avium subsp. paratuberculosis
gcagccacgccagcc

SEQ ID NO: 839032 - RNA, 15 nt, Mycobacterium avium subsp. paratuberculosis
gcagccagaugucgc

SEQ ID NO: 839033 - RNA, 18 nt, Mycobacterium avium subsp. paratuberculosis
gcagccagcccagccgcc

SEQ ID NO: 839034 - RNA, 15 nt, Mycobacterium avium subsp. paratuberculosis
gcagccagcccagcc

SEQ ID NO: 839035 - RNA, 13 nt, Mycobacterium avium subsp. paratuberculosis
gcagccagccugg

SEQ ID NO: 839036 - RNA, 16 nt, Mycobacterium avium subsp. paratuberculosis
gcagccagucgccggc

SEQ ID NO: 839037 - RNA, 16 nt, Mycobacterium avium subsp. paratuberculosis
gcagccaggcguuggu

SEQ ID NO: 839038 - RNA, 21 nt, Mycobacterium avium subsp. paratuberculosis
gcagccaggcguuggucacca

SEQ ID NO: 839039 - RNA, 13 nt, Mycobacterium avium subsp. paratuberculosis
gcagcccggcugc

SEQ ID NO: 839040 - RNA, 16 nt, Mycobacterium avium subsp. paratuberculosis
gcagccgaagaacugg

SEQ ID NO: 839041 - RNA, 13 nt, Mycobacterium avium subsp. paratuberculosis
gcagcccagccag

SEQ ID NO: 839042 - RNA, 14 nt, Mycobacterium avium subsp. paratuberculosis
gcagcccagccagc

SEQ ID NO: 839043 - RNA, 15 nt, Mycobacterium avium subsp. paratuberculosis
gcagcccagccagcg

SEQ ID NO: 839044 - RNA, 14 nt, Mycobacterium avium subsp. paratuberculosis
gcagccaggacagc

SEQ ID NO: 839045 - RNA, 13 nt, Mycobacterium avium subsp. paratuberculosis
gcagcccaggccc

SEQ ID NO: 839046 - RNA, 18 nt, Mycobacterium avium subsp. paratuberculosis
gcagcccaggcccagcag

SEQ ID NO: 839047 - RNA, 22 nt, Mycobacterium avium subsp. paratuberculosis
gcagcccaggcccagcagcacc

SEQ ID NO: 839048 - RNA, 15 nt, Mycobacterium avium subsp. paratuberculosis
gcagcccgggcugca

SEQ ID NO: 839049 - RNA, 14 nt, Mycobacterium avium subsp. paratuberculosis
gcagccgccgggcc

SEQ ID NO: 839050 - RNA, 22 nt, Mycobacterium avium subsp. paratuberculosis
gcagccgccgggccacgccgac

SEQ ID NO: 839051 - RNA, 14 nt, Mycobacterium avium subsp. paratuberculosis
gcagccgcgacggc

SEQ ID NO: 839052 - RNA, 16 nt, Mycobacterium avium subsp. paratuberculosis
gcagccgcgacggcgg

SEQ ID NO: 839053 - RNA, 14 nt, Mycobacterium avium subsp. paratuberculosis
gcagccgcgccacc

SEQ ID NO: 839054 - RNA, 14 nt, Mycobacterium avium subsp. paratuberculosis
gcagccgcgcccac

SEQ ID NO: 839055 - RNA, 19 nt, Mycobacterium avium subsp. paratuberculosis
gcagccgcgcccacccgcg

SEQ ID NO: 839056 - RNA, 15 nt, Mycobacterium avium subsp. paratuberculosis
gcagccgggugccca

SEQ ID NO: 839057 - RNA, 18 nt, Mycobacterium avium subsp. paratuberculosis
gcagccgggugcgggcca

SEQ ID NO: 839058 - RNA, 22 nt, Mycobacterium avium subsp. paratuberculosis
gcagccgggugcgggccagcag

SEQ ID NO: 839059 - RNA, 15 nt, Mycobacterium avium subsp. paratuberculosis
gcagccgggugcggu

SEQ ID NO: 839060 - RNA, 15 nt, Mycobacterium avium subsp. paratuberculosis
gcagccgccgcgcca

SEQ ID NO: 839061 - RNA, 13 nt, Mycobacterium avium subsp. paratuberculosis
gcagccgccgcgg

SEQ ID NO: 839062 - RNA, 18 nt, Mycobacterium avium subsp. paratuberculosis
gcagccgcaccucggggc

SEQ ID NO: 839063 - RNA, 22 nt, Mycobacterium avium subsp. paratuberculosis
gcagccgcaaggugauucgcgc

SEQ ID NO: 839064 - RNA, 16 nt, Mycobacterium avium subsp. paratuberculosis
gcagccgcacaccgcg

SEQ ID NO: 839065 - RNA, 19 nt, Mycobacterium avium subsp. paratuberculosis
gcagccgcacaccgcggcg

SEQ ID NO: 839066 - RNA, 21 nt, Mycobacterium avium subsp. paratuberculosis
gcagccgcacaccgcggcggc

SEQ ID NO: 839067 - RNA, 13 nt, Mycobacterium avium subsp. paratuberculosis
gcagccgcagcga

SEQ ID NO: 839068 - RNA, 15 nt, Mycobacterium avium subsp. paratuberculosis
gcagccgcagcgcgc

SEQ ID NO: 839069 - RNA, 17 nt, Mycobacterium avium subsp. paratuberculosis
gcagccgcagcggcggc

SEQ ID NO: 839070 - RNA, 18 nt, Mycobacterium avium subsp. paratuberculosis
gcagccgcagcggcggcu

SEQ ID NO: 839071 - RNA, 17 nt, Mycobacterium avium subsp. paratuberculosis
gcagccgaugucgucga

SEQ ID NO: 839072 - RNA, 23 nt, Mycobacterium avium subsp. paratuberculosis
gcagccgaugucgucgaacgcgg

SEQ ID NO: 839073 - RNA, 14 nt, Mycobacterium avium subsp. paratuberculosis
gcagccgcaacacg

SEQ ID NO: 839074 - RNA, 18 nt, Mycobacterium avium subsp. paratuberculosis
gcagccgcaacacggccu

SEQ ID NO: 839075 - RNA, 22 nt, Mycobacterium avium subsp. paratuberculosis
gcagccgcaacacggccucgau

SEQ ID NO: 839076 - RNA, 21 nt, Mycobacterium avium subsp. paratuberculosis
gcagccgaucucguagcccac

SEQ ID NO: 839077 - RNA, 13 nt, Mycobacterium avium subsp. paratuberculosis
gcagccgaucugg

SEQ ID NO: 839078 - RNA, 19 nt, Mycobacterium avium subsp. paratuberculosis
gcagccgaucuggcgggcg

SEQ ID NO: 839079 - RNA, 13 nt, Mycobacterium avium subsp. paratuberculosis
gcagccgucgaug

SEQ ID NO: 839080 - RNA, 15 nt, Mycobacterium avium subsp. paratuberculosis
gcagccgucgaugcc

SEQ ID NO: 839081 - RNA, 21 nt, Mycobacterium avium subsp. paratuberculosis
gcagccgucgaugccggcgac

SEQ ID NO: 839082 - RNA, 15 nt, Mycobacterium avium subsp. paratuberculosis
gcagccgucccagga

SEQ ID NO: 839083 - RNA, 16 nt, Mycobacterium avium subsp. paratuberculosis
gcagccgguccggcgg

SEQ ID NO: 839084 - RNA, 17 nt, Mycobacterium avium subsp. paratuberculosis
gcagccgguccggcggc

SEQ ID NO: 839085 - RNA, 21 nt, Mycobacterium avium subsp. paratuberculosis
gcagccgguccggcggcacca

SEQ ID NO: 839086 - RNA, 20 nt, Mycobacterium avium subsp. paratuberculosis
gcagccggucgaggucgccg

SEQ ID NO: 839087 - RNA, 21 nt, Mycobacterium avium subsp. paratuberculosis
gcagccggucgaggucgccga

SEQ ID NO: 839088 - RNA, 22 nt, Mycobacterium avium subsp. paratuberculosis
gcagccggucgaggucgccgac

SEQ ID NO: 839089 - RNA, 23 nt, Mycobacterium avium subsp. paratuberculosis
gcagccggucgaggucgccgaca

SEQ ID NO: 839090 - RNA, 14 nt, Mycobacterium avium subsp. paratuberculosis
gcagccggucggag

SEQ ID NO: 839091 - RNA, 13 nt, Mycobacterium avium subsp. paratuberculosis
gcagccgugccca

SEQ ID NO: 839092 - RNA, 22 nt, Mycobacterium avium subsp. paratuberculosis
gcagccguuccaucgggcccag

SEQ ID NO: 839093 - RNA, 23 nt, Mycobacterium avium subsp. paratuberculosis
gcagccguuccaucgggcccagc

SEQ ID NO: 839094 - RNA, 16 nt, Mycobacterium avium subsp. paratuberculosis
gcagcgagaaccggcg

SEQ ID NO: 839095 - RNA, 19 nt, Mycobacterium avium subsp. paratuberculosis
gcagcgagaaccggcgcag

SEQ ID NO: 839096 - RNA, 22 nt, Mycobacterium avium subsp. paratuberculosis
gcagcgagaccucccggcgcca

SEQ ID NO: 839097 - RNA, 16 nt, Mycobacterium avium subsp. paratuberculosis
gcagcgacucgggcag

SEQ ID NO: 839098 - RNA, 18 nt, Mycobacterium avium subsp. paratuberculosis
gcagcgacucguuggccg

SEQ ID NO: 839099 - RNA, 20 nt, Mycobacterium avium subsp. paratuberculosis
gcagcgacucguuggccggc

SEQ ID NO: 839100 - RNA, 17 nt, Mycobacterium avium subsp. paratuberculosis
gcagcgacuggaccacc

SEQ ID NO: 839101 - RNA, 23 nt, Mycobacterium avium subsp. paratuberculosis
gcagcgacuggcccucggaggug

SEQ ID NO: 839102 - RNA, 17 nt, Mycobacterium avium subsp. paratuberculosis
gcagcgacuugaccagc

SEQ ID NO: 839103 - RNA, 18 nt, Mycobacterium avium subsp. paratuberculosis
gcagcgacuugaccagca

SEQ ID NO: 839104 - RNA, 19 nt, Mycobacterium avium subsp. paratuberculosis
gcagcgacuugaccagcag

SEQ ID NO: 839105 - RNA, 20 nt, Mycobacterium avium subsp. paratuberculosis
gcagcgacuugaccagcagc

SEQ ID NO: 839106 - RNA, 22 nt, Mycobacterium avium subsp. paratuberculosis
gcagcgacggaucggccgcguc

SEQ ID NO: 839107 - RNA, 18 nt, Mycobacterium avium subsp. paratuberculosis
gcagccuucuucgccggg

SEQ ID NO: 839108 - RNA, 19 nt, Mycobacterium avium subsp. paratuberculosis
gcagccuucuucgccgggg

SEQ ID NO: 839109 - RNA, 18 nt, Mycobacterium avium subsp. paratuberculosis
gcagccuucuuggcgggc

SEQ ID NO: 839110 - RNA, 13 nt, Mycobacterium avium subsp. paratuberculosis
gcagcgcccggcg

SEQ ID NO: 839111 - RNA, 15 nt, Mycobacterium avium subsp. paratuberculosis
gcagcgcccggcgau

SEQ ID NO: 839112 - RNA, 14 nt, Mycobacterium avium subsp. paratuberculosis
gcagcgcccgggcc

SEQ ID NO: 839113 - RNA, 16 nt, Mycobacterium avium subsp. paratuberculosis
gcagcgcccgggccag

SEQ ID NO: 839114 - RNA, 14 nt, Mycobacterium avium subsp. paratuberculosis
gcagcgcccgggug

SEQ ID NO: 839115 - RNA, 12 nt, Mycobacterium avium subsp. paratuberculosis
gcagcgccgucc

SEQ ID NO: 839116 - RNA, 13 nt, Mycobacterium avium subsp. paratuberculosis
gcagcgccguccg

SEQ ID NO: 839117 - RNA, 16 nt, Mycobacterium avium subsp. paratuberculosis
gcagcgccguccgcac

SEQ ID NO: 839118 - RNA, 17 nt, Mycobacterium avium subsp. paratuberculosis
gcagcgccguccgcacc

SEQ ID NO: 839119 - RNA, 21 nt, Mycobacterium avium subsp. paratuberculosis
gcagcgccguccgcaccgcga

SEQ ID NO: 839120 - RNA, 23 nt, Mycobacterium avium subsp. paratuberculosis
gcagcgccguccgcaccgcgacg

SEQ ID NO: 839121 - RNA, 12 nt, Mycobacterium avium subsp. paratuberculosis
gcagcgccgucu

SEQ ID NO: 839122 - RNA, 15 nt, Mycobacterium avium subsp. paratuberculosis
gcagcgcccaggcgu

SEQ ID NO: 839123 - RNA, 21 nt, Mycobacterium avium subsp. paratuberculosis
gcagcgcccaggcgugcgcgu

SEQ ID NO: 839124 - RNA, 17 nt, Mycobacterium avium subsp. paratuberculosis
gcagcgccccgguccgg

SEQ ID NO: 839125 - RNA, 18 nt, Mycobacterium avium subsp. paratuberculosis
gcagcgccccgguccggc

SEQ ID NO: 839126 - RNA, 15 nt, Mycobacterium avium subsp. paratuberculosis
gcagcgccagcgcgc

SEQ ID NO: 839127 - RNA, 21 nt, Mycobacterium avium subsp. paratuberculosis
gcagcgcccaccgcucgucgg

SEQ ID NO: 839128 - RNA, 16 nt, Mycobacterium avium subsp. paratuberculosis
gcagcgaggcgcgcag

SEQ ID NO: 839129 - RNA, 22 nt, Mycobacterium avium subsp. paratuberculosis
gcagcgccagcagcggcacccg

SEQ ID NO: 839130 - RNA, 17 nt, Mycobacterium avium subsp. paratuberculosis
gcagcgccagcaccgcc

SEQ ID NO: 839131 - RNA, 17 nt, Mycobacterium avium subsp. paratuberculosis
gcagcgccagcaccggg

SEQ ID NO: 839132 - RNA, 21 nt, Mycobacterium avium subsp. paratuberculosis
gcagcgccagcaccgggccca

SEQ ID NO: 839133 - RNA, 22 nt, Mycobacterium avium subsp. paratuberculosis
gcagcgccagcaccgggcccag

SEQ ID NO: 839134 - RNA, 23 nt, Mycobacterium avium subsp. paratuberculosis
gcagcgccagcaccgggcccagc

SEQ ID NO: 839135 - RNA, 21 nt, Mycobacterium avium subsp. paratuberculosis
gcagcgagucgaagccguggc

SEQ ID NO: 839136 - RNA, 16 nt, Mycobacterium avium subsp. paratuberculosis
gcagcgaggcguccag

SEQ ID NO: 839137 - RNA, 18 nt, Mycobacterium avium subsp. paratuberculosis
gcagcgaggcguccagcg

SEQ ID NO: 839138 - RNA, 20 nt, Mycobacterium avium subsp. paratuberculosis
gcagcgaggcguccagcgcg

SEQ ID NO: 839139 - RNA, 12 nt, Mycobacterium avium subsp. paratuberculosis
gcagcgaggcgc

SEQ ID NO: 839140 - RNA, 16 nt, Mycobacterium avium subsp. paratuberculosis
gcagcgagaucccggu

SEQ ID NO: 839141 - RNA, 17 nt, Mycobacterium avium subsp. paratuberculosis
gcagcgagcacagcggc

SEQ ID NO: 839142 - RNA, 18 nt, Mycobacterium avium subsp. paratuberculosis
gcagcgagcacagcggcg

SEQ ID NO: 839143 - RNA, 20 nt, Mycobacterium avium subsp. paratuberculosis
gcagcgagcacagcggcgga

SEQ ID NO: 839144 - RNA, 18 nt, Mycobacterium avium subsp. paratuberculosis
gcaccaguugcaccggca

SEQ ID NO: 839145 - RNA, 21 nt, Mycobacterium avium subsp. paratuberculosis
gcaccaguugcaccggcaccg

SEQ ID NO: 839146 - RNA, 17 nt, Mycobacterium avium subsp. paratuberculosis
gcaccagucgcgcagcg

SEQ ID NO: 839147 - RNA, 20 nt, Mycobacterium avium subsp. paratuberculosis
gcaccagucgcgcagcguca

SEQ ID NO: 839148 - RNA, 15 nt, Mycobacterium avium subsp. paratuberculosis
gcaccagucggccau

SEQ ID NO: 839149 - RNA, 20 nt, Mycobacterium avium subsp. paratuberculosis
gcaccaguaggucacccggu

SEQ ID NO: 839150 - RNA, 19 nt, Mycobacterium avium subsp. paratuberculosis
gcacagcagcacguugucg

SEQ ID NO: 839151 - RNA, 23 nt, Mycobacterium avium subsp. paratuberculosis
gcacagcagggcaccgacggccg

SEQ ID NO: 839152 - RNA, 17 nt, Mycobacterium avium subsp. paratuberculosis
gcacagaucgucucggc

SEQ ID NO: 839153 - RNA, 21 nt, Mycobacterium avium subsp. paratuberculosis
gcacagaucgucucggccagc

SEQ ID NO: 839154 - RNA, 13 nt, Mycobacterium avium subsp. paratuberculosis
gcacagcaccagu

SEQ ID NO: 839155 - RNA, 23 nt, Mycobacterium avium subsp. paratuberculosis
gcacagcaccaguugcaccggca

SEQ ID NO: 839156 - RNA, 21 nt, Mycobacterium avium subsp. paratuberculosis
gcacagcauguccucggggug

SEQ ID NO: 839157 - RNA, 14 nt, Mycobacterium avium subsp. paratuberculosis
gcacagccagcgcc

SEQ ID NO: 839158 - RNA, 22 nt, Mycobacterium avium subsp. paratuberculosis
gcacagccagcgcccggcgacc

SEQ ID NO: 839159 - RNA, 23 nt, Mycobacterium avium subsp. paratuberculosis
gcacagccagcgcccggcgacca

SEQ ID NO: 839160 - RNA, 18 nt, Mycobacterium avium subsp. paratuberculosis
gcaccagguugucgccgc

SEQ ID NO: 839161 - RNA, 20 nt, Mycobacterium avium subsp. paratuberculosis
gcaccagguugucgccgcgc

SEQ ID NO: 839162 - RNA, 24 nt, Mycobacterium avium subsp. paratuberculosis
gcaccagguugucgccgcgccagc

SEQ ID NO: 839163 - RNA, 22 nt, Mycobacterium avium subsp. paratuberculosis
gcacagcacggcaucgauggcg

SEQ ID NO: 839164 - RNA, 14 nt, Mycobacterium avium subsp. paratuberculosis
gcaccccacccgcg

SEQ ID NO: 839165 - RNA, 21 nt, Mycobacterium avium subsp. paratuberculosis
gcaccccacccgcgcgacauc

SEQ ID NO: 839166 - RNA, 20 nt, Mycobacterium avium subsp. paratuberculosis
gcacccccaauugccgggcc

SEQ ID NO: 839167 - RNA, 21 nt, Mycobacterium avium subsp. paratuberculosis
gcacccccaauugccgggcca

SEQ ID NO: 839168 - RNA, 13 nt, Mycobacterium avium subsp. paratuberculosis
gcacccccggggc

SEQ ID NO: 839169 - RNA, 14 nt, Mycobacterium avium subsp. paratuberculosis
gcacccccggggcc

SEQ ID NO: 839170 - RNA, 20 nt, Mycobacterium avium subsp. paratuberculosis
gcacccccggggccuccagc

SEQ ID NO: 839171 - RNA, 23 nt, Mycobacterium avium subsp. paratuberculosis
gcacccccggggccuccagccag

SEQ ID NO: 839172 - RNA, 17 nt, Mycobacterium avium subsp. paratuberculosis
gcacccccuucuccacg

SEQ ID NO: 839173 - RNA, 15 nt, Mycobacterium avium subsp. paratuberculosis
gcaccccgccgcagc

SEQ ID NO: 839174 - RNA, 17 nt, Mycobacterium avium subsp. paratuberculosis
gcaccccgccgcagccc

SEQ ID NO: 839175 - RNA, 17 nt, Mycobacterium avium subsp. paratuberculosis
gcacccccucggcgccg

SEQ ID NO: 839176 - RNA, 22 nt, Mycobacterium avium subsp. paratuberculosis
gcacccauccccaggauggccg

SEQ ID NO: 839177 - RNA, 20 nt, Mycobacterium avium subsp. paratuberculosis
gcacccaggucaugguggcg

SEQ ID NO: 839178 - RNA, 12 nt, Mycobacterium avium subsp. paratuberculosis
gcacccagccgc

SEQ ID NO: 839179 - RNA, 16 nt, Mycobacterium avium subsp. paratuberculosis
gcacccagcggaaccg

SEQ ID NO: 839180 - RNA, 23 nt, Mycobacterium avium subsp. paratuberculosis
gcacccagcggaaccgggggccg

SEQ ID NO: 839181 - RNA, 14 nt, Mycobacterium avium subsp. paratuberculosis
gcacccagcacagc

SEQ ID NO: 839182 - RNA, 20 nt, Mycobacterium avium subsp. paratuberculosis
gcacccagcacagcgaggcg

SEQ ID NO: 839183 - RNA, 14 nt, Mycobacterium avium subsp. paratuberculosis
gcaccauccgcgac

SEQ ID NO: 839184 - RNA, 16 nt, Mycobacterium avium subsp. paratuberculosis
gcaccauccgcgacgc

SEQ ID NO: 839185 - RNA, 21 nt, Mycobacterium avium subsp. paratuberculosis
gcaccauccgcgacgccagca

SEQ ID NO: 839186 - RNA, 13 nt, Mycobacterium avium subsp. paratuberculosis
gcaccauccgcgc

SEQ ID NO: 839187 - RNA, 15 nt, Mycobacterium avium subsp. paratuberculosis
gcaccauccgcgcga

SEQ ID NO: 839188 - RNA, 21 nt, Mycobacterium avium subsp. paratuberculosis
gcaccauccgcgcgagcgcgc

SEQ ID NO: 839189 - RNA, 22 nt, Mycobacterium avium subsp. paratuberculosis
gcaccauccgcgcgagcgcgcu

SEQ ID NO: 839190 - RNA, 15 nt, Mycobacterium avium subsp. paratuberculosis
gcacccgccgcccga

SEQ ID NO: 839191 - RNA, 18 nt, Mycobacterium avium subsp. paratuberculosis
gcacccgcacgugcgcgc

SEQ ID NO: 839192 - RNA, 23 nt, Mycobacterium avium subsp. paratuberculosis
gcacccgcacgugcgcgccgacc

SEQ ID NO: 839193 - RNA, 17 nt, Mycobacterium avium subsp. paratuberculosis
gcacccgcagcuccagc

SEQ ID NO: 839194 - RNA, 20 nt, Mycobacterium avium subsp. paratuberculosis
gcacccgcagcuccagcgag

SEQ ID NO: 839195 - RNA, 18 nt, Mycobacterium avium subsp. paratuberculosis
gcacccgcagcucgccga

SEQ ID NO: 839196 - RNA, 21 nt, Mycobacterium avium subsp. paratuberculosis
gcacccgcagcucgccgagcg

SEQ ID NO: 839197 - RNA, 15 nt, Mycobacterium avium subsp. paratuberculosis
gcacccgcggcgcga

SEQ ID NO: 839198 - RNA, 20 nt, Mycobacterium avium subsp. paratuberculosis
gcacccgcgggucgucgggc

SEQ ID NO: 839199 - RNA, 15 nt, Mycobacterium avium subsp. paratuberculosis
gcacccgcucgccga

SEQ ID NO: 839200 - RNA, 20 nt, Mycobacterium avium subsp. paratuberculosis
gcacccgcucgccgaugacg

SEQ ID NO: 839201 - RNA, 18 nt, Mycobacterium avium subsp. paratuberculosis
gcacccgcucgcgggccc

SEQ ID NO: 839202 - RNA, 19 nt, Mycobacterium avium subsp. paratuberculosis
gcacccgcucgcgggcccg

SEQ ID NO: 839203 - RNA, 21 nt, Mycobacterium avium subsp. paratuberculosis
gcacccgcugauccagcagcg

SEQ ID NO: 839204 - RNA, 20 nt, Mycobacterium avium subsp. paratuberculosis
gcacccgcugcaccagcccg

SEQ ID NO: 839205 - RNA, 17 nt, Mycobacterium avium subsp. paratuberculosis
gcacccgcugcagccgg

SEQ ID NO: 839206 - RNA, 18 nt, Mycobacterium avium subsp. paratuberculosis
gcacccgcugcagccggu

SEQ ID NO: 839207 - RNA, 20 nt, Mycobacterium avium subsp. paratuberculosis
gcacccgcugcagccggucc

SEQ ID NO: 839208 - RNA, 18 nt, Mycobacterium avium subsp. paratuberculosis
gcacccgcuuuugccguc

SEQ ID NO: 839209 - RNA, 21 nt, Mycobacterium avium subsp. paratuberculosis
gcacccgcuuuugccgucggu

SEQ ID NO: 839210 - RNA, 20 nt, Mycobacterium avium subsp. paratuberculosis
gcacccgguucugggcgggc

SEQ ID NO: 839211 - RNA, 21 nt, Mycobacterium avium subsp. paratuberculosis
gcacccgguucugggcgggcu

SEQ ID NO: 839212 - RNA, 17 nt, Mycobacterium avium subsp. paratuberculosis
gcacccguucggcgucg

SEQ ID NO: 839213 - RNA, 18 nt, Mycobacterium avium subsp. paratuberculosis
gcaccgacuccuccggcc

SEQ ID NO: 839214 - RNA, 21 nt, Mycobacterium avium subsp. paratuberculosis
gcaccgacuccuccggcccga

SEQ ID NO: 839215 - RNA, 14 nt, Mycobacterium avium subsp. paratuberculosis
gcaccgacgaggag

SEQ ID NO: 839216 - RNA, 17 nt, Mycobacterium avium subsp. paratuberculosis
gcaccgacgcggcgacc

SEQ ID NO: 839217 - RNA, 15 nt, Mycobacterium avium subsp. paratuberculosis
gcaccgacggagccg

SEQ ID NO: 839218 - RNA, 17 nt, Mycobacterium avium subsp. paratuberculosis
gcaccgacugcggcgcu

SEQ ID NO: 839219 - RNA, 22 nt, Mycobacterium avium subsp. paratuberculosis
gcaccgacagcuugauguugcc

SEQ ID NO: 839220 - RNA, 22 nt, Mycobacterium avium subsp. paratuberculosis
gcaccgagaacagaugccggug

SEQ ID NO: 839221 - RNA, 16 nt, Mycobacterium avium subsp. paratuberculosis
gcaccgaccagcggga

SEQ ID NO: 839222 - RNA, 15 nt, Mycobacterium avium subsp. paratuberculosis
gcaccgaaucgccga

SEQ ID NO: 839223 - RNA, 17 nt, Mycobacterium avium subsp. paratuberculosis
gcaccgaaucgccgagc

SEQ ID NO: 839224 - RNA, 18 nt, Mycobacterium avium subsp. paratuberculosis
gcaccgaaucgccgagcu

SEQ ID NO: 839225 - RNA, 22 nt, Mycobacterium avium subsp. paratuberculosis
gcaccgaaucgccgagcucgau

SEQ ID NO: 839226 - RNA, 15 nt, Mycobacterium avium subsp. paratuberculosis
gcaccgaaccggcgg

SEQ ID NO: 839227 - RNA, 16 nt, Mycobacterium avium subsp. paratuberculosis
gcaccgaaccggcggg

SEQ ID NO: 839228 - RNA, 15 nt, Mycobacterium avium subsp. paratuberculosis
gcaccgaacgccagc

SEQ ID NO: 839229 - RNA, 17 nt, Mycobacterium avium subsp. paratuberculosis
gcaccgaacgccagcag

SEQ ID NO: 839230 - RNA, 18 nt, Mycobacterium avium subsp. paratuberculosis
gcaccgaacgccagcagc

SEQ ID NO: 839231 - RNA, 18 nt, Mycobacterium avium subsp. paratuberculosis
gcaccguugugacccgcu

SEQ ID NO: 839232 - RNA, 21 nt, Mycobacterium avium subsp. paratuberculosis
gcaccguugugacccgcucgg

SEQ ID NO: 839233 - RNA, 22 nt, Mycobacterium avium subsp. paratuberculosis
gcaccguugugacccgcucggg

SEQ ID NO: 839234 - RNA, 24 nt, Mycobacterium avium subsp. paratuberculosis
gcaccguugugacccgcucgggcg

SEQ ID NO: 839235 - RNA, 19 nt, Mycobacterium avium subsp. paratuberculosis
gcaccguccacagccggcg

SEQ ID NO: 839236 - RNA, 18 nt, Mycobacterium avium subsp. paratuberculosis
gcaccguggugacccgga

SEQ ID NO: 839237 - RNA, 19 nt, Mycobacterium avium subsp. paratuberculosis
gcaccgugcugauccacgc

SEQ ID NO: 839238 - RNA, 17 nt, Mycobacterium avium subsp. paratuberculosis
gcaccgugcugugcugc

SEQ ID NO: 839239 - RNA, 17 nt, Mycobacterium avium subsp. paratuberculosis
gcaccgugccgucggcg

SEQ ID NO: 839240 - RNA, 18 nt, Mycobacterium avium subsp. paratuberculosis
gcaccgugccgucggcgu

SEQ ID NO: 839241 - RNA, 22 nt, Mycobacterium avium subsp. paratuberculosis
gcaccgugccgcccgucgccuc

SEQ ID NO: 839242 - RNA, 16 nt, Mycobacterium avium subsp. paratuberculosis
gcaccgugccgcgcgg

SEQ ID NO: 839243 - RNA, 17 nt, Mycobacterium avium subsp. paratuberculosis
gcaccgugccgcgcggc

SEQ ID NO: 839244 - RNA, 18 nt, Mycobacterium avium subsp. paratuberculosis
gcaccgugccgcgcggcg

SEQ ID NO: 839245 - RNA, 19 nt, Mycobacterium avium subsp. paratuberculosis
gcaccgugccgcgcggcgg

SEQ ID NO: 839246 - RNA, 14 nt, Mycobacterium avium subsp. paratuberculosis
gcaccgucgccggc

SEQ ID NO: 839247 - RNA, 17 nt, Mycobacterium avium subsp. paratuberculosis
gcaccgucgccggcggg

SEQ ID NO: 839248 - RNA, 17 nt, Mycobacterium avium subsp. paratuberculosis
gcaccgucgucgcaccg

SEQ ID NO: 839249 - RNA, 20 nt, Mycobacterium avium subsp. paratuberculosis
gcaccgucgucgcaccggca

SEQ ID NO: 839250 - RNA, 13 nt, Mycobacterium avium subsp. paratuberculosis
gcaccgucgugcc

SEQ ID NO: 839251 - RNA, 19 nt, Mycobacterium avium subsp. paratuberculosis
gcaccgucugcgccgucac

SEQ ID NO: 839252 - RNA, 14 nt, Mycobacterium avium subsp. paratuberculosis
gcaccggucagcgc

SEQ ID NO: 839253 - RNA, 14 nt, Mycobacterium avium subsp. paratuberculosis
gcaccggugcaccg

SEQ ID NO: 839254 - RNA, 21 nt, Mycobacterium avium subsp. paratuberculosis
gcaccggugcggcggugacga

SEQ ID NO: 839255 - RNA, 21 nt, Mycobacterium avium subsp. paratuberculosis
gcaccgggugauaccggccca

SEQ ID NO: 839256 - RNA, 22 nt, Mycobacterium avium subsp. paratuberculosis
gcaccgggugauaccggcccag

SEQ ID NO: 839257 - RNA, 15 nt, Mycobacterium avium subsp. paratuberculosis
gcaccgggugggccg

SEQ ID NO: 839258 - RNA, 13 nt, Mycobacterium avium subsp. paratuberculosis
gcaccgucagcca

SEQ ID NO: 839259 - RNA, 13 nt, Mycobacterium avium subsp. paratuberculosis
gcaccgucaccgc

SEQ ID NO: 839260 - RNA, 18 nt, Mycobacterium avium subsp. paratuberculosis
gcaccgguuugucggcgc

SEQ ID NO: 839261 - RNA, 20 nt, Mycobacterium avium subsp. paratuberculosis
gcaccggguacaccggcucg

SEQ ID NO: 839262 - RNA, 23 nt, Mycobacterium avium subsp. paratuberculosis
gcaccggggucugcacgaugccg

SEQ ID NO: 839263 - RNA, 20 nt, Mycobacterium avium subsp. paratuberculosis
gcaccgggccgaaggcggcg

SEQ ID NO: 839264 - RNA, 23 nt, Mycobacterium avium subsp. paratuberculosis
gcaccgggccgaaggcggcgccg

SEQ ID NO: 839265 - RNA, 13 nt, Mycobacterium avium subsp. paratuberculosis
gcaccgggcgucg

SEQ ID NO: 839266 - RNA, 15 nt, Mycobacterium avium subsp. paratuberculosis
gcaccgggcugucgg

SEQ ID NO: 839267 - RNA, 17 nt, Mycobacterium avium subsp. paratuberculosis
gcaccgggcugucgggc

SEQ ID NO: 839268 - RNA, 19 nt, Mycobacterium avium subsp. paratuberculosis
gcaccgggcugucgggcag

SEQ ID NO: 839269 - RNA, 23 nt, Mycobacterium avium subsp. paratuberculosis
gcaccgggcugucgggcaggccg

SEQ ID NO: 839270 - RNA, 21 nt, Mycobacterium avium subsp. paratuberculosis
gcaccggggccaacuccggcg

SEQ ID NO: 839271 - RNA, 22 nt, Mycobacterium avium subsp. paratuberculosis
gcaccggggccaacuccggcgg

SEQ ID NO: 839272 - RNA, 16 nt, Mycobacterium avium subsp. paratuberculosis
gcaccggggccggcgg

SEQ ID NO: 839273 - RNA, 17 nt, Mycobacterium avium subsp. paratuberculosis
gcaccggggccggcggg

SEQ ID NO: 839274 - RNA, 19 nt, Mycobacterium avium subsp. paratuberculosis
gcaccgggaccagcgcggu

SEQ ID NO: 839275 - RNA, 14 nt, Mycobacterium avium subsp. paratuberculosis
gcaccgggcccagc

SEQ ID NO: 839276 - RNA, 17 nt, Mycobacterium avium subsp. paratuberculosis
gcaccgggcccagcucg

SEQ ID NO: 839277 - RNA, 14 nt, Mycobacterium avium subsp. paratuberculosis
gcaccgggcccgcc

SEQ ID NO: 839278 - RNA, 20 nt, Mycobacterium avium subsp. paratuberculosis
gcaccgggcccgcccgcagc

SEQ ID NO: 839279 - RNA, 23 nt, Mycobacterium avium subsp. paratuberculosis
gcaccgggcccgcccgcagcggc

SEQ ID NO: 839280 - RNA, 23 nt, Mycobacterium avium subsp. paratuberculosis
gcaccgcagucuuguugaccuuc

SEQ ID NO: 839281 - RNA, 22 nt, Mycobacterium avium subsp. paratuberculosis
gcaccgcauagcgggagccggc

SEQ ID NO: 839282 - RNA, 14 nt, Mycobacterium avium subsp. paratuberculosis
gcaccgccacggcg

SEQ ID NO: 839283 - RNA, 20 nt, Mycobacterium avium subsp. paratuberculosis
gcaccgccacgucgaacccg

SEQ ID NO: 839284 - RNA, 14 nt, Mycobacterium avium subsp. paratuberculosis
gcaccgccagcacc

SEQ ID NO: 839285 - RNA, 18 nt, Mycobacterium avium subsp. paratuberculosis
gcaccgccagcaccgacg

SEQ ID NO: 839286 - RNA, 16 nt, Mycobacterium avium subsp. paratuberculosis
gcaccgcauggggcag

SEQ ID NO: 839287 - RNA, 11 nt, Mycobacterium avium subsp. paratuberculosis
gcaccgccacc

SEQ ID NO: 839288 - RNA, 14 nt, Mycobacterium avium subsp. paratuberculosis
gcaccgccaccgcg

SEQ ID NO: 839289 - RNA, 17 nt, Mycobacterium avium subsp. paratuberculosis
gcaccgccaccgcgcaa

SEQ ID NO: 839290 - RNA, 15 nt, Mycobacterium avium subsp. paratuberculosis
gcaccgccaccggcc

SEQ ID NO: 839291 - RNA, 17 nt, Mycobacterium avium subsp. paratuberculosis
gcaccgccaccggcccg

SEQ ID NO: 839292 - RNA, 14 nt, Mycobacterium avium subsp. paratuberculosis
gcaccgccagucug

SEQ ID NO: 839293 - RNA, 15 nt, Mycobacterium avium subsp. paratuberculosis
gcaccgccaucgcgg

SEQ ID NO: 839294 - RNA, 17 nt, Mycobacterium avium subsp. paratuberculosis
gcaccgccaucgcggcg

SEQ ID NO: 839295 - RNA, 14 nt, Mycobacterium avium subsp. paratuberculosis
gcaccgccagcgcg

SEQ ID NO: 839296 - RNA, 16 nt, Mycobacterium avium subsp. paratuberculosis
gcaccgccagcgcggc

SEQ ID NO: 839297 - RNA, 16 nt, Mycobacterium avium subsp. paratuberculosis
gcaccgccagcgccgg

SEQ ID NO: 839298 - RNA, 17 nt, Mycobacterium avium subsp. paratuberculosis
gcaccgccagcgccggc

SEQ ID NO: 839299 - RNA, 16 nt, Mycobacterium avium subsp. paratuberculosis
gcaccgccagcauccg

SEQ ID NO: 839300 - RNA, 15 nt, Mycobacterium avium subsp. paratuberculosis
gcaccgccagcgccg

SEQ ID NO: 839301 - RNA, 13 nt, Mycobacterium avium subsp. paratuberculosis
gcaccgcgcgcca

SEQ ID NO: 839302 - RNA, 16 nt, Mycobacterium avium subsp. paratuberculosis
gcaccgcgcgccaggu

SEQ ID NO: 839303 - RNA, 17 nt, Mycobacterium avium subsp. paratuberculosis
gcaccgcgcucaccgcg

SEQ ID NO: 839304 - RNA, 18 nt, Mycobacterium avium subsp. paratuberculosis
gcaccgcgcucaccgcgg

SEQ ID NO: 839305 - RNA, 22 nt, Mycobacterium avium subsp. paratuberculosis
gcaccgcggaggaauucgccga

SEQ ID NO: 839306 - RNA, 23 nt, Mycobacterium avium subsp. paratuberculosis
gcaccgcggaggaauucgccgac

SEQ ID NO: 839307 - RNA, 19 nt, Mycobacterium avium subsp. paratuberculosis
gcaccgcggauuccagcgc

SEQ ID NO: 839308 - RNA, 12 nt, Mycobacterium avium subsp. paratuberculosis
gcaccgcggcca

SEQ ID NO: 839309 - RNA, 15 nt, Mycobacterium avium subsp. paratuberculosis
gcaccgcgcgcacca

SEQ ID NO: 839310 - RNA, 16 nt, Mycobacterium avium subsp. paratuberculosis
gcaccgcgcgcaccac

SEQ ID NO: 839311 - RNA, 17 nt, Mycobacterium avium subsp. paratuberculosis
gcaccgcggccaacccg

SEQ ID NO: 839312 - RNA, 20 nt, Mycobacterium avium subsp. paratuberculosis
gcaccgcggccgucgcggcg

SEQ ID NO: 839313 - RNA, 24 nt, Mycobacterium avium subsp. paratuberculosis
gcaccgcggccgucgcggcgaucg

SEQ ID NO: 839314 - RNA, 13 nt, Mycobacterium avium subsp. paratuberculosis
gcaccgcggccuc

SEQ ID NO: 839315 - RNA, 17 nt, Mycobacterium avium subsp. paratuberculosis
gcaccgcggccucggcg

SEQ ID NO: 839316 - RNA, 16 nt, Mycobacterium avium subsp. paratuberculosis
gcaccgccccgcaacc

SEQ ID NO: 839317 - RNA, 15 nt, Mycobacterium avium subsp. paratuberculosis
gcaccgcccccgcgg

SEQ ID NO: 839318 - RNA, 16 nt, Mycobacterium avium subsp. paratuberculosis
gcaccgcccccgcggc

SEQ ID NO: 839319 - RNA, 18 nt, Mycobacterium avium subsp. paratuberculosis
gcaccgcccccgcggcgg

SEQ ID NO: 839320 - RNA, 16 nt, Mycobacterium avium subsp. paratuberculosis
gcaccgggaacagcca

SEQ ID NO: 839321 - RNA, 20 nt, Mycobacterium avium subsp. paratuberculosis
gcaccgggaaggugucggcc

SEQ ID NO: 839322 - RNA, 19 nt, Mycobacterium avium subsp. paratuberculosis
gcaccggcgucgacagccg

SEQ ID NO: 839323 - RNA, 14 nt, Mycobacterium avium subsp. paratuberculosis
gcaccggcuggccg

SEQ ID NO: 839324 - RNA, 20 nt, Mycobacterium avium subsp. paratuberculosis
gcaccggcuggccgagcggc

SEQ ID NO: 839325 - RNA, 16 nt, Mycobacterium avium subsp. paratuberculosis
gcaccggcuggucggc

SEQ ID NO: 839326 - RNA, 18 nt, Mycobacterium avium subsp. paratuberculosis
gcaccggcuggucggcgg

SEQ ID NO: 839327 - RNA, 14 nt, Mycobacterium avium subsp. paratuberculosis
gcaccggcgacggc

SEQ ID NO: 839328 - RNA, 15 nt, Mycobacterium avium subsp. paratuberculosis
gcaccggcgacggcg

SEQ ID NO: 839329 - RNA, 19 nt, Mycobacterium avium subsp. paratuberculosis
gcaccggcgacggcgguuc

SEQ ID NO: 839330 - RNA, 20 nt, Mycobacterium avium subsp. paratuberculosis
gcaccggcgaguccgcggag

SEQ ID NO: 839331 - RNA, 17 nt, Mycobacterium avium subsp. paratuberculosis
gcaccggcgccccgggc

SEQ ID NO: 839332 - RNA, 20 nt, Mycobacterium avium subsp. paratuberculosis
gcaccggcgccccgggcagc

SEQ ID NO: 839333 - RNA, 12 nt, Mycobacterium avium subsp. paratuberculosis
gcaccggcgccg

SEQ ID NO: 839334 - RNA, 15 nt, Mycobacterium avium subsp. paratuberculosis
gcaccggcgccgcca

SEQ ID NO: 839335 - RNA, 17 nt, Mycobacterium avium subsp. paratuberculosis
gcaccggcgccgccacc

SEQ ID NO: 839336 - RNA, 13 nt, Mycobacterium avium subsp. paratuberculosis
gcaccggcgccuc

SEQ ID NO: 839337 - RNA, 15 nt, Mycobacterium avium subsp. paratuberculosis
gcaccggcgcgccgc

SEQ ID NO: 839338 - RNA, 16 nt, Mycobacterium avium subsp. paratuberculosis
gcaccggcgcgccgcg

SEQ ID NO: 839339 - RNA, 21 nt, Mycobacterium avium subsp. paratuberculosis
gcaccggcgcgccgcguucgg

SEQ ID NO: 839340 - RNA, 13 nt, Mycobacterium avium subsp. paratuberculosis
gcaccggcgcugg

SEQ ID NO: 839341 - RNA, 23 nt, Mycobacterium avium subsp. paratuberculosis
gcaccggcgcugguaguggcgug

SEQ ID NO: 839342 - RNA, 16 nt, Mycobacterium avium subsp. paratuberculosis
gcaccgcggcguagcg

SEQ ID NO: 839343 - RNA, 19 nt, Mycobacterium avium subsp. paratuberculosis
gcaccgcggcguagcgcca

SEQ ID NO: 839344 - RNA, 20 nt, Mycobacterium avium subsp. paratuberculosis
gcaccgcggcguagcgccag

SEQ ID NO: 839345 - RNA, 21 nt, Mycobacterium avium subsp. paratuberculosis
gcaccgcggcguagcgccagu

SEQ ID NO: 839346 - RNA, 20 nt, Mycobacterium avium subsp. paratuberculosis
gcaccgcggcgugcgccagu

SEQ ID NO: 839347 - RNA, 20 nt, Mycobacterium avium subsp. paratuberculosis
gcaccgcggcguggacgucg

SEQ ID NO: 839348 - RNA, 13 nt, Mycobacterium avium subsp. paratuberculosis
gcaccgcggcucg

SEQ ID NO: 839349 - RNA, 14 nt, Mycobacterium avium subsp. paratuberculosis
gcaccgcggcucgg

SEQ ID NO: 839350 - RNA, 15 nt, Mycobacterium avium subsp. paratuberculosis
gcaccgcggcgauga

SEQ ID NO: 839351 - RNA, 22 nt, Mycobacterium avium subsp. paratuberculosis
gcaccgcggcgaugauccgcgg

SEQ ID NO: 839352 - RNA, 17 nt, Mycobacterium avium subsp. paratuberculosis
gcaccgcggcgcgcauc

SEQ ID NO: 839353 - RNA, 18 nt, Mycobacterium avium subsp. paratuberculosis
gcaccgcggcgcgcaucg

SEQ ID NO: 839354 - RNA, 23 nt, Mycobacterium avium subsp. paratuberculosis
gcaccgcggcgcgcaucgccguc

SEQ ID NO: 839355 - RNA, 17 nt, Mycobacterium avium subsp. paratuberculosis
gcaccgcgggcacggcg

SEQ ID NO: 839356 - RNA, 18 nt, Mycobacterium avium subsp. paratuberculosis
gcacgaaaccgcguggcg

SEQ ID NO: 839357 - RNA, 21 nt, Mycobacterium avium subsp. paratuberculosis
gcacgaaaccguggaagucgc

SEQ ID NO: 839358 - RNA, 16 nt, Mycobacterium avium subsp. paratuberculosis
gcacgaaacugccgua

SEQ ID NO: 839359 - RNA, 18 nt, Mycobacterium avium subsp. paratuberculosis
gcaccuugcccgucgcgu

SEQ ID NO: 839360 - RNA, 15 nt, Mycobacterium avium subsp. paratuberculosis
gcaccuugcgcccgu

SEQ ID NO: 839361 - RNA, 16 nt, Mycobacterium avium subsp. paratuberculosis
gcaccugaccgucggc

SEQ ID NO: 839362 - RNA, 21 nt, Mycobacterium avium subsp. paratuberculosis
gcaccugaaccgcgcacucga

SEQ ID NO: 839363 - RNA, 14 nt, Mycobacterium avium subsp. paratuberculosis
gcaccugaacggcc

SEQ ID NO: 839364 - RNA, 21 nt, Mycobacterium avium subsp. paratuberculosis
gcaccugauaggggucggcga

SEQ ID NO: 839365 - RNA, 15 nt, Mycobacterium avium subsp. paratuberculosis
gcaccugaucgaugc

SEQ ID NO: 839366 - RNA, 12 nt, Mycobacterium avium subsp. paratuberculosis
gcaccugccguc

SEQ ID NO: 839367 - RNA, 18 nt, Mycobacterium avium subsp. paratuberculosis
gcaccugccgucgacgac

SEQ ID NO: 839368 - RNA, 19 nt, Mycobacterium avium subsp. paratuberculosis
gcaccugcgcgccguuggu

SEQ ID NO: 839369 - RNA, 20 nt, Mycobacterium avium subsp. paratuberculosis
gcaccuccaguugcgacccc

SEQ ID NO: 839370 - RNA, 17 nt, Mycobacterium avium subsp. paratuberculosis
gcaccucgaucaccggg

SEQ ID NO: 839371 - RNA, 14 nt, Mycobacterium avium subsp. paratuberculosis
gcaccucgaugccg

SEQ ID NO: 839372 - RNA, 21 nt, Mycobacterium avium subsp. paratuberculosis
gcaccucgaugccgugccggu

SEQ ID NO: 839373 - RNA, 22 nt, Mycobacterium avium subsp. paratuberculosis
gcaccucgaugccgugccggug

SEQ ID NO: 839374 - RNA, 23 nt, Mycobacterium avium subsp. paratuberculosis
gcaccucgaugccgugccggugg

SEQ ID NO: 839375 - RNA, 14 nt, Mycobacterium avium subsp. paratuberculosis
gcaccucgcccggc

SEQ ID NO: 839376 - RNA, 15 nt, Mycobacterium avium subsp. paratuberculosis
gcaccucgcccggcu

SEQ ID NO: 839377 - RNA, 19 nt, Mycobacterium avium subsp. paratuberculosis
gcaccucgcccugcagcgc

SEQ ID NO: 839378 - RNA, 21 nt, Mycobacterium avium subsp. paratuberculosis
gcaccucgcccugcagcgcga

SEQ ID NO: 839379 - RNA, 21 nt, Mycobacterium avium subsp. paratuberculosis
gcaccucgccgaucucgacca

SEQ ID NO: 839380 - RNA, 13 nt, Mycobacterium avium subsp. paratuberculosis
gcaccucgccggc

SEQ ID NO: 839381 - RNA, 14 nt, Mycobacterium avium subsp. paratuberculosis
gcaccucgccggcc

SEQ ID NO: 839382 - RNA, 15 nt, Mycobacterium avium subsp. paratuberculosis
gcaccucgccggccg

SEQ ID NO: 839383 - RNA, 23 nt, Mycobacterium avium subsp. paratuberculosis
gcaccucgcgcagcaccgaugcc

SEQ ID NO: 839384 - RNA, 12 nt, Mycobacterium avium subsp. paratuberculosis
gcaccucgcgcg

SEQ ID NO: 839385 - RNA, 15 nt, Mycobacterium avium subsp. paratuberculosis
gcaccucgcggcagc

SEQ ID NO: 839386 - RNA, 17 nt, Mycobacterium avium subsp. paratuberculosis
gcaccucgcggcagccu

SEQ ID NO: 839387 - RNA, 13 nt, Mycobacterium avium subsp. paratuberculosis
gcaccucgucgcc

SEQ ID NO: 839388 - RNA, 16 nt, Mycobacterium avium subsp. paratuberculosis
gcaccucgucgccguc

SEQ ID NO: 839389 - RNA, 16 nt, Mycobacterium avium subsp. paratuberculosis
gcaccucggcgucggc

SEQ ID NO: 839390 - RNA, 18 nt, Mycobacterium avium subsp. paratuberculosis
gcaccucgggaugggcau

SEQ ID NO: 839391 - RNA, 14 nt, Mycobacterium avium subsp. paratuberculosis
gcaccuccugcacc

SEQ ID NO: 839392 - RNA, 17 nt, Mycobacterium avium subsp. paratuberculosis
gcaccuccugcacccgu

SEQ ID NO: 839393 - RNA, 20 nt, Mycobacterium avium subsp. paratuberculosis
gcaccuccugggugagcggc

SEQ ID NO: 839394 - RNA, 16 nt, Mycobacterium avium subsp. paratuberculosis
gcaccucgaacgccgg

SEQ ID NO: 839395 - RNA, 17 nt, Mycobacterium avium subsp. paratuberculosis
gcaccucgaacgccggu

SEQ ID NO: 839396 - RNA, 19 nt, Mycobacterium avium subsp. paratuberculosis
gcaccucgaacgccgguuu

SEQ ID NO: 839397 - RNA, 14 nt, Mycobacterium avium subsp. paratuberculosis
gcaccucgaagccg

SEQ ID NO: 839398 - RNA, 20 nt, Mycobacterium avium subsp. paratuberculosis
gcaccucgaagggcgccagc

SEQ ID NO: 839399 - RNA, 13 nt, Mycobacterium avium subsp. paratuberculosis
gcaccucgcucag

SEQ ID NO: 839400 - RNA, 14 nt, Mycobacterium avium subsp. paratuberculosis
gcaccucgcucagc

SEQ ID NO: 839401 - RNA, 17 nt, Mycobacterium avium subsp. paratuberculosis
gcaccucgcucagcccg

SEQ ID NO: 839402 - RNA, 23 nt, Mycobacterium avium subsp. paratuberculosis
gcacgagcgucgugcgggcuccg

SEQ ID NO: 839403 - RNA, 13 nt, Mycobacterium avium subsp. paratuberculosis
gcacgacgucgac

SEQ ID NO: 839404 - RNA, 16 nt, Mycobacterium avium subsp. paratuberculosis
gcacgacgucgacguu

SEQ ID NO: 839405 - RNA, 14 nt, Mycobacterium avium subsp. paratuberculosis
gcacgacggucagc

SEQ ID NO: 839406 - RNA, 23 nt, Mycobacterium avium subsp. paratuberculosis
gcacgacggucagcacgcugauc

SEQ ID NO: 839407 - RNA, 13 nt, Mycobacterium avium subsp. paratuberculosis
gcacgacgccgcc

SEQ ID NO: 839408 - RNA, 15 nt, Mycobacterium avium subsp. paratuberculosis
gcacgacgccgccga

SEQ ID NO: 839409 - RNA, 16 nt, Mycobacterium avium subsp. paratuberculosis
gcacgacgccgccgag

SEQ ID NO: 839410 - RNA, 20 nt, Mycobacterium avium subsp. paratuberculosis
gcacgacgccgcugggcgug

SEQ ID NO: 839411 - RNA, 19 nt, Mycobacterium avium subsp. paratuberculosis
gcacgacgaacaccaccgg

SEQ ID NO: 839412 - RNA, 21 nt, Mycobacterium avium subsp. paratuberculosis
gcacgacgaacaccaccggca

SEQ ID NO: 839413 - RNA, 19 nt, Mycobacterium avium subsp. paratuberculosis
gcacgaccaugucggcgac

SEQ ID NO: 839414 - RNA, 23 nt, Mycobacterium avium subsp. paratuberculosis
gcacgaccaugucggcgacccgc

SEQ ID NO: 839415 - RNA, 14 nt, Mycobacterium avium subsp. paratuberculosis
gcacgaacagcagc

SEQ ID NO: 839416 - RNA, 20 nt, Mycobacterium avium subsp. paratuberculosis
gcacgaaauaaccgcgcggc

SEQ ID NO: 839417 - RNA, 22 nt, Mycobacterium avium subsp. paratuberculosis
gcacgaaauaaccgcgcggcgc

SEQ ID NO: 839418 - RNA, 13 nt, Mycobacterium avium subsp. paratuberculosis
gcacgaacaccac

SEQ ID NO: 839419 - RNA, 17 nt, Mycobacterium avium subsp. paratuberculosis
gcacgauggcgcggcgc

SEQ ID NO: 839420 - RNA, 17 nt, Mycobacterium avium subsp. paratuberculosis
gcacgaugccgcgcucg

SEQ ID NO: 839421 - RNA, 20 nt, Mycobacterium avium subsp. paratuberculosis
gcacgcccuggaaggcgauc

SEQ ID NO: 839422 - RNA, 13 nt, Mycobacterium avium subsp. paratuberculosis
gcacgcagugccg

SEQ ID NO: 839423 - RNA, 16 nt, Mycobacterium avium subsp. paratuberculosis
gcacgcagugccgcac

SEQ ID NO: 839424 - RNA, 19 nt, Mycobacterium avium subsp. paratuberculosis
gcacgcagugccgcaccag

SEQ ID NO: 839425 - RNA, 13 nt, Mycobacterium avium subsp. paratuberculosis
gcacgcagccgcg

SEQ ID NO: 839426 - RNA, 16 nt, Mycobacterium avium subsp. paratuberculosis
gcacgcugucgggguc

SEQ ID NO: 839427 - RNA, 21 nt, Mycobacterium avium subsp. paratuberculosis
gcacgcugucggggucgcggc

SEQ ID NO: 839428 - RNA, 20 nt, Mycobacterium avium subsp. paratuberculosis
gcacgcuguuggaaccggcc

SEQ ID NO: 839429 - RNA, 23 nt, Mycobacterium avium subsp. paratuberculosis
gcacgcuguuggaaccggccacc

SEQ ID NO: 839430 - RNA, 17 nt, Mycobacterium avium subsp. paratuberculosis
gcacgcguugcagcgcc

SEQ ID NO: 839431 - RNA, 16 nt, Mycobacterium avium subsp. paratuberculosis
gcacgcuggccggcag

SEQ ID NO: 839432 - RNA, 13 nt, Mycobacterium avium subsp. paratuberculosis
gcacgcguucgga

SEQ ID NO: 839433 - RNA, 19 nt, Mycobacterium avium subsp. paratuberculosis
gcacggacagcucaccggg

SEQ ID NO: 839434 - RNA, 14 nt, Mycobacterium avium subsp. paratuberculosis
gcacgccgagcagc

SEQ ID NO: 839435 - RNA, 20 nt, Mycobacterium avium subsp. paratuberculosis
gcacgccgagcagcaccggc

SEQ ID NO: 839436 - RNA, 21 nt, Mycobacterium avium subsp. paratuberculosis
gcacgccgagcagcaccggca

SEQ ID NO: 839437 - RNA, 13 nt, Mycobacterium avium subsp. paratuberculosis
gcacgccgccgcg

SEQ ID NO: 839438 - RNA, 15 nt, Mycobacterium avium subsp. paratuberculosis
gcacgccgccgcgaa

SEQ ID NO: 839439 - RNA, 18 nt, Mycobacterium avium subsp. paratuberculosis
gcacgccgaggcgugccg

SEQ ID NO: 839440 - RNA, 20 nt, Mycobacterium avium subsp. paratuberculosis
gcacgccgccgguggagaug

SEQ ID NO: 839441 - RNA, 12 nt, Mycobacterium avium subsp. paratuberculosis
gcacgccggccg

SEQ ID NO: 839442 - RNA, 22 nt, Mycobacterium avium subsp. paratuberculosis
gcacgccgcggaaggccagcuc

SEQ ID NO: 839443 - RNA, 18 nt, Mycobacterium avium subsp. paratuberculosis
gcacgccgcucgucgggc

SEQ ID NO: 839444 - RNA, 14 nt, Mycobacterium avium subsp. paratuberculosis
gcacgcggccgcgc

SEQ ID NO: 839445 - RNA, 16 nt, Mycobacterium avium subsp. paratuberculosis
gcacgcggccgcgccg

SEQ ID NO: 839446 - RNA, 20 nt, Mycobacterium avium subsp. paratuberculosis
gcacgcggccgcgccggccg

SEQ ID NO: 839447 - RNA, 19 nt, Mycobacterium avium subsp. paratuberculosis
gcacgcggacacgaacgac

SEQ ID NO: 839448 - RNA, 22 nt, Mycobacterium avium subsp. paratuberculosis
gcacgcggacacgaacgacgcg

SEQ ID NO: 839449 - RNA, 24 nt, Mycobacterium avium subsp. paratuberculosis
gcacgcggacacgaacgacgcggc

SEQ ID NO: 839450 - RNA, 21 nt, Mycobacterium avium subsp. paratuberculosis
gcacgcggaccuuggugucgg

SEQ ID NO: 839451 - RNA, 15 nt, Mycobacterium avium subsp. paratuberculosis
gcacgcggaucgcgc

SEQ ID NO: 839452 - RNA, 16 nt, Mycobacterium avium subsp. paratuberculosis
gcacgcggaucgcgcu

SEQ ID NO: 839453 - RNA, 20 nt, Mycobacterium avium subsp. paratuberculosis
gcacgcggaucgcgcugacc

SEQ ID NO: 839454 - RNA, 21 nt, Mycobacterium avium subsp. paratuberculosis
gcacgcggaucgcgcugacca

SEQ ID NO: 839455 - RNA, 15 nt, Mycobacterium avium subsp. paratuberculosis
gcacgcgcgggucgu

SEQ ID NO: 839456 - RNA, 22 nt, Mycobacterium avium subsp. paratuberculosis
gcacgcgcgggucgucggccug

SEQ ID NO: 839457 - RNA, 12 nt, Mycobacterium avium subsp. paratuberculosis
gcacgcgcgccg

SEQ ID NO: 839458 - RNA, 21 nt, Mycobacterium avium subsp. paratuberculosis
gcacguccuagacacgaauac

SEQ ID NO: 839459 - RNA, 15 nt, Mycobacterium avium subsp. paratuberculosis
gcacguccucgucgg

SEQ ID NO: 839460 - RNA, 16 nt, Mycobacterium avium subsp. paratuberculosis
gcacguccucgucggu

SEQ ID NO: 839461 - RNA, 20 nt, Mycobacterium avium subsp. paratuberculosis
gcacguccucgucgguccag

SEQ ID NO: 839462 - RNA, 18 nt, Mycobacterium avium subsp. paratuberculosis
gcacguccgccuccgacc

SEQ ID NO: 839463 - RNA, 20 nt, Mycobacterium avium subsp. paratuberculosis
gcacguccgccuccgaccag

SEQ ID NO: 839464 - RNA, 16 nt, Mycobacterium avium subsp. paratuberculosis
gcacgucgacgcccug

SEQ ID NO: 839465 - RNA, 14 nt, Mycobacterium avium subsp. paratuberculosis
gcacgucgacgccg

SEQ ID NO: 839466 - RNA, 15 nt, Mycobacterium avium subsp. paratuberculosis
gcacgucgacgccgg

SEQ ID NO: 839467 - RNA, 17 nt, Mycobacterium avium subsp. paratuberculosis
gcacgucgagcaccgcg

SEQ ID NO: 839468 - RNA, 20 nt, Mycobacterium avium subsp. paratuberculosis
gcacguccccgggcaccccg

SEQ ID NO: 839469 - RNA, 22 nt, Mycobacterium avium subsp. paratuberculosis
gcacguccccgggcaccccggu

SEQ ID NO: 839470 - RNA, 17 nt, Mycobacterium avium subsp. paratuberculosis
gcacguccccgugcagc

SEQ ID NO: 839471 - RNA, 18 nt, Mycobacterium avium subsp. paratuberculosis
gcacguccccgugcagcc

SEQ ID NO: 839472 - RNA, 21 nt, Mycobacterium avium subsp. paratuberculosis
gcacguccccgugcagccggg

SEQ ID NO: 839473 - RNA, 23 nt, Mycobacterium avium subsp. paratuberculosis
gcacguccccgugcagccgggcc

SEQ ID NO: 839474 - RNA, 19 nt, Mycobacterium avium subsp. paratuberculosis
gcacgucccgcccggcgcc

SEQ ID NO: 839475 - RNA, 21 nt, Mycobacterium avium subsp. paratuberculosis
gcacgucccgcccggcgccgg

SEQ ID NO: 839476 - RNA, 22 nt, Mycobacterium avium subsp. paratuberculosis
gcacgucccgcccggcgccggc

SEQ ID NO: 839477 - RNA, 23 nt, Mycobacterium avium subsp. paratuberculosis
gcacgucccgcccggcgccggcc

SEQ ID NO: 839478 - RNA, 15 nt, Mycobacterium avium subsp. paratuberculosis
gcacggugggcgccg

SEQ ID NO: 839479 - RNA, 17 nt, Mycobacterium avium subsp. paratuberculosis
gcacgguguagacgcgg

SEQ ID NO: 839480 - RNA, 19 nt, Mycobacterium avium subsp. paratuberculosis
gcacgguguagacgcgggc

SEQ ID NO: 839481 - RNA, 15 nt, Mycobacterium avium subsp. paratuberculosis
gcacguccagcccgc

SEQ ID NO: 839482 - RNA, 19 nt, Mycobacterium avium subsp. paratuberculosis
gcacguccagcccgcgcca

SEQ ID NO: 839483 - RNA, 20 nt, Mycobacterium avium subsp. paratuberculosis
gcacguccagcccgcgccag

SEQ ID NO: 839484 - RNA, 17 nt, Mycobacterium avium subsp. paratuberculosis
gcacggugcccgucggc

SEQ ID NO: 839485 - RNA, 19 nt, Mycobacterium avium subsp. paratuberculosis
gcacggugggacggcgggu

SEQ ID NO: 839486 - RNA, 18 nt, Mycobacterium avium subsp. paratuberculosis
gcacggugcacacgccga

SEQ ID NO: 839487 - RNA, 19 nt, Mycobacterium avium subsp. paratuberculosis
gcacggugcacacgccgag

SEQ ID NO: 839488 - RNA, 15 nt, Mycobacterium avium subsp. paratuberculosis
gcacggugcagcagc

SEQ ID NO: 839489 - RNA, 19 nt, Mycobacterium avium subsp. paratuberculosis
gcacggugcagcagcgccg

SEQ ID NO: 839490 - RNA, 14 nt, Mycobacterium avium subsp. paratuberculosis
gcacggugcgccgg

SEQ ID NO: 839491 - RNA, 15 nt, Mycobacterium avium subsp. paratuberculosis
gcacggugcgccggc

SEQ ID NO: 839492 - RNA, 16 nt, Mycobacterium avium subsp. paratuberculosis
gcacggugcgccggca

SEQ ID NO: 839493 - RNA, 22 nt, Mycobacterium avium subsp. paratuberculosis
gcacggugcgccggcagcggcc

SEQ ID NO: 839494 - RNA, 23 nt, Mycobacterium avium subsp. paratuberculosis
gcacggugcgccggcagcggccg

SEQ ID NO: 839495 - RNA, 15 nt, Mycobacterium avium subsp. paratuberculosis
gcacggugcgggugc

SEQ ID NO: 839496 - RNA, 18 nt, Mycobacterium avium subsp. paratuberculosis
gcacggugcgggugccga

SEQ ID NO: 839497 - RNA, 15 nt, Mycobacterium avium subsp. paratuberculosis
gcacggugaucagca

SEQ ID NO: 839498 - RNA, 22 nt, Mycobacterium avium subsp. paratuberculosis
gcacggugaucagcagcagguc

SEQ ID NO: 839499 - RNA, 17 nt, Mycobacterium avium subsp. paratuberculosis
gcacgggaugaucggcg

SEQ ID NO: 839500 - RNA, 22 nt, Mycobacterium avium subsp. paratuberculosis
gcacgggcccgcgggaucagcg

SEQ ID NO: 839501 - RNA, 12 nt, Mycobacterium avium subsp. paratuberculosis
gcacgggcggcg

SEQ ID NO: 839502 - RNA, 14 nt, Mycobacterium avium subsp. paratuberculosis
gcacgggcggcggg

SEQ ID NO: 839503 - RNA, 19 nt, Mycobacterium avium subsp. paratuberculosis
gcacgggcgggcagauggu

SEQ ID NO: 839504 - RNA, 15 nt, Mycobacterium avium subsp. paratuberculosis
gcacgggcaccgacg

SEQ ID NO: 839505 - RNA, 17 nt, Mycobacterium avium subsp. paratuberculosis
gcacgggcaccgacgag

SEQ ID NO: 839506 - RNA, 14 nt, Mycobacterium avium subsp. paratuberculosis
gcacggcucgucca

SEQ ID NO: 839507 - RNA, 17 nt, Mycobacterium avium subsp. paratuberculosis
gcacggcugcucccgaa

SEQ ID NO: 839508 - RNA, 13 nt, Mycobacterium avium subsp. paratuberculosis
gcacggcggcgcu

SEQ ID NO: 839509 - RNA, 14 nt, Mycobacterium avium subsp. paratuberculosis
gcacggcggcgcug

SEQ ID NO: 839510 - RNA, 12 nt, Mycobacterium avium subsp. paratuberculosis
gcacggcggcga

SEQ ID NO: 839511 - RNA, 14 nt, Mycobacterium avium subsp. paratuberculosis
gcacggcggcgaac

SEQ ID NO: 839512 - RNA, 21 nt, Mycobacterium avium subsp. paratuberculosis
gcacggcggcgaacgccgccg

SEQ ID NO: 839513 - RNA, 23 nt, Mycobacterium avium subsp. paratuberculosis
gcacggcggcgaacgccgccgug

SEQ ID NO: 839514 - RNA, 20 nt, Mycobacterium avium subsp. paratuberculosis
gaucgcgggcgacccgcugg

SEQ ID NO: 839515 - RNA, 17 nt, Mycobacterium avium subsp. paratuberculosis
gaucgcgggcugcggcg

SEQ ID NO: 839516 - RNA, 20 nt, Mycobacterium avium subsp. paratuberculosis
gaucgcggugaccgccgcca

SEQ ID NO: 839517 - RNA, 19 nt, Mycobacterium avium subsp. paratuberculosis
gaucgcguaguccagcacg

SEQ ID NO: 839518 - RNA, 23 nt, Mycobacterium avium subsp. paratuberculosis
gaucgcgucaaccaccggcaucg

SEQ ID NO: 839519 - RNA, 19 nt, Mycobacterium avium subsp. paratuberculosis
gaucgcggugacgcgccgg

SEQ ID NO: 839520 - RNA, 22 nt, Mycobacterium avium subsp. paratuberculosis
gaucgcggugcggggccgcggc

SEQ ID NO: 839521 - RNA, 14 nt, Mycobacterium avium subsp. paratuberculosis
gaucgcgguggcgc

SEQ ID NO: 839522 - RNA, 17 nt, Mycobacterium avium subsp. paratuberculosis
gaucgcgguggcgcccg

SEQ ID NO: 839523 - RNA, 18 nt, Mycobacterium avium subsp. paratuberculosis
gaucgcgguggcgcccgc

SEQ ID NO: 839524 - RNA, 18 nt, Mycobacterium avium subsp. paratuberculosis
gaucgcgugcgucacgcu

SEQ ID NO: 839525 - RNA, 12 nt, Mycobacterium avium subsp. paratuberculosis
gaucgcgucgac

SEQ ID NO: 839526 - RNA, 13 nt, Mycobacterium avium subsp. paratuberculosis
gaucgcgucgacg

SEQ ID NO: 839527 - RNA, 14 nt, Mycobacterium avium subsp. paratuberculosis
gaucgcgucgacga

SEQ ID NO: 839528 - RNA, 16 nt, Mycobacterium avium subsp. paratuberculosis
gaucgcgucgacgaug

SEQ ID NO: 839529 - RNA, 14 nt, Mycobacterium avium subsp. paratuberculosis
gaucgcgucgacgg

SEQ ID NO: 839530 - RNA, 16 nt, Mycobacterium avium subsp. paratuberculosis
gaucgcgucgacggcg

SEQ ID NO: 839531 - RNA, 18 nt, Mycobacterium avium subsp. paratuberculosis
gaucgcgucgacggcgcc

SEQ ID NO: 839532 - RNA, 20 nt, Mycobacterium avium subsp. paratuberculosis
gaucgcgucgacggcgccgg

SEQ ID NO: 839533 - RNA, 18 nt, Mycobacterium avium subsp. paratuberculosis
gaucgcgucgaugccggc

SEQ ID NO: 839534 - RNA, 16 nt, Mycobacterium avium subsp. paratuberculosis
gaucgcuucggccagc

SEQ ID NO: 839535 - RNA, 17 nt, Mycobacterium avium subsp. paratuberculosis
gaucgcuucggccagcg

SEQ ID NO: 839536 - RNA, 19 nt, Mycobacterium avium subsp. paratuberculosis
gaucgcuucggccagcgcg

SEQ ID NO: 839537 - RNA, 14 nt, Mycobacterium avium subsp. paratuberculosis
gaucgcggccacca

SEQ ID NO: 839538 - RNA, 15 nt, Mycobacterium avium subsp. paratuberculosis
gaucgcguucugcac

SEQ ID NO: 839539 - RNA, 22 nt, Mycobacterium avium subsp. paratuberculosis
gaucgcguucugcaccagcucg

SEQ ID NO: 839540 - RNA, 19 nt, Mycobacterium avium subsp. paratuberculosis
gaucgcgcugaccaggccg

SEQ ID NO: 839541 - RNA, 22 nt, Mycobacterium avium subsp. paratuberculosis
gaucgcgcugaccaggccgucc

SEQ ID NO: 839542 - RNA, 16 nt, Mycobacterium avium subsp. paratuberculosis
gaucgcgccggccgcc

SEQ ID NO: 839543 - RNA, 19 nt, Mycobacterium avium subsp. paratuberculosis
gaucgcgccuugggccauc

SEQ ID NO: 839544 - RNA, 12 nt, Mycobacterium avium subsp. paratuberculosis
gaucgcggcgua

SEQ ID NO: 839545 - RNA, 13 nt, Mycobacterium avium subsp. paratuberculosis
gaucgcggcggcg

SEQ ID NO: 839546 - RNA, 21 nt, Mycobacterium avium subsp. paratuberculosis
gaucgcggcgcugccgccggc

SEQ ID NO: 839547 - RNA, 22 nt, Mycobacterium avium subsp. paratuberculosis
gaucgcggcgcugccgccggcc

SEQ ID NO: 839548 - RNA, 19 nt, Mycobacterium avium subsp. paratuberculosis
gaucgcggcgagcagcgcg

SEQ ID NO: 839549 - RNA, 15 nt, Mycobacterium avium subsp. paratuberculosis
gaucgcggcgaugga

SEQ ID NO: 839550 - RNA, 13 nt, Mycobacterium avium subsp. paratuberculosis
gaucgcggccagc

SEQ ID NO: 839551 - RNA, 19 nt, Mycobacterium avium subsp. paratuberculosis
gaucgcggcccccugaucg

SEQ ID NO: 839552 - RNA, 12 nt, Mycobacterium avium subsp. paratuberculosis
gaucgcggcccg

SEQ ID NO: 839553 - RNA, 14 nt, Mycobacterium avium subsp. paratuberculosis
gaucgcggcccgcc

SEQ ID NO: 839554 - RNA, 20 nt, Mycobacterium avium subsp. paratuberculosis
gaucgcggcccgcggggcgu

SEQ ID NO: 839555 - RNA, 22 nt, Mycobacterium avium subsp. paratuberculosis
gaucgcggcccgcggggcguac

SEQ ID NO: 839556 - RNA, 13 nt, Mycobacterium avium subsp. paratuberculosis
gaucgcggccggc

SEQ ID NO: 839557 - RNA, 23 nt, Mycobacterium avium subsp. paratuberculosis
gaucgcggccggcgagucgcgga

SEQ ID NO: 839558 - RNA, 17 nt, Mycobacterium avium subsp. paratuberculosis
gaucggaccgcaccacc

SEQ ID NO: 839559 - RNA, 16 nt, Mycobacterium avium subsp. paratuberculosis
gaucggauucgggugg

SEQ ID NO: 839560 - RNA, 17 nt, Mycobacterium avium subsp. paratuberculosis
gaucggauucggguggc

SEQ ID NO: 839561 - RNA, 16 nt, Mycobacterium avium subsp. paratuberculosis
gaucggcccgacgggu

SEQ ID NO: 839562 - RNA, 23 nt, Mycobacterium avium subsp. paratuberculosis
gaucggcccgaucucgcgcgggu

SEQ ID NO: 839563 - RNA, 17 nt, Mycobacterium avium subsp. paratuberculosis
gaucggccaggcgccca

SEQ ID NO: 839564 - RNA, 22 nt, Mycobacterium avium subsp. paratuberculosis
gaucggccauggugccgccguu

SEQ ID NO: 839565 - RNA, 15 nt, Mycobacterium avium subsp. paratuberculosis
gaucggccagcaggu

SEQ ID NO: 839566 - RNA, 16 nt, Mycobacterium avium subsp. paratuberculosis
gaucggccagcagguc

SEQ ID NO: 839567 - RNA, 12 nt, Mycobacterium avium subsp. paratuberculosis
gaucggccagcg

SEQ ID NO: 839568 - RNA, 16 nt, Mycobacterium avium subsp. paratuberculosis
gaucggccagcgcggc

SEQ ID NO: 839569 - RNA, 20 nt, Mycobacterium avium subsp. paratuberculosis
gaucggccagcgcggccggg

SEQ ID NO: 839570 - RNA, 22 nt, Mycobacterium avium subsp. paratuberculosis
gaucggccagcgcggccgggcg

SEQ ID NO: 839571 - RNA, 18 nt, Mycobacterium avium subsp. paratuberculosis
gaucggcaggucgucgac

SEQ ID NO: 839572 - RNA, 22 nt, Mycobacterium avium subsp. paratuberculosis
gaucggcaggucgucgacgucg

SEQ ID NO: 839573 - RNA, 17 nt, Mycobacterium avium subsp. paratuberculosis
gaucggcaugacgccca

SEQ ID NO: 839574 - RNA, 17 nt, Mycobacterium avium subsp. paratuberculosis
gaucggcacccgcaaca

SEQ ID NO: 839575 - RNA, 13 nt, Mycobacterium avium subsp. paratuberculosis
gaucggcagcgcg

SEQ ID NO: 839576 - RNA, 14 nt, Mycobacterium avium subsp. paratuberculosis
gaucggcagcgcgc

SEQ ID NO: 839577 - RNA, 19 nt, Mycobacterium avium subsp. paratuberculosis
gaucggcaggauccggucg

SEQ ID NO: 839578 - RNA, 16 nt, Mycobacterium avium subsp. paratuberculosis
gaucggcggccaccag

SEQ ID NO: 839579 - RNA, 19 nt, Mycobacterium avium subsp. paratuberculosis
gaucggcggccaccagccg

SEQ ID NO: 839580 - RNA, 22 nt, Mycobacterium avium subsp. paratuberculosis
gaucggcggccaccagccggcc

SEQ ID NO: 839581 - RNA, 17 nt, Mycobacterium avium subsp. paratuberculosis
gaucggcgcgucggcgu

SEQ ID NO: 839582 - RNA, 13 nt, Mycobacterium avium subsp. paratuberculosis
gaucggcggccug

SEQ ID NO: 839583 - RNA, 15 nt, Mycobacterium avium subsp. paratuberculosis
gaucggcggccugcg

SEQ ID NO: 839584 - RNA, 16 nt, Mycobacterium avium subsp. paratuberculosis
gaucggcggccugcgg

SEQ ID NO: 839585 - RNA, 18 nt, Mycobacterium avium subsp. paratuberculosis
gaucggcggccugcggcg

SEQ ID NO: 839586 - RNA, 20 nt, Mycobacterium avium subsp. paratuberculosis
gaucggcggccugcggcggc

SEQ ID NO: 839587 - RNA, 12 nt, Mycobacterium avium subsp. paratuberculosis
gaucggcggcgg

SEQ ID NO: 839588 - RNA, 15 nt, Mycobacterium avium subsp. paratuberculosis
gaucggcggcggggu

SEQ ID NO: 839589 - RNA, 13 nt, Mycobacterium avium subsp. paratuberculosis
gaucggcggcucg

SEQ ID NO: 839590 - RNA, 15 nt, Mycobacterium avium subsp. paratuberculosis
gaucggcggcucgcc

SEQ ID NO: 839591 - RNA, 17 nt, Mycobacterium avium subsp. paratuberculosis
gaucggcggcucgccgg

SEQ ID NO: 839592 - RNA, 20 nt, Mycobacterium avium subsp. paratuberculosis
gaucggcggcucgccggcgu

SEQ ID NO: 839593 - RNA, 14 nt, Mycobacterium avium subsp. paratuberculosis
gaucggcgggaccc

SEQ ID NO: 839594 - RNA, 20 nt, Mycobacterium avium subsp. paratuberculosis
gaucggcgggcgccgaaucg

SEQ ID NO: 839595 - RNA, 19 nt, Mycobacterium avium subsp. paratuberculosis
gaucggcgggugcgggcgc

SEQ ID NO: 839596 - RNA, 18 nt, Mycobacterium avium subsp. paratuberculosis
gaucggcgguccgccgca

SEQ ID NO: 839597 - RNA, 23 nt, Mycobacterium avium subsp. paratuberculosis
gaucggcgguccgccgcagcggc

SEQ ID NO: 839598 - RNA, 14 nt, Mycobacterium avium subsp. paratuberculosis
gaucggcgcgccga

SEQ ID NO: 839599 - RNA, 17 nt, Mycobacterium avium subsp. paratuberculosis
gaucggcgcgaagucga

SEQ ID NO: 839600 - RNA, 19 nt, Mycobacterium avium subsp. paratuberculosis
gaucggcgccacgaccagc

SEQ ID NO: 839601 - RNA, 16 nt, Mycobacterium avium subsp. paratuberculosis
gaucggcgcccaccgc

SEQ ID NO: 839602 - RNA, 18 nt, Mycobacterium avium subsp. paratuberculosis
gaucggcgcccaccgcgg

SEQ ID NO: 839603 - RNA, 22 nt, Mycobacterium avium subsp. paratuberculosis
gaucggcgcccaccgcggcgcg

SEQ ID NO: 839604 - RNA, 13 nt, Mycobacterium avium subsp. paratuberculosis
gaucggccugggg

SEQ ID NO: 839605 - RNA, 18 nt, Mycobacterium avium subsp. paratuberculosis
gaucggccuggggggcgc

SEQ ID NO: 839606 - RNA, 12 nt, Mycobacterium avium subsp. paratuberculosis
gaucggccgcgu

SEQ ID NO: 839607 - RNA, 18 nt, Mycobacterium avium subsp. paratuberculosis
gaucggccgcgucgggca

SEQ ID NO: 839608 - RNA, 19 nt, Mycobacterium avium subsp. paratuberculosis
gaucggccgcugcccgggc

SEQ ID NO: 839609 - RNA, 22 nt, Mycobacterium avium subsp. paratuberculosis
gaucggccgcugcgggcgggcc

SEQ ID NO: 839610 - RNA, 17 nt, Mycobacterium avium subsp. paratuberculosis
gaucuacgucggcuggc

SEQ ID NO: 839611 - RNA, 22 nt, Mycobacterium avium subsp. paratuberculosis
gaucucgacgguggccucggcg

SEQ ID NO: 839612 - RNA, 21 nt, Mycobacterium avium subsp. paratuberculosis
gaucguugggcaugucgccga

SEQ ID NO: 839613 - RNA, 18 nt, Mycobacterium avium subsp. paratuberculosis
gaucguguggccgcccuc

SEQ ID NO: 839614 - RNA, 18 nt, Mycobacterium avium subsp. paratuberculosis
gaucucggggaucagcag

SEQ ID NO: 839615 - RNA, 14 nt, Mycobacterium avium subsp. paratuberculosis
gaucucggcggccg

SEQ ID NO: 839616 - RNA, 16 nt, Mycobacterium avium subsp. paratuberculosis
gaucucggcguacagc

SEQ ID NO: 839617 - RNA, 19 nt, Mycobacterium avium subsp. paratuberculosis
gaucucggcguacagcccg

SEQ ID NO: 839618 - RNA, 17 nt, Mycobacterium avium subsp. paratuberculosis
gaucucggucgccagca

SEQ ID NO: 839619 - RNA, 20 nt, Mycobacterium avium subsp. paratuberculosis
gaucucggucgccagcaccg

SEQ ID NO: 839620 - RNA, 16 nt, Mycobacterium avium subsp. paratuberculosis
gaucucggugagccgc

SEQ ID NO: 839621 - RNA, 13 nt, Mycobacterium avium subsp. paratuberculosis
gaucucggugccg

SEQ ID NO: 839622 - RNA, 15 nt, Mycobacterium avium subsp. paratuberculosis
gaucucggccagcgg

SEQ ID NO: 839623 - RNA, 19 nt, Mycobacterium avium subsp. paratuberculosis
gaucucgauggacgcggug

SEQ ID NO: 839624 - RNA, 16 nt, Mycobacterium avium subsp. paratuberculosis
gaucucgcgggcccgc

SEQ ID NO: 839625 - RNA, 17 nt, Mycobacterium avium subsp. paratuberculosis
gaucucgcgggcccgcg

SEQ ID NO: 839626 - RNA, 18 nt, Mycobacterium avium subsp. paratuberculosis
gaucucgcgggcccgcgc

SEQ ID NO: 839627 - RNA, 19 nt, Mycobacterium avium subsp. paratuberculosis
gaucgugaauucggccggg

SEQ ID NO: 839628 - RNA, 16 nt, Mycobacterium avium subsp. paratuberculosis
gaucgugacgccgucc

SEQ ID NO: 839629 - RNA, 23 nt, Mycobacterium avium subsp. paratuberculosis
gaucgugacgccguccgacgugc

SEQ ID NO: 839630 - RNA, 17 nt, Mycobacterium avium subsp. paratuberculosis
gaucgugcuguggaaca

SEQ ID NO: 839631 - RNA, 13 nt, Mycobacterium avium subsp. paratuberculosis
gaucgugucgauc

SEQ ID NO: 839632 - RNA, 19 nt, Mycobacterium avium subsp. paratuberculosis
gaucgugucuggccccguc

SEQ ID NO: 839633 - RNA, 20 nt, Mycobacterium avium subsp. paratuberculosis
gaucgugucuggccccgucg

SEQ ID NO: 839634 - RNA, 18 nt, Mycobacterium avium subsp. paratuberculosis
gaucgucuugaccgcccg

SEQ ID NO: 839635 - RNA, 16 nt, Mycobacterium avium subsp. paratuberculosis
gaucgucucggccagc

SEQ ID NO: 839636 - RNA, 17 nt, Mycobacterium avium subsp. paratuberculosis
gaucgucucggccagcc

SEQ ID NO: 839637 - RNA, 16 nt, Mycobacterium avium subsp. paratuberculosis
gaucgucucggccgcg

SEQ ID NO: 839638 - RNA, 17 nt, Mycobacterium avium subsp. paratuberculosis
gaucgucucggccgcgg

SEQ ID NO: 839639 - RNA, 18 nt, Mycobacterium avium subsp. paratuberculosis
gaucgucucggccgcggu

SEQ ID NO: 839640 - RNA, 22 nt, Mycobacterium avium subsp. paratuberculosis
gaucgucucggccgcggugcgu

SEQ ID NO: 839641 - RNA, 14 nt, Mycobacterium avium subsp. paratuberculosis
gaucgucucggcca

SEQ ID NO: 839642 - RNA, 19 nt, Mycobacterium avium subsp. paratuberculosis
gaucgucgaacucgggccc

SEQ ID NO: 839643 - RNA, 17 nt, Mycobacterium avium subsp. paratuberculosis
gaucgucgccgccaacg

SEQ ID NO: 839644 - RNA, 20 nt, Mycobacterium avium subsp. paratuberculosis
gaucgucgccgccaacgcga

SEQ ID NO: 839645 - RNA, 13 nt, Mycobacterium avium subsp. paratuberculosis
gaucgucgccguc

SEQ ID NO: 839646 - RNA, 15 nt, Mycobacterium avium subsp. paratuberculosis
gaucgucggcacugc

SEQ ID NO: 839647 - RNA, 20 nt, Mycobacterium avium subsp. paratuberculosis
gaucgucggcacugcccgca

SEQ ID NO: 839648 - RNA, 23 nt, Mycobacterium avium subsp. paratuberculosis
gaucgucggcacugcccgcaucg

SEQ ID NO: 839649 - RNA, 16 nt, Mycobacterium avium subsp. paratuberculosis
gaucguagggcucggc

SEQ ID NO: 839650 - RNA, 18 nt, Mycobacterium avium subsp. paratuberculosis
gaucgucgaccugcucgu

SEQ ID NO: 839651 - RNA, 22 nt, Mycobacterium avium subsp. paratuberculosis
gaucgucgaccugcucgucggu

SEQ ID NO: 839652 - RNA, 14 nt, Mycobacterium avium subsp. paratuberculosis
gaucgucaccgacc

SEQ ID NO: 839653 - RNA, 22 nt, Mycobacterium avium subsp. paratuberculosis
gaucgucaccgaccccucggcg

SEQ ID NO: 839654 - RNA, 22 nt, Mycobacterium avium subsp. paratuberculosis
gaucgucaccgugccgucgcug

SEQ ID NO: 839655 - RNA, 20 nt, Mycobacterium avium subsp. paratuberculosis
gaucguccaucgcgucgucc

SEQ ID NO: 839656 - RNA, 16 nt, Mycobacterium avium subsp. paratuberculosis
gaucgggucaccggcc

SEQ ID NO: 839657 - RNA, 19 nt, Mycobacterium avium subsp. paratuberculosis
gaucgggucccagaugcgc

SEQ ID NO: 839658 - RNA, 16 nt, Mycobacterium avium subsp. paratuberculosis
gaucgggucgcccggg

SEQ ID NO: 839659 - RNA, 17 nt, Mycobacterium avium subsp. paratuberculosis
gaucgggugagacggcc

SEQ ID NO: 839660 - RNA, 13 nt, Mycobacterium avium subsp. paratuberculosis
gaucggguggccc

SEQ ID NO: 839661 - RNA, 18 nt, Mycobacterium avium subsp. paratuberculosis
gaucgguguagcccggug

SEQ ID NO: 839662 - RNA, 18 nt, Mycobacterium avium subsp. paratuberculosis
gaucgguguccagccgca

SEQ ID NO: 839663 - RNA, 18 nt, Mycobacterium avium subsp. paratuberculosis
gaucggugcaggccgcga

SEQ ID NO: 839664 - RNA, 16 nt, Mycobacterium avium subsp. paratuberculosis
gaucggucucggugga

SEQ ID NO: 839665 - RNA, 20 nt, Mycobacterium avium subsp. paratuberculosis
gaucggugaacccgccggcg

SEQ ID NO: 839666 - RNA, 20 nt, Mycobacterium avium subsp. paratuberculosis
gaucggugccucuucgucgg

SEQ ID NO: 839667 - RNA, 14 nt, Mycobacterium avium subsp. paratuberculosis
gaucggugcgcggc

SEQ ID NO: 839668 - RNA, 18 nt, Mycobacterium avium subsp. paratuberculosis
gaucggugcgcggcgaag

SEQ ID NO: 839669 - RNA, 15 nt, Mycobacterium avium subsp. paratuberculosis
gaucgggaccgucac

SEQ ID NO: 839670 - RNA, 21 nt, Mycobacterium avium subsp. paratuberculosis
gaucggggcccaccccggaca

SEQ ID NO: 839671 - RNA, 13 nt, Mycobacterium avium subsp. paratuberculosis
gaucggggcgacc

SEQ ID NO: 839672 - RNA, 17 nt, Mycobacterium avium subsp. paratuberculosis
gaucggggcgcagcccg

SEQ ID NO: 839673 - RNA, 18 nt, Mycobacterium avium subsp. paratuberculosis
gaucggggaauccuggcc

SEQ ID NO: 839674 - RNA, 19 nt, Mycobacterium avium subsp. paratuberculosis
gaucggggaauccuggccg

SEQ ID NO: 839675 - RNA, 14 nt, Mycobacterium avium subsp. paratuberculosis
gaucggggugccgc

SEQ ID NO: 839676 - RNA, 19 nt, Mycobacterium avium subsp. paratuberculosis
gaucgggcguugcgccgcg

SEQ ID NO: 839677 - RNA, 17 nt, Mycobacterium avium subsp. paratuberculosis
gaucggcgugccggacu

SEQ ID NO: 839678 - RNA, 16 nt, Mycobacterium avium subsp. paratuberculosis
gaucggcuagcagcuc

SEQ ID NO: 839679 - RNA, 19 nt, Mycobacterium avium subsp. paratuberculosis
gaucggcugcgggccagcg

SEQ ID NO: 839680 - RNA, 23 nt, Mycobacterium avium subsp. paratuberculosis
gaucggcuuggggaagccggcca

SEQ ID NO: 839681 - RNA, 18 nt, Mycobacterium avium subsp. paratuberculosis
gaucggcuuggugggcgc

SEQ ID NO: 839682 - RNA, 13 nt, Mycobacterium avium subsp. paratuberculosis
gaucagugccgcg

SEQ ID NO: 839683 - RNA, 23 nt, Mycobacterium avium subsp. paratuberculosis
gaucauuccgccgaaacccgcug

SEQ ID NO: 839684 - RNA, 20 nt, Mycobacterium avium subsp. paratuberculosis
gauccaccaauucgcgcugc

SEQ ID NO: 839685 - RNA, 12 nt, Mycobacterium avium subsp. paratuberculosis
gauccaccgcgc

SEQ ID NO: 839686 - RNA, 19 nt, Mycobacterium avium subsp. paratuberculosis
gauccaccgcgcggccagc

SEQ ID NO: 839687 - RNA, 11 nt, Mycobacterium avium subsp. paratuberculosis
gauccacggcg

SEQ ID NO: 839688 - RNA, 17 nt, Mycobacterium avium subsp. paratuberculosis
gauccacuccagcaccg

SEQ ID NO: 839689 - RNA, 15 nt, Mycobacterium avium subsp. paratuberculosis
gauccacucccgcgc

SEQ ID NO: 839690 - RNA, 20 nt, Mycobacterium avium subsp. paratuberculosis
gauccacucccgcgcgcugu

SEQ ID NO: 839691 - RNA, 15 nt, Mycobacterium avium subsp. paratuberculosis
gaucccagcgggaca

SEQ ID NO: 839692 - RNA, 21 nt, Mycobacterium avium subsp. paratuberculosis
gaucccaggaacgcgcccggc

SEQ ID NO: 839693 - RNA, 15 nt, Mycobacterium avium subsp. paratuberculosis
gauccccaccgugac

SEQ ID NO: 839694 - RNA, 21 nt, Mycobacterium avium subsp. paratuberculosis
gauccccucacuccagcggcg

SEQ ID NO: 839695 - RNA, 11 nt, Mycobacterium avium subsp. paratuberculosis
gaucccgccgc

SEQ ID NO: 839696 - RNA, 18 nt, Mycobacterium avium subsp. paratuberculosis
gaucccgaacugccgcgc

SEQ ID NO: 839697 - RNA, 20 nt, Mycobacterium avium subsp. paratuberculosis
gaucccgaggaugccgccca

SEQ ID NO: 839698 - RNA, 16 nt, Mycobacterium avium subsp. paratuberculosis
gauccccgcagcuccc

SEQ ID NO: 839699 - RNA, 17 nt, Mycobacterium avium subsp. paratuberculosis
gaucccggccacgucga

SEQ ID NO: 839700 - RNA, 19 nt, Mycobacterium avium subsp. paratuberculosis
gaucccggccacgucgaug

SEQ ID NO: 839701 - RNA, 23 nt, Mycobacterium avium subsp. paratuberculosis
gaucccggccacgucgaugccga

SEQ ID NO: 839702 - RNA, 19 nt, Mycobacterium avium subsp. paratuberculosis
gaucccggccagcacccgc

SEQ ID NO: 839703 - RNA, 21 nt, Mycobacterium avium subsp. paratuberculosis
gaucccggccagcacccgcug

SEQ ID NO: 839704 - RNA, 14 nt, Mycobacterium avium subsp. paratuberculosis
gaucccgccgcccg

SEQ ID NO: 839705 - RNA, 15 nt, Mycobacterium avium subsp. paratuberculosis
gaucccgccgcccgc

SEQ ID NO: 839706 - RNA, 22 nt, Mycobacterium avium subsp. paratuberculosis
gaucccgccgcccgcccgagcg

SEQ ID NO: 839707 - RNA, 15 nt, Mycobacterium avium subsp. paratuberculosis
gaucccgccggcgau

SEQ ID NO: 839708 - RNA, 16 nt, Mycobacterium avium subsp. paratuberculosis
gaucccgccggcggcc

SEQ ID NO: 839709 - RNA, 21 nt, Mycobacterium avium subsp. paratuberculosis
gaucccgccggcggccacgau

SEQ ID NO: 839710 - RNA, 12 nt, Mycobacterium avium subsp. paratuberculosis
gaucacgggcac

SEQ ID NO: 839711 - RNA, 13 nt, Mycobacterium avium subsp. paratuberculosis
gaucacgccggug

SEQ ID NO: 839712 - RNA, 16 nt, Mycobacterium avium subsp. paratuberculosis
gaucacgccggugagc

SEQ ID NO: 839713 - RNA, 23 nt, Mycobacterium avium subsp. paratuberculosis
gaucacgccggugagcacgaccg

SEQ ID NO: 839714 - RNA, 14 nt, Mycobacterium avium subsp. paratuberculosis
gaucacgccggugg

SEQ ID NO: 839715 - RNA, 14 nt, Mycobacterium avium subsp. paratuberculosis
gaucacgcggcggg

SEQ ID NO: 839716 - RNA, 16 nt, Mycobacterium avium subsp. paratuberculosis
gaucacgcggcgggaa

SEQ ID NO: 839717 - RNA, 20 nt, Mycobacterium avium subsp. paratuberculosis
gaucacguguccgucgccgg

SEQ ID NO: 839718 - RNA, 22 nt, Mycobacterium avium subsp. paratuberculosis
gaucacguucaccugacgcauc

SEQ ID NO: 839719 - RNA, 18 nt, Mycobacterium avium subsp. paratuberculosis
gaucacguugucgcggcc

SEQ ID NO: 839720 - RNA, 22 nt, Mycobacterium avium subsp. paratuberculosis
gaucagguauugcgaaccucga

SEQ ID NO: 839721 - RNA, 23 nt, Mycobacterium avium subsp. paratuberculosis
gaucagcaccgccacgccguugg

SEQ ID NO: 839722 - RNA, 22 nt, Mycobacterium avium subsp. paratuberculosis
gaucagguccuugcgcgccgcg

SEQ ID NO: 839723 - RNA, 22 nt, Mycobacterium avium subsp. paratuberculosis
gaucagcaccgacgcggcgacc

SEQ ID NO: 839724 - RNA, 13 nt, Mycobacterium avium subsp. paratuberculosis
gaucagcaccgcc

SEQ ID NO: 839725 - RNA, 15 nt, Mycobacterium avium subsp. paratuberculosis
gaucagcaccgccac

SEQ ID NO: 839726 - RNA, 22 nt, Mycobacterium avium subsp. paratuberculosis
gaucagggugcucagccgcacg

SEQ ID NO: 839727 - RNA, 16 nt, Mycobacterium avium subsp. paratuberculosis
gaucaggucgccgauc

SEQ ID NO: 839728 - RNA, 17 nt, Mycobacterium avium subsp. paratuberculosis
gaucagagcgggccgac

SEQ ID NO: 839729 - RNA, 15 nt, Mycobacterium avium subsp. paratuberculosis
gaucagcaccaggug

SEQ ID NO: 839730 - RNA, 20 nt, Mycobacterium avium subsp. paratuberculosis
gaucagcaccagguggcccg

SEQ ID NO: 839731 - RNA, 18 nt, Mycobacterium avium subsp. paratuberculosis
gaucagcaccguccacag

SEQ ID NO: 839732 - RNA, 13 nt, Mycobacterium avium subsp. paratuberculosis
gaucagggcggcg

SEQ ID NO: 839733 - RNA, 13 nt, Mycobacterium avium subsp. paratuberculosis
gauccggacgacc

SEQ ID NO: 839734 - RNA, 15 nt, Mycobacterium avium subsp. paratuberculosis
gauccggacgaccug

SEQ ID NO: 839735 - RNA, 22 nt, Mycobacterium avium subsp. paratuberculosis
gauccggacgaccugggcgccg

SEQ ID NO: 839736 - RNA, 16 nt, Mycobacterium avium subsp. paratuberculosis
gauccggaucgggcgg

SEQ ID NO: 839737 - RNA, 20 nt, Mycobacterium avium subsp. paratuberculosis
gauccgcggguacggucggc

SEQ ID NO: 839738 - RNA, 14 nt, Mycobacterium avium subsp. paratuberculosis
gauccgcggcgccg

SEQ ID NO: 839739 - RNA, 17 nt, Mycobacterium avium subsp. paratuberculosis
gauccgcggcgccgggc

SEQ ID NO: 839740 - RNA, 19 nt, Mycobacterium avium subsp. paratuberculosis
gauccgcggcgccgggcgg

SEQ ID NO: 839741 - RNA, 20 nt, Mycobacterium avium subsp. paratuberculosis
gauccgcggcgccgggcggc

SEQ ID NO: 839742 - RNA, 24 nt, Mycobacterium avium subsp. paratuberculosis
gauccgcggcgccgggcggcccgc

SEQ ID NO: 839743 - RNA, 15 nt, Mycobacterium avium subsp. paratuberculosis
gauccgcgggccggc

SEQ ID NO: 839744 - RNA, 20 nt, Mycobacterium avium subsp. paratuberculosis
gaucccggacuccucggugg

SEQ ID NO: 839745 - RNA, 23 nt, Mycobacterium avium subsp. paratuberculosis
gaucccggacuccucgguggccu

SEQ ID NO: 839746 - RNA, 13 nt, Mycobacterium avium subsp. paratuberculosis
gaucccggggcgc

SEQ ID NO: 839747 - RNA, 16 nt, Mycobacterium avium subsp. paratuberculosis
gaucccggggcgcgcu

SEQ ID NO: 839748 - RNA, 13 nt, Mycobacterium avium subsp. paratuberculosis
gaucccggugaug

SEQ ID NO: 839749 - RNA, 23 nt, Mycobacterium avium subsp. paratuberculosis
gaucccgguucccggcaccacca

SEQ ID NO: 839750 - RNA, 13 nt, Mycobacterium avium subsp. paratuberculosis
gauccgcgccgcc

SEQ ID NO: 839751 - RNA, 21 nt, Mycobacterium avium subsp. paratuberculosis
gauccgcgccgccgccagcca

SEQ ID NO: 839752 - RNA, 22 nt, Mycobacterium avium subsp. paratuberculosis
gauccgcgccgccgccagccag

SEQ ID NO: 839753 - RNA, 14 nt, Mycobacterium avium subsp. paratuberculosis
gauccgcgccgcga

SEQ ID NO: 839754 - RNA, 16 nt, Mycobacterium avium subsp. paratuberculosis
gauccgcgcggccacc

SEQ ID NO: 839755 - RNA, 18 nt, Mycobacterium avium subsp. paratuberculosis
gauccgcgcggccaccag

SEQ ID NO: 839756 - RNA, 22 nt, Mycobacterium avium subsp. paratuberculosis
gaucccgucgucggcgccgcgc

SEQ ID NO: 839757 - RNA, 21 nt, Mycobacterium avium subsp. paratuberculosis
gaucccggcgagcacgccgcc

SEQ ID NO: 839758 - RNA, 17 nt, Mycobacterium avium subsp. paratuberculosis
gaucccguaggucgccu

SEQ ID NO: 839759 - RNA, 21 nt, Mycobacterium avium subsp. paratuberculosis
gaucgaugaauccgcgcagca

SEQ ID NO: 839760 - RNA, 17 nt, Mycobacterium avium subsp. paratuberculosis
gaucgaugcccagcgcg

SEQ ID NO: 839761 - RNA, 19 nt, Mycobacterium avium subsp. paratuberculosis
gaucgaugcccagcgcgcg

SEQ ID NO: 839762 - RNA, 22 nt, Mycobacterium avium subsp. paratuberculosis
gaucgaugcccagcgcgcggug

SEQ ID NO: 839763 - RNA, 14 nt, Mycobacterium avium subsp. paratuberculosis
gaucgagccgcggc

SEQ ID NO: 839764 - RNA, 18 nt, Mycobacterium avium subsp. paratuberculosis
gaucgagccgcggcccgc

SEQ ID NO: 839765 - RNA, 13 nt, Mycobacterium avium subsp. paratuberculosis
gaucgagccggcc

SEQ ID NO: 839766 - RNA, 16 nt, Mycobacterium avium subsp. paratuberculosis
gaucgagccggccguc

SEQ ID NO: 839767 - RNA, 19 nt, Mycobacterium avium subsp. paratuberculosis
gaucgcaggauggccugca

SEQ ID NO: 839768 - RNA, 22 nt, Mycobacterium avium subsp. paratuberculosis
gaucgcaggauggccugcacgg

SEQ ID NO: 839769 - RNA, 18 nt, Mycobacterium avium subsp. paratuberculosis
gaucgagaucagggcgcg

SEQ ID NO: 839770 - RNA, 16 nt, Mycobacterium avium subsp. paratuberculosis
gaucgagcaccagcgu

SEQ ID NO: 839771 - RNA, 18 nt, Mycobacterium avium subsp. paratuberculosis
gaucgagcaccagcgucg

SEQ ID NO: 839772 - RNA, 19 nt, Mycobacterium avium subsp. paratuberculosis
gaucgagcaccagcgucga

SEQ ID NO: 839773 - RNA, 20 nt, Mycobacterium avium subsp. paratuberculosis
gaucgagcaccagcgucgac

SEQ ID NO: 839774 - RNA, 22 nt, Mycobacterium avium subsp. paratuberculosis
gaucgagcaccagcgucgacgc

SEQ ID NO: 839775 - RNA, 13 nt, Mycobacterium avium subsp. paratuberculosis
gaucgacgccgcg

SEQ ID NO: 839776 - RNA, 15 nt, Mycobacterium avium subsp. paratuberculosis
gaucgacgccgcggu

SEQ ID NO: 839777 - RNA, 18 nt, Mycobacterium avium subsp. paratuberculosis
gaucgacgccgcgguggc

SEQ ID NO: 839778 - RNA, 20 nt, Mycobacterium avium subsp. paratuberculosis
gaucgacgccgcgguggccg

SEQ ID NO: 839779 - RNA, 13 nt, Mycobacterium avium subsp. paratuberculosis
gauccggccgcgg

SEQ ID NO: 839780 - RNA, 14 nt, Mycobacterium avium subsp. paratuberculosis
gauccggccggcgg

SEQ ID NO: 839781 - RNA, 15 nt, Mycobacterium avium subsp. paratuberculosis
gauccggcgcccgau

SEQ ID NO: 839782 - RNA, 16 nt, Mycobacterium avium subsp. paratuberculosis
gaucgacgccgaccgc

SEQ ID NO: 839783 - RNA, 17 nt, Mycobacterium avium subsp. paratuberculosis
gaucgacuccgggugga

SEQ ID NO: 839784 - RNA, 16 nt, Mycobacterium avium subsp. paratuberculosis
gaucgcgaacgcgccg

SEQ ID NO: 839785 - RNA, 17 nt, Mycobacterium avium subsp. paratuberculosis
gaucgcgaacgcgccgg

SEQ ID NO: 839786 - RNA, 20 nt, Mycobacterium avium subsp. paratuberculosis
gaucgcgaacgcgccgguga

SEQ ID NO: 839787 - RNA, 13 nt, Mycobacterium avium subsp. paratuberculosis
gaucgcccgccgc

SEQ ID NO: 839788 - RNA, 15 nt, Mycobacterium avium subsp. paratuberculosis
gaucgcccgccgcga

SEQ ID NO: 839789 - RNA, 18 nt, Mycobacterium avium subsp. paratuberculosis
gaucgcccgccgcgagcc

SEQ ID NO: 839790 - RNA, 14 nt, Mycobacterium avium subsp. paratuberculosis
gaucgccugauacg

SEQ ID NO: 839791 - RNA, 20 nt, Mycobacterium avium subsp. paratuberculosis
gaucgccugauacgacgucc

SEQ ID NO: 839792 - RNA, 21 nt, Mycobacterium avium subsp. paratuberculosis
gaucgccugauacgacguccg

SEQ ID NO: 839793 - RNA, 20 nt, Mycobacterium avium subsp. paratuberculosis
gaucgccuggcagcugccga

SEQ ID NO: 839794 - RNA, 17 nt, Mycobacterium avium subsp. paratuberculosis
gaucgcgcaggugaugc

SEQ ID NO: 839795 - RNA, 16 nt, Mycobacterium avium subsp. paratuberculosis
gaucgcgcaucacccg

SEQ ID NO: 839796 - RNA, 22 nt, Mycobacterium avium subsp. paratuberculosis
gaucgcgcaucacccggcgcgc

SEQ ID NO: 839797 - RNA, 23 nt, Mycobacterium avium subsp. paratuberculosis
gaucgcgcaucacccggcgcgcg

SEQ ID NO: 839798 - RNA, 15 nt, Mycobacterium avium subsp. paratuberculosis
gaucgcgcagccgcg

SEQ ID NO: 839799 - RNA, 19 nt, Mycobacterium avium subsp. paratuberculosis
gaucgcgcagccgcggugg

SEQ ID NO: 839800 - RNA, 20 nt, Mycobacterium avium subsp. paratuberculosis
gaucgcgcagccgcgguggc

SEQ ID NO: 839801 - RNA, 21 nt, Mycobacterium avium subsp. paratuberculosis
gaucgcgcagccgcgguggcg

SEQ ID NO: 839802 - RNA, 18 nt, Mycobacterium avium subsp. paratuberculosis
gaucgcgaugucgacgga

SEQ ID NO: 839803 - RNA, 12 nt, Mycobacterium avium subsp. paratuberculosis
gaucgcgaucac

SEQ ID NO: 839804 - RNA, 18 nt, Mycobacterium avium subsp. paratuberculosis
gaucgcgaucaccgcggc

SEQ ID NO: 839805 - RNA, 23 nt, Mycobacterium avium subsp. paratuberculosis
gaucgcgaucaccgcggccacca

SEQ ID NO: 839806 - RNA, 16 nt, Mycobacterium avium subsp. paratuberculosis
gaucgcgauccgggcg

SEQ ID NO: 839807 - RNA, 21 nt, Mycobacterium avium subsp. paratuberculosis
gaucgcgauccgggcgccggc

SEQ ID NO: 839808 - RNA, 17 nt, Mycobacterium avium subsp. paratuberculosis
gaucgcgaccaccggcc

SEQ ID NO: 839809 - RNA, 18 nt, Mycobacterium avium subsp. paratuberculosis
gaucgcgaccaccggccg

SEQ ID NO: 839810 - RNA, 20 nt, Mycobacterium avium subsp. paratuberculosis
gaucgcgaccaccggccgac

SEQ ID NO: 839811 - RNA, 18 nt, Mycobacterium avium subsp. paratuberculosis
gaucgcgaagaccagcgu

SEQ ID NO: 839812 - RNA, 13 nt, Mycobacterium avium subsp. paratuberculosis
gaucgcgacggcc

SEQ ID NO: 839813 - RNA, 14 nt, Mycobacterium avium subsp. paratuberculosis
gaucgcgacggccg

SEQ ID NO: 839814 - RNA, 13 nt, Mycobacterium avium subsp. paratuberculosis
gaucgccagcccg

SEQ ID NO: 839815 - RNA, 22 nt, Mycobacterium avium subsp. paratuberculosis
gaucgccagcccggcguacagc

SEQ ID NO: 839816 - RNA, 16 nt, Mycobacterium avium subsp. paratuberculosis
gaucgccagcaccggc

SEQ ID NO: 839817 - RNA, 18 nt, Mycobacterium avium subsp. paratuberculosis
gaucgccagcaccggcgc

SEQ ID NO: 839818 - RNA, 13 nt, Mycobacterium avium subsp. paratuberculosis
gaucgccagcacg

SEQ ID NO: 839819 - RNA, 12 nt, Mycobacterium avium subsp. paratuberculosis
gaucgccagccc

SEQ ID NO: 839820 - RNA, 20 nt, Mycobacterium avium subsp. paratuberculosis
gaucgccaacucgcugcgau

SEQ ID NO: 839821 - RNA, 15 nt, Mycobacterium avium subsp. paratuberculosis
gaucgccaccaccag

SEQ ID NO: 839822 - RNA, 18 nt, Mycobacterium avium subsp. paratuberculosis
gaucgccaccaccagcgg

SEQ ID NO: 839823 - RNA, 16 nt, Mycobacterium avium subsp. paratuberculosis
gaucgcaucgggcgac

SEQ ID NO: 839824 - RNA, 14 nt, Mycobacterium avium subsp. paratuberculosis
gaucgccaacgcgc

SEQ ID NO: 839825 - RNA, 20 nt, Mycobacterium avium subsp. paratuberculosis
gaucgccaggcguugcaccg

SEQ ID NO: 839826 - RNA, 19 nt, Mycobacterium avium subsp. paratuberculosis
gaucgccaguccggcgccg

SEQ ID NO: 839827 - RNA, 21 nt, Mycobacterium avium subsp. paratuberculosis
gaucgccaguccggcgccgac

SEQ ID NO: 839828 - RNA, 22 nt, Mycobacterium avium subsp. paratuberculosis
gaucgccaguccggcgccgacc

SEQ ID NO: 839829 - RNA, 17 nt, Mycobacterium avium subsp. paratuberculosis
gaucgccagcgccccca

SEQ ID NO: 839830 - RNA, 18 nt, Mycobacterium avium subsp. paratuberculosis
gaucgccagcgcccccag

SEQ ID NO: 839831 - RNA, 15 nt, Mycobacterium avium subsp. paratuberculosis
gaucgccagcgcggu

SEQ ID NO: 839832 - RNA, 17 nt, Mycobacterium avium subsp. paratuberculosis
gaucgccagcgcggugu

SEQ ID NO: 839833 - RNA, 14 nt, Mycobacterium avium subsp. paratuberculosis
gaucgccccggggg

SEQ ID NO: 839834 - RNA, 17 nt, Mycobacterium avium subsp. paratuberculosis
gaucgcccaucaccgca

SEQ ID NO: 839835 - RNA, 21 nt, Mycobacterium avium subsp. paratuberculosis
gaucgcccauuugccggugua

SEQ ID NO: 839836 - RNA, 14 nt, Mycobacterium avium subsp. paratuberculosis
gaucgccccgccgu

SEQ ID NO: 839837 - RNA, 15 nt, Mycobacterium avium subsp. paratuberculosis
gaucgcccaccuggu

SEQ ID NO: 839838 - RNA, 14 nt, Mycobacterium avium subsp. paratuberculosis
gaucgcccagcacc

SEQ ID NO: 839839 - RNA, 21 nt, Mycobacterium avium subsp. paratuberculosis
gaguucugguaggcggccggg

SEQ ID NO: 839840 - RNA, 20 nt, Mycobacterium avium subsp. paratuberculosis
gaguucgcgcacgcuggccg

SEQ ID NO: 839841 - RNA, 17 nt, Mycobacterium avium subsp. paratuberculosis
gaguucgcugaccgcca

SEQ ID NO: 839842 - RNA, 20 nt, Mycobacterium avium subsp. paratuberculosis
gaguucgaccucggugaugg

SEQ ID NO: 839843 - RNA, 20 nt, Mycobacterium avium subsp. paratuberculosis
gaguucgaugacgucgcgcu

SEQ ID NO: 839844 - RNA, 17 nt, Mycobacterium avium subsp. paratuberculosis
gaguuguacccuucggc

SEQ ID NO: 839845 - RNA, 19 nt, Mycobacterium avium subsp. paratuberculosis
gaguuugcccucgucgacc

SEQ ID NO: 839846 - RNA, 15 nt, Mycobacterium avium subsp. paratuberculosis
gaguuuggccagcuc

SEQ ID NO: 839847 - RNA, 19 nt, Mycobacterium avium subsp. paratuberculosis
gaguugauaggucacgccg

SEQ ID NO: 839848 - RNA, 15 nt, Mycobacterium avium subsp. paratuberculosis
gauacgcccggccac

SEQ ID NO: 839849 - RNA, 14 nt, Mycobacterium avium subsp. paratuberculosis
gauacgccgcgacg

SEQ ID NO: 839850 - RNA, 21 nt, Mycobacterium avium subsp. paratuberculosis
gauacgcgacgaaccgccaca

SEQ ID NO: 839851 - RNA, 16 nt, Mycobacterium avium subsp. paratuberculosis
gauaccggccagcacg

SEQ ID NO: 839852 - RNA, 17 nt, Mycobacterium avium subsp. paratuberculosis
gauaccggccagcacga

SEQ ID NO: 839853 - RNA, 19 nt, Mycobacterium avium subsp. paratuberculosis
gauaccggccagcacgaac

SEQ ID NO: 839854 - RNA, 21 nt, Mycobacterium avium subsp. paratuberculosis
gauaccggcccagcgcggugu

SEQ ID NO: 839855 - RNA, 16 nt, Mycobacterium avium subsp. paratuberculosis
gauaccggccggcgcg

SEQ ID NO: 839856 - RNA, 19 nt, Mycobacterium avium subsp. paratuberculosis
gauaauggcggccgccgcg

SEQ ID NO: 839857 - RNA, 21 nt, Mycobacterium avium subsp. paratuberculosis
gauaauggcggccgccgcgau

SEQ ID NO: 839858 - RNA, 13 nt, Mycobacterium avium subsp. paratuberculosis
gaucaaagccggu

SEQ ID NO: 839859 - RNA, 18 nt, Mycobacterium avium subsp. paratuberculosis
gaucaacaggcccagcag

SEQ ID NO: 839860 - RNA, 21 nt, Mycobacterium avium subsp. paratuberculosis
gaucaacaggcccagcagcgc

SEQ ID NO: 839861 - RNA, 14 nt, Mycobacterium avium subsp. paratuberculosis
gaucaacaccgcca

SEQ ID NO: 839862 - RNA, 16 nt, Mycobacterium avium subsp. paratuberculosis
gaucaacaccgccagc

SEQ ID NO: 839863 - RNA, 17 nt, Mycobacterium avium subsp. paratuberculosis
gaucaacaccgccagca

SEQ ID NO: 839864 - RNA, 14 nt, Mycobacterium avium subsp. paratuberculosis
gaucaacaccgcgc

SEQ ID NO: 839865 - RNA, 23 nt, Mycobacterium avium subsp. paratuberculosis
gaucaacacgucgucgugcgcgg

SEQ ID NO: 839866 - RNA, 13 nt, Mycobacterium avium subsp. paratuberculosis
gaucacccagccg

SEQ ID NO: 839867 - RNA, 15 nt, Mycobacterium avium subsp. paratuberculosis
gaucacccccgacac

SEQ ID NO: 839868 - RNA, 18 nt, Mycobacterium avium subsp. paratuberculosis
gaucacccccgacaccgu

SEQ ID NO: 839869 - RNA, 15 nt, Mycobacterium avium subsp. paratuberculosis
gaucaccccuggcgg

SEQ ID NO: 839870 - RNA, 17 nt, Mycobacterium avium subsp. paratuberculosis
gaucacccgccgggugg

SEQ ID NO: 839871 - RNA, 14 nt, Mycobacterium avium subsp. paratuberculosis
gaucacccgggucg

SEQ ID NO: 839872 - RNA, 14 nt, Mycobacterium avium subsp. paratuberculosis
gaucacccucggcg

SEQ ID NO: 839873 - RNA, 16 nt, Mycobacterium avium subsp. paratuberculosis
gaucacccucggcguc

SEQ ID NO: 839874 - RNA, 20 nt, Mycobacterium avium subsp. paratuberculosis
gaucacccucggcgucccgu

SEQ ID NO: 839875 - RNA, 15 nt, Mycobacterium avium subsp. paratuberculosis
gaucaccgcgcucgg

SEQ ID NO: 839876 - RNA, 16 nt, Mycobacterium avium subsp. paratuberculosis
gaucaccgcggccacc

SEQ ID NO: 839877 - RNA, 23 nt, Mycobacterium avium subsp. paratuberculosis
gaucaccgcggccaccaccgcca

SEQ ID NO: 839878 - RNA, 23 nt, Mycobacterium avium subsp. paratuberculosis
gaucaccgcggccaccugggcgg

SEQ ID NO: 839879 - RNA, 23 nt, Mycobacterium avium subsp. paratuberculosis
gaucaccgcggcgagcgcuucgg

SEQ ID NO: 839880 - RNA, 14 nt, Mycobacterium avium subsp. paratuberculosis
gaucaccgcguagc

SEQ ID NO: 839881 - RNA, 20 nt, Mycobacterium avium subsp. paratuberculosis
gaucaccgcguagcgccgcc

SEQ ID NO: 839882 - RNA, 17 nt, Mycobacterium avium subsp. paratuberculosis
gaucaccgccagcgcgc

SEQ ID NO: 839883 - RNA, 20 nt, Mycobacterium avium subsp. paratuberculosis
gaucaccgccagcgcgccga

SEQ ID NO: 839884 - RNA, 21 nt, Mycobacterium avium subsp. paratuberculosis
gaucaccgccagcgcgccgau

SEQ ID NO: 839885 - RNA, 23 nt, Mycobacterium avium subsp. paratuberculosis
gaucaccgagauggccaccauca

SEQ ID NO: 839886 - RNA, 17 nt, Mycobacterium avium subsp. paratuberculosis
gauagauguugcggccg

SEQ ID NO: 839887 - RNA, 16 nt, Mycobacterium avium subsp. paratuberculosis
gauagcccgccgcggc

SEQ ID NO: 839888 - RNA, 21 nt, Mycobacterium avium subsp. paratuberculosis
gauagcccgccgcggcgaccg

SEQ ID NO: 839889 - RNA, 20 nt, Mycobacterium avium subsp. paratuberculosis
gauagccccgccaggcggcg

SEQ ID NO: 839890 - RNA, 18 nt, Mycobacterium avium subsp. paratuberculosis
gauagccgagcggcgcca

SEQ ID NO: 839891 - RNA, 19 nt, Mycobacterium avium subsp. paratuberculosis
gauagccgagcggcgccac

SEQ ID NO: 839892 - RNA, 17 nt, Mycobacterium avium subsp. paratuberculosis
gauagccgcccugcccg

SEQ ID NO: 839893 - RNA, 18 nt, Mycobacterium avium subsp. paratuberculosis
gauagcuugagccccgcc

SEQ ID NO: 839894 - RNA, 15 nt, Mycobacterium avium subsp. paratuberculosis
gauaggccagcgcgu

SEQ ID NO: 839895 - RNA, 15 nt, Mycobacterium avium subsp. paratuberculosis
gauagaucgacgcga

SEQ ID NO: 839896 - RNA, 17 nt, Mycobacterium avium subsp. paratuberculosis
gauagaucgacgcgacc

SEQ ID NO: 839897 - RNA, 22 nt, Mycobacterium avium subsp. paratuberculosis
gauagaugagccgcagccgggu

SEQ ID NO: 839898 - RNA, 15 nt, Mycobacterium avium subsp. paratuberculosis
gauagagcaccgcgc

SEQ ID NO: 839899 - RNA, 13 nt, Mycobacterium avium subsp. paratuberculosis
gauaucccgcggg

SEQ ID NO: 839900 - RNA, 13 nt, Mycobacterium avium subsp. paratuberculosis
gauaggucacgcc

SEQ ID NO: 839901 - RNA, 15 nt, Mycobacterium avium subsp. paratuberculosis
gauaggucagcucga

SEQ ID NO: 839902 - RNA, 17 nt, Mycobacterium avium subsp. paratuberculosis
gauagggcgcgucgauc

SEQ ID NO: 839903 - RNA, 15 nt, Mycobacterium avium subsp. paratuberculosis
gauaggggucggcga

SEQ ID NO: 839904 - RNA, 23 nt, Mycobacterium avium subsp. paratuberculosis
gauaggcggcgacggcgucggcg

SEQ ID NO: 839905 - RNA, 12 nt, Mycobacterium avium subsp. paratuberculosis
gauaggcggcca

SEQ ID NO: 839906 - RNA, 14 nt, Mycobacterium avium subsp. paratuberculosis
gauaggcggccagc

SEQ ID NO: 839907 - RNA, 19 nt, Mycobacterium avium subsp. paratuberculosis
gaguucacccguggcugac

SEQ ID NO: 839908 - RNA, 21 nt, Mycobacterium avium subsp. paratuberculosis
gaguucagaagucgcccgcgu

SEQ ID NO: 839909 - RNA, 16 nt, Mycobacterium avium subsp. paratuberculosis
gagugugaagaccgga

SEQ ID NO: 839910 - RNA, 20 nt, Mycobacterium avium subsp. paratuberculosis
gaguggccggcguccaggcg

SEQ ID NO: 839911 - RNA, 17 nt, Mycobacterium avium subsp. paratuberculosis
gagugguaccggguggc

SEQ ID NO: 839912 - RNA, 19 nt, Mycobacterium avium subsp. paratuberculosis
gagugcggcgcggugcgcc

SEQ ID NO: 839913 - RNA, 19 nt, Mycobacterium avium subsp. paratuberculosis
gagugcucgauggccagcg

SEQ ID NO: 839914 - RNA, 23 nt, Mycobacterium avium subsp. paratuberculosis
gagugcucggcguugagccggcg

SEQ ID NO: 839915 - RNA, 18 nt, Mycobacterium avium subsp. paratuberculosis
gagugcuggacggcccga

SEQ ID NO: 839916 - RNA, 14 nt, Mycobacterium avium subsp. paratuberculosis
gagucccgcgcggc

SEQ ID NO: 839917 - RNA, 20 nt, Mycobacterium avium subsp. paratuberculosis
gagucccggcgcaccaggcg

SEQ ID NO: 839918 - RNA, 13 nt, Mycobacterium avium subsp. paratuberculosis
gagucccucggcg

SEQ ID NO: 839919 - RNA, 14 nt, Mycobacterium avium subsp. paratuberculosis
gagucaucgccacc

SEQ ID NO: 839920 - RNA, 21 nt, Mycobacterium avium subsp. paratuberculosis
gagucaucgccacccgcaccu

SEQ ID NO: 839921 - RNA, 22 nt, Mycobacterium avium subsp. paratuberculosis
gagucauucugaauucggccac

SEQ ID NO: 839922 - RNA, 16 nt, Mycobacterium avium subsp. paratuberculosis
gaguccaccggcggau

SEQ ID NO: 839923 - RNA, 15 nt, Mycobacterium avium subsp. paratuberculosis
gaguccacgacgucc

SEQ ID NO: 839924 - RNA, 22 nt, Mycobacterium avium subsp. paratuberculosis
gaguccacgacguccucgacga

SEQ ID NO: 839925 - RNA, 14 nt, Mycobacterium avium subsp. paratuberculosis
gaguccacgccgug

SEQ ID NO: 839926 - RNA, 15 nt, Mycobacterium avium subsp. paratuberculosis
gaguccagcacgccc

SEQ ID NO: 839927 - RNA, 13 nt, Mycobacterium avium subsp. paratuberculosis
gaguccagccagc

SEQ ID NO: 839928 - RNA, 21 nt, Mycobacterium avium subsp. paratuberculosis
gaguccagccagccgcgccgc

SEQ ID NO: 839929 - RNA, 16 nt, Mycobacterium avium subsp. paratuberculosis
gagucggugaccaccu

SEQ ID NO: 839930 - RNA, 21 nt, Mycobacterium avium subsp. paratuberculosis
gagucggugaccaccugcacc

SEQ ID NO: 839931 - RNA, 13 nt, Mycobacterium avium subsp. paratuberculosis
gagucgcuggcgc

SEQ ID NO: 839932 - RNA, 15 nt, Mycobacterium avium subsp. paratuberculosis
gagucgcuggcgcgc

SEQ ID NO: 839933 - RNA, 18 nt, Mycobacterium avium subsp. paratuberculosis
gagucgcuguuggcgacg

SEQ ID NO: 839934 - RNA, 18 nt, Mycobacterium avium subsp. paratuberculosis
gagucuacuuggccagcu

SEQ ID NO: 839935 - RNA, 22 nt, Mycobacterium avium subsp. paratuberculosis
gagucgguuucgaccugcgggu

SEQ ID NO: 839936 - RNA, 17 nt, Mycobacterium avium subsp. paratuberculosis
gagucgucggcgcgguu

SEQ ID NO: 839937 - RNA, 19 nt, Mycobacterium avium subsp. paratuberculosis
gagugcgaaacucaccgcg

SEQ ID NO: 839938 - RNA, 20 nt, Mycobacterium avium subsp. paratuberculosis
gagugcgaaacucaccgcgu

SEQ ID NO: 839939 - RNA, 19 nt, Mycobacterium avium subsp. paratuberculosis
gagugcgaaucaucguggc

SEQ ID NO: 839940 - RNA, 19 nt, Mycobacterium avium subsp. paratuberculosis
gagugaccgccagcaccgc

SEQ ID NO: 839941 - RNA, 20 nt, Mycobacterium avium subsp. paratuberculosis
gagugaccgccagcaccgcg

SEQ ID NO: 839942 - RNA, 21 nt, Mycobacterium avium subsp. paratuberculosis
gagugaccgccagcaccgcgg

SEQ ID NO: 839943 - RNA, 16 nt, Mycobacterium avium subsp. paratuberculosis
gagugaggccgaggcg

SEQ ID NO: 839944 - RNA, 20 nt, Mycobacterium avium subsp. paratuberculosis
gagugcaacuaccgacggca

SEQ ID NO: 839945 - RNA, 19 nt, Mycobacterium avium subsp. paratuberculosis
gaguagaacuucgccagcg

SEQ ID NO: 839946 - RNA, 14 nt, Mycobacterium avium subsp. paratuberculosis
gaguagucggcgau

SEQ ID NO: 839947 - RNA, 17 nt, Mycobacterium avium subsp. paratuberculosis
gaguaguuccggcgguc

SEQ ID NO: 839948 - RNA, 19 nt, Mycobacterium avium subsp. paratuberculosis
gaguauccgcgcagcgucu

SEQ ID NO: 839949 - RNA, 22 nt, Mycobacterium avium subsp. paratuberculosis
gaguagccgguucgucccgcgc

SEQ ID NO: 839950 - RNA, 17 nt, Mycobacterium avium subsp. paratuberculosis
gaguaugcagaugaugc

SEQ ID NO: 839951 - RNA, 18 nt, Mycobacterium avium subsp. paratuberculosis
gagucacccggcuggccg

SEQ ID NO: 839952 - RNA, 12 nt, Mycobacterium avium subsp. paratuberculosis
gagucaccggcu

SEQ ID NO: 839953 - RNA, 13 nt, Mycobacterium avium subsp. paratuberculosis
gaggugccggccg

SEQ ID NO: 839954 - RNA, 13 nt, Mycobacterium avium subsp. paratuberculosis
gaggugcucgacg

SEQ ID NO: 839955 - RNA, 13 nt, Mycobacterium avium subsp. paratuberculosis
gaggugcucgcgc

SEQ ID NO: 839956 - RNA, 16 nt, Mycobacterium avium subsp. paratuberculosis
gaggugcucgcgcagg

SEQ ID NO: 839957 - RNA, 15 nt, Mycobacterium avium subsp. paratuberculosis
gagggcguucgcggu

SEQ ID NO: 839958 - RNA, 21 nt, Mycobacterium avium subsp. paratuberculosis
gaggugaauaccacugcgcgc

SEQ ID NO: 839959 - RNA, 13 nt, Mycobacterium avium subsp. paratuberculosis
gaggugaccggcg

SEQ ID NO: 839960 - RNA, 16 nt, Mycobacterium avium subsp. paratuberculosis
gaggugaccggcgagg

SEQ ID NO: 839961 - RNA, 18 nt, Mycobacterium avium subsp. paratuberculosis
gaggugacgucgcgccgc

SEQ ID NO: 839962 - RNA, 16 nt, Mycobacterium avium subsp. paratuberculosis
gagguggcccagccgc

SEQ ID NO: 839963 - RNA, 12 nt, Mycobacterium avium subsp. paratuberculosis
gagguggcccgc

SEQ ID NO: 839964 - RNA, 15 nt, Mycobacterium avium subsp. paratuberculosis
gagguggcccgccac

SEQ ID NO: 839965 - RNA, 17 nt, Mycobacterium avium subsp. paratuberculosis
gagguggcccgccacgu

SEQ ID NO: 839966 - RNA, 12 nt, Mycobacterium avium subsp. paratuberculosis
gagguggccgcc

SEQ ID NO: 839967 - RNA, 13 nt, Mycobacterium avium subsp. paratuberculosis
gaggugguccgcg

SEQ ID NO: 839968 - RNA, 21 nt, Mycobacterium avium subsp. paratuberculosis
gaggugguuucggggucgccg

SEQ ID NO: 839969 - RNA, 14 nt, Mycobacterium avium subsp. paratuberculosis
gagggccaccggcu

SEQ ID NO: 839970 - RNA, 15 nt, Mycobacterium avium subsp. paratuberculosis
gagggccaccggcuc

SEQ ID NO: 839971 - RNA, 19 nt, Mycobacterium avium subsp. paratuberculosis
gagggcaacgucuggccac

SEQ ID NO: 839972 - RNA, 16 nt, Mycobacterium avium subsp. paratuberculosis
gagggccagcagucgu

SEQ ID NO: 839973 - RNA, 16 nt, Mycobacterium avium subsp. paratuberculosis
gagggccauccggccg

SEQ ID NO: 839974 - RNA, 19 nt, Mycobacterium avium subsp. paratuberculosis
gagggccauccggccggcg

SEQ ID NO: 839975 - RNA, 15 nt, Mycobacterium avium subsp. paratuberculosis
gagggcccgggcagg

SEQ ID NO: 839976 - RNA, 18 nt, Mycobacterium avium subsp. paratuberculosis
gagggcccgggcaggcau

SEQ ID NO: 839977 - RNA, 15 nt, Mycobacterium avium subsp. paratuberculosis
gagggaccuccagcg

SEQ ID NO: 839978 - RNA, 19 nt, Mycobacterium avium subsp. paratuberculosis
gaggcguugcgucccgcgc

SEQ ID NO: 839979 - RNA, 12 nt, Mycobacterium avium subsp. paratuberculosis
gagggcgggcca

SEQ ID NO: 839980 - RNA, 15 nt, Mycobacterium avium subsp. paratuberculosis
gagggcggggcagca

SEQ ID NO: 839981 - RNA, 17 nt, Mycobacterium avium subsp. paratuberculosis
gagggccuccaccacca

SEQ ID NO: 839982 - RNA, 15 nt, Mycobacterium avium subsp. paratuberculosis
gagggcgacgaugcc

SEQ ID NO: 839983 - RNA, 15 nt, Mycobacterium avium subsp. paratuberculosis
gaggugaucgccagc

SEQ ID NO: 839984 - RNA, 22 nt, Mycobacterium avium subsp. paratuberculosis
gaggugaucgcgaacgcgccgg

SEQ ID NO: 839985 - RNA, 18 nt, Mycobacterium avium subsp. paratuberculosis
gaggugaugccguccagc

SEQ ID NO: 839986 - RNA, 21 nt, Mycobacterium avium subsp. paratuberculosis
gaggugaugccguccagcaac

SEQ ID NO: 839987 - RNA, 16 nt, Mycobacterium avium subsp. paratuberculosis
gaggugauguuggccg

SEQ ID NO: 839988 - RNA, 19 nt, Mycobacterium avium subsp. paratuberculosis
gaggugauguuggccgcga

SEQ ID NO: 839989 - RNA, 22 nt, Mycobacterium avium subsp. paratuberculosis
gaggugauguuggccgcgacgc

SEQ ID NO: 839990 - RNA, 16 nt, Mycobacterium avium subsp. paratuberculosis
gaggugcaacacucga

SEQ ID NO: 839991 - RNA, 19 nt, Mycobacterium avium subsp. paratuberculosis
gaggugcaacacucgagcg

SEQ ID NO: 839992 - RNA, 17 nt, Mycobacterium avium subsp. paratuberculosis
gaggugcagcgggcugg

SEQ ID NO: 839993 - RNA, 19 nt, Mycobacterium avium subsp. paratuberculosis
gaggugcagcgggcuggcg

SEQ ID NO: 839994 - RNA, 14 nt, Mycobacterium avium subsp. paratuberculosis
gagggcgccguugu

SEQ ID NO: 839995 - RNA, 23 nt, Mycobacterium avium subsp. paratuberculosis
gagggcgccguuguaggccgcgc

SEQ ID NO: 839996 - RNA, 21 nt, Mycobacterium avium subsp. paratuberculosis
gaggaugguggugcaggcgaa

SEQ ID NO: 839997 - RNA, 18 nt, Mycobacterium avium subsp. paratuberculosis
gaggcacggcccgcucgg

SEQ ID NO: 839998 - RNA, 15 nt, Mycobacterium avium subsp. paratuberculosis
gaggccgaggcgagu

SEQ ID NO: 839999 - RNA, 12 nt, Mycobacterium avium subsp. paratuberculosis
gaggcagcgcgg

SEQ ID NO: 840000 - RNA, 13 nt, Mycobacterium avium subsp. paratuberculosis
gaggcagcgcgga

SEQ ID NO: 840001 - RNA, 23 nt, Mycobacterium avium subsp. paratuberculosis
gaggcacccgcugcaccagcccg

SEQ ID NO: 840002 - RNA, 15 nt, Mycobacterium avium subsp. paratuberculosis
gaggcaccgaacgcc

SEQ ID NO: 840003 - RNA, 23 nt, Mycobacterium avium subsp. paratuberculosis
gaggaucugcacgucggcggccg

SEQ ID NO: 840004 - RNA, 23 nt, Mycobacterium avium subsp. paratuberculosis
gaggaugacgacggucaccggca

SEQ ID NO: 840005 - RNA, 23 nt, Mycobacterium avium subsp. paratuberculosis
gaggaugccgcccaccaccggcu

SEQ ID NO: 840006 - RNA, 17 nt, Mycobacterium avium subsp. paratuberculosis
gaggaugcgcaccacgc

SEQ ID NO: 840007 - RNA, 18 nt, Mycobacterium avium subsp. paratuberculosis
gaggaugcgcaccacgcc

SEQ ID NO: 840008 - RNA, 24 nt, Mycobacterium avium subsp. paratuberculosis
gaggaugcgcaccacgcccgacga

SEQ ID NO: 840009 - RNA, 15 nt, Mycobacterium avium subsp. paratuberculosis
gaggauggggucgcg

SEQ ID NO: 840010 - RNA, 19 nt, Mycobacterium avium subsp. paratuberculosis
gaggauggggucgcgggcg

SEQ ID NO: 840011 - RNA, 19 nt, Mycobacterium avium subsp. paratuberculosis
gaggaaucgcggcaggcga

SEQ ID NO: 840012 - RNA, 15 nt, Mycobacterium avium subsp. paratuberculosis
gaggaauucgccgac

SEQ ID NO: 840013 - RNA, 13 nt, Mycobacterium avium subsp. paratuberculosis
gaggacaccacga

SEQ ID NO: 840014 - RNA, 14 nt, Mycobacterium avium subsp. paratuberculosis
gaggacaccacgau

SEQ ID NO: 840015 - RNA, 13 nt, Mycobacterium avium subsp. paratuberculosis
gaggacagcaccg

SEQ ID NO: 840016 - RNA, 14 nt, Mycobacterium avium subsp. paratuberculosis
gaggacagcaccgc

SEQ ID NO: 840017 - RNA, 15 nt, Mycobacterium avium subsp. paratuberculosis
gaggacagcgcggug

SEQ ID NO: 840018 - RNA, 21 nt, Mycobacterium avium subsp. paratuberculosis
gagcgcgcucaaccgcccagc

SEQ ID NO: 840019 - RNA, 15 nt, Mycobacterium avium subsp. paratuberculosis
gagcgcgcggugaug

SEQ ID NO: 840020 - RNA, 19 nt, Mycobacterium avium subsp. paratuberculosis
gagcgcgcggugaugaccu

SEQ ID NO: 840021 - RNA, 14 nt, Mycobacterium avium subsp. paratuberculosis
gagcgcgcugaucg

SEQ ID NO: 840022 - RNA, 17 nt, Mycobacterium avium subsp. paratuberculosis
gagcgcgcugaucgccg

SEQ ID NO: 840023 - RNA, 21 nt, Mycobacterium avium subsp. paratuberculosis
gagcgcgcuuaauacagcgcg

SEQ ID NO: 840024 - RNA, 18 nt, Mycobacterium avium subsp. paratuberculosis
gagcgcgccgagcagcug

SEQ ID NO: 840025 - RNA, 17 nt, Mycobacterium avium subsp. paratuberculosis
gagcgcgccgagguggc

SEQ ID NO: 840026 - RNA, 23 nt, Mycobacterium avium subsp. paratuberculosis
gagcgcgccgagguggcccgcca

SEQ ID NO: 840027 - RNA, 12 nt, Mycobacterium avium subsp. paratuberculosis
gagcgcgccgcc

SEQ ID NO: 840028 - RNA, 21 nt, Mycobacterium avium subsp. paratuberculosis
gagcgcgccgccgccgcccac

SEQ ID NO: 840029 - RNA, 19 nt, Mycobacterium avium subsp. paratuberculosis
gagcgcgccggcccgauag

SEQ ID NO: 840030 - RNA, 13 nt, Mycobacterium avium subsp. paratuberculosis
gaggaacccgacc

SEQ ID NO: 840031 - RNA, 16 nt, Mycobacterium avium subsp. paratuberculosis
gaggaacccgaccgcg

SEQ ID NO: 840032 - RNA, 17 nt, Mycobacterium avium subsp. paratuberculosis
gaggaacccgaccgcga

SEQ ID NO: 840033 - RNA, 13 nt, Mycobacterium avium subsp. paratuberculosis
gaggccugcgcgg

SEQ ID NO: 840034 - RNA, 16 nt, Mycobacterium avium subsp. paratuberculosis
gaggccugcgcggccg

SEQ ID NO: 840035 - RNA, 20 nt, Mycobacterium avium subsp. paratuberculosis
gaggccugcgcggccgcguc

SEQ ID NO: 840036 - RNA, 21 nt, Mycobacterium avium subsp. paratuberculosis
gaggccugcgcggccgcgucg

SEQ ID NO: 840037 - RNA, 23 nt, Mycobacterium avium subsp. paratuberculosis
gaggccuccagguagacgaugcc

SEQ ID NO: 840038 - RNA, 13 nt, Mycobacterium avium subsp. paratuberculosis
gaggccucgccgc

SEQ ID NO: 840039 - RNA, 14 nt, Mycobacterium avium subsp. paratuberculosis
gaggccucgccgcu

SEQ ID NO: 840040 - RNA, 19 nt, Mycobacterium avium subsp. paratuberculosis
gaggccguaucccaccacg

SEQ ID NO: 840041 - RNA, 16 nt, Mycobacterium avium subsp. paratuberculosis
gaggccgggcuggcgc

SEQ ID NO: 840042 - RNA, 15 nt, Mycobacterium avium subsp. paratuberculosis
gaggccgcggcgaca

SEQ ID NO: 840043 - RNA, 16 nt, Mycobacterium avium subsp. paratuberculosis
gaggccgcgggcguuc

SEQ ID NO: 840044 - RNA, 19 nt, Mycobacterium avium subsp. paratuberculosis
gaggccgauggcgcccagc

SEQ ID NO: 840045 - RNA, 17 nt, Mycobacterium avium subsp. paratuberculosis
gaggccgccccggccgc

SEQ ID NO: 840046 - RNA, 19 nt, Mycobacterium avium subsp. paratuberculosis
gaggccgccccggccgcgc

SEQ ID NO: 840047 - RNA, 19 nt, Mycobacterium avium subsp. paratuberculosis
gaggcgaagguggcgucgg

SEQ ID NO: 840048 - RNA, 14 nt, Mycobacterium avium subsp. paratuberculosis
gaggcgaaugcggc

SEQ ID NO: 840049 - RNA, 16 nt, Mycobacterium avium subsp. paratuberculosis
gaggcgacgucgaacg

SEQ ID NO: 840050 - RNA, 21 nt, Mycobacterium avium subsp. paratuberculosis
gaggcgagcaauuaaccggca

SEQ ID NO: 840051 - RNA, 18 nt, Mycobacterium avium subsp. paratuberculosis
gaggcgacccccgguguc

SEQ ID NO: 840052 - RNA, 21 nt, Mycobacterium avium subsp. paratuberculosis
gaggcgaguaaggccgaggcg

SEQ ID NO: 840053 - RNA, 23 nt, Mycobacterium avium subsp. paratuberculosis
gaggcgccacaacuggucgugcu

SEQ ID NO: 840054 - RNA, 17 nt, Mycobacterium avium subsp. paratuberculosis
gaggcgaucaucgcccc

SEQ ID NO: 840055 - RNA, 20 nt, Mycobacterium avium subsp. paratuberculosis
gaggcgaucaucgccccgga

SEQ ID NO: 840056 - RNA, 21 nt, Mycobacterium avium subsp. paratuberculosis
gaggcgauggugcccucgugg

SEQ ID NO: 840057 - RNA, 13 nt, Mycobacterium avium subsp. paratuberculosis
gaggcggccagcg

SEQ ID NO: 840058 - RNA, 21 nt, Mycobacterium avium subsp. paratuberculosis
gaggcggaucuucucgcugcu

SEQ ID NO: 840059 - RNA, 16 nt, Mycobacterium avium subsp. paratuberculosis
gaggcgcugcagcaug

SEQ ID NO: 840060 - RNA, 21 nt, Mycobacterium avium subsp. paratuberculosis
gaggcgccguauuggcaggcg

SEQ ID NO: 840061 - RNA, 23 nt, Mycobacterium avium subsp. paratuberculosis
gaggcgccguauuggcaggcgau

SEQ ID NO: 840062 - RNA, 18 nt, Mycobacterium avium subsp. paratuberculosis
gaggcgcuccugaaucgg

SEQ ID NO: 840063 - RNA, 14 nt, Mycobacterium avium subsp. paratuberculosis
gaggcgcucggccc

SEQ ID NO: 840064 - RNA, 17 nt, Mycobacterium avium subsp. paratuberculosis
gaggcgcucggcccgcu

SEQ ID NO: 840065 - RNA, 21 nt, Mycobacterium avium subsp. paratuberculosis
gaggcggguaggcgucgcgca

SEQ ID NO: 840066 - RNA, 22 nt, Mycobacterium avium subsp. paratuberculosis
gaggcgggugaggacgcccggc

SEQ ID NO: 840067 - RNA, 21 nt, Mycobacterium avium subsp. paratuberculosis
gaggcggguguauucgcccac

SEQ ID NO: 840068 - RNA, 22 nt, Mycobacterium avium subsp. paratuberculosis
gaggcggguguauucgcccacc

SEQ ID NO: 840069 - RNA, 23 nt, Mycobacterium avium subsp. paratuberculosis
gaggcggguguauucgcccaccc

SEQ ID NO: 840070 - RNA, 13 nt, Mycobacterium avium subsp. paratuberculosis
gaggcggucgacu

SEQ ID NO: 840071 - RNA, 15 nt, Mycobacterium avium subsp. paratuberculosis
gaggcggucggcgga

SEQ ID NO: 840072 - RNA, 14 nt, Mycobacterium avium subsp. paratuberculosis
gaggcggcgggggc

SEQ ID NO: 840073 - RNA, 19 nt, Mycobacterium avium subsp. paratuberculosis
gaggcggcguagucggcgc

SEQ ID NO: 840074 - RNA, 16 nt, Mycobacterium avium subsp. paratuberculosis
gaggcgguggugaugg

SEQ ID NO: 840075 - RNA, 21 nt, Mycobacterium avium subsp. paratuberculosis
gaggcgguuccgguggcgcga

SEQ ID NO: 840076 - RNA, 18 nt, Mycobacterium avium subsp. paratuberculosis
gaggcguagugcgcccag

SEQ ID NO: 840077 - RNA, 22 nt, Mycobacterium avium subsp. paratuberculosis
gaggcgucagggguuggcgcgc

SEQ ID NO: 840078 - RNA, 20 nt, Mycobacterium avium subsp. paratuberculosis
gaggcguccagcgcgucgcu

SEQ ID NO: 840079 - RNA, 13 nt, Mycobacterium avium subsp. paratuberculosis
gaggcgggcgauc

SEQ ID NO: 840080 - RNA, 14 nt, Mycobacterium avium subsp. paratuberculosis
gaggcgggcgaucu

SEQ ID NO: 840081 - RNA, 18 nt, Mycobacterium avium subsp. paratuberculosis
gaggcguccuccucgucc

SEQ ID NO: 840082 - RNA, 15 nt, Mycobacterium avium subsp. paratuberculosis
gaggcgucgacgcgc

SEQ ID NO: 840083 - RNA, 19 nt, Mycobacterium avium subsp. paratuberculosis
gaggcgucgacgcgcugcu

SEQ ID NO: 840084 - RNA, 22 nt, Mycobacterium avium subsp. paratuberculosis
aacuacuucgucagcagcgaca

SEQ ID NO: 840085 - RNA, 20 nt, Mycobacterium avium subsp. paratuberculosis
gacugucggcucgcccgcga

SEQ ID NO: 840086 - RNA, 20 nt, Mycobacterium avium subsp. paratuberculosis
gacugugaauuccgacgugc

SEQ ID NO: 840087 - RNA, 15 nt, Mycobacterium avium subsp. paratuberculosis
gacuucacaggccgc

SEQ ID NO: 840088 - RNA, 20 nt, Mycobacterium avium subsp. paratuberculosis
gacuguuugaugccgucggu

SEQ ID NO: 840089 - RNA, 19 nt, Mycobacterium avium subsp. paratuberculosis
aacguguacucggcgucgc

SEQ ID NO: 840090 - RNA, 20 nt, Mycobacterium avium subsp. paratuberculosis
aacgugucgagcacgucgac

SEQ ID NO: 840091 - RNA, 15 nt, Mycobacterium avium subsp. paratuberculosis
gagaaccggcgcaga

SEQ ID NO: 840092 - RNA, 13 nt, Mycobacterium avium subsp. paratuberculosis
gagaacaucagcc

SEQ ID NO: 840093 - RNA, 19 nt, Mycobacterium avium subsp. paratuberculosis
gacuuucgcgucugcucgc

SEQ ID NO: 840094 - RNA, 13 nt, Mycobacterium avium subsp. paratuberculosis
gacuugucgccgu

SEQ ID NO: 840095 - RNA, 16 nt, Mycobacterium avium subsp. paratuberculosis
gacuugucgggccgca

SEQ ID NO: 840096 - RNA, 17 nt, Mycobacterium avium subsp. paratuberculosis
gacuugucgggccgcac

SEQ ID NO: 840097 - RNA, 18 nt, Mycobacterium avium subsp. paratuberculosis
gacuugucgggccgcacu

SEQ ID NO: 840098 - RNA, 17 nt, Mycobacterium avium subsp. paratuberculosis
gagaaaagcgaccagcg

SEQ ID NO: 840099 - RNA, 16 nt, Mycobacterium avium subsp. paratuberculosis
gacuucguuggugguc

SEQ ID NO: 840100 - RNA, 22 nt, Mycobacterium avium subsp. paratuberculosis
gacuucguugguggucgacgcg

SEQ ID NO: 840101 - RNA, 24 nt, Mycobacterium avium subsp. paratuberculosis
gacuucguugguggucgacgcgcc

SEQ ID NO: 840102 - RNA, 14 nt, Mycobacterium avium subsp. paratuberculosis
gacuucuacggcgg

SEQ ID NO: 840103 - RNA, 17 nt, Mycobacterium avium subsp. paratuberculosis
gacuucuucagcuugac

SEQ ID NO: 840104 - RNA, 12 nt, Mycobacterium avium subsp. paratuberculosis
gacuugccgccg

SEQ ID NO: 840105 - RNA, 16 nt, Mycobacterium avium subsp. paratuberculosis
gacuugccgccggcgc

SEQ ID NO: 840106 - RNA, 22 nt, Mycobacterium avium subsp. paratuberculosis
gacuugcgcgccgugacgccga

SEQ ID NO: 840107 - RNA, 20 nt, Mycobacterium avium subsp. paratuberculosis
gacuuggccagcagccgcga

SEQ ID NO: 840108 - RNA, 16 nt, Mycobacterium avium subsp. paratuberculosis
gacuuggucagcccgc

SEQ ID NO: 840109 - RNA, 16 nt, Mycobacterium avium subsp. paratuberculosis
gacuugguggccagca

SEQ ID NO: 840110 - RNA, 19 nt, Mycobacterium avium subsp. paratuberculosis
gacuuccacuuacgcgagc

SEQ ID NO: 840111 - RNA, 21 nt, Mycobacterium avium subsp. paratuberculosis
gacuucccaguccggccagcg

SEQ ID NO: 840112 - RNA, 15 nt, Mycobacterium avium subsp. paratuberculosis
gacuucggcucggcg

SEQ ID NO: 840113 - RNA, 14 nt, Mycobacterium avium subsp. paratuberculosis
gacuucgcgugccg

SEQ ID NO: 840114 - RNA, 14 nt, Mycobacterium avium subsp. paratuberculosis
gacuggaucaucga

SEQ ID NO: 840115 - RNA, 19 nt, Mycobacterium avium subsp. paratuberculosis
gacuggcccacgcagccgu

SEQ ID NO: 840116 - RNA, 22 nt, Mycobacterium avium subsp. paratuberculosis
gacuggcccacgcagccgucga

SEQ ID NO: 840117 - RNA, 17 nt, Mycobacterium avium subsp. paratuberculosis
gacuggccaccgcgauc

SEQ ID NO: 840118 - RNA, 19 nt, Mycobacterium avium subsp. paratuberculosis
gacuggccaccgcgaucuc

SEQ ID NO: 840119 - RNA, 14 nt, Mycobacterium avium subsp. paratuberculosis
gacugggcgauugc

SEQ ID NO: 840120 - RNA, 17 nt, Mycobacterium avium subsp. paratuberculosis
gacuggcugagcagcac

SEQ ID NO: 840121 - RNA, 21 nt, Mycobacterium avium subsp. paratuberculosis
gacuggcugagcagcacccga

SEQ ID NO: 840122 - RNA, 15 nt, Mycobacterium avium subsp. paratuberculosis
gacugucggcgcccc

SEQ ID NO: 840123 - RNA, 19 nt, Mycobacterium avium subsp. paratuberculosis
gacuggugauagaucaucc

SEQ ID NO: 840124 - RNA, 23 nt, Mycobacterium avium subsp. paratuberculosis
gacuggugauagaucaucccggc

SEQ ID NO: 840125 - RNA, 20 nt, Mycobacterium avium subsp. paratuberculosis
gacuggugggcgucgugguc

SEQ ID NO: 840126 - RNA, 12 nt, Mycobacterium avium subsp. paratuberculosis
gacugcgccggg

SEQ ID NO: 840127 - RNA, 18 nt, Mycobacterium avium subsp. paratuberculosis
gacugcgccggggccgcg

SEQ ID NO: 840128 - RNA, 16 nt, Mycobacterium avium subsp. paratuberculosis
gacugcgcggccggcg

SEQ ID NO: 840129 - RNA, 20 nt, Mycobacterium avium subsp. paratuberculosis
gacugcgacggaucugcucg

SEQ ID NO: 840130 - RNA, 15 nt, Mycobacterium avium subsp. paratuberculosis
gacugcgacacccgc

SEQ ID NO: 840131 - RNA, 23 nt, Mycobacterium avium subsp. paratuberculosis
gacugcuugggcgccucgccgac

SEQ ID NO: 840132 - RNA, 17 nt, Mycobacterium avium subsp. paratuberculosis
gacugcccgaccgcgcc

SEQ ID NO: 840133 - RNA, 20 nt, Mycobacterium avium subsp. paratuberculosis
gacugcccgaccgcgccgaa

SEQ ID NO: 840134 - RNA, 15 nt, Mycobacterium avium subsp. paratuberculosis
gacugcagcgcggug

SEQ ID NO: 840135 - RNA, 14 nt, Mycobacterium avium subsp. paratuberculosis
gacugccgagcauc

SEQ ID NO: 840136 - RNA, 19 nt, Mycobacterium avium subsp. paratuberculosis
gacugcgaucgccgacgcc

SEQ ID NO: 840137 - RNA, 14 nt, Mycobacterium avium subsp. paratuberculosis
gacugcgcaccgcc

SEQ ID NO: 840138 - RNA, 16 nt, Mycobacterium avium subsp. paratuberculosis
gacugcgcaccgccag

SEQ ID NO: 840139 - RNA, 18 nt, Mycobacterium avium subsp. paratuberculosis
gacugcgcaccgccagca

SEQ ID NO: 840140 - RNA, 19 nt, Mycobacterium avium subsp. paratuberculosis
gacugcgcaccgccagcac

SEQ ID NO: 840141 - RNA, 19 nt, Mycobacterium avium subsp. paratuberculosis
gacugaugcccucgccggu

SEQ ID NO: 840142 - RNA, 16 nt, Mycobacterium avium subsp. paratuberculosis
gacugaugguggcgcg

SEQ ID NO: 840143 - RNA, 21 nt, Mycobacterium avium subsp. paratuberculosis
gacugaugguggcgcgcaucg

SEQ ID NO: 840144 - RNA, 13 nt, Mycobacterium avium subsp. paratuberculosis
gacugaucgacga

SEQ ID NO: 840145 - RNA, 20 nt, Mycobacterium avium subsp. paratuberculosis
gacugaucgacgagccgggc

SEQ ID NO: 840146 - RNA, 15 nt, Mycobacterium avium subsp. paratuberculosis
gacugaugaagccgc

SEQ ID NO: 840147 - RNA, 16 nt, Mycobacterium avium subsp. paratuberculosis
gacugaugaagccgcc

SEQ ID NO: 840148 - RNA, 17 nt, Mycobacterium avium subsp. paratuberculosis
gacugcacagugcgucg

SEQ ID NO: 840149 - RNA, 21 nt, Mycobacterium avium subsp. paratuberculosis
gacugcacagugcgucgccca

SEQ ID NO: 840150 - RNA, 12 nt, Mycobacterium avium subsp. paratuberculosis
gacugcacccga

SEQ ID NO: 840151 - RNA, 13 nt, Mycobacterium avium subsp. paratuberculosis
gacucggccagga

SEQ ID NO: 840152 - RNA, 17 nt, Mycobacterium avium subsp. paratuberculosis
gacucgaugcgcgugac

SEQ ID NO: 840153 - RNA, 18 nt, Mycobacterium avium subsp. paratuberculosis
gacucgaugcgcgugacg

SEQ ID NO: 840154 - RNA, 16 nt, Mycobacterium avium subsp. paratuberculosis
gacucguuggccggcu

SEQ ID NO: 840155 - RNA, 17 nt, Mycobacterium avium subsp. paratuberculosis
gacucguuggggccacc

SEQ ID NO: 840156 - RNA, 18 nt, Mycobacterium avium subsp. paratuberculosis
gacucguuggggccacca

SEQ ID NO: 840157 - RNA, 13 nt, Mycobacterium avium subsp. paratuberculosis
gacucgucgcuga

SEQ ID NO: 840158 - RNA, 15 nt, Mycobacterium avium subsp. paratuberculosis
gacucgaucgccacc

SEQ ID NO: 840159 - RNA, 17 nt, Mycobacterium avium subsp. paratuberculosis
gacucgaucgccaccga

SEQ ID NO: 840160 - RNA, 21 nt, Mycobacterium avium subsp. paratuberculosis
gacuccuugggagacugcgac

SEQ ID NO: 840161 - RNA, 23 nt, Mycobacterium avium subsp. paratuberculosis
gacuccuugggcauggugaagcc

SEQ ID NO: 840162 - RNA, 21 nt, Mycobacterium avium subsp. paratuberculosis
gacucgaagaaccgcaacacc

SEQ ID NO: 840163 - RNA, 16 nt, Mycobacterium avium subsp. paratuberculosis
gacucgaagaucgccu

SEQ ID NO: 840164 - RNA, 18 nt, Mycobacterium avium subsp. paratuberculosis
gacucgaccccgcccagc

SEQ ID NO: 840165 - RNA, 17 nt, Mycobacterium avium subsp. paratuberculosis
gacuccucacaccucgc

SEQ ID NO: 840166 - RNA, 21 nt, Mycobacterium avium subsp. paratuberculosis
gacuccucacaccucgcuacg

SEQ ID NO: 840167 - RNA, 19 nt, Mycobacterium avium subsp. paratuberculosis
gacuccuccggcccgaucg

SEQ ID NO: 840168 - RNA, 14 nt, Mycobacterium avium subsp. paratuberculosis
gacuccuccucggc

SEQ ID NO: 840169 - RNA, 16 nt, Mycobacterium avium subsp. paratuberculosis
gacuccuccucggcca

SEQ ID NO: 840170 - RNA, 23 nt, Mycobacterium avium subsp. paratuberculosis
gacuccuccucggccagccccac

SEQ ID NO: 840171 - RNA, 16 nt, Mycobacterium avium subsp. paratuberculosis
gacuccucgguggccu

SEQ ID NO: 840172 - RNA, 22 nt, Mycobacterium avium subsp. paratuberculosis
gacuccucgguggccucgcgca

SEQ ID NO: 840173 - RNA, 19 nt, Mycobacterium avium subsp. paratuberculosis
gacucagcccggcccagcc

SEQ ID NO: 840174 - RNA, 16 nt, Mycobacterium avium subsp. paratuberculosis
gacucacggcggcagc

SEQ ID NO: 840175 - RNA, 19 nt, Mycobacterium avium subsp. paratuberculosis
gacucacggcggcagcgcg

SEQ ID NO: 840176 - RNA, 15 nt, Mycobacterium avium subsp. paratuberculosis
gacucagcgucgaug

SEQ ID NO: 840177 - RNA, 18 nt, Mycobacterium avium subsp. paratuberculosis
gacuccaccaccuggccg

SEQ ID NO: 840178 - RNA, 20 nt, Mycobacterium avium subsp. paratuberculosis
gacuccaccaccuggccggc

SEQ ID NO: 840179 - RNA, 14 nt, Mycobacterium avium subsp. paratuberculosis
gacuccaccgccac

SEQ ID NO: 840180 - RNA, 15 nt, Mycobacterium avium subsp. paratuberculosis
gacuccaccgccacc

SEQ ID NO: 840181 - RNA, 18 nt, Mycobacterium avium subsp. paratuberculosis
gacuccaccgccaccgcg

SEQ ID NO: 840182 - RNA, 16 nt, Mycobacterium avium subsp. paratuberculosis
gacuccagcaccagca

SEQ ID NO: 840183 - RNA, 23 nt, Mycobacterium avium subsp. paratuberculosis
gacuccagcaccagcacggcgac

SEQ ID NO: 840184 - RNA, 19 nt, Mycobacterium avium subsp. paratuberculosis
gacuccagcaccggcgcca

SEQ ID NO: 840185 - RNA, 16 nt, Mycobacterium avium subsp. paratuberculosis
gacuccagcagcgccu

SEQ ID NO: 840186 - RNA, 22 nt, Mycobacterium avium subsp. paratuberculosis
gacuccagcagcgccuugccga

SEQ ID NO: 840187 - RNA, 12 nt, Mycobacterium avium subsp. paratuberculosis
gacuccagcgcg

SEQ ID NO: 840188 - RNA, 14 nt, Mycobacterium avium subsp. paratuberculosis
gacuccagcgcgau

SEQ ID NO: 840189 - RNA, 20 nt, Mycobacterium avium subsp. paratuberculosis
gacucccgagcgugggggcc

SEQ ID NO: 840190 - RNA, 16 nt, Mycobacterium avium subsp. paratuberculosis
gacuccggcgccgguc

SEQ ID NO: 840191 - RNA, 17 nt, Mycobacterium avium subsp. paratuberculosis
gacuccggcgccgguca

SEQ ID NO: 840192 - RNA, 19 nt, Mycobacterium avium subsp. paratuberculosis
gacuccggcgccggucagc

SEQ ID NO: 840193 - RNA, 20 nt, Mycobacterium avium subsp. paratuberculosis
gacuaauccccccgcgccgc

SEQ ID NO: 840194 - RNA, 13 nt, Mycobacterium avium subsp. paratuberculosis
gacuauacacgcc

SEQ ID NO: 840195 - RNA, 14 nt, Mycobacterium avium subsp. paratuberculosis
gacuaccgcgccca

SEQ ID NO: 840196 - RNA, 17 nt, Mycobacterium avium subsp. paratuberculosis
gacuaccgcgcccaggg

SEQ ID NO: 840197 - RNA, 23 nt, Mycobacterium avium subsp. paratuberculosis
gacgugcgcggcguucuccagca

SEQ ID NO: 840198 - RNA, 12 nt, Mycobacterium avium subsp. paratuberculosis
gacgugcgcggc

SEQ ID NO: 840199 - RNA, 14 nt, Mycobacterium avium subsp. paratuberculosis
gacgugcagcgcca

SEQ ID NO: 840200 - RNA, 17 nt, Mycobacterium avium subsp. paratuberculosis
gacgugcagcgccagca

SEQ ID NO: 840201 - RNA, 20 nt, Mycobacterium avium subsp. paratuberculosis
gacgugcccgaucucgucgg

SEQ ID NO: 840202 - RNA, 18 nt, Mycobacterium avium subsp. paratuberculosis
gacgugcccuuccccggc

SEQ ID NO: 840203 - RNA, 17 nt, Mycobacterium avium subsp. paratuberculosis
gacgugccggcgauggu

SEQ ID NO: 840204 - RNA, 18 nt, Mycobacterium avium subsp. paratuberculosis
gacgugccggcgauggug

SEQ ID NO: 840205 - RNA, 13 nt, Mycobacterium avium subsp. paratuberculosis
gacgugccggcgg

SEQ ID NO: 840206 - RNA, 16 nt, Mycobacterium avium subsp. paratuberculosis
gacgugcaccaccgcg

SEQ ID NO: 840207 - RNA, 20 nt, Mycobacterium avium subsp. paratuberculosis
gacgugcaccaccgcguuga

SEQ ID NO: 840208 - RNA, 14 nt, Mycobacterium avium subsp. paratuberculosis
gacgugcaccggcg

SEQ ID NO: 840209 - RNA, 16 nt, Mycobacterium avium subsp. paratuberculosis
gacgugcaccugcagc

SEQ ID NO: 840210 - RNA, 15 nt, Mycobacterium avium subsp. paratuberculosis
gacgugccguugacg

SEQ ID NO: 840211 - RNA, 13 nt, Mycobacterium avium subsp. paratuberculosis
gacguggcggccg

SEQ ID NO: 840212 - RNA, 15 nt, Mycobacterium avium subsp. paratuberculosis
gacguggcggccguc

SEQ ID NO: 840213 - RNA, 17 nt, Mycobacterium avium subsp. paratuberculosis
gacguggcggccgucgc

SEQ ID NO: 840214 - RNA, 16 nt, Mycobacterium avium subsp. paratuberculosis
gacguggcggcggugg

SEQ ID NO: 840215 - RNA, 20 nt, Mycobacterium avium subsp. paratuberculosis
gacgugcuuggccagcucgg

SEQ ID NO: 840216 - RNA, 17 nt, Mycobacterium avium subsp. paratuberculosis
gacguggagucgaagcg

SEQ ID NO: 840217 - RNA, 18 nt, Mycobacterium avium subsp. paratuberculosis
gacguggagucgaagcgg

SEQ ID NO: 840218 - RNA, 16 nt, Mycobacterium avium subsp. paratuberculosis
gacguggcaacgugcc

SEQ ID NO: 840219 - RNA, 14 nt, Mycobacterium avium subsp. paratuberculosis
gacguggaucucga

SEQ ID NO: 840220 - RNA, 15 nt, Mycobacterium avium subsp. paratuberculosis
gacguggaucucgaa

SEQ ID NO: 840221 - RNA, 14 nt, Mycobacterium avium subsp. paratuberculosis
gacgugggcggcca

SEQ ID NO: 840222 - RNA, 14 nt, Mycobacterium avium subsp. paratuberculosis
gacguggucgggca

SEQ ID NO: 840223 - RNA, 14 nt, Mycobacterium avium subsp. paratuberculosis
gacguggugcaccg

SEQ ID NO: 840224 - RNA, 17 nt, Mycobacterium avium subsp. paratuberculosis
gacguggugcaccgcca

SEQ ID NO: 840225 - RNA, 23 nt, Mycobacterium avium subsp. paratuberculosis
gacguggugcaccgccagcgcgg

SEQ ID NO: 840226 - RNA, 23 nt, Mycobacterium avium subsp. paratuberculosis
gacgugggugguggugccgucgc

SEQ ID NO: 840227 - RNA, 17 nt, Mycobacterium avium subsp. paratuberculosis
gacgugguugcguucgc

SEQ ID NO: 840228 - RNA, 22 nt, Mycobacterium avium subsp. paratuberculosis
gacgugguugcguucgccggcg

SEQ ID NO: 840229 - RNA, 23 nt, Mycobacterium avium subsp. paratuberculosis
gacgugguugcguucgccggcgu

SEQ ID NO: 840230 - RNA, 20 nt, Mycobacterium avium subsp. paratuberculosis
gacgugucgucgucgccgcc

SEQ ID NO: 840231 - RNA, 23 nt, Mycobacterium avium subsp. paratuberculosis
gacgugucgucgucgccgccggu

SEQ ID NO: 840232 - RNA, 13 nt, Mycobacterium avium subsp. paratuberculosis
gacgugcucggcg

SEQ ID NO: 840233 - RNA, 19 nt, Mycobacterium avium subsp. paratuberculosis
gacguuccgaacgugcagc

SEQ ID NO: 840234 - RNA, 16 nt, Mycobacterium avium subsp. paratuberculosis
gacguucuccccgccg

SEQ ID NO: 840235 - RNA, 21 nt, Mycobacterium avium subsp. paratuberculosis
gacguucgcguugagcgucgc

SEQ ID NO: 840236 - RNA, 13 nt, Mycobacterium avium subsp. paratuberculosis
gacguucggcggg

SEQ ID NO: 840237 - RNA, 12 nt, Mycobacterium avium subsp. paratuberculosis
gacguuggugau

SEQ ID NO: 840238 - RNA, 21 nt, Mycobacterium avium subsp. paratuberculosis
gacguuggugaucgccgacgu

SEQ ID NO: 840239 - RNA, 17 nt, Mycobacterium avium subsp. paratuberculosis
gacguuggccagcaccg

SEQ ID NO: 840240 - RNA, 20 nt, Mycobacterium avium subsp. paratuberculosis
gacguuggccagcaccgcgg

SEQ ID NO: 840241 - RNA, 15 nt, Mycobacterium avium subsp. paratuberculosis
gacguugaucgcgcc

SEQ ID NO: 840242 - RNA, 17 nt, Mycobacterium avium subsp. paratuberculosis
gacguugaugucgucca

SEQ ID NO: 840243 - RNA, 20 nt, Mycobacterium avium subsp. paratuberculosis
gacguugaugucguccaugc

SEQ ID NO: 840244 - RNA, 14 nt, Mycobacterium avium subsp. paratuberculosis
gacguugaccgcga

SEQ ID NO: 840245 - RNA, 15 nt, Mycobacterium avium subsp. paratuberculosis
gacguugaggcggcg

SEQ ID NO: 840246 - RNA, 16 nt, Mycobacterium avium subsp. paratuberculosis
gacguugaggcggcgg

SEQ ID NO: 840247 - RNA, 22 nt, Mycobacterium avium subsp. paratuberculosis
gacguccuugacccggccgcac

SEQ ID NO: 840248 - RNA, 14 nt, Mycobacterium avium subsp. paratuberculosis
gacguccuugauca

SEQ ID NO: 840249 - RNA, 19 nt, Mycobacterium avium subsp. paratuberculosis
gacgucgaagggucggucg

SEQ ID NO: 840250 - RNA, 22 nt, Mycobacterium avium subsp. paratuberculosis
gacguccucgaugccgaccgac

SEQ ID NO: 840251 - RNA, 14 nt, Mycobacterium avium subsp. paratuberculosis
gacguccucgcccg

SEQ ID NO: 840252 - RNA, 22 nt, Mycobacterium avium subsp. paratuberculosis
gacguccucgcccgggugcugc

SEQ ID NO: 840253 - RNA, 23 nt, Mycobacterium avium subsp. paratuberculosis
gacguccuggaucgcgcagguga

SEQ ID NO: 840254 - RNA, 15 nt, Mycobacterium avium subsp. paratuberculosis
gacgucgacugaucg

SEQ ID NO: 840255 - RNA, 16 nt, Mycobacterium avium subsp. paratuberculosis
gacgucgacugaucga

SEQ ID NO: 840256 - RNA, 20 nt, Mycobacterium avium subsp. paratuberculosis
gacgucgacgcgggcgacgu

SEQ ID NO: 840257 - RNA, 13 nt, Mycobacterium avium subsp. paratuberculosis
gacgucgacggca

SEQ ID NO: 840258 - RNA, 15 nt, Mycobacterium avium subsp. paratuberculosis
gacgucgacggcagc

SEQ ID NO: 840259 - RNA, 17 nt, Mycobacterium avium subsp. paratuberculosis
gacgucgacggcagcgc

SEQ ID NO: 840260 - RNA, 19 nt, Mycobacterium avium subsp. paratuberculosis
gacgucgaccgcgacgacc

SEQ ID NO: 840261 - RNA, 14 nt, Mycobacterium avium subsp. paratuberculosis
gacgucgaccgcgc

SEQ ID NO: 840262 - RNA, 16 nt, Mycobacterium avium subsp. paratuberculosis
gacgucgaccgcgccg

SEQ ID NO: 840263 - RNA, 13 nt, Mycobacterium avium subsp. paratuberculosis
gacgucgaacccg

SEQ ID NO: 840264 - RNA, 20 nt, Mycobacterium avium subsp. paratuberculosis
gacgucgaccuugcagcccg

SEQ ID NO: 840265 - RNA, 12 nt, Mycobacterium avium subsp. paratuberculosis
gacgucgacgac

SEQ ID NO: 840266 - RNA, 17 nt, Mycobacterium avium subsp. paratuberculosis
gacgucggacgcggccg

SEQ ID NO: 840267 - RNA, 20 nt, Mycobacterium avium subsp. paratuberculosis
gacgucggacgcggccgagc

SEQ ID NO: 840268 - RNA, 13 nt, Mycobacterium avium subsp. paratuberculosis
gacgucggccggc

SEQ ID NO: 840269 - RNA, 14 nt, Mycobacterium avium subsp. paratuberculosis
gacgucggccggcu

SEQ ID NO: 840270 - RNA, 19 nt, Mycobacterium avium subsp. paratuberculosis
gacgucggccggcugcagc

SEQ ID NO: 840271 - RNA, 13 nt, Mycobacterium avium subsp. paratuberculosis
gacgucgccggcc

SEQ ID NO: 840272 - RNA, 18 nt, Mycobacterium avium subsp. paratuberculosis
gacgucgccggccugccc

SEQ ID NO: 840273 - RNA, 20 nt, Mycobacterium avium subsp. paratuberculosis
gacgucgccggccugcccgc

SEQ ID NO: 840274 - RNA, 13 nt, Mycobacterium avium subsp. paratuberculosis
gacgucgcgcagg

SEQ ID NO: 840275 - RNA, 21 nt, Mycobacterium avium subsp. paratuberculosis
gacgucgcgcagguagguggc

SEQ ID NO: 840276 - RNA, 18 nt, Mycobacterium avium subsp. paratuberculosis
gacgucgcgccgcucggc

SEQ ID NO: 840277 - RNA, 22 nt, Mycobacterium avium subsp. paratuberculosis
gacgucgcgccgcucggccagc

SEQ ID NO: 840278 - RNA, 23 nt, Mycobacterium avium subsp. paratuberculosis
gacgucgcgccgcucggccagca

SEQ ID NO: 840279 - RNA, 18 nt, Mycobacterium avium subsp. paratuberculosis
gacgucgcgcggggugac

SEQ ID NO: 840280 - RNA, 19 nt, Mycobacterium avium subsp. paratuberculosis
gacgucgcgcggggugacg

SEQ ID NO: 840281 - RNA, 16 nt, Mycobacterium avium subsp. paratuberculosis
gacgucgcgcugccgg

SEQ ID NO: 840282 - RNA, 18 nt, Mycobacterium avium subsp. paratuberculosis
gacgucgcgcugccggcc

SEQ ID NO: 840283 - RNA, 17 nt, Mycobacterium avium subsp. paratuberculosis
gacgucgaugugcucgg

SEQ ID NO: 840284 - RNA, 19 nt, Mycobacterium avium subsp. paratuberculosis
gacgucgagaaaggccagc

SEQ ID NO: 840285 - RNA, 19 nt, Mycobacterium avium subsp. paratuberculosis
gacgucgagccagcgggcc

SEQ ID NO: 840286 - RNA, 13 nt, Mycobacterium avium subsp. paratuberculosis
gacgucgagcggc

SEQ ID NO: 840287 - RNA, 22 nt, Mycobacterium avium subsp. paratuberculosis
gacgucgagguguugucgugcc

SEQ ID NO: 840288 - RNA, 22 nt, Mycobacterium avium subsp. paratuberculosis
gacgucgccaccagaccggcga

SEQ ID NO: 840289 - RNA, 13 nt, Mycobacterium avium subsp. paratuberculosis
gacgucgcccacc

SEQ ID NO: 840290 - RNA, 15 nt, Mycobacterium avium subsp. paratuberculosis
gacgucgucgacccg

SEQ ID NO: 840291 - RNA, 20 nt, Mycobacterium avium subsp. paratuberculosis
gacgucgucgaugccgaucg

SEQ ID NO: 840292 - RNA, 13 nt, Mycobacterium avium subsp. paratuberculosis
gacgucgucgccc

SEQ ID NO: 840293 - RNA, 16 nt, Mycobacterium avium subsp. paratuberculosis
gacgucgucgcccacc

SEQ ID NO: 840294 - RNA, 14 nt, Mycobacterium avium subsp. paratuberculosis
gacgucgucgcggc

SEQ ID NO: 840295 - RNA, 15 nt, Mycobacterium avium subsp. paratuberculosis
gacgucgucguccca

SEQ ID NO: 840296 - RNA, 16 nt, Mycobacterium avium subsp. paratuberculosis
gacgucgugggcgauc

SEQ ID NO: 840297 - RNA, 22 nt, Mycobacterium avium subsp. paratuberculosis
gacgucggugaaauagcgcagc

SEQ ID NO: 840298 - RNA, 20 nt, Mycobacterium avium subsp. paratuberculosis
gacgucggguccgaccagca

SEQ ID NO: 840299 - RNA, 19 nt, Mycobacterium avium subsp. paratuberculosis
gacgucggucagcaucggg

SEQ ID NO: 840300 - RNA, 18 nt, Mycobacterium avium subsp. paratuberculosis
gacgucggcgcgcucggu

SEQ ID NO: 840301 - RNA, 22 nt, Mycobacterium avium subsp. paratuberculosis
gacgucggcgcggucgcaggcg

SEQ ID NO: 840302 - RNA, 22 nt, Mycobacterium avium subsp. paratuberculosis
gacgucggcgucaucgacuugc

SEQ ID NO: 840303 - RNA, 22 nt, Mycobacterium avium subsp. paratuberculosis
gacgucguugaccgaggcgauc

SEQ ID NO: 840304 - RNA, 19 nt, Mycobacterium avium subsp. paratuberculosis
gacgucguuuuccagccgg

SEQ ID NO: 840305 - RNA, 20 nt, Mycobacterium avium subsp. paratuberculosis
gacgucguuuuccagccggc

SEQ ID NO: 840306 - RNA, 22 nt, Mycobacterium avium subsp. paratuberculosis
gacgucguuuuccagccggcgc

SEQ ID NO: 840307 - RNA, 21 nt, Mycobacterium avium subsp. paratuberculosis
gacgucuaagucgaugccgcc

SEQ ID NO: 840308 - RNA, 15 nt, Mycobacterium avium subsp. paratuberculosis
gacgucugggccgcc

SEQ ID NO: 840309 - RNA, 16 nt, Mycobacterium avium subsp. paratuberculosis
gacgucugggccgccg

SEQ ID NO: 840310 - RNA, 19 nt, Mycobacterium avium subsp. paratuberculosis
gacgucugguuggccggcg

SEQ ID NO: 840311 - RNA, 20 nt, Mycobacterium avium subsp. paratuberculosis
gacgucugguuggccggcgg

SEQ ID NO: 840312 - RNA, 21 nt, Mycobacterium avium subsp. paratuberculosis
gacgucugguuggccggcggg

SEQ ID NO: 840313 - RNA, 21 nt, Mycobacterium avium subsp. paratuberculosis
gacgugaaaucccccgacccg

SEQ ID NO: 840314 - RNA, 22 nt, Mycobacterium avium subsp. paratuberculosis
gacgugacgaccuggucgccgc

SEQ ID NO: 840315 - RNA, 21 nt, Mycobacterium avium subsp. paratuberculosis
gacgugacgugccccucgacc

SEQ ID NO: 840316 - RNA, 23 nt, Mycobacterium avium subsp. paratuberculosis
gacgugauaguggucgucgucga

SEQ ID NO: 840317 - RNA, 20 nt, Mycobacterium avium subsp. paratuberculosis
gacgugauaucccuugccgc

SEQ ID NO: 840318 - RNA, 21 nt, Mycobacterium avium subsp. paratuberculosis
gacgugaucgcgguggccgua

SEQ ID NO: 840319 - RNA, 16 nt, Mycobacterium avium subsp. paratuberculosis
gacgugaucuggucgg

SEQ ID NO: 840320 - RNA, 23 nt, Mycobacterium avium subsp. paratuberculosis
gacgugaucuggucggccagcgc

SEQ ID NO: 840321 - RNA, 22 nt, Mycobacterium avium subsp. paratuberculosis
gacguccacguugaugccgccc

SEQ ID NO: 840322 - RNA, 23 nt, Mycobacterium avium subsp. paratuberculosis
gacguccacguugaugccgccca

SEQ ID NO: 840323 - RNA, 13 nt, Mycobacterium avium subsp. paratuberculosis
gacguccgcggga

SEQ ID NO: 840324 - RNA, 14 nt, Mycobacterium avium subsp. paratuberculosis
gacguccgggccgc

SEQ ID NO: 840325 - RNA, 15 nt, Mycobacterium avium subsp. paratuberculosis
gacguccgcgucggc

SEQ ID NO: 840326 - RNA, 22 nt, Mycobacterium avium subsp. paratuberculosis
gacguccgcgucggcgccggcc

SEQ ID NO: 840327 - RNA, 22 nt, Mycobacterium avium subsp. paratuberculosis
gacguccaccaggguggccgcc

SEQ ID NO: 840328 - RNA, 13 nt, Mycobacterium avium subsp. paratuberculosis
gacguccaccgga

SEQ ID NO: 840329 - RNA, 15 nt, Mycobacterium avium subsp. paratuberculosis
gacguccaccggaug

SEQ ID NO: 840330 - RNA, 14 nt, Mycobacterium avium subsp. paratuberculosis
gacguccagcgccg

SEQ ID NO: 840331 - RNA, 16 nt, Mycobacterium avium subsp. paratuberculosis
gacguccagcgccgcc

SEQ ID NO: 840332 - RNA, 15 nt, Mycobacterium avium subsp. paratuberculosis
gacguccaggccggc

SEQ ID NO: 840333 - RNA, 17 nt, Mycobacterium avium subsp. paratuberculosis
gacguccaggccggcgc

SEQ ID NO: 840334 - RNA, 19 nt, Mycobacterium avium subsp. paratuberculosis
gacguccaggccggcgccg

SEQ ID NO: 840335 - RNA, 17 nt, Mycobacterium avium subsp. paratuberculosis
gacgucaggccggucag

SEQ ID NO: 840336 - RNA, 18 nt, Mycobacterium avium subsp. paratuberculosis
gacgucaggccggucagc

SEQ ID NO: 840337 - RNA, 23 nt, Mycobacterium avium subsp. paratuberculosis
gacgucaggccggucagcgacga

SEQ ID NO: 840338 - RNA, 21 nt, Mycobacterium avium subsp. paratuberculosis
gacgucaggggugccggaggc

SEQ ID NO: 840339 - RNA, 15 nt, Mycobacterium avium subsp. paratuberculosis
gacgucagcccgcgu

SEQ ID NO: 840340 - RNA, 17 nt, Mycobacterium avium subsp. paratuberculosis
gacgucagcccgcgucg

SEQ ID NO: 840341 - RNA, 18 nt, Mycobacterium avium subsp. paratuberculosis
gacgucagcccgcgucgc

SEQ ID NO: 840342 - RNA, 21 nt, Mycobacterium avium subsp. paratuberculosis
gacgucagcccgcgucgcgca

SEQ ID NO: 840343 - RNA, 14 nt, Mycobacterium avium subsp. paratuberculosis
gacguagucgcgca

SEQ ID NO: 840344 - RNA, 17 nt, Mycobacterium avium subsp. paratuberculosis
gacguagucgcgcacca

SEQ ID NO: 840345 - RNA, 18 nt, Mycobacterium avium subsp. paratuberculosis
gacguagugcagccgccc

SEQ ID NO: 840346 - RNA, 21 nt, Mycobacterium avium subsp. paratuberculosis
gacguagugcagccgcccguc

SEQ ID NO: 840347 - RNA, 14 nt, Mycobacterium avium subsp. paratuberculosis
gacguaggacagca

SEQ ID NO: 840348 - RNA, 17 nt, Mycobacterium avium subsp. paratuberculosis
gacguaggacagcacca

SEQ ID NO: 840349 - RNA, 20 nt, Mycobacterium avium subsp. paratuberculosis
gacguaggcggccagcagca

SEQ ID NO: 840350 - RNA, 23 nt, Mycobacterium avium subsp. paratuberculosis
gacguaggcggccagcagcacca

SEQ ID NO: 840351 - RNA, 22 nt, Mycobacterium avium subsp. paratuberculosis
gacguaccagcugcccaccagc

SEQ ID NO: 840352 - RNA, 22 nt, Mycobacterium avium subsp. paratuberculosis
gacguacccccgcacgccagca

SEQ ID NO: 840353 - RNA, 23 nt, Mycobacterium avium subsp. paratuberculosis
gacguacccccgcacgccagcau

SEQ ID NO: 840354 - RNA, 16 nt, Mycobacterium avium subsp. paratuberculosis
gacgaccucgcccgcc

SEQ ID NO: 840355 - RNA, 22 nt, Mycobacterium avium subsp. paratuberculosis
gacguacagcgagccgucgacc

SEQ ID NO: 840356 - RNA, 14 nt, Mycobacterium avium subsp. paratuberculosis
gacgaccgcaccga

SEQ ID NO: 840357 - RNA, 20 nt, Mycobacterium avium subsp. paratuberculosis
gacgaccgucaucaucaccg

SEQ ID NO: 840358 - RNA, 16 nt, Mycobacterium avium subsp. paratuberculosis
gacgaccucccccgac

SEQ ID NO: 840359 - RNA, 19 nt, Mycobacterium avium subsp. paratuberculosis
gacguacuggcgccggucg

SEQ ID NO: 840360 - RNA, 21 nt, Mycobacterium avium subsp. paratuberculosis
gacguacuggcgccggucggu

SEQ ID NO: 840361 - RNA, 16 nt, Mycobacterium avium subsp. paratuberculosis
gacgaccgcgacggcg

SEQ ID NO: 840362 - RNA, 17 nt, Mycobacterium avium subsp. paratuberculosis
gacgaccgcgacggcgc

SEQ ID NO: 840363 - RNA, 22 nt, Mycobacterium avium subsp. paratuberculosis
gacgaccgcgacggcgcccgcc

SEQ ID NO: 840364 - RNA, 11 nt, Mycobacterium avium subsp. paratuberculosis
gacgaccgcgu

SEQ ID NO: 840365 - RNA, 18 nt, Mycobacterium avium subsp. paratuberculosis
gacgaccgcguccgaggc

SEQ ID NO: 840366 - RNA, 13 nt, Mycobacterium avium subsp. paratuberculosis
gacgaccggcagc

SEQ ID NO: 840367 - RNA, 18 nt, Mycobacterium avium subsp. paratuberculosis
gacgaccggcagccgcgc

SEQ ID NO: 840368 - RNA, 19 nt, Mycobacterium avium subsp. paratuberculosis
gacgaccagguccaccccg

SEQ ID NO: 840369 - RNA, 14 nt, Mycobacterium avium subsp. paratuberculosis
gacgaaaucgucgg

SEQ ID NO: 840370 - RNA, 22 nt, Mycobacterium avium subsp. paratuberculosis
gacgaccaucagcgcccgggug

SEQ ID NO: 840371 - RNA, 20 nt, Mycobacterium avium subsp. paratuberculosis
gacgacaccaccgugcuggc

SEQ ID NO: 840372 - RNA, 23 nt, Mycobacterium avium subsp. paratuberculosis
gacgacaccacggucgccgcgcc

SEQ ID NO: 840373 - RNA, 20 nt, Mycobacterium avium subsp. paratuberculosis
gacgaccaggaugcccagga

SEQ ID NO: 840374 - RNA, 20 nt, Mycobacterium avium subsp. paratuberculosis
aacucaccgguggccgcguc

SEQ ID NO: 840375 - RNA, 19 nt, Mycobacterium avium subsp. paratuberculosis
aacuccauccgccgucgac

SEQ ID NO: 840376 - RNA, 12 nt, Mycobacterium avium subsp. paratuberculosis
aacucaugggcc

SEQ ID NO: 840377 - RNA, 16 nt, Mycobacterium avium subsp. paratuberculosis
aacucaugggcccggc

SEQ ID NO: 840378 - RNA, 12 nt, Mycobacterium avium subsp. paratuberculosis
gagcaucacgaa

SEQ ID NO: 840379 - RNA, 14 nt, Mycobacterium avium subsp. paratuberculosis
gagcauccggcgca

SEQ ID NO: 840380 - RNA, 20 nt, Mycobacterium avium subsp. paratuberculosis
gagcauccggcgcacggcgc

SEQ ID NO: 840381 - RNA, 17 nt, Mycobacterium avium subsp. paratuberculosis
gagcaucuccagccggc

SEQ ID NO: 840382 - RNA, 18 nt, Mycobacterium avium subsp. paratuberculosis
gagcaucuccagccggcg

SEQ ID NO: 840383 - RNA, 14 nt, Mycobacterium avium subsp. paratuberculosis
gagcaucgccgagc

SEQ ID NO: 840384 - RNA, 20 nt, Mycobacterium avium subsp. paratuberculosis
gagcaucgccgagcgcaucg

SEQ ID NO: 840385 - RNA, 20 nt, Mycobacterium avium subsp. paratuberculosis
gagcaucgggguuccaccgu

SEQ ID NO: 840386 - RNA, 20 nt, Mycobacterium avium subsp. paratuberculosis
gagcaucucggugccgucga

SEQ ID NO: 840387 - RNA, 23 nt, Mycobacterium avium subsp. paratuberculosis
gagccaccucgaucagcggcauc

SEQ ID NO: 840388 - RNA, 12 nt, Mycobacterium avium subsp. paratuberculosis
aacucgacccgc

SEQ ID NO: 840389 - RNA, 14 nt, Mycobacterium avium subsp. paratuberculosis
gagcagcgcccggc

SEQ ID NO: 840390 - RNA, 14 nt, Mycobacterium avium subsp. paratuberculosis
gagcagcgccugcu

SEQ ID NO: 840391 - RNA, 15 nt, Mycobacterium avium subsp. paratuberculosis
gagcagcgcgaugcc

SEQ ID NO: 840392 - RNA, 21 nt, Mycobacterium avium subsp. paratuberculosis
gagcagcucgcggauccgcag

SEQ ID NO: 840393 - RNA, 14 nt, Mycobacterium avium subsp. paratuberculosis
gagcagcucggcgg

SEQ ID NO: 840394 - RNA, 21 nt, Mycobacterium avium subsp. paratuberculosis
gagcagcucggucaccagcgg

SEQ ID NO: 840395 - RNA, 17 nt, Mycobacterium avium subsp. paratuberculosis
gagcagcucagccgccu

SEQ ID NO: 840396 - RNA, 17 nt, Mycobacterium avium subsp. paratuberculosis
gagcagcugcagcgucg

SEQ ID NO: 840397 - RNA, 18 nt, Mycobacterium avium subsp. paratuberculosis
gagcagcugcagcgucgg

SEQ ID NO: 840398 - RNA, 18 nt, Mycobacterium avium subsp. paratuberculosis
gagcagcugggacagcgu

SEQ ID NO: 840399 - RNA, 15 nt, Mycobacterium avium subsp. paratuberculosis
gagcagcaugccgag

SEQ ID NO: 840400 - RNA, 18 nt, Mycobacterium avium subsp. paratuberculosis
gagcagcaugccgagcac

SEQ ID NO: 840401 - RNA, 19 nt, Mycobacterium avium subsp. paratuberculosis
gagcagcaugccgagcacc

SEQ ID NO: 840402 - RNA, 13 nt, Mycobacterium avium subsp. paratuberculosis
gagcagcccgacc

SEQ ID NO: 840403 - RNA, 15 nt, Mycobacterium avium subsp. paratuberculosis
gagcagcccgaccac

SEQ ID NO: 840404 - RNA, 13 nt, Mycobacterium avium subsp. paratuberculosis
gagcagcccggcg

SEQ ID NO: 840405 - RNA, 14 nt, Mycobacterium avium subsp. paratuberculosis
gagcagcccggcga

SEQ ID NO: 840406 - RNA, 20 nt, Mycobacterium avium subsp. paratuberculosis
gagcagccgaucuggcgggc

SEQ ID NO: 840407 - RNA, 22 nt, Mycobacterium avium subsp. paratuberculosis
gagcagccgaucuggcgggcgg

SEQ ID NO: 840408 - RNA, 22 nt, Mycobacterium avium subsp. paratuberculosis
gagcagccgcaacacggccucg

SEQ ID NO: 840409 - RNA, 16 nt, Mycobacterium avium subsp. paratuberculosis
gagcagccgggccagc

SEQ ID NO: 840410 - RNA, 20 nt, Mycobacterium avium subsp. paratuberculosis
gagcagcaccacccgcaccu

SEQ ID NO: 840411 - RNA, 23 nt, Mycobacterium avium subsp. paratuberculosis
gagcagcagaccgccggugcgca

SEQ ID NO: 840412 - RNA, 21 nt, Mycobacterium avium subsp. paratuberculosis
gagcagcagccgccgggccac

SEQ ID NO: 840413 - RNA, 14 nt, Mycobacterium avium subsp. paratuberculosis
gagcagcaccaccc

SEQ ID NO: 840414 - RNA, 18 nt, Mycobacterium avium subsp. paratuberculosis
gagcagcaccacccgcac

SEQ ID NO: 840415 - RNA, 18 nt, Mycobacterium avium subsp. paratuberculosis
gagcagcacccgacuucg

SEQ ID NO: 840416 - RNA, 22 nt, Mycobacterium avium subsp. paratuberculosis
gagcagcacccgacuucggcuc

SEQ ID NO: 840417 - RNA, 14 nt, Mycobacterium avium subsp. paratuberculosis
gagcagcaccggca

SEQ ID NO: 840418 - RNA, 22 nt, Mycobacterium avium subsp. paratuberculosis
gagcaguugcgcguugcgcgga

SEQ ID NO: 840419 - RNA, 20 nt, Mycobacterium avium subsp. paratuberculosis
gagcaguucgaugcgcucgg

SEQ ID NO: 840420 - RNA, 21 nt, Mycobacterium avium subsp. paratuberculosis
gagcaguucgaugcgcucggc

SEQ ID NO: 840421 - RNA, 17 nt, Mycobacterium avium subsp. paratuberculosis
gagcaguagacgccgcc

SEQ ID NO: 840422 - RNA, 22 nt, Mycobacterium avium subsp. paratuberculosis
gagcagguccucgaucgacacc

SEQ ID NO: 840423 - RNA, 15 nt, Mycobacterium avium subsp. paratuberculosis
gagcagggcgggcag

SEQ ID NO: 840424 - RNA, 19 nt, Mycobacterium avium subsp. paratuberculosis
gagcaggcugaucucggcg

SEQ ID NO: 840425 - RNA, 20 nt, Mycobacterium avium subsp. paratuberculosis
gagcaggcugaucucggcgg

SEQ ID NO: 840426 - RNA, 22 nt, Mycobacterium avium subsp. paratuberculosis
gagcaggcugaucucggcgguc

SEQ ID NO: 840427 - RNA, 18 nt, Mycobacterium avium subsp. paratuberculosis
gagcaggcuucgcagcag

SEQ ID NO: 840428 - RNA, 14 nt, Mycobacterium avium subsp. paratuberculosis
gagcagggccagcg

SEQ ID NO: 840429 - RNA, 16 nt, Mycobacterium avium subsp. paratuberculosis
gagcagggccagcggc

SEQ ID NO: 840430 - RNA, 20 nt, Mycobacterium avium subsp. paratuberculosis
gagccauaaaccggccggcg

SEQ ID NO: 840431 - RNA, 22 nt, Mycobacterium avium subsp. paratuberculosis
gagccauaaaccggccggcgcg

SEQ ID NO: 840432 - RNA, 14 nt, Mycobacterium avium subsp. paratuberculosis
gagccagcugcgcg

SEQ ID NO: 840433 - RNA, 13 nt, Mycobacterium avium subsp. paratuberculosis
gagcccaccgcgc

SEQ ID NO: 840434 - RNA, 17 nt, Mycobacterium avium subsp. paratuberculosis
gagccaguucgccagca

SEQ ID NO: 840435 - RNA, 21 nt, Mycobacterium avium subsp. paratuberculosis
gagccaguucgccagcaugcg

SEQ ID NO: 840436 - RNA, 17 nt, Mycobacterium avium subsp. paratuberculosis
gagcccccaccugaucg

SEQ ID NO: 840437 - RNA, 22 nt, Mycobacterium avium subsp. paratuberculosis
gagcccccaccugaucgcggcg

SEQ ID NO: 840438 - RNA, 13 nt, Mycobacterium avium subsp. paratuberculosis
gagcccagcugcg

SEQ ID NO: 840439 - RNA, 14 nt, Mycobacterium avium subsp. paratuberculosis
gagcccagcuuggc

SEQ ID NO: 840440 - RNA, 19 nt, Mycobacterium avium subsp. paratuberculosis
gagcccgacggcagcaccg

SEQ ID NO: 840441 - RNA, 16 nt, Mycobacterium avium subsp. paratuberculosis
gagcccggaccggccg

SEQ ID NO: 840442 - RNA, 14 nt, Mycobacterium avium subsp. paratuberculosis
gagcccgaacacgg

SEQ ID NO: 840443 - RNA, 12 nt, Mycobacterium avium subsp. paratuberculosis
gagcccgccggc

SEQ ID NO: 840444 - RNA, 13 nt, Mycobacterium avium subsp. paratuberculosis
gagcccgcgccca

SEQ ID NO: 840445 - RNA, 18 nt, Mycobacterium avium subsp. paratuberculosis
gagccgaaacggugcccg

SEQ ID NO: 840446 - RNA, 13 nt, Mycobacterium avium subsp. paratuberculosis
gagcccgucgacg

SEQ ID NO: 840447 - RNA, 12 nt, Mycobacterium avium subsp. paratuberculosis
gagcccugcgcc

SEQ ID NO: 840448 - RNA, 15 nt, Mycobacterium avium subsp. paratuberculosis
gagcccugcgccagc

SEQ ID NO: 840449 - RNA, 16 nt, Mycobacterium avium subsp. paratuberculosis
gagcccugcgccagca

SEQ ID NO: 840450 - RNA, 18 nt, Mycobacterium avium subsp. paratuberculosis
gagcccgggcaggcggcg

SEQ ID NO: 840451 - RNA, 18 nt, Mycobacterium avium subsp. paratuberculosis
gagcccggccaguccggc

SEQ ID NO: 840452 - RNA, 21 nt, Mycobacterium avium subsp. paratuberculosis
gagcccggccaguccggcagc

SEQ ID NO: 840453 - RNA, 21 nt, Mycobacterium avium subsp. paratuberculosis
gagcccggcgacgaagcagcu

SEQ ID NO: 840454 - RNA, 16 nt, Mycobacterium avium subsp. paratuberculosis
gagcccggcgacgucg

SEQ ID NO: 840455 - RNA, 16 nt, Mycobacterium avium subsp. paratuberculosis
gagccgacagucgcgg

SEQ ID NO: 840456 - RNA, 18 nt, Mycobacterium avium subsp. paratuberculosis
gagccgacagucgcgggc

SEQ ID NO: 840457 - RNA, 13 nt, Mycobacterium avium subsp. paratuberculosis
gagccgaccagcg

SEQ ID NO: 840458 - RNA, 15 nt, Mycobacterium avium subsp. paratuberculosis
gagccgaccagcgcg

SEQ ID NO: 840459 - RNA, 16 nt, Mycobacterium avium subsp. paratuberculosis
gagccgaccagcgcga

SEQ ID NO: 840460 - RNA, 14 nt, Mycobacterium avium subsp. paratuberculosis
gagccgacccgggc

SEQ ID NO: 840461 - RNA, 17 nt, Mycobacterium avium subsp. paratuberculosis
gagccgaccucggcgac

SEQ ID NO: 840462 - RNA, 21 nt, Mycobacterium avium subsp. paratuberculosis
gagccgaccucggcgacgaug

SEQ ID NO: 840463 - RNA, 16 nt, Mycobacterium avium subsp. paratuberculosis
gagccgagcaccaggc

SEQ ID NO: 840464 - RNA, 17 nt, Mycobacterium avium subsp. paratuberculosis
gagccgagcaccaggcg

SEQ ID NO: 840465 - RNA, 24 nt, Mycobacterium avium subsp. paratuberculosis
gagccgagcaccaggcgcaccagc

SEQ ID NO: 840466 - RNA, 13 nt, Mycobacterium avium subsp. paratuberculosis
gagccgagcaccg

SEQ ID NO: 840467 - RNA, 19 nt, Mycobacterium avium subsp. paratuberculosis
gagccgagcaccggcagca

SEQ ID NO: 840468 - RNA, 12 nt, Mycobacterium avium subsp. paratuberculosis
gagccgagcacg

SEQ ID NO: 840469 - RNA, 19 nt, Mycobacterium avium subsp. paratuberculosis
gagccgagcacgcagccgc

SEQ ID NO: 840470 - RNA, 17 nt, Mycobacterium avium subsp. paratuberculosis
gagccgaugcccagcag

SEQ ID NO: 840471 - RNA, 14 nt, Mycobacterium avium subsp. paratuberculosis
gagccgcaccgccu

SEQ ID NO: 840472 - RNA, 15 nt, Mycobacterium avium subsp. paratuberculosis
gagccgcaccgccuc

SEQ ID NO: 840473 - RNA, 14 nt, Mycobacterium avium subsp. paratuberculosis
gagcgccggacucg

SEQ ID NO: 840474 - RNA, 20 nt, Mycobacterium avium subsp. paratuberculosis
gagcgcgaaaaccagcaccg

SEQ ID NO: 840475 - RNA, 20 nt, Mycobacterium avium subsp. paratuberculosis
gagcgagaugaucagccgcc

SEQ ID NO: 840476 - RNA, 15 nt, Mycobacterium avium subsp. paratuberculosis
gagcgaugggcgcga

SEQ ID NO: 840477 - RNA, 18 nt, Mycobacterium avium subsp. paratuberculosis
gagcgaugggcgcgauca

SEQ ID NO: 840478 - RNA, 15 nt, Mycobacterium avium subsp. paratuberculosis
gagcgagccggcacg

SEQ ID NO: 840479 - RNA, 14 nt, Mycobacterium avium subsp. paratuberculosis
gagcgagcgcacca

SEQ ID NO: 840480 - RNA, 20 nt, Mycobacterium avium subsp. paratuberculosis
gagcgaggacgucgagcggc

SEQ ID NO: 840481 - RNA, 14 nt, Mycobacterium avium subsp. paratuberculosis
gagcgacaccaggu

SEQ ID NO: 840482 - RNA, 22 nt, Mycobacterium avium subsp. paratuberculosis
gagcgacauggucgggcgcacc

SEQ ID NO: 840483 - RNA, 18 nt, Mycobacterium avium subsp. paratuberculosis
gagcgaaggugccgcgau

SEQ ID NO: 840484 - RNA, 14 nt, Mycobacterium avium subsp. paratuberculosis
gagccggggcuggg

SEQ ID NO: 840485 - RNA, 19 nt, Mycobacterium avium subsp. paratuberculosis
gagccgggucauccagccg

SEQ ID NO: 840486 - RNA, 14 nt, Mycobacterium avium subsp. paratuberculosis
gagccgggugcccg

SEQ ID NO: 840487 - RNA, 16 nt, Mycobacterium avium subsp. paratuberculosis
gagccgguacggcucg

SEQ ID NO: 840488 - RNA, 14 nt, Mycobacterium avium subsp. paratuberculosis
gagccggucgaacg

SEQ ID NO: 840489 - RNA, 23 nt, Mycobacterium avium subsp. paratuberculosis
gagccggucgaacgccagcgccg

SEQ ID NO: 840490 - RNA, 14 nt, Mycobacterium avium subsp. paratuberculosis
gagccggucgggau

SEQ ID NO: 840491 - RNA, 16 nt, Mycobacterium avium subsp. paratuberculosis
gagccggucgugcgac

SEQ ID NO: 840492 - RNA, 22 nt, Mycobacterium avium subsp. paratuberculosis
gagccggucugggcgaccaugc

SEQ ID NO: 840493 - RNA, 24 nt, Mycobacterium avium subsp. paratuberculosis
gagccggucugggcgaccaugccg

SEQ ID NO: 840494 - RNA, 12 nt, Mycobacterium avium subsp. paratuberculosis
gagccgcccagg

SEQ ID NO: 840495 - RNA, 15 nt, Mycobacterium avium subsp. paratuberculosis
gagccgcccaggcgg

SEQ ID NO: 840496 - RNA, 19 nt, Mycobacterium avium subsp. paratuberculosis
gagccgcccaggcgggcca

SEQ ID NO: 840497 - RNA, 12 nt, Mycobacterium avium subsp. paratuberculosis
gagccgccgagc

SEQ ID NO: 840498 - RNA, 16 nt, Mycobacterium avium subsp. paratuberculosis
gagccgccgagccggc

SEQ ID NO: 840499 - RNA, 13 nt, Mycobacterium avium subsp. paratuberculosis
gagccgcagucga

SEQ ID NO: 840500 - RNA, 19 nt, Mycobacterium avium subsp. paratuberculosis
gagccgaagaucaccgcgu

SEQ ID NO: 840501 - RNA, 16 nt, Mycobacterium avium subsp. paratuberculosis
gagccgccacagcgcc

SEQ ID NO: 840502 - RNA, 21 nt, Mycobacterium avium subsp. paratuberculosis
gagccgccacggggcccgcga

SEQ ID NO: 840503 - RNA, 21 nt, Mycobacterium avium subsp. paratuberculosis
gagccguccggguucgacgcc

SEQ ID NO: 840504 - RNA, 22 nt, Mycobacterium avium subsp. paratuberculosis
gagccguccggguucgacgccu

SEQ ID NO: 840505 - RNA, 12 nt, Mycobacterium avium subsp. paratuberculosis
gagccgucgacc

SEQ ID NO: 840506 - RNA, 17 nt, Mycobacterium avium subsp. paratuberculosis
gagccgucgucgcugca

SEQ ID NO: 840507 - RNA, 15 nt, Mycobacterium avium subsp. paratuberculosis
gagccgucucggagc

SEQ ID NO: 840508 - RNA, 21 nt, Mycobacterium avium subsp. paratuberculosis
gagccgucucggagcgguguc

SEQ ID NO: 840509 - RNA, 16 nt, Mycobacterium avium subsp. paratuberculosis
gagccgugcagcgccc

SEQ ID NO: 840510 - RNA, 21 nt, Mycobacterium avium subsp. paratuberculosis
gagccgugcagcgcccagccg

SEQ ID NO: 840511 - RNA, 18 nt, Mycobacterium avium subsp. paratuberculosis
gagccgguagaucagcgc

SEQ ID NO: 840512 - RNA, 19 nt, Mycobacterium avium subsp. paratuberculosis
gagccgguagaucagcgcc

SEQ ID NO: 840513 - RNA, 12 nt, Mycobacterium avium subsp. paratuberculosis
gagccggugaug

SEQ ID NO: 840514 - RNA, 13 nt, Mycobacterium avium subsp. paratuberculosis
gagccggugauga

SEQ ID NO: 840515 - RNA, 17 nt, Mycobacterium avium subsp. paratuberculosis
gagccggugccgaggca

SEQ ID NO: 840516 - RNA, 18 nt, Mycobacterium avium subsp. paratuberculosis
gagccggugccgcccauc

SEQ ID NO: 840517 - RNA, 19 nt, Mycobacterium avium subsp. paratuberculosis
gagccgguagggccgguca

SEQ ID NO: 840518 - RNA, 19 nt, Mycobacterium avium subsp. paratuberculosis
gagccgguccgaccagcgg

SEQ ID NO: 840519 - RNA, 19 nt, Mycobacterium avium subsp. paratuberculosis
gagccgguccgacggcugc

SEQ ID NO: 840520 - RNA, 22 nt, Mycobacterium avium subsp. paratuberculosis
gagaagcucaugucguacgggc

SEQ ID NO: 840521 - RNA, 12 nt, Mycobacterium avium subsp. paratuberculosis
gagaaggccgcg

SEQ ID NO: 840522 - RNA, 14 nt, Mycobacterium avium subsp. paratuberculosis
gagaaggccgcgcg

SEQ ID NO: 840523 - RNA, 15 nt, Mycobacterium avium subsp. paratuberculosis
gagaaggcggcgucg

SEQ ID NO: 840524 - RNA, 13 nt, Mycobacterium avium subsp. paratuberculosis
gagaccagcagcu

SEQ ID NO: 840525 - RNA, 15 nt, Mycobacterium avium subsp. paratuberculosis
gagaccaggucggcc

SEQ ID NO: 840526 - RNA, 15 nt, Mycobacterium avium subsp. paratuberculosis
gagacaccgucgcgc

SEQ ID NO: 840527 - RNA, 15 nt, Mycobacterium avium subsp. paratuberculosis
gagacacgcgccggc

SEQ ID NO: 840528 - RNA, 18 nt, Mycobacterium avium subsp. paratuberculosis
gagacgaucucgccgucc

SEQ ID NO: 840529 - RNA, 13 nt, Mycobacterium avium subsp. paratuberculosis
gagacgaccagga

SEQ ID NO: 840530 - RNA, 20 nt, Mycobacterium avium subsp. paratuberculosis
gagacgaccaggaugcccag

SEQ ID NO: 840531 - RNA, 17 nt, Mycobacterium avium subsp. paratuberculosis
gagacgacgccaccauc

SEQ ID NO: 840532 - RNA, 13 nt, Mycobacterium avium subsp. paratuberculosis
gagaccuuggcgc

SEQ ID NO: 840533 - RNA, 15 nt, Mycobacterium avium subsp. paratuberculosis
gagaccucccggcgc

SEQ ID NO: 840534 - RNA, 16 nt, Mycobacterium avium subsp. paratuberculosis
gagaccucuucgaccc

SEQ ID NO: 840535 - RNA, 15 nt, Mycobacterium avium subsp. paratuberculosis
gagaccaugccgccg

SEQ ID NO: 840536 - RNA, 18 nt, Mycobacterium avium subsp. paratuberculosis
gagaccaugucggccagg

SEQ ID NO: 840537 - RNA, 14 nt, Mycobacterium avium subsp. paratuberculosis
gagacguggcggcg

SEQ ID NO: 840538 - RNA, 15 nt, Mycobacterium avium subsp. paratuberculosis
gagacguggcggcgg

SEQ ID NO: 840539 - RNA, 15 nt, Mycobacterium avium subsp. paratuberculosis
gagacguggucgggc

SEQ ID NO: 840540 - RNA, 19 nt, Mycobacterium avium subsp. paratuberculosis
gagacguggucgggcaugc

SEQ ID NO: 840541 - RNA, 15 nt, Mycobacterium avium subsp. paratuberculosis
gagacguugccgcac

SEQ ID NO: 840542 - RNA, 16 nt, Mycobacterium avium subsp. paratuberculosis
gagacguugccgcaca

SEQ ID NO: 840543 - RNA, 20 nt, Mycobacterium avium subsp. paratuberculosis
gagacguugccgcacaccgc

SEQ ID NO: 840544 - RNA, 20 nt, Mycobacterium avium subsp. paratuberculosis
gagaucaugccggcgaacuc

SEQ ID NO: 840545 - RNA, 15 nt, Mycobacterium avium subsp. paratuberculosis
gagauccaccgcgcg

SEQ ID NO: 840546 - RNA, 23 nt, Mycobacterium avium subsp. paratuberculosis
gagauccaccgcgcggccagcgg

SEQ ID NO: 840547 - RNA, 14 nt, Mycobacterium avium subsp. paratuberculosis
gagauccagcagcc

SEQ ID NO: 840548 - RNA, 19 nt, Mycobacterium avium subsp. paratuberculosis
gagaucgcgguggcgcccg

SEQ ID NO: 840549 - RNA, 22 nt, Mycobacterium avium subsp. paratuberculosis
gagaucgacccgcuccgacgcg

SEQ ID NO: 840550 - RNA, 21 nt, Mycobacterium avium subsp. paratuberculosis
gagaucggcgcggagcgucgc

SEQ ID NO: 840551 - RNA, 22 nt, Mycobacterium avium subsp. paratuberculosis
gagaucaccgcguagcgccgcc

SEQ ID NO: 840552 - RNA, 13 nt, Mycobacterium avium subsp. paratuberculosis
gagaucaccggca

SEQ ID NO: 840553 - RNA, 19 nt, Mycobacterium avium subsp. paratuberculosis
gagaucaccggcaccccca

SEQ ID NO: 840554 - RNA, 16 nt, Mycobacterium avium subsp. paratuberculosis
gagaucagcaccaggu

SEQ ID NO: 840555 - RNA, 19 nt, Mycobacterium avium subsp. paratuberculosis
gagaucagcaccagguggc

SEQ ID NO: 840556 - RNA, 16 nt, Mycobacterium avium subsp. paratuberculosis
gagaucagcaccgggu

SEQ ID NO: 840557 - RNA, 13 nt, Mycobacterium avium subsp. paratuberculosis
gagaucagcgcca

SEQ ID NO: 840558 - RNA, 19 nt, Mycobacterium avium subsp. paratuberculosis
gagaguuugcccucgucga

SEQ ID NO: 840559 - RNA, 21 nt, Mycobacterium avium subsp. paratuberculosis
gagaguuugcccucgucgacc

SEQ ID NO: 840560 - RNA, 15 nt, Mycobacterium avium subsp. paratuberculosis
gagagcuugccgcgg

SEQ ID NO: 840561 - RNA, 22 nt, Mycobacterium avium subsp. paratuberculosis
gagagcgucuuguuggcgaagu

SEQ ID NO: 840562 - RNA, 16 nt, Mycobacterium avium subsp. paratuberculosis
gagagcccgucgucgg

SEQ ID NO: 840563 - RNA, 21 nt, Mycobacterium avium subsp. paratuberculosis
gagagccgguagaucagcgcc

SEQ ID NO: 840564 - RNA, 22 nt, Mycobacterium avium subsp. paratuberculosis
gagagcgcgggcaccgucgucg

SEQ ID NO: 840565 - RNA, 15 nt, Mycobacterium avium subsp. paratuberculosis
gagagcgcgucgacg

SEQ ID NO: 840566 - RNA, 16 nt, Mycobacterium avium subsp. paratuberculosis
gagagcggaucggcgg

SEQ ID NO: 840567 - RNA, 16 nt, Mycobacterium avium subsp. paratuberculosis
gagagcaacaccucgg

SEQ ID NO: 840568 - RNA, 21 nt, Mycobacterium avium subsp. paratuberculosis
gagcaacagcgcuucgcgcug

SEQ ID NO: 840569 - RNA, 22 nt, Mycobacterium avium subsp. paratuberculosis
gagcaacagcgcuucgcgcugu

SEQ ID NO: 840570 - RNA, 20 nt, Mycobacterium avium subsp. paratuberculosis
gagcacacacaggucgcccg

SEQ ID NO: 840571 - RNA, 22 nt, Mycobacterium avium subsp. paratuberculosis
gagcacacacaggucgcccggc

SEQ ID NO: 840572 - RNA, 18 nt, Mycobacterium avium subsp. paratuberculosis
gagcacacccucaccccg

SEQ ID NO: 840573 - RNA, 19 nt, Mycobacterium avium subsp. paratuberculosis
gagcacacccucaccccgc

SEQ ID NO: 840574 - RNA, 15 nt, Mycobacterium avium subsp. paratuberculosis
gagcaagucggcggu

SEQ ID NO: 840575 - RNA, 17 nt, Mycobacterium avium subsp. paratuberculosis
gagcaacugggugagca

SEQ ID NO: 840576 - RNA, 15 nt, Mycobacterium avium subsp. paratuberculosis
gagcacaucggcguu

SEQ ID NO: 840577 - RNA, 22 nt, Mycobacterium avium subsp. paratuberculosis
gagcaauuaaccggcaggccgu

SEQ ID NO: 840578 - RNA, 14 nt, Mycobacterium avium subsp. paratuberculosis
gagcacagcacggc

SEQ ID NO: 840579 - RNA, 18 nt, Mycobacterium avium subsp. paratuberculosis
gagcacagcacggcaucg

SEQ ID NO: 840580 - RNA, 15 nt, Mycobacterium avium subsp. paratuberculosis
gagcacagcggcgga

SEQ ID NO: 840581 - RNA, 17 nt, Mycobacterium avium subsp. paratuberculosis
gagcaccacggcccgcg

SEQ ID NO: 840582 - RNA, 20 nt, Mycobacterium avium subsp. paratuberculosis
gagcaccagcccggccagcg

SEQ ID NO: 840583 - RNA, 22 nt, Mycobacterium avium subsp. paratuberculosis
gagcaccagcccggccagcggc

SEQ ID NO: 840584 - RNA, 11 nt, Mycobacterium avium subsp. paratuberculosis
gagcaccagcg

SEQ ID NO: 840585 - RNA, 21 nt, Mycobacterium avium subsp. paratuberculosis
gagcaccagcgucgacgcggu

SEQ ID NO: 840586 - RNA, 17 nt, Mycobacterium avium subsp. paratuberculosis
gagcaccaggcgcacca

SEQ ID NO: 840587 - RNA, 20 nt, Mycobacterium avium subsp. paratuberculosis
gagcaccaggcgcaccagcu

SEQ ID NO: 840588 - RNA, 17 nt, Mycobacterium avium subsp. paratuberculosis
gagcaccaggucguugc

SEQ ID NO: 840589 - RNA, 21 nt, Mycobacterium avium subsp. paratuberculosis
gagcacccagaaacaccaucg

SEQ ID NO: 840590 - RNA, 14 nt, Mycobacterium avium subsp. paratuberculosis
gagcaccccggcgg

SEQ ID NO: 840591 - RNA, 17 nt, Mycobacterium avium subsp. paratuberculosis
gagcaccccggcggccg

SEQ ID NO: 840592 - RNA, 18 nt, Mycobacterium avium subsp. paratuberculosis
gagcaccccggcggccgc

SEQ ID NO: 840593 - RNA, 22 nt, Mycobacterium avium subsp. paratuberculosis
gagcaccccggcggccgcgucg

SEQ ID NO: 840594 - RNA, 15 nt, Mycobacterium avium subsp. paratuberculosis
gagcacccgcccgga

SEQ ID NO: 840595 - RNA, 23 nt, Mycobacterium avium subsp. paratuberculosis
gagcacccggauggucugcagcg

SEQ ID NO: 840596 - RNA, 22 nt, Mycobacterium avium subsp. paratuberculosis
gagcacccggaugucguagacg

SEQ ID NO: 840597 - RNA, 13 nt, Mycobacterium avium subsp. paratuberculosis
gagcacccggcgg

SEQ ID NO: 840598 - RNA, 16 nt, Mycobacterium avium subsp. paratuberculosis
gagcaacaccggcacg

SEQ ID NO: 840599 - RNA, 17 nt, Mycobacterium avium subsp. paratuberculosis
gagauuggauuccagau

SEQ ID NO: 840600 - RNA, 16 nt, Mycobacterium avium subsp. paratuberculosis
gagaugcuggugacgc

SEQ ID NO: 840601 - RNA, 18 nt, Mycobacterium avium subsp. paratuberculosis
gagaugaagacccggccg

SEQ ID NO: 840602 - RNA, 19 nt, Mycobacterium avium subsp. paratuberculosis
gagaugaauucggcgaucu

SEQ ID NO: 840603 - RNA, 18 nt, Mycobacterium avium subsp. paratuberculosis
gagaugauggccgcgccg

SEQ ID NO: 840604 - RNA, 13 nt, Mycobacterium avium subsp. paratuberculosis
gagaucucggcgu

SEQ ID NO: 840605 - RNA, 16 nt, Mycobacterium avium subsp. paratuberculosis
gagaugcccacccgcu

SEQ ID NO: 840606 - RNA, 16 nt, Mycobacterium avium subsp. paratuberculosis
gagaugccccaggcga

SEQ ID NO: 840607 - RNA, 17 nt, Mycobacterium avium subsp. paratuberculosis
gagaugccgggaagcga

SEQ ID NO: 840608 - RNA, 14 nt, Mycobacterium avium subsp. paratuberculosis
gagaugcguucggc

SEQ ID NO: 840609 - RNA, 15 nt, Mycobacterium avium subsp. paratuberculosis
gagcacgucgacgcc

SEQ ID NO: 840610 - RNA, 17 nt, Mycobacterium avium subsp. paratuberculosis
gagcacgucgagcaccg

SEQ ID NO: 840611 - RNA, 16 nt, Mycobacterium avium subsp. paratuberculosis
gagcacgugggucaac

SEQ ID NO: 840612 - RNA, 18 nt, Mycobacterium avium subsp. paratuberculosis
gagcagacacaaaagcac

SEQ ID NO: 840613 - RNA, 19 nt, Mycobacterium avium subsp. paratuberculosis
gagcagacacaaaagcacc

SEQ ID NO: 840614 - RNA, 18 nt, Mycobacterium avium subsp. paratuberculosis
gagcagacacaaaagcgc

SEQ ID NO: 840615 - RNA, 20 nt, Mycobacterium avium subsp. paratuberculosis
gagcagacacaaaagcgccc

SEQ ID NO: 840616 - RNA, 21 nt, Mycobacterium avium subsp. paratuberculosis
gagcagacacaaaagcgcccg

SEQ ID NO: 840617 - RNA, 15 nt, Mycobacterium avium subsp. paratuberculosis
gagcagacccgccgc

SEQ ID NO: 840618 - RNA, 21 nt, Mycobacterium avium subsp. paratuberculosis
gagcagacccgccgcggcaac

SEQ ID NO: 840619 - RNA, 20 nt, Mycobacterium avium subsp. paratuberculosis
gagcagaccgaacccgggcg

SEQ ID NO: 840620 - RNA, 23 nt, Mycobacterium avium subsp. paratuberculosis
gagcagaccgaacccgggcgcgc

SEQ ID NO: 840621 - RNA, 18 nt, Mycobacterium avium subsp. paratuberculosis
gagcagacgcaaaaaccc

SEQ ID NO: 840622 - RNA, 17 nt, Mycobacterium avium subsp. paratuberculosis
gagcagacgcaaaagcc

SEQ ID NO: 840623 - RNA, 20 nt, Mycobacterium avium subsp. paratuberculosis
gagcagauccugcagcuggc

SEQ ID NO: 840624 - RNA, 16 nt, Mycobacterium avium subsp. paratuberculosis
gagcagaucgggucgc

SEQ ID NO: 840625 - RNA, 21 nt, Mycobacterium avium subsp. paratuberculosis
gagcagacgcgaaagcacccg

SEQ ID NO: 840626 - RNA, 24 nt, Mycobacterium avium subsp. paratuberculosis
gagcagacgcgaaagcacccgaca

SEQ ID NO: 840627 - RNA, 21 nt, Mycobacterium avium subsp. paratuberculosis
gagcagacgugaaaucccccg

SEQ ID NO: 840628 - RNA, 14 nt, Mycobacterium avium subsp. paratuberculosis
gagcagagcuacgg

SEQ ID NO: 840629 - RNA, 21 nt, Mycobacterium avium subsp. paratuberculosis
gagcagacgcaaaagccccca

SEQ ID NO: 840630 - RNA, 23 nt, Mycobacterium avium subsp. paratuberculosis
gagcagacgcaaaagccccgcga

SEQ ID NO: 840631 - RNA, 13 nt, Mycobacterium avium subsp. paratuberculosis
gagcacggugauc

SEQ ID NO: 840632 - RNA, 20 nt, Mycobacterium avium subsp. paratuberculosis
gagcagacgcgaaagcaccc

SEQ ID NO: 840633 - RNA, 17 nt, Mycobacterium avium subsp. paratuberculosis
gagcaccggcagcaccg

SEQ ID NO: 840634 - RNA, 20 nt, Mycobacterium avium subsp. paratuberculosis
gagcaccggcuggugcagca

SEQ ID NO: 840635 - RNA, 21 nt, Mycobacterium avium subsp. paratuberculosis
gagcaccggcuggugcagcag

SEQ ID NO: 840636 - RNA, 15 nt, Mycobacterium avium subsp. paratuberculosis
gagcaccgggccgaa

SEQ ID NO: 840637 - RNA, 17 nt, Mycobacterium avium subsp. paratuberculosis
gagcaccgggcgucggg

SEQ ID NO: 840638 - RNA, 21 nt, Mycobacterium avium subsp. paratuberculosis
gagcaccgugccgucggcguc

SEQ ID NO: 840639 - RNA, 22 nt, Mycobacterium avium subsp. paratuberculosis
gagcaccguugugacccgcucg

SEQ ID NO: 840640 - RNA, 14 nt, Mycobacterium avium subsp. paratuberculosis
gagcaccuccgaca

SEQ ID NO: 840641 - RNA, 14 nt, Mycobacterium avium subsp. paratuberculosis
gagcaccucgucgc

SEQ ID NO: 840642 - RNA, 22 nt, Mycobacterium avium subsp. paratuberculosis
gagcaccgcauaggaccggaug

SEQ ID NO: 840643 - RNA, 21 nt, Mycobacterium avium subsp. paratuberculosis
gagcaccgccgucccgucacg

SEQ ID NO: 840644 - RNA, 14 nt, Mycobacterium avium subsp. paratuberculosis
gagcaccgcgaaga

SEQ ID NO: 840645 - RNA, 22 nt, Mycobacterium avium subsp. paratuberculosis
gagcaccgcgaccacgccgcgg

SEQ ID NO: 840646 - RNA, 19 nt, Mycobacterium avium subsp. paratuberculosis
gagcaccgcgaccagcucg

SEQ ID NO: 840647 - RNA, 20 nt, Mycobacterium avium subsp. paratuberculosis
gagcaccgcgaccagcucgg

SEQ ID NO: 840648 - RNA, 18 nt, Mycobacterium avium subsp. paratuberculosis
gagcaccgcgaucaccga

SEQ ID NO: 840649 - RNA, 20 nt, Mycobacterium avium subsp. paratuberculosis
gagcaccgcgaucaccgaga

SEQ ID NO: 840650 - RNA, 19 nt, Mycobacterium avium subsp. paratuberculosis
gagcaccgcgaucgccgac

SEQ ID NO: 840651 - RNA, 16 nt, Mycobacterium avium subsp. paratuberculosis
gagcaccgcgcucacc

SEQ ID NO: 840652 - RNA, 15 nt, Mycobacterium avium subsp. paratuberculosis
gagcaccgcguccgc

SEQ ID NO: 840653 - RNA, 20 nt, Mycobacterium avium subsp. paratuberculosis
gagcaccgcguccgcgucgu

SEQ ID NO: 840654 - RNA, 14 nt, Mycobacterium avium subsp. paratuberculosis
gagcaccgcgucgu

SEQ ID NO: 840655 - RNA, 13 nt, Mycobacterium avium subsp. paratuberculosis
gagcacggugaac

SEQ ID NO: 840656 - RNA, 21 nt, Mycobacterium avium subsp. paratuberculosis
gagcacggugaacuccgggcc

SEQ ID NO: 840657 - RNA, 24 nt, Mycobacterium avium subsp. paratuberculosis
gagcacgcggaccuuggugucggc

SEQ ID NO: 840658 - RNA, 19 nt, Mycobacterium avium subsp. paratuberculosis
gagcacgcggccgcgccgg

SEQ ID NO: 840659 - RNA, 22 nt, Mycobacterium avium subsp. paratuberculosis
gagcacgcggccgcgccggccg

SEQ ID NO: 840660 - RNA, 20 nt, Mycobacterium avium subsp. paratuberculosis
gagcacgggaugaucggcgc

SEQ ID NO: 840661 - RNA, 16 nt, Mycobacterium avium subsp. paratuberculosis
gagcaccugcgcgacg

SEQ ID NO: 840662 - RNA, 18 nt, Mycobacterium avium subsp. paratuberculosis
gagcaccugcgcgacgcu

SEQ ID NO: 840663 - RNA, 19 nt, Mycobacterium avium subsp. paratuberculosis
gagcacgaacgcggccgcc

SEQ ID NO: 840664 - RNA, 23 nt, Mycobacterium avium subsp. paratuberculosis
gagcaccugaacggccgcgcaga

SEQ ID NO: 840665 - RNA, 20 nt, Mycobacterium avium subsp. paratuberculosis
gagcacgaaguacagcguca

SEQ ID NO: 840666 - RNA, 15 nt, Mycobacterium avium subsp. paratuberculosis
gagcacgcagccgcg

SEQ ID NO: 840667 - RNA, 22 nt, Mycobacterium avium subsp. paratuberculosis
gagcacgcagccgcgcccgaug

SEQ ID NO: 840668 - RNA, 17 nt, Mycobacterium avium subsp. paratuberculosis
gagcacgcccgcgaucg

SEQ ID NO: 840669 - RNA, 18 nt, Mycobacterium avium subsp. paratuberculosis
gagcacgcccgcgaucgg

SEQ ID NO: 840670 - RNA, 14 nt, Mycobacterium avium subsp. paratuberculosis
gagcacgccgccgg

SEQ ID NO: 840671 - RNA, 13 nt, Mycobacterium avium subsp. paratuberculosis
gccccgccggggg

SEQ ID NO: 840672 - RNA, 18 nt, Mycobacterium avium subsp. paratuberculosis
gccccgccgggguccgca

SEQ ID NO: 840673 - RNA, 19 nt, Mycobacterium avium subsp. paratuberculosis
gccccgccaggcggcgacg

SEQ ID NO: 840674 - RNA, 15 nt, Mycobacterium avium subsp. paratuberculosis
gccccgcccgcgacu

SEQ ID NO: 840675 - RNA, 19 nt, Mycobacterium avium subsp. paratuberculosis
gccccgcccgcgacugucg

SEQ ID NO: 840676 - RNA, 12 nt, Mycobacterium avium subsp. paratuberculosis
gccccgccgcgg

SEQ ID NO: 840677 - RNA, 16 nt, Mycobacterium avium subsp. paratuberculosis
gccccgccgcggccag

SEQ ID NO: 840678 - RNA, 13 nt, Mycobacterium avium subsp. paratuberculosis
gccccgcccggcg

SEQ ID NO: 840679 - RNA, 17 nt, Mycobacterium avium subsp. paratuberculosis
gccccgcccggcgcgca

SEQ ID NO: 840680 - RNA, 19 nt, Mycobacterium avium subsp. paratuberculosis
gccccgcccggcgcgcagc

SEQ ID NO: 840681 - RNA, 14 nt, Mycobacterium avium subsp. paratuberculosis
gccccgcccggcgg

SEQ ID NO: 840682 - RNA, 16 nt, Mycobacterium avium subsp. paratuberculosis
gccccgcccggcggcc

SEQ ID NO: 840683 - RNA, 13 nt, Mycobacterium avium subsp. paratuberculosis
gccccgcccgggg

SEQ ID NO: 840684 - RNA, 22 nt, Mycobacterium avium subsp. paratuberculosis
gccccgcccuugaacggcacca

SEQ ID NO: 840685 - RNA, 17 nt, Mycobacterium avium subsp. paratuberculosis
gccccgcaccgagccug

SEQ ID NO: 840686 - RNA, 13 nt, Mycobacterium avium subsp. paratuberculosis
gccccgccagcag

SEQ ID NO: 840687 - RNA, 21 nt, Mycobacterium avium subsp. paratuberculosis
gccccgccagcagaugccgcc

SEQ ID NO: 840688 - RNA, 21 nt, Mycobacterium avium subsp. paratuberculosis
gccccgcagugaaauucgcgc

SEQ ID NO: 840689 - RNA, 16 nt, Mycobacterium avium subsp. paratuberculosis
gccccgacgaucgcgc

SEQ ID NO: 840690 - RNA, 22 nt, Mycobacterium avium subsp. paratuberculosis
gccccgagcgucacgccagcgu

SEQ ID NO: 840691 - RNA, 17 nt, Mycobacterium avium subsp. paratuberculosis
gccccgaguccacgacg

SEQ ID NO: 840692 - RNA, 17 nt, Mycobacterium avium subsp. paratuberculosis
gccccgaguuccagcuc

SEQ ID NO: 840693 - RNA, 20 nt, Mycobacterium avium subsp. paratuberculosis
gccccccuugagccgguccg

SEQ ID NO: 840694 - RNA, 19 nt, Mycobacterium avium subsp. paratuberculosis
gcccccgaaaugcaucagc

SEQ ID NO: 840695 - RNA, 18 nt, Mycobacterium avium subsp. paratuberculosis
gcccccgaggagacgucg

SEQ ID NO: 840696 - RNA, 22 nt, Mycobacterium avium subsp. paratuberculosis
gcccccgaggagacgucggccg

SEQ ID NO: 840697 - RNA, 23 nt, Mycobacterium avium subsp. paratuberculosis
gcccccgauagccccgccaggcg

SEQ ID NO: 840698 - RNA, 17 nt, Mycobacterium avium subsp. paratuberculosis
gcccccgaugaacuugc

SEQ ID NO: 840699 - RNA, 13 nt, Mycobacterium avium subsp. paratuberculosis
gcccccgcagccc

SEQ ID NO: 840700 - RNA, 15 nt, Mycobacterium avium subsp. paratuberculosis
gcccccgcagcccgu

SEQ ID NO: 840701 - RNA, 21 nt, Mycobacterium avium subsp. paratuberculosis
gcccccgcccacagcgguauc

SEQ ID NO: 840702 - RNA, 12 nt, Mycobacterium avium subsp. paratuberculosis
gcccccgcccca

SEQ ID NO: 840703 - RNA, 15 nt, Mycobacterium avium subsp. paratuberculosis
gcccccgccccagcc

SEQ ID NO: 840704 - RNA, 20 nt, Mycobacterium avium subsp. paratuberculosis
gccccgacgugcagcgccag

SEQ ID NO: 840705 - RNA, 21 nt, Mycobacterium avium subsp. paratuberculosis
gccccgacgugcagcgccagc

SEQ ID NO: 840706 - RNA, 23 nt, Mycobacterium avium subsp. paratuberculosis
gccccgacgugcagcgccagcac

SEQ ID NO: 840707 - RNA, 15 nt, Mycobacterium avium subsp. paratuberculosis
gccccgagaucccag

SEQ ID NO: 840708 - RNA, 16 nt, Mycobacterium avium subsp. paratuberculosis
gccccgagaucccagc

SEQ ID NO: 840709 - RNA, 21 nt, Mycobacterium avium subsp. paratuberculosis
gccccgagcagcgggucgucg

SEQ ID NO: 840710 - RNA, 17 nt, Mycobacterium avium subsp. paratuberculosis
gccccgagccgacgaug

SEQ ID NO: 840711 - RNA, 15 nt, Mycobacterium avium subsp. paratuberculosis
aagacguugaugcga

SEQ ID NO: 840712 - RNA, 19 nt, Mycobacterium avium subsp. paratuberculosis
aagacggugggcccgccgu

SEQ ID NO: 840713 - RNA, 17 nt, Mycobacterium avium subsp. paratuberculosis
aagacguccgcgucggc

SEQ ID NO: 840714 - RNA, 16 nt, Mycobacterium avium subsp. paratuberculosis
gccccauugccgcgcc

SEQ ID NO: 840715 - RNA, 15 nt, Mycobacterium avium subsp. paratuberculosis
gcccccacgcucggc

SEQ ID NO: 840716 - RNA, 20 nt, Mycobacterium avium subsp. paratuberculosis
gcccccacgcagcggugcag

SEQ ID NO: 840717 - RNA, 22 nt, Mycobacterium avium subsp. paratuberculosis
gcccccacgcagcggugcagcc

SEQ ID NO: 840718 - RNA, 19 nt, Mycobacterium avium subsp. paratuberculosis
gccccaguuggcgucgucg

SEQ ID NO: 840719 - RNA, 22 nt, Mycobacterium avium subsp. paratuberculosis
gccccaguuggcgucgucggcg

SEQ ID NO: 840720 - RNA, 23 nt, Mycobacterium avium subsp. paratuberculosis
gccccaguuggcgucgucggcgg

SEQ ID NO: 840721 - RNA, 14 nt, Mycobacterium avium subsp. paratuberculosis
gccccaacggcgug

SEQ ID NO: 840722 - RNA, 19 nt, Mycobacterium avium subsp. paratuberculosis
gccccaacggugaucgaca

SEQ ID NO: 840723 - RNA, 19 nt, Mycobacterium avium subsp. paratuberculosis
gccccagguuccggugucg

SEQ ID NO: 840724 - RNA, 20 nt, Mycobacterium avium subsp. paratuberculosis
gccccagguuccggugucga

SEQ ID NO: 840725 - RNA, 18 nt, Mycobacterium avium subsp. paratuberculosis
gccccaaaagccuugacg

SEQ ID NO: 840726 - RNA, 14 nt, Mycobacterium avium subsp. paratuberculosis
gccccaaccccccu

SEQ ID NO: 840727 - RNA, 23 nt, Mycobacterium avium subsp. paratuberculosis
gcccaugucgaucggcucggcgc

SEQ ID NO: 840728 - RNA, 22 nt, Mycobacterium avium subsp. paratuberculosis
gcccauguccagguacgcgacg

SEQ ID NO: 840729 - RNA, 23 nt, Mycobacterium avium subsp. paratuberculosis
gcccauguccagguacgcgacgg

SEQ ID NO: 840730 - RNA, 21 nt, Mycobacterium avium subsp. paratuberculosis
gccauggcggcauccccagcu

SEQ ID NO: 840731 - RNA, 13 nt, Mycobacterium avium subsp. paratuberculosis
gccauggcggccc

SEQ ID NO: 840732 - RNA, 16 nt, Mycobacterium avium subsp. paratuberculosis
gccauggcggcccgcg

SEQ ID NO: 840733 - RNA, 17 nt, Mycobacterium avium subsp. paratuberculosis
gccauggcggcccgcgc

SEQ ID NO: 840734 - RNA, 23 nt, Mycobacterium avium subsp. paratuberculosis
gccauggcggcccgcgccggcgu

SEQ ID NO: 840735 - RNA, 14 nt, Mycobacterium avium subsp. paratuberculosis
gccaugggcaucgu

SEQ ID NO: 840736 - RNA, 22 nt, Mycobacterium avium subsp. paratuberculosis
gccauggcgcaccgcggccucg

SEQ ID NO: 840737 - RNA, 15 nt, Mycobacterium avium subsp. paratuberculosis
gccaugcgaccacga

SEQ ID NO: 840738 - RNA, 20 nt, Mycobacterium avium subsp. paratuberculosis
gccaugcgaccacgaccggg

SEQ ID NO: 840739 - RNA, 17 nt, Mycobacterium avium subsp. paratuberculosis
gccaugccucuucggcg

SEQ ID NO: 840740 - RNA, 22 nt, Mycobacterium avium subsp. paratuberculosis
gccaugccucuucggcgcgccg

SEQ ID NO: 840741 - RNA, 24 nt, Mycobacterium avium subsp. paratuberculosis
gccaugccucuucggcgcgccggc

SEQ ID NO: 840742 - RNA, 14 nt, Mycobacterium avium subsp. paratuberculosis
gccaugccgucgcg

SEQ ID NO: 840743 - RNA, 20 nt, Mycobacterium avium subsp. paratuberculosis
gccaugccggguuucggccc

SEQ ID NO: 840744 - RNA, 21 nt, Mycobacterium avium subsp. paratuberculosis
gccaugccggguuucggcccg

SEQ ID NO: 840745 - RNA, 22 nt, Mycobacterium avium subsp. paratuberculosis
gccaugccggguuucggcccgg

SEQ ID NO: 840746 - RNA, 13 nt, Mycobacterium avium subsp. paratuberculosis
gccaugccggugg

SEQ ID NO: 840747 - RNA, 12 nt, Mycobacterium avium subsp. paratuberculosis
gcccaggcgggc

SEQ ID NO: 840748 - RNA, 23 nt, Mycobacterium avium subsp. paratuberculosis
gcccaggcucaggaucagcagcc

SEQ ID NO: 840749 - RNA, 20 nt, Mycobacterium avium subsp. paratuberculosis
gcccaggcugaacaccacca

SEQ ID NO: 840750 - RNA, 23 nt, Mycobacterium avium subsp. paratuberculosis
gcccaggccggcgguggugccgc

SEQ ID NO: 840751 - RNA, 23 nt, Mycobacterium avium subsp. paratuberculosis
gcccaggccgcggucgccccggc

SEQ ID NO: 840752 - RNA, 14 nt, Mycobacterium avium subsp. paratuberculosis
gcccaggccggcga

SEQ ID NO: 840753 - RNA, 18 nt, Mycobacterium avium subsp. paratuberculosis
gcccaggccgacgccggc

SEQ ID NO: 840754 - RNA, 15 nt, Mycobacterium avium subsp. paratuberculosis
gcccaggccgagcgc

SEQ ID NO: 840755 - RNA, 16 nt, Mycobacterium avium subsp. paratuberculosis
gcccaggccgauggug

SEQ ID NO: 840756 - RNA, 17 nt, Mycobacterium avium subsp. paratuberculosis
gcccaggccgccagcuc

SEQ ID NO: 840757 - RNA, 17 nt, Mycobacterium avium subsp. paratuberculosis
gcccagugcgcgccgug

SEQ ID NO: 840758 - RNA, 13 nt, Mycobacterium avium subsp. paratuberculosis
gcccaguccaguc

SEQ ID NO: 840759 - RNA, 17 nt, Mycobacterium avium subsp. paratuberculosis
gcccaguucgcacccca

SEQ ID NO: 840760 - RNA, 19 nt, Mycobacterium avium subsp. paratuberculosis
gcccaugaacgcgucgccg

SEQ ID NO: 840761 - RNA, 22 nt, Mycobacterium avium subsp. paratuberculosis
gcccaugaacgcgucgccgugc

SEQ ID NO: 840762 - RNA, 22 nt, Mycobacterium avium subsp. paratuberculosis
gcccaugcccaugucgaucggc

SEQ ID NO: 840763 - RNA, 13 nt, Mycobacterium avium subsp. paratuberculosis
gcccaugccgcca

SEQ ID NO: 840764 - RNA, 16 nt, Mycobacterium avium subsp. paratuberculosis
gcccaguccugcagcu

SEQ ID NO: 840765 - RNA, 18 nt, Mycobacterium avium subsp. paratuberculosis
gcccaguccugcagcucg

SEQ ID NO: 840766 - RNA, 22 nt, Mycobacterium avium subsp. paratuberculosis
gcccaguccugcagcucgccgg

SEQ ID NO: 840767 - RNA, 13 nt, Mycobacterium avium subsp. paratuberculosis
gcccagucgccgc

SEQ ID NO: 840768 - RNA, 15 nt, Mycobacterium avium subsp. paratuberculosis
gcccagucgccgccg

SEQ ID NO: 840769 - RNA, 17 nt, Mycobacterium avium subsp. paratuberculosis
gcccagguucuccggcc

SEQ ID NO: 840770 - RNA, 19 nt, Mycobacterium avium subsp. paratuberculosis
gcccagguucuccggcccg

SEQ ID NO: 840771 - RNA, 19 nt, Mycobacterium avium subsp. paratuberculosis
gcccaggggagcggcggag

SEQ ID NO: 840772 - RNA, 14 nt, Mycobacterium avium subsp. paratuberculosis
gcccaggucgggac

SEQ ID NO: 840773 - RNA, 23 nt, Mycobacterium avium subsp. paratuberculosis
gcccagguauucguugcccugcc

SEQ ID NO: 840774 - RNA, 18 nt, Mycobacterium avium subsp. paratuberculosis
gcccagguccaccaggug

SEQ ID NO: 840775 - RNA, 15 nt, Mycobacterium avium subsp. paratuberculosis
gcccagguccaccgu

SEQ ID NO: 840776 - RNA, 19 nt, Mycobacterium avium subsp. paratuberculosis
gcccagguccaccguuguc

SEQ ID NO: 840777 - RNA, 16 nt, Mycobacterium avium subsp. paratuberculosis
gccauguccccgacca

SEQ ID NO: 840778 - RNA, 13 nt, Mycobacterium avium subsp. paratuberculosis
gcccagggcgugc

SEQ ID NO: 840779 - RNA, 15 nt, Mycobacterium avium subsp. paratuberculosis
gcccagggcgugcgc

SEQ ID NO: 840780 - RNA, 19 nt, Mycobacterium avium subsp. paratuberculosis
gcccagggcgugcgcggcc

SEQ ID NO: 840781 - RNA, 17 nt, Mycobacterium avium subsp. paratuberculosis
gccccgcuccuccucgc

SEQ ID NO: 840782 - RNA, 19 nt, Mycobacterium avium subsp. paratuberculosis
gccccgcuccuccucgcgc

SEQ ID NO: 840783 - RNA, 21 nt, Mycobacterium avium subsp. paratuberculosis
gccccgcuccuccucgcgccg

SEQ ID NO: 840784 - RNA, 23 nt, Mycobacterium avium subsp. paratuberculosis
gccccgcuccuccucgcgccgcc

SEQ ID NO: 840785 - RNA, 16 nt, Mycobacterium avium subsp. paratuberculosis
gccccggcaucgacau

SEQ ID NO: 840786 - RNA, 16 nt, Mycobacterium avium subsp. paratuberculosis
gccccggauccgucgc

SEQ ID NO: 840787 - RNA, 21 nt, Mycobacterium avium subsp. paratuberculosis
gccccggauccgucgccccgc

SEQ ID NO: 840788 - RNA, 22 nt, Mycobacterium avium subsp. paratuberculosis
gccccggaugaccagggugguc

SEQ ID NO: 840789 - RNA, 22 nt, Mycobacterium avium subsp. paratuberculosis
gccccgcugccggaccucgacc

SEQ ID NO: 840790 - RNA, 21 nt, Mycobacterium avium subsp. paratuberculosis
gccccgcugccguccggcggc

SEQ ID NO: 840791 - RNA, 22 nt, Mycobacterium avium subsp. paratuberculosis
gccccgcugccguccggcggca

SEQ ID NO: 840792 - RNA, 21 nt, Mycobacterium avium subsp. paratuberculosis
gcccgaaaaauaggugaccuc

SEQ ID NO: 840793 - RNA, 14 nt, Mycobacterium avium subsp. paratuberculosis
gccccuucgcgaca

SEQ ID NO: 840794 - RNA, 19 nt, Mycobacterium avium subsp. paratuberculosis
gccccggcccguccagauc

SEQ ID NO: 840795 - RNA, 17 nt, Mycobacterium avium subsp. paratuberculosis
gccccggccgagccggc

SEQ ID NO: 840796 - RNA, 19 nt, Mycobacterium avium subsp. paratuberculosis
gccccggccgagccggcgu

SEQ ID NO: 840797 - RNA, 16 nt, Mycobacterium avium subsp. paratuberculosis
gccccggccgagcgca

SEQ ID NO: 840798 - RNA, 18 nt, Mycobacterium avium subsp. paratuberculosis
gccccggccgagcgcagc

SEQ ID NO: 840799 - RNA, 15 nt, Mycobacterium avium subsp. paratuberculosis
gccccggccgcgcac

SEQ ID NO: 840800 - RNA, 19 nt, Mycobacterium avium subsp. paratuberculosis
gccccggccgcggugaccg

SEQ ID NO: 840801 - RNA, 12 nt, Mycobacterium avium subsp. paratuberculosis
gccccggccggc

SEQ ID NO: 840802 - RNA, 14 nt, Mycobacterium avium subsp. paratuberculosis
gccccuucgauguc

SEQ ID NO: 840803 - RNA, 20 nt, Mycobacterium avium subsp. paratuberculosis
gccccuucgaugucgccggc

SEQ ID NO: 840804 - RNA, 14 nt, Mycobacterium avium subsp. paratuberculosis
gcccgaacgcgcgu

SEQ ID NO: 840805 - RNA, 15 nt, Mycobacterium avium subsp. paratuberculosis
gcccgaacgcgcguc

SEQ ID NO: 840806 - RNA, 16 nt, Mycobacterium avium subsp. paratuberculosis
gcccgaacgcgcgucg

SEQ ID NO: 840807 - RNA, 17 nt, Mycobacterium avium subsp. paratuberculosis
gcccgaacgcgcgucgg

SEQ ID NO: 840808 - RNA, 23 nt, Mycobacterium avium subsp. paratuberculosis
gcccgaacucauggcgugcucgg

SEQ ID NO: 840809 - RNA, 14 nt, Mycobacterium avium subsp. paratuberculosis
gcccgaacagccgg

SEQ ID NO: 840810 - RNA, 17 nt, Mycobacterium avium subsp. paratuberculosis
gcccgaacagccgggcc

SEQ ID NO: 840811 - RNA, 18 nt, Mycobacterium avium subsp. paratuberculosis
gcccgaacagccgggcca

SEQ ID NO: 840812 - RNA, 23 nt, Mycobacterium avium subsp. paratuberculosis
gcccgaacagccgggccagcagc

SEQ ID NO: 840813 - RNA, 19 nt, Mycobacterium avium subsp. paratuberculosis
gcccgaacagccgggcggc

SEQ ID NO: 840814 - RNA, 23 nt, Mycobacterium avium subsp. paratuberculosis
gcccgaacaucgccucggccgcg

SEQ ID NO: 840815 - RNA, 20 nt, Mycobacterium avium subsp. paratuberculosis
gcccgaaaguccccgggugg

SEQ ID NO: 840816 - RNA, 18 nt, Mycobacterium avium subsp. paratuberculosis
gcccgaacaccuccucgg

SEQ ID NO: 840817 - RNA, 16 nt, Mycobacterium avium subsp. paratuberculosis
gcccgaacacgggcgg

SEQ ID NO: 840818 - RNA, 19 nt, Mycobacterium avium subsp. paratuberculosis
gcccgaacacgggcggcag

SEQ ID NO: 840819 - RNA, 15 nt, Mycobacterium avium subsp. paratuberculosis
gcccgaaccgcgucc

SEQ ID NO: 840820 - RNA, 16 nt, Mycobacterium avium subsp. paratuberculosis
gcccgaaccgcgucca

SEQ ID NO: 840821 - RNA, 18 nt, Mycobacterium avium subsp. paratuberculosis
gcccgaaccgcguccacg

SEQ ID NO: 840822 - RNA, 14 nt, Mycobacterium avium subsp. paratuberculosis
gcccgacgacgacg

SEQ ID NO: 840823 - RNA, 17 nt, Mycobacterium avium subsp. paratuberculosis
gcccgacgacgacgucg

SEQ ID NO: 840824 - RNA, 19 nt, Mycobacterium avium subsp. paratuberculosis
gcccgacgacgacgucgac

SEQ ID NO: 840825 - RNA, 20 nt, Mycobacterium avium subsp. paratuberculosis
gcccgacgacgacgucgacg

SEQ ID NO: 840826 - RNA, 14 nt, Mycobacterium avium subsp. paratuberculosis
gcccgacgacgauc

SEQ ID NO: 840827 - RNA, 14 nt, Mycobacterium avium subsp. paratuberculosis
gcccgacgacgccg

SEQ ID NO: 840828 - RNA, 17 nt, Mycobacterium avium subsp. paratuberculosis
gcccgacgacgccguca

SEQ ID NO: 840829 - RNA, 12 nt, Mycobacterium avium subsp. paratuberculosis
gcccgacgccgg

SEQ ID NO: 840830 - RNA, 15 nt, Mycobacterium avium subsp. paratuberculosis
gcccgacgccggacc

SEQ ID NO: 840831 - RNA, 20 nt, Mycobacterium avium subsp. paratuberculosis
gcccgacgccggaccccaca

SEQ ID NO: 840832 - RNA, 11 nt, Mycobacterium avium subsp. paratuberculosis
gcccgacgaug

SEQ ID NO: 840833 - RNA, 19 nt, Mycobacterium avium subsp. paratuberculosis
gcccgacgaugcggggcgg

SEQ ID NO: 840834 - RNA, 13 nt, Mycobacterium avium subsp. paratuberculosis
gcccgacggcguc

SEQ ID NO: 840835 - RNA, 20 nt, Mycobacterium avium subsp. paratuberculosis
gcccgacgggcgugccggcg

SEQ ID NO: 840836 - RNA, 19 nt, Mycobacterium avium subsp. paratuberculosis
gcccgacggguucgcgcag

SEQ ID NO: 840837 - RNA, 22 nt, Mycobacterium avium subsp. paratuberculosis
gcccgacuccucacaccucgcu

SEQ ID NO: 840838 - RNA, 15 nt, Mycobacterium avium subsp. paratuberculosis
gcccgacggcgcgcc

SEQ ID NO: 840839 - RNA, 17 nt, Mycobacterium avium subsp. paratuberculosis
gcccgacggauucccga

SEQ ID NO: 840840 - RNA, 15 nt, Mycobacterium avium subsp. paratuberculosis
gcccgacggcagcac

SEQ ID NO: 840841 - RNA, 16 nt, Mycobacterium avium subsp. paratuberculosis
gcccgacggcagcacc

SEQ ID NO: 840842 - RNA, 17 nt, Mycobacterium avium subsp. paratuberculosis
gcccgacggcagcaccg

SEQ ID NO: 840843 - RNA, 13 nt, Mycobacterium avium subsp. paratuberculosis
gcccgaccagcgg

SEQ ID NO: 840844 - RNA, 22 nt, Mycobacterium avium subsp. paratuberculosis
gcccgaccaccuccccgcggug

SEQ ID NO: 840845 - RNA, 23 nt, Mycobacterium avium subsp. paratuberculosis
gcccgaccaccuccccgcggugc

SEQ ID NO: 840846 - RNA, 24 nt, Mycobacterium avium subsp. paratuberculosis
gcccgacauccaggaccgcgcgcc

SEQ ID NO: 840847 - RNA, 18 nt, Mycobacterium avium subsp. paratuberculosis
gcccgacaucugccgggc

SEQ ID NO: 840848 - RNA, 21 nt, Mycobacterium avium subsp. paratuberculosis
gcccgacaucugccgggcggc

SEQ ID NO: 840849 - RNA, 22 nt, Mycobacterium avium subsp. paratuberculosis
gcccgacaucugccgggcggcg

SEQ ID NO: 840850 - RNA, 12 nt, Mycobacterium avium subsp. paratuberculosis
gcccgacccggc

SEQ ID NO: 840851 - RNA, 19 nt, Mycobacterium avium subsp. paratuberculosis
gcccgacccggucagcucg

SEQ ID NO: 840852 - RNA, 12 nt, Mycobacterium avium subsp. paratuberculosis
gcccgaccgcgc

SEQ ID NO: 840853 - RNA, 13 nt, Mycobacterium avium subsp. paratuberculosis
gcccgaccgcgcc

SEQ ID NO: 840854 - RNA, 14 nt, Mycobacterium avium subsp. paratuberculosis
gcccgaccgcgccg

SEQ ID NO: 840855 - RNA, 17 nt, Mycobacterium avium subsp. paratuberculosis
gcccgacaccgccccgc

SEQ ID NO: 840856 - RNA, 18 nt, Mycobacterium avium subsp. paratuberculosis
gcccgacaccgccccgcc

SEQ ID NO: 840857 - RNA, 24 nt, Mycobacterium avium subsp. paratuberculosis
gcccgacaccgccccgccgcgccg

SEQ ID NO: 840858 - RNA, 23 nt, Mycobacterium avium subsp. paratuberculosis
gcccgaagcugagguggccuccc

SEQ ID NO: 840859 - RNA, 17 nt, Mycobacterium avium subsp. paratuberculosis
gcccgaauugcgcugca

SEQ ID NO: 840860 - RNA, 14 nt, Mycobacterium avium subsp. paratuberculosis
gcccgagcggcauc

SEQ ID NO: 840861 - RNA, 15 nt, Mycobacterium avium subsp. paratuberculosis
gcccgagcggcauca

SEQ ID NO: 840862 - RNA, 22 nt, Mycobacterium avium subsp. paratuberculosis
gcccgagcggcgacuccagcag

SEQ ID NO: 840863 - RNA, 16 nt, Mycobacterium avium subsp. paratuberculosis
gcccgagcccgacggc

SEQ ID NO: 840864 - RNA, 20 nt, Mycobacterium avium subsp. paratuberculosis
gcccgagcccgacggcagca

SEQ ID NO: 840865 - RNA, 22 nt, Mycobacterium avium subsp. paratuberculosis
gcccgagcccgacggcagcacc

SEQ ID NO: 840866 - RNA, 22 nt, Mycobacterium avium subsp. paratuberculosis
gcccgagcccugcgccagcagc

SEQ ID NO: 840867 - RNA, 20 nt, Mycobacterium avium subsp. paratuberculosis
gcccgagaguccgccgccgg

SEQ ID NO: 840868 - RNA, 22 nt, Mycobacterium avium subsp. paratuberculosis
gcccgagaguccgccgccgggc

SEQ ID NO: 840869 - RNA, 14 nt, Mycobacterium avium subsp. paratuberculosis
gcccgagcaccacc

SEQ ID NO: 840870 - RNA, 16 nt, Mycobacterium avium subsp. paratuberculosis
gcccgcaccugcgcgc

SEQ ID NO: 840871 - RNA, 17 nt, Mycobacterium avium subsp. paratuberculosis
gcccgcaccugcgcgcc

SEQ ID NO: 840872 - RNA, 21 nt, Mycobacterium avium subsp. paratuberculosis
gcccgcaccugcgcgccguug

SEQ ID NO: 840873 - RNA, 12 nt, Mycobacterium avium subsp. paratuberculosis
gcccgcacccgc

SEQ ID NO: 840874 - RNA, 19 nt, Mycobacterium avium subsp. paratuberculosis
gcccgcacccgccgcccga

SEQ ID NO: 840875 - RNA, 22 nt, Mycobacterium avium subsp. paratuberculosis
gcccgcacccuugacuaccgcg

SEQ ID NO: 840876 - RNA, 16 nt, Mycobacterium avium subsp. paratuberculosis
gcccgcaccacccagc

SEQ ID NO: 840877 - RNA, 18 nt, Mycobacterium avium subsp. paratuberculosis
gcccgagcugaucgcggc

SEQ ID NO: 840878 - RNA, 13 nt, Mycobacterium avium subsp. paratuberculosis
gcccgccagcaug

SEQ ID NO: 840879 - RNA, 14 nt, Mycobacterium avium subsp. paratuberculosis
gcccgccacgugcg

SEQ ID NO: 840880 - RNA, 15 nt, Mycobacterium avium subsp. paratuberculosis
gcccgccacgugcgg

SEQ ID NO: 840881 - RNA, 16 nt, Mycobacterium avium subsp. paratuberculosis
gcccgccacggccagc

SEQ ID NO: 840882 - RNA, 17 nt, Mycobacterium avium subsp. paratuberculosis
gcccgccacggccagca

SEQ ID NO: 840883 - RNA, 22 nt, Mycobacterium avium subsp. paratuberculosis
gcccgccacggccagcaccgcc

SEQ ID NO: 840884 - RNA, 12 nt, Mycobacterium avium subsp. paratuberculosis
gcccgccagauc

SEQ ID NO: 840885 - RNA, 11 nt, Mycobacterium avium subsp. paratuberculosis
gcccgccaccc

SEQ ID NO: 840886 - RNA, 18 nt, Mycobacterium avium subsp. paratuberculosis
gcccgccacccgaggccg

SEQ ID NO: 840887 - RNA, 13 nt, Mycobacterium avium subsp. paratuberculosis
gcccgcagccgcu

SEQ ID NO: 840888 - RNA, 17 nt, Mycobacterium avium subsp. paratuberculosis
gcccgcagccgcuggcc

SEQ ID NO: 840889 - RNA, 14 nt, Mycobacterium avium subsp. paratuberculosis
gcccgcagcgcauc

SEQ ID NO: 840890 - RNA, 17 nt, Mycobacterium avium subsp. paratuberculosis
gcccgcagcgcaucggu

SEQ ID NO: 840891 - RNA, 14 nt, Mycobacterium avium subsp. paratuberculosis
gcccgcagccagcg

SEQ ID NO: 840892 - RNA, 21 nt, Mycobacterium avium subsp. paratuberculosis
gcccgcacguagacggugucg

SEQ ID NO: 840893 - RNA, 13 nt, Mycobacterium avium subsp. paratuberculosis
gcccgcacggccg

SEQ ID NO: 840894 - RNA, 15 nt, Mycobacterium avium subsp. paratuberculosis
gcccgcacggccgcc

SEQ ID NO: 840895 - RNA, 17 nt, Mycobacterium avium subsp. paratuberculosis
gcccgcacggccgccag

SEQ ID NO: 840896 - RNA, 21 nt, Mycobacterium avium subsp. paratuberculosis
gcccgcacuggucgugcugga

SEQ ID NO: 840897 - RNA, 13 nt, Mycobacterium avium subsp. paratuberculosis
gcccgcagcacgc

SEQ ID NO: 840898 - RNA, 21 nt, Mycobacterium avium subsp. paratuberculosis
gcccgcagcacgcccguagcg

SEQ ID NO: 840899 - RNA, 12 nt, Mycobacterium avium subsp. paratuberculosis
gcccgcagcauc

SEQ ID NO: 840900 - RNA, 13 nt, Mycobacterium avium subsp. paratuberculosis
gcccgcccggccc

SEQ ID NO: 840901 - RNA, 14 nt, Mycobacterium avium subsp. paratuberculosis
gcccgcccggcccg

SEQ ID NO: 840902 - RNA, 15 nt, Mycobacterium avium subsp. paratuberculosis
gcccgcccggcccgg

SEQ ID NO: 840903 - RNA, 20 nt, Mycobacterium avium subsp. paratuberculosis
gcccgcccggcccggcgcgg

SEQ ID NO: 840904 - RNA, 18 nt, Mycobacterium avium subsp. paratuberculosis
gcccgcccggcggcgcug

SEQ ID NO: 840905 - RNA, 21 nt, Mycobacterium avium subsp. paratuberculosis
gcccgcccuugucgauccggu

SEQ ID NO: 840906 - RNA, 18 nt, Mycobacterium avium subsp. paratuberculosis
gcccgccgaacaccggca

SEQ ID NO: 840907 - RNA, 19 nt, Mycobacterium avium subsp. paratuberculosis
gcccgccgaacaccggcag

SEQ ID NO: 840908 - RNA, 20 nt, Mycobacterium avium subsp. paratuberculosis
gcccgccgaacaccggcagc

SEQ ID NO: 840909 - RNA, 21 nt, Mycobacterium avium subsp. paratuberculosis
gcccgccgaacaccggcagcg

SEQ ID NO: 840910 - RNA, 12 nt, Mycobacterium avium subsp. paratuberculosis
gcccgcccggca

SEQ ID NO: 840911 - RNA, 13 nt, Mycobacterium avium subsp. paratuberculosis
gcccgcccgagag

SEQ ID NO: 840912 - RNA, 15 nt, Mycobacterium avium subsp. paratuberculosis
gcccgcccgagcguc

SEQ ID NO: 840913 - RNA, 12 nt, Mycobacterium avium subsp. paratuberculosis
gcccgccgccgg

SEQ ID NO: 840914 - RNA, 15 nt, Mycobacterium avium subsp. paratuberculosis
gcccgccgccggcgc

SEQ ID NO: 840915 - RNA, 11 nt, Mycobacterium avium subsp. paratuberculosis
gcccgccgccu

SEQ ID NO: 840916 - RNA, 16 nt, Mycobacterium avium subsp. paratuberculosis
gcccgccgccucaccg

SEQ ID NO: 840917 - RNA, 18 nt, Mycobacterium avium subsp. paratuberculosis
gcccgccgauggacacgc

SEQ ID NO: 840918 - RNA, 20 nt, Mycobacterium avium subsp. paratuberculosis
gcccgccgauggacacgcug

SEQ ID NO: 840919 - RNA, 23 nt, Mycobacterium avium subsp. paratuberculosis
gcccgccgauggacacgcugccg

SEQ ID NO: 840920 - RNA, 17 nt, Mycobacterium avium subsp. paratuberculosis
gcccgccgcaacgcgua

SEQ ID NO: 840921 - RNA, 14 nt, Mycobacterium avium subsp. paratuberculosis
gcccgccgacgccc

SEQ ID NO: 840922 - RNA, 13 nt, Mycobacterium avium subsp. paratuberculosis
gcccgccgacggc

SEQ ID NO: 840923 - RNA, 18 nt, Mycobacterium avium subsp. paratuberculosis
gcccgccgacggcugccc

SEQ ID NO: 840924 - RNA, 16 nt, Mycobacterium avium subsp. paratuberculosis
gcccgccgccaccacg

SEQ ID NO: 840925 - RNA, 14 nt, Mycobacterium avium subsp. paratuberculosis
gcccgcccggcacg

SEQ ID NO: 840926 - RNA, 19 nt, Mycobacterium avium subsp. paratuberculosis
gcccgcccuuggccgcgga

SEQ ID NO: 840927 - RNA, 17 nt, Mycobacterium avium subsp. paratuberculosis
gcccgccgaaccagauc

SEQ ID NO: 840928 - RNA, 21 nt, Mycobacterium avium subsp. paratuberculosis
gcccgccgaaccagaucggcg

SEQ ID NO: 840929 - RNA, 14 nt, Mycobacterium avium subsp. paratuberculosis
gcccgccucacagc

SEQ ID NO: 840930 - RNA, 18 nt, Mycobacterium avium subsp. paratuberculosis
gcccgccucacagcgaca

SEQ ID NO: 840931 - RNA, 18 nt, Mycobacterium avium subsp. paratuberculosis
gcccgccguagcgccggc

SEQ ID NO: 840932 - RNA, 15 nt, Mycobacterium avium subsp. paratuberculosis
gcccgccgucgacca

SEQ ID NO: 840933 - RNA, 18 nt, Mycobacterium avium subsp. paratuberculosis
gcccgccgucgaccacga

SEQ ID NO: 840934 - RNA, 23 nt, Mycobacterium avium subsp. paratuberculosis
gcccgccgucgaccacgaagggc

SEQ ID NO: 840935 - RNA, 22 nt, Mycobacterium avium subsp. paratuberculosis
gcccgccgucggcauccacccg

SEQ ID NO: 840936 - RNA, 17 nt, Mycobacterium avium subsp. paratuberculosis
gcccgccgcucaccgcc

SEQ ID NO: 840937 - RNA, 18 nt, Mycobacterium avium subsp. paratuberculosis
gcccgccgcucaccgccg

SEQ ID NO: 840938 - RNA, 19 nt, Mycobacterium avium subsp. paratuberculosis
gcccgccgcucaccgccga

SEQ ID NO: 840939 - RNA, 17 nt, Mycobacterium avium subsp. paratuberculosis
gcccgccgcugacgcgg

SEQ ID NO: 840940 - RNA, 16 nt, Mycobacterium avium subsp. paratuberculosis
gcccgccgcggccgcu

SEQ ID NO: 840941 - RNA, 20 nt, Mycobacterium avium subsp. paratuberculosis
gcccgccgcggccgcuggcg

SEQ ID NO: 840942 - RNA, 15 nt, Mycobacterium avium subsp. paratuberculosis
gcccgccgcggcgac

SEQ ID NO: 840943 - RNA, 20 nt, Mycobacterium avium subsp. paratuberculosis
gcccgccgcguacagcagcu

SEQ ID NO: 840944 - RNA, 15 nt, Mycobacterium avium subsp. paratuberculosis
gcccgccgcgucagc

SEQ ID NO: 840945 - RNA, 18 nt, Mycobacterium avium subsp. paratuberculosis
gcccgccgcgucagcggc

SEQ ID NO: 840946 - RNA, 15 nt, Mycobacterium avium subsp. paratuberculosis
gcccgccgcgcccgg

SEQ ID NO: 840947 - RNA, 12 nt, Mycobacterium avium subsp. paratuberculosis
gcccgccgcgac

SEQ ID NO: 840948 - RNA, 15 nt, Mycobacterium avium subsp. paratuberculosis
gcccgccgcgagccg

SEQ ID NO: 840949 - RNA, 15 nt, Mycobacterium avium subsp. paratuberculosis
gcccgccgccgaugc

SEQ ID NO: 840950 - RNA, 16 nt, Mycobacterium avium subsp. paratuberculosis
gcccgccgcgaccgcg

SEQ ID NO: 840951 - RNA, 13 nt, Mycobacterium avium subsp. paratuberculosis
gcccgccgcgacg

SEQ ID NO: 840952 - RNA, 14 nt, Mycobacterium avium subsp. paratuberculosis
gcccgccgcgacgg

SEQ ID NO: 840953 - RNA, 16 nt, Mycobacterium avium subsp. paratuberculosis
gcccgccgcgacgggu

SEQ ID NO: 840954 - RNA, 13 nt, Mycobacterium avium subsp. paratuberculosis
gcccgccgcgagc

SEQ ID NO: 840955 - RNA, 24 nt, Mycobacterium avium subsp. paratuberculosis
gcccggaucgucuugcggcccaac

SEQ ID NO: 840956 - RNA, 15 nt, Mycobacterium avium subsp. paratuberculosis
gcccggaugccggcg

SEQ ID NO: 840957 - RNA, 16 nt, Mycobacterium avium subsp. paratuberculosis
gcccggaugccggcgc

SEQ ID NO: 840958 - RNA, 19 nt, Mycobacterium avium subsp. paratuberculosis
gcccggaugccggcgccca

SEQ ID NO: 840959 - RNA, 20 nt, Mycobacterium avium subsp. paratuberculosis
gcccggaugccggcgcccag

SEQ ID NO: 840960 - RNA, 19 nt, Mycobacterium avium subsp. paratuberculosis
gcccggaucagcugaccgg

SEQ ID NO: 840961 - RNA, 20 nt, Mycobacterium avium subsp. paratuberculosis
gcccggaucagcugaccggc

SEQ ID NO: 840962 - RNA, 19 nt, Mycobacterium avium subsp. paratuberculosis
gcccggcaccgcggcggug

SEQ ID NO: 840963 - RNA, 17 nt, Mycobacterium avium subsp. paratuberculosis
gcccggcaccggugcgg

SEQ ID NO: 840964 - RNA, 15 nt, Mycobacterium avium subsp. paratuberculosis
gcccggcacgaacgc

SEQ ID NO: 840965 - RNA, 22 nt, Mycobacterium avium subsp. paratuberculosis
gcccggcaaccgaaucgagccg

SEQ ID NO: 840966 - RNA, 13 nt, Mycobacterium avium subsp. paratuberculosis
gcccggcaacacg

SEQ ID NO: 840967 - RNA, 23 nt, Mycobacterium avium subsp. paratuberculosis
gcccggcaacacguagucgccga

SEQ ID NO: 840968 - RNA, 13 nt, Mycobacterium avium subsp. paratuberculosis
gcccggauggccg

SEQ ID NO: 840969 - RNA, 15 nt, Mycobacterium avium subsp. paratuberculosis
gcccggaugucgggc

SEQ ID NO: 840970 - RNA, 16 nt, Mycobacterium avium subsp. paratuberculosis
gcccggaugucgggcg

SEQ ID NO: 840971 - RNA, 18 nt, Mycobacterium avium subsp. paratuberculosis
gcccggacggagccgugc

SEQ ID NO: 840972 - RNA, 15 nt, Mycobacterium avium subsp. paratuberculosis
gcccggacaccccgu

SEQ ID NO: 840973 - RNA, 16 nt, Mycobacterium avium subsp. paratuberculosis
gcccggacaccccgua

SEQ ID NO: 840974 - RNA, 15 nt, Mycobacterium avium subsp. paratuberculosis
gcccggagaaaccgu

SEQ ID NO: 840975 - RNA, 19 nt, Mycobacterium avium subsp. paratuberculosis
gcccggagaaaccgucggc

SEQ ID NO: 840976 - RNA, 20 nt, Mycobacterium avium subsp. paratuberculosis
gcccggagaaaccgucggcc

SEQ ID NO: 840977 - RNA, 22 nt, Mycobacterium avium subsp. paratuberculosis
gcccggagaaaccgucggcccg

SEQ ID NO: 840978 - RNA, 22 nt, Mycobacterium avium subsp. paratuberculosis
gcccggagaacuccuugagcuc

SEQ ID NO: 840979 - RNA, 16 nt, Mycobacterium avium subsp. paratuberculosis
gcccggagcugucggu

SEQ ID NO: 840980 - RNA, 18 nt, Mycobacterium avium subsp. paratuberculosis
gcccggagcugucgguga

SEQ ID NO: 840981 - RNA, 14 nt, Mycobacterium avium subsp. paratuberculosis
gcccggcagccgcu

SEQ ID NO: 840982 - RNA, 17 nt, Mycobacterium avium subsp. paratuberculosis
gcccggcagccgcuccg

SEQ ID NO: 840983 - RNA, 14 nt, Mycobacterium avium subsp. paratuberculosis
gcccggcagccggg

SEQ ID NO: 840984 - RNA, 18 nt, Mycobacterium avium subsp. paratuberculosis
gcccggccacucgccgcg

SEQ ID NO: 840985 - RNA, 19 nt, Mycobacterium avium subsp. paratuberculosis
gcccggccacucgccgcga

SEQ ID NO: 840986 - RNA, 12 nt, Mycobacterium avium subsp. paratuberculosis
gcccggccagca

SEQ ID NO: 840987 - RNA, 13 nt, Mycobacterium avium subsp. paratuberculosis
gcccggccaccug

SEQ ID NO: 840988 - RNA, 23 nt, Mycobacterium avium subsp. paratuberculosis
gcccggccaacgggaagagcggc

SEQ ID NO: 840989 - RNA, 14 nt, Mycobacterium avium subsp. paratuberculosis
gcccggccagccgg

SEQ ID NO: 840990 - RNA, 21 nt, Mycobacterium avium subsp. paratuberculosis
gcccggccagccggccgcuga

SEQ ID NO: 840991 - RNA, 13 nt, Mycobacterium avium subsp. paratuberculosis
gcccggccagcgg

SEQ ID NO: 840992 - RNA, 14 nt, Mycobacterium avium subsp. paratuberculosis
gcccggccagcggc

SEQ ID NO: 840993 - RNA, 15 nt, Mycobacterium avium subsp. paratuberculosis
gcccggccagcggca

SEQ ID NO: 840994 - RNA, 17 nt, Mycobacterium avium subsp. paratuberculosis
gcccggccagcacccgc

SEQ ID NO: 840995 - RNA, 13 nt, Mycobacterium avium subsp. paratuberculosis
gcccggccagccg

SEQ ID NO: 840996 - RNA, 15 nt, Mycobacterium avium subsp. paratuberculosis
gcccggaaucgucgg

SEQ ID NO: 840997 - RNA, 17 nt, Mycobacterium avium subsp. paratuberculosis
gcccggaaucgucggcc

SEQ ID NO: 840998 - RNA, 19 nt, Mycobacterium avium subsp. paratuberculosis
gcccggaaucgucggccac

SEQ ID NO: 840999 - RNA, 21 nt, Mycobacterium avium subsp. paratuberculosis
gcccggaaucgucggccacgc

SEQ ID NO: 841000 - RNA, 13 nt, Mycobacterium avium subsp. paratuberculosis
gcccggaccaggg

SEQ ID NO: 841001 - RNA, 17 nt, Mycobacterium avium subsp. paratuberculosis
gcccggaccaggguggc

SEQ ID NO: 841002 - RNA, 19 nt, Mycobacterium avium subsp. paratuberculosis
gcccggaccaggguggccc

SEQ ID NO: 841003 - RNA, 14 nt, Mycobacterium avium subsp. paratuberculosis
gcccggacccgcuc

SEQ ID NO: 841004 - RNA, 19 nt, Mycobacterium avium subsp. paratuberculosis
gcccggacccgcucgccga

SEQ ID NO: 841005 - RNA, 14 nt, Mycobacterium avium subsp. paratuberculosis
gcccggaccgccgc

SEQ ID NO: 841006 - RNA, 16 nt, Mycobacterium avium subsp. paratuberculosis
gcccggaccgccgcgg

SEQ ID NO: 841007 - RNA, 17 nt, Mycobacterium avium subsp. paratuberculosis
gcccggaccgccgcggc

SEQ ID NO: 841008 - RNA, 14 nt, Mycobacterium avium subsp. paratuberculosis
gcccggaccggccg

SEQ ID NO: 841009 - RNA, 15 nt, Mycobacterium avium subsp. paratuberculosis
gcccggaccggccgu

SEQ ID NO: 841010 - RNA, 13 nt, Mycobacterium avium subsp. paratuberculosis
gcccggaccggcu

SEQ ID NO: 841011 - RNA, 14 nt, Mycobacterium avium subsp. paratuberculosis
gcccggaccggcuc

SEQ ID NO: 841012 - RNA, 16 nt, Mycobacterium avium subsp. paratuberculosis
gcccggaacgcgucgc

SEQ ID NO: 841013 - RNA, 14 nt, Mycobacterium avium subsp. paratuberculosis
gcccgcuugccgac

SEQ ID NO: 841014 - RNA, 18 nt, Mycobacterium avium subsp. paratuberculosis
gcccggaaaaccccaccc

SEQ ID NO: 841015 - RNA, 17 nt, Mycobacterium avium subsp. paratuberculosis
gcccggaaagcgcgggc

SEQ ID NO: 841016 - RNA, 15 nt, Mycobacterium avium subsp. paratuberculosis
gcccgcuugauggcg

SEQ ID NO: 841017 - RNA, 14 nt, Mycobacterium avium subsp. paratuberculosis
gcccgcuggccgcc

SEQ ID NO: 841018 - RNA, 15 nt, Mycobacterium avium subsp. paratuberculosis
gcccgcuggccgccg

SEQ ID NO: 841019 - RNA, 15 nt, Mycobacterium avium subsp. paratuberculosis
gcccgcugcggcugg

SEQ ID NO: 841020 - RNA, 19 nt, Mycobacterium avium subsp. paratuberculosis
gcccgcuggggcgcaccgc

SEQ ID NO: 841021 - RNA, 20 nt, Mycobacterium avium subsp. paratuberculosis
gcccgcuggggcgcaccgcc

SEQ ID NO: 841022 - RNA, 21 nt, Mycobacterium avium subsp. paratuberculosis
gcccgcuggggcgcaccgccu

SEQ ID NO: 841023 - RNA, 22 nt, Mycobacterium avium subsp. paratuberculosis
gcccgcuggggcgcaccgccug

SEQ ID NO: 841024 - RNA, 19 nt, Mycobacterium avium subsp. paratuberculosis
gcccgcuucaggcagcgca

SEQ ID NO: 841025 - RNA, 22 nt, Mycobacterium avium subsp. paratuberculosis
gcccgcuucaggcagcgcacga

SEQ ID NO: 841026 - RNA, 16 nt, Mycobacterium avium subsp. paratuberculosis
gcccgcgccgcgucgu

SEQ ID NO: 841027 - RNA, 14 nt, Mycobacterium avium subsp. paratuberculosis
gcccgcugcgccga

SEQ ID NO: 841028 - RNA, 18 nt, Mycobacterium avium subsp. paratuberculosis
gcccgcugcggcgcaggu

SEQ ID NO: 841029 - RNA, 16 nt, Mycobacterium avium subsp. paratuberculosis
gcccgcugcgcggccg

SEQ ID NO: 841030 - RNA, 14 nt, Mycobacterium avium subsp. paratuberculosis
gcccgcugcgcggg

SEQ ID NO: 841031 - RNA, 18 nt, Mycobacterium avium subsp. paratuberculosis
gcccgcugcgcgggucgg

SEQ ID NO: 841032 - RNA, 20 nt, Mycobacterium avium subsp. paratuberculosis
gcccgcugcgcgggucggcg

SEQ ID NO: 841033 - RNA, 12 nt, Mycobacterium avium subsp. paratuberculosis
gcccgcgccgcg

SEQ ID NO: 841034 - RNA, 13 nt, Mycobacterium avium subsp. paratuberculosis
gcccgcgccgacc

SEQ ID NO: 841035 - RNA, 15 nt, Mycobacterium avium subsp. paratuberculosis
gcccgcgccgacggc

SEQ ID NO: 841036 - RNA, 19 nt, Mycobacterium avium subsp. paratuberculosis
gcccgcgccgacggccgcg

SEQ ID NO: 841037 - RNA, 15 nt, Mycobacterium avium subsp. paratuberculosis
gcccgcgcccaccug

SEQ ID NO: 841038 - RNA, 17 nt, Mycobacterium avium subsp. paratuberculosis
gcccgcgcccaccugga

SEQ ID NO: 841039 - RNA, 16 nt, Mycobacterium avium subsp. paratuberculosis
gcccgcgccccggccu

SEQ ID NO: 841040 - RNA, 16 nt, Mycobacterium avium subsp. paratuberculosis
gcccgcgccccggcgg

SEQ ID NO: 841041 - RNA, 17 nt, Mycobacterium avium subsp. paratuberculosis
gcccgcgccccggcggc

SEQ ID NO: 841042 - RNA, 18 nt, Mycobacterium avium subsp. paratuberculosis
gcccgcgccccggcggcc

SEQ ID NO: 841043 - RNA, 13 nt, Mycobacterium avium subsp. paratuberculosis
gcccgcgcccgcu

SEQ ID NO: 841044 - RNA, 20 nt, Mycobacterium avium subsp. paratuberculosis
gcccgcgccagcucggcggc

SEQ ID NO: 841045 - RNA, 14 nt, Mycobacterium avium subsp. paratuberculosis
gcccgcgccacccc

SEQ ID NO: 841046 - RNA, 17 nt, Mycobacterium avium subsp. paratuberculosis
gcccgcgccaccccgag

SEQ ID NO: 841047 - RNA, 15 nt, Mycobacterium avium subsp. paratuberculosis
gcccgcgcaggcccc

SEQ ID NO: 841048 - RNA, 16 nt, Mycobacterium avium subsp. paratuberculosis
gcccgcgcaucccguc

SEQ ID NO: 841049 - RNA, 17 nt, Mycobacterium avium subsp. paratuberculosis
gcccgcgcaucccgucg

SEQ ID NO: 841050 - RNA, 21 nt, Mycobacterium avium subsp. paratuberculosis
gcccgcgcaucccgucgacca

SEQ ID NO: 841051 - RNA, 15 nt, Mycobacterium avium subsp. paratuberculosis
gcccgcgcaccgcga

SEQ ID NO: 841052 - RNA, 16 nt, Mycobacterium avium subsp. paratuberculosis
gcccgcgcaccgcgaa

SEQ ID NO: 841053 - RNA, 22 nt, Mycobacterium avium subsp. paratuberculosis
gcccgcgcaccgucaucgcggc

SEQ ID NO: 841054 - RNA, 17 nt, Mycobacterium avium subsp. paratuberculosis
gcccgccucggcggccg

SEQ ID NO: 841055 - RNA, 18 nt, Mycobacterium avium subsp. paratuberculosis
gcccgccucggcggccgc

SEQ ID NO: 841056 - RNA, 23 nt, Mycobacterium avium subsp. paratuberculosis
gcccggccggccccuaccgccga

SEQ ID NO: 841057 - RNA, 23 nt, Mycobacterium avium subsp. paratuberculosis
gcccggccggcgcgaccagcggc

SEQ ID NO: 841058 - RNA, 16 nt, Mycobacterium avium subsp. paratuberculosis
gcccggccggucgccg

SEQ ID NO: 841059 - RNA, 14 nt, Mycobacterium avium subsp. paratuberculosis
gcccggccgccagc

SEQ ID NO: 841060 - RNA, 13 nt, Mycobacterium avium subsp. paratuberculosis
gcccggccgccag

SEQ ID NO: 841061 - RNA, 15 nt, Mycobacterium avium subsp. paratuberculosis
gcccggcccgucgag

SEQ ID NO: 841062 - RNA, 20 nt, Mycobacterium avium subsp. paratuberculosis
gcccggcccgcaucgaaucc

SEQ ID NO: 841063 - RNA, 17 nt, Mycobacterium avium subsp. paratuberculosis
gcccggcccgcuggccg

SEQ ID NO: 841064 - RNA, 14 nt, Mycobacterium avium subsp. paratuberculosis
gcccggcccggcga

SEQ ID NO: 841065 - RNA, 14 nt, Mycobacterium avium subsp. paratuberculosis
gcccggcccggcgc

SEQ ID NO: 841066 - RNA, 18 nt, Mycobacterium avium subsp. paratuberculosis
gcccggcccggcgcggcc

SEQ ID NO: 841067 - RNA, 19 nt, Mycobacterium avium subsp. paratuberculosis
gcccggcccggcgcggccg

SEQ ID NO: 841068 - RNA, 18 nt, Mycobacterium avium subsp. paratuberculosis
gcccggccccaccgccgc

SEQ ID NO: 841069 - RNA, 17 nt, Mycobacterium avium subsp. paratuberculosis
gcccggccaucugcgcg

SEQ ID NO: 841070 - RNA, 18 nt, Mycobacterium avium subsp. paratuberculosis
gcccggccaucugcgcga

SEQ ID NO: 841071 - RNA, 20 nt, Mycobacterium avium subsp. paratuberculosis
gcccggcccaagacccgcgu

SEQ ID NO: 841072 - RNA, 22 nt, Mycobacterium avium subsp. paratuberculosis
gcccggcccaagacccgcguca

SEQ ID NO: 841073 - RNA, 14 nt, Mycobacterium avium subsp. paratuberculosis
gcccggcccagccg

SEQ ID NO: 841074 - RNA, 15 nt, Mycobacterium avium subsp. paratuberculosis
gcccggcccagccgc

SEQ ID NO: 841075 - RNA, 16 nt, Mycobacterium avium subsp. paratuberculosis
gcccggcccagccggu

SEQ ID NO: 841076 - RNA, 13 nt, Mycobacterium avium subsp. paratuberculosis
gcccggcgcgcag

SEQ ID NO: 841077 - RNA, 15 nt, Mycobacterium avium subsp. paratuberculosis
gcccggcgcgcagcc

SEQ ID NO: 841078 - RNA, 14 nt, Mycobacterium avium subsp. paratuberculosis
gcccggcgccacgc

SEQ ID NO: 841079 - RNA, 17 nt, Mycobacterium avium subsp. paratuberculosis
gcccggcgccacgcaca

SEQ ID NO: 841080 - RNA, 14 nt, Mycobacterium avium subsp. paratuberculosis
gcccggcgcccggc

SEQ ID NO: 841081 - RNA, 16 nt, Mycobacterium avium subsp. paratuberculosis
gcccggcgcccggccg

SEQ ID NO: 841082 - RNA, 12 nt, Mycobacterium avium subsp. paratuberculosis
gcccggcgcccu

SEQ ID NO: 841083 - RNA, 18 nt, Mycobacterium avium subsp. paratuberculosis
gcccggcgccggacggcc

SEQ ID NO: 841084 - RNA, 15 nt, Mycobacterium avium subsp. paratuberculosis
gcccggcgccggccc

SEQ ID NO: 841085 - RNA, 16 nt, Mycobacterium avium subsp. paratuberculosis
gcccggcgccggcccg

SEQ ID NO: 841086 - RNA, 17 nt, Mycobacterium avium subsp. paratuberculosis
gcccggcgccggccgac

SEQ ID NO: 841087 - RNA, 14 nt, Mycobacterium avium subsp. paratuberculosis
gcccggcgccggcg

SEQ ID NO: 841088 - RNA, 15 nt, Mycobacterium avium subsp. paratuberculosis
gcccggcgccggcgg

SEQ ID NO: 841089 - RNA, 17 nt, Mycobacterium avium subsp. paratuberculosis
gcccggcgccggcggcc

SEQ ID NO: 841090 - RNA, 19 nt, Mycobacterium avium subsp. paratuberculosis
gcccggcgccggcggccac

SEQ ID NO: 841091 - RNA, 23 nt, Mycobacterium avium subsp. paratuberculosis
gcccggcgauacccgggagcauc

SEQ ID NO: 841092 - RNA, 13 nt, Mycobacterium avium subsp. paratuberculosis
gcccggcgagcga

SEQ ID NO: 841093 - RNA, 15 nt, Mycobacterium avium subsp. paratuberculosis
gcccggcgagcgacg

SEQ ID NO: 841094 - RNA, 14 nt, Mycobacterium avium subsp. paratuberculosis
gcccggcgagcagc

SEQ ID NO: 841095 - RNA, 20 nt, Mycobacterium avium subsp. paratuberculosis
gcccggccgaggucaccacc

SEQ ID NO: 841096 - RNA, 20 nt, Mycobacterium avium subsp. paratuberculosis
gcccggcgaugaucaggccg

SEQ ID NO: 841097 - RNA, 12 nt, Mycobacterium avium subsp. paratuberculosis
gcccggcgaugc

SEQ ID NO: 841098 - RNA, 18 nt, Mycobacterium avium subsp. paratuberculosis
gcccggcgaugccgagcc

SEQ ID NO: 841099 - RNA, 13 nt, Mycobacterium avium subsp. paratuberculosis
gcccggcgauguc

SEQ ID NO: 841100 - RNA, 20 nt, Mycobacterium avium subsp. paratuberculosis
gcccggcgaugucgggcacc

SEQ ID NO: 841101 - RNA, 18 nt, Mycobacterium avium subsp. paratuberculosis
gcccggcgaacaccacgg

SEQ ID NO: 841102 - RNA, 14 nt, Mycobacterium avium subsp. paratuberculosis
gcccggcgaccacc

SEQ ID NO: 841103 - RNA, 21 nt, Mycobacterium avium subsp. paratuberculosis
gcccggcgaccaccagccgca

SEQ ID NO: 841104 - RNA, 16 nt, Mycobacterium avium subsp. paratuberculosis
gcccggcgacgaagca

SEQ ID NO: 841105 - RNA, 21 nt, Mycobacterium avium subsp. paratuberculosis
gcccggcgacgaagcagcucg

SEQ ID NO: 841106 - RNA, 14 nt, Mycobacterium avium subsp. paratuberculosis
gcccggcgacgcgg

SEQ ID NO: 841107 - RNA, 13 nt, Mycobacterium avium subsp. paratuberculosis
gcccggcgacggc

SEQ ID NO: 841108 - RNA, 14 nt, Mycobacterium avium subsp. paratuberculosis
gcccggcgacgucg

SEQ ID NO: 841109 - RNA, 18 nt, Mycobacterium avium subsp. paratuberculosis
gcccggcgaaucagcagc

SEQ ID NO: 841110 - RNA, 17 nt, Mycobacterium avium subsp. paratuberculosis
gcccggcgugcaggauc

SEQ ID NO: 841111 - RNA, 14 nt, Mycobacterium avium subsp. paratuberculosis
gcccggcgucggug

SEQ ID NO: 841112 - RNA, 14 nt, Mycobacterium avium subsp. paratuberculosis
gcccggcgugggcc

SEQ ID NO: 841113 - RNA, 19 nt, Mycobacterium avium subsp. paratuberculosis
gcccggcgugggccgcagc

SEQ ID NO: 841114 - RNA, 22 nt, Mycobacterium avium subsp. paratuberculosis
gcccggcgugggccgcagcgcg

SEQ ID NO: 841115 - RNA, 16 nt, Mycobacterium avium subsp. paratuberculosis
gcccggcuccccgacc

SEQ ID NO: 841116 - RNA, 17 nt, Mycobacterium avium subsp. paratuberculosis
gcccggcuccccgacca

SEQ ID NO: 841117 - RNA, 19 nt, Mycobacterium avium subsp. paratuberculosis
gcccggcucaaaccguuga

SEQ ID NO: 841118 - RNA, 15 nt, Mycobacterium avium subsp. paratuberculosis
gcccggcucaaugcc

SEQ ID NO: 841119 - RNA, 22 nt, Mycobacterium avium subsp. paratuberculosis
gcccggcuaauucgggccgccg

SEQ ID NO: 841120 - RNA, 23 nt, Mycobacterium avium subsp. paratuberculosis
gcccggcuaauucgggccgccgc

SEQ ID NO: 841121 - RNA, 19 nt, Mycobacterium avium subsp. paratuberculosis
gcccggcguuccagcgcac

SEQ ID NO: 841122 - RNA, 20 nt, Mycobacterium avium subsp. paratuberculosis
gcccggcguuccagcgcaca

SEQ ID NO: 841123 - RNA, 20 nt, Mycobacterium avium subsp. paratuberculosis
gcccggcuacucggacgccg

SEQ ID NO: 841124 - RNA, 20 nt, Mycobacterium avium subsp. paratuberculosis
gcccggcuggcaggucgcgc

SEQ ID NO: 841125 - RNA, 16 nt, Mycobacterium avium subsp. paratuberculosis
gcccggcuucgccgcc

SEQ ID NO: 841126 - RNA, 17 nt, Mycobacterium avium subsp. paratuberculosis
gcccggcuucgccgccg

SEQ ID NO: 841127 - RNA, 17 nt, Mycobacterium avium subsp. paratuberculosis
gcccggcuucgccgcgc

SEQ ID NO: 841128 - RNA, 14 nt, Mycobacterium avium subsp. paratuberculosis
gcccggcucgccgg

SEQ ID NO: 841129 - RNA, 22 nt, Mycobacterium avium subsp. paratuberculosis
gcccggcucagcgcgacgugcc

SEQ ID NO: 841130 - RNA, 13 nt, Mycobacterium avium subsp. paratuberculosis
gcccggcucgccg

SEQ ID NO: 841131 - RNA, 13 nt, Mycobacterium avium subsp. paratuberculosis
gcccggcggugcc

SEQ ID NO: 841132 - RNA, 14 nt, Mycobacterium avium subsp. paratuberculosis
gcccggcggugccg

SEQ ID NO: 841133 - RNA, 15 nt, Mycobacterium avium subsp. paratuberculosis
gcccggcggugccga

SEQ ID NO: 841134 - RNA, 15 nt, Mycobacterium avium subsp. paratuberculosis
gcccggcgucacgcu

SEQ ID NO: 841135 - RNA, 20 nt, Mycobacterium avium subsp. paratuberculosis
gcccggcguccgcgaacggg

SEQ ID NO: 841136 - RNA, 13 nt, Mycobacterium avium subsp. paratuberculosis
gcccggcguccug

SEQ ID NO: 841137 - RNA, 17 nt, Mycobacterium avium subsp. paratuberculosis
gcccggcguccugcagc

SEQ ID NO: 841138 - RNA, 17 nt, Mycobacterium avium subsp. paratuberculosis
gcccggcgggcaucauc

SEQ ID NO: 841139 - RNA, 22 nt, Mycobacterium avium subsp. paratuberculosis
gcccggcgggucagcaccgcgg

SEQ ID NO: 841140 - RNA, 14 nt, Mycobacterium avium subsp. paratuberculosis
gcccggcggccggc

SEQ ID NO: 841141 - RNA, 16 nt, Mycobacterium avium subsp. paratuberculosis
gcccggcggccggccg

SEQ ID NO: 841142 - RNA, 12 nt, Mycobacterium avium subsp. paratuberculosis
gcccggcggcca

SEQ ID NO: 841143 - RNA, 15 nt, Mycobacterium avium subsp. paratuberculosis
gcccggcggccacca

SEQ ID NO: 841144 - RNA, 14 nt, Mycobacterium avium subsp. paratuberculosis
gcccggcggcaccg

SEQ ID NO: 841145 - RNA, 15 nt, Mycobacterium avium subsp. paratuberculosis
gcccggcgcugcgcc

SEQ ID NO: 841146 - RNA, 13 nt, Mycobacterium avium subsp. paratuberculosis
gcccggcgcggca

SEQ ID NO: 841147 - RNA, 14 nt, Mycobacterium avium subsp. paratuberculosis
gcccggcgcggcau

SEQ ID NO: 841148 - RNA, 15 nt, Mycobacterium avium subsp. paratuberculosis
gcccggcgcgccacg

SEQ ID NO: 841149 - RNA, 16 nt, Mycobacterium avium subsp. paratuberculosis
gcccggcgcgccacga

SEQ ID NO: 841150 - RNA, 19 nt, Mycobacterium avium subsp. paratuberculosis
gcccggcgcgccacgacgu

SEQ ID NO: 841151 - RNA, 13 nt, Mycobacterium avium subsp. paratuberculosis
gcccggcgcggcg

SEQ ID NO: 841152 - RNA, 14 nt, Mycobacterium avium subsp. paratuberculosis
gcccggcgcggcgg

SEQ ID NO: 841153 - RNA, 16 nt, Mycobacterium avium subsp. paratuberculosis
gcccggcgcggcggcg

SEQ ID NO: 841154 - RNA, 19 nt, Mycobacterium avium subsp. paratuberculosis
gcccggcgcggcggcgccg

SEQ ID NO: 841155 - RNA, 20 nt, Mycobacterium avium subsp. paratuberculosis
gcccggcgcuaaagccgacc

SEQ ID NO: 841156 - RNA, 14 nt, Mycobacterium avium subsp. paratuberculosis
gcccggcgcucacc

SEQ ID NO: 841157 - RNA, 23 nt, Mycobacterium avium subsp. paratuberculosis
gcccggcgcucaccgcgaugaug

SEQ ID NO: 841158 - RNA, 14 nt, Mycobacterium avium subsp. paratuberculosis
gcccguagccgcgg

SEQ ID NO: 841159 - RNA, 17 nt, Mycobacterium avium subsp. paratuberculosis
gcccguagccgcgguuc

SEQ ID NO: 841160 - RNA, 23 nt, Mycobacterium avium subsp. paratuberculosis
gcccguagccgcgguucggcguc

SEQ ID NO: 841161 - RNA, 21 nt, Mycobacterium avium subsp. paratuberculosis
gcccguagcggugggcgcgua

SEQ ID NO: 841162 - RNA, 23 nt, Mycobacterium avium subsp. paratuberculosis
gcccguagaacaguucgacguag

SEQ ID NO: 841163 - RNA, 16 nt, Mycobacterium avium subsp. paratuberculosis
gcccguagaugccggu

SEQ ID NO: 841164 - RNA, 19 nt, Mycobacterium avium subsp. paratuberculosis
gcccguagaugcggcccag

SEQ ID NO: 841165 - RNA, 20 nt, Mycobacterium avium subsp. paratuberculosis
gcccguagcucgcgccgacc

SEQ ID NO: 841166 - RNA, 22 nt, Mycobacterium avium subsp. paratuberculosis
gcccguagcucgcgccgacccg

SEQ ID NO: 841167 - RNA, 21 nt, Mycobacterium avium subsp. paratuberculosis
gcccgguuuccaguccggcgc

SEQ ID NO: 841168 - RNA, 15 nt, Mycobacterium avium subsp. paratuberculosis
gcccgguuccagcgg

SEQ ID NO: 841169 - RNA, 23 nt, Mycobacterium avium subsp. paratuberculosis
gcccgguuccagcggcaccgcca

SEQ ID NO: 841170 - RNA, 16 nt, Mycobacterium avium subsp. paratuberculosis
gcccgguuccgcgaca

SEQ ID NO: 841171 - RNA, 23 nt, Mycobacterium avium subsp. paratuberculosis
gcccgguuccgcgacaucgguga

SEQ ID NO: 841172 - RNA, 23 nt, Mycobacterium avium subsp. paratuberculosis
gcccgguguccacgucgcccagc

SEQ ID NO: 841173 - RNA, 23 nt, Mycobacterium avium subsp. paratuberculosis
gcccggucacccgugggccgacc

SEQ ID NO: 841174 - RNA, 22 nt, Mycobacterium avium subsp. paratuberculosis
gcccgguccaucccguugcgca

SEQ ID NO: 841175 - RNA, 16 nt, Mycobacterium avium subsp. paratuberculosis
gcccggucccgcguca

SEQ ID NO: 841176 - RNA, 15 nt, Mycobacterium avium subsp. paratuberculosis
gcccgguaggccgcc

SEQ ID NO: 841177 - RNA, 18 nt, Mycobacterium avium subsp. paratuberculosis
gcccgguaggccgccgcg

SEQ ID NO: 841178 - RNA, 18 nt, Mycobacterium avium subsp. paratuberculosis
gcccgguacagcgccgcg

SEQ ID NO: 841179 - RNA, 19 nt, Mycobacterium avium subsp. paratuberculosis
gcccgguacagcgccgcgg

SEQ ID NO: 841180 - RNA, 20 nt, Mycobacterium avium subsp. paratuberculosis
gcccgguacagcgccgcggc

SEQ ID NO: 841181 - RNA, 18 nt, Mycobacterium avium subsp. paratuberculosis
gcccgguacaucgacgcg

SEQ ID NO: 841182 - RNA, 15 nt, Mycobacterium avium subsp. paratuberculosis
gcccggugccacgau

SEQ ID NO: 841183 - RNA, 17 nt, Mycobacterium avium subsp. paratuberculosis
gcccggugcgacgccgc

SEQ ID NO: 841184 - RNA, 18 nt, Mycobacterium avium subsp. paratuberculosis
gcccggugcgacgccgcg

SEQ ID NO: 841185 - RNA, 15 nt, Mycobacterium avium subsp. paratuberculosis
gcccggugaucgccg

SEQ ID NO: 841186 - RNA, 15 nt, Mycobacterium avium subsp. paratuberculosis
gcccggucugcggcc

SEQ ID NO: 841187 - RNA, 16 nt, Mycobacterium avium subsp. paratuberculosis
gcccggucugcggccg

SEQ ID NO: 841188 - RNA, 18 nt, Mycobacterium avium subsp. paratuberculosis
gcccggucugcggccgcg

SEQ ID NO: 841189 - RNA, 15 nt, Mycobacterium avium subsp. paratuberculosis
gcccggugacgaaca

SEQ ID NO: 841190 - RNA, 17 nt, Mycobacterium avium subsp. paratuberculosis
gcccggugacgaacauc

SEQ ID NO: 841191 - RNA, 22 nt, Mycobacterium avium subsp. paratuberculosis
gcccggugacgaacaucgacga

SEQ ID NO: 841192 - RNA, 21 nt, Mycobacterium avium subsp. paratuberculosis
gcccggugagccucagggcgc

SEQ ID NO: 841193 - RNA, 17 nt, Mycobacterium avium subsp. paratuberculosis
gcccgguccgggucgcu

SEQ ID NO: 841194 - RNA, 19 nt, Mycobacterium avium subsp. paratuberculosis
gcccgguccgggucgcuga

SEQ ID NO: 841195 - RNA, 15 nt, Mycobacterium avium subsp. paratuberculosis
gcccggucgacuugg

SEQ ID NO: 841196 - RNA, 16 nt, Mycobacterium avium subsp. paratuberculosis
gcccggucgaggucgg

SEQ ID NO: 841197 - RNA, 18 nt, Mycobacterium avium subsp. paratuberculosis
gcccggucgaggucggcc

SEQ ID NO: 841198 - RNA, 20 nt, Mycobacterium avium subsp. paratuberculosis
gcccggucgaggucggccag

SEQ ID NO: 841199 - RNA, 22 nt, Mycobacterium avium subsp. paratuberculosis
gcccggucgaggucggccagca

SEQ ID NO: 841200 - RNA, 13 nt, Mycobacterium avium subsp. paratuberculosis
gcccggucguaca

SEQ ID NO: 841201 - RNA, 13 nt, Mycobacterium avium subsp. paratuberculosis
gcccggucgucga

SEQ ID NO: 841202 - RNA, 14 nt, Mycobacterium avium subsp. paratuberculosis
gcccggucgucgag

SEQ ID NO: 841203 - RNA, 16 nt, Mycobacterium avium subsp. paratuberculosis
gcccggucgucgagca

SEQ ID NO: 841204 - RNA, 13 nt, Mycobacterium avium subsp. paratuberculosis
gcccggucgucgc

SEQ ID NO: 841205 - RNA, 18 nt, Mycobacterium avium subsp. paratuberculosis
gcccggguugucgacgug

SEQ ID NO: 841206 - RNA, 19 nt, Mycobacterium avium subsp. paratuberculosis
gcccggguugucgacgugg

SEQ ID NO: 841207 - RNA, 21 nt, Mycobacterium avium subsp. paratuberculosis
gcccggguugucgacguggug

SEQ ID NO: 841208 - RNA, 22 nt, Mycobacterium avium subsp. paratuberculosis
gcccggguugucgacguggugc

SEQ ID NO: 841209 - RNA, 18 nt, Mycobacterium avium subsp. paratuberculosis
gcccgggugcaggcccag

SEQ ID NO: 841210 - RNA, 22 nt, Mycobacterium avium subsp. paratuberculosis
gcccggguugcacaggucgaug

SEQ ID NO: 841211 - RNA, 14 nt, Mycobacterium avium subsp. paratuberculosis
gcccggguggcguc

SEQ ID NO: 841212 - RNA, 17 nt, Mycobacterium avium subsp. paratuberculosis
gcccggguggcguccag

SEQ ID NO: 841213 - RNA, 13 nt, Mycobacterium avium subsp. paratuberculosis
gcccgggugggcg

SEQ ID NO: 841214 - RNA, 15 nt, Mycobacterium avium subsp. paratuberculosis
gcccgggugcgaaca

SEQ ID NO: 841215 - RNA, 21 nt, Mycobacterium avium subsp. paratuberculosis
gcccgggugcgaacagccacg

SEQ ID NO: 841216 - RNA, 22 nt, Mycobacterium avium subsp. paratuberculosis
gcccgggugcgcuugucggcgu

SEQ ID NO: 841217 - RNA, 20 nt, Mycobacterium avium subsp. paratuberculosis
gcccggguggacgcccgcga

SEQ ID NO: 841218 - RNA, 14 nt, Mycobacterium avium subsp. paratuberculosis
gcccgggucgucgg

SEQ ID NO: 841219 - RNA, 21 nt, Mycobacterium avium subsp. paratuberculosis
gcccgggugacaacgguggug

SEQ ID NO: 841220 - RNA, 16 nt, Mycobacterium avium subsp. paratuberculosis
gcccgggucgucggug

SEQ ID NO: 841221 - RNA, 17 nt, Mycobacterium avium subsp. paratuberculosis
gcccgggucgucggugc

SEQ ID NO: 841222 - RNA, 21 nt, Mycobacterium avium subsp. paratuberculosis
gcccgggucgucggugccgaa

SEQ ID NO: 841223 - RNA, 23 nt, Mycobacterium avium subsp. paratuberculosis
gcccgggucgucggugccgaagc

SEQ ID NO: 841224 - RNA, 14 nt, Mycobacterium avium subsp. paratuberculosis
gcccgggucgugcg

SEQ ID NO: 841225 - RNA, 20 nt, Mycobacterium avium subsp. paratuberculosis
gcccgggucgugcggcggcg

SEQ ID NO: 841226 - RNA, 14 nt, Mycobacterium avium subsp. paratuberculosis
gcccggggguggcg

SEQ ID NO: 841227 - RNA, 20 nt, Mycobacterium avium subsp. paratuberculosis
gcccggggugaugccggcgg

SEQ ID NO: 841228 - RNA, 21 nt, Mycobacterium avium subsp. paratuberculosis
gcccggggugaugccggcggu

SEQ ID NO: 841229 - RNA, 22 nt, Mycobacterium avium subsp. paratuberculosis
gcccggggugaugccggcggua

SEQ ID NO: 841230 - RNA, 11 nt, Mycobacterium avium subsp. paratuberculosis
gcccggggugc

SEQ ID NO: 841231 - RNA, 18 nt, Mycobacterium avium subsp. paratuberculosis
gcccggggugcuggcgua

SEQ ID NO: 841232 - RNA, 20 nt, Mycobacterium avium subsp. paratuberculosis
gcccgggguggauccgucgc

SEQ ID NO: 841233 - RNA, 20 nt, Mycobacterium avium subsp. paratuberculosis
gcccgggcuguugaccacgg

SEQ ID NO: 841234 - RNA, 14 nt, Mycobacterium avium subsp. paratuberculosis
gcccgggcugcagc

SEQ ID NO: 841235 - RNA, 19 nt, Mycobacterium avium subsp. paratuberculosis
gcccgggcugcagcagcga

SEQ ID NO: 841236 - RNA, 21 nt, Mycobacterium avium subsp. paratuberculosis
gcccggggcgcggaccgcacc

SEQ ID NO: 841237 - RNA, 17 nt, Mycobacterium avium subsp. paratuberculosis
gcccggggcggcgaugc

SEQ ID NO: 841238 - RNA, 20 nt, Mycobacterium avium subsp. paratuberculosis
gcccgggcuaucgcccggcg

SEQ ID NO: 841239 - RNA, 14 nt, Mycobacterium avium subsp. paratuberculosis
gcccgggcggcccg

SEQ ID NO: 841240 - RNA, 13 nt, Mycobacterium avium subsp. paratuberculosis
gcccgggcggcgg

SEQ ID NO: 841241 - RNA, 20 nt, Mycobacterium avium subsp. paratuberculosis
gcccgggcgauucgucgucg

SEQ ID NO: 841242 - RNA, 12 nt, Mycobacterium avium subsp. paratuberculosis
gcccgggcgccg

SEQ ID NO: 841243 - RNA, 22 nt, Mycobacterium avium subsp. paratuberculosis
gcccgggcaggcggcgcgccag

SEQ ID NO: 841244 - RNA, 18 nt, Mycobacterium avium subsp. paratuberculosis
gcccgggaaagcggguga

SEQ ID NO: 841245 - RNA, 20 nt, Mycobacterium avium subsp. paratuberculosis
gcccgggaaagcgggugacc

SEQ ID NO: 841246 - RNA, 19 nt, Mycobacterium avium subsp. paratuberculosis
gcccgggagaaccucaacg

SEQ ID NO: 841247 - RNA, 14 nt, Mycobacterium avium subsp. paratuberculosis
gcccggcugggcgc

SEQ ID NO: 841248 - RNA, 17 nt, Mycobacterium avium subsp. paratuberculosis
gcccggcugggcgcgca

SEQ ID NO: 841249 - RNA, 13 nt, Mycobacterium avium subsp. paratuberculosis
gcccggcugcgca

SEQ ID NO: 841250 - RNA, 22 nt, Mycobacterium avium subsp. paratuberculosis
gcccggcugcgcagcgcagcac

SEQ ID NO: 841251 - RNA, 18 nt, Mycobacterium avium subsp. paratuberculosis
gcccggcugcgccgcgcu

SEQ ID NO: 841252 - RNA, 16 nt, Mycobacterium avium subsp. paratuberculosis
gcccgggcacgacggu

SEQ ID NO: 841253 - RNA, 20 nt, Mycobacterium avium subsp. paratuberculosis
gcccgggcacgacggucagc

SEQ ID NO: 841254 - RNA, 16 nt, Mycobacterium avium subsp. paratuberculosis
gcccgggcccggggug

SEQ ID NO: 841255 - RNA, 23 nt, Mycobacterium avium subsp. paratuberculosis
gcccgggcccguagcucgcgccg

SEQ ID NO: 841256 - RNA, 14 nt, Mycobacterium avium subsp. paratuberculosis
gcccgggccgcagc

SEQ ID NO: 841257 - RNA, 16 nt, Mycobacterium avium subsp. paratuberculosis
gcccgggccgcagcuc

SEQ ID NO: 841258 - RNA, 17 nt, Mycobacterium avium subsp. paratuberculosis
gcccgggccgcagcucg

SEQ ID NO: 841259 - RNA, 14 nt, Mycobacterium avium subsp. paratuberculosis
gcccgggccgcgcc

SEQ ID NO: 841260 - RNA, 16 nt, Mycobacterium avium subsp. paratuberculosis
gcccgggccggaggug

SEQ ID NO: 841261 - RNA, 22 nt, Mycobacterium avium subsp. paratuberculosis
gcccgggccgucaucgccgacg

SEQ ID NO: 841262 - RNA, 13 nt, Mycobacterium avium subsp. paratuberculosis
gcccgggccgucc

SEQ ID NO: 841263 - RNA, 16 nt, Mycobacterium avium subsp. paratuberculosis
gcccuauggcaucgcc

SEQ ID NO: 841264 - RNA, 14 nt, Mycobacterium avium subsp. paratuberculosis
gcccuagucgacgc

SEQ ID NO: 841265 - RNA, 15 nt, Mycobacterium avium subsp. paratuberculosis
gcccuagucgacgcc

SEQ ID NO: 841266 - RNA, 14 nt, Mycobacterium avium subsp. paratuberculosis
gcccuacccgucca

SEQ ID NO: 841267 - RNA, 20 nt, Mycobacterium avium subsp. paratuberculosis
gcccuacccguccagcgcga

SEQ ID NO: 841268 - RNA, 22 nt, Mycobacterium avium subsp. paratuberculosis
gcccguugcugcguucggcgau

SEQ ID NO: 841269 - RNA, 22 nt, Mycobacterium avium subsp. paratuberculosis
gcccguugucgagcaccgcgau

SEQ ID NO: 841270 - RNA, 13 nt, Mycobacterium avium subsp. paratuberculosis
gcccguuguggcg

SEQ ID NO: 841271 - RNA, 17 nt, Mycobacterium avium subsp. paratuberculosis
gcccguuguggcggcca

SEQ ID NO: 841272 - RNA, 20 nt, Mycobacterium avium subsp. paratuberculosis
gcccguuguggcggccagcg

SEQ ID NO: 841273 - RNA, 22 nt, Mycobacterium avium subsp. paratuberculosis
gcccguuguggcggccagcgag

SEQ ID NO: 841274 - RNA, 14 nt, Mycobacterium avium subsp. paratuberculosis
gcccguucgagcgc

SEQ ID NO: 841275 - RNA, 21 nt, Mycobacterium avium subsp. paratuberculosis
gcccguucgaugaugggcgau

SEQ ID NO: 841276 - RNA, 23 nt, Mycobacterium avium subsp. paratuberculosis
gcccguucgaugaugggcgaucg

SEQ ID NO: 841277 - RNA, 13 nt, Mycobacterium avium subsp. paratuberculosis
gcccguugacgcc

SEQ ID NO: 841278 - RNA, 17 nt, Mycobacterium avium subsp. paratuberculosis
gcccguugagcaccgcg

SEQ ID NO: 841279 - RNA, 18 nt, Mycobacterium avium subsp. paratuberculosis
gcccguugagcaccgcga

SEQ ID NO: 841280 - RNA, 14 nt, Mycobacterium avium subsp. paratuberculosis
gcccguggccagcg

SEQ ID NO: 841281 - RNA, 19 nt, Mycobacterium avium subsp. paratuberculosis
gcccguggccagcgccagc

SEQ ID NO: 841282 - RNA, 19 nt, Mycobacterium avium subsp. paratuberculosis
gcccgugucgcggccuccg

SEQ ID NO: 841283 - RNA, 23 nt, Mycobacterium avium subsp. paratuberculosis
gcccgugcggcggggccucgaug

SEQ ID NO: 841284 - RNA, 13 nt, Mycobacterium avium subsp. paratuberculosis
gcccgucggcgug

SEQ ID NO: 841285 - RNA, 15 nt, Mycobacterium avium subsp. paratuberculosis
gcccgugaucgccac

SEQ ID NO: 841286 - RNA, 17 nt, Mycobacterium avium subsp. paratuberculosis
gcccgugaucgccacgg

SEQ ID NO: 841287 - RNA, 20 nt, Mycobacterium avium subsp. paratuberculosis
gcccgugaucgccacggcgg

SEQ ID NO: 841288 - RNA, 21 nt, Mycobacterium avium subsp. paratuberculosis
gcccgugaucgccacggcggu

SEQ ID NO: 841289 - RNA, 22 nt, Mycobacterium avium subsp. paratuberculosis
gcccgugaucgccacggcggug

SEQ ID NO: 841290 - RNA, 16 nt, Mycobacterium avium subsp. paratuberculosis
gcccguccagcgcaug

SEQ ID NO: 841291 - RNA, 16 nt, Mycobacterium avium subsp. paratuberculosis
gcccguagucggcggc

SEQ ID NO: 841292 - RNA, 23 nt, Mycobacterium avium subsp. paratuberculosis
gcccgucagccccuuaccggccg

SEQ ID NO: 841293 - RNA, 21 nt, Mycobacterium avium subsp. paratuberculosis
gcccgucacgcuggcgugacg

SEQ ID NO: 841294 - RNA, 14 nt, Mycobacterium avium subsp. paratuberculosis
gcccgucacggccg

SEQ ID NO: 841295 - RNA, 15 nt, Mycobacterium avium subsp. paratuberculosis
gcccgucacggccgu

SEQ ID NO: 841296 - RNA, 18 nt, Mycobacterium avium subsp. paratuberculosis
gcccgucacggccgucca

SEQ ID NO: 841297 - RNA, 20 nt, Mycobacterium avium subsp. paratuberculosis
gcccgucgaccuccucgacc

SEQ ID NO: 841298 - RNA, 13 nt, Mycobacterium avium subsp. paratuberculosis
gcccgucgacggg

SEQ ID NO: 841299 - RNA, 15 nt, Mycobacterium avium subsp. paratuberculosis
gcccgucgacgggcc

SEQ ID NO: 841300 - RNA, 16 nt, Mycobacterium avium subsp. paratuberculosis
gcccgucgacgggcca

SEQ ID NO: 841301 - RNA, 18 nt, Mycobacterium avium subsp. paratuberculosis
gcccgucgacgggccacc

SEQ ID NO: 841302 - RNA, 19 nt, Mycobacterium avium subsp. paratuberculosis
gcccgucgacgggccacca

SEQ ID NO: 841303 - RNA, 14 nt, Mycobacterium avium subsp. paratuberculosis
gcccgucgacgucg

SEQ ID NO: 841304 - RNA, 13 nt, Mycobacterium avium subsp. paratuberculosis
gcccgucgagcgg

SEQ ID NO: 841305 - RNA, 17 nt, Mycobacterium avium subsp. paratuberculosis
gcccgucgagcgucacg

SEQ ID NO: 841306 - RNA, 20 nt, Mycobacterium avium subsp. paratuberculosis
gcccgucgagcgucacgccg

SEQ ID NO: 841307 - RNA, 22 nt, Mycobacterium avium subsp. paratuberculosis
gcccgucgagcgucacgccgcg

SEQ ID NO: 841308 - RNA, 20 nt, Mycobacterium avium subsp. paratuberculosis
gcccgucgagcgucacgcug

SEQ ID NO: 841309 - RNA, 18 nt, Mycobacterium avium subsp. paratuberculosis
gcccgucgaucccggacu

SEQ ID NO: 841310 - RNA, 15 nt, Mycobacterium avium subsp. paratuberculosis
gcccgucccgccgac

SEQ ID NO: 841311 - RNA, 15 nt, Mycobacterium avium subsp. paratuberculosis
gcccgucccggccca

SEQ ID NO: 841312 - RNA, 15 nt, Mycobacterium avium subsp. paratuberculosis
gcccgucccugcgcg

SEQ ID NO: 841313 - RNA, 16 nt, Mycobacterium avium subsp. paratuberculosis
gcccguccccaccacc

SEQ ID NO: 841314 - RNA, 20 nt, Mycobacterium avium subsp. paratuberculosis
gcccguccccaccaccgaca

SEQ ID NO: 841315 - RNA, 20 nt, Mycobacterium avium subsp. paratuberculosis
gcccguccgccccgcugccg

SEQ ID NO: 841316 - RNA, 22 nt, Mycobacterium avium subsp. paratuberculosis
gcccgucaggccucgaggaucg

SEQ ID NO: 841317 - RNA, 14 nt, Mycobacterium avium subsp. paratuberculosis
gcccguccgggccg

SEQ ID NO: 841318 - RNA, 17 nt, Mycobacterium avium subsp. paratuberculosis
gcccguccgggccggcc

SEQ ID NO: 841319 - RNA, 12 nt, Mycobacterium avium subsp. paratuberculosis
gcccgucgcgca

SEQ ID NO: 841320 - RNA, 19 nt, Mycobacterium avium subsp. paratuberculosis
gcccgucggaggacaacgc

SEQ ID NO: 841321 - RNA, 14 nt, Mycobacterium avium subsp. paratuberculosis
gcccgucggcaacg

SEQ ID NO: 841322 - RNA, 16 nt, Mycobacterium avium subsp. paratuberculosis
gcccgucggcaacgcc

SEQ ID NO: 841323 - RNA, 18 nt, Mycobacterium avium subsp. paratuberculosis
gcccgucggcaacgccgg

SEQ ID NO: 841324 - RNA, 20 nt, Mycobacterium avium subsp. paratuberculosis
gcccgucggcaacgccgggu

SEQ ID NO: 841325 - RNA, 16 nt, Mycobacterium avium subsp. paratuberculosis
gcccgucgccaccacg

SEQ ID NO: 841326 - RNA, 20 nt, Mycobacterium avium subsp. paratuberculosis
gcccgucgccaccacggcgc

SEQ ID NO: 841327 - RNA, 12 nt, Mycobacterium avium subsp. paratuberculosis
gcccgucgccga

SEQ ID NO: 841328 - RNA, 14 nt, Mycobacterium avium subsp. paratuberculosis
gcccgucgccggcg

SEQ ID NO: 841329 - RNA, 15 nt, Mycobacterium avium subsp. paratuberculosis
gcccgucgccggcgc

SEQ ID NO: 841330 - RNA, 16 nt, Mycobacterium avium subsp. paratuberculosis
gcccgucgccggcgcg

SEQ ID NO: 841331 - RNA, 22 nt, Mycobacterium avium subsp. paratuberculosis
gcccgucgccgugcguccaguc

SEQ ID NO: 841332 - RNA, 14 nt, Mycobacterium avium subsp. paratuberculosis
gcccgucucggcgu

SEQ ID NO: 841333 - RNA, 15 nt, Mycobacterium avium subsp. paratuberculosis
gcccgucucggcgug

SEQ ID NO: 841334 - RNA, 19 nt, Mycobacterium avium subsp. paratuberculosis
gcccgucucggcgugcucg

SEQ ID NO: 841335 - RNA, 20 nt, Mycobacterium avium subsp. paratuberculosis
gcccgucucggcgugcucgg

SEQ ID NO: 841336 - RNA, 23 nt, Mycobacterium avium subsp. paratuberculosis
gcccgucucggcgugcucggcca

SEQ ID NO: 841337 - RNA, 13 nt, Mycobacterium avium subsp. paratuberculosis
gcccgucgucggu

SEQ ID NO: 841338 - RNA, 12 nt, Mycobacterium avium subsp. paratuberculosis
gcccgucgggcg

SEQ ID NO: 841339 - RNA, 19 nt, Mycobacterium avium subsp. paratuberculosis
gcccgucgggcgcggcggc

SEQ ID NO: 841340 - RNA, 14 nt, Mycobacterium avium subsp. paratuberculosis
gcccgucgggcggg

SEQ ID NO: 841341 - RNA, 14 nt, Mycobacterium avium subsp. paratuberculosis
gcccgucgucgccg

SEQ ID NO: 841342 - RNA, 17 nt, Mycobacterium avium subsp. paratuberculosis
gcccgucgucgccgaug

SEQ ID NO: 841343 - RNA, 18 nt, Mycobacterium avium subsp. paratuberculosis
gcccgucggccuccagcc

SEQ ID NO: 841344 - RNA, 19 nt, Mycobacterium avium subsp. paratuberculosis
gcccgucggccuccagccg

SEQ ID NO: 841345 - RNA, 14 nt, Mycobacterium avium subsp. paratuberculosis
gcccgucggccucg

SEQ ID NO: 841346 - RNA, 19 nt, Mycobacterium avium subsp. paratuberculosis
gcccgucggccucggcggu

SEQ ID NO: 841347 - RNA, 21 nt, Mycobacterium avium subsp. paratuberculosis
aagaucuccgggaacgcggcg

SEQ ID NO: 841348 - RNA, 18 nt, Mycobacterium avium subsp. paratuberculosis
aagaugaucucgccgagc

SEQ ID NO: 841349 - RNA, 21 nt, Mycobacterium avium subsp. paratuberculosis
aagaugccgaucaggcuggac

SEQ ID NO: 841350 - RNA, 14 nt, Mycobacterium avium subsp. paratuberculosis
gccgacgcgccguc

SEQ ID NO: 841351 - RNA, 15 nt, Mycobacterium avium subsp. paratuberculosis
gccgacgcgccgucg

SEQ ID NO: 841352 - RNA, 16 nt, Mycobacterium avium subsp. paratuberculosis
gccgacgcgccgucgg

SEQ ID NO: 841353 - RNA, 23 nt, Mycobacterium avium subsp. paratuberculosis
gccgacgcgccgucggcccacgg

SEQ ID NO: 841354 - RNA, 22 nt, Mycobacterium avium subsp. paratuberculosis
gccgacguaggacagcaccaca

SEQ ID NO: 841355 - RNA, 19 nt, Mycobacterium avium subsp. paratuberculosis
gccgacgguguccgcgggc

SEQ ID NO: 841356 - RNA, 17 nt, Mycobacterium avium subsp. paratuberculosis
gccgacggugucguaga

SEQ ID NO: 841357 - RNA, 16 nt, Mycobacterium avium subsp. paratuberculosis
gccgacguaaccguac

SEQ ID NO: 841358 - RNA, 21 nt, Mycobacterium avium subsp. paratuberculosis
gccgacguaaccguacggccc

SEQ ID NO: 841359 - RNA, 23 nt, Mycobacterium avium subsp. paratuberculosis
gccgacguaaccguacggcccga

SEQ ID NO: 841360 - RNA, 16 nt, Mycobacterium avium subsp. paratuberculosis
gccgacgucccagcac

SEQ ID NO: 841361 - RNA, 17 nt, Mycobacterium avium subsp. paratuberculosis
gccgacgucccagcaca

SEQ ID NO: 841362 - RNA, 17 nt, Mycobacterium avium subsp. paratuberculosis
gccgacgcgcugcgcgc

SEQ ID NO: 841363 - RNA, 18 nt, Mycobacterium avium subsp. paratuberculosis
gccgacgcgcugcgcgcc

SEQ ID NO: 841364 - RNA, 15 nt, Mycobacterium avium subsp. paratuberculosis
gccgacgggcccgcg

SEQ ID NO: 841365 - RNA, 17 nt, Mycobacterium avium subsp. paratuberculosis
gccgacggucugcggug

SEQ ID NO: 841366 - RNA, 13 nt, Mycobacterium avium subsp. paratuberculosis
gccgacggugagc

SEQ ID NO: 841367 - RNA, 14 nt, Mycobacterium avium subsp. paratuberculosis
gccgacggugagca

SEQ ID NO: 841368 - RNA, 19 nt, Mycobacterium avium subsp. paratuberculosis
gccgacggugagcaccgcc

SEQ ID NO: 841369 - RNA, 21 nt, Mycobacterium avium subsp. paratuberculosis
gccgacggugagcaccgccgu

SEQ ID NO: 841370 - RNA, 13 nt, Mycobacterium avium subsp. paratuberculosis
gccgacgguggcc

SEQ ID NO: 841371 - RNA, 17 nt, Mycobacterium avium subsp. paratuberculosis
gccgacgguggccccca

SEQ ID NO: 841372 - RNA, 20 nt, Mycobacterium avium subsp. paratuberculosis
gccgacgguggcccccacca

SEQ ID NO: 841373 - RNA, 17 nt, Mycobacterium avium subsp. paratuberculosis
aagaucgucuugaccgc

SEQ ID NO: 841374 - RNA, 15 nt, Mycobacterium avium subsp. paratuberculosis
aagaucgcccgccgc

SEQ ID NO: 841375 - RNA, 16 nt, Mycobacterium avium subsp. paratuberculosis
gccgacgccgaagauc

SEQ ID NO: 841376 - RNA, 22 nt, Mycobacterium avium subsp. paratuberculosis
gccgacgaugagggccagcagu

SEQ ID NO: 841377 - RNA, 18 nt, Mycobacterium avium subsp. paratuberculosis
gccgacgccagcacgugg

SEQ ID NO: 841378 - RNA, 16 nt, Mycobacterium avium subsp. paratuberculosis
gccgacgcccacagcg

SEQ ID NO: 841379 - RNA, 20 nt, Mycobacterium avium subsp. paratuberculosis
gccgacgcccacagcgccag

SEQ ID NO: 841380 - RNA, 22 nt, Mycobacterium avium subsp. paratuberculosis
gccgacgcccacagcgccagca

SEQ ID NO: 841381 - RNA, 15 nt, Mycobacterium avium subsp. paratuberculosis
gccgacgcccagcac

SEQ ID NO: 841382 - RNA, 17 nt, Mycobacterium avium subsp. paratuberculosis
gccgacgcccagcaccg

SEQ ID NO: 841383 - RNA, 15 nt, Mycobacterium avium subsp. paratuberculosis
gccgacgcccagcgc

SEQ ID NO: 841384 - RNA, 16 nt, Mycobacterium avium subsp. paratuberculosis
gccgacgcccagcgcg

SEQ ID NO: 841385 - RNA, 19 nt, Mycobacterium avium subsp. paratuberculosis
gccgacgcccagcgcggcg

SEQ ID NO: 841386 - RNA, 13 nt, Mycobacterium avium subsp. paratuberculosis
gccgacgcccagg

SEQ ID NO: 841387 - RNA, 14 nt, Mycobacterium avium subsp. paratuberculosis
gccgacgcccaggc

SEQ ID NO: 841388 - RNA, 19 nt, Mycobacterium avium subsp. paratuberculosis
gccgacgcauguccgccgu

SEQ ID NO: 841389 - RNA, 15 nt, Mycobacterium avium subsp. paratuberculosis
gccgacgaugucggc

SEQ ID NO: 841390 - RNA, 13 nt, Mycobacterium avium subsp. paratuberculosis
gccgaccuggcgg

SEQ ID NO: 841391 - RNA, 17 nt, Mycobacterium avium subsp. paratuberculosis
gccgaccuggcggccgg

SEQ ID NO: 841392 - RNA, 18 nt, Mycobacterium avium subsp. paratuberculosis
gccgacgaucccggcgag

SEQ ID NO: 841393 - RNA, 20 nt, Mycobacterium avium subsp. paratuberculosis
gccgacgaucccggcgagca

SEQ ID NO: 841394 - RNA, 22 nt, Mycobacterium avium subsp. paratuberculosis
gccgacgaucccggcgagcacg

SEQ ID NO: 841395 - RNA, 23 nt, Mycobacterium avium subsp. paratuberculosis
gccgacgaucccggcgagcacgc

SEQ ID NO: 841396 - RNA, 15 nt, Mycobacterium avium subsp. paratuberculosis
gccgacgauccgcgc

SEQ ID NO: 841397 - RNA, 16 nt, Mycobacterium avium subsp. paratuberculosis
gccgacgauccgcgcc

SEQ ID NO: 841398 - RNA, 17 nt, Mycobacterium avium subsp. paratuberculosis
gccgacgauccgcgccg

SEQ ID NO: 841399 - RNA, 21 nt, Mycobacterium avium subsp. paratuberculosis
gccgaccugcgcgacggcgcu

SEQ ID NO: 841400 - RNA, 16 nt, Mycobacterium avium subsp. paratuberculosis
gccgacgauccgggcg

SEQ ID NO: 841401 - RNA, 20 nt, Mycobacterium avium subsp. paratuberculosis
gccgacgauccgggcgcccu

SEQ ID NO: 841402 - RNA, 14 nt, Mycobacterium avium subsp. paratuberculosis
gccgaccagcagga

SEQ ID NO: 841403 - RNA, 21 nt, Mycobacterium avium subsp. paratuberculosis
gccgaccagcaggacgcgccc

SEQ ID NO: 841404 - RNA, 13 nt, Mycobacterium avium subsp. paratuberculosis
gccgaccagcgcg

SEQ ID NO: 841405 - RNA, 14 nt, Mycobacterium avium subsp. paratuberculosis
gccgaccagcgcga

SEQ ID NO: 841406 - RNA, 16 nt, Mycobacterium avium subsp. paratuberculosis
gccgaccagcgcgauc

SEQ ID NO: 841407 - RNA, 23 nt, Mycobacterium avium subsp. paratuberculosis
gccgacccgguugauccggaucg

SEQ ID NO: 841408 - RNA, 11 nt, Mycobacterium avium subsp. paratuberculosis
gccgacccgcu

SEQ ID NO: 841409 - RNA, 23 nt, Mycobacterium avium subsp. paratuberculosis
gccgacccggcguaguucgucga

SEQ ID NO: 841410 - RNA, 20 nt, Mycobacterium avium subsp. paratuberculosis
gccgaccacccccagcccgc

SEQ ID NO: 841411 - RNA, 17 nt, Mycobacterium avium subsp. paratuberculosis
gccgaccagccgaggcg

SEQ ID NO: 841412 - RNA, 15 nt, Mycobacterium avium subsp. paratuberculosis
gccgaccacgccgcg

SEQ ID NO: 841413 - RNA, 17 nt, Mycobacterium avium subsp. paratuberculosis
gccgaccacgccgcgcu

SEQ ID NO: 841414 - RNA, 13 nt, Mycobacterium avium subsp. paratuberculosis
gccgaccacggcc

SEQ ID NO: 841415 - RNA, 15 nt, Mycobacterium avium subsp. paratuberculosis
gccgaccaccuugcg

SEQ ID NO: 841416 - RNA, 20 nt, Mycobacterium avium subsp. paratuberculosis
gccgaccaccuugcgcagca

SEQ ID NO: 841417 - RNA, 23 nt, Mycobacterium avium subsp. paratuberculosis
gccgaccaccuugcgcagcagca

SEQ ID NO: 841418 - RNA, 23 nt, Mycobacterium avium subsp. paratuberculosis
gccgaccaacacccccgcgcugc

SEQ ID NO: 841419 - RNA, 15 nt, Mycobacterium avium subsp. paratuberculosis
gccgaccaacgggcg

SEQ ID NO: 841420 - RNA, 19 nt, Mycobacterium avium subsp. paratuberculosis
gccgaccaacgggcggcgg

SEQ ID NO: 841421 - RNA, 20 nt, Mycobacterium avium subsp. paratuberculosis
gccgaccaacgggcggcgga

SEQ ID NO: 841422 - RNA, 16 nt, Mycobacterium avium subsp. paratuberculosis
gccgaccugcacgcug

SEQ ID NO: 841423 - RNA, 15 nt, Mycobacterium avium subsp. paratuberculosis
gccgaccucgucggc

SEQ ID NO: 841424 - RNA, 18 nt, Mycobacterium avium subsp. paratuberculosis
gccgaccucgucggcggu

SEQ ID NO: 841425 - RNA, 21 nt, Mycobacterium avium subsp. paratuberculosis
gccgaccucgucggcggugcc

SEQ ID NO: 841426 - RNA, 22 nt, Mycobacterium avium subsp. paratuberculosis
gccgaccucgucggcggugccg

SEQ ID NO: 841427 - RNA, 23 nt, Mycobacterium avium subsp. paratuberculosis
gccgaccucgucggcggugccga

SEQ ID NO: 841428 - RNA, 16 nt, Mycobacterium avium subsp. paratuberculosis
gccgaccucggccagc

SEQ ID NO: 841429 - RNA, 13 nt, Mycobacterium avium subsp. paratuberculosis
gccgaccucggcg

SEQ ID NO: 841430 - RNA, 16 nt, Mycobacterium avium subsp. paratuberculosis
gccgaccucggcgacg

SEQ ID NO: 841431 - RNA, 16 nt, Mycobacterium avium subsp. paratuberculosis
gccgaccucgauggcg

SEQ ID NO: 841432 - RNA, 18 nt, Mycobacterium avium subsp. paratuberculosis
gccgaccgagggcgcggg

SEQ ID NO: 841433 - RNA, 14 nt, Mycobacterium avium subsp. paratuberculosis
gccgacccugcguc

SEQ ID NO: 841434 - RNA, 15 nt, Mycobacterium avium subsp. paratuberculosis
gccgacccugcgucc

SEQ ID NO: 841435 - RNA, 20 nt, Mycobacterium avium subsp. paratuberculosis
gccgacccugcguccggccc

SEQ ID NO: 841436 - RNA, 22 nt, Mycobacterium avium subsp. paratuberculosis
gccgacccugcguccggcccgg

SEQ ID NO: 841437 - RNA, 16 nt, Mycobacterium avium subsp. paratuberculosis
gccgaccgacaguucg

SEQ ID NO: 841438 - RNA, 23 nt, Mycobacterium avium subsp. paratuberculosis
gccgaccgacaguucggcgcgca

SEQ ID NO: 841439 - RNA, 15 nt, Mycobacterium avium subsp. paratuberculosis
gccgaccgacccggc

SEQ ID NO: 841440 - RNA, 16 nt, Mycobacterium avium subsp. paratuberculosis
gccgaccgacccggcc

SEQ ID NO: 841441 - RNA, 19 nt, Mycobacterium avium subsp. paratuberculosis
gccgaccgacccggccagc

SEQ ID NO: 841442 - RNA, 19 nt, Mycobacterium avium subsp. paratuberculosis
gccgaccggucucgaccgc

SEQ ID NO: 841443 - RNA, 20 nt, Mycobacterium avium subsp. paratuberculosis
gccgaccggucucgaccgcg

SEQ ID NO: 841444 - RNA, 21 nt, Mycobacterium avium subsp. paratuberculosis
gccgaccggucucgaccgcgg

SEQ ID NO: 841445 - RNA, 14 nt, Mycobacterium avium subsp. paratuberculosis
gccgaagcgccacg

SEQ ID NO: 841446 - RNA, 15 nt, Mycobacterium avium subsp. paratuberculosis
gccgaagccgccguc

SEQ ID NO: 841447 - RNA, 17 nt, Mycobacterium avium subsp. paratuberculosis
gccgaagccgccguccc

SEQ ID NO: 841448 - RNA, 21 nt, Mycobacterium avium subsp. paratuberculosis
gccgaagccgccguccccgcg

SEQ ID NO: 841449 - RNA, 14 nt, Mycobacterium avium subsp. paratuberculosis
gccgaagccggcgc

SEQ ID NO: 841450 - RNA, 16 nt, Mycobacterium avium subsp. paratuberculosis
gccgaagccggcgcag

SEQ ID NO: 841451 - RNA, 17 nt, Mycobacterium avium subsp. paratuberculosis
gccgaagccggcgcagg

SEQ ID NO: 841452 - RNA, 13 nt, Mycobacterium avium subsp. paratuberculosis
gccgaagccgucg

SEQ ID NO: 841453 - RNA, 14 nt, Mycobacterium avium subsp. paratuberculosis
gccgaagccgucga

SEQ ID NO: 841454 - RNA, 17 nt, Mycobacterium avium subsp. paratuberculosis
gccgaagccguugacgg

SEQ ID NO: 841455 - RNA, 15 nt, Mycobacterium avium subsp. paratuberculosis
gccgaagcgggucgg

SEQ ID NO: 841456 - RNA, 12 nt, Mycobacterium avium subsp. paratuberculosis
gccgaauccggc

SEQ ID NO: 841457 - RNA, 19 nt, Mycobacterium avium subsp. paratuberculosis
gccgaagcguuccgccguc

SEQ ID NO: 841458 - RNA, 16 nt, Mycobacterium avium subsp. paratuberculosis
gccgaagcggcgcacg

SEQ ID NO: 841459 - RNA, 23 nt, Mycobacterium avium subsp. paratuberculosis
gccgaauugcuuacgcaucgccg

SEQ ID NO: 841460 - RNA, 18 nt, Mycobacterium avium subsp. paratuberculosis
gccgaauuguucggccac

SEQ ID NO: 841461 - RNA, 19 nt, Mycobacterium avium subsp. paratuberculosis
gccgaauuguucggccacc

SEQ ID NO: 841462 - RNA, 20 nt, Mycobacterium avium subsp. paratuberculosis
gccgaauuguucggccaccg

SEQ ID NO: 841463 - RNA, 14 nt, Mycobacterium avium subsp. paratuberculosis
gccgacaacauccg

SEQ ID NO: 841464 - RNA, 15 nt, Mycobacterium avium subsp. paratuberculosis
gccgacaacauccgc

SEQ ID NO: 841465 - RNA, 23 nt, Mycobacterium avium subsp. paratuberculosis
gccgacaacgacagcacccaggu

SEQ ID NO: 841466 - RNA, 23 nt, Mycobacterium avium subsp. paratuberculosis
gccgaaucggcuguggcgcacag

SEQ ID NO: 841467 - RNA, 15 nt, Mycobacterium avium subsp. paratuberculosis
gccgaauccggccgg

SEQ ID NO: 841468 - RNA, 22 nt, Mycobacterium avium subsp. paratuberculosis
gccgaauccggccggagaccgc

SEQ ID NO: 841469 - RNA, 23 nt, Mycobacterium avium subsp. paratuberculosis
gccgaauccggccggagaccgcc

SEQ ID NO: 841470 - RNA, 17 nt, Mycobacterium avium subsp. paratuberculosis
gccgaagcccgcagcga

SEQ ID NO: 841471 - RNA, 13 nt, Mycobacterium avium subsp. paratuberculosis
gccgaagcccgac

SEQ ID NO: 841472 - RNA, 18 nt, Mycobacterium avium subsp. paratuberculosis
gccgaacgucgagcgcgg

SEQ ID NO: 841473 - RNA, 21 nt, Mycobacterium avium subsp. paratuberculosis
gccgaacgucgagcgcggccc

SEQ ID NO: 841474 - RNA, 23 nt, Mycobacterium avium subsp. paratuberculosis
gccgaacgucgagcgcggcccgc

SEQ ID NO: 841475 - RNA, 16 nt, Mycobacterium avium subsp. paratuberculosis
gccgaacgugcgcggc

SEQ ID NO: 841476 - RNA, 22 nt, Mycobacterium avium subsp. paratuberculosis
gccgaacgugcgcggcgcgcga

SEQ ID NO: 841477 - RNA, 22 nt, Mycobacterium avium subsp. paratuberculosis
gccgaacgugcugugcgggcgg

SEQ ID NO: 841478 - RNA, 22 nt, Mycobacterium avium subsp. paratuberculosis
gccgaacggcaugucgguggac

SEQ ID NO: 841479 - RNA, 14 nt, Mycobacterium avium subsp. paratuberculosis
gccgaacgggucgg

SEQ ID NO: 841480 - RNA, 18 nt, Mycobacterium avium subsp. paratuberculosis
gccgaacgggucggcgac

SEQ ID NO: 841481 - RNA, 19 nt, Mycobacterium avium subsp. paratuberculosis
gccgaacgcgcugucgccc

SEQ ID NO: 841482 - RNA, 23 nt, Mycobacterium avium subsp. paratuberculosis
gccgaacgcgcugucgcccucga

SEQ ID NO: 841483 - RNA, 23 nt, Mycobacterium avium subsp. paratuberculosis
gccgaacgccggauuggcgucgg

SEQ ID NO: 841484 - RNA, 20 nt, Mycobacterium avium subsp. paratuberculosis
gccgaacgccuccgccgccc

SEQ ID NO: 841485 - RNA, 20 nt, Mycobacterium avium subsp. paratuberculosis
gccgaacgauggugugcagc

SEQ ID NO: 841486 - RNA, 13 nt, Mycobacterium avium subsp. paratuberculosis
gccgaacgcacca

SEQ ID NO: 841487 - RNA, 16 nt, Mycobacterium avium subsp. paratuberculosis
gccgaacgccaccacc

SEQ ID NO: 841488 - RNA, 13 nt, Mycobacterium avium subsp. paratuberculosis
gccgaacccgccc

SEQ ID NO: 841489 - RNA, 18 nt, Mycobacterium avium subsp. paratuberculosis
gccgaaccgcuccccgag

SEQ ID NO: 841490 - RNA, 21 nt, Mycobacterium avium subsp. paratuberculosis
gccgaaccgcuccccgagcac

SEQ ID NO: 841491 - RNA, 18 nt, Mycobacterium avium subsp. paratuberculosis
gccgaaccggaucuggcc

SEQ ID NO: 841492 - RNA, 17 nt, Mycobacterium avium subsp. paratuberculosis
gccgaaccggggccgca

SEQ ID NO: 841493 - RNA, 20 nt, Mycobacterium avium subsp. paratuberculosis
gccgaaccggggccgcaccu

SEQ ID NO: 841494 - RNA, 13 nt, Mycobacterium avium subsp. paratuberculosis
gccgaaccgggcg

SEQ ID NO: 841495 - RNA, 18 nt, Mycobacterium avium subsp. paratuberculosis
gccgaaccgaucaccggc

SEQ ID NO: 841496 - RNA, 19 nt, Mycobacterium avium subsp. paratuberculosis
gccgaaccagaucggcggg

SEQ ID NO: 841497 - RNA, 22 nt, Mycobacterium avium subsp. paratuberculosis
gccgaaccagaucggcgggugc

SEQ ID NO: 841498 - RNA, 15 nt, Mycobacterium avium subsp. paratuberculosis
gccgaaacgcccggc

SEQ ID NO: 841499 - RNA, 16 nt, Mycobacterium avium subsp. paratuberculosis
gccgaaagccuccgcg

SEQ ID NO: 841500 - RNA, 22 nt, Mycobacterium avium subsp. paratuberculosis
gccgaaagccuccgcgaucagc

SEQ ID NO: 841501 - RNA, 18 nt, Mycobacterium avium subsp. paratuberculosis
gccgaaaucaacgcgccg

SEQ ID NO: 841502 - RNA, 19 nt, Mycobacterium avium subsp. paratuberculosis
gccgaaaucaacgcgccga

SEQ ID NO: 841503 - RNA, 21 nt, Mycobacterium avium subsp. paratuberculosis
gccgaaaucaacgcgccgaac

SEQ ID NO: 841504 - RNA, 16 nt, Mycobacterium avium subsp. paratuberculosis
gcccucccccgagucg

SEQ ID NO: 841505 - RNA, 17 nt, Mycobacterium avium subsp. paratuberculosis
gcccucaggcguccagc

SEQ ID NO: 841506 - RNA, 19 nt, Mycobacterium avium subsp. paratuberculosis
gcccucaggcguccagcac

SEQ ID NO: 841507 - RNA, 17 nt, Mycobacterium avium subsp. paratuberculosis
gcccuccacggugcgca

SEQ ID NO: 841508 - RNA, 22 nt, Mycobacterium avium subsp. paratuberculosis
gcccuccacgucgucggacagc

SEQ ID NO: 841509 - RNA, 14 nt, Mycobacterium avium subsp. paratuberculosis
gcccucaucgucga

SEQ ID NO: 841510 - RNA, 12 nt, Mycobacterium avium subsp. paratuberculosis
gcccuccagcug

SEQ ID NO: 841511 - RNA, 16 nt, Mycobacterium avium subsp. paratuberculosis
gccgagccgcaccgcc

SEQ ID NO: 841512 - RNA, 15 nt, Mycobacterium avium subsp. paratuberculosis
gccgagccgacccgg

SEQ ID NO: 841513 - RNA, 16 nt, Mycobacterium avium subsp. paratuberculosis
gccgagccgagccgac

SEQ ID NO: 841514 - RNA, 15 nt, Mycobacterium avium subsp. paratuberculosis
gccgagccgaggccg

SEQ ID NO: 841515 - RNA, 18 nt, Mycobacterium avium subsp. paratuberculosis
gccgagccggcacggccg

SEQ ID NO: 841516 - RNA, 21 nt, Mycobacterium avium subsp. paratuberculosis
gccgagccggcacggccggcc

SEQ ID NO: 841517 - RNA, 11 nt, Mycobacterium avium subsp. paratuberculosis
gccgagccgcu

SEQ ID NO: 841518 - RNA, 16 nt, Mycobacterium avium subsp. paratuberculosis
gccgagccgcuccacc

SEQ ID NO: 841519 - RNA, 13 nt, Mycobacterium avium subsp. paratuberculosis
gccgagccggccg

SEQ ID NO: 841520 - RNA, 15 nt, Mycobacterium avium subsp. paratuberculosis
gccgagccggccgaa

SEQ ID NO: 841521 - RNA, 13 nt, Mycobacterium avium subsp. paratuberculosis
gccgagccgggcc

SEQ ID NO: 841522 - RNA, 14 nt, Mycobacterium avium subsp. paratuberculosis
gccgagccgggcgg

SEQ ID NO: 841523 - RNA, 15 nt, Mycobacterium avium subsp. paratuberculosis
gccgagccgggcggc

SEQ ID NO: 841524 - RNA, 17 nt, Mycobacterium avium subsp. paratuberculosis
gccgagccgggcggcca

SEQ ID NO: 841525 - RNA, 18 nt, Mycobacterium avium subsp. paratuberculosis
gccgagccgggcggccag

SEQ ID NO: 841526 - RNA, 19 nt, Mycobacterium avium subsp. paratuberculosis
gccgagccgggcggccagc

SEQ ID NO: 841527 - RNA, 14 nt, Mycobacterium avium subsp. paratuberculosis
gccgagccgguccg

SEQ ID NO: 841528 - RNA, 23 nt, Mycobacterium avium subsp. paratuberculosis
gccgagccgguccgaccagcggc

SEQ ID NO: 841529 - RNA, 14 nt, Mycobacterium avium subsp. paratuberculosis
gccgagccgucguc

SEQ ID NO: 841530 - RNA, 16 nt, Mycobacterium avium subsp. paratuberculosis
gccgagccgucgucgc

SEQ ID NO: 841531 - RNA, 15 nt, Mycobacterium avium subsp. paratuberculosis
gccgagcguucggcg

SEQ ID NO: 841532 - RNA, 23 nt, Mycobacterium avium subsp. paratuberculosis
gccgagcguucggcgcggaucgu

SEQ ID NO: 841533 - RNA, 15 nt, Mycobacterium avium subsp. paratuberculosis
gccgagcgucacgcu

SEQ ID NO: 841534 - RNA, 22 nt, Mycobacterium avium subsp. paratuberculosis
gccgagcgugcauucagugcga

SEQ ID NO: 841535 - RNA, 14 nt, Mycobacterium avium subsp. paratuberculosis
gccgagcgcaccgc

SEQ ID NO: 841536 - RNA, 15 nt, Mycobacterium avium subsp. paratuberculosis
gccgagcgcaccgcg

SEQ ID NO: 841537 - RNA, 22 nt, Mycobacterium avium subsp. paratuberculosis
gccgagcgcaccgcggagcgca

SEQ ID NO: 841538 - RNA, 19 nt, Mycobacterium avium subsp. paratuberculosis
gccgagcgcaagggccgac

SEQ ID NO: 841539 - RNA, 23 nt, Mycobacterium avium subsp. paratuberculosis
gccgagcgcaagggccgacaucg

SEQ ID NO: 841540 - RNA, 14 nt, Mycobacterium avium subsp. paratuberculosis
gccgagcgcaucga

SEQ ID NO: 841541 - RNA, 19 nt, Mycobacterium avium subsp. paratuberculosis
gccgagcccuuugcgcugc

SEQ ID NO: 841542 - RNA, 15 nt, Mycobacterium avium subsp. paratuberculosis
gccgagcccgccggc

SEQ ID NO: 841543 - RNA, 16 nt, Mycobacterium avium subsp. paratuberculosis
gccgagcccgccggcg

SEQ ID NO: 841544 - RNA, 18 nt, Mycobacterium avium subsp. paratuberculosis
gccgagcccgccggcggc

SEQ ID NO: 841545 - RNA, 21 nt, Mycobacterium avium subsp. paratuberculosis
gccgagcccgccggcggcgau

SEQ ID NO: 841546 - RNA, 13 nt, Mycobacterium avium subsp. paratuberculosis
gccgagcccgccg

SEQ ID NO: 841547 - RNA, 14 nt, Mycobacterium avium subsp. paratuberculosis
gccgagcccgccgg

SEQ ID NO: 841548 - RNA, 16 nt, Mycobacterium avium subsp. paratuberculosis
gccgagcaacagcccg

SEQ ID NO: 841549 - RNA, 17 nt, Mycobacterium avium subsp. paratuberculosis
gccgagcaacagcccga

SEQ ID NO: 841550 - RNA, 20 nt, Mycobacterium avium subsp. paratuberculosis
gccgagcacaccgucgcccg

SEQ ID NO: 841551 - RNA, 21 nt, Mycobacterium avium subsp. paratuberculosis
gccgagcacaccgucgcccgc

SEQ ID NO: 841552 - RNA, 16 nt, Mycobacterium avium subsp. paratuberculosis
gccgagcagcucagcc

SEQ ID NO: 841553 - RNA, 23 nt, Mycobacterium avium subsp. paratuberculosis
gccgagcagcucagccgccuggc

SEQ ID NO: 841554 - RNA, 16 nt, Mycobacterium avium subsp. paratuberculosis
gccgagcagcucggcg

SEQ ID NO: 841555 - RNA, 18 nt, Mycobacterium avium subsp. paratuberculosis
gccgagcagcucggcggc

SEQ ID NO: 841556 - RNA, 16 nt, Mycobacterium avium subsp. paratuberculosis
gccgagauuggacgac

SEQ ID NO: 841557 - RNA, 14 nt, Mycobacterium avium subsp. paratuberculosis
gccgagaucgaccc

SEQ ID NO: 841558 - RNA, 15 nt, Mycobacterium avium subsp. paratuberculosis
gccgagaucgcggug

SEQ ID NO: 841559 - RNA, 20 nt, Mycobacterium avium subsp. paratuberculosis
gccgagaucgcgguggcgcc

SEQ ID NO: 841560 - RNA, 13 nt, Mycobacterium avium subsp. paratuberculosis
gccgagcaaccgg

SEQ ID NO: 841561 - RNA, 16 nt, Mycobacterium avium subsp. paratuberculosis
gccgagcaaccgggau

SEQ ID NO: 841562 - RNA, 19 nt, Mycobacterium avium subsp. paratuberculosis
gccgacguuguugucgaug

SEQ ID NO: 841563 - RNA, 20 nt, Mycobacterium avium subsp. paratuberculosis
gccgacuagcgcggcggccu

SEQ ID NO: 841564 - RNA, 16 nt, Mycobacterium avium subsp. paratuberculosis
gccgacuccccgcccg

SEQ ID NO: 841565 - RNA, 19 nt, Mycobacterium avium subsp. paratuberculosis
gccgacuccccgcccggca

SEQ ID NO: 841566 - RNA, 18 nt, Mycobacterium avium subsp. paratuberculosis
gccgacucgaugcgcgug

SEQ ID NO: 841567 - RNA, 21 nt, Mycobacterium avium subsp. paratuberculosis
gccgacucgcaggugccggug

SEQ ID NO: 841568 - RNA, 18 nt, Mycobacterium avium subsp. paratuberculosis
gccgacgugcuuggccag

SEQ ID NO: 841569 - RNA, 19 nt, Mycobacterium avium subsp. paratuberculosis
gccgacgugcuuggccagc

SEQ ID NO: 841570 - RNA, 22 nt, Mycobacterium avium subsp. paratuberculosis
gccgacgucucauaccagugcc

SEQ ID NO: 841571 - RNA, 18 nt, Mycobacterium avium subsp. paratuberculosis
gccgacgucugguuggcc

SEQ ID NO: 841572 - RNA, 18 nt, Mycobacterium avium subsp. paratuberculosis
gccgacgugaugcacccg

SEQ ID NO: 841573 - RNA, 16 nt, Mycobacterium avium subsp. paratuberculosis
gccgacgugcccgauc

SEQ ID NO: 841574 - RNA, 14 nt, Mycobacterium avium subsp. paratuberculosis
gccgacgugccggu

SEQ ID NO: 841575 - RNA, 15 nt, Mycobacterium avium subsp. paratuberculosis
gccgacgugccggug

SEQ ID NO: 841576 - RNA, 17 nt, Mycobacterium avium subsp. paratuberculosis
gccgacgugccggugga

SEQ ID NO: 841577 - RNA, 13 nt, Mycobacterium avium subsp. paratuberculosis
gccgacguccugg

SEQ ID NO: 841578 - RNA, 17 nt, Mycobacterium avium subsp. paratuberculosis
gccgacgucgaccaggu

SEQ ID NO: 841579 - RNA, 19 nt, Mycobacterium avium subsp. paratuberculosis
gccgacgucaggguggccu

SEQ ID NO: 841580 - RNA, 12 nt, Mycobacterium avium subsp. paratuberculosis
gccgacgucggu

SEQ ID NO: 841581 - RNA, 14 nt, Mycobacterium avium subsp. paratuberculosis
gccgacgucgguga

SEQ ID NO: 841582 - RNA, 22 nt, Mycobacterium avium subsp. paratuberculosis
gccgacgucgugggcgauccgc

SEQ ID NO: 841583 - RNA, 13 nt, Mycobacterium avium subsp. paratuberculosis
gccgagacggcgu

SEQ ID NO: 841584 - RNA, 18 nt, Mycobacterium avium subsp. paratuberculosis
gccgagacugaugguggc

SEQ ID NO: 841585 - RNA, 23 nt, Mycobacterium avium subsp. paratuberculosis
gccgagacugaugguggcgcgca

SEQ ID NO: 841586 - RNA, 18 nt, Mycobacterium avium subsp. paratuberculosis
gccgagacauagacguua

SEQ ID NO: 841587 - RNA, 20 nt, Mycobacterium avium subsp. paratuberculosis
gccgagaccagccagaacga

SEQ ID NO: 841588 - RNA, 15 nt, Mycobacterium avium subsp. paratuberculosis
gccgagagcgcgucg

SEQ ID NO: 841589 - RNA, 21 nt, Mycobacterium avium subsp. paratuberculosis
gccgagagcgcgucgacgcgg

SEQ ID NO: 841590 - RNA, 23 nt, Mycobacterium avium subsp. paratuberculosis
gccgagagcgcgucgacgcgguc

SEQ ID NO: 841591 - RNA, 20 nt, Mycobacterium avium subsp. paratuberculosis
gccgagagcucuugcgcccc

SEQ ID NO: 841592 - RNA, 21 nt, Mycobacterium avium subsp. paratuberculosis
gccgagagcucuugcgcccca

SEQ ID NO: 841593 - RNA, 17 nt, Mycobacterium avium subsp. paratuberculosis
gccgacuugaucgcggc

SEQ ID NO: 841594 - RNA, 18 nt, Mycobacterium avium subsp. paratuberculosis
gccgacuugaucgcggcg

SEQ ID NO: 841595 - RNA, 18 nt, Mycobacterium avium subsp. paratuberculosis
gccgacuuggugccaugc

SEQ ID NO: 841596 - RNA, 15 nt, Mycobacterium avium subsp. paratuberculosis
gccgacuuggucagc

SEQ ID NO: 841597 - RNA, 19 nt, Mycobacterium avium subsp. paratuberculosis
gccgaucaccucgccggcc

SEQ ID NO: 841598 - RNA, 20 nt, Mycobacterium avium subsp. paratuberculosis
gccgaucaccucgccggccg

SEQ ID NO: 841599 - RNA, 21 nt, Mycobacterium avium subsp. paratuberculosis
gccgaucaccucgccggccgg

SEQ ID NO: 841600 - RNA, 21 nt, Mycobacterium avium subsp. paratuberculosis
gccgaucaccugacagacccg

SEQ ID NO: 841601 - RNA, 13 nt, Mycobacterium avium subsp. paratuberculosis
gccgaucacgccg

SEQ ID NO: 841602 - RNA, 17 nt, Mycobacterium avium subsp. paratuberculosis
gccgaucacgccggugg

SEQ ID NO: 841603 - RNA, 23 nt, Mycobacterium avium subsp. paratuberculosis
gccgaucacgccgguggacaggu

SEQ ID NO: 841604 - RNA, 16 nt, Mycobacterium avium subsp. paratuberculosis
gccgaucacggugauc

SEQ ID NO: 841605 - RNA, 21 nt, Mycobacterium avium subsp. paratuberculosis
gccgaucacggugaucgccgg

SEQ ID NO: 841606 - RNA, 13 nt, Mycobacterium avium subsp. paratuberculosis
gccgaucagugcc

SEQ ID NO: 841607 - RNA, 16 nt, Mycobacterium avium subsp. paratuberculosis
gccgaucagugccgcg

SEQ ID NO: 841608 - RNA, 20 nt, Mycobacterium avium subsp. paratuberculosis
gccgaucagugccgcgccaa

SEQ ID NO: 841609 - RNA, 22 nt, Mycobacterium avium subsp. paratuberculosis
gccgaucagugccgcgccaacg

SEQ ID NO: 841610 - RNA, 16 nt, Mycobacterium avium subsp. paratuberculosis
gccgauccagccgucg

SEQ ID NO: 841611 - RNA, 17 nt, Mycobacterium avium subsp. paratuberculosis
gccgauccagccgucgu

SEQ ID NO: 841612 - RNA, 18 nt, Mycobacterium avium subsp. paratuberculosis
gccgaucauggucggcga

SEQ ID NO: 841613 - RNA, 22 nt, Mycobacterium avium subsp. paratuberculosis
gccgaucauggucggcgacgcc

SEQ ID NO: 841614 - RNA, 20 nt, Mycobacterium avium subsp. paratuberculosis
gccgaucagcgucagcaccg

SEQ ID NO: 841615 - RNA, 22 nt, Mycobacterium avium subsp. paratuberculosis
gccgaucagcgucagcaccgcg

SEQ ID NO: 841616 - RNA, 23 nt, Mycobacterium avium subsp. paratuberculosis
gccgaucagcgucagcaccgcga

SEQ ID NO: 841617 - RNA, 15 nt, Mycobacterium avium subsp. paratuberculosis
gccgaucagcggcgg

SEQ ID NO: 841618 - RNA, 20 nt, Mycobacterium avium subsp. paratuberculosis
gccgaucagcggcgggccca

SEQ ID NO: 841619 - RNA, 22 nt, Mycobacterium avium subsp. paratuberculosis
gccgaucagcggcgggcccagc

SEQ ID NO: 841620 - RNA, 15 nt, Mycobacterium avium subsp. paratuberculosis
gccgaucagcugcuc

SEQ ID NO: 841621 - RNA, 18 nt, Mycobacterium avium subsp. paratuberculosis
gccgaucagcugcucggc

SEQ ID NO: 841622 - RNA, 20 nt, Mycobacterium avium subsp. paratuberculosis
gccgaucagcugcucggcca

SEQ ID NO: 841623 - RNA, 22 nt, Mycobacterium avium subsp. paratuberculosis
gccgaucagcugcucggccacc

SEQ ID NO: 841624 - RNA, 14 nt, Mycobacterium avium subsp. paratuberculosis
gccgaucagcggcg

SEQ ID NO: 841625 - RNA, 13 nt, Mycobacterium avium subsp. paratuberculosis
gccgaucagcacc

SEQ ID NO: 841626 - RNA, 20 nt, Mycobacterium avium subsp. paratuberculosis
gccgaguuccugcgaccgcc

SEQ ID NO: 841627 - RNA, 21 nt, Mycobacterium avium subsp. paratuberculosis
gccgaguuccugcgaccgccg

SEQ ID NO: 841628 - RNA, 23 nt, Mycobacterium avium subsp. paratuberculosis
gccgaguuccugcgaccgccgcc

SEQ ID NO: 841629 - RNA, 16 nt, Mycobacterium avium subsp. paratuberculosis
gccgaguucgaccucg

SEQ ID NO: 841630 - RNA, 14 nt, Mycobacterium avium subsp. paratuberculosis
gccgaggucgccgg

SEQ ID NO: 841631 - RNA, 15 nt, Mycobacterium avium subsp. paratuberculosis
gccgaggucgccggu

SEQ ID NO: 841632 - RNA, 19 nt, Mycobacterium avium subsp. paratuberculosis
gccgaggucgcggcggccg

SEQ ID NO: 841633 - RNA, 14 nt, Mycobacterium avium subsp. paratuberculosis
gccgaggucggucg

SEQ ID NO: 841634 - RNA, 22 nt, Mycobacterium avium subsp. paratuberculosis
gccgaggucggucgcggcaucc

SEQ ID NO: 841635 - RNA, 17 nt, Mycobacterium avium subsp. paratuberculosis
gccgaguuuggcgucga

SEQ ID NO: 841636 - RNA, 20 nt, Mycobacterium avium subsp. paratuberculosis
gccgaguuuggcgucgaugc

SEQ ID NO: 841637 - RNA, 14 nt, Mycobacterium avium subsp. paratuberculosis
gccgagcucgaugu

SEQ ID NO: 841638 - RNA, 15 nt, Mycobacterium avium subsp. paratuberculosis
gccgagcucggccac

SEQ ID NO: 841639 - RNA, 17 nt, Mycobacterium avium subsp. paratuberculosis
gccgagcucggccacca

SEQ ID NO: 841640 - RNA, 20 nt, Mycobacterium avium subsp. paratuberculosis
gccgagcucggccaccagcg

SEQ ID NO: 841641 - RNA, 22 nt, Mycobacterium avium subsp. paratuberculosis
gccgagcucgugaugguccagc

SEQ ID NO: 841642 - RNA, 21 nt, Mycobacterium avium subsp. paratuberculosis
gccgagggggaagucgaccgg

SEQ ID NO: 841643 - RNA, 13 nt, Mycobacterium avium subsp. paratuberculosis
gccgagggugccg

SEQ ID NO: 841644 - RNA, 22 nt, Mycobacterium avium subsp. paratuberculosis
gccgagggugccggccaccggc

SEQ ID NO: 841645 - RNA, 17 nt, Mycobacterium avium subsp. paratuberculosis
gccgagguagccgcgca

SEQ ID NO: 841646 - RNA, 18 nt, Mycobacterium avium subsp. paratuberculosis
gccgagguagccgcgcac

SEQ ID NO: 841647 - RNA, 22 nt, Mycobacterium avium subsp. paratuberculosis
gccgagguagccgcgcaccacg

SEQ ID NO: 841648 - RNA, 17 nt, Mycobacterium avium subsp. paratuberculosis
gccgagguagucggccu

SEQ ID NO: 841649 - RNA, 16 nt, Mycobacterium avium subsp. paratuberculosis
gccgaggucaccaccg

SEQ ID NO: 841650 - RNA, 18 nt, Mycobacterium avium subsp. paratuberculosis
gccgaggucaccaccgag

SEQ ID NO: 841651 - RNA, 15 nt, Mycobacterium avium subsp. paratuberculosis
gccgaggucaccgcg

SEQ ID NO: 841652 - RNA, 16 nt, Mycobacterium avium subsp. paratuberculosis
gccgaggucaccgcgg

SEQ ID NO: 841653 - RNA, 15 nt, Mycobacterium avium subsp. paratuberculosis
gccgagguccgcggu

SEQ ID NO: 841654 - RNA, 16 nt, Mycobacterium avium subsp. paratuberculosis
gccgaggucgccgacg

SEQ ID NO: 841655 - RNA, 21 nt, Mycobacterium avium subsp. paratuberculosis
gccgaggucgccgacgccguc

SEQ ID NO: 841656 - RNA, 22 nt, Mycobacterium avium subsp. paratuberculosis
gccgcccacaccgacaccggcc

SEQ ID NO: 841657 - RNA, 23 nt, Mycobacterium avium subsp. paratuberculosis
gccgcccacaccgacaccggccg

SEQ ID NO: 841658 - RNA, 24 nt, Mycobacterium avium subsp. paratuberculosis
gccgcccacaccgacaccggccgg

SEQ ID NO: 841659 - RNA, 14 nt, Mycobacterium avium subsp. paratuberculosis
gccgcccaccaccg

SEQ ID NO: 841660 - RNA, 15 nt, Mycobacterium avium subsp. paratuberculosis
gccgcccaccaccgg

SEQ ID NO: 841661 - RNA, 16 nt, Mycobacterium avium subsp. paratuberculosis
gccgcccaccaccggc

SEQ ID NO: 841662 - RNA, 18 nt, Mycobacterium avium subsp. paratuberculosis
gccgcccaccaccggcuu

SEQ ID NO: 841663 - RNA, 22 nt, Mycobacterium avium subsp. paratuberculosis
gccgcccaccacgaaccaggcg

SEQ ID NO: 841664 - RNA, 20 nt, Mycobacterium avium subsp. paratuberculosis
gccgcccacgccgcccaggc

SEQ ID NO: 841665 - RNA, 21 nt, Mycobacterium avium subsp. paratuberculosis
gccgcccacgccgcccaggcc

SEQ ID NO: 841666 - RNA, 20 nt, Mycobacterium avium subsp. paratuberculosis
gccgcccaacgacgucggcg

SEQ ID NO: 841667 - RNA, 23 nt, Mycobacterium avium subsp. paratuberculosis
gccgcccaacgacgucggcguca

SEQ ID NO: 841668 - RNA, 18 nt, Mycobacterium avium subsp. paratuberculosis
gccgccaguuguuggccg

SEQ ID NO: 841669 - RNA, 15 nt, Mycobacterium avium subsp. paratuberculosis
gccgccaucauccgc

SEQ ID NO: 841670 - RNA, 22 nt, Mycobacterium avium subsp. paratuberculosis
gccgccaucgaucgggcgucgc

SEQ ID NO: 841671 - RNA, 16 nt, Mycobacterium avium subsp. paratuberculosis
gccgccaucgccgccg

SEQ ID NO: 841672 - RNA, 18 nt, Mycobacterium avium subsp. paratuberculosis
gccgccaucgccgccgcc

SEQ ID NO: 841673 - RNA, 15 nt, Mycobacterium avium subsp. paratuberculosis
gccgccaucgccucg

SEQ ID NO: 841674 - RNA, 12 nt, Mycobacterium avium subsp. paratuberculosis
gccgccauccgc

SEQ ID NO: 841675 - RNA, 14 nt, Mycobacterium avium subsp. paratuberculosis
gccgccauccgcgc

SEQ ID NO: 841676 - RNA, 15 nt, Mycobacterium avium subsp. paratuberculosis
gccgccauccgcgcc

SEQ ID NO: 841677 - RNA, 21 nt, Mycobacterium avium subsp. paratuberculosis
gccgccauccgcgccgaacgc

SEQ ID NO: 841678 - RNA, 13 nt, Mycobacterium avium subsp. paratuberculosis
gccgccaucaccg

SEQ ID NO: 841679 - RNA, 15 nt, Mycobacterium avium subsp. paratuberculosis
gccgccaucaccgcg

SEQ ID NO: 841680 - RNA, 17 nt, Mycobacterium avium subsp. paratuberculosis
gccgccaucaccgcgcu

SEQ ID NO: 841681 - RNA, 16 nt, Mycobacterium avium subsp. paratuberculosis
gccgccaggucggggc

SEQ ID NO: 841682 - RNA, 17 nt, Mycobacterium avium subsp. paratuberculosis
gccgccagggcgcggcg

SEQ ID NO: 841683 - RNA, 16 nt, Mycobacterium avium subsp. paratuberculosis
gccgccagggccaggu

SEQ ID NO: 841684 - RNA, 20 nt, Mycobacterium avium subsp. paratuberculosis
gccgccagggucucgggcag

SEQ ID NO: 841685 - RNA, 21 nt, Mycobacterium avium subsp. paratuberculosis
gccgccagggucucgggcagc

SEQ ID NO: 841686 - RNA, 16 nt, Mycobacterium avium subsp. paratuberculosis
gccgccagguuggcgg

SEQ ID NO: 841687 - RNA, 17 nt, Mycobacterium avium subsp. paratuberculosis
gccgccagguuggcggc

SEQ ID NO: 841688 - RNA, 21 nt, Mycobacterium avium subsp. paratuberculosis
gccgccagguuggcggcggcc

SEQ ID NO: 841689 - RNA, 17 nt, Mycobacterium avium subsp. paratuberculosis
gccgcccagcagcgggc

SEQ ID NO: 841690 - RNA, 18 nt, Mycobacterium avium subsp. paratuberculosis
gccgcccagcagcgggcc

SEQ ID NO: 841691 - RNA, 20 nt, Mycobacterium avium subsp. paratuberculosis
gccgcccagcagcgggcccg

SEQ ID NO: 841692 - RNA, 17 nt, Mycobacterium avium subsp. paratuberculosis
gccgcccagcccgcgcc

SEQ ID NO: 841693 - RNA, 18 nt, Mycobacterium avium subsp. paratuberculosis
gccgcccagcccgcgccg

SEQ ID NO: 841694 - RNA, 20 nt, Mycobacterium avium subsp. paratuberculosis
gccgcccacuggucguugca

SEQ ID NO: 841695 - RNA, 13 nt, Mycobacterium avium subsp. paratuberculosis
gccgcccagcggc

SEQ ID NO: 841696 - RNA, 14 nt, Mycobacterium avium subsp. paratuberculosis
gccgcccagcggcc

SEQ ID NO: 841697 - RNA, 16 nt, Mycobacterium avium subsp. paratuberculosis
gccgcccagcggcccc

SEQ ID NO: 841698 - RNA, 17 nt, Mycobacterium avium subsp. paratuberculosis
gccgcccagcggccccg

SEQ ID NO: 841699 - RNA, 15 nt, Mycobacterium avium subsp. paratuberculosis
gccgcccagcgguga

SEQ ID NO: 841700 - RNA, 13 nt, Mycobacterium avium subsp. paratuberculosis
gccgcccaggccc

SEQ ID NO: 841701 - RNA, 15 nt, Mycobacterium avium subsp. paratuberculosis
gccgcccaggccccg

SEQ ID NO: 841702 - RNA, 19 nt, Mycobacterium avium subsp. paratuberculosis
gccgcccaggccccggccg

SEQ ID NO: 841703 - RNA, 20 nt, Mycobacterium avium subsp. paratuberculosis
gccgcccaggccccggccga

SEQ ID NO: 841704 - RNA, 15 nt, Mycobacterium avium subsp. paratuberculosis
gccgcccaucggcag

SEQ ID NO: 841705 - RNA, 16 nt, Mycobacterium avium subsp. paratuberculosis
gccgcccaucaccccg

SEQ ID NO: 841706 - RNA, 20 nt, Mycobacterium avium subsp. paratuberculosis
gccgcccaucaccccgaagc

SEQ ID NO: 841707 - RNA, 23 nt, Mycobacterium avium subsp. paratuberculosis
gccgcccaucagcaggaccaggc

SEQ ID NO: 841708 - RNA, 16 nt, Mycobacterium avium subsp. paratuberculosis
gccgcccagucgccgc

SEQ ID NO: 841709 - RNA, 17 nt, Mycobacterium avium subsp. paratuberculosis
gccgcccagucgccgcc

SEQ ID NO: 841710 - RNA, 14 nt, Mycobacterium avium subsp. paratuberculosis
gccgcccaucaccc

SEQ ID NO: 841711 - RNA, 17 nt, Mycobacterium avium subsp. paratuberculosis
gccgcccaggcgggcca

SEQ ID NO: 841712 - RNA, 23 nt, Mycobacterium avium subsp. paratuberculosis
gccgcccaggcgggccagcucga

SEQ ID NO: 841713 - RNA, 13 nt, Mycobacterium avium subsp. paratuberculosis
gccgcccgcccga

SEQ ID NO: 841714 - RNA, 14 nt, Mycobacterium avium subsp. paratuberculosis
gccgcccgcccgag

SEQ ID NO: 841715 - RNA, 22 nt, Mycobacterium avium subsp. paratuberculosis
gccgcccgcccgagcgucauuc

SEQ ID NO: 841716 - RNA, 13 nt, Mycobacterium avium subsp. paratuberculosis
gccgcccgaacuc

SEQ ID NO: 841717 - RNA, 12 nt, Mycobacterium avium subsp. paratuberculosis
gccgcccgauca

SEQ ID NO: 841718 - RNA, 23 nt, Mycobacterium avium subsp. paratuberculosis
gccgcccgaucaucucaccgacg

SEQ ID NO: 841719 - RNA, 13 nt, Mycobacterium avium subsp. paratuberculosis
gccgcccgcacca

SEQ ID NO: 841720 - RNA, 15 nt, Mycobacterium avium subsp. paratuberculosis
gccgcccgcaccagc

SEQ ID NO: 841721 - RNA, 13 nt, Mycobacterium avium subsp. paratuberculosis
gccgcccgcaccu

SEQ ID NO: 841722 - RNA, 17 nt, Mycobacterium avium subsp. paratuberculosis
gccgcccgcaccugcgc

SEQ ID NO: 841723 - RNA, 19 nt, Mycobacterium avium subsp. paratuberculosis
gccgcccgcaccugcgcgc

SEQ ID NO: 841724 - RNA, 21 nt, Mycobacterium avium subsp. paratuberculosis
gccgcccgcaccugcgcgccg

SEQ ID NO: 841725 - RNA, 14 nt, Mycobacterium avium subsp. paratuberculosis
gccgcccccgccgc

SEQ ID NO: 841726 - RNA, 16 nt, Mycobacterium avium subsp. paratuberculosis
gccgcccccgccgcga

SEQ ID NO: 841727 - RNA, 18 nt, Mycobacterium avium subsp. paratuberculosis
gccgcccccgccgcgagc

SEQ ID NO: 841728 - RNA, 15 nt, Mycobacterium avium subsp. paratuberculosis
gccgcccccgcggcg

SEQ ID NO: 841729 - RNA, 16 nt, Mycobacterium avium subsp. paratuberculosis
gccgcccccgcggcgu

SEQ ID NO: 841730 - RNA, 17 nt, Mycobacterium avium subsp. paratuberculosis
gccgcccccgcggcguc

SEQ ID NO: 841731 - RNA, 20 nt, Mycobacterium avium subsp. paratuberculosis
gccgcccccgauagccccgc

SEQ ID NO: 841732 - RNA, 16 nt, Mycobacterium avium subsp. paratuberculosis
gccgcccccgcccaca

SEQ ID NO: 841733 - RNA, 20 nt, Mycobacterium avium subsp. paratuberculosis
gccgccccgaacagcgccag

SEQ ID NO: 841734 - RNA, 21 nt, Mycobacterium avium subsp. paratuberculosis
gccgccccgaucggauccgcc

SEQ ID NO: 841735 - RNA, 13 nt, Mycobacterium avium subsp. paratuberculosis
gccgccccggccg

SEQ ID NO: 841736 - RNA, 14 nt, Mycobacterium avium subsp. paratuberculosis
gccgccccggccgc

SEQ ID NO: 841737 - RNA, 15 nt, Mycobacterium avium subsp. paratuberculosis
gccgccccggccgcg

SEQ ID NO: 841738 - RNA, 21 nt, Mycobacterium avium subsp. paratuberculosis
gccgccccggccgcgcaccgc

SEQ ID NO: 841739 - RNA, 22 nt, Mycobacterium avium subsp. paratuberculosis
gccgccgcauuccucggccagc

SEQ ID NO: 841740 - RNA, 23 nt, Mycobacterium avium subsp. paratuberculosis
gccgccgcauuccucggccagcu

SEQ ID NO: 841741 - RNA, 16 nt, Mycobacterium avium subsp. paratuberculosis
gccgccgcagcgcagc

SEQ ID NO: 841742 - RNA, 17 nt, Mycobacterium avium subsp. paratuberculosis
gccgccgcagcgcagcg

SEQ ID NO: 841743 - RNA, 14 nt, Mycobacterium avium subsp. paratuberculosis
gccgccgcaggcga

SEQ ID NO: 841744 - RNA, 19 nt, Mycobacterium avium subsp. paratuberculosis
gccgccgcauaccgcccgc

SEQ ID NO: 841745 - RNA, 22 nt, Mycobacterium avium subsp. paratuberculosis
gccgccgcauaccgcccgcgcu

SEQ ID NO: 841746 - RNA, 17 nt, Mycobacterium avium subsp. paratuberculosis
gccgccgagcaacagcc

SEQ ID NO: 841747 - RNA, 20 nt, Mycobacterium avium subsp. paratuberculosis
gccgccgagcaacagcccga

SEQ ID NO: 841748 - RNA, 16 nt, Mycobacterium avium subsp. paratuberculosis
gccgccgccagcgcgg

SEQ ID NO: 841749 - RNA, 13 nt, Mycobacterium avium subsp. paratuberculosis
gccgccgccaccg

SEQ ID NO: 841750 - RNA, 14 nt, Mycobacterium avium subsp. paratuberculosis
gccgccgccaccgu

SEQ ID NO: 841751 - RNA, 15 nt, Mycobacterium avium subsp. paratuberculosis
gccgccgccaccguc

SEQ ID NO: 841752 - RNA, 22 nt, Mycobacterium avium subsp. paratuberculosis
gccgccgccaucuccuccgggc

SEQ ID NO: 841753 - RNA, 14 nt, Mycobacterium avium subsp. paratuberculosis
gccgccgccagcac

SEQ ID NO: 841754 - RNA, 13 nt, Mycobacterium avium subsp. paratuberculosis
gccgccgccagcc

SEQ ID NO: 841755 - RNA, 16 nt, Mycobacterium avium subsp. paratuberculosis
gccgccgccagccagc

SEQ ID NO: 841756 - RNA, 13 nt, Mycobacterium avium subsp. paratuberculosis
gccgccgcaccgg

SEQ ID NO: 841757 - RNA, 14 nt, Mycobacterium avium subsp. paratuberculosis
gccgccgcaccggc

SEQ ID NO: 841758 - RNA, 15 nt, Mycobacterium avium subsp. paratuberculosis
gccgccgcaccggcc

SEQ ID NO: 841759 - RNA, 20 nt, Mycobacterium avium subsp. paratuberculosis
gccgccgcaccggccggccc

SEQ ID NO: 841760 - RNA, 14 nt, Mycobacterium avium subsp. paratuberculosis
gccgccgcagcagc

SEQ ID NO: 841761 - RNA, 19 nt, Mycobacterium avium subsp. paratuberculosis
gccgccgcagcagccgcgc

SEQ ID NO: 841762 - RNA, 18 nt, Mycobacterium avium subsp. paratuberculosis
gccgccgagcucggccac

SEQ ID NO: 841763 - RNA, 21 nt, Mycobacterium avium subsp. paratuberculosis
gccgccgagcucggccaccag

SEQ ID NO: 841764 - RNA, 21 nt, Mycobacterium avium subsp. paratuberculosis
gccgccgauucaaccccgcgc

SEQ ID NO: 841765 - RNA, 22 nt, Mycobacterium avium subsp. paratuberculosis
gccgccgauucaaccccgcgcg

SEQ ID NO: 841766 - RNA, 23 nt, Mycobacterium avium subsp. paratuberculosis
gccgccgauucaaccccgcgcgc

SEQ ID NO: 841767 - RNA, 16 nt, Mycobacterium avium subsp. paratuberculosis
gccgccgauuccggcc

SEQ ID NO: 841768 - RNA, 17 nt, Mycobacterium avium subsp. paratuberculosis
gccgccgauuccggccg

SEQ ID NO: 841769 - RNA, 18 nt, Mycobacterium avium subsp. paratuberculosis
gccgccgauuccggccgg

SEQ ID NO: 841770 - RNA, 18 nt, Mycobacterium avium subsp. paratuberculosis
gccgccgcaauacaccgc

SEQ ID NO: 841771 - RNA, 19 nt, Mycobacterium avium subsp. paratuberculosis
gccgccgcaauacaccgcg

SEQ ID NO: 841772 - RNA, 20 nt, Mycobacterium avium subsp. paratuberculosis
gccgccgcacacuuccggga

SEQ ID NO: 841773 - RNA, 22 nt, Mycobacterium avium subsp. paratuberculosis
gccgccgacugugcgaugucgg

SEQ ID NO: 841774 - RNA, 13 nt, Mycobacterium avium subsp. paratuberculosis
gccgccgagccgc

SEQ ID NO: 841775 - RNA, 15 nt, Mycobacterium avium subsp. paratuberculosis
gccgccgagccgcgg

SEQ ID NO: 841776 - RNA, 13 nt, Mycobacterium avium subsp. paratuberculosis
gccgccgagcguc

SEQ ID NO: 841777 - RNA, 14 nt, Mycobacterium avium subsp. paratuberculosis
gccgccgagcguca

SEQ ID NO: 841778 - RNA, 17 nt, Mycobacterium avium subsp. paratuberculosis
gccgccgacgucguggg

SEQ ID NO: 841779 - RNA, 17 nt, Mycobacterium avium subsp. paratuberculosis
gccgccgacuccccgcc

SEQ ID NO: 841780 - RNA, 13 nt, Mycobacterium avium subsp. paratuberculosis
gccgccgacggug

SEQ ID NO: 841781 - RNA, 17 nt, Mycobacterium avium subsp. paratuberculosis
gccgccgacgguggccc

SEQ ID NO: 841782 - RNA, 13 nt, Mycobacterium avium subsp. paratuberculosis
gccgccgacgucg

SEQ ID NO: 841783 - RNA, 16 nt, Mycobacterium avium subsp. paratuberculosis
gccgccgacgucgugg

SEQ ID NO: 841784 - RNA, 15 nt, Mycobacterium avium subsp. paratuberculosis
gccgccgacgauguc

SEQ ID NO: 841785 - RNA, 23 nt, Mycobacterium avium subsp. paratuberculosis
gccgccgaccacaugccguugcc

SEQ ID NO: 841786 - RNA, 17 nt, Mycobacterium avium subsp. paratuberculosis
gccgccgaccacgccgc

SEQ ID NO: 841787 - RNA, 15 nt, Mycobacterium avium subsp. paratuberculosis
gccgccgacagcacc

SEQ ID NO: 841788 - RNA, 17 nt, Mycobacterium avium subsp. paratuberculosis
gccgccgacagcaccuc

SEQ ID NO: 841789 - RNA, 19 nt, Mycobacterium avium subsp. paratuberculosis
gccgccgacagcaccucgc

SEQ ID NO: 841790 - RNA, 12 nt, Mycobacterium avium subsp. paratuberculosis
gccgccgaccgc

SEQ ID NO: 841791 - RNA, 17 nt, Mycobacterium avium subsp. paratuberculosis
gccgccgaccgccgagc

SEQ ID NO: 841792 - RNA, 18 nt, Mycobacterium avium subsp. paratuberculosis
gccgccgaccgccgagcg

SEQ ID NO: 841793 - RNA, 21 nt, Mycobacterium avium subsp. paratuberculosis
gccgccgaccgccgagcgggc

SEQ ID NO: 841794 - RNA, 22 nt, Mycobacterium avium subsp. paratuberculosis
gccgccgaccgccgagcgggcg

SEQ ID NO: 841795 - RNA, 15 nt, Mycobacterium avium subsp. paratuberculosis
gccgccgaacagccg

SEQ ID NO: 841796 - RNA, 16 nt, Mycobacterium avium subsp. paratuberculosis
gccgccgaacagccgg

SEQ ID NO: 841797 - RNA, 16 nt, Mycobacterium avium subsp. paratuberculosis
gccgccgaagccggcu

SEQ ID NO: 841798 - RNA, 19 nt, Mycobacterium avium subsp. paratuberculosis
gccgccgaagccggcucga

SEQ ID NO: 841799 - RNA, 14 nt, Mycobacterium avium subsp. paratuberculosis
gccgccgaagcggc

SEQ ID NO: 841800 - RNA, 16 nt, Mycobacterium avium subsp. paratuberculosis
gccgccgaagcggcgc

SEQ ID NO: 841801 - RNA, 17 nt, Mycobacterium avium subsp. paratuberculosis
gccgccgaagcggcgca

SEQ ID NO: 841802 - RNA, 18 nt, Mycobacterium avium subsp. paratuberculosis
gccgccgaagcccgacau

SEQ ID NO: 841803 - RNA, 14 nt, Mycobacterium avium subsp. paratuberculosis
gccgccgacaccac

SEQ ID NO: 841804 - RNA, 15 nt, Mycobacterium avium subsp. paratuberculosis
gccgccgacaccacc

SEQ ID NO: 841805 - RNA, 20 nt, Mycobacterium avium subsp. paratuberculosis
gccgccgacaccaccacgaa

SEQ ID NO: 841806 - RNA, 15 nt, Mycobacterium avium subsp. paratuberculosis
gccgcccugcccguc

SEQ ID NO: 841807 - RNA, 16 nt, Mycobacterium avium subsp. paratuberculosis
gccgcccucggugacg

SEQ ID NO: 841808 - RNA, 17 nt, Mycobacterium avium subsp. paratuberculosis
gccgcccucucacggcg

SEQ ID NO: 841809 - RNA, 20 nt, Mycobacterium avium subsp. paratuberculosis
gccgcccucucacggcggua

SEQ ID NO: 841810 - RNA, 13 nt, Mycobacterium avium subsp. paratuberculosis
gccgcccucgccg

SEQ ID NO: 841811 - RNA, 14 nt, Mycobacterium avium subsp. paratuberculosis
gccgcccucgccga

SEQ ID NO: 841812 - RNA, 23 nt, Mycobacterium avium subsp. paratuberculosis
gccgcccucgccgaaccggggcc

SEQ ID NO: 841813 - RNA, 16 nt, Mycobacterium avium subsp. paratuberculosis
gccgcccucgcugccg

SEQ ID NO: 841814 - RNA, 13 nt, Mycobacterium avium subsp. paratuberculosis
gccgcccucggcc

SEQ ID NO: 841815 - RNA, 14 nt, Mycobacterium avium subsp. paratuberculosis
gccgcccucggccg

SEQ ID NO: 841816 - RNA, 15 nt, Mycobacterium avium subsp. paratuberculosis
gccgcccucggccgu

SEQ ID NO: 841817 - RNA, 18 nt, Mycobacterium avium subsp. paratuberculosis
gccgcccucggccguacc

SEQ ID NO: 841818 - RNA, 17 nt, Mycobacterium avium subsp. paratuberculosis
gccgcccguccgggccg

SEQ ID NO: 841819 - RNA, 14 nt, Mycobacterium avium subsp. paratuberculosis
gccgcccguccugg

SEQ ID NO: 841820 - RNA, 14 nt, Mycobacterium avium subsp. paratuberculosis
gccgcccgucgccu

SEQ ID NO: 841821 - RNA, 22 nt, Mycobacterium avium subsp. paratuberculosis
gccgcccgucgccuccugcugg

SEQ ID NO: 841822 - RNA, 20 nt, Mycobacterium avium subsp. paratuberculosis
gccgcccggcgagcagcccg

SEQ ID NO: 841823 - RNA, 13 nt, Mycobacterium avium subsp. paratuberculosis
gccgcccgucggg

SEQ ID NO: 841824 - RNA, 15 nt, Mycobacterium avium subsp. paratuberculosis
gccgcccgucggggc

SEQ ID NO: 841825 - RNA, 19 nt, Mycobacterium avium subsp. paratuberculosis
gccgcccuugcucgcggcg

SEQ ID NO: 841826 - RNA, 17 nt, Mycobacterium avium subsp. paratuberculosis
gccgcccuuguugaugg

SEQ ID NO: 841827 - RNA, 23 nt, Mycobacterium avium subsp. paratuberculosis
gccgcccuuguugaugguguugc

SEQ ID NO: 841828 - RNA, 23 nt, Mycobacterium avium subsp. paratuberculosis
gccgccgaaagccuccgcgauca

SEQ ID NO: 841829 - RNA, 23 nt, Mycobacterium avium subsp. paratuberculosis
gccgcccugcgggaacagcggga

SEQ ID NO: 841830 - RNA, 13 nt, Mycobacterium avium subsp. paratuberculosis
gccgcccggcgag

SEQ ID NO: 841831 - RNA, 22 nt, Mycobacterium avium subsp. paratuberculosis
gccgcccgcuggggcgcaccgc

SEQ ID NO: 841832 - RNA, 13 nt, Mycobacterium avium subsp. paratuberculosis
gccgcccggcgcg

SEQ ID NO: 841833 - RNA, 14 nt, Mycobacterium avium subsp. paratuberculosis
gccgcccggcgcgc

SEQ ID NO: 841834 - RNA, 15 nt, Mycobacterium avium subsp. paratuberculosis
gccgcccggcgcgcc

SEQ ID NO: 841835 - RNA, 17 nt, Mycobacterium avium subsp. paratuberculosis
gccgcccggcgcgccgc

SEQ ID NO: 841836 - RNA, 18 nt, Mycobacterium avium subsp. paratuberculosis
gccgcccggcgcgccgca

SEQ ID NO: 841837 - RNA, 19 nt, Mycobacterium avium subsp. paratuberculosis
gccgcccggcgcgccgcag

SEQ ID NO: 841838 - RNA, 14 nt, Mycobacterium avium subsp. paratuberculosis
gccgcccgggcccg

SEQ ID NO: 841839 - RNA, 13 nt, Mycobacterium avium subsp. paratuberculosis
gccgcccgggccg

SEQ ID NO: 841840 - RNA, 14 nt, Mycobacterium avium subsp. paratuberculosis
gccgcccgggcggc

SEQ ID NO: 841841 - RNA, 16 nt, Mycobacterium avium subsp. paratuberculosis
gccgcccgggcggccc

SEQ ID NO: 841842 - RNA, 18 nt, Mycobacterium avium subsp. paratuberculosis
gccgcccgggcggcccgc

SEQ ID NO: 841843 - RNA, 19 nt, Mycobacterium avium subsp. paratuberculosis
gccgcccgggcggcccgca

SEQ ID NO: 841844 - RNA, 18 nt, Mycobacterium avium subsp. paratuberculosis
gccgcccggcgaucucgg

SEQ ID NO: 841845 - RNA, 22 nt, Mycobacterium avium subsp. paratuberculosis
gccgcccggcgaucucggagac

SEQ ID NO: 841846 - RNA, 12 nt, Mycobacterium avium subsp. paratuberculosis
gccgcccggcgc

SEQ ID NO: 841847 - RNA, 13 nt, Mycobacterium avium subsp. paratuberculosis
gccgcccgguccg

SEQ ID NO: 841848 - RNA, 14 nt, Mycobacterium avium subsp. paratuberculosis
gccgcccgcgcggc

SEQ ID NO: 841849 - RNA, 19 nt, Mycobacterium avium subsp. paratuberculosis
gccgcccgcgcggcggcca

SEQ ID NO: 841850 - RNA, 17 nt, Mycobacterium avium subsp. paratuberculosis
gccgcccgcgcgugguc

SEQ ID NO: 841851 - RNA, 20 nt, Mycobacterium avium subsp. paratuberculosis
gccgcccgcgcgugguccca

SEQ ID NO: 841852 - RNA, 20 nt, Mycobacterium avium subsp. paratuberculosis
gccgaucgugaauucggccg

SEQ ID NO: 841853 - RNA, 17 nt, Mycobacterium avium subsp. paratuberculosis
gccgaucgugacgccgu

SEQ ID NO: 841854 - RNA, 21 nt, Mycobacterium avium subsp. paratuberculosis
gccgaucgugacgccguccga

SEQ ID NO: 841855 - RNA, 19 nt, Mycobacterium avium subsp. paratuberculosis
gccgaucucgaccagcgcc

SEQ ID NO: 841856 - RNA, 15 nt, Mycobacterium avium subsp. paratuberculosis
gccgaucucggccaa

SEQ ID NO: 841857 - RNA, 16 nt, Mycobacterium avium subsp. paratuberculosis
gccgaucucggccaac

SEQ ID NO: 841858 - RNA, 18 nt, Mycobacterium avium subsp. paratuberculosis
gccgaucucggccaaccg

SEQ ID NO: 841859 - RNA, 23 nt, Mycobacterium avium subsp. paratuberculosis
gccgaucucguagcccaccucga

SEQ ID NO: 841860 - RNA, 19 nt, Mycobacterium avium subsp. paratuberculosis
gccgaucugaccgagcagc

SEQ ID NO: 841861 - RNA, 14 nt, Mycobacterium avium subsp. paratuberculosis
gccgauuccggccg

SEQ ID NO: 841862 - RNA, 15 nt, Mycobacterium avium subsp. paratuberculosis
gccgauuccggccgg

SEQ ID NO: 841863 - RNA, 16 nt, Mycobacterium avium subsp. paratuberculosis
gccgauuccgucggug

SEQ ID NO: 841864 - RNA, 23 nt, Mycobacterium avium subsp. paratuberculosis
gccgauuccgucgguggcggugg

SEQ ID NO: 841865 - RNA, 14 nt, Mycobacterium avium subsp. paratuberculosis
gccgaucugcucgg

SEQ ID NO: 841866 - RNA, 16 nt, Mycobacterium avium subsp. paratuberculosis
gccgaucggggcgcag

SEQ ID NO: 841867 - RNA, 18 nt, Mycobacterium avium subsp. paratuberculosis
gccgaucggggcgcagcc

SEQ ID NO: 841868 - RNA, 23 nt, Mycobacterium avium subsp. paratuberculosis
gccgaucggggcgcagcccggcg

SEQ ID NO: 841869 - RNA, 13 nt, Mycobacterium avium subsp. paratuberculosis
gccgaucccggcc

SEQ ID NO: 841870 - RNA, 15 nt, Mycobacterium avium subsp. paratuberculosis
gccgaucccggccac

SEQ ID NO: 841871 - RNA, 18 nt, Mycobacterium avium subsp. paratuberculosis
gccgaucccggccacguc

SEQ ID NO: 841872 - RNA, 20 nt, Mycobacterium avium subsp. paratuberculosis
gccgaucccggccacgucga

SEQ ID NO: 841873 - RNA, 20 nt, Mycobacterium avium subsp. paratuberculosis
gccgaucccggccagcaccc

SEQ ID NO: 841874 - RNA, 22 nt, Mycobacterium avium subsp. paratuberculosis
gccgaucccggccagcacccgc

SEQ ID NO: 841875 - RNA, 22 nt, Mycobacterium avium subsp. paratuberculosis
gccgcaauacggugcccgccgc

SEQ ID NO: 841876 - RNA, 23 nt, Mycobacterium avium subsp. paratuberculosis
gccgcaauacggugcccgccgcg

SEQ ID NO: 841877 - RNA, 22 nt, Mycobacterium avium subsp. paratuberculosis
gccgcaacagguuucgcucguc

SEQ ID NO: 841878 - RNA, 11 nt, Mycobacterium avium subsp. paratuberculosis
gccgcaacacg

SEQ ID NO: 841879 - RNA, 13 nt, Mycobacterium avium subsp. paratuberculosis
gccgcaacagccg

SEQ ID NO: 841880 - RNA, 15 nt, Mycobacterium avium subsp. paratuberculosis
gccgcaacagccggc

SEQ ID NO: 841881 - RNA, 17 nt, Mycobacterium avium subsp. paratuberculosis
gccgcaacagccggccc

SEQ ID NO: 841882 - RNA, 18 nt, Mycobacterium avium subsp. paratuberculosis
gccgcaacagccggcccg

SEQ ID NO: 841883 - RNA, 19 nt, Mycobacterium avium subsp. paratuberculosis
gccgcaacagccggcccga

SEQ ID NO: 841884 - RNA, 16 nt, Mycobacterium avium subsp. paratuberculosis
gccgcaaucggcgccg

SEQ ID NO: 841885 - RNA, 19 nt, Mycobacterium avium subsp. paratuberculosis
gccgcaaucggcgccggcu

SEQ ID NO: 841886 - RNA, 14 nt, Mycobacterium avium subsp. paratuberculosis
gccgauucggcgcc

SEQ ID NO: 841887 - RNA, 20 nt, Mycobacterium avium subsp. paratuberculosis
gccgauucggcgccgcgacc

SEQ ID NO: 841888 - RNA, 21 nt, Mycobacterium avium subsp. paratuberculosis
gccgcagcaggugcaucgcca

SEQ ID NO: 841889 - RNA, 19 nt, Mycobacterium avium subsp. paratuberculosis
gccgcagcaggugcgccag

SEQ ID NO: 841890 - RNA, 22 nt, Mycobacterium avium subsp. paratuberculosis
gccgcagcaggugcgccagauc

SEQ ID NO: 841891 - RNA, 17 nt, Mycobacterium avium subsp. paratuberculosis
gccgcagcaccaccucg

SEQ ID NO: 841892 - RNA, 19 nt, Mycobacterium avium subsp. paratuberculosis
gccgcagcacgcugaagcc

SEQ ID NO: 841893 - RNA, 12 nt, Mycobacterium avium subsp. paratuberculosis
gccgcagcacgg

SEQ ID NO: 841894 - RNA, 13 nt, Mycobacterium avium subsp. paratuberculosis
gccgcagcagccg

SEQ ID NO: 841895 - RNA, 23 nt, Mycobacterium avium subsp. paratuberculosis
gccgcagcagccgcgccaccgcg

SEQ ID NO: 841896 - RNA, 14 nt, Mycobacterium avium subsp. paratuberculosis
gccgcagcagcgag

SEQ ID NO: 841897 - RNA, 21 nt, Mycobacterium avium subsp. paratuberculosis
gccgcacuuggccucgggcga

SEQ ID NO: 841898 - RNA, 17 nt, Mycobacterium avium subsp. paratuberculosis
gccgcagaucagggcga

SEQ ID NO: 841899 - RNA, 18 nt, Mycobacterium avium subsp. paratuberculosis
gccgcagaucagggcgau

SEQ ID NO: 841900 - RNA, 12 nt, Mycobacterium avium subsp. paratuberculosis
gccgcaccagca

SEQ ID NO: 841901 - RNA, 13 nt, Mycobacterium avium subsp. paratuberculosis
gccgcaccagcac

SEQ ID NO: 841902 - RNA, 15 nt, Mycobacterium avium subsp. paratuberculosis
gccgcaccagcaccc

SEQ ID NO: 841903 - RNA, 20 nt, Mycobacterium avium subsp. paratuberculosis
gccgcaccagcaccccgccg

SEQ ID NO: 841904 - RNA, 21 nt, Mycobacterium avium subsp. paratuberculosis
gccgcaccagcaccccgccgc

SEQ ID NO: 841905 - RNA, 18 nt, Mycobacterium avium subsp. paratuberculosis
gccgcacccagcgggcga

SEQ ID NO: 841906 - RNA, 14 nt, Mycobacterium avium subsp. paratuberculosis
gccgcaccccaccc

SEQ ID NO: 841907 - RNA, 16 nt, Mycobacterium avium subsp. paratuberculosis
gccgcaccccacccgc

SEQ ID NO: 841908 - RNA, 19 nt, Mycobacterium avium subsp. paratuberculosis
gccgcaccccacccgcgcg

SEQ ID NO: 841909 - RNA, 20 nt, Mycobacterium avium subsp. paratuberculosis
gccgcaccccacccgcgcga

SEQ ID NO: 841910 - RNA, 21 nt, Mycobacterium avium subsp. paratuberculosis
gccgcaccccacccgcgcgac

SEQ ID NO: 841911 - RNA, 16 nt, Mycobacterium avium subsp. paratuberculosis
gccgcacccccuccac

SEQ ID NO: 841912 - RNA, 21 nt, Mycobacterium avium subsp. paratuberculosis
gccgcacccccuccacacggc

SEQ ID NO: 841913 - RNA, 19 nt, Mycobacterium avium subsp. paratuberculosis
gccgcacccgauccacggc

SEQ ID NO: 841914 - RNA, 15 nt, Mycobacterium avium subsp. paratuberculosis
gccgcacagccggcg

SEQ ID NO: 841915 - RNA, 16 nt, Mycobacterium avium subsp. paratuberculosis
gccgcacagccggcgg

SEQ ID NO: 841916 - RNA, 18 nt, Mycobacterium avium subsp. paratuberculosis
gccgcacagccggcggcg

SEQ ID NO: 841917 - RNA, 15 nt, Mycobacterium avium subsp. paratuberculosis
gccgcacaccgcggc

SEQ ID NO: 841918 - RNA, 16 nt, Mycobacterium avium subsp. paratuberculosis
gccgcacaccgcggcg

SEQ ID NO: 841919 - RNA, 22 nt, Mycobacterium avium subsp. paratuberculosis
gccgcacaccgcggcggcgucg

SEQ ID NO: 841920 - RNA, 18 nt, Mycobacterium avium subsp. paratuberculosis
gccgcacaccgucuccca

SEQ ID NO: 841921 - RNA, 21 nt, Mycobacterium avium subsp. paratuberculosis
gccgcacaccgucucccacga

SEQ ID NO: 841922 - RNA, 19 nt, Mycobacterium avium subsp. paratuberculosis
gccgcacaccugcaucacg

SEQ ID NO: 841923 - RNA, 20 nt, Mycobacterium avium subsp. paratuberculosis
gccgcacaccugcaucacga

SEQ ID NO: 841924 - RNA, 13 nt, Mycobacterium avium subsp. paratuberculosis
gccgcacaccgcg

SEQ ID NO: 841925 - RNA, 14 nt, Mycobacterium avium subsp. paratuberculosis
gccgcacaccgcgc

SEQ ID NO: 841926 - RNA, 17 nt, Mycobacterium avium subsp. paratuberculosis
gccgcacaccgcgcaga

SEQ ID NO: 841927 - RNA, 13 nt, Mycobacterium avium subsp. paratuberculosis
gccgcacaccacc

SEQ ID NO: 841928 - RNA, 16 nt, Mycobacterium avium subsp. paratuberculosis
gccgccagcgccaccc

SEQ ID NO: 841929 - RNA, 16 nt, Mycobacterium avium subsp. paratuberculosis
gccgccagcucgucca

SEQ ID NO: 841930 - RNA, 13 nt, Mycobacterium avium subsp. paratuberculosis
gccgccagccgcg

SEQ ID NO: 841931 - RNA, 15 nt, Mycobacterium avium subsp. paratuberculosis
gccgccagccgcguc

SEQ ID NO: 841932 - RNA, 14 nt, Mycobacterium avium subsp. paratuberculosis
gccgccagccagcc

SEQ ID NO: 841933 - RNA, 16 nt, Mycobacterium avium subsp. paratuberculosis
gccgccagccagccgg

SEQ ID NO: 841934 - RNA, 14 nt, Mycobacterium avium subsp. paratuberculosis
gccgccagcgcccg

SEQ ID NO: 841935 - RNA, 16 nt, Mycobacterium avium subsp. paratuberculosis
gccgccagcgcccgcg

SEQ ID NO: 841936 - RNA, 24 nt, Mycobacterium avium subsp. paratuberculosis
gccgccagcgcccgcgcgugggcc

SEQ ID NO: 841937 - RNA, 14 nt, Mycobacterium avium subsp. paratuberculosis
gccgccagcagugu

SEQ ID NO: 841938 - RNA, 12 nt, Mycobacterium avium subsp. paratuberculosis
gccgccagcgca

SEQ ID NO: 841939 - RNA, 19 nt, Mycobacterium avium subsp. paratuberculosis
gccgccagcgcaccgagcc

SEQ ID NO: 841940 - RNA, 12 nt, Mycobacterium avium subsp. paratuberculosis
gccgccagccgg

SEQ ID NO: 841941 - RNA, 20 nt, Mycobacterium avium subsp. paratuberculosis
gccgccagcagcacggcaau

SEQ ID NO: 841942 - RNA, 16 nt, Mycobacterium avium subsp. paratuberculosis
gccgccagcagcagcg

SEQ ID NO: 841943 - RNA, 19 nt, Mycobacterium avium subsp. paratuberculosis
gccgccagcaccaccguca

SEQ ID NO: 841944 - RNA, 20 nt, Mycobacterium avium subsp. paratuberculosis
gccgccagcaccaccgucac

SEQ ID NO: 841945 - RNA, 13 nt, Mycobacterium avium subsp. paratuberculosis
gccgccagcaccu

SEQ ID NO: 841946 - RNA, 15 nt, Mycobacterium avium subsp. paratuberculosis
gccgccagcaccucg

SEQ ID NO: 841947 - RNA, 22 nt, Mycobacterium avium subsp. paratuberculosis
gccgccagcaccucgcggcagc

SEQ ID NO: 841948 - RNA, 12 nt, Mycobacterium avium subsp. paratuberculosis
gccgccagcacc

SEQ ID NO: 841949 - RNA, 15 nt, Mycobacterium avium subsp. paratuberculosis
gccgccagcaccacc

SEQ ID NO: 841950 - RNA, 19 nt, Mycobacterium avium subsp. paratuberculosis
gccgccaccacgauguuga

SEQ ID NO: 841951 - RNA, 13 nt, Mycobacterium avium subsp. paratuberculosis
gccgccaccacgg

SEQ ID NO: 841952 - RNA, 14 nt, Mycobacterium avium subsp. paratuberculosis
gccgccaccacggc

SEQ ID NO: 841953 - RNA, 15 nt, Mycobacterium avium subsp. paratuberculosis
gccgccaccacggca

SEQ ID NO: 841954 - RNA, 18 nt, Mycobacterium avium subsp. paratuberculosis
gccgccacaccucggcga

SEQ ID NO: 841955 - RNA, 13 nt, Mycobacterium avium subsp. paratuberculosis
gccgccacagcgc

SEQ ID NO: 841956 - RNA, 14 nt, Mycobacterium avium subsp. paratuberculosis
gccgccacagcgcc

SEQ ID NO: 841957 - RNA, 20 nt, Mycobacterium avium subsp. paratuberculosis
gccgccacagcgccucgcgg

SEQ ID NO: 841958 - RNA, 20 nt, Mycobacterium avium subsp. paratuberculosis
gccgccaaggggaacaacgc

SEQ ID NO: 841959 - RNA, 18 nt, Mycobacterium avium subsp. paratuberculosis
gccgccaagugcggugug

SEQ ID NO: 841960 - RNA, 13 nt, Mycobacterium avium subsp. paratuberculosis
gccgccaccaaca

SEQ ID NO: 841961 - RNA, 19 nt, Mycobacterium avium subsp. paratuberculosis
gccgccaccaacaucgacg

SEQ ID NO: 841962 - RNA, 22 nt, Mycobacterium avium subsp. paratuberculosis
gccgccaccaacaucgacgugc

SEQ ID NO: 841963 - RNA, 16 nt, Mycobacterium avium subsp. paratuberculosis
gccgccaaaucgauca

SEQ ID NO: 841964 - RNA, 13 nt, Mycobacterium avium subsp. paratuberculosis
gccgccaacgcga

SEQ ID NO: 841965 - RNA, 16 nt, Mycobacterium avium subsp. paratuberculosis
gccgccaacgcgaacg

SEQ ID NO: 841966 - RNA, 19 nt, Mycobacterium avium subsp. paratuberculosis
gccgcauggugcggguguc

SEQ ID NO: 841967 - RNA, 22 nt, Mycobacterium avium subsp. paratuberculosis
gccgcauacaccuugucggcga

SEQ ID NO: 841968 - RNA, 14 nt, Mycobacterium avium subsp. paratuberculosis
gccgcauaccgccc

SEQ ID NO: 841969 - RNA, 15 nt, Mycobacterium avium subsp. paratuberculosis
gccgcauaccgcccg

SEQ ID NO: 841970 - RNA, 17 nt, Mycobacterium avium subsp. paratuberculosis
gccgcauaccgcccgcg

SEQ ID NO: 841971 - RNA, 23 nt, Mycobacterium avium subsp. paratuberculosis
gccgcaucaccuucugcgcgccg

SEQ ID NO: 841972 - RNA, 15 nt, Mycobacterium avium subsp. paratuberculosis
gccgcauuggcaccg

SEQ ID NO: 841973 - RNA, 24 nt, Mycobacterium avium subsp. paratuberculosis
gccgcauuggcaccgucgaccucg

SEQ ID NO: 841974 - RNA, 16 nt, Mycobacterium avium subsp. paratuberculosis
gccgcauucggugagc

SEQ ID NO: 841975 - RNA, 18 nt, Mycobacterium avium subsp. paratuberculosis
gccgcaugucgaccucgg

SEQ ID NO: 841976 - RNA, 19 nt, Mycobacterium avium subsp. paratuberculosis
gccgcaugucgaccucggc

SEQ ID NO: 841977 - RNA, 23 nt, Mycobacterium avium subsp. paratuberculosis
gccgcaugucgaccucggccacc

SEQ ID NO: 841978 - RNA, 22 nt, Mycobacterium avium subsp. paratuberculosis
gccgcauguugugcccgacggc

SEQ ID NO: 841979 - RNA, 23 nt, Mycobacterium avium subsp. paratuberculosis
gccgcauguugugcccgacggcg

SEQ ID NO: 841980 - RNA, 17 nt, Mycobacterium avium subsp. paratuberculosis
gccgcauuccucggcca

SEQ ID NO: 841981 - RNA, 18 nt, Mycobacterium avium subsp. paratuberculosis
gccgcauuccucggccag

SEQ ID NO: 841982 - RNA, 19 nt, Mycobacterium avium subsp. paratuberculosis
gccgcauuccucggccagc

SEQ ID NO: 841983 - RNA, 17 nt, Mycobacterium avium subsp. paratuberculosis
gccgcauuggugccggc

SEQ ID NO: 841984 - RNA, 18 nt, Mycobacterium avium subsp. paratuberculosis
gccgcauuggugccggcc

SEQ ID NO: 841985 - RNA, 19 nt, Mycobacterium avium subsp. paratuberculosis
gccgcauuggugccggccu

SEQ ID NO: 841986 - RNA, 22 nt, Mycobacterium avium subsp. paratuberculosis
gccgcauuggugccggccucgu

SEQ ID NO: 841987 - RNA, 23 nt, Mycobacterium avium subsp. paratuberculosis
gccgcauuggugccggccucguc

SEQ ID NO: 841988 - RNA, 15 nt, Mycobacterium avium subsp. paratuberculosis
gccgccaaccagguc

SEQ ID NO: 841989 - RNA, 14 nt, Mycobacterium avium subsp. paratuberculosis
gccgcagccgaucu

SEQ ID NO: 841990 - RNA, 15 nt, Mycobacterium avium subsp. paratuberculosis
gccgcagcccaggcc

SEQ ID NO: 841991 - RNA, 18 nt, Mycobacterium avium subsp. paratuberculosis
gccgcagcccaggcccag

SEQ ID NO: 841992 - RNA, 20 nt, Mycobacterium avium subsp. paratuberculosis
gccgcagcccaggcccagca

SEQ ID NO: 841993 - RNA, 21 nt, Mycobacterium avium subsp. paratuberculosis
gccgcagcccaggcccagcag

SEQ ID NO: 841994 - RNA, 12 nt, Mycobacterium avium subsp. paratuberculosis
gccgcagccgcg

SEQ ID NO: 841995 - RNA, 13 nt, Mycobacterium avium subsp. paratuberculosis
gccgcagccgcgc

SEQ ID NO: 841996 - RNA, 17 nt, Mycobacterium avium subsp. paratuberculosis
gccgcagccgcgcggcc

SEQ ID NO: 841997 - RNA, 18 nt, Mycobacterium avium subsp. paratuberculosis
gccgcagccgcgcggccg

SEQ ID NO: 841998 - RNA, 22 nt, Mycobacterium avium subsp. paratuberculosis
gccgcagccgcgcggccggcca

SEQ ID NO: 841999 - RNA, 19 nt, Mycobacterium avium subsp. paratuberculosis
gccgcagccuucuuggcgg

SEQ ID NO: 842000 - RNA, 19 nt, Mycobacterium avium subsp. paratuberculosis
gccgcagcgcagcgucggc

SEQ ID NO: 842001 - RNA, 13 nt, Mycobacterium avium subsp. paratuberculosis
gccgcagcgcauc

SEQ ID NO: 842002 - RNA, 18 nt, Mycobacterium avium subsp. paratuberculosis
gccgcagcgcaucgccgg

SEQ ID NO: 842003 - RNA, 19 nt, Mycobacterium avium subsp. paratuberculosis
gccgcagcgcaucgccggc

SEQ ID NO: 842004 - RNA, 21 nt, Mycobacterium avium subsp. paratuberculosis
gccgcaggugcucgccggcgc

SEQ ID NO: 842005 - RNA, 15 nt, Mycobacterium avium subsp. paratuberculosis
gccgcagucgaucac

SEQ ID NO: 842006 - RNA, 15 nt, Mycobacterium avium subsp. paratuberculosis
gccgcagugccggcg

SEQ ID NO: 842007 - RNA, 16 nt, Mycobacterium avium subsp. paratuberculosis
gccgcagugccggcgc

SEQ ID NO: 842008 - RNA, 20 nt, Mycobacterium avium subsp. paratuberculosis
gccgcagugccggcgcaccg

SEQ ID NO: 842009 - RNA, 12 nt, Mycobacterium avium subsp. paratuberculosis
gccgcagcccgc

SEQ ID NO: 842010 - RNA, 15 nt, Mycobacterium avium subsp. paratuberculosis
gccgcaggugguggg

SEQ ID NO: 842011 - RNA, 17 nt, Mycobacterium avium subsp. paratuberculosis
gccgcagguggugggcg

SEQ ID NO: 842012 - RNA, 19 nt, Mycobacterium avium subsp. paratuberculosis
gccgcagguggugggcgug

SEQ ID NO: 842013 - RNA, 17 nt, Mycobacterium avium subsp. paratuberculosis
gccaugcccucgaucga

SEQ ID NO: 842014 - RNA, 13 nt, Mycobacterium avium subsp. paratuberculosis
gccaugccgccga

SEQ ID NO: 842015 - RNA, 19 nt, Mycobacterium avium subsp. paratuberculosis
gccaugccgccgaccgccg

SEQ ID NO: 842016 - RNA, 24 nt, Mycobacterium avium subsp. paratuberculosis
gccaugccgccgaccgccgagcgg

SEQ ID NO: 842017 - RNA, 16 nt, Mycobacterium avium subsp. paratuberculosis
gccaugccggccugac

SEQ ID NO: 842018 - RNA, 12 nt, Mycobacterium avium subsp. paratuberculosis
gccaucguggcc

SEQ ID NO: 842019 - RNA, 16 nt, Mycobacterium avium subsp. paratuberculosis
gccaucguggccgcgu

SEQ ID NO: 842020 - RNA, 19 nt, Mycobacterium avium subsp. paratuberculosis
gccaucgugggcgccgucg

SEQ ID NO: 842021 - RNA, 24 nt, Mycobacterium avium subsp. paratuberculosis
gccaucgugggcgccgucgccgcc

SEQ ID NO: 842022 - RNA, 15 nt, Mycobacterium avium subsp. paratuberculosis
gccaucucgggagug

SEQ ID NO: 842023 - RNA, 22 nt, Mycobacterium avium subsp. paratuberculosis
gccaucucgggagugcggccca

SEQ ID NO: 842024 - RNA, 17 nt, Mycobacterium avium subsp. paratuberculosis
gccaucuccugcacgcg

SEQ ID NO: 842025 - RNA, 18 nt, Mycobacterium avium subsp. paratuberculosis
gccaucuccugcacgcgc

SEQ ID NO: 842026 - RNA, 22 nt, Mycobacterium avium subsp. paratuberculosis
gccaucuccugcacgcgcgggu

SEQ ID NO: 842027 - RNA, 23 nt, Mycobacterium avium subsp. paratuberculosis
gccaugaagccguugccgccgcg

SEQ ID NO: 842028 - RNA, 22 nt, Mycobacterium avium subsp. paratuberculosis
gccaugaacugguuccacacca

SEQ ID NO: 842029 - RNA, 19 nt, Mycobacterium avium subsp. paratuberculosis
gccaugaacggcggggccu

SEQ ID NO: 842030 - RNA, 16 nt, Mycobacterium avium subsp. paratuberculosis
gccaucuggaacgcga

SEQ ID NO: 842031 - RNA, 13 nt, Mycobacterium avium subsp. paratuberculosis
gccaucuggccgc

SEQ ID NO: 842032 - RNA, 18 nt, Mycobacterium avium subsp. paratuberculosis
gccaucuggccgcgggug

SEQ ID NO: 842033 - RNA, 22 nt, Mycobacterium avium subsp. paratuberculosis
gccaucuggccgcgggugcggc

SEQ ID NO: 842034 - RNA, 23 nt, Mycobacterium avium subsp. paratuberculosis
gccaucuucacgugcgcggcguc

SEQ ID NO: 842035 - RNA, 19 nt, Mycobacterium avium subsp. paratuberculosis
gccaucuucaguucggccg

SEQ ID NO: 842036 - RNA, 19 nt, Mycobacterium avium subsp. paratuberculosis
gccaucgaucgggcgucgc

SEQ ID NO: 842037 - RNA, 22 nt, Mycobacterium avium subsp. paratuberculosis
gccaucgaucgggcgucgcaga

SEQ ID NO: 842038 - RNA, 13 nt, Mycobacterium avium subsp. paratuberculosis
gccaucgcccggu

SEQ ID NO: 842039 - RNA, 18 nt, Mycobacterium avium subsp. paratuberculosis
gccaucgcccggugcgcc

SEQ ID NO: 842040 - RNA, 21 nt, Mycobacterium avium subsp. paratuberculosis
gccaucgcccggugcgccagc

SEQ ID NO: 842041 - RNA, 18 nt, Mycobacterium avium subsp. paratuberculosis
gccaucgccucggccacc

SEQ ID NO: 842042 - RNA, 22 nt, Mycobacterium avium subsp. paratuberculosis
gccaucgcggcccccacgcagc

SEQ ID NO: 842043 - RNA, 17 nt, Mycobacterium avium subsp. paratuberculosis
gccaucgccgccaucgc

SEQ ID NO: 842044 - RNA, 18 nt, Mycobacterium avium subsp. paratuberculosis
gccaucgccgcgguggcg

SEQ ID NO: 842045 - RNA, 20 nt, Mycobacterium avium subsp. paratuberculosis
gccaucgccgcgguggcgcc

SEQ ID NO: 842046 - RNA, 13 nt, Mycobacterium avium subsp. paratuberculosis
gccaucggcagac

SEQ ID NO: 842047 - RNA, 19 nt, Mycobacterium avium subsp. paratuberculosis
gccaucggcagacccagca

SEQ ID NO: 842048 - RNA, 22 nt, Mycobacterium avium subsp. paratuberculosis
gccaucgcggcguuguggccac

SEQ ID NO: 842049 - RNA, 22 nt, Mycobacterium avium subsp. paratuberculosis
gccaucggcaucgcgcgcggcg

SEQ ID NO: 842050 - RNA, 15 nt, Mycobacterium avium subsp. paratuberculosis
gccaucgucacuucg

SEQ ID NO: 842051 - RNA, 15 nt, Mycobacterium avium subsp. paratuberculosis
gccauccgggcggca

SEQ ID NO: 842052 - RNA, 21 nt, Mycobacterium avium subsp. paratuberculosis
gccauccgggcggcaucgcgc

SEQ ID NO: 842053 - RNA, 14 nt, Mycobacterium avium subsp. paratuberculosis
gccauccguucggc

SEQ ID NO: 842054 - RNA, 17 nt, Mycobacterium avium subsp. paratuberculosis
gccauccguucggcucu

SEQ ID NO: 842055 - RNA, 18 nt, Mycobacterium avium subsp. paratuberculosis
gccaucgacuccagcacc

SEQ ID NO: 842056 - RNA, 19 nt, Mycobacterium avium subsp. paratuberculosis
gccaucgacuccagcaccg

SEQ ID NO: 842057 - RNA, 21 nt, Mycobacterium avium subsp. paratuberculosis
gccaucgacuccagcaccggc

SEQ ID NO: 842058 - RNA, 23 nt, Mycobacterium avium subsp. paratuberculosis
gccauccugaagaagcggccgua

SEQ ID NO: 842059 - RNA, 16 nt, Mycobacterium avium subsp. paratuberculosis
gccauaaaccggccgg

SEQ ID NO: 842060 - RNA, 14 nt, Mycobacterium avium subsp. paratuberculosis
gccaguugcucggg

SEQ ID NO: 842061 - RNA, 16 nt, Mycobacterium avium subsp. paratuberculosis
gccaguuugccgucgg

SEQ ID NO: 842062 - RNA, 20 nt, Mycobacterium avium subsp. paratuberculosis
gccaguugggggccagcgcc

SEQ ID NO: 842063 - RNA, 21 nt, Mycobacterium avium subsp. paratuberculosis
gccaguugggggccagcgccg

SEQ ID NO: 842064 - RNA, 19 nt, Mycobacterium avium subsp. paratuberculosis
gccauagaccauaaucggc

SEQ ID NO: 842065 - RNA, 17 nt, Mycobacterium avium subsp. paratuberculosis
gccauagauguuggcgu

SEQ ID NO: 842066 - RNA, 15 nt, Mycobacterium avium subsp. paratuberculosis
gccaucagcccggcg

SEQ ID NO: 842067 - RNA, 22 nt, Mycobacterium avium subsp. paratuberculosis
gccaucaugcccaccaucccgc

SEQ ID NO: 842068 - RNA, 18 nt, Mycobacterium avium subsp. paratuberculosis
gccauccccgcguuggcc

SEQ ID NO: 842069 - RNA, 14 nt, Mycobacterium avium subsp. paratuberculosis
gccauccgcgccga

SEQ ID NO: 842070 - RNA, 16 nt, Mycobacterium avium subsp. paratuberculosis
gccauccgcgccgaac

SEQ ID NO: 842071 - RNA, 15 nt, Mycobacterium avium subsp. paratuberculosis
gccaucccggugccg

SEQ ID NO: 842072 - RNA, 16 nt, Mycobacterium avium subsp. paratuberculosis
gccaucccggugccgc

SEQ ID NO: 842073 - RNA, 15 nt, Mycobacterium avium subsp. paratuberculosis
gccaucccgguggac

SEQ ID NO: 842074 - RNA, 13 nt, Mycobacterium avium subsp. paratuberculosis
gccauccgccacc

SEQ ID NO: 842075 - RNA, 14 nt, Mycobacterium avium subsp. paratuberculosis
gccauccgccaccc

SEQ ID NO: 842076 - RNA, 16 nt, Mycobacterium avium subsp. paratuberculosis
gccauccgccacccgc

SEQ ID NO: 842077 - RNA, 15 nt, Mycobacterium avium subsp. paratuberculosis
gccaucaccagcgcg

SEQ ID NO: 842078 - RNA, 16 nt, Mycobacterium avium subsp. paratuberculosis
gccaucaccagcgcgu

SEQ ID NO: 842079 - RNA, 22 nt, Mycobacterium avium subsp. paratuberculosis
gccaucaccagcgcguagagca

SEQ ID NO: 842080 - RNA, 12 nt, Mycobacterium avium subsp. paratuberculosis
gccaucaccgcg

SEQ ID NO: 842081 - RNA, 17 nt, Mycobacterium avium subsp. paratuberculosis
gccaucaaccgauuucg

SEQ ID NO: 842082 - RNA, 22 nt, Mycobacterium avium subsp. paratuberculosis
gccaucaaccgauuucggccag

SEQ ID NO: 842083 - RNA, 17 nt, Mycobacterium avium subsp. paratuberculosis
gccaucagaacgcccgc

SEQ ID NO: 842084 - RNA, 22 nt, Mycobacterium avium subsp. paratuberculosis
gccaucagcaccgaaucgccga

SEQ ID NO: 842085 - RNA, 13 nt, Mycobacterium avium subsp. paratuberculosis
gccaucagcagcg

SEQ ID NO: 842086 - RNA, 16 nt, Mycobacterium avium subsp. paratuberculosis
gccaucagcagcgccu

SEQ ID NO: 842087 - RNA, 15 nt, Mycobacterium avium subsp. paratuberculosis
gccaucagccgccgu

SEQ ID NO: 842088 - RNA, 17 nt, Mycobacterium avium subsp. paratuberculosis
gccaucagccgccgucg

SEQ ID NO: 842089 - RNA, 18 nt, Mycobacterium avium subsp. paratuberculosis
gccaucagccgccgucgc

SEQ ID NO: 842090 - RNA, 15 nt, Mycobacterium avium subsp. paratuberculosis
gccaggcgguggccg

SEQ ID NO: 842091 - RNA, 17 nt, Mycobacterium avium subsp. paratuberculosis
gccaggcgguggccgaa

SEQ ID NO: 842092 - RNA, 18 nt, Mycobacterium avium subsp. paratuberculosis
gccaggcguugcaccgcg

SEQ ID NO: 842093 - RNA, 18 nt, Mycobacterium avium subsp. paratuberculosis
gccaggcguuggucacca

SEQ ID NO: 842094 - RNA, 21 nt, Mycobacterium avium subsp. paratuberculosis
gccaggcguuggucaccauca

SEQ ID NO: 842095 - RNA, 22 nt, Mycobacterium avium subsp. paratuberculosis
gccagggugacggucaugccga

SEQ ID NO: 842096 - RNA, 14 nt, Mycobacterium avium subsp. paratuberculosis
gccagggugccccg

SEQ ID NO: 842097 - RNA, 17 nt, Mycobacterium avium subsp. paratuberculosis
gccagggugccccgcac

SEQ ID NO: 842098 - RNA, 20 nt, Mycobacterium avium subsp. paratuberculosis
gccagggugccccgcaccgc

SEQ ID NO: 842099 - RNA, 19 nt, Mycobacterium avium subsp. paratuberculosis
gccagggucucgggcagca

SEQ ID NO: 842100 - RNA, 16 nt, Mycobacterium avium subsp. paratuberculosis
gccagggugccgacga

SEQ ID NO: 842101 - RNA, 20 nt, Mycobacterium avium subsp. paratuberculosis
gccaggguggggaucacguc

SEQ ID NO: 842102 - RNA, 21 nt, Mycobacterium avium subsp. paratuberculosis
gccaggguggggaucacgucg

SEQ ID NO: 842103 - RNA, 22 nt, Mycobacterium avium subsp. paratuberculosis
gccaggguggggaucacgucgg

SEQ ID NO: 842104 - RNA, 17 nt, Mycobacterium avium subsp. paratuberculosis
gccagggugucccagcg

SEQ ID NO: 842105 - RNA, 18 nt, Mycobacterium avium subsp. paratuberculosis
gccagggugucccagcgc

SEQ ID NO: 842106 - RNA, 20 nt, Mycobacterium avium subsp. paratuberculosis
gccagggugucccagcgcca

SEQ ID NO: 842107 - RNA, 22 nt, Mycobacterium avium subsp. paratuberculosis
gccagguacuccgguaccacgc

SEQ ID NO: 842108 - RNA, 18 nt, Mycobacterium avium subsp. paratuberculosis
gccagguacuccucgaag

SEQ ID NO: 842109 - RNA, 17 nt, Mycobacterium avium subsp. paratuberculosis
gccagguacugaucacc

SEQ ID NO: 842110 - RNA, 20 nt, Mycobacterium avium subsp. paratuberculosis
gccagguacugaucaccgcg

SEQ ID NO: 842111 - RNA, 12 nt, Mycobacterium avium subsp. paratuberculosis
gccaggucgggg

SEQ ID NO: 842112 - RNA, 16 nt, Mycobacterium avium subsp. paratuberculosis
gccaggugaacagguc

SEQ ID NO: 842113 - RNA, 18 nt, Mycobacterium avium subsp. paratuberculosis
gccaggugcacgccgagc

SEQ ID NO: 842114 - RNA, 12 nt, Mycobacterium avium subsp. paratuberculosis
gccaggugcagc

SEQ ID NO: 842115 - RNA, 17 nt, Mycobacterium avium subsp. paratuberculosis
gccaggugugcccgccc

SEQ ID NO: 842116 - RNA, 18 nt, Mycobacterium avium subsp. paratuberculosis
gccagguucaggcccgcg

SEQ ID NO: 842117 - RNA, 21 nt, Mycobacterium avium subsp. paratuberculosis
gccagguucaggcccgcgccg

SEQ ID NO: 842118 - RNA, 22 nt, Mycobacterium avium subsp. paratuberculosis
gccagguucaggcccgcgccga

SEQ ID NO: 842119 - RNA, 16 nt, Mycobacterium avium subsp. paratuberculosis
gccagguucaggcuga

SEQ ID NO: 842120 - RNA, 22 nt, Mycobacterium avium subsp. paratuberculosis
gccagguuccaccgggcgucgg

SEQ ID NO: 842121 - RNA, 19 nt, Mycobacterium avium subsp. paratuberculosis
gccagguguaggcggccac

SEQ ID NO: 842122 - RNA, 17 nt, Mycobacterium avium subsp. paratuberculosis
gccaguaccagcggccg

SEQ ID NO: 842123 - RNA, 21 nt, Mycobacterium avium subsp. paratuberculosis
gccaguaccagcggccgucgc

SEQ ID NO: 842124 - RNA, 22 nt, Mycobacterium avium subsp. paratuberculosis
gccaguaccagcggccgucgcg

SEQ ID NO: 842125 - RNA, 15 nt, Mycobacterium avium subsp. paratuberculosis
gccagguggccgcuu

SEQ ID NO: 842126 - RNA, 21 nt, Mycobacterium avium subsp. paratuberculosis
gccagugggggaauggcgguc

SEQ ID NO: 842127 - RNA, 16 nt, Mycobacterium avium subsp. paratuberculosis
gccaguucccggccag

SEQ ID NO: 842128 - RNA, 16 nt, Mycobacterium avium subsp. paratuberculosis
gccaguucccgggcga

SEQ ID NO: 842129 - RNA, 15 nt, Mycobacterium avium subsp. paratuberculosis
gccaguucgccggug

SEQ ID NO: 842130 - RNA, 14 nt, Mycobacterium avium subsp. paratuberculosis
gccaguucaccgcg

SEQ ID NO: 842131 - RNA, 15 nt, Mycobacterium avium subsp. paratuberculosis
gccaguucaccgcgc

SEQ ID NO: 842132 - RNA, 15 nt, Mycobacterium avium subsp. paratuberculosis
gccaguguggccgcg

SEQ ID NO: 842133 - RNA, 16 nt, Mycobacterium avium subsp. paratuberculosis
gccaguguggccgcgg

SEQ ID NO: 842134 - RNA, 17 nt, Mycobacterium avium subsp. paratuberculosis
gccaguugaaguccggc

SEQ ID NO: 842135 - RNA, 21 nt, Mycobacterium avium subsp. paratuberculosis
gccaguugaaguccggcgguc

SEQ ID NO: 842136 - RNA, 21 nt, Mycobacterium avium subsp. paratuberculosis
gccaguugacguugaucgcgc

SEQ ID NO: 842137 - RNA, 18 nt, Mycobacterium avium subsp. paratuberculosis
gccaguugaucagcccga

SEQ ID NO: 842138 - RNA, 20 nt, Mycobacterium avium subsp. paratuberculosis
gccaguugcacuuucggcag

SEQ ID NO: 842139 - RNA, 18 nt, Mycobacterium avium subsp. paratuberculosis
gccaguucggguccgcgg

SEQ ID NO: 842140 - RNA, 16 nt, Mycobacterium avium subsp. paratuberculosis
gccaguucgucgcgcg

SEQ ID NO: 842141 - RNA, 17 nt, Mycobacterium avium subsp. paratuberculosis
gccaguucgucgcgcga

SEQ ID NO: 842142 - RNA, 14 nt, Mycobacterium avium subsp. paratuberculosis
gccaguucgucggc

SEQ ID NO: 842143 - RNA, 16 nt, Mycobacterium avium subsp. paratuberculosis
gccaguucgucggccg

SEQ ID NO: 842144 - RNA, 20 nt, Mycobacterium avium subsp. paratuberculosis
gccaguucgucggccgucgg

SEQ ID NO: 842145 - RNA, 22 nt, Mycobacterium avium subsp. paratuberculosis
gccaguucgucggccgucggcg

SEQ ID NO: 842146 - RNA, 14 nt, Mycobacterium avium subsp. paratuberculosis
gccaguucgagcgc

SEQ ID NO: 842147 - RNA, 18 nt, Mycobacterium avium subsp. paratuberculosis
gccaguucgagcgccgcg

SEQ ID NO: 842148 - RNA, 19 nt, Mycobacterium avium subsp. paratuberculosis
gccaguucgagcgccgcgg

SEQ ID NO: 842149 - RNA, 17 nt, Mycobacterium avium subsp. paratuberculosis
gccaguccaggccgccg

SEQ ID NO: 842150 - RNA, 18 nt, Mycobacterium avium subsp. paratuberculosis
gccaguccaggccgccgu

SEQ ID NO: 842151 - RNA, 17 nt, Mycobacterium avium subsp. paratuberculosis
gccaguccgccgccguc

SEQ ID NO: 842152 - RNA, 14 nt, Mycobacterium avium subsp. paratuberculosis
gccagugccgggcc

SEQ ID NO: 842153 - RNA, 13 nt, Mycobacterium avium subsp. paratuberculosis
gccagugauccug

SEQ ID NO: 842154 - RNA, 15 nt, Mycobacterium avium subsp. paratuberculosis
gccagugauccuggu

SEQ ID NO: 842155 - RNA, 15 nt, Mycobacterium avium subsp. paratuberculosis
gccaggcggcgacga

SEQ ID NO: 842156 - RNA, 20 nt, Mycobacterium avium subsp. paratuberculosis
gccaggcgaugaagccggcg

SEQ ID NO: 842157 - RNA, 20 nt, Mycobacterium avium subsp. paratuberculosis
gccaggcgcgcgcuggugcg

SEQ ID NO: 842158 - RNA, 17 nt, Mycobacterium avium subsp. paratuberculosis
gccaggcgcgcguagcg

SEQ ID NO: 842159 - RNA, 14 nt, Mycobacterium avium subsp. paratuberculosis
gccaggccgugauc

SEQ ID NO: 842160 - RNA, 16 nt, Mycobacterium avium subsp. paratuberculosis
gccaggccgucggcgc

SEQ ID NO: 842161 - RNA, 16 nt, Mycobacterium avium subsp. paratuberculosis
gccaggcccaccgucg

SEQ ID NO: 842162 - RNA, 20 nt, Mycobacterium avium subsp. paratuberculosis
gccaggcccaccgucgccac

SEQ ID NO: 842163 - RNA, 12 nt, Mycobacterium avium subsp. paratuberculosis
gccaggccaugg

SEQ ID NO: 842164 - RNA, 20 nt, Mycobacterium avium subsp. paratuberculosis
gccaggccauggcgcaccgc

SEQ ID NO: 842165 - RNA, 21 nt, Mycobacterium avium subsp. paratuberculosis
gccaggccauggcgcaccgcg

SEQ ID NO: 842166 - RNA, 17 nt, Mycobacterium avium subsp. paratuberculosis
gccagcgucgcgccgcc

SEQ ID NO: 842167 - RNA, 18 nt, Mycobacterium avium subsp. paratuberculosis
gccagcgucgcgccgcca

SEQ ID NO: 842168 - RNA, 17 nt, Mycobacterium avium subsp. paratuberculosis
gccagcgucuccggcgg

SEQ ID NO: 842169 - RNA, 18 nt, Mycobacterium avium subsp. paratuberculosis
gccagcgucuccggcggg

SEQ ID NO: 842170 - RNA, 20 nt, Mycobacterium avium subsp. paratuberculosis
gccagcgucuccggcgggcu

SEQ ID NO: 842171 - RNA, 19 nt, Mycobacterium avium subsp. paratuberculosis
gccagcgugaacagcgccc

SEQ ID NO: 842172 - RNA, 23 nt, Mycobacterium avium subsp. paratuberculosis
gccagcgugaacagcgcccggcc

SEQ ID NO: 842173 - RNA, 16 nt, Mycobacterium avium subsp. paratuberculosis
gccagcgugacgcccg

SEQ ID NO: 842174 - RNA, 22 nt, Mycobacterium avium subsp. paratuberculosis
gccagcgugacgcccggcgccg

SEQ ID NO: 842175 - RNA, 16 nt, Mycobacterium avium subsp. paratuberculosis
gccagcgugacgccgg

SEQ ID NO: 842176 - RNA, 22 nt, Mycobacterium avium subsp. paratuberculosis
gccaggaagacguaggcggcca

SEQ ID NO: 842177 - RNA, 14 nt, Mycobacterium avium subsp. paratuberculosis
gccagcggccgauc

SEQ ID NO: 842178 - RNA, 15 nt, Mycobacterium avium subsp. paratuberculosis
gccagcggccgauca

SEQ ID NO: 842179 - RNA, 19 nt, Mycobacterium avium subsp. paratuberculosis
gccagcggccagcccgcgg

SEQ ID NO: 842180 - RNA, 19 nt, Mycobacterium avium subsp. paratuberculosis
gccagcgucugcugcgcca

SEQ ID NO: 842181 - RNA, 20 nt, Mycobacterium avium subsp. paratuberculosis
gccagcgucuugacgaacuc

SEQ ID NO: 842182 - RNA, 23 nt, Mycobacterium avium subsp. paratuberculosis
gccaggaaggccaguucgacgau

SEQ ID NO: 842183 - RNA, 24 nt, Mycobacterium avium subsp. paratuberculosis
gccaggaccacccacucccagccg

SEQ ID NO: 842184 - RNA, 19 nt, Mycobacterium avium subsp. paratuberculosis
gccaggaccagcgggucga

SEQ ID NO: 842185 - RNA, 18 nt, Mycobacterium avium subsp. paratuberculosis
gccaggaauaacgccggc

SEQ ID NO: 842186 - RNA, 20 nt, Mycobacterium avium subsp. paratuberculosis
gccaggaauaacgccggccc

SEQ ID NO: 842187 - RNA, 22 nt, Mycobacterium avium subsp. paratuberculosis
gccaggaauaacgccggccccg

SEQ ID NO: 842188 - RNA, 14 nt, Mycobacterium avium subsp. paratuberculosis
gccaggaagccggc

SEQ ID NO: 842189 - RNA, 17 nt, Mycobacterium avium subsp. paratuberculosis
gccaggaagccggcgac

SEQ ID NO: 842190 - RNA, 18 nt, Mycobacterium avium subsp. paratuberculosis
gccaggaagccggcgacg

SEQ ID NO: 842191 - RNA, 15 nt, Mycobacterium avium subsp. paratuberculosis
gccaggacagcguca

SEQ ID NO: 842192 - RNA, 16 nt, Mycobacterium avium subsp. paratuberculosis
gccaggccaccgcacg

SEQ ID NO: 842193 - RNA, 14 nt, Mycobacterium avium subsp. paratuberculosis
gccaggaccggauc

SEQ ID NO: 842194 - RNA, 15 nt, Mycobacterium avium subsp. paratuberculosis
gccaggcaggcggcc

SEQ ID NO: 842195 - RNA, 23 nt, Mycobacterium avium subsp. paratuberculosis
gccaggcaggcggccagggcggc

SEQ ID NO: 842196 - RNA, 15 nt, Mycobacterium avium subsp. paratuberculosis
gccacugccgccgcc

SEQ ID NO: 842197 - RNA, 17 nt, Mycobacterium avium subsp. paratuberculosis
gccacugccgccgccca

SEQ ID NO: 842198 - RNA, 14 nt, Mycobacterium avium subsp. paratuberculosis
gccacucgucgacg

SEQ ID NO: 842199 - RNA, 14 nt, Mycobacterium avium subsp. paratuberculosis
gccacucgucgaug

SEQ ID NO: 842200 - RNA, 12 nt, Mycobacterium avium subsp. paratuberculosis
gccacgguggcg

SEQ ID NO: 842201 - RNA, 14 nt, Mycobacterium avium subsp. paratuberculosis
gccacucgccgcga

SEQ ID NO: 842202 - RNA, 17 nt, Mycobacterium avium subsp. paratuberculosis
gccacucgccgcgaacg

SEQ ID NO: 842203 - RNA, 14 nt, Mycobacterium avium subsp. paratuberculosis
gccacucgccguga

SEQ ID NO: 842204 - RNA, 14 nt, Mycobacterium avium subsp. paratuberculosis
gccacucgcguccc

SEQ ID NO: 842205 - RNA, 14 nt, Mycobacterium avium subsp. paratuberculosis
gccacgggcggucg

SEQ ID NO: 842206 - RNA, 16 nt, Mycobacterium avium subsp. paratuberculosis
gccacggucaggcgca

SEQ ID NO: 842207 - RNA, 17 nt, Mycobacterium avium subsp. paratuberculosis
gccacggucaggcgcag

SEQ ID NO: 842208 - RNA, 18 nt, Mycobacterium avium subsp. paratuberculosis
gccacggucaggcgcagc

SEQ ID NO: 842209 - RNA, 19 nt, Mycobacterium avium subsp. paratuberculosis
gccacggucaggcgcagcc

SEQ ID NO: 842210 - RNA, 18 nt, Mycobacterium avium subsp. paratuberculosis
gccacggggcccgcgacc

SEQ ID NO: 842211 - RNA, 14 nt, Mycobacterium avium subsp. paratuberculosis
gccacggggcgccg

SEQ ID NO: 842212 - RNA, 20 nt, Mycobacterium avium subsp. paratuberculosis
gccacggggcugcgggccag

SEQ ID NO: 842213 - RNA, 12 nt, Mycobacterium avium subsp. paratuberculosis
gccacggcggau

SEQ ID NO: 842214 - RNA, 21 nt, Mycobacterium avium subsp. paratuberculosis
gccacggcgccaugcgccgcg

SEQ ID NO: 842215 - RNA, 16 nt, Mycobacterium avium subsp. paratuberculosis
gccacggcgacgacca

SEQ ID NO: 842216 - RNA, 18 nt, Mycobacterium avium subsp. paratuberculosis
gccacggcgacgaccacc

SEQ ID NO: 842217 - RNA, 13 nt, Mycobacterium avium subsp. paratuberculosis
gccacggcggugu

SEQ ID NO: 842218 - RNA, 18 nt, Mycobacterium avium subsp. paratuberculosis
gccacggcggugucggcg

SEQ ID NO: 842219 - RNA, 20 nt, Mycobacterium avium subsp. paratuberculosis
gccacggcggugucggcggc

SEQ ID NO: 842220 - RNA, 14 nt, Mycobacterium avium subsp. paratuberculosis
gccacggcgggguc

SEQ ID NO: 842221 - RNA, 21 nt, Mycobacterium avium subsp. paratuberculosis
gccacggcggggucaagcggc

SEQ ID NO: 842222 - RNA, 21 nt, Mycobacterium avium subsp. paratuberculosis
gccagaccgguugcggcgaac

SEQ ID NO: 842223 - RNA, 15 nt, Mycobacterium avium subsp. paratuberculosis
gccagacgaacgcgg

SEQ ID NO: 842224 - RNA, 22 nt, Mycobacterium avium subsp. paratuberculosis
gccagaccguucuccgaggcgu

SEQ ID NO: 842225 - RNA, 17 nt, Mycobacterium avium subsp. paratuberculosis
gccagaccucgccgacg

SEQ ID NO: 842226 - RNA, 20 nt, Mycobacterium avium subsp. paratuberculosis
gccagaccucgccgacggug

SEQ ID NO: 842227 - RNA, 21 nt, Mycobacterium avium subsp. paratuberculosis
gccagacgguggggcuggccg

SEQ ID NO: 842228 - RNA, 16 nt, Mycobacterium avium subsp. paratuberculosis
gccagacgcgcaccgc

SEQ ID NO: 842229 - RNA, 19 nt, Mycobacterium avium subsp. paratuberculosis
gccagacgcgcaccgccac

SEQ ID NO: 842230 - RNA, 20 nt, Mycobacterium avium subsp. paratuberculosis
gccagacgcgcaccgccacc

SEQ ID NO: 842231 - RNA, 23 nt, Mycobacterium avium subsp. paratuberculosis
gccagacucacggcggcagcgcg

SEQ ID NO: 842232 - RNA, 21 nt, Mycobacterium avium subsp. paratuberculosis
gccagacugaugcccucgccg

SEQ ID NO: 842233 - RNA, 22 nt, Mycobacterium avium subsp. paratuberculosis
gccagacugaugcccucgccgg

SEQ ID NO: 842234 - RNA, 23 nt, Mycobacterium avium subsp. paratuberculosis
gccagacugaugcccucgccggu

SEQ ID NO: 842235 - RNA, 13 nt, Mycobacterium avium subsp. paratuberculosis
gccagacugcgca

SEQ ID NO: 842236 - RNA, 20 nt, Mycobacterium avium subsp. paratuberculosis
gccagacugcgcaccgccag

SEQ ID NO: 842237 - RNA, 22 nt, Mycobacterium avium subsp. paratuberculosis
gccagaccacaagggccaccgg

SEQ ID NO: 842238 - RNA, 16 nt, Mycobacterium avium subsp. paratuberculosis
gccagaacggcggcag

SEQ ID NO: 842239 - RNA, 17 nt, Mycobacterium avium subsp. paratuberculosis
gccagaaaucgccggga

SEQ ID NO: 842240 - RNA, 18 nt, Mycobacterium avium subsp. paratuberculosis
gccagaaaucgccgggau

SEQ ID NO: 842241 - RNA, 14 nt, Mycobacterium avium subsp. paratuberculosis
gccagaacacgccc

SEQ ID NO: 842242 - RNA, 21 nt, Mycobacterium avium subsp. paratuberculosis
gccagaacacgccccggcggg

SEQ ID NO: 842243 - RNA, 21 nt, Mycobacterium avium subsp. paratuberculosis
gccagaagaucugccggugcc

SEQ ID NO: 842244 - RNA, 19 nt, Mycobacterium avium subsp. paratuberculosis
gccacgcccuggccgccgg

SEQ ID NO: 842245 - RNA, 22 nt, Mycobacterium avium subsp. paratuberculosis
gccacgcccuggccgccggccg

SEQ ID NO: 842246 - RNA, 12 nt, Mycobacterium avium subsp. paratuberculosis
gccacgccgaca

SEQ ID NO: 842247 - RNA, 15 nt, Mycobacterium avium subsp. paratuberculosis
gccacgccgacaccg

SEQ ID NO: 842248 - RNA, 17 nt, Mycobacterium avium subsp. paratuberculosis
gccacgccgacaccguc

SEQ ID NO: 842249 - RNA, 21 nt, Mycobacterium avium subsp. paratuberculosis
gccacgccgacaccgucgccg

SEQ ID NO: 842250 - RNA, 14 nt, Mycobacterium avium subsp. paratuberculosis
gccacgccgaccag

SEQ ID NO: 842251 - RNA, 16 nt, Mycobacterium avium subsp. paratuberculosis
gccacgccgaccaggu

SEQ ID NO: 842252 - RNA, 17 nt, Mycobacterium avium subsp. paratuberculosis
gccacgccgaccagguc

SEQ ID NO: 842253 - RNA, 14 nt, Mycobacterium avium subsp. paratuberculosis
gccacgccccggcg

SEQ ID NO: 842254 - RNA, 21 nt, Mycobacterium avium subsp. paratuberculosis
gccacgcccgcagcgcaucgg

SEQ ID NO: 842255 - RNA, 20 nt, Mycobacterium avium subsp. paratuberculosis
gccacggccgcggcccggcc

SEQ ID NO: 842256 - RNA, 16 nt, Mycobacterium avium subsp. paratuberculosis
gccacggcacgucgag

SEQ ID NO: 842257 - RNA, 15 nt, Mycobacterium avium subsp. paratuberculosis
gccacggccaccgcc

SEQ ID NO: 842258 - RNA, 16 nt, Mycobacterium avium subsp. paratuberculosis
gccacggccaccgccg

SEQ ID NO: 842259 - RNA, 20 nt, Mycobacterium avium subsp. paratuberculosis
gccacggccagcaccgccag

SEQ ID NO: 842260 - RNA, 23 nt, Mycobacterium avium subsp. paratuberculosis
gccacggccagcaccgccagcgc

SEQ ID NO: 842261 - RNA, 20 nt, Mycobacterium avium subsp. paratuberculosis
gccacgcccaccgguggccg

SEQ ID NO: 842262 - RNA, 19 nt, Mycobacterium avium subsp. paratuberculosis
gccacgccgacuagcgcgg

SEQ ID NO: 842263 - RNA, 13 nt, Mycobacterium avium subsp. paratuberculosis
gccacgccgaugg

SEQ ID NO: 842264 - RNA, 17 nt, Mycobacterium avium subsp. paratuberculosis
gccacgagcccagccgu

SEQ ID NO: 842265 - RNA, 18 nt, Mycobacterium avium subsp. paratuberculosis
gccacgagcccagccguc

SEQ ID NO: 842266 - RNA, 19 nt, Mycobacterium avium subsp. paratuberculosis
gccacgagcccagccgucg

SEQ ID NO: 842267 - RNA, 18 nt, Mycobacterium avium subsp. paratuberculosis
gccacgaccucggggucg

SEQ ID NO: 842268 - RNA, 20 nt, Mycobacterium avium subsp. paratuberculosis
gccacgaccucggggucggc

SEQ ID NO: 842269 - RNA, 22 nt, Mycobacterium avium subsp. paratuberculosis
gccacgaccucggggucggccg

SEQ ID NO: 842270 - RNA, 15 nt, Mycobacterium avium subsp. paratuberculosis
gccacgacggcgcug

SEQ ID NO: 842271 - RNA, 16 nt, Mycobacterium avium subsp. paratuberculosis
gccacgaucaccacca

SEQ ID NO: 842272 - RNA, 22 nt, Mycobacterium avium subsp. paratuberculosis
gccacgaucaccaccaccgccg

SEQ ID NO: 842273 - RNA, 14 nt, Mycobacterium avium subsp. paratuberculosis
gccacgauccgcgc

SEQ ID NO: 842274 - RNA, 17 nt, Mycobacterium avium subsp. paratuberculosis
gccacgaugaucgucgg

SEQ ID NO: 842275 - RNA, 18 nt, Mycobacterium avium subsp. paratuberculosis
gccacgaugaucgucggc

SEQ ID NO: 842276 - RNA, 21 nt, Mycobacterium avium subsp. paratuberculosis
gccacgauccggggcagcagc

SEQ ID NO: 842277 - RNA, 14 nt, Mycobacterium avium subsp. paratuberculosis
gccacgaucgcgau

SEQ ID NO: 842278 - RNA, 22 nt, Mycobacterium avium subsp. paratuberculosis
gccacgcaggcguccagggcca

SEQ ID NO: 842279 - RNA, 16 nt, Mycobacterium avium subsp. paratuberculosis
gccacgcagucgucga

SEQ ID NO: 842280 - RNA, 22 nt, Mycobacterium avium subsp. paratuberculosis
gccacgaugcugauacccgcgc

SEQ ID NO: 842281 - RNA, 19 nt, Mycobacterium avium subsp. paratuberculosis
gccacgauggggacgucga

SEQ ID NO: 842282 - RNA, 11 nt, Mycobacterium avium subsp. paratuberculosis
gccacgcacac

SEQ ID NO: 842283 - RNA, 16 nt, Mycobacterium avium subsp. paratuberculosis
gccacgcacaccgcgc

SEQ ID NO: 842284 - RNA, 15 nt, Mycobacterium avium subsp. paratuberculosis
gccacacuggcguga

SEQ ID NO: 842285 - RNA, 17 nt, Mycobacterium avium subsp. paratuberculosis
gccacacuggcgugacg

SEQ ID NO: 842286 - RNA, 20 nt, Mycobacterium avium subsp. paratuberculosis
gccacacuggcgugacgcuc

SEQ ID NO: 842287 - RNA, 17 nt, Mycobacterium avium subsp. paratuberculosis
gccaccgucccgguguc

SEQ ID NO: 842288 - RNA, 22 nt, Mycobacterium avium subsp. paratuberculosis
gccaccgucccggugucgccgu

SEQ ID NO: 842289 - RNA, 16 nt, Mycobacterium avium subsp. paratuberculosis
gccaccgucgccggcu

SEQ ID NO: 842290 - RNA, 13 nt, Mycobacterium avium subsp. paratuberculosis
gccaccgucgucg

SEQ ID NO: 842291 - RNA, 14 nt, Mycobacterium avium subsp. paratuberculosis
gccaccgucgucga

SEQ ID NO: 842292 - RNA, 16 nt, Mycobacterium avium subsp. paratuberculosis
gccaccgucgucgagc

SEQ ID NO: 842293 - RNA, 19 nt, Mycobacterium avium subsp. paratuberculosis
gccaccgucgucgagcgcu

SEQ ID NO: 842294 - RNA, 18 nt, Mycobacterium avium subsp. paratuberculosis
gccaccgucuucggggcc

SEQ ID NO: 842295 - RNA, 19 nt, Mycobacterium avium subsp. paratuberculosis
gccaccgucuucggggccg

SEQ ID NO: 842296 - RNA, 14 nt, Mycobacterium avium subsp. paratuberculosis
gccacauguucucc

SEQ ID NO: 842297 - RNA, 16 nt, Mycobacterium avium subsp. paratuberculosis
gccacaugggccacgg

SEQ ID NO: 842298 - RNA, 18 nt, Mycobacterium avium subsp. paratuberculosis
gccacaugggccacggcg

SEQ ID NO: 842299 - RNA, 15 nt, Mycobacterium avium subsp. paratuberculosis
gccaccucgacggcg

SEQ ID NO: 842300 - RNA, 16 nt, Mycobacterium avium subsp. paratuberculosis
gccaccuugucggcgc

SEQ ID NO: 842301 - RNA, 19 nt, Mycobacterium avium subsp. paratuberculosis
gccaccuugucggcgccca

SEQ ID NO: 842302 - RNA, 22 nt, Mycobacterium avium subsp. paratuberculosis
gccaccucgaucagcggcaucg

SEQ ID NO: 842303 - RNA, 14 nt, Mycobacterium avium subsp. paratuberculosis
gccaccucgccgca

SEQ ID NO: 842304 - RNA, 18 nt, Mycobacterium avium subsp. paratuberculosis
gccaccucgccgcaggcg

SEQ ID NO: 842305 - RNA, 20 nt, Mycobacterium avium subsp. paratuberculosis
gccaccgugccuuacgccgg

SEQ ID NO: 842306 - RNA, 23 nt, Mycobacterium avium subsp. paratuberculosis
gccaccgugccuuacgccggggu

SEQ ID NO: 842307 - RNA, 19 nt, Mycobacterium avium subsp. paratuberculosis
gccaccuccuccgguccgg

SEQ ID NO: 842308 - RNA, 20 nt, Mycobacterium avium subsp. paratuberculosis
gccaccuccuccgguccggg

SEQ ID NO: 842309 - RNA, 15 nt, Mycobacterium avium subsp. paratuberculosis
gccacgacgcgccac

SEQ ID NO: 842310 - RNA, 15 nt, Mycobacterium avium subsp. paratuberculosis
gccacgacgcggcga

SEQ ID NO: 842311 - RNA, 16 nt, Mycobacterium avium subsp. paratuberculosis
gccacgacgcggcgau

SEQ ID NO: 842312 - RNA, 23 nt, Mycobacterium avium subsp. paratuberculosis
gccacgacgcggcgcgcgaugga

SEQ ID NO: 842313 - RNA, 18 nt, Mycobacterium avium subsp. paratuberculosis
gccacgacauccccgcaa

SEQ ID NO: 842314 - RNA, 13 nt, Mycobacterium avium subsp. paratuberculosis
gccacgacaccag

SEQ ID NO: 842315 - RNA, 17 nt, Mycobacterium avium subsp. paratuberculosis
gccagauacuccucggu

SEQ ID NO: 842316 - RNA, 18 nt, Mycobacterium avium subsp. paratuberculosis
gccagauacuccucggug

SEQ ID NO: 842317 - RNA, 17 nt, Mycobacterium avium subsp. paratuberculosis
gccagaugcgccgcgga

SEQ ID NO: 842318 - RNA, 18 nt, Mycobacterium avium subsp. paratuberculosis
gccagaucuccgccuucg

SEQ ID NO: 842319 - RNA, 14 nt, Mycobacterium avium subsp. paratuberculosis
gccagaucgacccc

SEQ ID NO: 842320 - RNA, 17 nt, Mycobacterium avium subsp. paratuberculosis
gccagaucgacgccgcg

SEQ ID NO: 842321 - RNA, 21 nt, Mycobacterium avium subsp. paratuberculosis
gccagaucgaggccagcgcga

SEQ ID NO: 842322 - RNA, 18 nt, Mycobacterium avium subsp. paratuberculosis
gccagaucgcugaugcgc

SEQ ID NO: 842323 - RNA, 15 nt, Mycobacterium avium subsp. paratuberculosis
gccagcaccagcgug

SEQ ID NO: 842324 - RNA, 13 nt, Mycobacterium avium subsp. paratuberculosis
gccagcaccucga

SEQ ID NO: 842325 - RNA, 20 nt, Mycobacterium avium subsp. paratuberculosis
gccagcaccucgaacgccgg

SEQ ID NO: 842326 - RNA, 14 nt, Mycobacterium avium subsp. paratuberculosis
gccagcaccucgcg

SEQ ID NO: 842327 - RNA, 16 nt, Mycobacterium avium subsp. paratuberculosis
gccagcaccucgcggc

SEQ ID NO: 842328 - RNA, 20 nt, Mycobacterium avium subsp. paratuberculosis
gccagcaccucgcggcagcc

SEQ ID NO: 842329 - RNA, 21 nt, Mycobacterium avium subsp. paratuberculosis
gccagcaccucggcgaccacg

SEQ ID NO: 842330 - RNA, 18 nt, Mycobacterium avium subsp. paratuberculosis
gccagcaccuggcgcacc

SEQ ID NO: 842331 - RNA, 22 nt, Mycobacterium avium subsp. paratuberculosis
gccagcaccuggcgcaccgccg

SEQ ID NO: 842332 - RNA, 23 nt, Mycobacterium avium subsp. paratuberculosis
gccagcaccuggcgcaccgccgc

SEQ ID NO: 842333 - RNA, 22 nt, Mycobacterium avium subsp. paratuberculosis
gccagcaccagcagccggucga

SEQ ID NO: 842334 - RNA, 13 nt, Mycobacterium avium subsp. paratuberculosis
gccagcaccagcc

SEQ ID NO: 842335 - RNA, 14 nt, Mycobacterium avium subsp. paratuberculosis
gccagcaccagccc

SEQ ID NO: 842336 - RNA, 16 nt, Mycobacterium avium subsp. paratuberculosis
gccagcaccagcccga

SEQ ID NO: 842337 - RNA, 18 nt, Mycobacterium avium subsp. paratuberculosis
gccagcaccagcccgaug

SEQ ID NO: 842338 - RNA, 21 nt, Mycobacterium avium subsp. paratuberculosis
gccagcaccagcccgaugccg

SEQ ID NO: 842339 - RNA, 15 nt, Mycobacterium avium subsp. paratuberculosis
gccagcaccagcgcg

SEQ ID NO: 842340 - RNA, 20 nt, Mycobacterium avium subsp. paratuberculosis
gccagcacacccucgacccg

SEQ ID NO: 842341 - RNA, 13 nt, Mycobacterium avium subsp. paratuberculosis
gccagcaccaccg

SEQ ID NO: 842342 - RNA, 17 nt, Mycobacterium avium subsp. paratuberculosis
gccagcaccaccgcgag

SEQ ID NO: 842343 - RNA, 20 nt, Mycobacterium avium subsp. paratuberculosis
gccagcaccaccgucaccgc

SEQ ID NO: 842344 - RNA, 21 nt, Mycobacterium avium subsp. paratuberculosis
gccagcaccaccgucaccgcc

SEQ ID NO: 842345 - RNA, 14 nt, Mycobacterium avium subsp. paratuberculosis
gccagcaccacguc

SEQ ID NO: 842346 - RNA, 11 nt, Mycobacterium avium subsp. paratuberculosis
gccagcaccac

SEQ ID NO: 842347 - RNA, 13 nt, Mycobacterium avium subsp. paratuberculosis
gccagcaccacca

SEQ ID NO: 842348 - RNA, 21 nt, Mycobacterium avium subsp. paratuberculosis
gccagcaccaccaacggcucg

SEQ ID NO: 842349 - RNA, 16 nt, Mycobacterium avium subsp. paratuberculosis
gccagcagcagcgccg

SEQ ID NO: 842350 - RNA, 18 nt, Mycobacterium avium subsp. paratuberculosis
gccagcagcagcgccgcc

SEQ ID NO: 842351 - RNA, 23 nt, Mycobacterium avium subsp. paratuberculosis
gccagcagcagcgccgccaccgg

SEQ ID NO: 842352 - RNA, 17 nt, Mycobacterium avium subsp. paratuberculosis
gccagcagcagcgcggc

SEQ ID NO: 842353 - RNA, 17 nt, Mycobacterium avium subsp. paratuberculosis
gccagcagccagcuggu

SEQ ID NO: 842354 - RNA, 13 nt, Mycobacterium avium subsp. paratuberculosis
gccagcacgccgg

SEQ ID NO: 842355 - RNA, 14 nt, Mycobacterium avium subsp. paratuberculosis
gccagcagcaggua

SEQ ID NO: 842356 - RNA, 15 nt, Mycobacterium avium subsp. paratuberculosis
gccagcagcgccgcu

SEQ ID NO: 842357 - RNA, 14 nt, Mycobacterium avium subsp. paratuberculosis
gccagcagcccggg

SEQ ID NO: 842358 - RNA, 15 nt, Mycobacterium avium subsp. paratuberculosis
gccagcagccgcagc

SEQ ID NO: 842359 - RNA, 12 nt, Mycobacterium avium subsp. paratuberculosis
gccagcagcgca

SEQ ID NO: 842360 - RNA, 12 nt, Mycobacterium avium subsp. paratuberculosis
gccagcagcccg

SEQ ID NO: 842361 - RNA, 13 nt, Mycobacterium avium subsp. paratuberculosis
gccagcagccgcu

SEQ ID NO: 842362 - RNA, 14 nt, Mycobacterium avium subsp. paratuberculosis
gccagcagccgggu

SEQ ID NO: 842363 - RNA, 18 nt, Mycobacterium avium subsp. paratuberculosis
gccagcagccgguacagc

SEQ ID NO: 842364 - RNA, 15 nt, Mycobacterium avium subsp. paratuberculosis
gccagcacggccacc

SEQ ID NO: 842365 - RNA, 22 nt, Mycobacterium avium subsp. paratuberculosis
gccagcacggccaccagcagcg

SEQ ID NO: 842366 - RNA, 14 nt, Mycobacterium avium subsp. paratuberculosis
gccagcacggccag

SEQ ID NO: 842367 - RNA, 14 nt, Mycobacterium avium subsp. paratuberculosis
gccagcacgccggu

SEQ ID NO: 842368 - RNA, 22 nt, Mycobacterium avium subsp. paratuberculosis
gccagcacgccggucagcacca

SEQ ID NO: 842369 - RNA, 14 nt, Mycobacterium avium subsp. paratuberculosis
gccagcacgaucgg

SEQ ID NO: 842370 - RNA, 15 nt, Mycobacterium avium subsp. paratuberculosis
gccagcacgaucggg

SEQ ID NO: 842371 - RNA, 15 nt, Mycobacterium avium subsp. paratuberculosis
gccagcacgcaggcg

SEQ ID NO: 842372 - RNA, 16 nt, Mycobacterium avium subsp. paratuberculosis
gccagcacgcccccgc

SEQ ID NO: 842373 - RNA, 23 nt, Mycobacterium avium subsp. paratuberculosis
gccagcacgaacaccacguagcc

SEQ ID NO: 842374 - RNA, 14 nt, Mycobacterium avium subsp. paratuberculosis
gccagcacgacccc

SEQ ID NO: 842375 - RNA, 15 nt, Mycobacterium avium subsp. paratuberculosis
gccagcacgaccccg

SEQ ID NO: 842376 - RNA, 17 nt, Mycobacterium avium subsp. paratuberculosis
gccagcacgaccccgcc

SEQ ID NO: 842377 - RNA, 21 nt, Mycobacterium avium subsp. paratuberculosis
gccagcacgaccccgcccacg

SEQ ID NO: 842378 - RNA, 22 nt, Mycobacterium avium subsp. paratuberculosis
gccagcacgaccccgcccacga

SEQ ID NO: 842379 - RNA, 14 nt, Mycobacterium avium subsp. paratuberculosis
gccagcagcguggg

SEQ ID NO: 842380 - RNA, 23 nt, Mycobacterium avium subsp. paratuberculosis
gccagcaguguccagucggccgu

SEQ ID NO: 842381 - RNA, 14 nt, Mycobacterium avium subsp. paratuberculosis
gccagcagucguga

SEQ ID NO: 842382 - RNA, 17 nt, Mycobacterium avium subsp. paratuberculosis
gccagcagucgugacgc

SEQ ID NO: 842383 - RNA, 21 nt, Mycobacterium avium subsp. paratuberculosis
gccagcagucgugacgcggcg

SEQ ID NO: 842384 - RNA, 22 nt, Mycobacterium avium subsp. paratuberculosis
gccagcagucgugacgcggcgu

SEQ ID NO: 842385 - RNA, 14 nt, Mycobacterium avium subsp. paratuberculosis
gccagcagugccac

SEQ ID NO: 842386 - RNA, 21 nt, Mycobacterium avium subsp. paratuberculosis
gccagcagugccaccaccacg

SEQ ID NO: 842387 - RNA, 24 nt, Mycobacterium avium subsp. paratuberculosis
gccagcagugccaccaccacggcc

SEQ ID NO: 842388 - RNA, 18 nt, Mycobacterium avium subsp. paratuberculosis
gccagcagguccgccggu

SEQ ID NO: 842389 - RNA, 22 nt, Mycobacterium avium subsp. paratuberculosis
gccagcagguccgccggugcca

SEQ ID NO: 842390 - RNA, 23 nt, Mycobacterium avium subsp. paratuberculosis
gccagcagguccgccggugccag

SEQ ID NO: 842391 - RNA, 22 nt, Mycobacterium avium subsp. paratuberculosis
gccagcaggucgaaggcggccg

SEQ ID NO: 842392 - RNA, 23 nt, Mycobacterium avium subsp. paratuberculosis
gccagcaggucgaaggcggccgc

SEQ ID NO: 842393 - RNA, 18 nt, Mycobacterium avium subsp. paratuberculosis
gccagcaggucgucgacg

SEQ ID NO: 842394 - RNA, 19 nt, Mycobacterium avium subsp. paratuberculosis
gccagcaggucgucgacgu

SEQ ID NO: 842395 - RNA, 20 nt, Mycobacterium avium subsp. paratuberculosis
gccagcaggucgucgacguc

SEQ ID NO: 842396 - RNA, 17 nt, Mycobacterium avium subsp. paratuberculosis
gccagcagggucagcga

SEQ ID NO: 842397 - RNA, 22 nt, Mycobacterium avium subsp. paratuberculosis
gccagcagggucagcgacaacg

SEQ ID NO: 842398 - RNA, 16 nt, Mycobacterium avium subsp. paratuberculosis
gccagcagggcgccga

SEQ ID NO: 842399 - RNA, 17 nt, Mycobacterium avium subsp. paratuberculosis
gccagcagggcgccgac

SEQ ID NO: 842400 - RNA, 18 nt, Mycobacterium avium subsp. paratuberculosis
gccagcagggcgccgacg

SEQ ID NO: 842401 - RNA, 21 nt, Mycobacterium avium subsp. paratuberculosis
gccagcagggcgccgacgauc

SEQ ID NO: 842402 - RNA, 22 nt, Mycobacterium avium subsp. paratuberculosis
gccagcagguagaagccgcgac

SEQ ID NO: 842403 - RNA, 15 nt, Mycobacterium avium subsp. paratuberculosis
gccagcagcgcgucg

SEQ ID NO: 842404 - RNA, 17 nt, Mycobacterium avium subsp. paratuberculosis
gccagcagcgcgucgcg

SEQ ID NO: 842405 - RNA, 14 nt, Mycobacterium avium subsp. paratuberculosis
gccagcagcgcgcc

SEQ ID NO: 842406 - RNA, 21 nt, Mycobacterium avium subsp. paratuberculosis
gccagcagcgcgccgcgcugg

SEQ ID NO: 842407 - RNA, 15 nt, Mycobacterium avium subsp. paratuberculosis
gccagcagcgcggcg

SEQ ID NO: 842408 - RNA, 16 nt, Mycobacterium avium subsp. paratuberculosis
gccagcagcgcggcga

SEQ ID NO: 842409 - RNA, 18 nt, Mycobacterium avium subsp. paratuberculosis
gccagcagcggcacccgg

SEQ ID NO: 842410 - RNA, 22 nt, Mycobacterium avium subsp. paratuberculosis
gccagcagcggcacccgguccg

SEQ ID NO: 842411 - RNA, 19 nt, Mycobacterium avium subsp. paratuberculosis
gccagcagcggcaguagcg

SEQ ID NO: 842412 - RNA, 20 nt, Mycobacterium avium subsp. paratuberculosis
gccagcgaguccagccagcc

SEQ ID NO: 842413 - RNA, 18 nt, Mycobacterium avium subsp. paratuberculosis
gccagcgagucgaugacc

SEQ ID NO: 842414 - RNA, 21 nt, Mycobacterium avium subsp. paratuberculosis
gccagcgagucgaugaccucg

SEQ ID NO: 842415 - RNA, 20 nt, Mycobacterium avium subsp. paratuberculosis
gccagccggucaucgcguag

SEQ ID NO: 842416 - RNA, 19 nt, Mycobacterium avium subsp. paratuberculosis
gccagccggucgucggggc

SEQ ID NO: 842417 - RNA, 21 nt, Mycobacterium avium subsp. paratuberculosis
gccagccggucgucggggcau

SEQ ID NO: 842418 - RNA, 19 nt, Mycobacterium avium subsp. paratuberculosis
gccagccggugcggucggc

SEQ ID NO: 842419 - RNA, 22 nt, Mycobacterium avium subsp. paratuberculosis
gccagccggugcggucggcguc

SEQ ID NO: 842420 - RNA, 19 nt, Mycobacterium avium subsp. paratuberculosis
gccagccggugcugacccg

SEQ ID NO: 842421 - RNA, 14 nt, Mycobacterium avium subsp. paratuberculosis
gccagccgguggcg

SEQ ID NO: 842422 - RNA, 21 nt, Mycobacterium avium subsp. paratuberculosis
gccagccgggguagggcggcg

SEQ ID NO: 842423 - RNA, 16 nt, Mycobacterium avium subsp. paratuberculosis
gccagccgggccgagc

SEQ ID NO: 842424 - RNA, 21 nt, Mycobacterium avium subsp. paratuberculosis
gccagccgggccgagcgcgcc

SEQ ID NO: 842425 - RNA, 13 nt, Mycobacterium avium subsp. paratuberculosis
gccagccgggcga

SEQ ID NO: 842426 - RNA, 16 nt, Mycobacterium avium subsp. paratuberculosis
gccagccgggcgaccg

SEQ ID NO: 842427 - RNA, 12 nt, Mycobacterium avium subsp. paratuberculosis
gccagcgcaccg

SEQ ID NO: 842428 - RNA, 15 nt, Mycobacterium avium subsp. paratuberculosis
gccagcgcaccgagc

SEQ ID NO: 842429 - RNA, 20 nt, Mycobacterium avium subsp. paratuberculosis
gccagcgcaccgggcccgcc

SEQ ID NO: 842430 - RNA, 22 nt, Mycobacterium avium subsp. paratuberculosis
gccagcgcaccgggcccgcccg

SEQ ID NO: 842431 - RNA, 14 nt, Mycobacterium avium subsp. paratuberculosis
gccagcgcagcacu

SEQ ID NO: 842432 - RNA, 16 nt, Mycobacterium avium subsp. paratuberculosis
gccagcgcagcacuga

SEQ ID NO: 842433 - RNA, 13 nt, Mycobacterium avium subsp. paratuberculosis
gccagcgcagcga

SEQ ID NO: 842434 - RNA, 20 nt, Mycobacterium avium subsp. paratuberculosis
gccagcgcagguacgcggcg

SEQ ID NO: 842435 - RNA, 20 nt, Mycobacterium avium subsp. paratuberculosis
gccagcgccagcgccagcgu

SEQ ID NO: 842436 - RNA, 15 nt, Mycobacterium avium subsp. paratuberculosis
gccagcggcagcggc

SEQ ID NO: 842437 - RNA, 16 nt, Mycobacterium avium subsp. paratuberculosis
gccagcggcagcggcg

SEQ ID NO: 842438 - RNA, 20 nt, Mycobacterium avium subsp. paratuberculosis
gccagcggcagcggcgucgu

SEQ ID NO: 842439 - RNA, 13 nt, Mycobacterium avium subsp. paratuberculosis
gccagcggcagcg

SEQ ID NO: 842440 - RNA, 17 nt, Mycobacterium avium subsp. paratuberculosis
gccagcggcagcgacag

SEQ ID NO: 842441 - RNA, 21 nt, Mycobacterium avium subsp. paratuberculosis
gccagcggcagcgacagcgcg

SEQ ID NO: 842442 - RNA, 15 nt, Mycobacterium avium subsp. paratuberculosis
gccagcgcggcggcg

SEQ ID NO: 842443 - RNA, 18 nt, Mycobacterium avium subsp. paratuberculosis
gccagcgcggcggcgccg

SEQ ID NO: 842444 - RNA, 18 nt, Mycobacterium avium subsp. paratuberculosis
gccagcgcgucggccagc

SEQ ID NO: 842445 - RNA, 21 nt, Mycobacterium avium subsp. paratuberculosis
gccagcgcgucggccagcacc

SEQ ID NO: 842446 - RNA, 20 nt, Mycobacterium avium subsp. paratuberculosis
gccagcgcgugaucggugcc

SEQ ID NO: 842447 - RNA, 21 nt, Mycobacterium avium subsp. paratuberculosis
gccagcgcgugaucggugccc

SEQ ID NO: 842448 - RNA, 23 nt, Mycobacterium avium subsp. paratuberculosis
gccagcgcgugaucggugcccgc

SEQ ID NO: 842449 - RNA, 16 nt, Mycobacterium avium subsp. paratuberculosis
gccagcgcgugcgggg

SEQ ID NO: 842450 - RNA, 18 nt, Mycobacterium avium subsp. paratuberculosis
gccagcgcgugcggggug

SEQ ID NO: 842451 - RNA, 22 nt, Mycobacterium avium subsp. paratuberculosis
gccagcgcgugcggggugugca

SEQ ID NO: 842452 - RNA, 14 nt, Mycobacterium avium subsp. paratuberculosis
gccagcgcgucggc

SEQ ID NO: 842453 - RNA, 20 nt, Mycobacterium avium subsp. paratuberculosis
gccagcgcgucgcacagcgc

SEQ ID NO: 842454 - RNA, 23 nt, Mycobacterium avium subsp. paratuberculosis
gccagcgcgucgcacagcgccgc

SEQ ID NO: 842455 - RNA, 20 nt, Mycobacterium avium subsp. paratuberculosis
gccagcgcggcggucgcgcg

SEQ ID NO: 842456 - RNA, 15 nt, Mycobacterium avium subsp. paratuberculosis
gccagcgcggcguca

SEQ ID NO: 842457 - RNA, 19 nt, Mycobacterium avium subsp. paratuberculosis
gccagcgcgguggccagca

SEQ ID NO: 842458 - RNA, 20 nt, Mycobacterium avium subsp. paratuberculosis
gccagcgcgguggccagcag

SEQ ID NO: 842459 - RNA, 15 nt, Mycobacterium avium subsp. paratuberculosis
gccagcgcggugucg

SEQ ID NO: 842460 - RNA, 14 nt, Mycobacterium avium subsp. paratuberculosis
gccagcgcggugug

SEQ ID NO: 842461 - RNA, 15 nt, Mycobacterium avium subsp. paratuberculosis
gccagcgcggugugc

SEQ ID NO: 842462 - RNA, 22 nt, Mycobacterium avium subsp. paratuberculosis
gccagcgcggugugcggcggcu

SEQ ID NO: 842463 - RNA, 18 nt, Mycobacterium avium subsp. paratuberculosis
gccagcgcggggucggcc

SEQ ID NO: 842464 - RNA, 20 nt, Mycobacterium avium subsp. paratuberculosis
gccagcgcggggucggccag

SEQ ID NO: 842465 - RNA, 21 nt, Mycobacterium avium subsp. paratuberculosis
gccagcgcggggucggccagu

SEQ ID NO: 842466 - RNA, 12 nt, Mycobacterium avium subsp. paratuberculosis
gccagcgcggug

SEQ ID NO: 842467 - RNA, 23 nt, Mycobacterium avium subsp. paratuberculosis
gccagcgcggugaagucggugcc

SEQ ID NO: 842468 - RNA, 15 nt, Mycobacterium avium subsp. paratuberculosis
gccagcgcggugccc

SEQ ID NO: 842469 - RNA, 16 nt, Mycobacterium avium subsp. paratuberculosis
gccagcgcggugccca

SEQ ID NO: 842470 - RNA, 21 nt, Mycobacterium avium subsp. paratuberculosis
gccagcccggugaucgccgcc

SEQ ID NO: 842471 - RNA, 17 nt, Mycobacterium avium subsp. paratuberculosis
gccagccgcucccggcg

SEQ ID NO: 842472 - RNA, 14 nt, Mycobacterium avium subsp. paratuberculosis
gccagccgcgcggc

SEQ ID NO: 842473 - RNA, 15 nt, Mycobacterium avium subsp. paratuberculosis
gccagccgcgcggcg

SEQ ID NO: 842474 - RNA, 16 nt, Mycobacterium avium subsp. paratuberculosis
gccagccgcgcggcgu

SEQ ID NO: 842475 - RNA, 13 nt, Mycobacterium avium subsp. paratuberculosis
gccagccggcccu

SEQ ID NO: 842476 - RNA, 14 nt, Mycobacterium avium subsp. paratuberculosis
gccagccggccgcu

SEQ ID NO: 842477 - RNA, 16 nt, Mycobacterium avium subsp. paratuberculosis
gccagccggccgcuga

SEQ ID NO: 842478 - RNA, 13 nt, Mycobacterium avium subsp. paratuberculosis
gccagccgcgcga

SEQ ID NO: 842479 - RNA, 15 nt, Mycobacterium avium subsp. paratuberculosis
gccagcccgucgggu

SEQ ID NO: 842480 - RNA, 15 nt, Mycobacterium avium subsp. paratuberculosis
gccagcccguggcca

SEQ ID NO: 842481 - RNA, 20 nt, Mycobacterium avium subsp. paratuberculosis
gccagcccguggccagcgcc

SEQ ID NO: 842482 - RNA, 20 nt, Mycobacterium avium subsp. paratuberculosis
gccagcccguuguggcggcc

SEQ ID NO: 842483 - RNA, 21 nt, Mycobacterium avium subsp. paratuberculosis
gccagcccguuguggcggcca

SEQ ID NO: 842484 - RNA, 18 nt, Mycobacterium avium subsp. paratuberculosis
gccagcccgcgcaauacc

SEQ ID NO: 842485 - RNA, 12 nt, Mycobacterium avium subsp. paratuberculosis
gccagcccggcg

SEQ ID NO: 842486 - RNA, 19 nt, Mycobacterium avium subsp. paratuberculosis
gccagcccggcguacagca

SEQ ID NO: 842487 - RNA, 16 nt, Mycobacterium avium subsp. paratuberculosis
gccagcccgcccagcg

SEQ ID NO: 842488 - RNA, 22 nt, Mycobacterium avium subsp. paratuberculosis
gccagcccgcccagcgccacgg

SEQ ID NO: 842489 - RNA, 13 nt, Mycobacterium avium subsp. paratuberculosis
gccagcccgccga

SEQ ID NO: 842490 - RNA, 15 nt, Mycobacterium avium subsp. paratuberculosis
gccagcccgccgaac

SEQ ID NO: 842491 - RNA, 16 nt, Mycobacterium avium subsp. paratuberculosis
gccagcccgccgaacc

SEQ ID NO: 842492 - RNA, 20 nt, Mycobacterium avium subsp. paratuberculosis
gccagccccgggaaccagcc

SEQ ID NO: 842493 - RNA, 15 nt, Mycobacterium avium subsp. paratuberculosis
gccagcccgaaaguc

SEQ ID NO: 842494 - RNA, 16 nt, Mycobacterium avium subsp. paratuberculosis
gccagccacgccgaca

SEQ ID NO: 842495 - RNA, 13 nt, Mycobacterium avium subsp. paratuberculosis
gccagccccacca

SEQ ID NO: 842496 - RNA, 15 nt, Mycobacterium avium subsp. paratuberculosis
gccagccccaccggc

SEQ ID NO: 842497 - RNA, 16 nt, Mycobacterium avium subsp. paratuberculosis
gccagccccaccggcc

SEQ ID NO: 842498 - RNA, 18 nt, Mycobacterium avium subsp. paratuberculosis
gccagccccaccggccac

SEQ ID NO: 842499 - RNA, 16 nt, Mycobacterium avium subsp. paratuberculosis
gccagccaggccgucg

SEQ ID NO: 842500 - RNA, 16 nt, Mycobacterium avium subsp. paratuberculosis
gccagccaggcgauga

SEQ ID NO: 842501 - RNA, 20 nt, Mycobacterium avium subsp. paratuberculosis
gccagcccaucccgauccgc

SEQ ID NO: 842502 - RNA, 16 nt, Mycobacterium avium subsp. paratuberculosis
gccagccagccgccca

SEQ ID NO: 842503 - RNA, 20 nt, Mycobacterium avium subsp. paratuberculosis
gccagccagccgcccagcau

SEQ ID NO: 842504 - RNA, 17 nt, Mycobacterium avium subsp. paratuberculosis
gcaucguugccggcggc

SEQ ID NO: 842505 - RNA, 18 nt, Mycobacterium avium subsp. paratuberculosis
gcaucguugccggcggcg

SEQ ID NO: 842506 - RNA, 20 nt, Mycobacterium avium subsp. paratuberculosis
gcaucguugccggcggcgaa

SEQ ID NO: 842507 - RNA, 17 nt, Mycobacterium avium subsp. paratuberculosis
gcaucgugaugcgggua

SEQ ID NO: 842508 - RNA, 16 nt, Mycobacterium avium subsp. paratuberculosis
gcaucgucgcggcgcu

SEQ ID NO: 842509 - RNA, 13 nt, Mycobacterium avium subsp. paratuberculosis
gcaucgucggcgc

SEQ ID NO: 842510 - RNA, 14 nt, Mycobacterium avium subsp. paratuberculosis
gcaucgucggcgcc

SEQ ID NO: 842511 - RNA, 18 nt, Mycobacterium avium subsp. paratuberculosis
gcaucgucggcgccggcg

SEQ ID NO: 842512 - RNA, 19 nt, Mycobacterium avium subsp. paratuberculosis
gcaucgucggcgccggcgc

SEQ ID NO: 842513 - RNA, 17 nt, Mycobacterium avium subsp. paratuberculosis
gcaucucggcgaagguc

SEQ ID NO: 842514 - RNA, 14 nt, Mycobacterium avium subsp. paratuberculosis
gcaucucggugccg

SEQ ID NO: 842515 - RNA, 22 nt, Mycobacterium avium subsp. paratuberculosis
gcaucucggugccgucgaucgc

SEQ ID NO: 842516 - RNA, 23 nt, Mycobacterium avium subsp. paratuberculosis
gcaucucgaaugcggcugccggc

SEQ ID NO: 842517 - RNA, 14 nt, Mycobacterium avium subsp. paratuberculosis
gcaucucccgcgcg

SEQ ID NO: 842518 - RNA, 15 nt, Mycobacterium avium subsp. paratuberculosis
gcaucuccgagucgg

SEQ ID NO: 842519 - RNA, 14 nt, Mycobacterium avium subsp. paratuberculosis
gcaucuccagccgc

SEQ ID NO: 842520 - RNA, 17 nt, Mycobacterium avium subsp. paratuberculosis
gcaucuccagccggcga

SEQ ID NO: 842521 - RNA, 18 nt, Mycobacterium avium subsp. paratuberculosis
gcaucuccagccggcgaa

SEQ ID NO: 842522 - RNA, 16 nt, Mycobacterium avium subsp. paratuberculosis
gcaucgggcgcucggc

SEQ ID NO: 842523 - RNA, 18 nt, Mycobacterium avium subsp. paratuberculosis
gcaucgggcgcucggcca

SEQ ID NO: 842524 - RNA, 19 nt, Mycobacterium avium subsp. paratuberculosis
gcaucgggcgcucggccag

SEQ ID NO: 842525 - RNA, 12 nt, Mycobacterium avium subsp. paratuberculosis
gcaucggucagc

SEQ ID NO: 842526 - RNA, 16 nt, Mycobacterium avium subsp. paratuberculosis
gcaucggucaccagcu

SEQ ID NO: 842527 - RNA, 19 nt, Mycobacterium avium subsp. paratuberculosis
gcaucggguugccggcggc

SEQ ID NO: 842528 - RNA, 12 nt, Mycobacterium avium subsp. paratuberculosis
gcaucgguggca

SEQ ID NO: 842529 - RNA, 20 nt, Mycobacterium avium subsp. paratuberculosis
gcaucggcucguagcgggcg

SEQ ID NO: 842530 - RNA, 20 nt, Mycobacterium avium subsp. paratuberculosis
gcaucggcuggucggcggcc

SEQ ID NO: 842531 - RNA, 14 nt, Mycobacterium avium subsp. paratuberculosis
gcaucggcgccgga

SEQ ID NO: 842532 - RNA, 13 nt, Mycobacterium avium subsp. paratuberculosis
gcaucggcgacgc

SEQ ID NO: 842533 - RNA, 14 nt, Mycobacterium avium subsp. paratuberculosis
gcaucggcgacgcc

SEQ ID NO: 842534 - RNA, 13 nt, Mycobacterium avium subsp. paratuberculosis
gcaucggcgcccu

SEQ ID NO: 842535 - RNA, 17 nt, Mycobacterium avium subsp. paratuberculosis
gcaucggcgcccucgcc

SEQ ID NO: 842536 - RNA, 21 nt, Mycobacterium avium subsp. paratuberculosis
gcaucggcgcccucgccgacc

SEQ ID NO: 842537 - RNA, 23 nt, Mycobacterium avium subsp. paratuberculosis
gcaucggcgcccucgccgaccug

SEQ ID NO: 842538 - RNA, 12 nt, Mycobacterium avium subsp. paratuberculosis
gcaucggcgccg

SEQ ID NO: 842539 - RNA, 17 nt, Mycobacterium avium subsp. paratuberculosis
gcaucgccaaggcgcug

SEQ ID NO: 842540 - RNA, 19 nt, Mycobacterium avium subsp. paratuberculosis
gcaucgccaaggcgcugug

SEQ ID NO: 842541 - RNA, 14 nt, Mycobacterium avium subsp. paratuberculosis
gcaucgccgaaccg

SEQ ID NO: 842542 - RNA, 18 nt, Mycobacterium avium subsp. paratuberculosis
gcaucgccgaaccgggcg

SEQ ID NO: 842543 - RNA, 12 nt, Mycobacterium avium subsp. paratuberculosis
gcaucgccgagc

SEQ ID NO: 842544 - RNA, 16 nt, Mycobacterium avium subsp. paratuberculosis
gcaucgccgagcgcau

SEQ ID NO: 842545 - RNA, 17 nt, Mycobacterium avium subsp. paratuberculosis
gcaucgccucggcggcc

SEQ ID NO: 842546 - RNA, 18 nt, Mycobacterium avium subsp. paratuberculosis
gcaucgccucggcggccg

SEQ ID NO: 842547 - RNA, 21 nt, Mycobacterium avium subsp. paratuberculosis
gcaucgccucggcggccgccc

SEQ ID NO: 842548 - RNA, 18 nt, Mycobacterium avium subsp. paratuberculosis
gcaucgccguccacgggu

SEQ ID NO: 842549 - RNA, 13 nt, Mycobacterium avium subsp. paratuberculosis
gcaucgccgccaa

SEQ ID NO: 842550 - RNA, 17 nt, Mycobacterium avium subsp. paratuberculosis
gcaucgccgcgacccgg

SEQ ID NO: 842551 - RNA, 13 nt, Mycobacterium avium subsp. paratuberculosis
gcaucgccggcga

SEQ ID NO: 842552 - RNA, 22 nt, Mycobacterium avium subsp. paratuberculosis
gcaucgccggcgaugcgcgccu

SEQ ID NO: 842553 - RNA, 13 nt, Mycobacterium avium subsp. paratuberculosis
gcaucgcgcgcgg

SEQ ID NO: 842554 - RNA, 16 nt, Mycobacterium avium subsp. paratuberculosis
gcaucgcgcgcggcgg

SEQ ID NO: 842555 - RNA, 18 nt, Mycobacterium avium subsp. paratuberculosis
gcaucgcgcgcggcggcc

SEQ ID NO: 842556 - RNA, 19 nt, Mycobacterium avium subsp. paratuberculosis
gcaucgcgcgcggcggcca

SEQ ID NO: 842557 - RNA, 14 nt, Mycobacterium avium subsp. paratuberculosis
gcaucgcgccgcau

SEQ ID NO: 842558 - RNA, 14 nt, Mycobacterium avium subsp. paratuberculosis
gcaucgcggcgaug

SEQ ID NO: 842559 - RNA, 16 nt, Mycobacterium avium subsp. paratuberculosis
gcaucgcgggccaccg

SEQ ID NO: 842560 - RNA, 20 nt, Mycobacterium avium subsp. paratuberculosis
gcaucgcgggccaccggcgc

SEQ ID NO: 842561 - RNA, 21 nt, Mycobacterium avium subsp. paratuberculosis
gcaucgcgggccaccggcgcc

SEQ ID NO: 842562 - RNA, 19 nt, Mycobacterium avium subsp. paratuberculosis
gcaucggaugccggggcag

SEQ ID NO: 842563 - RNA, 14 nt, Mycobacterium avium subsp. paratuberculosis
gcaucgcugccguc

SEQ ID NO: 842564 - RNA, 23 nt, Mycobacterium avium subsp. paratuberculosis
gcaucgcugguggccgacgugcc

SEQ ID NO: 842565 - RNA, 18 nt, Mycobacterium avium subsp. paratuberculosis
gcaucggcaguccgcgcc

SEQ ID NO: 842566 - RNA, 20 nt, Mycobacterium avium subsp. paratuberculosis
gcaucggcaguccgcgccgg

SEQ ID NO: 842567 - RNA, 16 nt, Mycobacterium avium subsp. paratuberculosis
gcaucgaauccacgaa

SEQ ID NO: 842568 - RNA, 20 nt, Mycobacterium avium subsp. paratuberculosis
gcaucgacugcgacacccgc

SEQ ID NO: 842569 - RNA, 16 nt, Mycobacterium avium subsp. paratuberculosis
gcaucgagaugcugug

SEQ ID NO: 842570 - RNA, 15 nt, Mycobacterium avium subsp. paratuberculosis
gcaucgaggaccggc

SEQ ID NO: 842571 - RNA, 16 nt, Mycobacterium avium subsp. paratuberculosis
gcaucgaggaucgcca

SEQ ID NO: 842572 - RNA, 20 nt, Mycobacterium avium subsp. paratuberculosis
gcaucgcacagauacgcgac

SEQ ID NO: 842573 - RNA, 13 nt, Mycobacterium avium subsp. paratuberculosis
gcaucgcagcgcg

SEQ ID NO: 842574 - RNA, 16 nt, Mycobacterium avium subsp. paratuberculosis
gcaucgcagcgcgcgg

SEQ ID NO: 842575 - RNA, 18 nt, Mycobacterium avium subsp. paratuberculosis
gcaucgauggcgggcgcg

SEQ ID NO: 842576 - RNA, 21 nt, Mycobacterium avium subsp. paratuberculosis
gcaucgauggcgggcgcgccg

SEQ ID NO: 842577 - RNA, 18 nt, Mycobacterium avium subsp. paratuberculosis
gcaucgagcugcaacgcg

SEQ ID NO: 842578 - RNA, 20 nt, Mycobacterium avium subsp. paratuberculosis
gcauccggcgcacggcgccc

SEQ ID NO: 842579 - RNA, 13 nt, Mycobacterium avium subsp. paratuberculosis
gcauccggcucag

SEQ ID NO: 842580 - RNA, 17 nt, Mycobacterium avium subsp. paratuberculosis
gcauccgggaggccagc

SEQ ID NO: 842581 - RNA, 18 nt, Mycobacterium avium subsp. paratuberculosis
gcauccgggaggccagca

SEQ ID NO: 842582 - RNA, 19 nt, Mycobacterium avium subsp. paratuberculosis
gcauccgggaggccagcac

SEQ ID NO: 842583 - RNA, 20 nt, Mycobacterium avium subsp. paratuberculosis
gcauccgggaggccagcacc

SEQ ID NO: 842584 - RNA, 22 nt, Mycobacterium avium subsp. paratuberculosis
gcauccggccgucgucgggcag

SEQ ID NO: 842585 - RNA, 17 nt, Mycobacterium avium subsp. paratuberculosis
gcauccucauagccggc

SEQ ID NO: 842586 - RNA, 18 nt, Mycobacterium avium subsp. paratuberculosis
gcauccucauagccggcc

SEQ ID NO: 842587 - RNA, 19 nt, Mycobacterium avium subsp. paratuberculosis
gcauccucauagccggccg

SEQ ID NO: 842588 - RNA, 20 nt, Mycobacterium avium subsp. paratuberculosis
gcauccucauagccggccgc

SEQ ID NO: 842589 - RNA, 13 nt, Mycobacterium avium subsp. paratuberculosis
gcauccggugccg

SEQ ID NO: 842590 - RNA, 13 nt, Mycobacterium avium subsp. paratuberculosis
gcauccgucggcc

SEQ ID NO: 842591 - RNA, 14 nt, Mycobacterium avium subsp. paratuberculosis
gcauccgucggccu

SEQ ID NO: 842592 - RNA, 17 nt, Mycobacterium avium subsp. paratuberculosis
gcauccgucggccuugc

SEQ ID NO: 842593 - RNA, 15 nt, Mycobacterium avium subsp. paratuberculosis
gcaucgaaccgccgc

SEQ ID NO: 842594 - RNA, 16 nt, Mycobacterium avium subsp. paratuberculosis
gcaucgaaccgccgcg

SEQ ID NO: 842595 - RNA, 24 nt, Mycobacterium avium subsp. paratuberculosis
gcaucgaaccgccgcgcucgcacc

SEQ ID NO: 842596 - RNA, 14 nt, Mycobacterium avium subsp. paratuberculosis
gcauccucggcgcg

SEQ ID NO: 842597 - RNA, 18 nt, Mycobacterium avium subsp. paratuberculosis
gcauccucggcgcgucgg

SEQ ID NO: 842598 - RNA, 18 nt, Mycobacterium avium subsp. paratuberculosis
gcaucgacaugcccggcg

SEQ ID NO: 842599 - RNA, 19 nt, Mycobacterium avium subsp. paratuberculosis
gcaucgacaugcccggcga

SEQ ID NO: 842600 - RNA, 20 nt, Mycobacterium avium subsp. paratuberculosis
gcaucgacaugcccggcgac

SEQ ID NO: 842601 - RNA, 19 nt, Mycobacterium avium subsp. paratuberculosis
gcauccccagcugggccgc

SEQ ID NO: 842602 - RNA, 21 nt, Mycobacterium avium subsp. paratuberculosis
gcauccccagcugggccgcca

SEQ ID NO: 842603 - RNA, 21 nt, Mycobacterium avium subsp. paratuberculosis
gcauccccuuggugcggucga

SEQ ID NO: 842604 - RNA, 13 nt, Mycobacterium avium subsp. paratuberculosis
gcaucccgccgaa

SEQ ID NO: 842605 - RNA, 14 nt, Mycobacterium avium subsp. paratuberculosis
gcaucccgccgaac

SEQ ID NO: 842606 - RNA, 18 nt, Mycobacterium avium subsp. paratuberculosis
gcaucccgccgaacccgc

SEQ ID NO: 842607 - RNA, 21 nt, Mycobacterium avium subsp. paratuberculosis
gcaucccgcuucuggcgggcg

SEQ ID NO: 842608 - RNA, 13 nt, Mycobacterium avium subsp. paratuberculosis
gcauccagccguc

SEQ ID NO: 842609 - RNA, 16 nt, Mycobacterium avium subsp. paratuberculosis
gcauccagccguccag

SEQ ID NO: 842610 - RNA, 15 nt, Mycobacterium avium subsp. paratuberculosis
gcauccagcgccgcc

SEQ ID NO: 842611 - RNA, 16 nt, Mycobacterium avium subsp. paratuberculosis
gcauccagguggcgcc

SEQ ID NO: 842612 - RNA, 22 nt, Mycobacterium avium subsp. paratuberculosis
gcauccagguggcgccuccgcc

SEQ ID NO: 842613 - RNA, 15 nt, Mycobacterium avium subsp. paratuberculosis
gcauccagucggcgc

SEQ ID NO: 842614 - RNA, 16 nt, Mycobacterium avium subsp. paratuberculosis
gcauccagucggcgcc

SEQ ID NO: 842615 - RNA, 18 nt, Mycobacterium avium subsp. paratuberculosis
gcauccagucggcgccga

SEQ ID NO: 842616 - RNA, 13 nt, Mycobacterium avium subsp. paratuberculosis
gcauccgacaccg

SEQ ID NO: 842617 - RNA, 16 nt, Mycobacterium avium subsp. paratuberculosis
gcauccgcaacgugcg

SEQ ID NO: 842618 - RNA, 22 nt, Mycobacterium avium subsp. paratuberculosis
gcauccgcaacgugcgccggcc

SEQ ID NO: 842619 - RNA, 12 nt, Mycobacterium avium subsp. paratuberculosis
gcauccgcaccg

SEQ ID NO: 842620 - RNA, 20 nt, Mycobacterium avium subsp. paratuberculosis
gcaucccugacacgaccgcc

SEQ ID NO: 842621 - RNA, 16 nt, Mycobacterium avium subsp. paratuberculosis
gcaucccuggugaccg

SEQ ID NO: 842622 - RNA, 17 nt, Mycobacterium avium subsp. paratuberculosis
gcaucccacccggguug

SEQ ID NO: 842623 - RNA, 14 nt, Mycobacterium avium subsp. paratuberculosis
gcaucccgucgacc

SEQ ID NO: 842624 - RNA, 20 nt, Mycobacterium avium subsp. paratuberculosis
gcaucccgucgaccaggacg

SEQ ID NO: 842625 - RNA, 14 nt, Mycobacterium avium subsp. paratuberculosis
gcauccgcagcacc

SEQ ID NO: 842626 - RNA, 18 nt, Mycobacterium avium subsp. paratuberculosis
gcauccgcagcaccaggg

SEQ ID NO: 842627 - RNA, 17 nt, Mycobacterium avium subsp. paratuberculosis
gcauccgccgggcggcg

SEQ ID NO: 842628 - RNA, 16 nt, Mycobacterium avium subsp. paratuberculosis
gcauccgcucgccgcg

SEQ ID NO: 842629 - RNA, 18 nt, Mycobacterium avium subsp. paratuberculosis
gcauccgcucgccgcggg

SEQ ID NO: 842630 - RNA, 20 nt, Mycobacterium avium subsp. paratuberculosis
gcauccgcucgccgcgggug

SEQ ID NO: 842631 - RNA, 13 nt, Mycobacterium avium subsp. paratuberculosis
gcauccgcuggug

SEQ ID NO: 842632 - RNA, 16 nt, Mycobacterium avium subsp. paratuberculosis
gcauccgcuggugcgc

SEQ ID NO: 842633 - RNA, 22 nt, Mycobacterium avium subsp. paratuberculosis
gcauccgcuggugcgcgccggc

SEQ ID NO: 842634 - RNA, 16 nt, Mycobacterium avium subsp. paratuberculosis
gcauccggaaccgggc

SEQ ID NO: 842635 - RNA, 18 nt, Mycobacterium avium subsp. paratuberculosis
gcauccggaaccgggcac

SEQ ID NO: 842636 - RNA, 15 nt, Mycobacterium avium subsp. paratuberculosis
gcaucauugagccgc

SEQ ID NO: 842637 - RNA, 15 nt, Mycobacterium avium subsp. paratuberculosis
gcauccaccagggcg

SEQ ID NO: 842638 - RNA, 15 nt, Mycobacterium avium subsp. paratuberculosis
gcauccagcacggcc

SEQ ID NO: 842639 - RNA, 15 nt, Mycobacterium avium subsp. paratuberculosis
gcaucaucucggcga

SEQ ID NO: 842640 - RNA, 16 nt, Mycobacterium avium subsp. paratuberculosis
gcaucaucucggcgaa

SEQ ID NO: 842641 - RNA, 14 nt, Mycobacterium avium subsp. paratuberculosis
gcaucaugccgccc

SEQ ID NO: 842642 - RNA, 22 nt, Mycobacterium avium subsp. paratuberculosis
gcaucaugucgaagaagcggcc

SEQ ID NO: 842643 - RNA, 14 nt, Mycobacterium avium subsp. paratuberculosis
gcaucagggccagc

SEQ ID NO: 842644 - RNA, 12 nt, Mycobacterium avium subsp. paratuberculosis
gcaucagggcgu

SEQ ID NO: 842645 - RNA, 20 nt, Mycobacterium avium subsp. paratuberculosis
gcaucaucggcacgccgggg

SEQ ID NO: 842646 - RNA, 22 nt, Mycobacterium avium subsp. paratuberculosis
gcaucaucggcacgccggggcc

SEQ ID NO: 842647 - RNA, 16 nt, Mycobacterium avium subsp. paratuberculosis
gcaucaggucggugcc

SEQ ID NO: 842648 - RNA, 18 nt, Mycobacterium avium subsp. paratuberculosis
gcaucaggucggugccgc

SEQ ID NO: 842649 - RNA, 22 nt, Mycobacterium avium subsp. paratuberculosis
gcauacugcuugccgucgacgc

SEQ ID NO: 842650 - RNA, 17 nt, Mycobacterium avium subsp. paratuberculosis
gcauagauaccggccag

SEQ ID NO: 842651 - RNA, 20 nt, Mycobacterium avium subsp. paratuberculosis
gcauagcgggagccggccag

SEQ ID NO: 842652 - RNA, 15 nt, Mycobacterium avium subsp. paratuberculosis
gcauaggccgcgagg

SEQ ID NO: 842653 - RNA, 15 nt, Mycobacterium avium subsp. paratuberculosis
gcauagcuggcgccg

SEQ ID NO: 842654 - RNA, 15 nt, Mycobacterium avium subsp. paratuberculosis
gcauaggccagcacc

SEQ ID NO: 842655 - RNA, 21 nt, Mycobacterium avium subsp. paratuberculosis
gcauaguccagcucgcgaagc

SEQ ID NO: 842656 - RNA, 14 nt, Mycobacterium avium subsp. paratuberculosis
gcauagucggcccg

SEQ ID NO: 842657 - RNA, 14 nt, Mycobacterium avium subsp. paratuberculosis
gcauacagcaggcu

SEQ ID NO: 842658 - RNA, 16 nt, Mycobacterium avium subsp. paratuberculosis
gcauaccagcgcuggu

SEQ ID NO: 842659 - RNA, 17 nt, Mycobacterium avium subsp. paratuberculosis
gcauaccgcccgcgcug

SEQ ID NO: 842660 - RNA, 14 nt, Mycobacterium avium subsp. paratuberculosis
gcaucacccggcgc

SEQ ID NO: 842661 - RNA, 18 nt, Mycobacterium avium subsp. paratuberculosis
gcaucacccggcgcgcgg

SEQ ID NO: 842662 - RNA, 19 nt, Mycobacterium avium subsp. paratuberculosis
gcaucaacugcaccagcgg

SEQ ID NO: 842663 - RNA, 21 nt, Mycobacterium avium subsp. paratuberculosis
gcaucaacugcaccagcggcg

SEQ ID NO: 842664 - RNA, 15 nt, Mycobacterium avium subsp. paratuberculosis
gcaucagcucggcag

SEQ ID NO: 842665 - RNA, 14 nt, Mycobacterium avium subsp. paratuberculosis
gcaucagcugccgu

SEQ ID NO: 842666 - RNA, 23 nt, Mycobacterium avium subsp. paratuberculosis
gcaucagcugccguccggguccg

SEQ ID NO: 842667 - RNA, 22 nt, Mycobacterium avium subsp. paratuberculosis
gcaucagcggagugaccgccag

SEQ ID NO: 842668 - RNA, 23 nt, Mycobacterium avium subsp. paratuberculosis
gcaucagcggagugaccgccagc

SEQ ID NO: 842669 - RNA, 14 nt, Mycobacterium avium subsp. paratuberculosis
gcaucagcggggcg

SEQ ID NO: 842670 - RNA, 14 nt, Mycobacterium avium subsp. paratuberculosis
gcaucagcgugaug

SEQ ID NO: 842671 - RNA, 18 nt, Mycobacterium avium subsp. paratuberculosis
gcaucaccuucugcgcgc

SEQ ID NO: 842672 - RNA, 13 nt, Mycobacterium avium subsp. paratuberculosis
gcaucacgucggc

SEQ ID NO: 842673 - RNA, 15 nt, Mycobacterium avium subsp. paratuberculosis
gcaucacgucggcga

SEQ ID NO: 842674 - RNA, 22 nt, Mycobacterium avium subsp. paratuberculosis
gcaguuuggucauguaccaggc

SEQ ID NO: 842675 - RNA, 22 nt, Mycobacterium avium subsp. paratuberculosis
gcaguugcgcguugcgcggacc

SEQ ID NO: 842676 - RNA, 20 nt, Mycobacterium avium subsp. paratuberculosis
gcaguucgggaucgucgccg

SEQ ID NO: 842677 - RNA, 20 nt, Mycobacterium avium subsp. paratuberculosis
gcaguuccuugcgcagcacc

SEQ ID NO: 842678 - RNA, 13 nt, Mycobacterium avium subsp. paratuberculosis
gcaguucgaccgg

SEQ ID NO: 842679 - RNA, 13 nt, Mycobacterium avium subsp. paratuberculosis
gcaguucgaucac

SEQ ID NO: 842680 - RNA, 13 nt, Mycobacterium avium subsp. paratuberculosis
gcaguucgaugcc

SEQ ID NO: 842681 - RNA, 19 nt, Mycobacterium avium subsp. paratuberculosis
gcaguucgaugcgcucggc

SEQ ID NO: 842682 - RNA, 19 nt, Mycobacterium avium subsp. paratuberculosis
gcagugguugagcagcaga

SEQ ID NO: 842683 - RNA, 15 nt, Mycobacterium avium subsp. paratuberculosis
gcaguuaccggcgua

SEQ ID NO: 842684 - RNA, 16 nt, Mycobacterium avium subsp. paratuberculosis
gcaguguccagucggc

SEQ ID NO: 842685 - RNA, 20 nt, Mycobacterium avium subsp. paratuberculosis
gcaguguccgaucgccuccu

SEQ ID NO: 842686 - RNA, 21 nt, Mycobacterium avium subsp. paratuberculosis
gcagugucggaaucggcgccg

SEQ ID NO: 842687 - RNA, 22 nt, Mycobacterium avium subsp. paratuberculosis
gcagugucggaaucggcgccga

SEQ ID NO: 842688 - RNA, 14 nt, Mycobacterium avium subsp. paratuberculosis
gcagugcgccgucc

SEQ ID NO: 842689 - RNA, 15 nt, Mycobacterium avium subsp. paratuberculosis
gcagugcgcggcguc

SEQ ID NO: 842690 - RNA, 18 nt, Mycobacterium avium subsp. paratuberculosis
gcagugccccguccggcg

SEQ ID NO: 842691 - RNA, 19 nt, Mycobacterium avium subsp. paratuberculosis
gcagugccccguccggcgc

SEQ ID NO: 842692 - RNA, 20 nt, Mycobacterium avium subsp. paratuberculosis
gcagugccccguccggcgcc

SEQ ID NO: 842693 - RNA, 16 nt, Mycobacterium avium subsp. paratuberculosis
gcagugcccgcccagc

SEQ ID NO: 842694 - RNA, 12 nt, Mycobacterium avium subsp. paratuberculosis
gcagugccgcac

SEQ ID NO: 842695 - RNA, 13 nt, Mycobacterium avium subsp. paratuberculosis
gcagugccggcgc

SEQ ID NO: 842696 - RNA, 15 nt, Mycobacterium avium subsp. paratuberculosis
gcagugccggcgcac

SEQ ID NO: 842697 - RNA, 16 nt, Mycobacterium avium subsp. paratuberculosis
gcagugccggcgcacc

SEQ ID NO: 842698 - RNA, 19 nt, Mycobacterium avium subsp. paratuberculosis
gcagugccggcgcaccgcg

SEQ ID NO: 842699 - RNA, 21 nt, Mycobacterium avium subsp. paratuberculosis
gcagugccggcgcaccgcguc

SEQ ID NO: 842700 - RNA, 16 nt, Mycobacterium avium subsp. paratuberculosis
gcagugcacgacgacc

SEQ ID NO: 842701 - RNA, 19 nt, Mycobacterium avium subsp. paratuberculosis
gcagugcacgacgaccgcg

SEQ ID NO: 842702 - RNA, 21 nt, Mycobacterium avium subsp. paratuberculosis
gcagugcacgacgaccgcguc

SEQ ID NO: 842703 - RNA, 13 nt, Mycobacterium avium subsp. paratuberculosis
gcagugaucggcg

SEQ ID NO: 842704 - RNA, 17 nt, Mycobacterium avium subsp. paratuberculosis
gcagugccaacacggcg

SEQ ID NO: 842705 - RNA, 19 nt, Mycobacterium avium subsp. paratuberculosis
gcagugccaacacggcggc

SEQ ID NO: 842706 - RNA, 17 nt, Mycobacterium avium subsp. paratuberculosis
gcagugccaccaccacg

SEQ ID NO: 842707 - RNA, 18 nt, Mycobacterium avium subsp. paratuberculosis
gcagugccaccaccacgg

SEQ ID NO: 842708 - RNA, 22 nt, Mycobacterium avium subsp. paratuberculosis
gcagugccaccaccacggccag

SEQ ID NO: 842709 - RNA, 17 nt, Mycobacterium avium subsp. paratuberculosis
gcagugagggaacgccg

SEQ ID NO: 842710 - RNA, 20 nt, Mycobacterium avium subsp. paratuberculosis
gcagugagggaacgccgauc

SEQ ID NO: 842711 - RNA, 14 nt, Mycobacterium avium subsp. paratuberculosis
gcagcgcgacaccg

SEQ ID NO: 842712 - RNA, 15 nt, Mycobacterium avium subsp. paratuberculosis
gcagcgcgaccagcc

SEQ ID NO: 842713 - RNA, 19 nt, Mycobacterium avium subsp. paratuberculosis
gcagcgcgaccagcccggc

SEQ ID NO: 842714 - RNA, 18 nt, Mycobacterium avium subsp. paratuberculosis
gcagcgccuugccgacga

SEQ ID NO: 842715 - RNA, 22 nt, Mycobacterium avium subsp. paratuberculosis
gcagcgccuugccgacgacguc

SEQ ID NO: 842716 - RNA, 15 nt, Mycobacterium avium subsp. paratuberculosis
gcagcgccucgccgg

SEQ ID NO: 842717 - RNA, 20 nt, Mycobacterium avium subsp. paratuberculosis
gcagcgccucgccgggcccg

SEQ ID NO: 842718 - RNA, 16 nt, Mycobacterium avium subsp. paratuberculosis
gcagcgcccagccgag

SEQ ID NO: 842719 - RNA, 20 nt, Mycobacterium avium subsp. paratuberculosis
gcagcgcccagccgagccgg

SEQ ID NO: 842720 - RNA, 21 nt, Mycobacterium avium subsp. paratuberculosis
gcagcgccucccggaccacca

SEQ ID NO: 842721 - RNA, 21 nt, Mycobacterium avium subsp. paratuberculosis
gcagcgccucggcgaucggcc

SEQ ID NO: 842722 - RNA, 22 nt, Mycobacterium avium subsp. paratuberculosis
gcagcgccucggcgaucggccg

SEQ ID NO: 842723 - RNA, 16 nt, Mycobacterium avium subsp. paratuberculosis
gcagcgccucggcggg

SEQ ID NO: 842724 - RNA, 21 nt, Mycobacterium avium subsp. paratuberculosis
gcagcgccucggcgggccgcc

SEQ ID NO: 842725 - RNA, 17 nt, Mycobacterium avium subsp. paratuberculosis
gcagcgccucggcgugg

SEQ ID NO: 842726 - RNA, 21 nt, Mycobacterium avium subsp. paratuberculosis
gcagcgccucggcguggcagg

SEQ ID NO: 842727 - RNA, 17 nt, Mycobacterium avium subsp. paratuberculosis
gcauguuggugaucagc

SEQ ID NO: 842728 - RNA, 13 nt, Mycobacterium avium subsp. paratuberculosis
gcauuagcgcgug

SEQ ID NO: 842729 - RNA, 16 nt, Mycobacterium avium subsp. paratuberculosis
gcauucaggucaccgc

SEQ ID NO: 842730 - RNA, 14 nt, Mycobacterium avium subsp. paratuberculosis
gcauuccaccgcgc

SEQ ID NO: 842731 - RNA, 16 nt, Mycobacterium avium subsp. paratuberculosis
gcauuccaccgcgcgg

SEQ ID NO: 842732 - RNA, 17 nt, Mycobacterium avium subsp. paratuberculosis
gcauuccaccgcgcggc

SEQ ID NO: 842733 - RNA, 21 nt, Mycobacterium avium subsp. paratuberculosis
gcauguucaaucccguugcgg

SEQ ID NO: 842734 - RNA, 22 nt, Mycobacterium avium subsp. paratuberculosis
gcauguaggacaccccggcgau

SEQ ID NO: 842735 - RNA, 15 nt, Mycobacterium avium subsp. paratuberculosis
gcaugucgaccucgg

SEQ ID NO: 842736 - RNA, 22 nt, Mycobacterium avium subsp. paratuberculosis
gcaugucgaccucggccaccac

SEQ ID NO: 842737 - RNA, 17 nt, Mycobacterium avium subsp. paratuberculosis
gcaugucgcccgcgucg

SEQ ID NO: 842738 - RNA, 18 nt, Mycobacterium avium subsp. paratuberculosis
gcaugucgcccgcgucgu

SEQ ID NO: 842739 - RNA, 19 nt, Mycobacterium avium subsp. paratuberculosis
gcaugucgcccgcgucgug

SEQ ID NO: 842740 - RNA, 22 nt, Mycobacterium avium subsp. paratuberculosis
gcaugucgcccgcgucguggcc

SEQ ID NO: 842741 - RNA, 15 nt, Mycobacterium avium subsp. paratuberculosis
gcaugucgccgaacg

SEQ ID NO: 842742 - RNA, 21 nt, Mycobacterium avium subsp. paratuberculosis
gcauguccggggugagcaggg

SEQ ID NO: 842743 - RNA, 23 nt, Mycobacterium avium subsp. paratuberculosis
gcauggugcggguguccgagcgg

SEQ ID NO: 842744 - RNA, 19 nt, Mycobacterium avium subsp. paratuberculosis
gcauggugaagcccagcgc

SEQ ID NO: 842745 - RNA, 17 nt, Mycobacterium avium subsp. paratuberculosis
gcauggucagguaggcg

SEQ ID NO: 842746 - RNA, 21 nt, Mycobacterium avium subsp. paratuberculosis
gcauggucagguaggcgucga

SEQ ID NO: 842747 - RNA, 20 nt, Mycobacterium avium subsp. paratuberculosis
gcaugggcggcaagccgagu

SEQ ID NO: 842748 - RNA, 21 nt, Mycobacterium avium subsp. paratuberculosis
gcaugggcggcaagccgaguu

SEQ ID NO: 842749 - RNA, 14 nt, Mycobacterium avium subsp. paratuberculosis
gcaugggcgugccg

SEQ ID NO: 842750 - RNA, 19 nt, Mycobacterium avium subsp. paratuberculosis
gcaugggcgugccggcccg

SEQ ID NO: 842751 - RNA, 17 nt, Mycobacterium avium subsp. paratuberculosis
gcauggcgaugacgucg

SEQ ID NO: 842752 - RNA, 20 nt, Mycobacterium avium subsp. paratuberculosis
gcauggcgaucaccccggcg

SEQ ID NO: 842753 - RNA, 23 nt, Mycobacterium avium subsp. paratuberculosis
gcauggcgaugaccagcgcgaac

SEQ ID NO: 842754 - RNA, 18 nt, Mycobacterium avium subsp. paratuberculosis
gcauggacccgaagucga

SEQ ID NO: 842755 - RNA, 21 nt, Mycobacterium avium subsp. paratuberculosis
gcauggacccgaagucgacgc

SEQ ID NO: 842756 - RNA, 17 nt, Mycobacterium avium subsp. paratuberculosis
gcauggacacgcccugg

SEQ ID NO: 842757 - RNA, 13 nt, Mycobacterium avium subsp. paratuberculosis
gcaugcguccggu

SEQ ID NO: 842758 - RNA, 12 nt, Mycobacterium avium subsp. paratuberculosis
gcaugcaccggu

SEQ ID NO: 842759 - RNA, 15 nt, Mycobacterium avium subsp. paratuberculosis
gcaugcaccggugca

SEQ ID NO: 842760 - RNA, 19 nt, Mycobacterium avium subsp. paratuberculosis
gcaugcccacgccgucgac

SEQ ID NO: 842761 - RNA, 20 nt, Mycobacterium avium subsp. paratuberculosis
gcaugccggaacaccucgaa

SEQ ID NO: 842762 - RNA, 19 nt, Mycobacterium avium subsp. paratuberculosis
gcaugcccguagaugccgg

SEQ ID NO: 842763 - RNA, 16 nt, Mycobacterium avium subsp. paratuberculosis
gcaugcgccagagcgc

SEQ ID NO: 842764 - RNA, 18 nt, Mycobacterium avium subsp. paratuberculosis
gcaugcgccagagcgcga

SEQ ID NO: 842765 - RNA, 13 nt, Mycobacterium avium subsp. paratuberculosis
gcaugccgucggc

SEQ ID NO: 842766 - RNA, 14 nt, Mycobacterium avium subsp. paratuberculosis
gcaugccgucggcg

SEQ ID NO: 842767 - RNA, 19 nt, Mycobacterium avium subsp. paratuberculosis
gcaugccguucagcgcggc

SEQ ID NO: 842768 - RNA, 12 nt, Mycobacterium avium subsp. paratuberculosis
gcaugccggccg

SEQ ID NO: 842769 - RNA, 14 nt, Mycobacterium avium subsp. paratuberculosis
gcaugccgggcagg

SEQ ID NO: 842770 - RNA, 14 nt, Mycobacterium avium subsp. paratuberculosis
gcaugccgggccag

SEQ ID NO: 842771 - RNA, 19 nt, Mycobacterium avium subsp. paratuberculosis
gcaugccgggccagccggc

SEQ ID NO: 842772 - RNA, 13 nt, Mycobacterium avium subsp. paratuberculosis
gcaugccggccgg

SEQ ID NO: 842773 - RNA, 18 nt, Mycobacterium avium subsp. paratuberculosis
gcaugccggccggcacga

SEQ ID NO: 842774 - RNA, 21 nt, Mycobacterium avium subsp. paratuberculosis
gcaugccggccuucucgcgca

SEQ ID NO: 842775 - RNA, 19 nt, Mycobacterium avium subsp. paratuberculosis
gcaugccggugucggugcg

SEQ ID NO: 842776 - RNA, 20 nt, Mycobacterium avium subsp. paratuberculosis
gcaucugguauucgauggug

SEQ ID NO: 842777 - RNA, 13 nt, Mycobacterium avium subsp. paratuberculosis
gcaucugcucggc

SEQ ID NO: 842778 - RNA, 22 nt, Mycobacterium avium subsp. paratuberculosis
gcaucugcucggcguccagcaa

SEQ ID NO: 842779 - RNA, 18 nt, Mycobacterium avium subsp. paratuberculosis
gcaugaaccaggccgcgc

SEQ ID NO: 842780 - RNA, 24 nt, Mycobacterium avium subsp. paratuberculosis
gcaugaaccaggccgcgcuggcgc

SEQ ID NO: 842781 - RNA, 17 nt, Mycobacterium avium subsp. paratuberculosis
gcaugaagaucagcacc

SEQ ID NO: 842782 - RNA, 20 nt, Mycobacterium avium subsp. paratuberculosis
gcaugaagaucagcaccguc

SEQ ID NO: 842783 - RNA, 14 nt, Mycobacterium avium subsp. paratuberculosis
gcaugaccggccag

SEQ ID NO: 842784 - RNA, 16 nt, Mycobacterium avium subsp. paratuberculosis
gcaugaucaccgccag

SEQ ID NO: 842785 - RNA, 20 nt, Mycobacterium avium subsp. paratuberculosis
gcaugaucaccgccagcgcg

SEQ ID NO: 842786 - RNA, 21 nt, Mycobacterium avium subsp. paratuberculosis
gcaugacggccugcaccacca

SEQ ID NO: 842787 - RNA, 13 nt, Mycobacterium avium subsp. paratuberculosis
gccaaucaccgcg

SEQ ID NO: 842788 - RNA, 18 nt, Mycobacterium avium subsp. paratuberculosis
gccaaggcaagucgucgg

SEQ ID NO: 842789 - RNA, 20 nt, Mycobacterium avium subsp. paratuberculosis
gccaaggcaagucgucggug

SEQ ID NO: 842790 - RNA, 13 nt, Mycobacterium avium subsp. paratuberculosis
gccaaggccagca

SEQ ID NO: 842791 - RNA, 16 nt, Mycobacterium avium subsp. paratuberculosis
gccaaggccagcaacc

SEQ ID NO: 842792 - RNA, 18 nt, Mycobacterium avium subsp. paratuberculosis
gccaaggccagcaaccgc

SEQ ID NO: 842793 - RNA, 22 nt, Mycobacterium avium subsp. paratuberculosis
gccaagcgguuccagaccggcg

SEQ ID NO: 842794 - RNA, 23 nt, Mycobacterium avium subsp. paratuberculosis
gccaagcgguuccagaccggcgg

SEQ ID NO: 842795 - RNA, 18 nt, Mycobacterium avium subsp. paratuberculosis
gccaagcguauccggcca

SEQ ID NO: 842796 - RNA, 22 nt, Mycobacterium avium subsp. paratuberculosis
gccaagcguauccggccagccg

SEQ ID NO: 842797 - RNA, 23 nt, Mycobacterium avium subsp. paratuberculosis
gccaaugaaauucaggccacgca

SEQ ID NO: 842798 - RNA, 22 nt, Mycobacterium avium subsp. paratuberculosis
gccacaacgucucugucgucga

SEQ ID NO: 842799 - RNA, 15 nt, Mycobacterium avium subsp. paratuberculosis
gccacaacuggucgu

SEQ ID NO: 842800 - RNA, 18 nt, Mycobacterium avium subsp. paratuberculosis
gccacaacuggucgugcu

SEQ ID NO: 842801 - RNA, 21 nt, Mycobacterium avium subsp. paratuberculosis
gccacaacuggucgugcucgu

SEQ ID NO: 842802 - RNA, 13 nt, Mycobacterium avium subsp. paratuberculosis
gccacaccgccgg

SEQ ID NO: 842803 - RNA, 16 nt, Mycobacterium avium subsp. paratuberculosis
gccacaccggggccag

SEQ ID NO: 842804 - RNA, 16 nt, Mycobacterium avium subsp. paratuberculosis
gccacacccgucgacu

SEQ ID NO: 842805 - RNA, 20 nt, Mycobacterium avium subsp. paratuberculosis
gccacacccgucgacucggc

SEQ ID NO: 842806 - RNA, 12 nt, Mycobacterium avium subsp. paratuberculosis
gccacaccgccg

SEQ ID NO: 842807 - RNA, 22 nt, Mycobacterium avium subsp. paratuberculosis
gccacacacugcugcgcagacc

SEQ ID NO: 842808 - RNA, 16 nt, Mycobacterium avium subsp. paratuberculosis
gccaacgguucggccg

SEQ ID NO: 842809 - RNA, 23 nt, Mycobacterium avium subsp. paratuberculosis
gccaacgguucggccgcucgggu

SEQ ID NO: 842810 - RNA, 20 nt, Mycobacterium avium subsp. paratuberculosis
gccaacgguuuccaccacca

SEQ ID NO: 842811 - RNA, 23 nt, Mycobacterium avium subsp. paratuberculosis
gccaacgguuuccaccaccaccc

SEQ ID NO: 842812 - RNA, 14 nt, Mycobacterium avium subsp. paratuberculosis
gccaacgccucguc

SEQ ID NO: 842813 - RNA, 21 nt, Mycobacterium avium subsp. paratuberculosis
gccaacgccucgucgaccgcg

SEQ ID NO: 842814 - RNA, 12 nt, Mycobacterium avium subsp. paratuberculosis
gccaacgcgacg

SEQ ID NO: 842815 - RNA, 22 nt, Mycobacterium avium subsp. paratuberculosis
gccaacggauucagcgucgcca

SEQ ID NO: 842816 - RNA, 17 nt, Mycobacterium avium subsp. paratuberculosis
gccaacgggaagagcgg

SEQ ID NO: 842817 - RNA, 17 nt, Mycobacterium avium subsp. paratuberculosis
gccaacgagcgcgccga

SEQ ID NO: 842818 - RNA, 13 nt, Mycobacterium avium subsp. paratuberculosis
gccaacccgggcg

SEQ ID NO: 842819 - RNA, 21 nt, Mycobacterium avium subsp. paratuberculosis
gccaacccgggcgccauccgc

SEQ ID NO: 842820 - RNA, 16 nt, Mycobacterium avium subsp. paratuberculosis
gccaaccgcccggcgc

SEQ ID NO: 842821 - RNA, 20 nt, Mycobacterium avium subsp. paratuberculosis
gccaaccgcccggcgccgau

SEQ ID NO: 842822 - RNA, 13 nt, Mycobacterium avium subsp. paratuberculosis
gccaaccgccggg

SEQ ID NO: 842823 - RNA, 17 nt, Mycobacterium avium subsp. paratuberculosis
gccaaccgccggggaag

SEQ ID NO: 842824 - RNA, 21 nt, Mycobacterium avium subsp. paratuberculosis
gcauugcccaucgccacgccg

SEQ ID NO: 842825 - RNA, 14 nt, Mycobacterium avium subsp. paratuberculosis
gcauucggcgacgc

SEQ ID NO: 842826 - RNA, 17 nt, Mycobacterium avium subsp. paratuberculosis
gcauuuccagguccggg

SEQ ID NO: 842827 - RNA, 13 nt, Mycobacterium avium subsp. paratuberculosis
gcauuggcgaugg

SEQ ID NO: 842828 - RNA, 14 nt, Mycobacterium avium subsp. paratuberculosis
gcauuugcccuccu

SEQ ID NO: 842829 - RNA, 15 nt, Mycobacterium avium subsp. paratuberculosis
gcauuugccgacaug

SEQ ID NO: 842830 - RNA, 16 nt, Mycobacterium avium subsp. paratuberculosis
gcauuucgcgcacguc

SEQ ID NO: 842831 - RNA, 21 nt, Mycobacterium avium subsp. paratuberculosis
gcauuucggacggcgacggca

SEQ ID NO: 842832 - RNA, 14 nt, Mycobacterium avium subsp. paratuberculosis
gcauuucggcgucc

SEQ ID NO: 842833 - RNA, 17 nt, Mycobacterium avium subsp. paratuberculosis
gccaaagccuacggcgc

SEQ ID NO: 842834 - RNA, 20 nt, Mycobacterium avium subsp. paratuberculosis
gccaaagccuacggcgccgg

SEQ ID NO: 842835 - RNA, 21 nt, Mycobacterium avium subsp. paratuberculosis
gccaaagccuacggcgccggu

SEQ ID NO: 842836 - RNA, 19 nt, Mycobacterium avium subsp. paratuberculosis
gccaaaguuggcaucccgc

SEQ ID NO: 842837 - RNA, 17 nt, Mycobacterium avium subsp. paratuberculosis
gccaaaucgcuugcgcc

SEQ ID NO: 842838 - RNA, 19 nt, Mycobacterium avium subsp. paratuberculosis
gccaaaucgcuugcgccgc

SEQ ID NO: 842839 - RNA, 16 nt, Mycobacterium avium subsp. paratuberculosis
gccaacagugcgcagg

SEQ ID NO: 842840 - RNA, 22 nt, Mycobacterium avium subsp. paratuberculosis
gccaaccaggucgcggcgcugc

SEQ ID NO: 842841 - RNA, 18 nt, Mycobacterium avium subsp. paratuberculosis
gccaacagcagcgccgcg

SEQ ID NO: 842842 - RNA, 20 nt, Mycobacterium avium subsp. paratuberculosis
gccaacagcagcgccgcggc

SEQ ID NO: 842843 - RNA, 24 nt, Mycobacterium avium subsp. paratuberculosis
gccaacagcagcgccgcggccggu

SEQ ID NO: 842844 - RNA, 16 nt, Mycobacterium avium subsp. paratuberculosis
gccaacacggcggcgc

SEQ ID NO: 842845 - RNA, 15 nt, Mycobacterium avium subsp. paratuberculosis
gcggcggugccggug

SEQ ID NO: 842846 - RNA, 14 nt, Mycobacterium avium subsp. paratuberculosis
gcggcggugcgcag

SEQ ID NO: 842847 - RNA, 19 nt, Mycobacterium avium subsp. paratuberculosis
gcggcggugcgcagccgcu

SEQ ID NO: 842848 - RNA, 18 nt, Mycobacterium avium subsp. paratuberculosis
aagcuaguuucacgcucg

SEQ ID NO: 842849 - RNA, 22 nt, Mycobacterium avium subsp. paratuberculosis
aagcuaguuucacgcucggcgg

SEQ ID NO: 842850 - RNA, 14 nt, Mycobacterium avium subsp. paratuberculosis
aagcucgcgucgac

SEQ ID NO: 842851 - RNA, 20 nt, Mycobacterium avium subsp. paratuberculosis
gcggcgguuuuggucggcac

SEQ ID NO: 842852 - RNA, 14 nt, Mycobacterium avium subsp. paratuberculosis
gcggcguccgcggc

SEQ ID NO: 842853 - RNA, 19 nt, Mycobacterium avium subsp. paratuberculosis
gcggcguccgcggccgcgg

SEQ ID NO: 842854 - RNA, 21 nt, Mycobacterium avium subsp. paratuberculosis
gcggcguccgcggccgcggcg

SEQ ID NO: 842855 - RNA, 15 nt, Mycobacterium avium subsp. paratuberculosis
gcggcguccucgacc

SEQ ID NO: 842856 - RNA, 18 nt, Mycobacterium avium subsp. paratuberculosis
gcggcguccucgaccacc

SEQ ID NO: 842857 - RNA, 19 nt, Mycobacterium avium subsp. paratuberculosis
gcggcguccucgaccaccc

SEQ ID NO: 842858 - RNA, 20 nt, Mycobacterium avium subsp. paratuberculosis
gcggcguccucgaccacccg

SEQ ID NO: 842859 - RNA, 12 nt, Mycobacterium avium subsp. paratuberculosis
aagcugccguug

SEQ ID NO: 842860 - RNA, 14 nt, Mycobacterium avium subsp. paratuberculosis
aagcugcgcagccg

SEQ ID NO: 842861 - RNA, 13 nt, Mycobacterium avium subsp. paratuberculosis
aagcugccgacca

SEQ ID NO: 842862 - RNA, 15 nt, Mycobacterium avium subsp. paratuberculosis
gcggcguuggccgcc

SEQ ID NO: 842863 - RNA, 22 nt, Mycobacterium avium subsp. paratuberculosis
gcggcgucgaugucgcccggcg

SEQ ID NO: 842864 - RNA, 14 nt, Mycobacterium avium subsp. paratuberculosis
gcggcgucggcgac

SEQ ID NO: 842865 - RNA, 18 nt, Mycobacterium avium subsp. paratuberculosis
gcggcgucggcgacggcg

SEQ ID NO: 842866 - RNA, 18 nt, Mycobacterium avium subsp. paratuberculosis
gcggcgucgggauggucg

SEQ ID NO: 842867 - RNA, 17 nt, Mycobacterium avium subsp. paratuberculosis
gcggcgucgggcgggug

SEQ ID NO: 842868 - RNA, 18 nt, Mycobacterium avium subsp. paratuberculosis
gcggcgucguaguugcgg

SEQ ID NO: 842869 - RNA, 14 nt, Mycobacterium avium subsp. paratuberculosis
gcggcgucgucgcc

SEQ ID NO: 842870 - RNA, 15 nt, Mycobacterium avium subsp. paratuberculosis
gcggcgucgucgccg

SEQ ID NO: 842871 - RNA, 12 nt, Mycobacterium avium subsp. paratuberculosis
gcggcgucggcc

SEQ ID NO: 842872 - RNA, 13 nt, Mycobacterium avium subsp. paratuberculosis
gcggcgucggccg

SEQ ID NO: 842873 - RNA, 14 nt, Mycobacterium avium subsp. paratuberculosis
gcggcgucggccgg

SEQ ID NO: 842874 - RNA, 15 nt, Mycobacterium avium subsp. paratuberculosis
gcggcgucggccggg

SEQ ID NO: 842875 - RNA, 16 nt, Mycobacterium avium subsp. paratuberculosis
gcggcgucggccgggc

SEQ ID NO: 842876 - RNA, 13 nt, Mycobacterium avium subsp. paratuberculosis
gcggcgucggccu

SEQ ID NO: 842877 - RNA, 15 nt, Mycobacterium avium subsp. paratuberculosis
gcggcgucggccugc

SEQ ID NO: 842878 - RNA, 16 nt, Mycobacterium avium subsp. paratuberculosis
gcggcgucggccugcc

SEQ ID NO: 842879 - RNA, 22 nt, Mycobacterium avium subsp. paratuberculosis
gcggcgucgaccgccccgccgg

SEQ ID NO: 842880 - RNA, 13 nt, Mycobacterium avium subsp. paratuberculosis
gcggcgucgagca

SEQ ID NO: 842881 - RNA, 14 nt, Mycobacterium avium subsp. paratuberculosis
gcggcggugccgca

SEQ ID NO: 842882 - RNA, 15 nt, Mycobacterium avium subsp. paratuberculosis
gcggcggugccgcag

SEQ ID NO: 842883 - RNA, 17 nt, Mycobacterium avium subsp. paratuberculosis
gcggcggugaucgccgg

SEQ ID NO: 842884 - RNA, 19 nt, Mycobacterium avium subsp. paratuberculosis
gcggcggugaucucgucgg

SEQ ID NO: 842885 - RNA, 21 nt, Mycobacterium avium subsp. paratuberculosis
gcggcggugaucucgucggcg

SEQ ID NO: 842886 - RNA, 22 nt, Mycobacterium avium subsp. paratuberculosis
gcggcggugaucucgucggcgg

SEQ ID NO: 842887 - RNA, 23 nt, Mycobacterium avium subsp. paratuberculosis
gcggcggugaucucgucggcggc

SEQ ID NO: 842888 - RNA, 20 nt, Mycobacterium avium subsp. paratuberculosis
gcggcggugagcgcgucgag

SEQ ID NO: 842889 - RNA, 21 nt, Mycobacterium avium subsp. paratuberculosis
gcggcggugaccggaucggcc

SEQ ID NO: 842890 - RNA, 21 nt, Mycobacterium avium subsp. paratuberculosis
gcggcggugacgaacccgccg

SEQ ID NO: 842891 - RNA, 22 nt, Mycobacterium avium subsp. paratuberculosis
gcggcggugacgaacccgccgc

SEQ ID NO: 842892 - RNA, 18 nt, Mycobacterium avium subsp. paratuberculosis
gcggcggucacgcccggg

SEQ ID NO: 842893 - RNA, 17 nt, Mycobacterium avium subsp. paratuberculosis
gcggcgguccgcccgga

SEQ ID NO: 842894 - RNA, 18 nt, Mycobacterium avium subsp. paratuberculosis
gcggcgguccgcccggac

SEQ ID NO: 842895 - RNA, 13 nt, Mycobacterium avium subsp. paratuberculosis
gcggcggucgcgc

SEQ ID NO: 842896 - RNA, 18 nt, Mycobacterium avium subsp. paratuberculosis
gcggcggucgcgcgccgg

SEQ ID NO: 842897 - RNA, 13 nt, Mycobacterium avium subsp. paratuberculosis
gcggcggucggca

SEQ ID NO: 842898 - RNA, 14 nt, Mycobacterium avium subsp. paratuberculosis
gcggcggucggcau

SEQ ID NO: 842899 - RNA, 17 nt, Mycobacterium avium subsp. paratuberculosis
gcggcggucggcauagc

SEQ ID NO: 842900 - RNA, 22 nt, Mycobacterium avium subsp. paratuberculosis
gcggcggucggcauagcgccgc

SEQ ID NO: 842901 - RNA, 14 nt, Mycobacterium avium subsp. paratuberculosis
gcggcggucggcgc

SEQ ID NO: 842902 - RNA, 15 nt, Mycobacterium avium subsp. paratuberculosis
gcggcggucggcgcc

SEQ ID NO: 842903 - RNA, 17 nt, Mycobacterium avium subsp. paratuberculosis
gcggcggucggcgccga

SEQ ID NO: 842904 - RNA, 23 nt, Mycobacterium avium subsp. paratuberculosis
gcggcggucagguucgccacgau

SEQ ID NO: 842905 - RNA, 19 nt, Mycobacterium avium subsp. paratuberculosis
gcggcgggcccgcagcucg

SEQ ID NO: 842906 - RNA, 16 nt, Mycobacterium avium subsp. paratuberculosis
gcggcgggcccggcga

SEQ ID NO: 842907 - RNA, 20 nt, Mycobacterium avium subsp. paratuberculosis
gcggcgggcccggcgaugcg

SEQ ID NO: 842908 - RNA, 15 nt, Mycobacterium avium subsp. paratuberculosis
gcggcgggccgcaau

SEQ ID NO: 842909 - RNA, 20 nt, Mycobacterium avium subsp. paratuberculosis
gcggcgguauucgucacccc

SEQ ID NO: 842910 - RNA, 22 nt, Mycobacterium avium subsp. paratuberculosis
gcggcgguauucgucaccccac

SEQ ID NO: 842911 - RNA, 14 nt, Mycobacterium avium subsp. paratuberculosis
gcggcgggccagcu

SEQ ID NO: 842912 - RNA, 21 nt, Mycobacterium avium subsp. paratuberculosis
gcggcgggccagcucgucgag

SEQ ID NO: 842913 - RNA, 17 nt, Mycobacterium avium subsp. paratuberculosis
gcggcgggccagggcga

SEQ ID NO: 842914 - RNA, 13 nt, Mycobacterium avium subsp. paratuberculosis
gcggcgggccagu

SEQ ID NO: 842915 - RNA, 13 nt, Mycobacterium avium subsp. paratuberculosis
gcggcgggcccag

SEQ ID NO: 842916 - RNA, 14 nt, Mycobacterium avium subsp. paratuberculosis
gcggcgggcccagc

SEQ ID NO: 842917 - RNA, 15 nt, Mycobacterium avium subsp. paratuberculosis
gcggcgggcccagca

SEQ ID NO: 842918 - RNA, 16 nt, Mycobacterium avium subsp. paratuberculosis
gcggcgggcccagcag

SEQ ID NO: 842919 - RNA, 20 nt, Mycobacterium avium subsp. paratuberculosis
gcggcgggagcuaggcggcc

SEQ ID NO: 842920 - RNA, 22 nt, Mycobacterium avium subsp. paratuberculosis
gcggcgggaaaccaccugccgc

SEQ ID NO: 842921 - RNA, 16 nt, Mycobacterium avium subsp. paratuberculosis
gcggcggcgucggcgu

SEQ ID NO: 842922 - RNA, 15 nt, Mycobacterium avium subsp. paratuberculosis
gcggcggcucggcgg

SEQ ID NO: 842923 - RNA, 15 nt, Mycobacterium avium subsp. paratuberculosis
gcggcggcucgucca

SEQ ID NO: 842924 - RNA, 13 nt, Mycobacterium avium subsp. paratuberculosis
gcggcggcugccu

SEQ ID NO: 842925 - RNA, 18 nt, Mycobacterium avium subsp. paratuberculosis
gcggcggcugccucgacg

SEQ ID NO: 842926 - RNA, 19 nt, Mycobacterium avium subsp. paratuberculosis
gcggcggcugccucgacga

SEQ ID NO: 842927 - RNA, 15 nt, Mycobacterium avium subsp. paratuberculosis
gcggcggcugggccg

SEQ ID NO: 842928 - RNA, 21 nt, Mycobacterium avium subsp. paratuberculosis
gcggcggcugggccgcggcgc

SEQ ID NO: 842929 - RNA, 16 nt, Mycobacterium avium subsp. paratuberculosis
gcggcggcguuggccg

SEQ ID NO: 842930 - RNA, 15 nt, Mycobacterium avium subsp. paratuberculosis
gcggcggcgggccag

SEQ ID NO: 842931 - RNA, 13 nt, Mycobacterium avium subsp. paratuberculosis
gcggcggcggucc

SEQ ID NO: 842932 - RNA, 15 nt, Mycobacterium avium subsp. paratuberculosis
gcggcggcggucggc

SEQ ID NO: 842933 - RNA, 12 nt, Mycobacterium avium subsp. paratuberculosis
gcggcggcggug

SEQ ID NO: 842934 - RNA, 13 nt, Mycobacterium avium subsp. paratuberculosis
gcggcggcggugc

SEQ ID NO: 842935 - RNA, 15 nt, Mycobacterium avium subsp. paratuberculosis
gcggcggcggugccu

SEQ ID NO: 842936 - RNA, 19 nt, Mycobacterium avium subsp. paratuberculosis
gcggcggcguccgcggccg

SEQ ID NO: 842937 - RNA, 12 nt, Mycobacterium avium subsp. paratuberculosis
gcggcggcgucg

SEQ ID NO: 842938 - RNA, 17 nt, Mycobacterium avium subsp. paratuberculosis
gcggcggcgucgaccgc

SEQ ID NO: 842939 - RNA, 15 nt, Mycobacterium avium subsp. paratuberculosis
gcggcggccgcgucg

SEQ ID NO: 842940 - RNA, 19 nt, Mycobacterium avium subsp. paratuberculosis
gcggcggccgcgucgccga

SEQ ID NO: 842941 - RNA, 12 nt, Mycobacterium avium subsp. paratuberculosis
gcggcggccggc

SEQ ID NO: 842942 - RNA, 14 nt, Mycobacterium avium subsp. paratuberculosis
gcggcggccggcca

SEQ ID NO: 842943 - RNA, 17 nt, Mycobacterium avium subsp. paratuberculosis
gcggcggccggccagca

SEQ ID NO: 842944 - RNA, 14 nt, Mycobacterium avium subsp. paratuberculosis
gcggcggccggcgc

SEQ ID NO: 842945 - RNA, 19 nt, Mycobacterium avium subsp. paratuberculosis
gcggcggccugcaccucgg

SEQ ID NO: 842946 - RNA, 22 nt, Mycobacterium avium subsp. paratuberculosis
gcggcggccugcaccucgggau

SEQ ID NO: 842947 - RNA, 16 nt, Mycobacterium avium subsp. paratuberculosis
gcggcggccugcgcgu

SEQ ID NO: 842948 - RNA, 20 nt, Mycobacterium avium subsp. paratuberculosis
gcggcggcccuucucggacg

SEQ ID NO: 842949 - RNA, 16 nt, Mycobacterium avium subsp. paratuberculosis
gcggcggccgacgcgc

SEQ ID NO: 842950 - RNA, 18 nt, Mycobacterium avium subsp. paratuberculosis
gcggcggaaucgcaacca

SEQ ID NO: 842951 - RNA, 14 nt, Mycobacterium avium subsp. paratuberculosis
gcggcggccagcuc

SEQ ID NO: 842952 - RNA, 21 nt, Mycobacterium avium subsp. paratuberculosis
gcggcggccagcucggcccgc

SEQ ID NO: 842953 - RNA, 15 nt, Mycobacterium avium subsp. paratuberculosis
gcggcggcccgccgc

SEQ ID NO: 842954 - RNA, 22 nt, Mycobacterium avium subsp. paratuberculosis
gcggcggcccgccgcgcccggc

SEQ ID NO: 842955 - RNA, 13 nt, Mycobacterium avium subsp. paratuberculosis
gcggcggcccgcg

SEQ ID NO: 842956 - RNA, 14 nt, Mycobacterium avium subsp. paratuberculosis
gcggcggcccgcgc

SEQ ID NO: 842957 - RNA, 14 nt, Mycobacterium avium subsp. paratuberculosis
gcggcggcccggcg

SEQ ID NO: 842958 - RNA, 15 nt, Mycobacterium avium subsp. paratuberculosis
gcggcggcccggcgu

SEQ ID NO: 842959 - RNA, 16 nt, Mycobacterium avium subsp. paratuberculosis
gcggcggcccggcguc

SEQ ID NO: 842960 - RNA, 14 nt, Mycobacterium avium subsp. paratuberculosis
gcggcggcccgucg

SEQ ID NO: 842961 - RNA, 20 nt, Mycobacterium avium subsp. paratuberculosis
gcggcggcccgucgccacca

SEQ ID NO: 842962 - RNA, 13 nt, Mycobacterium avium subsp. paratuberculosis
gcggcggaccguc

SEQ ID NO: 842963 - RNA, 16 nt, Mycobacterium avium subsp. paratuberculosis
gcggcggaccgucggu

SEQ ID NO: 842964 - RNA, 17 nt, Mycobacterium avium subsp. paratuberculosis
gcggcggaccgucggug

SEQ ID NO: 842965 - RNA, 16 nt, Mycobacterium avium subsp. paratuberculosis
gcggcggccaccucgc

SEQ ID NO: 842966 - RNA, 18 nt, Mycobacterium avium subsp. paratuberculosis
gcggcggccaccucgccg

SEQ ID NO: 842967 - RNA, 20 nt, Mycobacterium avium subsp. paratuberculosis
gcggcggccaccucgccgca

SEQ ID NO: 842968 - RNA, 21 nt, Mycobacterium avium subsp. paratuberculosis
gcggcggccaccucgccgcag

SEQ ID NO: 842969 - RNA, 19 nt, Mycobacterium avium subsp. paratuberculosis
gcggcggccaccucggcgg

SEQ ID NO: 842970 - RNA, 14 nt, Mycobacterium avium subsp. paratuberculosis
gcggcgcaccgagu

SEQ ID NO: 842971 - RNA, 20 nt, Mycobacterium avium subsp. paratuberculosis
gcggcgcaccgagucgguga

SEQ ID NO: 842972 - RNA, 18 nt, Mycobacterium avium subsp. paratuberculosis
gcggcgcaccccguccag

SEQ ID NO: 842973 - RNA, 13 nt, Mycobacterium avium subsp. paratuberculosis
gcggcgcacccgg

SEQ ID NO: 842974 - RNA, 21 nt, Mycobacterium avium subsp. paratuberculosis
gcggcgcacccgggcagcuuc

SEQ ID NO: 842975 - RNA, 16 nt, Mycobacterium avium subsp. paratuberculosis
gcggcgcagaugaccg

SEQ ID NO: 842976 - RNA, 23 nt, Mycobacterium avium subsp. paratuberculosis
gcggcgcagaugaccggccugca

SEQ ID NO: 842977 - RNA, 12 nt, Mycobacterium avium subsp. paratuberculosis
gcggcgcagcac

SEQ ID NO: 842978 - RNA, 22 nt, Mycobacterium avium subsp. paratuberculosis
gcggcgcaccgugucgucgcug

SEQ ID NO: 842979 - RNA, 23 nt, Mycobacterium avium subsp. paratuberculosis
gcggcgcaccgugucgucgcuga

SEQ ID NO: 842980 - RNA, 13 nt, Mycobacterium avium subsp. paratuberculosis
gcggcgcaccugg

SEQ ID NO: 842981 - RNA, 20 nt, Mycobacterium avium subsp. paratuberculosis
gcggcgcaccuggcgcagca

SEQ ID NO: 842982 - RNA, 15 nt, Mycobacterium avium subsp. paratuberculosis
gcggcgcagucggcc

SEQ ID NO: 842983 - RNA, 16 nt, Mycobacterium avium subsp. paratuberculosis
gcggcgcagucggccg

SEQ ID NO: 842984 - RNA, 17 nt, Mycobacterium avium subsp. paratuberculosis
gcggcgcagucggccgg

SEQ ID NO: 842985 - RNA, 20 nt, Mycobacterium avium subsp. paratuberculosis
gcggcgcaguucgaccggca

SEQ ID NO: 842986 - RNA, 20 nt, Mycobacterium avium subsp. paratuberculosis
gcggcgcagggcggccggcc

SEQ ID NO: 842987 - RNA, 22 nt, Mycobacterium avium subsp. paratuberculosis
gcggcgcagggcggccggccag

SEQ ID NO: 842988 - RNA, 16 nt, Mycobacterium avium subsp. paratuberculosis
gcggcgcagguccggc

SEQ ID NO: 842989 - RNA, 17 nt, Mycobacterium avium subsp. paratuberculosis
gcggcgcagguccggca

SEQ ID NO: 842990 - RNA, 18 nt, Mycobacterium avium subsp. paratuberculosis
gcggcgcagguccggcag

SEQ ID NO: 842991 - RNA, 21 nt, Mycobacterium avium subsp. paratuberculosis
gcggcgcagguccggcagcgc

SEQ ID NO: 842992 - RNA, 13 nt, Mycobacterium avium subsp. paratuberculosis
gcggcgcaggccg

SEQ ID NO: 842993 - RNA, 17 nt, Mycobacterium avium subsp. paratuberculosis
gcggcgcaggccgguca

SEQ ID NO: 842994 - RNA, 16 nt, Mycobacterium avium subsp. paratuberculosis
gcggcgcaggcgcgca

SEQ ID NO: 842995 - RNA, 14 nt, Mycobacterium avium subsp. paratuberculosis
gcggcgcagccagc

SEQ ID NO: 842996 - RNA, 16 nt, Mycobacterium avium subsp. paratuberculosis
gcggcgcagccagcuc

SEQ ID NO: 842997 - RNA, 18 nt, Mycobacterium avium subsp. paratuberculosis
gcggcgcagcacggccac

SEQ ID NO: 842998 - RNA, 21 nt, Mycobacterium avium subsp. paratuberculosis
gcggcgcagcacggccacugc

SEQ ID NO: 842999 - RNA, 15 nt, Mycobacterium avium subsp. paratuberculosis
gcggcgcagcgucuc

SEQ ID NO: 843000 - RNA, 19 nt, Mycobacterium avium subsp. paratuberculosis
gcggcgcagcgucucgauc

SEQ ID NO: 843001 - RNA, 20 nt, Mycobacterium avium subsp. paratuberculosis
gcggcgcagcgucucgaucg

SEQ ID NO: 843002 - RNA, 19 nt, Mycobacterium avium subsp. paratuberculosis
gcggcgcagcucgcgcagc

SEQ ID NO: 843003 - RNA, 22 nt, Mycobacterium avium subsp. paratuberculosis
gcggcgcagcucgcgcagcugg

SEQ ID NO: 843004 - RNA, 17 nt, Mycobacterium avium subsp. paratuberculosis
gcggcgcgaggcgcggg

SEQ ID NO: 843005 - RNA, 13 nt, Mycobacterium avium subsp. paratuberculosis
gcggcgccgcccg

SEQ ID NO: 843006 - RNA, 18 nt, Mycobacterium avium subsp. paratuberculosis
gcggcgccgggaucggca

SEQ ID NO: 843007 - RNA, 14 nt, Mycobacterium avium subsp. paratuberculosis
gcggcgccgggcgg

SEQ ID NO: 843008 - RNA, 16 nt, Mycobacterium avium subsp. paratuberculosis
gcggcgccggccgggc

SEQ ID NO: 843009 - RNA, 13 nt, Mycobacterium avium subsp. paratuberculosis
gcggcgccggccg

SEQ ID NO: 843010 - RNA, 18 nt, Mycobacterium avium subsp. paratuberculosis
gcggcgccgcggcccugc

SEQ ID NO: 843011 - RNA, 15 nt, Mycobacterium avium subsp. paratuberculosis
gcggcgccgcggcgg

SEQ ID NO: 843012 - RNA, 13 nt, Mycobacterium avium subsp. paratuberculosis
gcggcgccggaug

SEQ ID NO: 843013 - RNA, 11 nt, Mycobacterium avium subsp. paratuberculosis
gcggcgccggc

SEQ ID NO: 843014 - RNA, 14 nt, Mycobacterium avium subsp. paratuberculosis
gcggcgccgccacg

SEQ ID NO: 843015 - RNA, 16 nt, Mycobacterium avium subsp. paratuberculosis
gcggcgccgccacggc

SEQ ID NO: 843016 - RNA, 22 nt, Mycobacterium avium subsp. paratuberculosis
gcggcgccgccacggcacgucg

SEQ ID NO: 843017 - RNA, 15 nt, Mycobacterium avium subsp. paratuberculosis
gcggcgccgacgucc

SEQ ID NO: 843018 - RNA, 15 nt, Mycobacterium avium subsp. paratuberculosis
gcggcgccgcagcuc

SEQ ID NO: 843019 - RNA, 13 nt, Mycobacterium avium subsp. paratuberculosis
gcggcgccgccac

SEQ ID NO: 843020 - RNA, 14 nt, Mycobacterium avium subsp. paratuberculosis
gcggcgcagcgcga

SEQ ID NO: 843021 - RNA, 23 nt, Mycobacterium avium subsp. paratuberculosis
gcggcgcaugaccgauccgccgg

SEQ ID NO: 843022 - RNA, 14 nt, Mycobacterium avium subsp. paratuberculosis
gcggcgccgaaccg

SEQ ID NO: 843023 - RNA, 14 nt, Mycobacterium avium subsp. paratuberculosis
gcggcgccgaacuc

SEQ ID NO: 843024 - RNA, 12 nt, Mycobacterium avium subsp. paratuberculosis
gcggcgccgaug

SEQ ID NO: 843025 - RNA, 13 nt, Mycobacterium avium subsp. paratuberculosis
gcggcgccgaugg

SEQ ID NO: 843026 - RNA, 15 nt, Mycobacterium avium subsp. paratuberculosis
gcggcgccgauggcg

SEQ ID NO: 843027 - RNA, 18 nt, Mycobacterium avium subsp. paratuberculosis
gcggcgcccucgccggcg

SEQ ID NO: 843028 - RNA, 20 nt, Mycobacterium avium subsp. paratuberculosis
gcggcgcccucgccggcggc

SEQ ID NO: 843029 - RNA, 21 nt, Mycobacterium avium subsp. paratuberculosis
gcggcgcccucgccggcggcg

SEQ ID NO: 843030 - RNA, 21 nt, Mycobacterium avium subsp. paratuberculosis
gcggcgcccuucccggucggc

SEQ ID NO: 843031 - RNA, 23 nt, Mycobacterium avium subsp. paratuberculosis
gcggcgccgaaaaacgcgacggc

SEQ ID NO: 843032 - RNA, 19 nt, Mycobacterium avium subsp. paratuberculosis
gcggcgcggagccggccgc

SEQ ID NO: 843033 - RNA, 21 nt, Mycobacterium avium subsp. paratuberculosis
gcggcgcggagccggccgccg

SEQ ID NO: 843034 - RNA, 14 nt, Mycobacterium avium subsp. paratuberculosis
gcggcgcggccacc

SEQ ID NO: 843035 - RNA, 17 nt, Mycobacterium avium subsp. paratuberculosis
gcggcgcggccaccccg

SEQ ID NO: 843036 - RNA, 18 nt, Mycobacterium avium subsp. paratuberculosis
gcggcgcggccaccccgg

SEQ ID NO: 843037 - RNA, 14 nt, Mycobacterium avium subsp. paratuberculosis
gcggcgcggcccgg

SEQ ID NO: 843038 - RNA, 15 nt, Mycobacterium avium subsp. paratuberculosis
gcggcgcggcccggc

SEQ ID NO: 843039 - RNA, 22 nt, Mycobacterium avium subsp. paratuberculosis
aagcguugcgcguucaagccgc

SEQ ID NO: 843040 - RNA, 20 nt, Mycobacterium avium subsp. paratuberculosis
gcggcgcggccgauucggcg

SEQ ID NO: 843041 - RNA, 14 nt, Mycobacterium avium subsp. paratuberculosis
gcggcgcggacccc

SEQ ID NO: 843042 - RNA, 16 nt, Mycobacterium avium subsp. paratuberculosis
gcggcgcgcucgucgu

SEQ ID NO: 843043 - RNA, 19 nt, Mycobacterium avium subsp. paratuberculosis
gcggcgcgcucgucgucgg

SEQ ID NO: 843044 - RNA, 14 nt, Mycobacterium avium subsp. paratuberculosis
gcggcgcgcgccag

SEQ ID NO: 843045 - RNA, 13 nt, Mycobacterium avium subsp. paratuberculosis
gcggcgcgcgccg

SEQ ID NO: 843046 - RNA, 15 nt, Mycobacterium avium subsp. paratuberculosis
gcggcgcgcgccgca

SEQ ID NO: 843047 - RNA, 16 nt, Mycobacterium avium subsp. paratuberculosis
gcggcgcgcgccgcag

SEQ ID NO: 843048 - RNA, 14 nt, Mycobacterium avium subsp. paratuberculosis
gcggcgcgcggccg

SEQ ID NO: 843049 - RNA, 16 nt, Mycobacterium avium subsp. paratuberculosis
gcggcgcgcggccgcg

SEQ ID NO: 843050 - RNA, 19 nt, Mycobacterium avium subsp. paratuberculosis
gcggcgcgcggccgcgacu

SEQ ID NO: 843051 - RNA, 13 nt, Mycobacterium avium subsp. paratuberculosis
gcggcgcgcgcca

SEQ ID NO: 843052 - RNA, 16 nt, Mycobacterium avium subsp. paratuberculosis
gcggcgcgccggccgg

SEQ ID NO: 843053 - RNA, 13 nt, Mycobacterium avium subsp. paratuberculosis
gcggcgcgccggg

SEQ ID NO: 843054 - RNA, 21 nt, Mycobacterium avium subsp. paratuberculosis
gcggcgcgaucgucgaccacc

SEQ ID NO: 843055 - RNA, 21 nt, Mycobacterium avium subsp. paratuberculosis
gcggcgcgaugaucgccggcg

SEQ ID NO: 843056 - RNA, 23 nt, Mycobacterium avium subsp. paratuberculosis
gcggcgcgaugaucgccggcgcc

SEQ ID NO: 843057 - RNA, 13 nt, Mycobacterium avium subsp. paratuberculosis
gcggcgcgaugcu

SEQ ID NO: 843058 - RNA, 23 nt, Mycobacterium avium subsp. paratuberculosis
gcggcgcgaugcuauucgggcca

SEQ ID NO: 843059 - RNA, 18 nt, Mycobacterium avium subsp. paratuberculosis
gcggcgcgcagccggccg

SEQ ID NO: 843060 - RNA, 12 nt, Mycobacterium avium subsp. paratuberculosis
gcggcgcgcagg

SEQ ID NO: 843061 - RNA, 15 nt, Mycobacterium avium subsp. paratuberculosis
gcggcgcgcaucgcc

SEQ ID NO: 843062 - RNA, 22 nt, Mycobacterium avium subsp. paratuberculosis
gcggcgcgcaucgccguccacg

SEQ ID NO: 843063 - RNA, 15 nt, Mycobacterium avium subsp. paratuberculosis
gcggcgcgcaucguc

SEQ ID NO: 843064 - RNA, 17 nt, Mycobacterium avium subsp. paratuberculosis
gcggcgcgcaucgucgc

SEQ ID NO: 843065 - RNA, 18 nt, Mycobacterium avium subsp. paratuberculosis
gcggcgcgcaucgucgcg

SEQ ID NO: 843066 - RNA, 20 nt, Mycobacterium avium subsp. paratuberculosis
gcggcgcgcaucgucgcggc

SEQ ID NO: 843067 - RNA, 13 nt, Mycobacterium avium subsp. paratuberculosis
gcggcggacagca

SEQ ID NO: 843068 - RNA, 15 nt, Mycobacterium avium subsp. paratuberculosis
gcggcggacagcacg

SEQ ID NO: 843069 - RNA, 13 nt, Mycobacterium avium subsp. paratuberculosis
gcggcggaacucg

SEQ ID NO: 843070 - RNA, 15 nt, Mycobacterium avium subsp. paratuberculosis
gcggcgcuggucggc

SEQ ID NO: 843071 - RNA, 16 nt, Mycobacterium avium subsp. paratuberculosis
gcggcgcuggucggcg

SEQ ID NO: 843072 - RNA, 15 nt, Mycobacterium avium subsp. paratuberculosis
gcggcgcuugaccuc

SEQ ID NO: 843073 - RNA, 17 nt, Mycobacterium avium subsp. paratuberculosis
gcggcgcuugaccucgc

SEQ ID NO: 843074 - RNA, 19 nt, Mycobacterium avium subsp. paratuberculosis
gcggcgcuugaccucgccg

SEQ ID NO: 843075 - RNA, 20 nt, Mycobacterium avium subsp. paratuberculosis
gcggcgcuugaccucgccga

SEQ ID NO: 843076 - RNA, 22 nt, Mycobacterium avium subsp. paratuberculosis
gcggcgcuugaccucgccgagc

SEQ ID NO: 843077 - RNA, 23 nt, Mycobacterium avium subsp. paratuberculosis
gcggcgcuugacgaacgccacca

SEQ ID NO: 843078 - RNA, 16 nt, Mycobacterium avium subsp. paratuberculosis
gcggcgcgggcggcgu

SEQ ID NO: 843079 - RNA, 16 nt, Mycobacterium avium subsp. paratuberculosis
gcggcgcgggucgcgg

SEQ ID NO: 843080 - RNA, 20 nt, Mycobacterium avium subsp. paratuberculosis
gcggcgcggucgcaggccgc

SEQ ID NO: 843081 - RNA, 16 nt, Mycobacterium avium subsp. paratuberculosis
gcggcgcggugcgccg

SEQ ID NO: 843082 - RNA, 19 nt, Mycobacterium avium subsp. paratuberculosis
gcggcgcggugcgccgaca

SEQ ID NO: 843083 - RNA, 13 nt, Mycobacterium avium subsp. paratuberculosis
gcggcgcgguuga

SEQ ID NO: 843084 - RNA, 17 nt, Mycobacterium avium subsp. paratuberculosis
gcggcgcgguugaccgc

SEQ ID NO: 843085 - RNA, 22 nt, Mycobacterium avium subsp. paratuberculosis
gcggcgcgguugaccgccgaca

SEQ ID NO: 843086 - RNA, 14 nt, Mycobacterium avium subsp. paratuberculosis
gcggcgcggcggug

SEQ ID NO: 843087 - RNA, 14 nt, Mycobacterium avium subsp. paratuberculosis
gcggcgcggcgcag

SEQ ID NO: 843088 - RNA, 17 nt, Mycobacterium avium subsp. paratuberculosis
gcggcgaugaccgccug

SEQ ID NO: 843089 - RNA, 16 nt, Mycobacterium avium subsp. paratuberculosis
gcggcgaugaccggac

SEQ ID NO: 843090 - RNA, 21 nt, Mycobacterium avium subsp. paratuberculosis
gcggcgaugaucacgaaguug

SEQ ID NO: 843091 - RNA, 18 nt, Mycobacterium avium subsp. paratuberculosis
gcggcgaugauccgcggc

SEQ ID NO: 843092 - RNA, 20 nt, Mycobacterium avium subsp. paratuberculosis
gcggcgaugauccgcggcgc

SEQ ID NO: 843093 - RNA, 21 nt, Mycobacterium avium subsp. paratuberculosis
gcggcgaugauccgcggcgcc

SEQ ID NO: 843094 - RNA, 22 nt, Mycobacterium avium subsp. paratuberculosis
gcggcgaugauccgcggcgccg

SEQ ID NO: 843095 - RNA, 18 nt, Mycobacterium avium subsp. paratuberculosis
gcggcgauggacguccag

SEQ ID NO: 843096 - RNA, 15 nt, Mycobacterium avium subsp. paratuberculosis
gcggcgauggcccgc

SEQ ID NO: 843097 - RNA, 22 nt, Mycobacterium avium subsp. paratuberculosis
gcggcgauggugggcagccggc

SEQ ID NO: 843098 - RNA, 14 nt, Mycobacterium avium subsp. paratuberculosis
gcggcgaugucguc

SEQ ID NO: 843099 - RNA, 19 nt, Mycobacterium avium subsp. paratuberculosis
gcggcgaugucgucgacgc

SEQ ID NO: 843100 - RNA, 21 nt, Mycobacterium avium subsp. paratuberculosis
gcggcgaugucgucgacgcug

SEQ ID NO: 843101 - RNA, 15 nt, Mycobacterium avium subsp. paratuberculosis
gcggcgaugaucggg

SEQ ID NO: 843102 - RNA, 17 nt, Mycobacterium avium subsp. paratuberculosis
gcggcgaugaucgggau

SEQ ID NO: 843103 - RNA, 19 nt, Mycobacterium avium subsp. paratuberculosis
gcggcgaugaagccccgga

SEQ ID NO: 843104 - RNA, 20 nt, Mycobacterium avium subsp. paratuberculosis
gcggcgaugaagccccggac

SEQ ID NO: 843105 - RNA, 13 nt, Mycobacterium avium subsp. paratuberculosis
gcggcgaugaccg

SEQ ID NO: 843106 - RNA, 19 nt, Mycobacterium avium subsp. paratuberculosis
gcggcgaugcgcuccagca

SEQ ID NO: 843107 - RNA, 18 nt, Mycobacterium avium subsp. paratuberculosis
gcggcgaucuugucccgc

SEQ ID NO: 843108 - RNA, 19 nt, Mycobacterium avium subsp. paratuberculosis
gcggcgaucuuugcggccg

SEQ ID NO: 843109 - RNA, 16 nt, Mycobacterium avium subsp. paratuberculosis
gcggcgaucucggcgg

SEQ ID NO: 843110 - RNA, 21 nt, Mycobacterium avium subsp. paratuberculosis
gcggcgaucucggcggccgcg

SEQ ID NO: 843111 - RNA, 22 nt, Mycobacterium avium subsp. paratuberculosis
gcggcgaucucggcggccgcgu

SEQ ID NO: 843112 - RNA, 13 nt, Mycobacterium avium subsp. paratuberculosis
gcggcgaucggcg

SEQ ID NO: 843113 - RNA, 14 nt, Mycobacterium avium subsp. paratuberculosis
gcggcgaucggcgc

SEQ ID NO: 843114 - RNA, 15 nt, Mycobacterium avium subsp. paratuberculosis
gcggcgaucggcgcg

SEQ ID NO: 843115 - RNA, 16 nt, Mycobacterium avium subsp. paratuberculosis
gcggcgaucggcgcgg

SEQ ID NO: 843116 - RNA, 17 nt, Mycobacterium avium subsp. paratuberculosis
gcggcgaucggcgcggc

SEQ ID NO: 843117 - RNA, 15 nt, Mycobacterium avium subsp. paratuberculosis
gcggcgaucggcggu

SEQ ID NO: 843118 - RNA, 12 nt, Mycobacterium avium subsp. paratuberculosis
gcggcgaucggg

SEQ ID NO: 843119 - RNA, 21 nt, Mycobacterium avium subsp. paratuberculosis
gcggcgaucgggucaccggcc

SEQ ID NO: 843120 - RNA, 18 nt, Mycobacterium avium subsp. paratuberculosis
gcggcgaucucgaucgug

SEQ ID NO: 843121 - RNA, 13 nt, Mycobacterium avium subsp. paratuberculosis
gcggcgauccggc

SEQ ID NO: 843122 - RNA, 14 nt, Mycobacterium avium subsp. paratuberculosis
gcggcgauccggcc

SEQ ID NO: 843123 - RNA, 15 nt, Mycobacterium avium subsp. paratuberculosis
gcggcgauccggccg

SEQ ID NO: 843124 - RNA, 15 nt, Mycobacterium avium subsp. paratuberculosis
gcggcgaucagcccg

SEQ ID NO: 843125 - RNA, 17 nt, Mycobacterium avium subsp. paratuberculosis
gcggcgaucagcccggc

SEQ ID NO: 843126 - RNA, 20 nt, Mycobacterium avium subsp. paratuberculosis
gcggcgaucagcccggcccg

SEQ ID NO: 843127 - RNA, 17 nt, Mycobacterium avium subsp. paratuberculosis
gcggcgaucagcugcuc

SEQ ID NO: 843128 - RNA, 18 nt, Mycobacterium avium subsp. paratuberculosis
gcggcgaucagcugcucg

SEQ ID NO: 843129 - RNA, 14 nt, Mycobacterium avium subsp. paratuberculosis
gcggcgaucgccgc

SEQ ID NO: 843130 - RNA, 15 nt, Mycobacterium avium subsp. paratuberculosis
gcggcgaucgcgagc

SEQ ID NO: 843131 - RNA, 16 nt, Mycobacterium avium subsp. paratuberculosis
gcggcgaucgcgagca

SEQ ID NO: 843132 - RNA, 11 nt, Mycobacterium avium subsp. paratuberculosis
gcggcgaucag

SEQ ID NO: 843133 - RNA, 12 nt, Mycobacterium avium subsp. paratuberculosis
gcggcgaucagc

SEQ ID NO: 843134 - RNA, 16 nt, Mycobacterium avium subsp. paratuberculosis
gcggcgaucaccgccg

SEQ ID NO: 843135 - RNA, 17 nt, Mycobacterium avium subsp. paratuberculosis
gcggcgaucaccgccgc

SEQ ID NO: 843136 - RNA, 19 nt, Mycobacterium avium subsp. paratuberculosis
gcggcgaucaccgccgcgg

SEQ ID NO: 843137 - RNA, 19 nt, Mycobacterium avium subsp. paratuberculosis
gcggcgaggacgucgucga

SEQ ID NO: 843138 - RNA, 21 nt, Mycobacterium avium subsp. paratuberculosis
gcggcgaggacgucgucgacg

SEQ ID NO: 843139 - RNA, 16 nt, Mycobacterium avium subsp. paratuberculosis
gcggcgagucccggcg

SEQ ID NO: 843140 - RNA, 19 nt, Mycobacterium avium subsp. paratuberculosis
gcggcgagucccggcgcac

SEQ ID NO: 843141 - RNA, 22 nt, Mycobacterium avium subsp. paratuberculosis
gcggcgagucccggcgcaccag

SEQ ID NO: 843142 - RNA, 14 nt, Mycobacterium avium subsp. paratuberculosis
gcggcgaguccggc

SEQ ID NO: 843143 - RNA, 16 nt, Mycobacterium avium subsp. paratuberculosis
gcggcgaguccggcca

SEQ ID NO: 843144 - RNA, 17 nt, Mycobacterium avium subsp. paratuberculosis
gcggcgaguccggccag

SEQ ID NO: 843145 - RNA, 19 nt, Mycobacterium avium subsp. paratuberculosis
gcggcgaguccggccaggu

SEQ ID NO: 843146 - RNA, 14 nt, Mycobacterium avium subsp. paratuberculosis
gcggcgaguucggc

SEQ ID NO: 843147 - RNA, 15 nt, Mycobacterium avium subsp. paratuberculosis
gcggcgaguucggcg

SEQ ID NO: 843148 - RNA, 16 nt, Mycobacterium avium subsp. paratuberculosis
gcggcgaguucggcgg

SEQ ID NO: 843149 - RNA, 19 nt, Mycobacterium avium subsp. paratuberculosis
gcggcgaguucggcggccc

SEQ ID NO: 843150 - RNA, 20 nt, Mycobacterium avium subsp. paratuberculosis
gcggcgaguucggcggcccg

SEQ ID NO: 843151 - RNA, 23 nt, Mycobacterium avium subsp. paratuberculosis
gcggcgaguucugguaggcggcc

SEQ ID NO: 843152 - RNA, 18 nt, Mycobacterium avium subsp. paratuberculosis
gcggcgagcugaucggcg

SEQ ID NO: 843153 - RNA, 21 nt, Mycobacterium avium subsp. paratuberculosis
gcggcgagcugaucggcguug

SEQ ID NO: 843154 - RNA, 15 nt, Mycobacterium avium subsp. paratuberculosis
gcggcgagccggccg

SEQ ID NO: 843155 - RNA, 20 nt, Mycobacterium avium subsp. paratuberculosis
gcggcgagauuggccucggc

SEQ ID NO: 843156 - RNA, 22 nt, Mycobacterium avium subsp. paratuberculosis
gcggcgagauuggccucggcgc

SEQ ID NO: 843157 - RNA, 15 nt, Mycobacterium avium subsp. paratuberculosis
gcggcgagcagcgcg

SEQ ID NO: 843158 - RNA, 16 nt, Mycobacterium avium subsp. paratuberculosis
gcggcgagcagcgcga

SEQ ID NO: 843159 - RNA, 17 nt, Mycobacterium avium subsp. paratuberculosis
gcggcgagcagcgcgau

SEQ ID NO: 843160 - RNA, 21 nt, Mycobacterium avium subsp. paratuberculosis
gcggcgagcagcgcgaugccg

SEQ ID NO: 843161 - RNA, 15 nt, Mycobacterium avium subsp. paratuberculosis
gcggcgaccgcgacg

SEQ ID NO: 843162 - RNA, 22 nt, Mycobacterium avium subsp. paratuberculosis
gcggcgacuccagcagcgccag

SEQ ID NO: 843163 - RNA, 23 nt, Mycobacterium avium subsp. paratuberculosis
gcggcgacuccagcagcgccagc

SEQ ID NO: 843164 - RNA, 21 nt, Mycobacterium avium subsp. paratuberculosis
gcggcgacccgcuucgcccgg

SEQ ID NO: 843165 - RNA, 22 nt, Mycobacterium avium subsp. paratuberculosis
gcggcgacccgcuucgcccggc

SEQ ID NO: 843166 - RNA, 18 nt, Mycobacterium avium subsp. paratuberculosis
gcggcgaccggggcggug

SEQ ID NO: 843167 - RNA, 19 nt, Mycobacterium avium subsp. paratuberculosis
gcggcgaccggggcgguga

SEQ ID NO: 843168 - RNA, 12 nt, Mycobacterium avium subsp. paratuberculosis
gcggcgacccgc

SEQ ID NO: 843169 - RNA, 21 nt, Mycobacterium avium subsp. paratuberculosis
gcggcgaccaccaccgcccac

SEQ ID NO: 843170 - RNA, 18 nt, Mycobacterium avium subsp. paratuberculosis
gcggcgaccaccucggcg

SEQ ID NO: 843171 - RNA, 19 nt, Mycobacterium avium subsp. paratuberculosis
gcggcgaccaccucggcga

SEQ ID NO: 843172 - RNA, 21 nt, Mycobacterium avium subsp. paratuberculosis
gcggcgaccaccucggcgacg

SEQ ID NO: 843173 - RNA, 13 nt, Mycobacterium avium subsp. paratuberculosis
gcggcgaccacga

SEQ ID NO: 843174 - RNA, 14 nt, Mycobacterium avium subsp. paratuberculosis
gcggcgaccacgaa

SEQ ID NO: 843175 - RNA, 20 nt, Mycobacterium avium subsp. paratuberculosis
gcggcgacaucgccgagacg

SEQ ID NO: 843176 - RNA, 18 nt, Mycobacterium avium subsp. paratuberculosis
gcggcgacauuggccgcg

SEQ ID NO: 843177 - RNA, 20 nt, Mycobacterium avium subsp. paratuberculosis
gcggcgacauuggccgcgcg

SEQ ID NO: 843178 - RNA, 22 nt, Mycobacterium avium subsp. paratuberculosis
gcggcgacauuggccgcgcgca

SEQ ID NO: 843179 - RNA, 20 nt, Mycobacterium avium subsp. paratuberculosis
gcggcgacacccagcggcgc

SEQ ID NO: 843180 - RNA, 22 nt, Mycobacterium avium subsp. paratuberculosis
gcggcgacacccagcggcgcgg

SEQ ID NO: 843181 - RNA, 18 nt, Mycobacterium avium subsp. paratuberculosis
gcggcgacacgccgacga

SEQ ID NO: 843182 - RNA, 23 nt, Mycobacterium avium subsp. paratuberculosis
gcggcgacacgccgacgauccgc

SEQ ID NO: 843183 - RNA, 21 nt, Mycobacterium avium subsp. paratuberculosis
gcggcgaagacgucggcgcgg

SEQ ID NO: 843184 - RNA, 15 nt, Mycobacterium avium subsp. paratuberculosis
gcggcgaaguugcgg

SEQ ID NO: 843185 - RNA, 24 nt, Mycobacterium avium subsp. paratuberculosis
gcggcgaauaccagggcgaggaac

SEQ ID NO: 843186 - RNA, 18 nt, Mycobacterium avium subsp. paratuberculosis
gcggcgaauccgagcauc

SEQ ID NO: 843187 - RNA, 17 nt, Mycobacterium avium subsp. paratuberculosis
gcggcgaaugccugacg

SEQ ID NO: 843188 - RNA, 15 nt, Mycobacterium avium subsp. paratuberculosis
gcggcgaaggccagc

SEQ ID NO: 843189 - RNA, 12 nt, Mycobacterium avium subsp. paratuberculosis
gcggccugcacc

SEQ ID NO: 843190 - RNA, 22 nt, Mycobacterium avium subsp. paratuberculosis
gcggccugcacccaggucaugg

SEQ ID NO: 843191 - RNA, 14 nt, Mycobacterium avium subsp. paratuberculosis
gcggccugcaccuc

SEQ ID NO: 843192 - RNA, 13 nt, Mycobacterium avium subsp. paratuberculosis
gcggccugcagca

SEQ ID NO: 843193 - RNA, 14 nt, Mycobacterium avium subsp. paratuberculosis
gcggccugcagcac

SEQ ID NO: 843194 - RNA, 15 nt, Mycobacterium avium subsp. paratuberculosis
gcggccugccggccg

SEQ ID NO: 843195 - RNA, 18 nt, Mycobacterium avium subsp. paratuberculosis
gcggccugccggccgccg

SEQ ID NO: 843196 - RNA, 13 nt, Mycobacterium avium subsp. paratuberculosis
gcggccucggcgu

SEQ ID NO: 843197 - RNA, 22 nt, Mycobacterium avium subsp. paratuberculosis
gcggccucggcguccgcggcgg

SEQ ID NO: 843198 - RNA, 16 nt, Mycobacterium avium subsp. paratuberculosis
gcggccucgguggucg

SEQ ID NO: 843199 - RNA, 21 nt, Mycobacterium avium subsp. paratuberculosis
gcggccucgccgucgaaggcc

SEQ ID NO: 843200 - RNA, 15 nt, Mycobacterium avium subsp. paratuberculosis
gcggccucggcaccg

SEQ ID NO: 843201 - RNA, 20 nt, Mycobacterium avium subsp. paratuberculosis
gcggccucggcaccgugccg

SEQ ID NO: 843202 - RNA, 21 nt, Mycobacterium avium subsp. paratuberculosis
gcggccucggcaccgugccgc

SEQ ID NO: 843203 - RNA, 15 nt, Mycobacterium avium subsp. paratuberculosis
gcggccucguugacc

SEQ ID NO: 843204 - RNA, 23 nt, Mycobacterium avium subsp. paratuberculosis
gcggccucucagcgcugucgcgg

SEQ ID NO: 843205 - RNA, 18 nt, Mycobacterium avium subsp. paratuberculosis
gcggccugagccgccggg

SEQ ID NO: 843206 - RNA, 14 nt, Mycobacterium avium subsp. paratuberculosis
gcggcgaacgccgc

SEQ ID NO: 843207 - RNA, 16 nt, Mycobacterium avium subsp. paratuberculosis
gcggcgaacgccgccg

SEQ ID NO: 843208 - RNA, 17 nt, Mycobacterium avium subsp. paratuberculosis
gcggcgaacgccgccgu

SEQ ID NO: 843209 - RNA, 14 nt, Mycobacterium avium subsp. paratuberculosis
gcggcgaacgcgcg

SEQ ID NO: 843210 - RNA, 16 nt, Mycobacterium avium subsp. paratuberculosis
gcggcgaacgcgcggu

SEQ ID NO: 843211 - RNA, 23 nt, Mycobacterium avium subsp. paratuberculosis
gcggcgaacgcgcggucgucgcc

SEQ ID NO: 843212 - RNA, 13 nt, Mycobacterium avium subsp. paratuberculosis
gcggcgaacgcgu

SEQ ID NO: 843213 - RNA, 18 nt, Mycobacterium avium subsp. paratuberculosis
gcggcgaacgcgucccgg

SEQ ID NO: 843214 - RNA, 19 nt, Mycobacterium avium subsp. paratuberculosis
gcggcgaacgcgucccggg

SEQ ID NO: 843215 - RNA, 14 nt, Mycobacterium avium subsp. paratuberculosis
gcggcgaagccggc

SEQ ID NO: 843216 - RNA, 19 nt, Mycobacterium avium subsp. paratuberculosis
gcggcgaagccggccccgc

SEQ ID NO: 843217 - RNA, 18 nt, Mycobacterium avium subsp. paratuberculosis
gcggcgaacaccucggcg

SEQ ID NO: 843218 - RNA, 19 nt, Mycobacterium avium subsp. paratuberculosis
gcggcgaacaccucggcga

SEQ ID NO: 843219 - RNA, 13 nt, Mycobacterium avium subsp. paratuberculosis
gcggccugcgcgu

SEQ ID NO: 843220 - RNA, 14 nt, Mycobacterium avium subsp. paratuberculosis
gcggcgaaccagca

SEQ ID NO: 843221 - RNA, 17 nt, Mycobacterium avium subsp. paratuberculosis
gcggcgaaccgggcccg

SEQ ID NO: 843222 - RNA, 19 nt, Mycobacterium avium subsp. paratuberculosis
gcggcgaaccgggcccgua

SEQ ID NO: 843223 - RNA, 15 nt, Mycobacterium avium subsp. paratuberculosis
gcggccaacccgggc

SEQ ID NO: 843224 - RNA, 19 nt, Mycobacterium avium subsp. paratuberculosis
gcggccaacccgggcgcca

SEQ ID NO: 843225 - RNA, 16 nt, Mycobacterium avium subsp. paratuberculosis
gcggcaugaccggcca

SEQ ID NO: 843226 - RNA, 17 nt, Mycobacterium avium subsp. paratuberculosis
gcggcaugaccggccag

SEQ ID NO: 843227 - RNA, 11 nt, Mycobacterium avium subsp. paratuberculosis
gcggcaugccc

SEQ ID NO: 843228 - RNA, 12 nt, Mycobacterium avium subsp. paratuberculosis
gcggcaugccgc

SEQ ID NO: 843229 - RNA, 17 nt, Mycobacterium avium subsp. paratuberculosis
gcggcaugccgcccggg

SEQ ID NO: 843230 - RNA, 21 nt, Mycobacterium avium subsp. paratuberculosis
aagcgcggguccugcaaccgc

SEQ ID NO: 843231 - RNA, 15 nt, Mycobacterium avium subsp. paratuberculosis
gcggcauggcuggcg

SEQ ID NO: 843232 - RNA, 16 nt, Mycobacterium avium subsp. paratuberculosis
gcggcauggcuggcgg

SEQ ID NO: 843233 - RNA, 18 nt, Mycobacterium avium subsp. paratuberculosis
gcggcauggcuggcggca

SEQ ID NO: 843234 - RNA, 21 nt, Mycobacterium avium subsp. paratuberculosis
gcggcauggcuggcggcaacg

SEQ ID NO: 843235 - RNA, 13 nt, Mycobacterium avium subsp. paratuberculosis
gcggccgccagcg

SEQ ID NO: 843236 - RNA, 18 nt, Mycobacterium avium subsp. paratuberculosis
gcggccgccagcgcaccg

SEQ ID NO: 843237 - RNA, 23 nt, Mycobacterium avium subsp. paratuberculosis
gcggccgccagcgcaccgagccc

SEQ ID NO: 843238 - RNA, 13 nt, Mycobacterium avium subsp. paratuberculosis
gcggccgcccagc

SEQ ID NO: 843239 - RNA, 20 nt, Mycobacterium avium subsp. paratuberculosis
gcggccgcccagcccgcgcc

SEQ ID NO: 843240 - RNA, 21 nt, Mycobacterium avium subsp. paratuberculosis
gcggccgcccagcccgcgccg

SEQ ID NO: 843241 - RNA, 23 nt, Mycobacterium avium subsp. paratuberculosis
gcggccgcccagcccgcgccgag

SEQ ID NO: 843242 - RNA, 22 nt, Mycobacterium avium subsp. paratuberculosis
gcggccgcccgggcggcccgca

SEQ ID NO: 843243 - RNA, 13 nt, Mycobacterium avium subsp. paratuberculosis
gcggccgcccggu

SEQ ID NO: 843244 - RNA, 18 nt, Mycobacterium avium subsp. paratuberculosis
gcggccgcccgguccggg

SEQ ID NO: 843245 - RNA, 14 nt, Mycobacterium avium subsp. paratuberculosis
gcggccgccagcgu

SEQ ID NO: 843246 - RNA, 16 nt, Mycobacterium avium subsp. paratuberculosis
gcggccgccagcgucc

SEQ ID NO: 843247 - RNA, 13 nt, Mycobacterium avium subsp. paratuberculosis
gcggccgccauca

SEQ ID NO: 843248 - RNA, 12 nt, Mycobacterium avium subsp. paratuberculosis
gcggccgccacg

SEQ ID NO: 843249 - RNA, 18 nt, Mycobacterium avium subsp. paratuberculosis
gcggccgccacgcuggug

SEQ ID NO: 843250 - RNA, 11 nt, Mycobacterium avium subsp. paratuberculosis
gcggccgccag

SEQ ID NO: 843251 - RNA, 17 nt, Mycobacterium avium subsp. paratuberculosis
gcggccgcagcgcaucg

SEQ ID NO: 843252 - RNA, 22 nt, Mycobacterium avium subsp. paratuberculosis
gcggccgcagcgcaucgccggc

SEQ ID NO: 843253 - RNA, 15 nt, Mycobacterium avium subsp. paratuberculosis
gcggccgcagcgcga

SEQ ID NO: 843254 - RNA, 20 nt, Mycobacterium avium subsp. paratuberculosis
gcggccgaucaccucgaugg

SEQ ID NO: 843255 - RNA, 20 nt, Mycobacterium avium subsp. paratuberculosis
gcggccgaucauggucggcg

SEQ ID NO: 843256 - RNA, 23 nt, Mycobacterium avium subsp. paratuberculosis
gcggccgaucauggucggcgacg

SEQ ID NO: 843257 - RNA, 18 nt, Mycobacterium avium subsp. paratuberculosis
gcggccgauucggcgccg

SEQ ID NO: 843258 - RNA, 22 nt, Mycobacterium avium subsp. paratuberculosis
gcggccgcaaucggcgccggcu

SEQ ID NO: 843259 - RNA, 12 nt, Mycobacterium avium subsp. paratuberculosis
gcggccgagccg

SEQ ID NO: 843260 - RNA, 18 nt, Mycobacterium avium subsp. paratuberculosis
gcggccgagcgcaccgcg

SEQ ID NO: 843261 - RNA, 19 nt, Mycobacterium avium subsp. paratuberculosis
gcggccgagcgcaccgcgg

SEQ ID NO: 843262 - RNA, 22 nt, Mycobacterium avium subsp. paratuberculosis
gcggccaacgccucgucgaccg

SEQ ID NO: 843263 - RNA, 21 nt, Mycobacterium avium subsp. paratuberculosis
gcggccaacgcgacgaagccg

SEQ ID NO: 843264 - RNA, 15 nt, Mycobacterium avium subsp. paratuberculosis
gcggccggccagcgc

SEQ ID NO: 843265 - RNA, 18 nt, Mycobacterium avium subsp. paratuberculosis
gcggccggccagcgcgcg

SEQ ID NO: 843266 - RNA, 13 nt, Mycobacterium avium subsp. paratuberculosis
gcggccggccagu

SEQ ID NO: 843267 - RNA, 15 nt, Mycobacterium avium subsp. paratuberculosis
gcggccggcccagcg

SEQ ID NO: 843268 - RNA, 16 nt, Mycobacterium avium subsp. paratuberculosis
gcggccggcccagcgc

SEQ ID NO: 843269 - RNA, 16 nt, Mycobacterium avium subsp. paratuberculosis
gcggccggccccggcc

SEQ ID NO: 843270 - RNA, 17 nt, Mycobacterium avium subsp. paratuberculosis
gcggccggccccggccg

SEQ ID NO: 843271 - RNA, 12 nt, Mycobacterium avium subsp. paratuberculosis
gcggccggcccg

SEQ ID NO: 843272 - RNA, 14 nt, Mycobacterium avium subsp. paratuberculosis
gcggccggcccggc

SEQ ID NO: 843273 - RNA, 20 nt, Mycobacterium avium subsp. paratuberculosis
gcggccggcccggcccgacg

SEQ ID NO: 843274 - RNA, 14 nt, Mycobacterium avium subsp. paratuberculosis
gcggccggccgaca

SEQ ID NO: 843275 - RNA, 17 nt, Mycobacterium avium subsp. paratuberculosis
gcggccggccgacaccc

SEQ ID NO: 843276 - RNA, 12 nt, Mycobacterium avium subsp. paratuberculosis
gcggccggccgc

SEQ ID NO: 843277 - RNA, 20 nt, Mycobacterium avium subsp. paratuberculosis
gcggccgggcggccggagcc

SEQ ID NO: 843278 - RNA, 22 nt, Mycobacterium avium subsp. paratuberculosis
gcggccggaucgaauccggcgg

SEQ ID NO: 843279 - RNA, 23 nt, Mycobacterium avium subsp. paratuberculosis
gcggccggaucgaauccggcggc

SEQ ID NO: 843280 - RNA, 17 nt, Mycobacterium avium subsp. paratuberculosis
gcggccggagccgaccu

SEQ ID NO: 843281 - RNA, 18 nt, Mycobacterium avium subsp. paratuberculosis
gcggccggaaucucgugg

SEQ ID NO: 843282 - RNA, 17 nt, Mycobacterium avium subsp. paratuberculosis
gcggccgcuucccaccc

SEQ ID NO: 843283 - RNA, 20 nt, Mycobacterium avium subsp. paratuberculosis
gcggccgcuucccacccggu

SEQ ID NO: 843284 - RNA, 12 nt, Mycobacterium avium subsp. paratuberculosis
gcggccgccggg

SEQ ID NO: 843285 - RNA, 14 nt, Mycobacterium avium subsp. paratuberculosis
gcggccgcugcgcc

SEQ ID NO: 843286 - RNA, 15 nt, Mycobacterium avium subsp. paratuberculosis
gcggccgcugcgccc

SEQ ID NO: 843287 - RNA, 17 nt, Mycobacterium avium subsp. paratuberculosis
gcggccgcugcgcccag

SEQ ID NO: 843288 - RNA, 18 nt, Mycobacterium avium subsp. paratuberculosis
gcggccgcugcgcccagc

SEQ ID NO: 843289 - RNA, 22 nt, Mycobacterium avium subsp. paratuberculosis
gcggccgccuuggugauccggg

SEQ ID NO: 843290 - RNA, 22 nt, Mycobacterium avium subsp. paratuberculosis
gcggccgcguugucgaccacca

SEQ ID NO: 843291 - RNA, 22 nt, Mycobacterium avium subsp. paratuberculosis
gcggccgcuaguuggugcuggg

SEQ ID NO: 843292 - RNA, 20 nt, Mycobacterium avium subsp. paratuberculosis
gcggccgccuucacgaccgg

SEQ ID NO: 843293 - RNA, 15 nt, Mycobacterium avium subsp. paratuberculosis
gcggccgccggcacc

SEQ ID NO: 843294 - RNA, 17 nt, Mycobacterium avium subsp. paratuberculosis
gcggccgccggcaccgu

SEQ ID NO: 843295 - RNA, 22 nt, Mycobacterium avium subsp. paratuberculosis
gcggccgccggcaccguccggc

SEQ ID NO: 843296 - RNA, 13 nt, Mycobacterium avium subsp. paratuberculosis
gcggccgccggcc

SEQ ID NO: 843297 - RNA, 15 nt, Mycobacterium avium subsp. paratuberculosis
gcggccgccggccag

SEQ ID NO: 843298 - RNA, 16 nt, Mycobacterium avium subsp. paratuberculosis
gcggccgccggccagc

SEQ ID NO: 843299 - RNA, 16 nt, Mycobacterium avium subsp. paratuberculosis
gcggccgccgcccgcg

SEQ ID NO: 843300 - RNA, 18 nt, Mycobacterium avium subsp. paratuberculosis
gcggccgccgcccgcgcg

SEQ ID NO: 843301 - RNA, 15 nt, Mycobacterium avium subsp. paratuberculosis
gcggccgccgccgcg

SEQ ID NO: 843302 - RNA, 18 nt, Mycobacterium avium subsp. paratuberculosis
gcggccgccgccgcggcc

SEQ ID NO: 843303 - RNA, 21 nt, Mycobacterium avium subsp. paratuberculosis
gcggccgccgccgcggccgcg

SEQ ID NO: 843304 - RNA, 15 nt, Mycobacterium avium subsp. paratuberculosis
gcggccgccgcgacg

SEQ ID NO: 843305 - RNA, 16 nt, Mycobacterium avium subsp. paratuberculosis
gcggccgccgcgacgg

SEQ ID NO: 843306 - RNA, 13 nt, Mycobacterium avium subsp. paratuberculosis
gcggccgccgggc

SEQ ID NO: 843307 - RNA, 17 nt, Mycobacterium avium subsp. paratuberculosis
gcggccgccgggccggc

SEQ ID NO: 843308 - RNA, 20 nt, Mycobacterium avium subsp. paratuberculosis
gcggccgccgggccggcggc

SEQ ID NO: 843309 - RNA, 21 nt, Mycobacterium avium subsp. paratuberculosis
gcggccgccgggccggcggcc

SEQ ID NO: 843310 - RNA, 23 nt, Mycobacterium avium subsp. paratuberculosis
gcggccgccgggccggcggccag

SEQ ID NO: 843311 - RNA, 14 nt, Mycobacterium avium subsp. paratuberculosis
gcggccgccggggc

SEQ ID NO: 843312 - RNA, 15 nt, Mycobacterium avium subsp. paratuberculosis
gcggccgccggggcc

SEQ ID NO: 843313 - RNA, 18 nt, Mycobacterium avium subsp. paratuberculosis
gcggccgccggggcccca

SEQ ID NO: 843314 - RNA, 22 nt, Mycobacterium avium subsp. paratuberculosis
gcggccgccggggccccaaccc

SEQ ID NO: 843315 - RNA, 12 nt, Mycobacterium avium subsp. paratuberculosis
gcggccgucgcg

SEQ ID NO: 843316 - RNA, 14 nt, Mycobacterium avium subsp. paratuberculosis
gcggccgucgccgg

SEQ ID NO: 843317 - RNA, 17 nt, Mycobacterium avium subsp. paratuberculosis
gcggccgucgccgggcg

SEQ ID NO: 843318 - RNA, 14 nt, Mycobacterium avium subsp. paratuberculosis
gcggccgucgcggc

SEQ ID NO: 843319 - RNA, 23 nt, Mycobacterium avium subsp. paratuberculosis
gcggccgucgcggcgaucgcgag

SEQ ID NO: 843320 - RNA, 13 nt, Mycobacterium avium subsp. paratuberculosis
gcggccgucgccg

SEQ ID NO: 843321 - RNA, 12 nt, Mycobacterium avium subsp. paratuberculosis
gcggccguagcg

SEQ ID NO: 843322 - RNA, 21 nt, Mycobacterium avium subsp. paratuberculosis
gcggccguagcguugccggcc

SEQ ID NO: 843323 - RNA, 22 nt, Mycobacterium avium subsp. paratuberculosis
gcggccguagcguugccggccg

SEQ ID NO: 843324 - RNA, 17 nt, Mycobacterium avium subsp. paratuberculosis
gcggccguccaccacca

SEQ ID NO: 843325 - RNA, 18 nt, Mycobacterium avium subsp. paratuberculosis
gcggccguccaccaccaa

SEQ ID NO: 843326 - RNA, 16 nt, Mycobacterium avium subsp. paratuberculosis
gcggccguccagcguc

SEQ ID NO: 843327 - RNA, 13 nt, Mycobacterium avium subsp. paratuberculosis
gcggccgguugcc

SEQ ID NO: 843328 - RNA, 22 nt, Mycobacterium avium subsp. paratuberculosis
gcggccgguugccuuuccgcgc

SEQ ID NO: 843329 - RNA, 16 nt, Mycobacterium avium subsp. paratuberculosis
gcggccguagccggac

SEQ ID NO: 843330 - RNA, 18 nt, Mycobacterium avium subsp. paratuberculosis
gcggccguagccggaccg

SEQ ID NO: 843331 - RNA, 13 nt, Mycobacterium avium subsp. paratuberculosis
gcggccggugcca

SEQ ID NO: 843332 - RNA, 17 nt, Mycobacterium avium subsp. paratuberculosis
gcggccggcacuaccgc

SEQ ID NO: 843333 - RNA, 21 nt, Mycobacterium avium subsp. paratuberculosis
gcggccgggucgagcgcgccg

SEQ ID NO: 843334 - RNA, 19 nt, Mycobacterium avium subsp. paratuberculosis
gcggccggggcagacccgc

SEQ ID NO: 843335 - RNA, 22 nt, Mycobacterium avium subsp. paratuberculosis
gcggccggggcagacccgcguc

SEQ ID NO: 843336 - RNA, 21 nt, Mycobacterium avium subsp. paratuberculosis
gcggccggggggaggucgcgg

SEQ ID NO: 843337 - RNA, 19 nt, Mycobacterium avium subsp. paratuberculosis
gcggccggggugacuucga

SEQ ID NO: 843338 - RNA, 21 nt, Mycobacterium avium subsp. paratuberculosis
gcggccggccacgcucggcgg

SEQ ID NO: 843339 - RNA, 13 nt, Mycobacterium avium subsp. paratuberculosis
gcggccggccagc

SEQ ID NO: 843340 - RNA, 14 nt, Mycobacterium avium subsp. paratuberculosis
gcggccggccagca

SEQ ID NO: 843341 - RNA, 20 nt, Mycobacterium avium subsp. paratuberculosis
gcggccggccagcagccggu

SEQ ID NO: 843342 - RNA, 18 nt, Mycobacterium avium subsp. paratuberculosis
gcggguguugaccuuguc

SEQ ID NO: 843343 - RNA, 19 nt, Mycobacterium avium subsp. paratuberculosis
gcggguggccgggucgccg

SEQ ID NO: 843344 - RNA, 19 nt, Mycobacterium avium subsp. paratuberculosis
gcgggugguguggcgucgg

SEQ ID NO: 843345 - RNA, 20 nt, Mycobacterium avium subsp. paratuberculosis
gcgggugguguggcgucggc

SEQ ID NO: 843346 - RNA, 22 nt, Mycobacterium avium subsp. paratuberculosis
gcgggugguguggcgucggccg

SEQ ID NO: 843347 - RNA, 21 nt, Mycobacterium avium subsp. paratuberculosis
gcggguguauucgcccacccc

SEQ ID NO: 843348 - RNA, 20 nt, Mycobacterium avium subsp. paratuberculosis
gcggguguccgagcgggccg

SEQ ID NO: 843349 - RNA, 14 nt, Mycobacterium avium subsp. paratuberculosis
gcgggugucgagcc

SEQ ID NO: 843350 - RNA, 14 nt, Mycobacterium avium subsp. paratuberculosis
gcgggugucgccgg

SEQ ID NO: 843351 - RNA, 20 nt, Mycobacterium avium subsp. paratuberculosis
gcggguggggaagacgugca

SEQ ID NO: 843352 - RNA, 13 nt, Mycobacterium avium subsp. paratuberculosis
gcggguggggauc

SEQ ID NO: 843353 - RNA, 19 nt, Mycobacterium avium subsp. paratuberculosis
gcggguggcgccacagccg

SEQ ID NO: 843354 - RNA, 18 nt, Mycobacterium avium subsp. paratuberculosis
gcgggugcugggcggauc

SEQ ID NO: 843355 - RNA, 15 nt, Mycobacterium avium subsp. paratuberculosis
gcgggugcggccagc

SEQ ID NO: 843356 - RNA, 17 nt, Mycobacterium avium subsp. paratuberculosis
gcgggugcggccgguug

SEQ ID NO: 843357 - RNA, 19 nt, Mycobacterium avium subsp. paratuberculosis
gcgggugcggccgguugcc

SEQ ID NO: 843358 - RNA, 22 nt, Mycobacterium avium subsp. paratuberculosis
gcgggugcuggucagcaucggc

SEQ ID NO: 843359 - RNA, 17 nt, Mycobacterium avium subsp. paratuberculosis
gcggguggaucuugacg

SEQ ID NO: 843360 - RNA, 23 nt, Mycobacterium avium subsp. paratuberculosis
gcggguggaucuugacggcgacg

SEQ ID NO: 843361 - RNA, 13 nt, Mycobacterium avium subsp. paratuberculosis
gcggguggccagc

SEQ ID NO: 843362 - RNA, 13 nt, Mycobacterium avium subsp. paratuberculosis
gcggguggccggg

SEQ ID NO: 843363 - RNA, 19 nt, Mycobacterium avium subsp. paratuberculosis
gcggguuggucccgaucac

SEQ ID NO: 843364 - RNA, 22 nt, Mycobacterium avium subsp. paratuberculosis
gcggguuggucccgaucaccuu

SEQ ID NO: 843365 - RNA, 20 nt, Mycobacterium avium subsp. paratuberculosis
gcggguugucgucgucggcg

SEQ ID NO: 843366 - RNA, 23 nt, Mycobacterium avium subsp. paratuberculosis
gcggguugucgucgucggcgaac

SEQ ID NO: 843367 - RNA, 14 nt, Mycobacterium avium subsp. paratuberculosis
gcggguggcggccg

SEQ ID NO: 843368 - RNA, 18 nt, Mycobacterium avium subsp. paratuberculosis
gcggguugcgguccccgg

SEQ ID NO: 843369 - RNA, 17 nt, Mycobacterium avium subsp. paratuberculosis
gcggguugccgcuggcg

SEQ ID NO: 843370 - RNA, 14 nt, Mycobacterium avium subsp. paratuberculosis
gcggguucuggccg

SEQ ID NO: 843371 - RNA, 23 nt, Mycobacterium avium subsp. paratuberculosis
gcggguucuggccguggucggcg

SEQ ID NO: 843372 - RNA, 21 nt, Mycobacterium avium subsp. paratuberculosis
gcggguucuucagggcggugc

SEQ ID NO: 843373 - RNA, 13 nt, Mycobacterium avium subsp. paratuberculosis
gcggguuuggccg

SEQ ID NO: 843374 - RNA, 19 nt, Mycobacterium avium subsp. paratuberculosis
gcggguuuggccgcgggcg

SEQ ID NO: 843375 - RNA, 20 nt, Mycobacterium avium subsp. paratuberculosis
gcgguagaugucggguccgc

SEQ ID NO: 843376 - RNA, 16 nt, Mycobacterium avium subsp. paratuberculosis
gcgguagaggcgggcg

SEQ ID NO: 843377 - RNA, 17 nt, Mycobacterium avium subsp. paratuberculosis
gcgguagaucgacaggg

SEQ ID NO: 843378 - RNA, 22 nt, Mycobacterium avium subsp. paratuberculosis
gcgguaugcccgggccgucauc

SEQ ID NO: 843379 - RNA, 21 nt, Mycobacterium avium subsp. paratuberculosis
gcgguauucgucaccccacca

SEQ ID NO: 843380 - RNA, 17 nt, Mycobacterium avium subsp. paratuberculosis
gcgguagacaccgccgu

SEQ ID NO: 843381 - RNA, 18 nt, Mycobacterium avium subsp. paratuberculosis
gcgguaucgguggauccg

SEQ ID NO: 843382 - RNA, 15 nt, Mycobacterium avium subsp. paratuberculosis
gcggucaacaccggg

SEQ ID NO: 843383 - RNA, 22 nt, Mycobacterium avium subsp. paratuberculosis
gcggucaacaccgggauccggc

SEQ ID NO: 843384 - RNA, 14 nt, Mycobacterium avium subsp. paratuberculosis
gcggucaacacgaa

SEQ ID NO: 843385 - RNA, 16 nt, Mycobacterium avium subsp. paratuberculosis
gcggucaacacgaagc

SEQ ID NO: 843386 - RNA, 18 nt, Mycobacterium avium subsp. paratuberculosis
gcggucaacacgaagccg

SEQ ID NO: 843387 - RNA, 16 nt, Mycobacterium avium subsp. paratuberculosis
gcggucaugcgcgggc

SEQ ID NO: 843388 - RNA, 18 nt, Mycobacterium avium subsp. paratuberculosis
gcggucaugcgcgggcaa

SEQ ID NO: 843389 - RNA, 19 nt, Mycobacterium avium subsp. paratuberculosis
gcggucaugcgcgggcaau

SEQ ID NO: 843390 - RNA, 22 nt, Mycobacterium avium subsp. paratuberculosis
gcgguccaccaccacacccgcg

SEQ ID NO: 843391 - RNA, 14 nt, Mycobacterium avium subsp. paratuberculosis
gcgguccacccgaa

SEQ ID NO: 843392 - RNA, 14 nt, Mycobacterium avium subsp. paratuberculosis
gcgguccaccgacg

SEQ ID NO: 843393 - RNA, 17 nt, Mycobacterium avium subsp. paratuberculosis
gcgguccaccgacgcca

SEQ ID NO: 843394 - RNA, 20 nt, Mycobacterium avium subsp. paratuberculosis
gcgguccaccgacgccacgu

SEQ ID NO: 843395 - RNA, 23 nt, Mycobacterium avium subsp. paratuberculosis
gcgguccaccgacgccacgucgu

SEQ ID NO: 843396 - RNA, 15 nt, Mycobacterium avium subsp. paratuberculosis
gcgguccacgccggc

SEQ ID NO: 843397 - RNA, 16 nt, Mycobacterium avium subsp. paratuberculosis
gcgguccacgccggcg

SEQ ID NO: 843398 - RNA, 17 nt, Mycobacterium avium subsp. paratuberculosis
gcgguccacgccggcga

SEQ ID NO: 843399 - RNA, 17 nt, Mycobacterium avium subsp. paratuberculosis
gcgguccacggucagcg

SEQ ID NO: 843400 - RNA, 20 nt, Mycobacterium avium subsp. paratuberculosis
gcgguccacggucagcgcgu

SEQ ID NO: 843401 - RNA, 16 nt, Mycobacterium avium subsp. paratuberculosis
gcgguccacgguggcg

SEQ ID NO: 843402 - RNA, 22 nt, Mycobacterium avium subsp. paratuberculosis
gcgguccacguuggcgaagccg

SEQ ID NO: 843403 - RNA, 13 nt, Mycobacterium avium subsp. paratuberculosis
gcgggucucgccc

SEQ ID NO: 843404 - RNA, 19 nt, Mycobacterium avium subsp. paratuberculosis
gcgggugaaucgacaccgc

SEQ ID NO: 843405 - RNA, 22 nt, Mycobacterium avium subsp. paratuberculosis
gcgggugaaucgacaccgcacg

SEQ ID NO: 843406 - RNA, 23 nt, Mycobacterium avium subsp. paratuberculosis
gcgggugaaucgacaccgcacgg

SEQ ID NO: 843407 - RNA, 15 nt, Mycobacterium avium subsp. paratuberculosis
gcgggugaccgacag

SEQ ID NO: 843408 - RNA, 14 nt, Mycobacterium avium subsp. paratuberculosis
gcgggugaccggcg

SEQ ID NO: 843409 - RNA, 17 nt, Mycobacterium avium subsp. paratuberculosis
gcgggugaccggcgccg

SEQ ID NO: 843410 - RNA, 20 nt, Mycobacterium avium subsp. paratuberculosis
gcgggugaccggcgccgggu

SEQ ID NO: 843411 - RNA, 15 nt, Mycobacterium avium subsp. paratuberculosis
gcgggugacgaucac

SEQ ID NO: 843412 - RNA, 17 nt, Mycobacterium avium subsp. paratuberculosis
gcgggugacgaucaccg

SEQ ID NO: 843413 - RNA, 18 nt, Mycobacterium avium subsp. paratuberculosis
gcgggugacgaucaccgc

SEQ ID NO: 843414 - RNA, 16 nt, Mycobacterium avium subsp. paratuberculosis
gcgggugacgaucugg

SEQ ID NO: 843415 - RNA, 13 nt, Mycobacterium avium subsp. paratuberculosis
gcgggugacgcug

SEQ ID NO: 843416 - RNA, 18 nt, Mycobacterium avium subsp. paratuberculosis
gcgggucgucgggccggg

SEQ ID NO: 843417 - RNA, 23 nt, Mycobacterium avium subsp. paratuberculosis
gcgggucgucgggcggcaggaac

SEQ ID NO: 843418 - RNA, 18 nt, Mycobacterium avium subsp. paratuberculosis
gcgggucgugcaucggcg

SEQ ID NO: 843419 - RNA, 15 nt, Mycobacterium avium subsp. paratuberculosis
gcgggucguuggcgg

SEQ ID NO: 843420 - RNA, 18 nt, Mycobacterium avium subsp. paratuberculosis
gcgggucguuugguggug

SEQ ID NO: 843421 - RNA, 18 nt, Mycobacterium avium subsp. paratuberculosis
gcgggucucgaaccgggc

SEQ ID NO: 843422 - RNA, 16 nt, Mycobacterium avium subsp. paratuberculosis
gcgggugcagccggau

SEQ ID NO: 843423 - RNA, 17 nt, Mycobacterium avium subsp. paratuberculosis
gcgggugcgcucgacgg

SEQ ID NO: 843424 - RNA, 16 nt, Mycobacterium avium subsp. paratuberculosis
gcgggugcgcugcagc

SEQ ID NO: 843425 - RNA, 17 nt, Mycobacterium avium subsp. paratuberculosis
gcgggucugugaccacg

SEQ ID NO: 843426 - RNA, 21 nt, Mycobacterium avium subsp. paratuberculosis
gcgggugaggacgcccggcga

SEQ ID NO: 843427 - RNA, 17 nt, Mycobacterium avium subsp. paratuberculosis
gcgggugaggggcgcgc

SEQ ID NO: 843428 - RNA, 18 nt, Mycobacterium avium subsp. paratuberculosis
gcgggugaguagccgaua

SEQ ID NO: 843429 - RNA, 16 nt, Mycobacterium avium subsp. paratuberculosis
gcgggugaucugcgcc

SEQ ID NO: 843430 - RNA, 22 nt, Mycobacterium avium subsp. paratuberculosis
gcgggugaugccguacauggug

SEQ ID NO: 843431 - RNA, 14 nt, Mycobacterium avium subsp. paratuberculosis
gcgggucggcguca

SEQ ID NO: 843432 - RNA, 15 nt, Mycobacterium avium subsp. paratuberculosis
gcgggucgucgacgu

SEQ ID NO: 843433 - RNA, 16 nt, Mycobacterium avium subsp. paratuberculosis
gcgggucgucgacguc

SEQ ID NO: 843434 - RNA, 16 nt, Mycobacterium avium subsp. paratuberculosis
gcgggucggcgccggc

SEQ ID NO: 843435 - RNA, 17 nt, Mycobacterium avium subsp. paratuberculosis
gcgggucggcgccggcc

SEQ ID NO: 843436 - RNA, 14 nt, Mycobacterium avium subsp. paratuberculosis
gcgggucgcgguuc

SEQ ID NO: 843437 - RNA, 17 nt, Mycobacterium avium subsp. paratuberculosis
gcgggucggcgacggcg

SEQ ID NO: 843438 - RNA, 13 nt, Mycobacterium avium subsp. paratuberculosis
gcgggucggcgcc

SEQ ID NO: 843439 - RNA, 12 nt, Mycobacterium avium subsp. paratuberculosis
gcgggucgaugg

SEQ ID NO: 843440 - RNA, 14 nt, Mycobacterium avium subsp. paratuberculosis
gcgggucgccgggc

SEQ ID NO: 843441 - RNA, 13 nt, Mycobacterium avium subsp. paratuberculosis
gcgggucgcgcgg

SEQ ID NO: 843442 - RNA, 18 nt, Mycobacterium avium subsp. paratuberculosis
gcgggucgcgcugcggga

SEQ ID NO: 843443 - RNA, 18 nt, Mycobacterium avium subsp. paratuberculosis
gcgggucgcggcccaccg

SEQ ID NO: 843444 - RNA, 23 nt, Mycobacterium avium subsp. paratuberculosis
gcgggucgcggcccaccgcgucg

SEQ ID NO: 843445 - RNA, 18 nt, Mycobacterium avium subsp. paratuberculosis
gcgggucgcuggccgcga

SEQ ID NO: 843446 - RNA, 15 nt, Mycobacterium avium subsp. paratuberculosis
gcgggucggccggcg

SEQ ID NO: 843447 - RNA, 16 nt, Mycobacterium avium subsp. paratuberculosis
gcgggucggccggcgg

SEQ ID NO: 843448 - RNA, 13 nt, Mycobacterium avium subsp. paratuberculosis
gcgggucggcgac

SEQ ID NO: 843449 - RNA, 21 nt, Mycobacterium avium subsp. paratuberculosis
gcggguccaucgccucgacca

SEQ ID NO: 843450 - RNA, 14 nt, Mycobacterium avium subsp. paratuberculosis
gcggguccagccgc

SEQ ID NO: 843451 - RNA, 18 nt, Mycobacterium avium subsp. paratuberculosis
gcggguccagccgccggc

SEQ ID NO: 843452 - RNA, 19 nt, Mycobacterium avium subsp. paratuberculosis
gcggguccagccgccggcg

SEQ ID NO: 843453 - RNA, 13 nt, Mycobacterium avium subsp. paratuberculosis
gcgggucagcagc

SEQ ID NO: 843454 - RNA, 23 nt, Mycobacterium avium subsp. paratuberculosis
gcgggucagcagcgucugcgcca

SEQ ID NO: 843455 - RNA, 14 nt, Mycobacterium avium subsp. paratuberculosis
gcggggccggcgcg

SEQ ID NO: 843456 - RNA, 20 nt, Mycobacterium avium subsp. paratuberculosis
gcggggccggcggcggccag

SEQ ID NO: 843457 - RNA, 16 nt, Mycobacterium avium subsp. paratuberculosis
gcggggccaccaggcg

SEQ ID NO: 843458 - RNA, 23 nt, Mycobacterium avium subsp. paratuberculosis
gcggggccaccaggcgccgucga

SEQ ID NO: 843459 - RNA, 13 nt, Mycobacterium avium subsp. paratuberculosis
gcggggcgccgac

SEQ ID NO: 843460 - RNA, 13 nt, Mycobacterium avium subsp. paratuberculosis
gcggggcgcgagg

SEQ ID NO: 843461 - RNA, 16 nt, Mycobacterium avium subsp. paratuberculosis
gcggggcgcgaggcgc

SEQ ID NO: 843462 - RNA, 18 nt, Mycobacterium avium subsp. paratuberculosis
gcggggcgcgaggcgcga

SEQ ID NO: 843463 - RNA, 17 nt, Mycobacterium avium subsp. paratuberculosis
gcggggccggugauggu

SEQ ID NO: 843464 - RNA, 18 nt, Mycobacterium avium subsp. paratuberculosis
gcggggccuccaccagcg

SEQ ID NO: 843465 - RNA, 12 nt, Mycobacterium avium subsp. paratuberculosis
gcggggccucga

SEQ ID NO: 843466 - RNA, 15 nt, Mycobacterium avium subsp. paratuberculosis
gcggggccucgucgc

SEQ ID NO: 843467 - RNA, 21 nt, Mycobacterium avium subsp. paratuberculosis
gcggggcgaccuugcgcagcc

SEQ ID NO: 843468 - RNA, 14 nt, Mycobacterium avium subsp. paratuberculosis
gcggggcgagcugg

SEQ ID NO: 843469 - RNA, 17 nt, Mycobacterium avium subsp. paratuberculosis
gcggggcgagcuggccg

SEQ ID NO: 843470 - RNA, 14 nt, Mycobacterium avium subsp. paratuberculosis
gcggggcugauguu

SEQ ID NO: 843471 - RNA, 16 nt, Mycobacterium avium subsp. paratuberculosis
gcgggggagccgugca

SEQ ID NO: 843472 - RNA, 12 nt, Mycobacterium avium subsp. paratuberculosis
gcgggggccgcc

SEQ ID NO: 843473 - RNA, 13 nt, Mycobacterium avium subsp. paratuberculosis
gcgggggccgccg

SEQ ID NO: 843474 - RNA, 16 nt, Mycobacterium avium subsp. paratuberculosis
gcgggggcggccgggc

SEQ ID NO: 843475 - RNA, 13 nt, Mycobacterium avium subsp. paratuberculosis
gcgggggcggccu

SEQ ID NO: 843476 - RNA, 22 nt, Mycobacterium avium subsp. paratuberculosis
gcgggggauccgccugcgcggg

SEQ ID NO: 843477 - RNA, 13 nt, Mycobacterium avium subsp. paratuberculosis
gcgggggcggcgg

SEQ ID NO: 843478 - RNA, 15 nt, Mycobacterium avium subsp. paratuberculosis
gcggggccgcggccg

SEQ ID NO: 843479 - RNA, 12 nt, Mycobacterium avium subsp. paratuberculosis
gcggggcggccg

SEQ ID NO: 843480 - RNA, 14 nt, Mycobacterium avium subsp. paratuberculosis
gcggggcggccgcc

SEQ ID NO: 843481 - RNA, 18 nt, Mycobacterium avium subsp. paratuberculosis
gcggggcggccgccgggc

SEQ ID NO: 843482 - RNA, 22 nt, Mycobacterium avium subsp. paratuberculosis
gcggggcggcggcgccggggcu

SEQ ID NO: 843483 - RNA, 18 nt, Mycobacterium avium subsp. paratuberculosis
gcggggcguccagcgagg

SEQ ID NO: 843484 - RNA, 14 nt, Mycobacterium avium subsp. paratuberculosis
gcggggcgucgaug

SEQ ID NO: 843485 - RNA, 16 nt, Mycobacterium avium subsp. paratuberculosis
gcggggcgucgcccgc

SEQ ID NO: 843486 - RNA, 11 nt, Mycobacterium avium subsp. paratuberculosis
gcggggcgucu

SEQ ID NO: 843487 - RNA, 20 nt, Mycobacterium avium subsp. paratuberculosis
gcggggcgugcccggcgccg

SEQ ID NO: 843488 - RNA, 13 nt, Mycobacterium avium subsp. paratuberculosis
gcggguacggcgg

SEQ ID NO: 843489 - RNA, 19 nt, Mycobacterium avium subsp. paratuberculosis
gcggguacggcggccgcgg

SEQ ID NO: 843490 - RNA, 16 nt, Mycobacterium avium subsp. paratuberculosis
gcggguacggucggcc

SEQ ID NO: 843491 - RNA, 17 nt, Mycobacterium avium subsp. paratuberculosis
gcggguacggucggccg

SEQ ID NO: 843492 - RNA, 13 nt, Mycobacterium avium subsp. paratuberculosis
gcggguacagccg

SEQ ID NO: 843493 - RNA, 22 nt, Mycobacterium avium subsp. paratuberculosis
gcggguagacguucuccccgcc

SEQ ID NO: 843494 - RNA, 19 nt, Mycobacterium avium subsp. paratuberculosis
gcggguagcccgucgacgg

SEQ ID NO: 843495 - RNA, 21 nt, Mycobacterium avium subsp. paratuberculosis
gcgggucacacccucggcccg

SEQ ID NO: 843496 - RNA, 22 nt, Mycobacterium avium subsp. paratuberculosis
gcgggucacacccucggcccgc

SEQ ID NO: 843497 - RNA, 16 nt, Mycobacterium avium subsp. paratuberculosis
gcggggggagaggcgc

SEQ ID NO: 843498 - RNA, 14 nt, Mycobacterium avium subsp. paratuberculosis
gcggggugcgcggc

SEQ ID NO: 843499 - RNA, 22 nt, Mycobacterium avium subsp. paratuberculosis
gcgggguaguucuugacgccga

SEQ ID NO: 843500 - RNA, 23 nt, Mycobacterium avium subsp. paratuberculosis
gcggggucccaauccucgccgag

SEQ ID NO: 843501 - RNA, 15 nt, Mycobacterium avium subsp. paratuberculosis
gcggggucgggauca

SEQ ID NO: 843502 - RNA, 18 nt, Mycobacterium avium subsp. paratuberculosis
gcgggguggcgccggcca

SEQ ID NO: 843503 - RNA, 20 nt, Mycobacterium avium subsp. paratuberculosis
gcgggguggcgccggccagc

SEQ ID NO: 843504 - RNA, 17 nt, Mycobacterium avium subsp. paratuberculosis
gcggggugugcucggcg

SEQ ID NO: 843505 - RNA, 19 nt, Mycobacterium avium subsp. paratuberculosis
gcgggguguucaccgcgcc

SEQ ID NO: 843506 - RNA, 21 nt, Mycobacterium avium subsp. paratuberculosis
gcgggguucaacuccucgaag

SEQ ID NO: 843507 - RNA, 14 nt, Mycobacterium avium subsp. paratuberculosis
gcggggugcccggc

SEQ ID NO: 843508 - RNA, 16 nt, Mycobacterium avium subsp. paratuberculosis
gcggggugcccggcga

SEQ ID NO: 843509 - RNA, 19 nt, Mycobacterium avium subsp. paratuberculosis
gcggggugggcaccuggcc

SEQ ID NO: 843510 - RNA, 12 nt, Mycobacterium avium subsp. paratuberculosis
gcggggugucga

SEQ ID NO: 843511 - RNA, 15 nt, Mycobacterium avium subsp. paratuberculosis
gcggggugucgaccc

SEQ ID NO: 843512 - RNA, 22 nt, Mycobacterium avium subsp. paratuberculosis
gcggggugucgacccaggucga

SEQ ID NO: 843513 - RNA, 23 nt, Mycobacterium avium subsp. paratuberculosis
gcggggugucgacccaggucgag

SEQ ID NO: 843514 - RNA, 15 nt, Mycobacterium avium subsp. paratuberculosis
gcggggugucgcggc

SEQ ID NO: 843515 - RNA, 17 nt, Mycobacterium avium subsp. paratuberculosis
gcgggacacggcggcgc

SEQ ID NO: 843516 - RNA, 16 nt, Mycobacterium avium subsp. paratuberculosis
gcgggacagcaccacc

SEQ ID NO: 843517 - RNA, 17 nt, Mycobacterium avium subsp. paratuberculosis
gcgggacagcaccacca

SEQ ID NO: 843518 - RNA, 21 nt, Mycobacterium avium subsp. paratuberculosis
gcgggacagcaccaccagguc

SEQ ID NO: 843519 - RNA, 15 nt, Mycobacterium avium subsp. paratuberculosis
gcgggacgccguuga

SEQ ID NO: 843520 - RNA, 21 nt, Mycobacterium avium subsp. paratuberculosis
gcgggacgcgcagaucgucga

SEQ ID NO: 843521 - RNA, 23 nt, Mycobacterium avium subsp. paratuberculosis
gcgggacggaaucacgcaccguc

SEQ ID NO: 843522 - RNA, 18 nt, Mycobacterium avium subsp. paratuberculosis
gcgggaccgggcccggcg

SEQ ID NO: 843523 - RNA, 19 nt, Mycobacterium avium subsp. paratuberculosis
gcgggaccgggcccggcgc

SEQ ID NO: 843524 - RNA, 15 nt, Mycobacterium avium subsp. paratuberculosis
gcgggaccagcgccu

SEQ ID NO: 843525 - RNA, 15 nt, Mycobacterium avium subsp. paratuberculosis
gcgggacccgcgacc

SEQ ID NO: 843526 - RNA, 20 nt, Mycobacterium avium subsp. paratuberculosis
gcgggaccgaggugccgcgg

SEQ ID NO: 843527 - RNA, 22 nt, Mycobacterium avium subsp. paratuberculosis
gcgggaccgaggugccgcgggu

SEQ ID NO: 843528 - RNA, 19 nt, Mycobacterium avium subsp. paratuberculosis
gcgggaggacagcgcggug

SEQ ID NO: 843529 - RNA, 13 nt, Mycobacterium avium subsp. paratuberculosis
gcgggagcgcugg

SEQ ID NO: 843530 - RNA, 20 nt, Mycobacterium avium subsp. paratuberculosis
gcgggagcgcuggucggcga

SEQ ID NO: 843531 - RNA, 15 nt, Mycobacterium avium subsp. paratuberculosis
gcgggacgaucugcg

SEQ ID NO: 843532 - RNA, 18 nt, Mycobacterium avium subsp. paratuberculosis
gcgggagagcgcgggcac

SEQ ID NO: 843533 - RNA, 14 nt, Mycobacterium avium subsp. paratuberculosis
gcgggacggcggcg

SEQ ID NO: 843534 - RNA, 22 nt, Mycobacterium avium subsp. paratuberculosis
gcgggccagcguuuccagcgcc

SEQ ID NO: 843535 - RNA, 14 nt, Mycobacterium avium subsp. paratuberculosis
gcgggccagcucga

SEQ ID NO: 843536 - RNA, 20 nt, Mycobacterium avium subsp. paratuberculosis
gcgggccagcucgucgagcc

SEQ ID NO: 843537 - RNA, 21 nt, Mycobacterium avium subsp. paratuberculosis
gcgggccagcucgucgagccg

SEQ ID NO: 843538 - RNA, 13 nt, Mycobacterium avium subsp. paratuberculosis
gcgggcaggccga

SEQ ID NO: 843539 - RNA, 21 nt, Mycobacterium avium subsp. paratuberculosis
gcgggcaucaucgcuacaccc

SEQ ID NO: 843540 - RNA, 15 nt, Mycobacterium avium subsp. paratuberculosis
gcgggcagcccaggu

SEQ ID NO: 843541 - RNA, 14 nt, Mycobacterium avium subsp. paratuberculosis
gcgggcagccgcuu

SEQ ID NO: 843542 - RNA, 17 nt, Mycobacterium avium subsp. paratuberculosis
gcgggcagccgcuuggc

SEQ ID NO: 843543 - RNA, 19 nt, Mycobacterium avium subsp. paratuberculosis
gcgggcagccgcuuggccg

SEQ ID NO: 843544 - RNA, 22 nt, Mycobacterium avium subsp. paratuberculosis
gcgggcagccgcuuggccgggc

SEQ ID NO: 843545 - RNA, 13 nt, Mycobacterium avium subsp. paratuberculosis
gcgggcagccggc

SEQ ID NO: 843546 - RNA, 14 nt, Mycobacterium avium subsp. paratuberculosis
gcgggcagccggcg

SEQ ID NO: 843547 - RNA, 20 nt, Mycobacterium avium subsp. paratuberculosis
gcgggcagcgagucgaaggc

SEQ ID NO: 843548 - RNA, 20 nt, Mycobacterium avium subsp. paratuberculosis
gcgggcacuuaacaccucgc

SEQ ID NO: 843549 - RNA, 14 nt, Mycobacterium avium subsp. paratuberculosis
gcgggcacuucguc

SEQ ID NO: 843550 - RNA, 17 nt, Mycobacterium avium subsp. paratuberculosis
gcgggcacgccgccgcg

SEQ ID NO: 843551 - RNA, 14 nt, Mycobacterium avium subsp. paratuberculosis
gcgggcacgucgcg

SEQ ID NO: 843552 - RNA, 17 nt, Mycobacterium avium subsp. paratuberculosis
gcgggcacgucgcgcgg

SEQ ID NO: 843553 - RNA, 15 nt, Mycobacterium avium subsp. paratuberculosis
gcgggcaccgucguc

SEQ ID NO: 843554 - RNA, 16 nt, Mycobacterium avium subsp. paratuberculosis
gcgggcaccgucgucg

SEQ ID NO: 843555 - RNA, 14 nt, Mycobacterium avium subsp. paratuberculosis
gcgggcaccucgau

SEQ ID NO: 843556 - RNA, 14 nt, Mycobacterium avium subsp. paratuberculosis
gcgggcaccucggc

SEQ ID NO: 843557 - RNA, 16 nt, Mycobacterium avium subsp. paratuberculosis
gcgggcaccucggcca

SEQ ID NO: 843558 - RNA, 18 nt, Mycobacterium avium subsp. paratuberculosis
gcgggcaccucggccagg

SEQ ID NO: 843559 - RNA, 17 nt, Mycobacterium avium subsp. paratuberculosis
gcgggaguccacgccgu

SEQ ID NO: 843560 - RNA, 15 nt, Mycobacterium avium subsp. paratuberculosis
gcgggaguggccggc

SEQ ID NO: 843561 - RNA, 17 nt, Mycobacterium avium subsp. paratuberculosis
gcgggaguggccggcgu

SEQ ID NO: 843562 - RNA, 16 nt, Mycobacterium avium subsp. paratuberculosis
gcgggaucccagucgu

SEQ ID NO: 843563 - RNA, 20 nt, Mycobacterium avium subsp. paratuberculosis
gcgggaucccgcagccgcga

SEQ ID NO: 843564 - RNA, 17 nt, Mycobacterium avium subsp. paratuberculosis
gcgggaucgcggcgguc

SEQ ID NO: 843565 - RNA, 15 nt, Mycobacterium avium subsp. paratuberculosis
gcgggaucggccggc

SEQ ID NO: 843566 - RNA, 16 nt, Mycobacterium avium subsp. paratuberculosis
gcgggaucggccggcg

SEQ ID NO: 843567 - RNA, 17 nt, Mycobacterium avium subsp. paratuberculosis
gcgggaaucacgcccca

SEQ ID NO: 843568 - RNA, 21 nt, Mycobacterium avium subsp. paratuberculosis
gcgggaaucccacccgcaacg

SEQ ID NO: 843569 - RNA, 16 nt, Mycobacterium avium subsp. paratuberculosis
gcgggaauggccgcgc

SEQ ID NO: 843570 - RNA, 19 nt, Mycobacterium avium subsp. paratuberculosis
gcgggaauuggcaccggac

SEQ ID NO: 843571 - RNA, 22 nt, Mycobacterium avium subsp. paratuberculosis
gcggcuuggucaccagcucgcc

SEQ ID NO: 843572 - RNA, 23 nt, Mycobacterium avium subsp. paratuberculosis
gcggcuuggucaccagcucgccg

SEQ ID NO: 843573 - RNA, 21 nt, Mycobacterium avium subsp. paratuberculosis
gcggcuuggccaccaccacgg

SEQ ID NO: 843574 - RNA, 12 nt, Mycobacterium avium subsp. paratuberculosis
gcggcuuggccg

SEQ ID NO: 843575 - RNA, 15 nt, Mycobacterium avium subsp. paratuberculosis
gcggcuugcccguuc

SEQ ID NO: 843576 - RNA, 16 nt, Mycobacterium avium subsp. paratuberculosis
gcggcuugccgccgca

SEQ ID NO: 843577 - RNA, 17 nt, Mycobacterium avium subsp. paratuberculosis
gcggcuugaccggcucg

SEQ ID NO: 843578 - RNA, 22 nt, Mycobacterium avium subsp. paratuberculosis
gcggcuugaccggcucgccggc

SEQ ID NO: 843579 - RNA, 16 nt, Mycobacterium avium subsp. paratuberculosis
gcggcuugagcgccag

SEQ ID NO: 843580 - RNA, 21 nt, Mycobacterium avium subsp. paratuberculosis
gcggcuugagcgccagcgcgg

SEQ ID NO: 843581 - RNA, 23 nt, Mycobacterium avium subsp. paratuberculosis
aagcuggccaccgcaucgccgag

SEQ ID NO: 843582 - RNA, 22 nt, Mycobacterium avium subsp. paratuberculosis
aagcugggcgcccagaugccgc

SEQ ID NO: 843583 - RNA, 20 nt, Mycobacterium avium subsp. paratuberculosis
aagcuggucgccaaacugcg

SEQ ID NO: 843584 - RNA, 18 nt, Mycobacterium avium subsp. paratuberculosis
gcggcuaguuggccggcu

SEQ ID NO: 843585 - RNA, 16 nt, Mycobacterium avium subsp. paratuberculosis
gcggcucagcaacccg

SEQ ID NO: 843586 - RNA, 23 nt, Mycobacterium avium subsp. paratuberculosis
gcggcucaacgauuuccgguucc

SEQ ID NO: 843587 - RNA, 15 nt, Mycobacterium avium subsp. paratuberculosis
gcggcucacagcgcg

SEQ ID NO: 843588 - RNA, 21 nt, Mycobacterium avium subsp. paratuberculosis
gcggcucacaugggcgcguug

SEQ ID NO: 843589 - RNA, 22 nt, Mycobacterium avium subsp. paratuberculosis
gcggcucacaugggcgcguugg

SEQ ID NO: 843590 - RNA, 15 nt, Mycobacterium avium subsp. paratuberculosis
gcgggcgagcagcgc

SEQ ID NO: 843591 - RNA, 20 nt, Mycobacterium avium subsp. paratuberculosis
gcgggcgagcagcgcccggg

SEQ ID NO: 843592 - RNA, 16 nt, Mycobacterium avium subsp. paratuberculosis
gcgggcgagccgacag

SEQ ID NO: 843593 - RNA, 13 nt, Mycobacterium avium subsp. paratuberculosis
gcgggcgacccgc

SEQ ID NO: 843594 - RNA, 24 nt, Mycobacterium avium subsp. paratuberculosis
gcgggcgacccgcuggaacagcgg

SEQ ID NO: 843595 - RNA, 22 nt, Mycobacterium avium subsp. paratuberculosis
gcgggcgaucuccagcggccgg

SEQ ID NO: 843596 - RNA, 23 nt, Mycobacterium avium subsp. paratuberculosis
gcgggcgaucucgauggccacgc

SEQ ID NO: 843597 - RNA, 12 nt, Mycobacterium avium subsp. paratuberculosis
gcgggcccggcg

SEQ ID NO: 843598 - RNA, 14 nt, Mycobacterium avium subsp. paratuberculosis
gcgggcccggcgau

SEQ ID NO: 843599 - RNA, 15 nt, Mycobacterium avium subsp. paratuberculosis
gcgggcccggcgaug

SEQ ID NO: 843600 - RNA, 22 nt, Mycobacterium avium subsp. paratuberculosis
gcgggcccgcaacuguucgcgg

SEQ ID NO: 843601 - RNA, 16 nt, Mycobacterium avium subsp. paratuberculosis
gcgggcccgcagcucg

SEQ ID NO: 843602 - RNA, 17 nt, Mycobacterium avium subsp. paratuberculosis
gcgggcccgcagcucgg

SEQ ID NO: 843603 - RNA, 13 nt, Mycobacterium avium subsp. paratuberculosis
gcgggcccgcgua

SEQ ID NO: 843604 - RNA, 15 nt, Mycobacterium avium subsp. paratuberculosis
gcgggcgaccugcgg

SEQ ID NO: 843605 - RNA, 18 nt, Mycobacterium avium subsp. paratuberculosis
gcgggcgaccugcgggcc

SEQ ID NO: 843606 - RNA, 20 nt, Mycobacterium avium subsp. paratuberculosis
gcgggcgaccugcgggccca

SEQ ID NO: 843607 - RNA, 15 nt, Mycobacterium avium subsp. paratuberculosis
gcgggcgacgucggg

SEQ ID NO: 843608 - RNA, 13 nt, Mycobacterium avium subsp. paratuberculosis
gcgggcccgcgcc

SEQ ID NO: 843609 - RNA, 15 nt, Mycobacterium avium subsp. paratuberculosis
gcgggcccgcgccgc

SEQ ID NO: 843610 - RNA, 12 nt, Mycobacterium avium subsp. paratuberculosis
gcgggcccagcu

SEQ ID NO: 843611 - RNA, 13 nt, Mycobacterium avium subsp. paratuberculosis
gcgggcccagcuc

SEQ ID NO: 843612 - RNA, 15 nt, Mycobacterium avium subsp. paratuberculosis
gcgggcccagcucgg

SEQ ID NO: 843613 - RNA, 18 nt, Mycobacterium avium subsp. paratuberculosis
gcgggccaggcccaccgu

SEQ ID NO: 843614 - RNA, 20 nt, Mycobacterium avium subsp. paratuberculosis
gcgggccaggcccaccgucg

SEQ ID NO: 843615 - RNA, 22 nt, Mycobacterium avium subsp. paratuberculosis
gcgggccaggcccaccgucgcc

SEQ ID NO: 843616 - RNA, 13 nt, Mycobacterium avium subsp. paratuberculosis
gcgggcccaccgc

SEQ ID NO: 843617 - RNA, 14 nt, Mycobacterium avium subsp. paratuberculosis
gcgggcccaccgcg

SEQ ID NO: 843618 - RNA, 16 nt, Mycobacterium avium subsp. paratuberculosis
gcgggcccaccgcgcg

SEQ ID NO: 843619 - RNA, 19 nt, Mycobacterium avium subsp. paratuberculosis
gcgggcccaccgcgcgcug

SEQ ID NO: 843620 - RNA, 15 nt, Mycobacterium avium subsp. paratuberculosis
gcgggccaggcggga

SEQ ID NO: 843621 - RNA, 21 nt, Mycobacterium avium subsp. paratuberculosis
gcgggccaggcgggacguugu

SEQ ID NO: 843622 - RNA, 13 nt, Mycobacterium avium subsp. paratuberculosis
gcgggccagggcg

SEQ ID NO: 843623 - RNA, 14 nt, Mycobacterium avium subsp. paratuberculosis
gcgggccaggucga

SEQ ID NO: 843624 - RNA, 17 nt, Mycobacterium avium subsp. paratuberculosis
gcgggccaggucgagcg

SEQ ID NO: 843625 - RNA, 18 nt, Mycobacterium avium subsp. paratuberculosis
gcgggccagucgccgcgc

SEQ ID NO: 843626 - RNA, 23 nt, Mycobacterium avium subsp. paratuberculosis
gcgggcaugaaccaggccgcgcu

SEQ ID NO: 843627 - RNA, 23 nt, Mycobacterium avium subsp. paratuberculosis
gcgggccaggauguucaccccgg

SEQ ID NO: 843628 - RNA, 17 nt, Mycobacterium avium subsp. paratuberculosis
gcgggccaggcacggcc

SEQ ID NO: 843629 - RNA, 20 nt, Mycobacterium avium subsp. paratuberculosis
gcgggccaggcacggcccgu

SEQ ID NO: 843630 - RNA, 14 nt, Mycobacterium avium subsp. paratuberculosis
gcgggcgcagcucg

SEQ ID NO: 843631 - RNA, 22 nt, Mycobacterium avium subsp. paratuberculosis
gcgggcgauuucgucggcggug

SEQ ID NO: 843632 - RNA, 17 nt, Mycobacterium avium subsp. paratuberculosis
gcgggcgaugcggcccg

SEQ ID NO: 843633 - RNA, 13 nt, Mycobacterium avium subsp. paratuberculosis
gcgggcgauggcg

SEQ ID NO: 843634 - RNA, 14 nt, Mycobacterium avium subsp. paratuberculosis
gcgggcgcccucca

SEQ ID NO: 843635 - RNA, 16 nt, Mycobacterium avium subsp. paratuberculosis
gcgggcgcccuccacg

SEQ ID NO: 843636 - RNA, 17 nt, Mycobacterium avium subsp. paratuberculosis
gcgggcggcaggucggc

SEQ ID NO: 843637 - RNA, 21 nt, Mycobacterium avium subsp. paratuberculosis
gcgggcggcaggucggcggga

SEQ ID NO: 843638 - RNA, 14 nt, Mycobacterium avium subsp. paratuberculosis
gcgggcggccagcc

SEQ ID NO: 843639 - RNA, 13 nt, Mycobacterium avium subsp. paratuberculosis
gcgggcggccccg

SEQ ID NO: 843640 - RNA, 16 nt, Mycobacterium avium subsp. paratuberculosis
gcgggcggcccgcacg

SEQ ID NO: 843641 - RNA, 15 nt, Mycobacterium avium subsp. paratuberculosis
gcgggcggcgucggc

SEQ ID NO: 843642 - RNA, 12 nt, Mycobacterium avium subsp. paratuberculosis
gcgggcggggcc

SEQ ID NO: 843643 - RNA, 13 nt, Mycobacterium avium subsp. paratuberculosis
gcgggcggggccc

SEQ ID NO: 843644 - RNA, 17 nt, Mycobacterium avium subsp. paratuberculosis
gcgggcggggccugcgg

SEQ ID NO: 843645 - RNA, 21 nt, Mycobacterium avium subsp. paratuberculosis
gcgggcgggggaucggcggga

SEQ ID NO: 843646 - RNA, 23 nt, Mycobacterium avium subsp. paratuberculosis
gcgggcgggggaucggcgggacc

SEQ ID NO: 843647 - RNA, 12 nt, Mycobacterium avium subsp. paratuberculosis
gcgggcgggccg

SEQ ID NO: 843648 - RNA, 14 nt, Mycobacterium avium subsp. paratuberculosis
gcgggcgggccgcc

SEQ ID NO: 843649 - RNA, 16 nt, Mycobacterium avium subsp. paratuberculosis
gcgggcgggccgccag

SEQ ID NO: 843650 - RNA, 16 nt, Mycobacterium avium subsp. paratuberculosis
gcgggcggcgcagucg

SEQ ID NO: 843651 - RNA, 16 nt, Mycobacterium avium subsp. paratuberculosis
gcgggcggcggcuggg

SEQ ID NO: 843652 - RNA, 13 nt, Mycobacterium avium subsp. paratuberculosis
gcgggcggcgaac

SEQ ID NO: 843653 - RNA, 20 nt, Mycobacterium avium subsp. paratuberculosis
gcgggcggcgaacaccagca

SEQ ID NO: 843654 - RNA, 17 nt, Mycobacterium avium subsp. paratuberculosis
gcgggcugcagggccgg

SEQ ID NO: 843655 - RNA, 20 nt, Mycobacterium avium subsp. paratuberculosis
gcgggcugcagggccggguc

SEQ ID NO: 843656 - RNA, 21 nt, Mycobacterium avium subsp. paratuberculosis
gcgggcugcagggccgggucg

SEQ ID NO: 843657 - RNA, 15 nt, Mycobacterium avium subsp. paratuberculosis
gcgggcuggugcgca

SEQ ID NO: 843658 - RNA, 20 nt, Mycobacterium avium subsp. paratuberculosis
gcgggcuggugcgcagccgu

SEQ ID NO: 843659 - RNA, 21 nt, Mycobacterium avium subsp. paratuberculosis
gcgggcuggugcgcagccguc

SEQ ID NO: 843660 - RNA, 16 nt, Mycobacterium avium subsp. paratuberculosis
gcgggcugucggcgcc

SEQ ID NO: 843661 - RNA, 14 nt, Mycobacterium avium subsp. paratuberculosis
gcggggaggcccag

SEQ ID NO: 843662 - RNA, 23 nt, Mycobacterium avium subsp. paratuberculosis
gcggggaggcccagcccgccgcg

SEQ ID NO: 843663 - RNA, 16 nt, Mycobacterium avium subsp. paratuberculosis
gcggggaggucgucgc

SEQ ID NO: 843664 - RNA, 21 nt, Mycobacterium avium subsp. paratuberculosis
gcggggaggucgucgcgucca

SEQ ID NO: 843665 - RNA, 22 nt, Mycobacterium avium subsp. paratuberculosis
gcggggaggucgucgcguccag

SEQ ID NO: 843666 - RNA, 18 nt, Mycobacterium avium subsp. paratuberculosis
gcgggcuaggcucggcag

SEQ ID NO: 843667 - RNA, 15 nt, Mycobacterium avium subsp. paratuberculosis
gcgggcucccgcucg

SEQ ID NO: 843668 - RNA, 17 nt, Mycobacterium avium subsp. paratuberculosis
gcgggcucccucgucgc

SEQ ID NO: 843669 - RNA, 20 nt, Mycobacterium avium subsp. paratuberculosis
gcgggcuccgcacgaccuga

SEQ ID NO: 843670 - RNA, 18 nt, Mycobacterium avium subsp. paratuberculosis
gcgggcucgaacaacccg

SEQ ID NO: 843671 - RNA, 22 nt, Mycobacterium avium subsp. paratuberculosis
gcgggcucgaacaacccggccg

SEQ ID NO: 843672 - RNA, 23 nt, Mycobacterium avium subsp. paratuberculosis
gcgggcucgaacaacccggccgc

SEQ ID NO: 843673 - RNA, 12 nt, Mycobacterium avium subsp. paratuberculosis
gcgggcucgccg

SEQ ID NO: 843674 - RNA, 14 nt, Mycobacterium avium subsp. paratuberculosis
gcgggcucgccggc

SEQ ID NO: 843675 - RNA, 15 nt, Mycobacterium avium subsp. paratuberculosis
gcgggcucgccggcc

SEQ ID NO: 843676 - RNA, 19 nt, Mycobacterium avium subsp. paratuberculosis
gcgggcucgccggcccgac

SEQ ID NO: 843677 - RNA, 21 nt, Mycobacterium avium subsp. paratuberculosis
gcgggcucgcgcuggcggcca

SEQ ID NO: 843678 - RNA, 24 nt, Mycobacterium avium subsp. paratuberculosis
gcgggcucgcgcuggcggccaucg

SEQ ID NO: 843679 - RNA, 20 nt, Mycobacterium avium subsp. paratuberculosis
gcgggcucgcggccugcggg

SEQ ID NO: 843680 - RNA, 19 nt, Mycobacterium avium subsp. paratuberculosis
gcgggcucggaguugcgca

SEQ ID NO: 843681 - RNA, 13 nt, Mycobacterium avium subsp. paratuberculosis
gcgggcugacguc

SEQ ID NO: 843682 - RNA, 15 nt, Mycobacterium avium subsp. paratuberculosis
gcgggcugacgucga

SEQ ID NO: 843683 - RNA, 17 nt, Mycobacterium avium subsp. paratuberculosis
gcgggcguccucgucgg

SEQ ID NO: 843684 - RNA, 19 nt, Mycobacterium avium subsp. paratuberculosis
gcgggcguccucgucggcg

SEQ ID NO: 843685 - RNA, 20 nt, Mycobacterium avium subsp. paratuberculosis
gcgggcguccucgucggcga

SEQ ID NO: 843686 - RNA, 20 nt, Mycobacterium avium subsp. paratuberculosis
gcgggcguccuugaccagcu

SEQ ID NO: 843687 - RNA, 14 nt, Mycobacterium avium subsp. paratuberculosis
gcgggcggucgcgc

SEQ ID NO: 843688 - RNA, 14 nt, Mycobacterium avium subsp. paratuberculosis
gcgggcguccacga

SEQ ID NO: 843689 - RNA, 23 nt, Mycobacterium avium subsp. paratuberculosis
gcgggcguggcggucggugcgca

SEQ ID NO: 843690 - RNA, 12 nt, Mycobacterium avium subsp. paratuberculosis
gcggcagcagcu

SEQ ID NO: 843691 - RNA, 17 nt, Mycobacterium avium subsp. paratuberculosis
gcggcagauagaucagc

SEQ ID NO: 843692 - RNA, 12 nt, Mycobacterium avium subsp. paratuberculosis
gcggcagcagca

SEQ ID NO: 843693 - RNA, 18 nt, Mycobacterium avium subsp. paratuberculosis
gcggcagcagcaccagcg

SEQ ID NO: 843694 - RNA, 20 nt, Mycobacterium avium subsp. paratuberculosis
gcggcagauggucucgaucu

SEQ ID NO: 843695 - RNA, 16 nt, Mycobacterium avium subsp. paratuberculosis
gcggcacgccgcucgu

SEQ ID NO: 843696 - RNA, 22 nt, Mycobacterium avium subsp. paratuberculosis
gcggcacgccgcucgucgggca

SEQ ID NO: 843697 - RNA, 17 nt, Mycobacterium avium subsp. paratuberculosis
gcggcagaccguccggu

SEQ ID NO: 843698 - RNA, 22 nt, Mycobacterium avium subsp. paratuberculosis
gcggcagaccguccgguucggc

SEQ ID NO: 843699 - RNA, 23 nt, Mycobacterium avium subsp. paratuberculosis
gcggcagaccguccgguucggcg

SEQ ID NO: 843700 - RNA, 24 nt, Mycobacterium avium subsp. paratuberculosis
gcggcagaccguccgguucggcgg

SEQ ID NO: 843701 - RNA, 12 nt, Mycobacterium avium subsp. paratuberculosis
gcggcacgccga

SEQ ID NO: 843702 - RNA, 18 nt, Mycobacterium avium subsp. paratuberculosis
gcggcacgccgaccaccc

SEQ ID NO: 843703 - RNA, 15 nt, Mycobacterium avium subsp. paratuberculosis
gcggcacgauggacg

SEQ ID NO: 843704 - RNA, 21 nt, Mycobacterium avium subsp. paratuberculosis
gcggcacgauggacgcccaac

SEQ ID NO: 843705 - RNA, 14 nt, Mycobacterium avium subsp. paratuberculosis
gcggcacgaucggc

SEQ ID NO: 843706 - RNA, 17 nt, Mycobacterium avium subsp. paratuberculosis
gcggcacgaucggcagc

SEQ ID NO: 843707 - RNA, 19 nt, Mycobacterium avium subsp. paratuberculosis
gcggcacgaucggcagcgc

SEQ ID NO: 843708 - RNA, 21 nt, Mycobacterium avium subsp. paratuberculosis
gcggcacgaucggcagcgcca

SEQ ID NO: 843709 - RNA, 16 nt, Mycobacterium avium subsp. paratuberculosis
gcggcacgaaguuggu

SEQ ID NO: 843710 - RNA, 20 nt, Mycobacterium avium subsp. paratuberculosis
gcggcaccucggccuugacc

SEQ ID NO: 843711 - RNA, 12 nt, Mycobacterium avium subsp. paratuberculosis
gcggcaccacgc

SEQ ID NO: 843712 - RNA, 15 nt, Mycobacterium avium subsp. paratuberculosis
gcggcacaccgcgcg

SEQ ID NO: 843713 - RNA, 16 nt, Mycobacterium avium subsp. paratuberculosis
gcggcacaccgcgcga

SEQ ID NO: 843714 - RNA, 20 nt, Mycobacterium avium subsp. paratuberculosis
gcggcacaggcgaaucggcg

SEQ ID NO: 843715 - RNA, 22 nt, Mycobacterium avium subsp. paratuberculosis
gcggcacaggcgaaucggcgca

SEQ ID NO: 843716 - RNA, 18 nt, Mycobacterium avium subsp. paratuberculosis
gcggcaccagguaccggc

SEQ ID NO: 843717 - RNA, 19 nt, Mycobacterium avium subsp. paratuberculosis
gcggcaccagguaccggcg

SEQ ID NO: 843718 - RNA, 20 nt, Mycobacterium avium subsp. paratuberculosis
gcggcaccagguaccggcgg

SEQ ID NO: 843719 - RNA, 21 nt, Mycobacterium avium subsp. paratuberculosis
gcggcaccagguaccggcggg

SEQ ID NO: 843720 - RNA, 23 nt, Mycobacterium avium subsp. paratuberculosis
gcggcaccagguaccggcgggcg

SEQ ID NO: 843721 - RNA, 15 nt, Mycobacterium avium subsp. paratuberculosis
gcggcaccagucgcg

SEQ ID NO: 843722 - RNA, 23 nt, Mycobacterium avium subsp. paratuberculosis
gcggcaccagucgcgcagcguca

SEQ ID NO: 843723 - RNA, 13 nt, Mycobacterium avium subsp. paratuberculosis
gcggcacccgguc

SEQ ID NO: 843724 - RNA, 16 nt, Mycobacterium avium subsp. paratuberculosis
gcggcacccgguccgg

SEQ ID NO: 843725 - RNA, 20 nt, Mycobacterium avium subsp. paratuberculosis
gcggcacccgguccggcccg

SEQ ID NO: 843726 - RNA, 22 nt, Mycobacterium avium subsp. paratuberculosis
gcggcacccgguccggcccggg

SEQ ID NO: 843727 - RNA, 12 nt, Mycobacterium avium subsp. paratuberculosis
gcggcaccgcgg

SEQ ID NO: 843728 - RNA, 14 nt, Mycobacterium avium subsp. paratuberculosis
gcggcaccgcggcu

SEQ ID NO: 843729 - RNA, 17 nt, Mycobacterium avium subsp. paratuberculosis
gcggcaccgcggcucgg

SEQ ID NO: 843730 - RNA, 23 nt, Mycobacterium avium subsp. paratuberculosis
gcggcaccgccgcgguggguccg

SEQ ID NO: 843731 - RNA, 19 nt, Mycobacterium avium subsp. paratuberculosis
gcggcaccgcugccggccg

SEQ ID NO: 843732 - RNA, 20 nt, Mycobacterium avium subsp. paratuberculosis
gcggcaccgcugccggccga

SEQ ID NO: 843733 - RNA, 12 nt, Mycobacterium avium subsp. paratuberculosis
gcggcaccggcg

SEQ ID NO: 843734 - RNA, 14 nt, Mycobacterium avium subsp. paratuberculosis
gcggcaccggcgaa

SEQ ID NO: 843735 - RNA, 16 nt, Mycobacterium avium subsp. paratuberculosis
gcggcaccgucaccga

SEQ ID NO: 843736 - RNA, 16 nt, Mycobacterium avium subsp. paratuberculosis
gcggcaccgaucggca

SEQ ID NO: 843737 - RNA, 17 nt, Mycobacterium avium subsp. paratuberculosis
gcggcaccgaucggcac

SEQ ID NO: 843738 - RNA, 19 nt, Mycobacterium avium subsp. paratuberculosis
gcggcaccgaucggcacgu

SEQ ID NO: 843739 - RNA, 15 nt, Mycobacterium avium subsp. paratuberculosis
gcggcaccgccaucg

SEQ ID NO: 843740 - RNA, 12 nt, Mycobacterium avium subsp. paratuberculosis
gcggcaccgccc

SEQ ID NO: 843741 - RNA, 15 nt, Mycobacterium avium subsp. paratuberculosis
gcggcaccgcccggg

SEQ ID NO: 843742 - RNA, 22 nt, Mycobacterium avium subsp. paratuberculosis
gcggcaccgcccggguugucga

SEQ ID NO: 843743 - RNA, 14 nt, Mycobacterium avium subsp. paratuberculosis
gcggcagggccagc

SEQ ID NO: 843744 - RNA, 18 nt, Mycobacterium avium subsp. paratuberculosis
gcggcagggccagcacca

SEQ ID NO: 843745 - RNA, 15 nt, Mycobacterium avium subsp. paratuberculosis
gcggcagggccaggc

SEQ ID NO: 843746 - RNA, 23 nt, Mycobacterium avium subsp. paratuberculosis
gcggcagggccaggccgugaucg

SEQ ID NO: 843747 - RNA, 14 nt, Mycobacterium avium subsp. paratuberculosis
gcggcagcgucgcc

SEQ ID NO: 843748 - RNA, 17 nt, Mycobacterium avium subsp. paratuberculosis
gcggcagcgucgccagc

SEQ ID NO: 843749 - RNA, 16 nt, Mycobacterium avium subsp. paratuberculosis
gcggcagcggcgucgu

SEQ ID NO: 843750 - RNA, 18 nt, Mycobacterium avium subsp. paratuberculosis
gcggcagcggcgucgucg

SEQ ID NO: 843751 - RNA, 13 nt, Mycobacterium avium subsp. paratuberculosis
gcggcagccgggc

SEQ ID NO: 843752 - RNA, 15 nt, Mycobacterium avium subsp. paratuberculosis
gcggcagccgggcga

SEQ ID NO: 843753 - RNA, 18 nt, Mycobacterium avium subsp. paratuberculosis
gcggcagccgggcgauca

SEQ ID NO: 843754 - RNA, 12 nt, Mycobacterium avium subsp. paratuberculosis
gcggcagcgcgg

SEQ ID NO: 843755 - RNA, 14 nt, Mycobacterium avium subsp. paratuberculosis
gcggcagcgcggcg

SEQ ID NO: 843756 - RNA, 16 nt, Mycobacterium avium subsp. paratuberculosis
gcggcagcgcggcguu

SEQ ID NO: 843757 - RNA, 13 nt, Mycobacterium avium subsp. paratuberculosis
gcggcagcgccag

SEQ ID NO: 843758 - RNA, 19 nt, Mycobacterium avium subsp. paratuberculosis
gcggcagccuuuccacauc

SEQ ID NO: 843759 - RNA, 18 nt, Mycobacterium avium subsp. paratuberculosis
gcggcagcgaacugccgg

SEQ ID NO: 843760 - RNA, 23 nt, Mycobacterium avium subsp. paratuberculosis
gcggcagcgaacugccggcauag

SEQ ID NO: 843761 - RNA, 23 nt, Mycobacterium avium subsp. paratuberculosis
gcggcagcgacagcgcgucggcc

SEQ ID NO: 843762 - RNA, 21 nt, Mycobacterium avium subsp. paratuberculosis
gcggcagcgaggcgcgcaggu

SEQ ID NO: 843763 - RNA, 17 nt, Mycobacterium avium subsp. paratuberculosis
gcggcaucgucaccucg

SEQ ID NO: 843764 - RNA, 13 nt, Mycobacterium avium subsp. paratuberculosis
gcggcaucgucgg

SEQ ID NO: 843765 - RNA, 14 nt, Mycobacterium avium subsp. paratuberculosis
gcggcaucgucggg

SEQ ID NO: 843766 - RNA, 18 nt, Mycobacterium avium subsp. paratuberculosis
gcggcaucggcgacggcg

SEQ ID NO: 843767 - RNA, 13 nt, Mycobacterium avium subsp. paratuberculosis
gcggcaguccgcc

SEQ ID NO: 843768 - RNA, 15 nt, Mycobacterium avium subsp. paratuberculosis
gcggcaguccgccgg

SEQ ID NO: 843769 - RNA, 13 nt, Mycobacterium avium subsp. paratuberculosis
gcggcaguccggc

SEQ ID NO: 843770 - RNA, 15 nt, Mycobacterium avium subsp. paratuberculosis
gcggcaguccggcga

SEQ ID NO: 843771 - RNA, 16 nt, Mycobacterium avium subsp. paratuberculosis
gcggcaucgcgccgca

SEQ ID NO: 843772 - RNA, 19 nt, Mycobacterium avium subsp. paratuberculosis
gcggcaucgcgccgcauga

SEQ ID NO: 843773 - RNA, 18 nt, Mycobacterium avium subsp. paratuberculosis
gcggcaucgcgcgcggcg

SEQ ID NO: 843774 - RNA, 22 nt, Mycobacterium avium subsp. paratuberculosis
gcggcagguuggggacggcgag

SEQ ID NO: 843775 - RNA, 19 nt, Mycobacterium avium subsp. paratuberculosis
gcggcagguggggcagcac

SEQ ID NO: 843776 - RNA, 21 nt, Mycobacterium avium subsp. paratuberculosis
gcggcagguggggcagcaccu

SEQ ID NO: 843777 - RNA, 12 nt, Mycobacterium avium subsp. paratuberculosis
gcggcagguggu

SEQ ID NO: 843778 - RNA, 17 nt, Mycobacterium avium subsp. paratuberculosis
gcggcagguggucggug

SEQ ID NO: 843779 - RNA, 22 nt, Mycobacterium avium subsp. paratuberculosis
gcggcagguggauugucggccg

SEQ ID NO: 843780 - RNA, 22 nt, Mycobacterium avium subsp. paratuberculosis
gcggcagguaggcgccgcucga

SEQ ID NO: 843781 - RNA, 20 nt, Mycobacterium avium subsp. paratuberculosis
gcggcaggucggccagcgcc

SEQ ID NO: 843782 - RNA, 14 nt, Mycobacterium avium subsp. paratuberculosis
gcggcaggucggcg

SEQ ID NO: 843783 - RNA, 16 nt, Mycobacterium avium subsp. paratuberculosis
gcggcaggucggcggg

SEQ ID NO: 843784 - RNA, 20 nt, Mycobacterium avium subsp. paratuberculosis
gcggcaggucggcgggagcc

SEQ ID NO: 843785 - RNA, 23 nt, Mycobacterium avium subsp. paratuberculosis
gcggcaggucggcgggagccggc

SEQ ID NO: 843786 - RNA, 15 nt, Mycobacterium avium subsp. paratuberculosis
gcggcaggucgucgu

SEQ ID NO: 843787 - RNA, 17 nt, Mycobacterium avium subsp. paratuberculosis
gcggcaggucgucgucg

SEQ ID NO: 843788 - RNA, 21 nt, Mycobacterium avium subsp. paratuberculosis
gcggcaggucgucgucgccgc

SEQ ID NO: 843789 - RNA, 19 nt, Mycobacterium avium subsp. paratuberculosis
aagccgucgaccccgccgg

SEQ ID NO: 843790 - RNA, 22 nt, Mycobacterium avium subsp. paratuberculosis
aagccggucuugggcucggcgc

SEQ ID NO: 843791 - RNA, 22 nt, Mycobacterium avium subsp. paratuberculosis
aagccguagacggucagguucu

SEQ ID NO: 843792 - RNA, 16 nt, Mycobacterium avium subsp. paratuberculosis
aagccgugacccgccg

SEQ ID NO: 843793 - RNA, 18 nt, Mycobacterium avium subsp. paratuberculosis
aagccguucgcgccgaga

SEQ ID NO: 843794 - RNA, 18 nt, Mycobacterium avium subsp. paratuberculosis
aagccguugccgccgcgc

SEQ ID NO: 843795 - RNA, 21 nt, Mycobacterium avium subsp. paratuberculosis
aagccguugccgccgcgcgcg

SEQ ID NO: 843796 - RNA, 16 nt, Mycobacterium avium subsp. paratuberculosis
gcggcaaugccguugg

SEQ ID NO: 843797 - RNA, 15 nt, Mycobacterium avium subsp. paratuberculosis
gcggcacaccagcgu

SEQ ID NO: 843798 - RNA, 13 nt, Mycobacterium avium subsp. paratuberculosis
gcggcaccaaccc

SEQ ID NO: 843799 - RNA, 20 nt, Mycobacterium avium subsp. paratuberculosis
gcggcaccaacccgaucggc

SEQ ID NO: 843800 - RNA, 21 nt, Mycobacterium avium subsp. paratuberculosis
gcggcaccaacccgaucggcc

SEQ ID NO: 843801 - RNA, 15 nt, Mycobacterium avium subsp. paratuberculosis
gcggcaccaccagcg

SEQ ID NO: 843802 - RNA, 15 nt, Mycobacterium avium subsp. paratuberculosis
gcggcaccacccgcg

SEQ ID NO: 843803 - RNA, 19 nt, Mycobacterium avium subsp. paratuberculosis
gcggcaccacccgcggccg

SEQ ID NO: 843804 - RNA, 14 nt, Mycobacterium avium subsp. paratuberculosis
gcggcaccacccgg

SEQ ID NO: 843805 - RNA, 15 nt, Mycobacterium avium subsp. paratuberculosis
gcggcaccacccggu

SEQ ID NO: 843806 - RNA, 21 nt, Mycobacterium avium subsp. paratuberculosis
aagccgaucgcggcgaucagc

SEQ ID NO: 843807 - RNA, 17 nt, Mycobacterium avium subsp. paratuberculosis
aagccgaucaccggcgc

SEQ ID NO: 843808 - RNA, 17 nt, Mycobacterium avium subsp. paratuberculosis
aagccgagcuugggccg

SEQ ID NO: 843809 - RNA, 23 nt, Mycobacterium avium subsp. paratuberculosis
aagccgaggucgcggcggccggc

SEQ ID NO: 843810 - RNA, 13 nt, Mycobacterium avium subsp. paratuberculosis
aagccgcgaucgg

SEQ ID NO: 843811 - RNA, 14 nt, Mycobacterium avium subsp. paratuberculosis
aagccggcgacgac

SEQ ID NO: 843812 - RNA, 16 nt, Mycobacterium avium subsp. paratuberculosis
aagccggcgacgaccg

SEQ ID NO: 843813 - RNA, 14 nt, Mycobacterium avium subsp. paratuberculosis
aagccggagaaggc

SEQ ID NO: 843814 - RNA, 14 nt, Mycobacterium avium subsp. paratuberculosis
aagccggcgucgau

SEQ ID NO: 843815 - RNA, 23 nt, Mycobacterium avium subsp. paratuberculosis
aagccggcgucgaugaugccggc

SEQ ID NO: 843816 - RNA, 14 nt, Mycobacterium avium subsp. paratuberculosis
gcggcaaccagcuc

SEQ ID NO: 843817 - RNA, 22 nt, Mycobacterium avium subsp. paratuberculosis
gcggcaaccagcuccggcaacg

SEQ ID NO: 843818 - RNA, 17 nt, Mycobacterium avium subsp. paratuberculosis
gcggcaacccgaucgcc

SEQ ID NO: 843819 - RNA, 19 nt, Mycobacterium avium subsp. paratuberculosis
gcggcaacccgaucgccga

SEQ ID NO: 843820 - RNA, 14 nt, Mycobacterium avium subsp. paratuberculosis
gcggcaacgccagc

SEQ ID NO: 843821 - RNA, 16 nt, Mycobacterium avium subsp. paratuberculosis
gcggcaacgccagcca

SEQ ID NO: 843822 - RNA, 17 nt, Mycobacterium avium subsp. paratuberculosis
gcggcaacgccagccag

SEQ ID NO: 843823 - RNA, 19 nt, Mycobacterium avium subsp. paratuberculosis
gcggcaacggguugcgaaa

SEQ ID NO: 843824 - RNA, 20 nt, Mycobacterium avium subsp. paratuberculosis
gcggcaacugggcggccugc

SEQ ID NO: 843825 - RNA, 21 nt, Mycobacterium avium subsp. paratuberculosis
gcggcaagcccuuuggcggcc

SEQ ID NO: 843826 - RNA, 22 nt, Mycobacterium avium subsp. paratuberculosis
gcggcaaggcguuccaucugcu

SEQ ID NO: 843827 - RNA, 18 nt, Mycobacterium avium subsp. paratuberculosis
gcggauuaccgugacggc

SEQ ID NO: 843828 - RNA, 23 nt, Mycobacterium avium subsp. paratuberculosis
gcggauuaccgugacggcaucgg

SEQ ID NO: 843829 - RNA, 15 nt, Mycobacterium avium subsp. paratuberculosis
gcggauuccagcgcg

SEQ ID NO: 843830 - RNA, 19 nt, Mycobacterium avium subsp. paratuberculosis
gcggauuccagcgcgaccg

SEQ ID NO: 843831 - RNA, 16 nt, Mycobacterium avium subsp. paratuberculosis
gcggauuccagcgcgu

SEQ ID NO: 843832 - RNA, 15 nt, Mycobacterium avium subsp. paratuberculosis
gcggauuccggcauc

SEQ ID NO: 843833 - RNA, 18 nt, Mycobacterium avium subsp. paratuberculosis
gcggauuccggcaucggc

SEQ ID NO: 843834 - RNA, 12 nt, Mycobacterium avium subsp. paratuberculosis
gcggauugacca

SEQ ID NO: 843835 - RNA, 15 nt, Mycobacterium avium subsp. paratuberculosis
gcggauugaccagca

SEQ ID NO: 843836 - RNA, 18 nt, Mycobacterium avium subsp. paratuberculosis
gcggauuggucgggcaca

SEQ ID NO: 843837 - RNA, 18 nt, Mycobacterium avium subsp. paratuberculosis
gcggauuucucagcggcg

SEQ ID NO: 843838 - RNA, 17 nt, Mycobacterium avium subsp. paratuberculosis
gcggcaaaacgcugggc

SEQ ID NO: 843839 - RNA, 18 nt, Mycobacterium avium subsp. paratuberculosis
gcggcaaagcguugccgc

SEQ ID NO: 843840 - RNA, 18 nt, Mycobacterium avium subsp. paratuberculosis
gcggcaacacgccggcgg

SEQ ID NO: 843841 - RNA, 19 nt, Mycobacterium avium subsp. paratuberculosis
gcggcaacacgccggcggc

SEQ ID NO: 843842 - RNA, 21 nt, Mycobacterium avium subsp. paratuberculosis
gcggcaacacgccggcggcca

SEQ ID NO: 843843 - RNA, 22 nt, Mycobacterium avium subsp. paratuberculosis
gcggcaacacgccggcggccac

SEQ ID NO: 843844 - RNA, 23 nt, Mycobacterium avium subsp. paratuberculosis
gcggcaacacgccggcggccacg

SEQ ID NO: 843845 - RNA, 15 nt, Mycobacterium avium subsp. paratuberculosis
gcggcaacagcacca

SEQ ID NO: 843846 - RNA, 17 nt, Mycobacterium avium subsp. paratuberculosis
gcggcaacagcaccagc

SEQ ID NO: 843847 - RNA, 23 nt, Mycobacterium avium subsp. paratuberculosis
gcggcaacagcaccagcaccacc

SEQ ID NO: 843848 - RNA, 15 nt, Mycobacterium avium subsp. paratuberculosis
gcggauaaccgucca

SEQ ID NO: 843849 - RNA, 17 nt, Mycobacterium avium subsp. paratuberculosis
gcggaguuuggacauca

SEQ ID NO: 843850 - RNA, 20 nt, Mycobacterium avium subsp. paratuberculosis
gcggaguuuggacaucacgu

SEQ ID NO: 843851 - RNA, 16 nt, Mycobacterium avium subsp. paratuberculosis
gcggagugaccgccag

SEQ ID NO: 843852 - RNA, 17 nt, Mycobacterium avium subsp. paratuberculosis
gcggagugaccgccagc

SEQ ID NO: 843853 - RNA, 18 nt, Mycobacterium avium subsp. paratuberculosis
gcggagugaccgccagca

SEQ ID NO: 843854 - RNA, 19 nt, Mycobacterium avium subsp. paratuberculosis
gcggagugaccgccagcac

SEQ ID NO: 843855 - RNA, 16 nt, Mycobacterium avium subsp. paratuberculosis
gcggauacgcccggcc

SEQ ID NO: 843856 - RNA, 17 nt, Mycobacterium avium subsp. paratuberculosis
gcggauagaggcggcgc

SEQ ID NO: 843857 - RNA, 17 nt, Mycobacterium avium subsp. paratuberculosis
gcggauagcccagcgug

SEQ ID NO: 843858 - RNA, 17 nt, Mycobacterium avium subsp. paratuberculosis
gcggaucaugcgcguca

SEQ ID NO: 843859 - RNA, 23 nt, Mycobacterium avium subsp. paratuberculosis
gcggaucaugcgcgucauggccg

SEQ ID NO: 843860 - RNA, 19 nt, Mycobacterium avium subsp. paratuberculosis
gcggaucaggucggucacc

SEQ ID NO: 843861 - RNA, 17 nt, Mycobacterium avium subsp. paratuberculosis
gcggaucaguaccggcg

SEQ ID NO: 843862 - RNA, 19 nt, Mycobacterium avium subsp. paratuberculosis
gcggaucaguaccggcgau

SEQ ID NO: 843863 - RNA, 16 nt, Mycobacterium avium subsp. paratuberculosis
gcggaucagcaccgac

SEQ ID NO: 843864 - RNA, 18 nt, Mycobacterium avium subsp. paratuberculosis
gcggaucagcaccgacgc

SEQ ID NO: 843865 - RNA, 19 nt, Mycobacterium avium subsp. paratuberculosis
gcggaucagcaccgacgcg

SEQ ID NO: 843866 - RNA, 20 nt, Mycobacterium avium subsp. paratuberculosis
gcggaucagcaccgacgcgg

SEQ ID NO: 843867 - RNA, 23 nt, Mycobacterium avium subsp. paratuberculosis
gcggaucagcaccgacgcggcga

SEQ ID NO: 843868 - RNA, 23 nt, Mycobacterium avium subsp. paratuberculosis
gcggauccucaguccgccccgau

SEQ ID NO: 843869 - RNA, 17 nt, Mycobacterium avium subsp. paratuberculosis
gcggaucgaacagggcg

SEQ ID NO: 843870 - RNA, 21 nt, Mycobacterium avium subsp. paratuberculosis
gcggaucgaacagggcggcgg

SEQ ID NO: 843871 - RNA, 14 nt, Mycobacterium avium subsp. paratuberculosis
gcggauccagcacc

SEQ ID NO: 843872 - RNA, 16 nt, Mycobacterium avium subsp. paratuberculosis
gcggauccagcaccgc

SEQ ID NO: 843873 - RNA, 20 nt, Mycobacterium avium subsp. paratuberculosis
gcggauccagcaccgccacg

SEQ ID NO: 843874 - RNA, 22 nt, Mycobacterium avium subsp. paratuberculosis
gcggaucgagguagcgugcgcc

SEQ ID NO: 843875 - RNA, 23 nt, Mycobacterium avium subsp. paratuberculosis
gcggauccagguggggcacgggc

SEQ ID NO: 843876 - RNA, 15 nt, Mycobacterium avium subsp. paratuberculosis
gcggaucccgguucc

SEQ ID NO: 843877 - RNA, 23 nt, Mycobacterium avium subsp. paratuberculosis
gcggaucccgguucccgugcugg

SEQ ID NO: 843878 - RNA, 14 nt, Mycobacterium avium subsp. paratuberculosis
gcggauccgacgaa

SEQ ID NO: 843879 - RNA, 13 nt, Mycobacterium avium subsp. paratuberculosis
gcggauccgggcc

SEQ ID NO: 843880 - RNA, 14 nt, Mycobacterium avium subsp. paratuberculosis
gcggauccgggccg

SEQ ID NO: 843881 - RNA, 15 nt, Mycobacterium avium subsp. paratuberculosis
gcggauccgggccgc

SEQ ID NO: 843882 - RNA, 17 nt, Mycobacterium avium subsp. paratuberculosis
gcggauccgggccgccu

SEQ ID NO: 843883 - RNA, 17 nt, Mycobacterium avium subsp. paratuberculosis
gcggauccgggccggcg

SEQ ID NO: 843884 - RNA, 15 nt, Mycobacterium avium subsp. paratuberculosis
gcggaugucggugug

SEQ ID NO: 843885 - RNA, 23 nt, Mycobacterium avium subsp. paratuberculosis
gcggaugucgguguggaccgcgc

SEQ ID NO: 843886 - RNA, 15 nt, Mycobacterium avium subsp. paratuberculosis
gcggaugggugcggu

SEQ ID NO: 843887 - RNA, 15 nt, Mycobacterium avium subsp. paratuberculosis
gcggauggcgacggc

SEQ ID NO: 843888 - RNA, 15 nt, Mycobacterium avium subsp. paratuberculosis
gcggauggugacggc

SEQ ID NO: 843889 - RNA, 15 nt, Mycobacterium avium subsp. paratuberculosis
gcggauggccccggc

SEQ ID NO: 843890 - RNA, 16 nt, Mycobacterium avium subsp. paratuberculosis
gcggauggccccggcg

SEQ ID NO: 843891 - RNA, 17 nt, Mycobacterium avium subsp. paratuberculosis
gcggauggccccggcga

SEQ ID NO: 843892 - RNA, 21 nt, Mycobacterium avium subsp. paratuberculosis
gcggauggccccggcgagucu

SEQ ID NO: 843893 - RNA, 16 nt, Mycobacterium avium subsp. paratuberculosis
gcggauggccucggcg

SEQ ID NO: 843894 - RNA, 20 nt, Mycobacterium avium subsp. paratuberculosis
gcggauggccucggcgaugc

SEQ ID NO: 843895 - RNA, 15 nt, Mycobacterium avium subsp. paratuberculosis
gcggauggcgccguc

SEQ ID NO: 843896 - RNA, 17 nt, Mycobacterium avium subsp. paratuberculosis
gcggauggcgccgucga

SEQ ID NO: 843897 - RNA, 19 nt, Mycobacterium avium subsp. paratuberculosis
gcggaugaugguggccagu

SEQ ID NO: 843898 - RNA, 16 nt, Mycobacterium avium subsp. paratuberculosis
gcggaugcccaggccg

SEQ ID NO: 843899 - RNA, 17 nt, Mycobacterium avium subsp. paratuberculosis
gcggaugcccgccggcg

SEQ ID NO: 843900 - RNA, 18 nt, Mycobacterium avium subsp. paratuberculosis
gcggaugcccgccggcgu

SEQ ID NO: 843901 - RNA, 18 nt, Mycobacterium avium subsp. paratuberculosis
gcggaugacgggugcuca

SEQ ID NO: 843902 - RNA, 22 nt, Mycobacterium avium subsp. paratuberculosis
gcggaugacgugcaccaccgcg

SEQ ID NO: 843903 - RNA, 21 nt, Mycobacterium avium subsp. paratuberculosis
gcggaugaccaggucgccggc

SEQ ID NO: 843904 - RNA, 22 nt, Mycobacterium avium subsp. paratuberculosis
gcggaugaccaggucgccggcg

SEQ ID NO: 843905 - RNA, 18 nt, Mycobacterium avium subsp. paratuberculosis
gcggaugaagugcgccag

SEQ ID NO: 843906 - RNA, 19 nt, Mycobacterium avium subsp. paratuberculosis
gcggaugaagugcgccagc

SEQ ID NO: 843907 - RNA, 21 nt, Mycobacterium avium subsp. paratuberculosis
gcggaugaagugcgccagcga

SEQ ID NO: 843908 - RNA, 16 nt, Mycobacterium avium subsp. paratuberculosis
gcggaucggcgguccc

SEQ ID NO: 843909 - RNA, 22 nt, Mycobacterium avium subsp. paratuberculosis
gcggaucgggcguggcgucggu

SEQ ID NO: 843910 - RNA, 18 nt, Mycobacterium avium subsp. paratuberculosis
gcggaucgguggacgcgg

SEQ ID NO: 843911 - RNA, 16 nt, Mycobacterium avium subsp. paratuberculosis
gcggaucgucaccgac

SEQ ID NO: 843912 - RNA, 14 nt, Mycobacterium avium subsp. paratuberculosis
gcggaucggcccga

SEQ ID NO: 843913 - RNA, 20 nt, Mycobacterium avium subsp. paratuberculosis
gcggaucggcccgaucucgc

SEQ ID NO: 843914 - RNA, 14 nt, Mycobacterium avium subsp. paratuberculosis
gcggaucggcggcg

SEQ ID NO: 843915 - RNA, 19 nt, Mycobacterium avium subsp. paratuberculosis
gcggaucggcggcgacggc

SEQ ID NO: 843916 - RNA, 13 nt, Mycobacterium avium subsp. paratuberculosis
gcggaucggcggu

SEQ ID NO: 843917 - RNA, 14 nt, Mycobacterium avium subsp. paratuberculosis
gcggaucgcaucgg

SEQ ID NO: 843918 - RNA, 20 nt, Mycobacterium avium subsp. paratuberculosis
gcggaucgcgcugaccaggc

SEQ ID NO: 843919 - RNA, 20 nt, Mycobacterium avium subsp. paratuberculosis
gcggaucgcgggcgacccgc

SEQ ID NO: 843920 - RNA, 21 nt, Mycobacterium avium subsp. paratuberculosis
gcggaucgcgggcgacccgcu

SEQ ID NO: 843921 - RNA, 22 nt, Mycobacterium avium subsp. paratuberculosis
gcggaucgcgggcgacccgcug

SEQ ID NO: 843922 - RNA, 14 nt, Mycobacterium avium subsp. paratuberculosis
gcggaucucgucgg

SEQ ID NO: 843923 - RNA, 15 nt, Mycobacterium avium subsp. paratuberculosis
gcggaucucgucggg

SEQ ID NO: 843924 - RNA, 17 nt, Mycobacterium avium subsp. paratuberculosis
gcggaucucgucgggcc

SEQ ID NO: 843925 - RNA, 18 nt, Mycobacterium avium subsp. paratuberculosis
gcggaucucgucgggcca

SEQ ID NO: 843926 - RNA, 20 nt, Mycobacterium avium subsp. paratuberculosis
gcggaucuugguguccagcg

SEQ ID NO: 843927 - RNA, 15 nt, Mycobacterium avium subsp. paratuberculosis
gcggaucucggugcc

SEQ ID NO: 843928 - RNA, 16 nt, Mycobacterium avium subsp. paratuberculosis
gcggaucucgaccucg

SEQ ID NO: 843929 - RNA, 18 nt, Mycobacterium avium subsp. paratuberculosis
gcggaucucgaccucguc

SEQ ID NO: 843930 - RNA, 22 nt, Mycobacterium avium subsp. paratuberculosis
gcggaucucgaccucgucggcg

SEQ ID NO: 843931 - RNA, 15 nt, Mycobacterium avium subsp. paratuberculosis
gcggacccggucggc

SEQ ID NO: 843932 - RNA, 16 nt, Mycobacterium avium subsp. paratuberculosis
gcggacccggucggcc

SEQ ID NO: 843933 - RNA, 17 nt, Mycobacterium avium subsp. paratuberculosis
gcggacccggucggccg

SEQ ID NO: 843934 - RNA, 19 nt, Mycobacterium avium subsp. paratuberculosis
gcggacccggucggccgcg

SEQ ID NO: 843935 - RNA, 20 nt, Mycobacterium avium subsp. paratuberculosis
gcggacccagcuccucggcc

SEQ ID NO: 843936 - RNA, 16 nt, Mycobacterium avium subsp. paratuberculosis
gcggaccgcaccccca

SEQ ID NO: 843937 - RNA, 16 nt, Mycobacterium avium subsp. paratuberculosis
gcggacccuggccagc

SEQ ID NO: 843938 - RNA, 17 nt, Mycobacterium avium subsp. paratuberculosis
gcggacccuggccagca

SEQ ID NO: 843939 - RNA, 22 nt, Mycobacterium avium subsp. paratuberculosis
gcggacccuggccagcaccgcg

SEQ ID NO: 843940 - RNA, 13 nt, Mycobacterium avium subsp. paratuberculosis
gcggaccggcgau

SEQ ID NO: 843941 - RNA, 21 nt, Mycobacterium avium subsp. paratuberculosis
gcggaccggcgauuucggccg

SEQ ID NO: 843942 - RNA, 16 nt, Mycobacterium avium subsp. paratuberculosis
gcggacgauguccgcc

SEQ ID NO: 843943 - RNA, 17 nt, Mycobacterium avium subsp. paratuberculosis
gcggacgauguccgccg

SEQ ID NO: 843944 - RNA, 20 nt, Mycobacterium avium subsp. paratuberculosis
gcggacgauguccgccggcc

SEQ ID NO: 843945 - RNA, 22 nt, Mycobacterium avium subsp. paratuberculosis
gcggacgauguccgccggccgg

SEQ ID NO: 843946 - RNA, 23 nt, Mycobacterium avium subsp. paratuberculosis
gcggacgauguccgccggccggu

SEQ ID NO: 843947 - RNA, 19 nt, Mycobacterium avium subsp. paratuberculosis
gcggaccuuggugucggcg

SEQ ID NO: 843948 - RNA, 20 nt, Mycobacterium avium subsp. paratuberculosis
gcggaccuuggugucggcga

SEQ ID NO: 843949 - RNA, 18 nt, Mycobacterium avium subsp. paratuberculosis
gcggaccggcggccgcca

SEQ ID NO: 843950 - RNA, 18 nt, Mycobacterium avium subsp. paratuberculosis
gcggaccgucggugucga

SEQ ID NO: 843951 - RNA, 23 nt, Mycobacterium avium subsp. paratuberculosis
gcggaccgucggugucgaagacg

SEQ ID NO: 843952 - RNA, 18 nt, Mycobacterium avium subsp. paratuberculosis
gcggaccccagcgugacg

SEQ ID NO: 843953 - RNA, 23 nt, Mycobacterium avium subsp. paratuberculosis
gcggaccccagcgugacgucgac

SEQ ID NO: 843954 - RNA, 18 nt, Mycobacterium avium subsp. paratuberculosis
gcggacccgacggucggg

SEQ ID NO: 843955 - RNA, 20 nt, Mycobacterium avium subsp. paratuberculosis
gcggacccgacggucgggcc

SEQ ID NO: 843956 - RNA, 22 nt, Mycobacterium avium subsp. paratuberculosis
gcggacccgacggucgggccca

SEQ ID NO: 843957 - RNA, 23 nt, Mycobacterium avium subsp. paratuberculosis
gcggacccgacggucgggcccag

SEQ ID NO: 843958 - RNA, 18 nt, Mycobacterium avium subsp. paratuberculosis
gcggaccaccgcgugcga

SEQ ID NO: 843959 - RNA, 13 nt, Mycobacterium avium subsp. paratuberculosis
gcggacagggcgg

SEQ ID NO: 843960 - RNA, 16 nt, Mycobacterium avium subsp. paratuberculosis
gcggacagggcggcga

SEQ ID NO: 843961 - RNA, 19 nt, Mycobacterium avium subsp. paratuberculosis
gcggacaucgccucggcgu

SEQ ID NO: 843962 - RNA, 14 nt, Mycobacterium avium subsp. paratuberculosis
gcggacacggccgg

SEQ ID NO: 843963 - RNA, 15 nt, Mycobacterium avium subsp. paratuberculosis
gcggacagcacguug

SEQ ID NO: 843964 - RNA, 13 nt, Mycobacterium avium subsp. paratuberculosis
gcggacagcgcgg

SEQ ID NO: 843965 - RNA, 19 nt, Mycobacterium avium subsp. paratuberculosis
gcggacagcgcggugaugu

SEQ ID NO: 843966 - RNA, 16 nt, Mycobacterium avium subsp. paratuberculosis
gcggacagcucgccgg

SEQ ID NO: 843967 - RNA, 17 nt, Mycobacterium avium subsp. paratuberculosis
gcggacagcucgccggc

SEQ ID NO: 843968 - RNA, 20 nt, Mycobacterium avium subsp. paratuberculosis
gcggacagcucgccggccgc

SEQ ID NO: 843969 - RNA, 18 nt, Mycobacterium avium subsp. paratuberculosis
gcggacacgaacgacgcg

SEQ ID NO: 843970 - RNA, 19 nt, Mycobacterium avium subsp. paratuberculosis
gcggaguaggcgccgccgc

SEQ ID NO: 843971 - RNA, 13 nt, Mycobacterium avium subsp. paratuberculosis
gcggaggucagcg

SEQ ID NO: 843972 - RNA, 19 nt, Mycobacterium avium subsp. paratuberculosis
gcggaggucagcggcccga

SEQ ID NO: 843973 - RNA, 21 nt, Mycobacterium avium subsp. paratuberculosis
gcggaggucagcggcccgauc

SEQ ID NO: 843974 - RNA, 12 nt, Mycobacterium avium subsp. paratuberculosis
gcggaggccugc

SEQ ID NO: 843975 - RNA, 16 nt, Mycobacterium avium subsp. paratuberculosis
gcggaggcgagcagcc

SEQ ID NO: 843976 - RNA, 17 nt, Mycobacterium avium subsp. paratuberculosis
gcggaggcgagcagccg

SEQ ID NO: 843977 - RNA, 14 nt, Mycobacterium avium subsp. paratuberculosis
gcggagcgucgcga

SEQ ID NO: 843978 - RNA, 18 nt, Mycobacterium avium subsp. paratuberculosis
gcggaggaauucgccgac

SEQ ID NO: 843979 - RNA, 21 nt, Mycobacterium avium subsp. paratuberculosis
gcggaggaguuuuucggggug

SEQ ID NO: 843980 - RNA, 13 nt, Mycobacterium avium subsp. paratuberculosis
gcggaggaugccg

SEQ ID NO: 843981 - RNA, 15 nt, Mycobacterium avium subsp. paratuberculosis
gcggaggaugccggc

SEQ ID NO: 843982 - RNA, 15 nt, Mycobacterium avium subsp. paratuberculosis
gcggagcggcgguca

SEQ ID NO: 843983 - RNA, 18 nt, Mycobacterium avium subsp. paratuberculosis
gcggagcggcggucacga

SEQ ID NO: 843984 - RNA, 16 nt, Mycobacterium avium subsp. paratuberculosis
gcggagcgggucagcg

SEQ ID NO: 843985 - RNA, 17 nt, Mycobacterium avium subsp. paratuberculosis
gcggagcgggucagcgu

SEQ ID NO: 843986 - RNA, 20 nt, Mycobacterium avium subsp. paratuberculosis
gcggagaaggugucgcacug

SEQ ID NO: 843987 - RNA, 22 nt, Mycobacterium avium subsp. paratuberculosis
gcggagaaggugucgcacugcu

SEQ ID NO: 843988 - RNA, 20 nt, Mycobacterium avium subsp. paratuberculosis
gcggagaucaccccuggcgg

SEQ ID NO: 843989 - RNA, 22 nt, Mycobacterium avium subsp. paratuberculosis
gcggagaugcuggugacgccgc

SEQ ID NO: 843990 - RNA, 14 nt, Mycobacterium avium subsp. paratuberculosis
gcggagccggccgc

SEQ ID NO: 843991 - RNA, 20 nt, Mycobacterium avium subsp. paratuberculosis
gcggacggguugggcgccag

SEQ ID NO: 843992 - RNA, 16 nt, Mycobacterium avium subsp. paratuberculosis
gcggacgugauaucgg

SEQ ID NO: 843993 - RNA, 17 nt, Mycobacterium avium subsp. paratuberculosis
gcggacggucccgacgc

SEQ ID NO: 843994 - RNA, 12 nt, Mycobacterium avium subsp. paratuberculosis
gcggacggucgc

SEQ ID NO: 843995 - RNA, 14 nt, Mycobacterium avium subsp. paratuberculosis
gcggacggucgccg

SEQ ID NO: 843996 - RNA, 15 nt, Mycobacterium avium subsp. paratuberculosis
gcggacggucgccga

SEQ ID NO: 843997 - RNA, 19 nt, Mycobacterium avium subsp. paratuberculosis
gcggacggucgccgacgua

SEQ ID NO: 843998 - RNA, 23 nt, Mycobacterium avium subsp. paratuberculosis
gcggacuggcugagcagcacccg

SEQ ID NO: 843999 - RNA, 21 nt, Mycobacterium avium subsp. paratuberculosis
gcggacuggugggcgucgugg

SEQ ID NO: 844000 - RNA, 18 nt, Mycobacterium avium subsp. paratuberculosis
gcggacugcccgaccgcg

SEQ ID NO: 844001 - RNA, 14 nt, Mycobacterium avium subsp. paratuberculosis
gcggacucggcgaa

SEQ ID NO: 844002 - RNA, 16 nt, Mycobacterium avium subsp. paratuberculosis
gcggacgggccgcauc

SEQ ID NO: 844003 - RNA, 19 nt, Mycobacterium avium subsp. paratuberculosis
gcggacgggccgcauccgc

SEQ ID NO: 844004 - RNA, 17 nt, Mycobacterium avium subsp. paratuberculosis
gcggacgggaccacccg

SEQ ID NO: 844005 - RNA, 16 nt, Mycobacterium avium subsp. paratuberculosis
gcggaccugggugcgc

SEQ ID NO: 844006 - RNA, 17 nt, Mycobacterium avium subsp. paratuberculosis
gcggaccugggugcgcc

SEQ ID NO: 844007 - RNA, 16 nt, Mycobacterium avium subsp. paratuberculosis
gcggacgacggccagc

SEQ ID NO: 844008 - RNA, 18 nt, Mycobacterium avium subsp. paratuberculosis
gcggacgcggccagcgcc

SEQ ID NO: 844009 - RNA, 19 nt, Mycobacterium avium subsp. paratuberculosis
gcggacgcggccagcgccc

SEQ ID NO: 844010 - RNA, 15 nt, Mycobacterium avium subsp. paratuberculosis
gcggacggcaccgac

SEQ ID NO: 844011 - RNA, 16 nt, Mycobacterium avium subsp. paratuberculosis
gcggacggcaccgacg

SEQ ID NO: 844012 - RNA, 18 nt, Mycobacterium avium subsp. paratuberculosis
gcgcugcaaccgguccgc

SEQ ID NO: 844013 - RNA, 21 nt, Mycobacterium avium subsp. paratuberculosis
gcgcugcaaccgguccgccgu

SEQ ID NO: 844014 - RNA, 21 nt, Mycobacterium avium subsp. paratuberculosis
gcgcugaucgaguccucgcgg

SEQ ID NO: 844015 - RNA, 14 nt, Mycobacterium avium subsp. paratuberculosis
gcgcugaucgccgc

SEQ ID NO: 844016 - RNA, 14 nt, Mycobacterium avium subsp. paratuberculosis
gcgcugcagcagcc

SEQ ID NO: 844017 - RNA, 18 nt, Mycobacterium avium subsp. paratuberculosis
gcgcugcagcagcccgau

SEQ ID NO: 844018 - RNA, 21 nt, Mycobacterium avium subsp. paratuberculosis
gcgcugcagcagcccgaucac

SEQ ID NO: 844019 - RNA, 15 nt, Mycobacterium avium subsp. paratuberculosis
gcgcugcagcaucca

SEQ ID NO: 844020 - RNA, 21 nt, Mycobacterium avium subsp. paratuberculosis
gcgcugcaugccggugucggu

SEQ ID NO: 844021 - RNA, 17 nt, Mycobacterium avium subsp. paratuberculosis
gcgcugcauagucggcc

SEQ ID NO: 844022 - RNA, 19 nt, Mycobacterium avium subsp. paratuberculosis
gcgcugcauagucggcccg

SEQ ID NO: 844023 - RNA, 20 nt, Mycobacterium avium subsp. paratuberculosis
gcgcugcauagucggcccga

SEQ ID NO: 844024 - RNA, 17 nt, Mycobacterium avium subsp. paratuberculosis
gcgcugcaggcccgggu

SEQ ID NO: 844025 - RNA, 14 nt, Mycobacterium avium subsp. paratuberculosis
gcgcugcgcgccgc

SEQ ID NO: 844026 - RNA, 11 nt, Mycobacterium avium subsp. paratuberculosis
gcgcugcgcga

SEQ ID NO: 844027 - RNA, 16 nt, Mycobacterium avium subsp. paratuberculosis
gcgcugcgccgggugg

SEQ ID NO: 844028 - RNA, 12 nt, Mycobacterium avium subsp. paratuberculosis
gcgcugcgccgu

SEQ ID NO: 844029 - RNA, 17 nt, Mycobacterium avium subsp. paratuberculosis
gcgcugcccgugccgca

SEQ ID NO: 844030 - RNA, 12 nt, Mycobacterium avium subsp. paratuberculosis
gcgcugccgacg

SEQ ID NO: 844031 - RNA, 19 nt, Mycobacterium avium subsp. paratuberculosis
gcgcugccgacgaugucgg

SEQ ID NO: 844032 - RNA, 20 nt, Mycobacterium avium subsp. paratuberculosis
gcgcugccgacgaugucggc

SEQ ID NO: 844033 - RNA, 14 nt, Mycobacterium avium subsp. paratuberculosis
gcgcugcccgaugg

SEQ ID NO: 844034 - RNA, 16 nt, Mycobacterium avium subsp. paratuberculosis
gcgcugcccgauggug

SEQ ID NO: 844035 - RNA, 16 nt, Mycobacterium avium subsp. paratuberculosis
gcgcugcccgccgcgg

SEQ ID NO: 844036 - RNA, 13 nt, Mycobacterium avium subsp. paratuberculosis
gcgcugcccgcga

SEQ ID NO: 844037 - RNA, 15 nt, Mycobacterium avium subsp. paratuberculosis
gcgcugcccagcgcg

SEQ ID NO: 844038 - RNA, 17 nt, Mycobacterium avium subsp. paratuberculosis
gcgcugcccagcgcggu

SEQ ID NO: 844039 - RNA, 22 nt, Mycobacterium avium subsp. paratuberculosis
gcgcugcccagcgcggucgcca

SEQ ID NO: 844040 - RNA, 15 nt, Mycobacterium avium subsp. paratuberculosis
gcgcugccagggccg

SEQ ID NO: 844041 - RNA, 16 nt, Mycobacterium avium subsp. paratuberculosis
gcgcugccagggccgg

SEQ ID NO: 844042 - RNA, 19 nt, Mycobacterium avium subsp. paratuberculosis
gcgcugccagggccgggcg

SEQ ID NO: 844043 - RNA, 14 nt, Mycobacterium avium subsp. paratuberculosis
gcgcugccgagcac

SEQ ID NO: 844044 - RNA, 16 nt, Mycobacterium avium subsp. paratuberculosis
gcgcugccgagcaccu

SEQ ID NO: 844045 - RNA, 18 nt, Mycobacterium avium subsp. paratuberculosis
gcgcugccgagcaccucg

SEQ ID NO: 844046 - RNA, 22 nt, Mycobacterium avium subsp. paratuberculosis
gcgcugccgagcaccucgucgc

SEQ ID NO: 844047 - RNA, 14 nt, Mycobacterium avium subsp. paratuberculosis
gcgcugccgccggc

SEQ ID NO: 844048 - RNA, 16 nt, Mycobacterium avium subsp. paratuberculosis
gcgcugccgccggccu

SEQ ID NO: 844049 - RNA, 13 nt, Mycobacterium avium subsp. paratuberculosis
gcgcugccgcgcc

SEQ ID NO: 844050 - RNA, 22 nt, Mycobacterium avium subsp. paratuberculosis
gcgcugccgcgccccgagcagc

SEQ ID NO: 844051 - RNA, 17 nt, Mycobacterium avium subsp. paratuberculosis
gcgcugccggcgcaccc

SEQ ID NO: 844052 - RNA, 13 nt, Mycobacterium avium subsp. paratuberculosis
gcgcugccggugc

SEQ ID NO: 844053 - RNA, 20 nt, Mycobacterium avium subsp. paratuberculosis
gcgcugccggugcugcucga

SEQ ID NO: 844054 - RNA, 17 nt, Mycobacterium avium subsp. paratuberculosis
gcgcugcuugacccgcu

SEQ ID NO: 844055 - RNA, 15 nt, Mycobacterium avium subsp. paratuberculosis
gcgcugcgcgguggc

SEQ ID NO: 844056 - RNA, 14 nt, Mycobacterium avium subsp. paratuberculosis
gcgcugcggcgucg

SEQ ID NO: 844057 - RNA, 22 nt, Mycobacterium avium subsp. paratuberculosis
gcgcugcucggaggaaccgugc

SEQ ID NO: 844058 - RNA, 17 nt, Mycobacterium avium subsp. paratuberculosis
gcgcuggaucugcccga

SEQ ID NO: 844059 - RNA, 13 nt, Mycobacterium avium subsp. paratuberculosis
gcgcuggccagcg

SEQ ID NO: 844060 - RNA, 16 nt, Mycobacterium avium subsp. paratuberculosis
gcgcuggccagcgcga

SEQ ID NO: 844061 - RNA, 19 nt, Mycobacterium avium subsp. paratuberculosis
gcgcuggccagcgcgacgg

SEQ ID NO: 844062 - RNA, 14 nt, Mycobacterium avium subsp. paratuberculosis
gcgcuggccagcgc

SEQ ID NO: 844063 - RNA, 14 nt, Mycobacterium avium subsp. paratuberculosis
gcgcuggccagcgu

SEQ ID NO: 844064 - RNA, 17 nt, Mycobacterium avium subsp. paratuberculosis
gcgcuggcgauggugcc

SEQ ID NO: 844065 - RNA, 22 nt, Mycobacterium avium subsp. paratuberculosis
gcgcuggcgauggugccgaagc

SEQ ID NO: 844066 - RNA, 19 nt, Mycobacterium avium subsp. paratuberculosis
gcgcuggccguggccguga

SEQ ID NO: 844067 - RNA, 18 nt, Mycobacterium avium subsp. paratuberculosis
gcgcuggccgaucccggc

SEQ ID NO: 844068 - RNA, 13 nt, Mycobacterium avium subsp. paratuberculosis
gcgcuggcgaaca

SEQ ID NO: 844069 - RNA, 12 nt, Mycobacterium avium subsp. paratuberculosis
gcgcuggccgcg

SEQ ID NO: 844070 - RNA, 17 nt, Mycobacterium avium subsp. paratuberculosis
gcgcuggccgcggccag

SEQ ID NO: 844071 - RNA, 13 nt, Mycobacterium avium subsp. paratuberculosis
gcgcuggccggcc

SEQ ID NO: 844072 - RNA, 20 nt, Mycobacterium avium subsp. paratuberculosis
gcgcuggccggccaccagcg

SEQ ID NO: 844073 - RNA, 12 nt, Mycobacterium avium subsp. paratuberculosis
gcgcgcagucgc

SEQ ID NO: 844074 - RNA, 14 nt, Mycobacterium avium subsp. paratuberculosis
gcgcgcaucgccgu

SEQ ID NO: 844075 - RNA, 13 nt, Mycobacterium avium subsp. paratuberculosis
gcgcgcaucgccg

SEQ ID NO: 844076 - RNA, 22 nt, Mycobacterium avium subsp. paratuberculosis
gcgcgcaucaccgaggucaccg

SEQ ID NO: 844077 - RNA, 21 nt, Mycobacterium avium subsp. paratuberculosis
gcgcgcaucgcgggccaccgg

SEQ ID NO: 844078 - RNA, 20 nt, Mycobacterium avium subsp. paratuberculosis
gcgcgcaucgucgcggcgcu

SEQ ID NO: 844079 - RNA, 14 nt, Mycobacterium avium subsp. paratuberculosis
gcgcgcaucguggc

SEQ ID NO: 844080 - RNA, 18 nt, Mycobacterium avium subsp. paratuberculosis
gcgcgcaucucgaaugcg

SEQ ID NO: 844081 - RNA, 15 nt, Mycobacterium avium subsp. paratuberculosis
gcgcgcaucugcucg

SEQ ID NO: 844082 - RNA, 18 nt, Mycobacterium avium subsp. paratuberculosis
gcgcgcaucugcucggcg

SEQ ID NO: 844083 - RNA, 19 nt, Mycobacterium avium subsp. paratuberculosis
gcgcgcaucugcucggcgu

SEQ ID NO: 844084 - RNA, 18 nt, Mycobacterium avium subsp. paratuberculosis
gcgcucggccauccgggc

SEQ ID NO: 844085 - RNA, 20 nt, Mycobacterium avium subsp. paratuberculosis
gcgcucggccauccgggcgg

SEQ ID NO: 844086 - RNA, 17 nt, Mycobacterium avium subsp. paratuberculosis
gcgcucgcgggugcgcu

SEQ ID NO: 844087 - RNA, 12 nt, Mycobacterium avium subsp. paratuberculosis
gcgcgcaggucg

SEQ ID NO: 844088 - RNA, 15 nt, Mycobacterium avium subsp. paratuberculosis
gcgcgcaggaacguc

SEQ ID NO: 844089 - RNA, 12 nt, Mycobacterium avium subsp. paratuberculosis
gcgcgcaggcgc

SEQ ID NO: 844090 - RNA, 18 nt, Mycobacterium avium subsp. paratuberculosis
gcgcgcaggcgcaccacc

SEQ ID NO: 844091 - RNA, 20 nt, Mycobacterium avium subsp. paratuberculosis
gcgcgcaggcgcaccaccag

SEQ ID NO: 844092 - RNA, 17 nt, Mycobacterium avium subsp. paratuberculosis
gcgcgcaggcgcgcggc

SEQ ID NO: 844093 - RNA, 20 nt, Mycobacterium avium subsp. paratuberculosis
gcgcgcaggcgcgcggccag

SEQ ID NO: 844094 - RNA, 15 nt, Mycobacterium avium subsp. paratuberculosis
gcgcgcaggcgcuga

SEQ ID NO: 844095 - RNA, 12 nt, Mycobacterium avium subsp. paratuberculosis
gcgcgcaggcug

SEQ ID NO: 844096 - RNA, 12 nt, Mycobacterium avium subsp. paratuberculosis
gcgcgcagcucg

SEQ ID NO: 844097 - RNA, 16 nt, Mycobacterium avium subsp. paratuberculosis
gcgcgcagccggccgu

SEQ ID NO: 844098 - RNA, 14 nt, Mycobacterium avium subsp. paratuberculosis
gcgcgcagcaccag

SEQ ID NO: 844099 - RNA, 17 nt, Mycobacterium avium subsp. paratuberculosis
gcgcgcagccacgagcc

SEQ ID NO: 844100 - RNA, 19 nt, Mycobacterium avium subsp. paratuberculosis
gcgcgcagccacgagccca

SEQ ID NO: 844101 - RNA, 20 nt, Mycobacterium avium subsp. paratuberculosis
gcgcgcagccagucgccggc

SEQ ID NO: 844102 - RNA, 12 nt, Mycobacterium avium subsp. paratuberculosis
gcgcgcagccca

SEQ ID NO: 844103 - RNA, 15 nt, Mycobacterium avium subsp. paratuberculosis
gcgcgcagcccagcc

SEQ ID NO: 844104 - RNA, 23 nt, Mycobacterium avium subsp. paratuberculosis
gcgcgcacguuggcggccagcgc

SEQ ID NO: 844105 - RNA, 12 nt, Mycobacterium avium subsp. paratuberculosis
gcgcgcagaaca

SEQ ID NO: 844106 - RNA, 17 nt, Mycobacterium avium subsp. paratuberculosis
gcgcgcagaacaccacc

SEQ ID NO: 844107 - RNA, 21 nt, Mycobacterium avium subsp. paratuberculosis
gcgcgcagaacaccaccgcca

SEQ ID NO: 844108 - RNA, 14 nt, Mycobacterium avium subsp. paratuberculosis
gcgcgcacggcagc

SEQ ID NO: 844109 - RNA, 19 nt, Mycobacterium avium subsp. paratuberculosis
gcgcgcacggcagcccgac

SEQ ID NO: 844110 - RNA, 23 nt, Mycobacterium avium subsp. paratuberculosis
gcgcgcacggcagcccgacgucc

SEQ ID NO: 844111 - RNA, 17 nt, Mycobacterium avium subsp. paratuberculosis
gcgcgcacgcggacacg

SEQ ID NO: 844112 - RNA, 20 nt, Mycobacterium avium subsp. paratuberculosis
gcgcgcaccugaaccgcgca

SEQ ID NO: 844113 - RNA, 21 nt, Mycobacterium avium subsp. paratuberculosis
gcgcgcaccugaaccgcgcac

SEQ ID NO: 844114 - RNA, 16 nt, Mycobacterium avium subsp. paratuberculosis
gcgcucguccagggug

SEQ ID NO: 844115 - RNA, 20 nt, Mycobacterium avium subsp. paratuberculosis
gcgcucguccaggguggcca

SEQ ID NO: 844116 - RNA, 22 nt, Mycobacterium avium subsp. paratuberculosis
gcgcucguccaggguggccagc

SEQ ID NO: 844117 - RNA, 13 nt, Mycobacterium avium subsp. paratuberculosis
gcgcucgucgaug

SEQ ID NO: 844118 - RNA, 13 nt, Mycobacterium avium subsp. paratuberculosis
gcgcucggucagc

SEQ ID NO: 844119 - RNA, 20 nt, Mycobacterium avium subsp. paratuberculosis
gcgcucgucguagucgaggc

SEQ ID NO: 844120 - RNA, 22 nt, Mycobacterium avium subsp. paratuberculosis
gcgcucgucguagucgaggccg

SEQ ID NO: 844121 - RNA, 14 nt, Mycobacterium avium subsp. paratuberculosis
gcgcucgucgucgc

SEQ ID NO: 844122 - RNA, 17 nt, Mycobacterium avium subsp. paratuberculosis
gcgcucgucgucgguga

SEQ ID NO: 844123 - RNA, 16 nt, Mycobacterium avium subsp. paratuberculosis
gcgcucgugaccggcg

SEQ ID NO: 844124 - RNA, 17 nt, Mycobacterium avium subsp. paratuberculosis
gcgcucgggggugcccg

SEQ ID NO: 844125 - RNA, 19 nt, Mycobacterium avium subsp. paratuberculosis
gcgcucggucgcggcgauc

SEQ ID NO: 844126 - RNA, 21 nt, Mycobacterium avium subsp. paratuberculosis
gcgcucggucgcggcgaucgg

SEQ ID NO: 844127 - RNA, 17 nt, Mycobacterium avium subsp. paratuberculosis
gcgcucggcgaccgccg

SEQ ID NO: 844128 - RNA, 14 nt, Mycobacterium avium subsp. paratuberculosis
gcgcucggcgaccu

SEQ ID NO: 844129 - RNA, 21 nt, Mycobacterium avium subsp. paratuberculosis
gcgcucggcgaccugcggcuc

SEQ ID NO: 844130 - RNA, 18 nt, Mycobacterium avium subsp. paratuberculosis
gcgcucuguuggccgucg

SEQ ID NO: 844131 - RNA, 18 nt, Mycobacterium avium subsp. paratuberculosis
gcgcucuugggcggccgg

SEQ ID NO: 844132 - RNA, 23 nt, Mycobacterium avium subsp. paratuberculosis
gcgcugaccagcgugaccucgac

SEQ ID NO: 844133 - RNA, 17 nt, Mycobacterium avium subsp. paratuberculosis
gcgcugaccaggccguc

SEQ ID NO: 844134 - RNA, 22 nt, Mycobacterium avium subsp. paratuberculosis
gcgcugaccaggccguccacca

SEQ ID NO: 844135 - RNA, 14 nt, Mycobacterium avium subsp. paratuberculosis
gcgcugaagcgcga

SEQ ID NO: 844136 - RNA, 18 nt, Mycobacterium avium subsp. paratuberculosis
gcgcugaagugcagcgca

SEQ ID NO: 844137 - RNA, 21 nt, Mycobacterium avium subsp. paratuberculosis
gcgcugaagugcagcgcaugg

SEQ ID NO: 844138 - RNA, 16 nt, Mycobacterium avium subsp. paratuberculosis
gcgcugagcacggugg

SEQ ID NO: 844139 - RNA, 20 nt, Mycobacterium avium subsp. paratuberculosis
gcgcugagcacggugggcgc

SEQ ID NO: 844140 - RNA, 20 nt, Mycobacterium avium subsp. paratuberculosis
gcgcugagcagguccucgau

SEQ ID NO: 844141 - RNA, 22 nt, Mycobacterium avium subsp. paratuberculosis
gcgcugagcagguccucgaucg

SEQ ID NO: 844142 - RNA, 22 nt, Mycobacterium avium subsp. paratuberculosis
gcgcugagcgacauggucgggc

SEQ ID NO: 844143 - RNA, 23 nt, Mycobacterium avium subsp. paratuberculosis
gcgcugagcgacauggucgggcg

SEQ ID NO: 844144 - RNA, 14 nt, Mycobacterium avium subsp. paratuberculosis
gcgcugacccccgu

SEQ ID NO: 844145 - RNA, 19 nt, Mycobacterium avium subsp. paratuberculosis
gcggaaugcaggaucgcgg

SEQ ID NO: 844146 - RNA, 16 nt, Mycobacterium avium subsp. paratuberculosis
gcggaauuuucgccgu

SEQ ID NO: 844147 - RNA, 20 nt, Mycobacterium avium subsp. paratuberculosis
gcggaauuuucgccgucacu

SEQ ID NO: 844148 - RNA, 21 nt, Mycobacterium avium subsp. paratuberculosis
gcggaaucacuuccgcggcaa

SEQ ID NO: 844149 - RNA, 15 nt, Mycobacterium avium subsp. paratuberculosis
gcggaaucgcccggg

SEQ ID NO: 844150 - RNA, 12 nt, Mycobacterium avium subsp. paratuberculosis
gcggaagcgcgu

SEQ ID NO: 844151 - RNA, 13 nt, Mycobacterium avium subsp. paratuberculosis
gcggaagccccag

SEQ ID NO: 844152 - RNA, 15 nt, Mycobacterium avium subsp. paratuberculosis
gcggaagccccaggc

SEQ ID NO: 844153 - RNA, 20 nt, Mycobacterium avium subsp. paratuberculosis
gcggaagcucaucgaggucg

SEQ ID NO: 844154 - RNA, 15 nt, Mycobacterium avium subsp. paratuberculosis
gcggaaggccagcuc

SEQ ID NO: 844155 - RNA, 16 nt, Mycobacterium avium subsp. paratuberculosis
gcggaaguagcccgga

SEQ ID NO: 844156 - RNA, 13 nt, Mycobacterium avium subsp. paratuberculosis
gcggaacagccgg

SEQ ID NO: 844157 - RNA, 18 nt, Mycobacterium avium subsp. paratuberculosis
gcggaacccacgugcggc

SEQ ID NO: 844158 - RNA, 20 nt, Mycobacterium avium subsp. paratuberculosis
gcggaacccacgugcggcgc

SEQ ID NO: 844159 - RNA, 22 nt, Mycobacterium avium subsp. paratuberculosis
gcggaacccacgugcggcgccc

SEQ ID NO: 844160 - RNA, 23 nt, Mycobacterium avium subsp. paratuberculosis
gcggaacccacgugcggcgcccu

SEQ ID NO: 844161 - RNA, 16 nt, Mycobacterium avium subsp. paratuberculosis
gcggaacccggguggc

SEQ ID NO: 844162 - RNA, 19 nt, Mycobacterium avium subsp. paratuberculosis
gcggaacccggguggcccg

SEQ ID NO: 844163 - RNA, 22 nt, Mycobacterium avium subsp. paratuberculosis
gcggaacccguugcgcccuuga

SEQ ID NO: 844164 - RNA, 13 nt, Mycobacterium avium subsp. paratuberculosis
gcggaaccgacac

SEQ ID NO: 844165 - RNA, 14 nt, Mycobacterium avium subsp. paratuberculosis
gcggaaccggccgg

SEQ ID NO: 844166 - RNA, 14 nt, Mycobacterium avium subsp. paratuberculosis
gcggaaccgggccg

SEQ ID NO: 844167 - RNA, 15 nt, Mycobacterium avium subsp. paratuberculosis
gcggaaccgggccgc

SEQ ID NO: 844168 - RNA, 21 nt, Mycobacterium avium subsp. paratuberculosis
gcggaaccgggccgcuggccg

SEQ ID NO: 844169 - RNA, 20 nt, Mycobacterium avium subsp. paratuberculosis
gcggaaccguagaccaccuc

SEQ ID NO: 844170 - RNA, 23 nt, Mycobacterium avium subsp. paratuberculosis
gcggaacaccgccuugcccggcu

SEQ ID NO: 844171 - RNA, 15 nt, Mycobacterium avium subsp. paratuberculosis
gcggaacgcgccggg

SEQ ID NO: 844172 - RNA, 17 nt, Mycobacterium avium subsp. paratuberculosis
gcggaacggucggggcg

SEQ ID NO: 844173 - RNA, 16 nt, Mycobacterium avium subsp. paratuberculosis
gcggaacugcucccag

SEQ ID NO: 844174 - RNA, 23 nt, Mycobacterium avium subsp. paratuberculosis
gcggaacugcucccaggcgucgu

SEQ ID NO: 844175 - RNA, 16 nt, Mycobacterium avium subsp. paratuberculosis
gcgcuuugccgucccc

SEQ ID NO: 844176 - RNA, 22 nt, Mycobacterium avium subsp. paratuberculosis
gcgcuuucgaagugacgccgcu

SEQ ID NO: 844177 - RNA, 14 nt, Mycobacterium avium subsp. paratuberculosis
gcgcuuucgccgaa

SEQ ID NO: 844178 - RNA, 15 nt, Mycobacterium avium subsp. paratuberculosis
gcgcuuucgcugguc

SEQ ID NO: 844179 - RNA, 17 nt, Mycobacterium avium subsp. paratuberculosis
gcgcuuucgcuggucgc

SEQ ID NO: 844180 - RNA, 20 nt, Mycobacterium avium subsp. paratuberculosis
gcgcuuuggaccagggcggu

SEQ ID NO: 844181 - RNA, 19 nt, Mycobacterium avium subsp. paratuberculosis
gcggaaacgacgucgccac

SEQ ID NO: 844182 - RNA, 23 nt, Mycobacterium avium subsp. paratuberculosis
gcggaaacuccuggccccgauca

SEQ ID NO: 844183 - RNA, 19 nt, Mycobacterium avium subsp. paratuberculosis
gcgcuugcggcgcagccag

SEQ ID NO: 844184 - RNA, 22 nt, Mycobacterium avium subsp. paratuberculosis
gcgcuugcggcgcagccagcuc

SEQ ID NO: 844185 - RNA, 15 nt, Mycobacterium avium subsp. paratuberculosis
gcgcuugcgcucggu

SEQ ID NO: 844186 - RNA, 13 nt, Mycobacterium avium subsp. paratuberculosis
gcgcuugucggcg

SEQ ID NO: 844187 - RNA, 14 nt, Mycobacterium avium subsp. paratuberculosis
gcgcuugucggcgu

SEQ ID NO: 844188 - RNA, 18 nt, Mycobacterium avium subsp. paratuberculosis
gcgcuugucggcguggcc

SEQ ID NO: 844189 - RNA, 22 nt, Mycobacterium avium subsp. paratuberculosis
gcgcuugcguucccagcccggc

SEQ ID NO: 844190 - RNA, 16 nt, Mycobacterium avium subsp. paratuberculosis
gcgcuugggucgccgg

SEQ ID NO: 844191 - RNA, 17 nt, Mycobacterium avium subsp. paratuberculosis
gcgcuugucagcggccu

SEQ ID NO: 844192 - RNA, 18 nt, Mycobacterium avium subsp. paratuberculosis
gcgcuugcgaucgccgcg

SEQ ID NO: 844193 - RNA, 13 nt, Mycobacterium avium subsp. paratuberculosis
gcgcuugcgaccg

SEQ ID NO: 844194 - RNA, 15 nt, Mycobacterium avium subsp. paratuberculosis
gcgcuugcgaccgcc

SEQ ID NO: 844195 - RNA, 17 nt, Mycobacterium avium subsp. paratuberculosis
gcgcuugcgaccgccgc

SEQ ID NO: 844196 - RNA, 15 nt, Mycobacterium avium subsp. paratuberculosis
gcgcuugcgaucgcc

SEQ ID NO: 844197 - RNA, 15 nt, Mycobacterium avium subsp. paratuberculosis
gcgcuugccgcgacc

SEQ ID NO: 844198 - RNA, 19 nt, Mycobacterium avium subsp. paratuberculosis
gcgcuugccgcgacccggg

SEQ ID NO: 844199 - RNA, 22 nt, Mycobacterium avium subsp. paratuberculosis
gcgcuugacgaacgccaccacg

SEQ ID NO: 844200 - RNA, 21 nt, Mycobacterium avium subsp. paratuberculosis
gcgcuuaauacagcgcguugg

SEQ ID NO: 844201 - RNA, 14 nt, Mycobacterium avium subsp. paratuberculosis
gcgcuguucgggau

SEQ ID NO: 844202 - RNA, 16 nt, Mycobacterium avium subsp. paratuberculosis
gcgcuguggugacggc

SEQ ID NO: 844203 - RNA, 21 nt, Mycobacterium avium subsp. paratuberculosis
gcgcugugcgccauguccggc

SEQ ID NO: 844204 - RNA, 20 nt, Mycobacterium avium subsp. paratuberculosis
gcgcugucgcgggcccgcgu

SEQ ID NO: 844205 - RNA, 14 nt, Mycobacterium avium subsp. paratuberculosis
gcgcugucggcggg

SEQ ID NO: 844206 - RNA, 16 nt, Mycobacterium avium subsp. paratuberculosis
gcgcuguccuggucgc

SEQ ID NO: 844207 - RNA, 15 nt, Mycobacterium avium subsp. paratuberculosis
gcgcuguaggcggcg

SEQ ID NO: 844208 - RNA, 22 nt, Mycobacterium avium subsp. paratuberculosis
gcgcuucgcgcuguucgggauu

SEQ ID NO: 844209 - RNA, 16 nt, Mycobacterium avium subsp. paratuberculosis
gcgcuugacggccggg

SEQ ID NO: 844210 - RNA, 18 nt, Mycobacterium avium subsp. paratuberculosis
gcgcuugacggccgggcc

SEQ ID NO: 844211 - RNA, 18 nt, Mycobacterium avium subsp. paratuberculosis
gcgcugguaccgguugcc

SEQ ID NO: 844212 - RNA, 22 nt, Mycobacterium avium subsp. paratuberculosis
gcgcugguaccgguugcccggu

SEQ ID NO: 844213 - RNA, 20 nt, Mycobacterium avium subsp. paratuberculosis
gcgcuggucaacucgacccg

SEQ ID NO: 844214 - RNA, 22 nt, Mycobacterium avium subsp. paratuberculosis
gcgcugggugaacaccccgcgg

SEQ ID NO: 844215 - RNA, 16 nt, Mycobacterium avium subsp. paratuberculosis
gcgcugggugcgggcu

SEQ ID NO: 844216 - RNA, 17 nt, Mycobacterium avium subsp. paratuberculosis
gcgcugggugcgggcug

SEQ ID NO: 844217 - RNA, 22 nt, Mycobacterium avium subsp. paratuberculosis
gcgcuggguguuccccgggcga

SEQ ID NO: 844218 - RNA, 22 nt, Mycobacterium avium subsp. paratuberculosis
gcgcugggcuaacgcuggucga

SEQ ID NO: 844219 - RNA, 23 nt, Mycobacterium avium subsp. paratuberculosis
gcgcugggcuaacgcuggucgaa

SEQ ID NO: 844220 - RNA, 17 nt, Mycobacterium avium subsp. paratuberculosis
gcgcugguugucgacgc

SEQ ID NO: 844221 - RNA, 22 nt, Mycobacterium avium subsp. paratuberculosis
gcgcuggugcgggccagcacga

SEQ ID NO: 844222 - RNA, 16 nt, Mycobacterium avium subsp. paratuberculosis
gcgcuggugcugccga

SEQ ID NO: 844223 - RNA, 18 nt, Mycobacterium avium subsp. paratuberculosis
gcgcuggugcagcagggc

SEQ ID NO: 844224 - RNA, 11 nt, Mycobacterium avium subsp. paratuberculosis
gcgcuggucgg

SEQ ID NO: 844225 - RNA, 17 nt, Mycobacterium avium subsp. paratuberculosis
gcgcuggucggcgaacc

SEQ ID NO: 844226 - RNA, 14 nt, Mycobacterium avium subsp. paratuberculosis
gcgcuggucggcgg

SEQ ID NO: 844227 - RNA, 14 nt, Mycobacterium avium subsp. paratuberculosis
gcgcuggcgcgccg

SEQ ID NO: 844228 - RNA, 16 nt, Mycobacterium avium subsp. paratuberculosis
gcgcuggcgcgccgua

SEQ ID NO: 844229 - RNA, 16 nt, Mycobacterium avium subsp. paratuberculosis
gcgcugggagcgggcc

SEQ ID NO: 844230 - RNA, 13 nt, Mycobacterium avium subsp. paratuberculosis
gcucuucgacgac

SEQ ID NO: 844231 - RNA, 18 nt, Mycobacterium avium subsp. paratuberculosis
gcucuguuggccgucgcu

SEQ ID NO: 844232 - RNA, 21 nt, Mycobacterium avium subsp. paratuberculosis
gcucuuggugguggucgucga

SEQ ID NO: 844233 - RNA, 23 nt, Mycobacterium avium subsp. paratuberculosis
gcucuuggugguggucgucgacg

SEQ ID NO: 844234 - RNA, 20 nt, Mycobacterium avium subsp. paratuberculosis
gcugaacgcgauccaggugu

SEQ ID NO: 844235 - RNA, 12 nt, Mycobacterium avium subsp. paratuberculosis
gcugaacgcggu

SEQ ID NO: 844236 - RNA, 22 nt, Mycobacterium avium subsp. paratuberculosis
gcucuuggcgaccucguggucc

SEQ ID NO: 844237 - RNA, 15 nt, Mycobacterium avium subsp. paratuberculosis
gcucuugggcggccg

SEQ ID NO: 844238 - RNA, 16 nt, Mycobacterium avium subsp. paratuberculosis
gcucuugacggccgcg

SEQ ID NO: 844239 - RNA, 20 nt, Mycobacterium avium subsp. paratuberculosis
gcucuucggcgccgagcguc

SEQ ID NO: 844240 - RNA, 16 nt, Mycobacterium avium subsp. paratuberculosis
gcucuucggucaucgu

SEQ ID NO: 844241 - RNA, 16 nt, Mycobacterium avium subsp. paratuberculosis
gcucuucgcgcgcggc

SEQ ID NO: 844242 - RNA, 23 nt, Mycobacterium avium subsp. paratuberculosis
gcucugguuuuacacaccagcgg

SEQ ID NO: 844243 - RNA, 18 nt, Mycobacterium avium subsp. paratuberculosis
gcucuggccgaucuuguc

SEQ ID NO: 844244 - RNA, 15 nt, Mycobacterium avium subsp. paratuberculosis
gcucugcgcgcggug

SEQ ID NO: 844245 - RNA, 14 nt, Mycobacterium avium subsp. paratuberculosis
gcucgucgucgccg

SEQ ID NO: 844246 - RNA, 14 nt, Mycobacterium avium subsp. paratuberculosis
gcucgucgucggag

SEQ ID NO: 844247 - RNA, 17 nt, Mycobacterium avium subsp. paratuberculosis
gcucgugaccggcggug

SEQ ID NO: 844248 - RNA, 18 nt, Mycobacterium avium subsp. paratuberculosis
gcucgugaccggcggugu

SEQ ID NO: 844249 - RNA, 21 nt, Mycobacterium avium subsp. paratuberculosis
gcucgugaugguccagcaccg

SEQ ID NO: 844250 - RNA, 17 nt, Mycobacterium avium subsp. paratuberculosis
gcucgugcaaaccggac

SEQ ID NO: 844251 - RNA, 19 nt, Mycobacterium avium subsp. paratuberculosis
gcucgugcaaaccggaccg

SEQ ID NO: 844252 - RNA, 22 nt, Mycobacterium avium subsp. paratuberculosis
gcucgugcaaaccggaccgccg

SEQ ID NO: 844253 - RNA, 23 nt, Mycobacterium avium subsp. paratuberculosis
gcucgugcaaaccggaccgccgc

SEQ ID NO: 844254 - RNA, 13 nt, Mycobacterium avium subsp. paratuberculosis
gcucgugcagccg

SEQ ID NO: 844255 - RNA, 14 nt, Mycobacterium avium subsp. paratuberculosis
gcucgugcagccgg

SEQ ID NO: 844256 - RNA, 18 nt, Mycobacterium avium subsp. paratuberculosis
gcucgugcagccggcggc

SEQ ID NO: 844257 - RNA, 16 nt, Mycobacterium avium subsp. paratuberculosis
gcucguggcgggcccg

SEQ ID NO: 844258 - RNA, 20 nt, Mycobacterium avium subsp. paratuberculosis
gcucguggcgggcccgggcg

SEQ ID NO: 844259 - RNA, 19 nt, Mycobacterium avium subsp. paratuberculosis
gcucgugggaaugcggcug

SEQ ID NO: 844260 - RNA, 23 nt, Mycobacterium avium subsp. paratuberculosis
gcucguggguggucugcugggcg

SEQ ID NO: 844261 - RNA, 20 nt, Mycobacterium avium subsp. paratuberculosis
gcucugccuacuugcggccg

SEQ ID NO: 844262 - RNA, 21 nt, Mycobacterium avium subsp. paratuberculosis
gcucugccuacuugcggccgc

SEQ ID NO: 844263 - RNA, 23 nt, Mycobacterium avium subsp. paratuberculosis
gcugaacgucgucagcaccgugg

SEQ ID NO: 844264 - RNA, 16 nt, Mycobacterium avium subsp. paratuberculosis
gcugaacggugcccgc

SEQ ID NO: 844265 - RNA, 18 nt, Mycobacterium avium subsp. paratuberculosis
gcugaacggugcccgccg

SEQ ID NO: 844266 - RNA, 22 nt, Mycobacterium avium subsp. paratuberculosis
gcucuucucguucugcgugcgg

SEQ ID NO: 844267 - RNA, 17 nt, Mycobacterium avium subsp. paratuberculosis
gcugaacgggcagccac

SEQ ID NO: 844268 - RNA, 17 nt, Mycobacterium avium subsp. paratuberculosis
gcugaacucgacgucga

SEQ ID NO: 844269 - RNA, 19 nt, Mycobacterium avium subsp. paratuberculosis
gcugaacucgacgucgacg

SEQ ID NO: 844270 - RNA, 23 nt, Mycobacterium avium subsp. paratuberculosis
gcugaacugcucgaccagcgccg

SEQ ID NO: 844271 - RNA, 23 nt, Mycobacterium avium subsp. paratuberculosis
gcugaagaucgaaaugaccgcgc

SEQ ID NO: 844272 - RNA, 17 nt, Mycobacterium avium subsp. paratuberculosis
gcugaagcccaccgccg

SEQ ID NO: 844273 - RNA, 18 nt, Mycobacterium avium subsp. paratuberculosis
gcugaagcccaccgccgu

SEQ ID NO: 844274 - RNA, 17 nt, Mycobacterium avium subsp. paratuberculosis
gcugaagaagaugggcg

SEQ ID NO: 844275 - RNA, 20 nt, Mycobacterium avium subsp. paratuberculosis
gcugaagaagaugggcgccg

SEQ ID NO: 844276 - RNA, 14 nt, Mycobacterium avium subsp. paratuberculosis
gcugaccgagcggc

SEQ ID NO: 844277 - RNA, 15 nt, Mycobacterium avium subsp. paratuberculosis
gcugaccgagcggcg

SEQ ID NO: 844278 - RNA, 20 nt, Mycobacterium avium subsp. paratuberculosis
gcugaagccgaacgcgcugu

SEQ ID NO: 844279 - RNA, 18 nt, Mycobacterium avium subsp. paratuberculosis
gcugacccgggcggccug

SEQ ID NO: 844280 - RNA, 14 nt, Mycobacterium avium subsp. paratuberculosis
gcugacccggucgc

SEQ ID NO: 844281 - RNA, 15 nt, Mycobacterium avium subsp. paratuberculosis
gcugacccggucgcg

SEQ ID NO: 844282 - RNA, 18 nt, Mycobacterium avium subsp. paratuberculosis
gcugacccggucgcggcc

SEQ ID NO: 844283 - RNA, 20 nt, Mycobacterium avium subsp. paratuberculosis
gcugacgauucuugaccacc

SEQ ID NO: 844284 - RNA, 21 nt, Mycobacterium avium subsp. paratuberculosis
gcugacgauggcgaccgcgca

SEQ ID NO: 844285 - RNA, 16 nt, Mycobacterium avium subsp. paratuberculosis
gcugaccucgcgcacc

SEQ ID NO: 844286 - RNA, 22 nt, Mycobacterium avium subsp. paratuberculosis
gcugaccucgcgcaccggcugc

SEQ ID NO: 844287 - RNA, 17 nt, Mycobacterium avium subsp. paratuberculosis
gcugaccgacggcgacc

SEQ ID NO: 844288 - RNA, 16 nt, Mycobacterium avium subsp. paratuberculosis
gcugacgaacgcgccg

SEQ ID NO: 844289 - RNA, 18 nt, Mycobacterium avium subsp. paratuberculosis
gcugaccugugcgcccca

SEQ ID NO: 844290 - RNA, 19 nt, Mycobacterium avium subsp. paratuberculosis
gcugaccugugcgccccac

SEQ ID NO: 844291 - RNA, 23 nt, Mycobacterium avium subsp. paratuberculosis
gcugaccugugcgccccacggcg

SEQ ID NO: 844292 - RNA, 13 nt, Mycobacterium avium subsp. paratuberculosis
gcugaccgucgac

SEQ ID NO: 844293 - RNA, 14 nt, Mycobacterium avium subsp. paratuberculosis
gcugaccgucgacc

SEQ ID NO: 844294 - RNA, 15 nt, Mycobacterium avium subsp. paratuberculosis
gcugaccgucgacca

SEQ ID NO: 844295 - RNA, 19 nt, Mycobacterium avium subsp. paratuberculosis
gcugaccguggugucggag

SEQ ID NO: 844296 - RNA, 17 nt, Mycobacterium avium subsp. paratuberculosis
gcugaccggcggugccg

SEQ ID NO: 844297 - RNA, 20 nt, Mycobacterium avium subsp. paratuberculosis
gcugaccggcggugccggcc

SEQ ID NO: 844298 - RNA, 23 nt, Mycobacterium avium subsp. paratuberculosis
gcugaccggcggugccggccaga

SEQ ID NO: 844299 - RNA, 13 nt, Mycobacterium avium subsp. paratuberculosis
gcugaccggcgau

SEQ ID NO: 844300 - RNA, 12 nt, Mycobacterium avium subsp. paratuberculosis
gcugaccggcgg

SEQ ID NO: 844301 - RNA, 15 nt, Mycobacterium avium subsp. paratuberculosis
gcugaccggccaccu

SEQ ID NO: 844302 - RNA, 15 nt, Mycobacterium avium subsp. paratuberculosis
gcucggucaccagcg

SEQ ID NO: 844303 - RNA, 13 nt, Mycobacterium avium subsp. paratuberculosis
gcucggucacccc

SEQ ID NO: 844304 - RNA, 14 nt, Mycobacterium avium subsp. paratuberculosis
gcucggucaacccg

SEQ ID NO: 844305 - RNA, 15 nt, Mycobacterium avium subsp. paratuberculosis
gcucggucaacccga

SEQ ID NO: 844306 - RNA, 16 nt, Mycobacterium avium subsp. paratuberculosis
gcucggucaacccgau

SEQ ID NO: 844307 - RNA, 19 nt, Mycobacterium avium subsp. paratuberculosis
gcucggucaagccggccag

SEQ ID NO: 844308 - RNA, 20 nt, Mycobacterium avium subsp. paratuberculosis
gcucggucaagccggccagc

SEQ ID NO: 844309 - RNA, 21 nt, Mycobacterium avium subsp. paratuberculosis
gcucggucaagccggccagca

SEQ ID NO: 844310 - RNA, 22 nt, Mycobacterium avium subsp. paratuberculosis
gcucgggugucgccgagccgca

SEQ ID NO: 844311 - RNA, 16 nt, Mycobacterium avium subsp. paratuberculosis
gcucgguaugcggcga

SEQ ID NO: 844312 - RNA, 20 nt, Mycobacterium avium subsp. paratuberculosis
gcucgguaugcggcgacgau

SEQ ID NO: 844313 - RNA, 18 nt, Mycobacterium avium subsp. paratuberculosis
gcucgggcuucggcguca

SEQ ID NO: 844314 - RNA, 20 nt, Mycobacterium avium subsp. paratuberculosis
gcucggggcaguaguggucc

SEQ ID NO: 844315 - RNA, 16 nt, Mycobacterium avium subsp. paratuberculosis
gcucggggcucgcggu

SEQ ID NO: 844316 - RNA, 19 nt, Mycobacterium avium subsp. paratuberculosis
gcucggggcucgcggugug

SEQ ID NO: 844317 - RNA, 15 nt, Mycobacterium avium subsp. paratuberculosis
gcucgggggugcccg

SEQ ID NO: 844318 - RNA, 15 nt, Mycobacterium avium subsp. paratuberculosis
gcucggggucggccg

SEQ ID NO: 844319 - RNA, 18 nt, Mycobacterium avium subsp. paratuberculosis
gcucggggucggcgucgg

SEQ ID NO: 844320 - RNA, 15 nt, Mycobacterium avium subsp. paratuberculosis
gcucgggcgguggcg

SEQ ID NO: 844321 - RNA, 14 nt, Mycobacterium avium subsp. paratuberculosis
gcucggucgccacg

SEQ ID NO: 844322 - RNA, 17 nt, Mycobacterium avium subsp. paratuberculosis
gcucggucgccacggcc

SEQ ID NO: 844323 - RNA, 18 nt, Mycobacterium avium subsp. paratuberculosis
gcucggucgccacggccg

SEQ ID NO: 844324 - RNA, 19 nt, Mycobacterium avium subsp. paratuberculosis
gcucggucgccacggccgg

SEQ ID NO: 844325 - RNA, 13 nt, Mycobacterium avium subsp. paratuberculosis
gcucggucgcggu

SEQ ID NO: 844326 - RNA, 20 nt, Mycobacterium avium subsp. paratuberculosis
gcucggucgcggucggcgcc

SEQ ID NO: 844327 - RNA, 14 nt, Mycobacterium avium subsp. paratuberculosis
gcucggucagcacc

SEQ ID NO: 844328 - RNA, 14 nt, Mycobacterium avium subsp. paratuberculosis
gcucggucagccgg

SEQ ID NO: 844329 - RNA, 18 nt, Mycobacterium avium subsp. paratuberculosis
gcucggucagccgggcgg

SEQ ID NO: 844330 - RNA, 14 nt, Mycobacterium avium subsp. paratuberculosis
gcucggcgacgcug

SEQ ID NO: 844331 - RNA, 18 nt, Mycobacterium avium subsp. paratuberculosis
gcucgggcgccucgaaca

SEQ ID NO: 844332 - RNA, 16 nt, Mycobacterium avium subsp. paratuberculosis
gcucggcgcgacguug

SEQ ID NO: 844333 - RNA, 13 nt, Mycobacterium avium subsp. paratuberculosis
gcucggcgcgcgg

SEQ ID NO: 844334 - RNA, 16 nt, Mycobacterium avium subsp. paratuberculosis
gcucggcgcgucgucc

SEQ ID NO: 844335 - RNA, 15 nt, Mycobacterium avium subsp. paratuberculosis
gcucggcgcuccagc

SEQ ID NO: 844336 - RNA, 13 nt, Mycobacterium avium subsp. paratuberculosis
gcucggcgauggu

SEQ ID NO: 844337 - RNA, 12 nt, Mycobacterium avium subsp. paratuberculosis
gcucggcgcccc

SEQ ID NO: 844338 - RNA, 18 nt, Mycobacterium avium subsp. paratuberculosis
gcucggcgccgaccucgg

SEQ ID NO: 844339 - RNA, 20 nt, Mycobacterium avium subsp. paratuberculosis
gcucggcgccgaccucggcc

SEQ ID NO: 844340 - RNA, 18 nt, Mycobacterium avium subsp. paratuberculosis
gcucggcgccgagcguga

SEQ ID NO: 844341 - RNA, 14 nt, Mycobacterium avium subsp. paratuberculosis
gcucggcgccggcc

SEQ ID NO: 844342 - RNA, 15 nt, Mycobacterium avium subsp. paratuberculosis
gcucggcgccggccg

SEQ ID NO: 844343 - RNA, 16 nt, Mycobacterium avium subsp. paratuberculosis
gcucggcgccggccgu

SEQ ID NO: 844344 - RNA, 18 nt, Mycobacterium avium subsp. paratuberculosis
gcucggcgccggccguca

SEQ ID NO: 844345 - RNA, 20 nt, Mycobacterium avium subsp. paratuberculosis
gcucggcgccggccgucacg

SEQ ID NO: 844346 - RNA, 17 nt, Mycobacterium avium subsp. paratuberculosis
gcucggcgaucuggcgg

SEQ ID NO: 844347 - RNA, 18 nt, Mycobacterium avium subsp. paratuberculosis
gcucggcgaucuggcggu

SEQ ID NO: 844348 - RNA, 22 nt, Mycobacterium avium subsp. paratuberculosis
gcucggcgaucuggcgguugga

SEQ ID NO: 844349 - RNA, 14 nt, Mycobacterium avium subsp. paratuberculosis
gcucggcgaucacc

SEQ ID NO: 844350 - RNA, 16 nt, Mycobacterium avium subsp. paratuberculosis
gcucggcgaucaccgc

SEQ ID NO: 844351 - RNA, 18 nt, Mycobacterium avium subsp. paratuberculosis
gcucggcgaucaccgcgu

SEQ ID NO: 844352 - RNA, 13 nt, Mycobacterium avium subsp. paratuberculosis
gcucggcgagcug

SEQ ID NO: 844353 - RNA, 21 nt, Mycobacterium avium subsp. paratuberculosis
gcucggcgagguagaccgccg

SEQ ID NO: 844354 - RNA, 22 nt, Mycobacterium avium subsp. paratuberculosis
gcucggcgagguagaccgccga

SEQ ID NO: 844355 - RNA, 21 nt, Mycobacterium avium subsp. paratuberculosis
gcucggcgagcaaggcgagca

SEQ ID NO: 844356 - RNA, 17 nt, Mycobacterium avium subsp. paratuberculosis
gcucggcgagcaccgug

SEQ ID NO: 844357 - RNA, 18 nt, Mycobacterium avium subsp. paratuberculosis
gcucggccaucccggugc

SEQ ID NO: 844358 - RNA, 20 nt, Mycobacterium avium subsp. paratuberculosis
gcucggccaucccggugccg

SEQ ID NO: 844359 - RNA, 22 nt, Mycobacterium avium subsp. paratuberculosis
gcucggccaucccggugccgcu

SEQ ID NO: 844360 - RNA, 18 nt, Mycobacterium avium subsp. paratuberculosis
gcucggccauccgggcgg

SEQ ID NO: 844361 - RNA, 19 nt, Mycobacterium avium subsp. paratuberculosis
gcucggccauccgggcggc

SEQ ID NO: 844362 - RNA, 18 nt, Mycobacterium avium subsp. paratuberculosis
gcucgucagcgcgggcca

SEQ ID NO: 844363 - RNA, 23 nt, Mycobacterium avium subsp. paratuberculosis
gcucgucagcgcgggccagcagu

SEQ ID NO: 844364 - RNA, 21 nt, Mycobacterium avium subsp. paratuberculosis
gcucguccagcccggucacca

SEQ ID NO: 844365 - RNA, 19 nt, Mycobacterium avium subsp. paratuberculosis
gcucguaguuggggccggc

SEQ ID NO: 844366 - RNA, 21 nt, Mycobacterium avium subsp. paratuberculosis
gcucggugcgccagaucagcg

SEQ ID NO: 844367 - RNA, 20 nt, Mycobacterium avium subsp. paratuberculosis
gcucguagcuggugcgcagc

SEQ ID NO: 844368 - RNA, 24 nt, Mycobacterium avium subsp. paratuberculosis
gcucguagcuggugcgcagcccgc

SEQ ID NO: 844369 - RNA, 17 nt, Mycobacterium avium subsp. paratuberculosis
gcucggugcgcaccccg

SEQ ID NO: 844370 - RNA, 18 nt, Mycobacterium avium subsp. paratuberculosis
gcucggugcgcauggcgu

SEQ ID NO: 844371 - RNA, 12 nt, Mycobacterium avium subsp. paratuberculosis
gcucggugcgcc

SEQ ID NO: 844372 - RNA, 12 nt, Mycobacterium avium subsp. paratuberculosis
gcucggugccgc

SEQ ID NO: 844373 - RNA, 21 nt, Mycobacterium avium subsp. paratuberculosis
gcucggugaucugcaccagcg

SEQ ID NO: 844374 - RNA, 15 nt, Mycobacterium avium subsp. paratuberculosis
gcucgguggcgucgg

SEQ ID NO: 844375 - RNA, 20 nt, Mycobacterium avium subsp. paratuberculosis
gcucgguggcgucggcggcc

SEQ ID NO: 844376 - RNA, 22 nt, Mycobacterium avium subsp. paratuberculosis
gcucgguggcgucggcggccug

SEQ ID NO: 844377 - RNA, 13 nt, Mycobacterium avium subsp. paratuberculosis
gcucguaacgcca

SEQ ID NO: 844378 - RNA, 15 nt, Mycobacterium avium subsp. paratuberculosis
gcucguaacgccacg

SEQ ID NO: 844379 - RNA, 20 nt, Mycobacterium avium subsp. paratuberculosis
gcucguaacgccacggcggc

SEQ ID NO: 844380 - RNA, 23 nt, Mycobacterium avium subsp. paratuberculosis
gcucguaacgccacggcggccga

SEQ ID NO: 844381 - RNA, 22 nt, Mycobacterium avium subsp. paratuberculosis
gcucguccucgaaagccgcugu

SEQ ID NO: 844382 - RNA, 12 nt, Mycobacterium avium subsp. paratuberculosis
gcucgucgacgu

SEQ ID NO: 844383 - RNA, 18 nt, Mycobacterium avium subsp. paratuberculosis
gcucgucgagcauccggc

SEQ ID NO: 844384 - RNA, 20 nt, Mycobacterium avium subsp. paratuberculosis
gcucgucgagcauccggcgc

SEQ ID NO: 844385 - RNA, 13 nt, Mycobacterium avium subsp. paratuberculosis
gcucgucgccgac

SEQ ID NO: 844386 - RNA, 12 nt, Mycobacterium avium subsp. paratuberculosis
gcucgucgaguc

SEQ ID NO: 844387 - RNA, 21 nt, Mycobacterium avium subsp. paratuberculosis
gcucguccaggguggccagca

SEQ ID NO: 844388 - RNA, 17 nt, Mycobacterium avium subsp. paratuberculosis
gcucgucgagccggccg

SEQ ID NO: 844389 - RNA, 15 nt, Mycobacterium avium subsp. paratuberculosis
gcucgucgcggagga

SEQ ID NO: 844390 - RNA, 13 nt, Mycobacterium avium subsp. paratuberculosis
gcucgucggccag

SEQ ID NO: 844391 - RNA, 15 nt, Mycobacterium avium subsp. paratuberculosis
gcucgucggcgcgcc

SEQ ID NO: 844392 - RNA, 16 nt, Mycobacterium avium subsp. paratuberculosis
gcucgucggcgcgcca

SEQ ID NO: 844393 - RNA, 21 nt, Mycobacterium avium subsp. paratuberculosis
gcucgucggcgcgccacccga

SEQ ID NO: 844394 - RNA, 24 nt, Mycobacterium avium subsp. paratuberculosis
gcucgucggcgggcaccucggcca

SEQ ID NO: 844395 - RNA, 20 nt, Mycobacterium avium subsp. paratuberculosis
gcucgucgggaacgccgauc

SEQ ID NO: 844396 - RNA, 21 nt, Mycobacterium avium subsp. paratuberculosis
gcucgucgggcacaucccgca

SEQ ID NO: 844397 - RNA, 20 nt, Mycobacterium avium subsp. paratuberculosis
gcucgucggggcagccgucg

SEQ ID NO: 844398 - RNA, 19 nt, Mycobacterium avium subsp. paratuberculosis
gcucgucggguguggcgcc

SEQ ID NO: 844399 - RNA, 20 nt, Mycobacterium avium subsp. paratuberculosis
gcucgucggguguggcgccg

SEQ ID NO: 844400 - RNA, 14 nt, Mycobacterium avium subsp. paratuberculosis
gcucgucggugacg

SEQ ID NO: 844401 - RNA, 16 nt, Mycobacterium avium subsp. paratuberculosis
gcucgucgugauggcg

SEQ ID NO: 844402 - RNA, 22 nt, Mycobacterium avium subsp. paratuberculosis
gcucgucgugggugacccggcc

SEQ ID NO: 844403 - RNA, 17 nt, Mycobacterium avium subsp. paratuberculosis
gcucgucguugaccugc

SEQ ID NO: 844404 - RNA, 16 nt, Mycobacterium avium subsp. paratuberculosis
gcucgcucccgcgcgg

SEQ ID NO: 844405 - RNA, 15 nt, Mycobacterium avium subsp. paratuberculosis
gcucgcugaucugcg

SEQ ID NO: 844406 - RNA, 21 nt, Mycobacterium avium subsp. paratuberculosis
gcucgcugaucugcggcacca

SEQ ID NO: 844407 - RNA, 23 nt, Mycobacterium avium subsp. paratuberculosis
gcucgcugaucugcggcaccacg

SEQ ID NO: 844408 - RNA, 17 nt, Mycobacterium avium subsp. paratuberculosis
gcucgcuguggcggacg

SEQ ID NO: 844409 - RNA, 15 nt, Mycobacterium avium subsp. paratuberculosis
gcucggccagcgggu

SEQ ID NO: 844410 - RNA, 16 nt, Mycobacterium avium subsp. paratuberculosis
gcucggccagcgggug

SEQ ID NO: 844411 - RNA, 23 nt, Mycobacterium avium subsp. paratuberculosis
gcucggccagcgggugauggccg

SEQ ID NO: 844412 - RNA, 15 nt, Mycobacterium avium subsp. paratuberculosis
gcucggccagcgcgc

SEQ ID NO: 844413 - RNA, 17 nt, Mycobacterium avium subsp. paratuberculosis
gcucggccagcgcgccg

SEQ ID NO: 844414 - RNA, 12 nt, Mycobacterium avium subsp. paratuberculosis
gcucggccagcg

SEQ ID NO: 844415 - RNA, 14 nt, Mycobacterium avium subsp. paratuberculosis
gcucggccagcagc

SEQ ID NO: 844416 - RNA, 16 nt, Mycobacterium avium subsp. paratuberculosis
gcucggccagcagcac

SEQ ID NO: 844417 - RNA, 14 nt, Mycobacterium avium subsp. paratuberculosis
gcucgcgcuggcgg

SEQ ID NO: 844418 - RNA, 17 nt, Mycobacterium avium subsp. paratuberculosis
gcucgcgcuggcggcca

SEQ ID NO: 844419 - RNA, 15 nt, Mycobacterium avium subsp. paratuberculosis
gcucgcgcugccgcg

SEQ ID NO: 844420 - RNA, 19 nt, Mycobacterium avium subsp. paratuberculosis
gcucgcgcugccgcgcgcc

SEQ ID NO: 844421 - RNA, 13 nt, Mycobacterium avium subsp. paratuberculosis
gcucgcggauccg

SEQ ID NO: 844422 - RNA, 14 nt, Mycobacterium avium subsp. paratuberculosis
gcucgcgucgacgu

SEQ ID NO: 844423 - RNA, 13 nt, Mycobacterium avium subsp. paratuberculosis
gcucgcguucggg

SEQ ID NO: 844424 - RNA, 19 nt, Mycobacterium avium subsp. paratuberculosis
gcucgcuauaucgcaccgg

SEQ ID NO: 844425 - RNA, 22 nt, Mycobacterium avium subsp. paratuberculosis
gcucgcuauaucgcaccggcgc

SEQ ID NO: 844426 - RNA, 14 nt, Mycobacterium avium subsp. paratuberculosis
gcucgcgccgggcg

SEQ ID NO: 844427 - RNA, 18 nt, Mycobacterium avium subsp. paratuberculosis
gcucgcgccgggcggccu

SEQ ID NO: 844428 - RNA, 12 nt, Mycobacterium avium subsp. paratuberculosis
gcucgcgcggug

SEQ ID NO: 844429 - RNA, 16 nt, Mycobacterium avium subsp. paratuberculosis
gcucgcgcccggccag

SEQ ID NO: 844430 - RNA, 18 nt, Mycobacterium avium subsp. paratuberculosis
gcucgcgcccggccaggu

SEQ ID NO: 844431 - RNA, 16 nt, Mycobacterium avium subsp. paratuberculosis
gcucgcgccgacccgc

SEQ ID NO: 844432 - RNA, 20 nt, Mycobacterium avium subsp. paratuberculosis
gcucgcgccgacccgcccgc

SEQ ID NO: 844433 - RNA, 22 nt, Mycobacterium avium subsp. paratuberculosis
gcucgccgucacaccgcggcca

SEQ ID NO: 844434 - RNA, 23 nt, Mycobacterium avium subsp. paratuberculosis
gcucgccgucacaccgcggccag

SEQ ID NO: 844435 - RNA, 12 nt, Mycobacterium avium subsp. paratuberculosis
gcucgccgccga

SEQ ID NO: 844436 - RNA, 22 nt, Mycobacterium avium subsp. paratuberculosis
gcucgccgaugacguugcgcgc

SEQ ID NO: 844437 - RNA, 20 nt, Mycobacterium avium subsp. paratuberculosis
gcucgccgaugucggccggu

SEQ ID NO: 844438 - RNA, 21 nt, Mycobacterium avium subsp. paratuberculosis
gcucgccgaugucggccgguc

SEQ ID NO: 844439 - RNA, 22 nt, Mycobacterium avium subsp. paratuberculosis
gcucgccgaaaugccgugccag

SEQ ID NO: 844440 - RNA, 24 nt, Mycobacterium avium subsp. paratuberculosis
gcucgccgaaaugccgugccagcc

SEQ ID NO: 844441 - RNA, 20 nt, Mycobacterium avium subsp. paratuberculosis
gcucgaucucggccaccguc

SEQ ID NO: 844442 - RNA, 23 nt, Mycobacterium avium subsp. paratuberculosis
gcucgaucugcuccgggguggcc

SEQ ID NO: 844443 - RNA, 19 nt, Mycobacterium avium subsp. paratuberculosis
gcucgaucuggcggacccg

SEQ ID NO: 844444 - RNA, 20 nt, Mycobacterium avium subsp. paratuberculosis
gcucgaucuggcggacccgc

SEQ ID NO: 844445 - RNA, 17 nt, Mycobacterium avium subsp. paratuberculosis
gcucgaucggcgcgccg

SEQ ID NO: 844446 - RNA, 16 nt, Mycobacterium avium subsp. paratuberculosis
gcucgaucgccgcgcc

SEQ ID NO: 844447 - RNA, 20 nt, Mycobacterium avium subsp. paratuberculosis
gcucgaucgccgcgcccagc

SEQ ID NO: 844448 - RNA, 13 nt, Mycobacterium avium subsp. paratuberculosis
gcucgaucgcguu

SEQ ID NO: 844449 - RNA, 21 nt, Mycobacterium avium subsp. paratuberculosis
gcucgaucgcguucugcacca

SEQ ID NO: 844450 - RNA, 23 nt, Mycobacterium avium subsp. paratuberculosis
gcucgaucgcguucugcaccagc

SEQ ID NO: 844451 - RNA, 23 nt, Mycobacterium avium subsp. paratuberculosis
gcucgaucagcgacucgaccccg

SEQ ID NO: 844452 - RNA, 13 nt, Mycobacterium avium subsp. paratuberculosis
gcucgcgcagcug

SEQ ID NO: 844453 - RNA, 17 nt, Mycobacterium avium subsp. paratuberculosis
gcucgcgcagcuggccg

SEQ ID NO: 844454 - RNA, 17 nt, Mycobacterium avium subsp. paratuberculosis
gcucgccgucggccagc

SEQ ID NO: 844455 - RNA, 14 nt, Mycobacterium avium subsp. paratuberculosis
gcucgccgguggcg

SEQ ID NO: 844456 - RNA, 19 nt, Mycobacterium avium subsp. paratuberculosis
gcucgccgguggcggcgac

SEQ ID NO: 844457 - RNA, 20 nt, Mycobacterium avium subsp. paratuberculosis
gcucgccgguggcggcgaca

SEQ ID NO: 844458 - RNA, 13 nt, Mycobacterium avium subsp. paratuberculosis
gcucgccggcggc

SEQ ID NO: 844459 - RNA, 15 nt, Mycobacterium avium subsp. paratuberculosis
gcucgccggcggccg

SEQ ID NO: 844460 - RNA, 23 nt, Mycobacterium avium subsp. paratuberculosis
gcucgccggcggccgccacgcug

SEQ ID NO: 844461 - RNA, 13 nt, Mycobacterium avium subsp. paratuberculosis
gcucgccggcguc

SEQ ID NO: 844462 - RNA, 12 nt, Mycobacterium avium subsp. paratuberculosis
gcucgccggcua

SEQ ID NO: 844463 - RNA, 13 nt, Mycobacterium avium subsp. paratuberculosis
gcucgccggcuac

SEQ ID NO: 844464 - RNA, 15 nt, Mycobacterium avium subsp. paratuberculosis
gcucgccggcuaccg

SEQ ID NO: 844465 - RNA, 23 nt, Mycobacterium avium subsp. paratuberculosis
gcucgccggcuaccggcgcugga

SEQ ID NO: 844466 - RNA, 19 nt, Mycobacterium avium subsp. paratuberculosis
gcucgccggcgcgcagcca

SEQ ID NO: 844467 - RNA, 18 nt, Mycobacterium avium subsp. paratuberculosis
gcucgccggggacgacgg

SEQ ID NO: 844468 - RNA, 15 nt, Mycobacterium avium subsp. paratuberculosis
gcucgccggcgcgca

SEQ ID NO: 844469 - RNA, 20 nt, Mycobacterium avium subsp. paratuberculosis
gcucgccggcgcgcaccccg

SEQ ID NO: 844470 - RNA, 14 nt, Mycobacterium avium subsp. paratuberculosis
gcucgccggcgcgc

SEQ ID NO: 844471 - RNA, 14 nt, Mycobacterium avium subsp. paratuberculosis
gcucgccggcccga

SEQ ID NO: 844472 - RNA, 17 nt, Mycobacterium avium subsp. paratuberculosis
gcucgccggcccgaccg

SEQ ID NO: 844473 - RNA, 20 nt, Mycobacterium avium subsp. paratuberculosis
gcucgccggcccgaccggag

SEQ ID NO: 844474 - RNA, 14 nt, Mycobacterium avium subsp. paratuberculosis
gcucgccggccgcg

SEQ ID NO: 844475 - RNA, 19 nt, Mycobacterium avium subsp. paratuberculosis
gcucgccggccgcgggcga

SEQ ID NO: 844476 - RNA, 18 nt, Mycobacterium avium subsp. paratuberculosis
gcucgccgcugucgucga

SEQ ID NO: 844477 - RNA, 12 nt, Mycobacterium avium subsp. paratuberculosis
gcucgccgcggc

SEQ ID NO: 844478 - RNA, 14 nt, Mycobacterium avium subsp. paratuberculosis
gcucgccgcggcca

SEQ ID NO: 844479 - RNA, 15 nt, Mycobacterium avium subsp. paratuberculosis
gcucgccgcggccac

SEQ ID NO: 844480 - RNA, 16 nt, Mycobacterium avium subsp. paratuberculosis
gcucgccgcggccacg

SEQ ID NO: 844481 - RNA, 14 nt, Mycobacterium avium subsp. paratuberculosis
gcucgccgcgggug

SEQ ID NO: 844482 - RNA, 12 nt, Mycobacterium avium subsp. paratuberculosis
gcucgccgcgua

SEQ ID NO: 844483 - RNA, 17 nt, Mycobacterium avium subsp. paratuberculosis
gcucgccgcguacgccg

SEQ ID NO: 844484 - RNA, 17 nt, Mycobacterium avium subsp. paratuberculosis
gcucgccgcucguaacg

SEQ ID NO: 844485 - RNA, 15 nt, Mycobacterium avium subsp. paratuberculosis
gcucgagcaacacca

SEQ ID NO: 844486 - RNA, 21 nt, Mycobacterium avium subsp. paratuberculosis
gcucgagcaacaccaccuugg

SEQ ID NO: 844487 - RNA, 18 nt, Mycobacterium avium subsp. paratuberculosis
gcucgagcacaucggcgu

SEQ ID NO: 844488 - RNA, 16 nt, Mycobacterium avium subsp. paratuberculosis
gcucgaguuuggccag

SEQ ID NO: 844489 - RNA, 18 nt, Mycobacterium avium subsp. paratuberculosis
gcucgaguuuggccagcu

SEQ ID NO: 844490 - RNA, 19 nt, Mycobacterium avium subsp. paratuberculosis
gcucgaguuuggccagcuc

SEQ ID NO: 844491 - RNA, 20 nt, Mycobacterium avium subsp. paratuberculosis
gcucgacguagucgcgcacc

SEQ ID NO: 844492 - RNA, 23 nt, Mycobacterium avium subsp. paratuberculosis
gcucgacguagucgcgcaccauc

SEQ ID NO: 844493 - RNA, 16 nt, Mycobacterium avium subsp. paratuberculosis
gcucgacggcacccgg

SEQ ID NO: 844494 - RNA, 18 nt, Mycobacterium avium subsp. paratuberculosis
gcucgacggcacccggcc

SEQ ID NO: 844495 - RNA, 20 nt, Mycobacterium avium subsp. paratuberculosis
gcucgacggcacccggcccu

SEQ ID NO: 844496 - RNA, 21 nt, Mycobacterium avium subsp. paratuberculosis
gcucgacggcacccggcccua

SEQ ID NO: 844497 - RNA, 14 nt, Mycobacterium avium subsp. paratuberculosis
gcucgacggccggc

SEQ ID NO: 844498 - RNA, 19 nt, Mycobacterium avium subsp. paratuberculosis
gcucgacggccugcacguc

SEQ ID NO: 844499 - RNA, 19 nt, Mycobacterium avium subsp. paratuberculosis
gcuccugcagcgcggcgau

SEQ ID NO: 844500 - RNA, 20 nt, Mycobacterium avium subsp. paratuberculosis
gcucgaccucggcgaccagc

SEQ ID NO: 844501 - RNA, 22 nt, Mycobacterium avium subsp. paratuberculosis
gcucgaccucggcgaccagcga

SEQ ID NO: 844502 - RNA, 17 nt, Mycobacterium avium subsp. paratuberculosis
gcucgaccucggcggcc

SEQ ID NO: 844503 - RNA, 18 nt, Mycobacterium avium subsp. paratuberculosis
gcucgaccucggcggcca

SEQ ID NO: 844504 - RNA, 20 nt, Mycobacterium avium subsp. paratuberculosis
gcucgacgcgcacccgggac

SEQ ID NO: 844505 - RNA, 17 nt, Mycobacterium avium subsp. paratuberculosis
gcucgaccgcggcgaug

SEQ ID NO: 844506 - RNA, 16 nt, Mycobacterium avium subsp. paratuberculosis
gcucgacgcgucgaca

SEQ ID NO: 844507 - RNA, 22 nt, Mycobacterium avium subsp. paratuberculosis
gcucgacgaacuccgcgcgcgg

SEQ ID NO: 844508 - RNA, 15 nt, Mycobacterium avium subsp. paratuberculosis
gcucgacgaccucgc

SEQ ID NO: 844509 - RNA, 18 nt, Mycobacterium avium subsp. paratuberculosis
gcucgacgacuucggccu

SEQ ID NO: 844510 - RNA, 17 nt, Mycobacterium avium subsp. paratuberculosis
gcucgacgaggcgggcg

SEQ ID NO: 844511 - RNA, 18 nt, Mycobacterium avium subsp. paratuberculosis
gcucgacgaggcgggcga

SEQ ID NO: 844512 - RNA, 20 nt, Mycobacterium avium subsp. paratuberculosis
gcucgacgaguuccucgugc

SEQ ID NO: 844513 - RNA, 15 nt, Mycobacterium avium subsp. paratuberculosis
gcuccguccaccggc

SEQ ID NO: 844514 - RNA, 17 nt, Mycobacterium avium subsp. paratuberculosis
gcuccguccaccggcac

SEQ ID NO: 844515 - RNA, 20 nt, Mycobacterium avium subsp. paratuberculosis
gcuccguccaccggcacggc

SEQ ID NO: 844516 - RNA, 17 nt, Mycobacterium avium subsp. paratuberculosis
gcuccucggucagcggc

SEQ ID NO: 844517 - RNA, 15 nt, Mycobacterium avium subsp. paratuberculosis
gcuccucggccagca

SEQ ID NO: 844518 - RNA, 18 nt, Mycobacterium avium subsp. paratuberculosis
gcuccucggccagcacca

SEQ ID NO: 844519 - RNA, 19 nt, Mycobacterium avium subsp. paratuberculosis
gcuccucggccagcaccag

SEQ ID NO: 844520 - RNA, 16 nt, Mycobacterium avium subsp. paratuberculosis
gcuccuccucgcgccg

SEQ ID NO: 844521 - RNA, 17 nt, Mycobacterium avium subsp. paratuberculosis
gcuccuccucgcgccgc

SEQ ID NO: 844522 - RNA, 18 nt, Mycobacterium avium subsp. paratuberculosis
gcuccuccucgcgccgcc

SEQ ID NO: 844523 - RNA, 19 nt, Mycobacterium avium subsp. paratuberculosis
gcuccuccucgcgccgcca

SEQ ID NO: 844524 - RNA, 22 nt, Mycobacterium avium subsp. paratuberculosis
gcuccuccucgcgccgccacgc

SEQ ID NO: 844525 - RNA, 14 nt, Mycobacterium avium subsp. paratuberculosis
gcuccucgaccacg

SEQ ID NO: 844526 - RNA, 15 nt, Mycobacterium avium subsp. paratuberculosis
gcuccucgaccacgc

SEQ ID NO: 844527 - RNA, 20 nt, Mycobacterium avium subsp. paratuberculosis
gcuccuccggguccccgccg

SEQ ID NO: 844528 - RNA, 19 nt, Mycobacterium avium subsp. paratuberculosis
gcuccggucgcgucgugcg

SEQ ID NO: 844529 - RNA, 14 nt, Mycobacterium avium subsp. paratuberculosis
gcuccggucggcgc

SEQ ID NO: 844530 - RNA, 15 nt, Mycobacterium avium subsp. paratuberculosis
gcuccggucggcgcu

SEQ ID NO: 844531 - RNA, 18 nt, Mycobacterium avium subsp. paratuberculosis
gcuccggucggcgcucgc

SEQ ID NO: 844532 - RNA, 15 nt, Mycobacterium avium subsp. paratuberculosis
gcuccgcggccagcu

SEQ ID NO: 844533 - RNA, 14 nt, Mycobacterium avium subsp. paratuberculosis
gcuccgcggcgggc

SEQ ID NO: 844534 - RNA, 22 nt, Mycobacterium avium subsp. paratuberculosis
gcuccgccacccugcgcaccgc

SEQ ID NO: 844535 - RNA, 15 nt, Mycobacterium avium subsp. paratuberculosis
gcuccgcaugcccgg

SEQ ID NO: 844536 - RNA, 18 nt, Mycobacterium avium subsp. paratuberculosis
gcuccgcaugcccgggcg

SEQ ID NO: 844537 - RNA, 15 nt, Mycobacterium avium subsp. paratuberculosis
gcuccgcacgaccug

SEQ ID NO: 844538 - RNA, 17 nt, Mycobacterium avium subsp. paratuberculosis
gcuccgaucuccuggug

SEQ ID NO: 844539 - RNA, 21 nt, Mycobacterium avium subsp. paratuberculosis
gcuccgaucuccuggugucgu

SEQ ID NO: 844540 - RNA, 14 nt, Mycobacterium avium subsp. paratuberculosis
gcucaccugcggcc

SEQ ID NO: 844541 - RNA, 16 nt, Mycobacterium avium subsp. paratuberculosis
gcucaccugcggcccg

SEQ ID NO: 844542 - RNA, 17 nt, Mycobacterium avium subsp. paratuberculosis
gcucaccugcggcccgu

SEQ ID NO: 844543 - RNA, 18 nt, Mycobacterium avium subsp. paratuberculosis
gcucaccugcggcccguc

SEQ ID NO: 844544 - RNA, 13 nt, Mycobacterium avium subsp. paratuberculosis
gcucaccggcgug

SEQ ID NO: 844545 - RNA, 15 nt, Mycobacterium avium subsp. paratuberculosis
gcucaccgcggggug

SEQ ID NO: 844546 - RNA, 22 nt, Mycobacterium avium subsp. paratuberculosis
gcucaccgcggggugcccggcg

SEQ ID NO: 844547 - RNA, 17 nt, Mycobacterium avium subsp. paratuberculosis
gcucaccggccagggcc

SEQ ID NO: 844548 - RNA, 23 nt, Mycobacterium avium subsp. paratuberculosis
gcucaccggccagggccgccgca

SEQ ID NO: 844549 - RNA, 11 nt, Mycobacterium avium subsp. paratuberculosis
gcucacggugu

SEQ ID NO: 844550 - RNA, 14 nt, Mycobacterium avium subsp. paratuberculosis
gcucacggugucgg

SEQ ID NO: 844551 - RNA, 17 nt, Mycobacterium avium subsp. paratuberculosis
gcucacggugucggcgg

SEQ ID NO: 844552 - RNA, 19 nt, Mycobacterium avium subsp. paratuberculosis
gcucacggugucggcggug

SEQ ID NO: 844553 - RNA, 21 nt, Mycobacterium avium subsp. paratuberculosis
gcucacucgucuugcagccgg

SEQ ID NO: 844554 - RNA, 15 nt, Mycobacterium avium subsp. paratuberculosis
gcuggacacccccga

SEQ ID NO: 844555 - RNA, 20 nt, Mycobacterium avium subsp. paratuberculosis
gcuggacacccccgauccgc

SEQ ID NO: 844556 - RNA, 18 nt, Mycobacterium avium subsp. paratuberculosis
gcuggaagucggucugcg

SEQ ID NO: 844557 - RNA, 18 nt, Mycobacterium avium subsp. paratuberculosis
gcuggaaguucgcuggcg

SEQ ID NO: 844558 - RNA, 19 nt, Mycobacterium avium subsp. paratuberculosis
gcuggaaguucgcuggcgg

SEQ ID NO: 844559 - RNA, 14 nt, Mycobacterium avium subsp. paratuberculosis
gcuggacggcccga

SEQ ID NO: 844560 - RNA, 18 nt, Mycobacterium avium subsp. paratuberculosis
gcuggacggcccgacgac

SEQ ID NO: 844561 - RNA, 19 nt, Mycobacterium avium subsp. paratuberculosis
gcuggacggcccgacgacg

SEQ ID NO: 844562 - RNA, 17 nt, Mycobacterium avium subsp. paratuberculosis
gcuggauguccaggccg

SEQ ID NO: 844563 - RNA, 17 nt, Mycobacterium avium subsp. paratuberculosis
gcuggauggcgcccagc

SEQ ID NO: 844564 - RNA, 21 nt, Mycobacterium avium subsp. paratuberculosis
gcuggauggcgcccagcccga

SEQ ID NO: 844565 - RNA, 20 nt, Mycobacterium avium subsp. paratuberculosis
gcuggaugugguugcuggcg

SEQ ID NO: 844566 - RNA, 23 nt, Mycobacterium avium subsp. paratuberculosis
gcuggauuccaccguggucggca

SEQ ID NO: 844567 - RNA, 17 nt, Mycobacterium avium subsp. paratuberculosis
gcuggauucgucgcugg

SEQ ID NO: 844568 - RNA, 17 nt, Mycobacterium avium subsp. paratuberculosis
gcuggaugaaggucgcg

SEQ ID NO: 844569 - RNA, 18 nt, Mycobacterium avium subsp. paratuberculosis
gcuggaugaaggucgcgg

SEQ ID NO: 844570 - RNA, 17 nt, Mycobacterium avium subsp. paratuberculosis
gcuggaguaggugcccg

SEQ ID NO: 844571 - RNA, 13 nt, Mycobacterium avium subsp. paratuberculosis
gcugcugcggccg

SEQ ID NO: 844572 - RNA, 15 nt, Mycobacterium avium subsp. paratuberculosis
gcugcugcggccgga

SEQ ID NO: 844573 - RNA, 15 nt, Mycobacterium avium subsp. paratuberculosis
gcugcugcagcgccc

SEQ ID NO: 844574 - RNA, 12 nt, Mycobacterium avium subsp. paratuberculosis
gcugcugcacga

SEQ ID NO: 844575 - RNA, 23 nt, Mycobacterium avium subsp. paratuberculosis
gcugcugcacgacgaccgcgacg

SEQ ID NO: 844576 - RNA, 16 nt, Mycobacterium avium subsp. paratuberculosis
gcugcugcacgucgcc

SEQ ID NO: 844577 - RNA, 19 nt, Mycobacterium avium subsp. paratuberculosis
gcugcugcacgucgccggc

SEQ ID NO: 844578 - RNA, 12 nt, Mycobacterium avium subsp. paratuberculosis
gcugcggcgucg

SEQ ID NO: 844579 - RNA, 17 nt, Mycobacterium avium subsp. paratuberculosis
gcugcgggaagccgagu

SEQ ID NO: 844580 - RNA, 17 nt, Mycobacterium avium subsp. paratuberculosis
gcugcgggaccagcgcc

SEQ ID NO: 844581 - RNA, 21 nt, Mycobacterium avium subsp. paratuberculosis
gcugcgggaccagcgccucgg

SEQ ID NO: 844582 - RNA, 16 nt, Mycobacterium avium subsp. paratuberculosis
gcugcugggugccgcg

SEQ ID NO: 844583 - RNA, 23 nt, Mycobacterium avium subsp. paratuberculosis
gcugcuggucgacgucauccggc

SEQ ID NO: 844584 - RNA, 22 nt, Mycobacterium avium subsp. paratuberculosis
gcugcugggacgggucggcggc

SEQ ID NO: 844585 - RNA, 23 nt, Mycobacterium avium subsp. paratuberculosis
gcugcugggacgggucggcggcg

SEQ ID NO: 844586 - RNA, 18 nt, Mycobacterium avium subsp. paratuberculosis
gcuggaacagcgggccgg

SEQ ID NO: 844587 - RNA, 20 nt, Mycobacterium avium subsp. paratuberculosis
gcuggaacagcgggccggcg

SEQ ID NO: 844588 - RNA, 23 nt, Mycobacterium avium subsp. paratuberculosis
gcugcuuugucucacgccucguc

SEQ ID NO: 844589 - RNA, 14 nt, Mycobacterium avium subsp. paratuberculosis
gcugcugucgaaca

SEQ ID NO: 844590 - RNA, 19 nt, Mycobacterium avium subsp. paratuberculosis
gcugcuucgucgccgggcu

SEQ ID NO: 844591 - RNA, 13 nt, Mycobacterium avium subsp. paratuberculosis
gcuggccguccgg

SEQ ID NO: 844592 - RNA, 20 nt, Mycobacterium avium subsp. paratuberculosis
gcuggccguccggauagccg

SEQ ID NO: 844593 - RNA, 16 nt, Mycobacterium avium subsp. paratuberculosis
gcuggccgucggcgau

SEQ ID NO: 844594 - RNA, 17 nt, Mycobacterium avium subsp. paratuberculosis
gcuggccgucggcgaug

SEQ ID NO: 844595 - RNA, 20 nt, Mycobacterium avium subsp. paratuberculosis
gcuggccgucgucgaggccg

SEQ ID NO: 844596 - RNA, 21 nt, Mycobacterium avium subsp. paratuberculosis
gcuggccgugcaccgucgccg

SEQ ID NO: 844597 - RNA, 15 nt, Mycobacterium avium subsp. paratuberculosis
gcuggccgggcucga

SEQ ID NO: 844598 - RNA, 14 nt, Mycobacterium avium subsp. paratuberculosis
gcuggccgcgcagc

SEQ ID NO: 844599 - RNA, 14 nt, Mycobacterium avium subsp. paratuberculosis
gcuggccgcgccac

SEQ ID NO: 844600 - RNA, 16 nt, Mycobacterium avium subsp. paratuberculosis
gcuggccgcgccacag

SEQ ID NO: 844601 - RNA, 15 nt, Mycobacterium avium subsp. paratuberculosis
gcuggccgcggccag

SEQ ID NO: 844602 - RNA, 21 nt, Mycobacterium avium subsp. paratuberculosis
gcuggccgcggccagcugccc

SEQ ID NO: 844603 - RNA, 16 nt, Mycobacterium avium subsp. paratuberculosis
gcuggccgcggcgauc

SEQ ID NO: 844604 - RNA, 20 nt, Mycobacterium avium subsp. paratuberculosis
gcuggccgcggcgaucggcg

SEQ ID NO: 844605 - RNA, 20 nt, Mycobacterium avium subsp. paratuberculosis
gcuggccgcgaacggcccgc

SEQ ID NO: 844606 - RNA, 12 nt, Mycobacterium avium subsp. paratuberculosis
gcuggccgcacg

SEQ ID NO: 844607 - RNA, 19 nt, Mycobacterium avium subsp. paratuberculosis
gcuggccgcccaccacgaa

SEQ ID NO: 844608 - RNA, 13 nt, Mycobacterium avium subsp. paratuberculosis
gcuggccgccccg

SEQ ID NO: 844609 - RNA, 14 nt, Mycobacterium avium subsp. paratuberculosis
gcuggccgccccga

SEQ ID NO: 844610 - RNA, 17 nt, Mycobacterium avium subsp. paratuberculosis
gcuggccgagagccggu

SEQ ID NO: 844611 - RNA, 20 nt, Mycobacterium avium subsp. paratuberculosis
gcuggccgaucccggccacg

SEQ ID NO: 844612 - RNA, 21 nt, Mycobacterium avium subsp. paratuberculosis
gcuggccgaucccggccacgu

SEQ ID NO: 844613 - RNA, 15 nt, Mycobacterium avium subsp. paratuberculosis
gcuggcccggcgcgg

SEQ ID NO: 844614 - RNA, 17 nt, Mycobacterium avium subsp. paratuberculosis
gcuggcccggcgcggcg

SEQ ID NO: 844615 - RNA, 19 nt, Mycobacterium avium subsp. paratuberculosis
gcuggcccggcgcggcggc

SEQ ID NO: 844616 - RNA, 23 nt, Mycobacterium avium subsp. paratuberculosis
gcuggcccggcgcggcggcgccg

SEQ ID NO: 844617 - RNA, 20 nt, Mycobacterium avium subsp. paratuberculosis
gcuggccguggccgugaugc

SEQ ID NO: 844618 - RNA, 15 nt, Mycobacterium avium subsp. paratuberculosis
gcuggccuccagcuu

SEQ ID NO: 844619 - RNA, 16 nt, Mycobacterium avium subsp. paratuberculosis
gcuggcgaacauggug

SEQ ID NO: 844620 - RNA, 17 nt, Mycobacterium avium subsp. paratuberculosis
gcuggcgaauccgggcc

SEQ ID NO: 844621 - RNA, 18 nt, Mycobacterium avium subsp. paratuberculosis
gcuggcgaugugaucgcg

SEQ ID NO: 844622 - RNA, 23 nt, Mycobacterium avium subsp. paratuberculosis
gcuggcgaugugaucgcggccca

SEQ ID NO: 844623 - RNA, 13 nt, Mycobacterium avium subsp. paratuberculosis
gcuggcgauggug

SEQ ID NO: 844624 - RNA, 17 nt, Mycobacterium avium subsp. paratuberculosis
gcuggcgauggugccga

SEQ ID NO: 844625 - RNA, 19 nt, Mycobacterium avium subsp. paratuberculosis
gcuggcgaucaucgucguc

SEQ ID NO: 844626 - RNA, 22 nt, Mycobacterium avium subsp. paratuberculosis
gcuggcgaccaucagccugcgg

SEQ ID NO: 844627 - RNA, 19 nt, Mycobacterium avium subsp. paratuberculosis
gcuggcgaucaccuugcgg

SEQ ID NO: 844628 - RNA, 13 nt, Mycobacterium avium subsp. paratuberculosis
gcuggccaccgca

SEQ ID NO: 844629 - RNA, 20 nt, Mycobacterium avium subsp. paratuberculosis
gcuggccaccgcaucgccga

SEQ ID NO: 844630 - RNA, 21 nt, Mycobacterium avium subsp. paratuberculosis
gcuggccaccgcaucgccgag

SEQ ID NO: 844631 - RNA, 15 nt, Mycobacterium avium subsp. paratuberculosis
gcuggccagcaccag

SEQ ID NO: 844632 - RNA, 16 nt, Mycobacterium avium subsp. paratuberculosis
gcuggccagcaccagc

SEQ ID NO: 844633 - RNA, 17 nt, Mycobacterium avium subsp. paratuberculosis
gcuggccagcaccagcg

SEQ ID NO: 844634 - RNA, 20 nt, Mycobacterium avium subsp. paratuberculosis
gcuggccagcaccagcgcgc

SEQ ID NO: 844635 - RNA, 24 nt, Mycobacterium avium subsp. paratuberculosis
gcuggccagcaccagcgcgcgggu

SEQ ID NO: 844636 - RNA, 16 nt, Mycobacterium avium subsp. paratuberculosis
gcuggccagcucggcg

SEQ ID NO: 844637 - RNA, 19 nt, Mycobacterium avium subsp. paratuberculosis
gcuggccaucgccgagccg

SEQ ID NO: 844638 - RNA, 22 nt, Mycobacterium avium subsp. paratuberculosis
gcuggccaggcuggcgucgaac

SEQ ID NO: 844639 - RNA, 18 nt, Mycobacterium avium subsp. paratuberculosis
gcuggccagguauucgcg

SEQ ID NO: 844640 - RNA, 14 nt, Mycobacterium avium subsp. paratuberculosis
gcuggccagcgcga

SEQ ID NO: 844641 - RNA, 20 nt, Mycobacterium avium subsp. paratuberculosis
gcuggccacgauccggggca

SEQ ID NO: 844642 - RNA, 19 nt, Mycobacterium avium subsp. paratuberculosis
gcuggcaggguugccccaa

SEQ ID NO: 844643 - RNA, 18 nt, Mycobacterium avium subsp. paratuberculosis
gcuggcaggucgcgccgg

SEQ ID NO: 844644 - RNA, 20 nt, Mycobacterium avium subsp. paratuberculosis
gcuggcaggucgcgccggag

SEQ ID NO: 844645 - RNA, 15 nt, Mycobacterium avium subsp. paratuberculosis
gcuggcaucgucggc

SEQ ID NO: 844646 - RNA, 19 nt, Mycobacterium avium subsp. paratuberculosis
gcuggcaucgucggcgccg

SEQ ID NO: 844647 - RNA, 21 nt, Mycobacterium avium subsp. paratuberculosis
gcuggcaucgucggcgccggc

SEQ ID NO: 844648 - RNA, 22 nt, Mycobacterium avium subsp. paratuberculosis
gcuggcaucgucggcgccggcg

SEQ ID NO: 844649 - RNA, 13 nt, Mycobacterium avium subsp. paratuberculosis
gcuggccaccacg

SEQ ID NO: 844650 - RNA, 14 nt, Mycobacterium avium subsp. paratuberculosis
gcuggccaccacgg

SEQ ID NO: 844651 - RNA, 16 nt, Mycobacterium avium subsp. paratuberculosis
gcuggccaccacgggu

SEQ ID NO: 844652 - RNA, 16 nt, Mycobacterium avium subsp. paratuberculosis
gcugcaacaacuucgg

SEQ ID NO: 844653 - RNA, 13 nt, Mycobacterium avium subsp. paratuberculosis
gcugcaccggggc

SEQ ID NO: 844654 - RNA, 15 nt, Mycobacterium avium subsp. paratuberculosis
gcugcaccggggccg

SEQ ID NO: 844655 - RNA, 16 nt, Mycobacterium avium subsp. paratuberculosis
gcugcaccggggccgg

SEQ ID NO: 844656 - RNA, 18 nt, Mycobacterium avium subsp. paratuberculosis
gcugcaccggggccggcg

SEQ ID NO: 844657 - RNA, 19 nt, Mycobacterium avium subsp. paratuberculosis
gcugcaccggggccggcgg

SEQ ID NO: 844658 - RNA, 20 nt, Mycobacterium avium subsp. paratuberculosis
gcugcaccggggccggcggg

SEQ ID NO: 844659 - RNA, 16 nt, Mycobacterium avium subsp. paratuberculosis
gcugcaccggguacac

SEQ ID NO: 844660 - RNA, 17 nt, Mycobacterium avium subsp. paratuberculosis
gcugcacccaccggcgc

SEQ ID NO: 844661 - RNA, 18 nt, Mycobacterium avium subsp. paratuberculosis
gcugcacccaccggcgca

SEQ ID NO: 844662 - RNA, 17 nt, Mycobacterium avium subsp. paratuberculosis
gcugcaccguuuccggu

SEQ ID NO: 844663 - RNA, 13 nt, Mycobacterium avium subsp. paratuberculosis
gcugauguucagu

SEQ ID NO: 844664 - RNA, 18 nt, Mycobacterium avium subsp. paratuberculosis
gcugaugcggacaccagu

SEQ ID NO: 844665 - RNA, 20 nt, Mycobacterium avium subsp. paratuberculosis
gcugacuccaucccgugcgg

SEQ ID NO: 844666 - RNA, 14 nt, Mycobacterium avium subsp. paratuberculosis
gcugacgucgucgc

SEQ ID NO: 844667 - RNA, 19 nt, Mycobacterium avium subsp. paratuberculosis
gcugacgucgucgcccacc

SEQ ID NO: 844668 - RNA, 14 nt, Mycobacterium avium subsp. paratuberculosis
gcugacggcgucgu

SEQ ID NO: 844669 - RNA, 17 nt, Mycobacterium avium subsp. paratuberculosis
gcugacggcgucguuga

SEQ ID NO: 844670 - RNA, 14 nt, Mycobacterium avium subsp. paratuberculosis
gcugaugccgccga

SEQ ID NO: 844671 - RNA, 22 nt, Mycobacterium avium subsp. paratuberculosis
gcugaugccguccuugucgcgc

SEQ ID NO: 844672 - RNA, 19 nt, Mycobacterium avium subsp. paratuberculosis
gcugacugccggcgacggu

SEQ ID NO: 844673 - RNA, 20 nt, Mycobacterium avium subsp. paratuberculosis
gcugacugccggcgacggug

SEQ ID NO: 844674 - RNA, 15 nt, Mycobacterium avium subsp. paratuberculosis
gcugacugcgaucgc

SEQ ID NO: 844675 - RNA, 16 nt, Mycobacterium avium subsp. paratuberculosis
gcugacugcgaucgcc

SEQ ID NO: 844676 - RNA, 18 nt, Mycobacterium avium subsp. paratuberculosis
gcugacugcgaucgccga

SEQ ID NO: 844677 - RNA, 16 nt, Mycobacterium avium subsp. paratuberculosis
gcugacgggaccgcac

SEQ ID NO: 844678 - RNA, 15 nt, Mycobacterium avium subsp. paratuberculosis
gcugacgggccggcg

SEQ ID NO: 844679 - RNA, 16 nt, Mycobacterium avium subsp. paratuberculosis
gcugacgggccggcgg

SEQ ID NO: 844680 - RNA, 15 nt, Mycobacterium avium subsp. paratuberculosis
gcugacggucgccga

SEQ ID NO: 844681 - RNA, 16 nt, Mycobacterium avium subsp. paratuberculosis
gcugacgccgcggugc

SEQ ID NO: 844682 - RNA, 16 nt, Mycobacterium avium subsp. paratuberculosis
gcugacgccguugcgg

SEQ ID NO: 844683 - RNA, 23 nt, Mycobacterium avium subsp. paratuberculosis
gcugacgccguugcggugcucgu

SEQ ID NO: 844684 - RNA, 14 nt, Mycobacterium avium subsp. paratuberculosis
gcugacgcgaccgc

SEQ ID NO: 844685 - RNA, 21 nt, Mycobacterium avium subsp. paratuberculosis
gcugacgcgaccgcgcggcga

SEQ ID NO: 844686 - RNA, 14 nt, Mycobacterium avium subsp. paratuberculosis
gcugacgcggcggg

SEQ ID NO: 844687 - RNA, 11 nt, Mycobacterium avium subsp. paratuberculosis
gcugacggcca

SEQ ID NO: 844688 - RNA, 17 nt, Mycobacterium avium subsp. paratuberculosis
gcugcaguagccggcca

SEQ ID NO: 844689 - RNA, 18 nt, Mycobacterium avium subsp. paratuberculosis
gcugcauagucggcccga

SEQ ID NO: 844690 - RNA, 19 nt, Mycobacterium avium subsp. paratuberculosis
gcugcauagucggcccgau

SEQ ID NO: 844691 - RNA, 22 nt, Mycobacterium avium subsp. paratuberculosis
gcugcaucaugccgcccaucac

SEQ ID NO: 844692 - RNA, 13 nt, Mycobacterium avium subsp. paratuberculosis
gcugcagggccgg

SEQ ID NO: 844693 - RNA, 18 nt, Mycobacterium avium subsp. paratuberculosis
gcugcagggccgggucga

SEQ ID NO: 844694 - RNA, 23 nt, Mycobacterium avium subsp. paratuberculosis
gcugcagggccgggucgaacggc

SEQ ID NO: 844695 - RNA, 14 nt, Mycobacterium avium subsp. paratuberculosis
gcugcagcgccgcc

SEQ ID NO: 844696 - RNA, 15 nt, Mycobacterium avium subsp. paratuberculosis
gcugcagcgccgccc

SEQ ID NO: 844697 - RNA, 16 nt, Mycobacterium avium subsp. paratuberculosis
gcugcagcggcggcca

SEQ ID NO: 844698 - RNA, 15 nt, Mycobacterium avium subsp. paratuberculosis
gcugcaggcgacgaa

SEQ ID NO: 844699 - RNA, 15 nt, Mycobacterium avium subsp. paratuberculosis
gcugcagcuccucgg

SEQ ID NO: 844700 - RNA, 18 nt, Mycobacterium avium subsp. paratuberculosis
gcugcagcuccucggcgg

SEQ ID NO: 844701 - RNA, 14 nt, Mycobacterium avium subsp. paratuberculosis
gcugcacgucacgg

SEQ ID NO: 844702 - RNA, 19 nt, Mycobacterium avium subsp. paratuberculosis
gcugcacgucacgggccag

SEQ ID NO: 844703 - RNA, 13 nt, Mycobacterium avium subsp. paratuberculosis
gcugcacgucgcc

SEQ ID NO: 844704 - RNA, 14 nt, Mycobacterium avium subsp. paratuberculosis
gcugcacgucgccg

SEQ ID NO: 844705 - RNA, 17 nt, Mycobacterium avium subsp. paratuberculosis
gcugcacgucgccggcg

SEQ ID NO: 844706 - RNA, 19 nt, Mycobacterium avium subsp. paratuberculosis
gcugcacgcugcgcacccg

SEQ ID NO: 844707 - RNA, 14 nt, Mycobacterium avium subsp. paratuberculosis
gcugcacggggugc

SEQ ID NO: 844708 - RNA, 20 nt, Mycobacterium avium subsp. paratuberculosis
gcugcacgcguugcagcgcc

SEQ ID NO: 844709 - RNA, 24 nt, Mycobacterium avium subsp. paratuberculosis
gcugcacgcguugcagcgccgcgg

SEQ ID NO: 844710 - RNA, 15 nt, Mycobacterium avium subsp. paratuberculosis
gcugcacgacgaccg

SEQ ID NO: 844711 - RNA, 16 nt, Mycobacterium avium subsp. paratuberculosis
gcugcacgacgaccgc

SEQ ID NO: 844712 - RNA, 19 nt, Mycobacterium avium subsp. paratuberculosis
gcugcacgacgaccgcgac

SEQ ID NO: 844713 - RNA, 20 nt, Mycobacterium avium subsp. paratuberculosis
gcugcacgacgaccgcgacg

SEQ ID NO: 844714 - RNA, 21 nt, Mycobacterium avium subsp. paratuberculosis
gcugcacgacgaccgcgacgg

SEQ ID NO: 844715 - RNA, 22 nt, Mycobacterium avium subsp. paratuberculosis
gcugcacgacgaccgcgacggc

SEQ ID NO: 844716 - RNA, 12 nt, Mycobacterium avium subsp. paratuberculosis
gcugccccuucg

SEQ ID NO: 844717 - RNA, 14 nt, Mycobacterium avium subsp. paratuberculosis
gcugcccgacccgc

SEQ ID NO: 844718 - RNA, 19 nt, Mycobacterium avium subsp. paratuberculosis
gcugcccgacccgcaccac

SEQ ID NO: 844719 - RNA, 20 nt, Mycobacterium avium subsp. paratuberculosis
gcugcccgacccgcaccacc

SEQ ID NO: 844720 - RNA, 14 nt, Mycobacterium avium subsp. paratuberculosis
gcugcccgauggug

SEQ ID NO: 844721 - RNA, 14 nt, Mycobacterium avium subsp. paratuberculosis
gcugcccgcacugg

SEQ ID NO: 844722 - RNA, 16 nt, Mycobacterium avium subsp. paratuberculosis
gcugcccgcacugguc

SEQ ID NO: 844723 - RNA, 14 nt, Mycobacterium avium subsp. paratuberculosis
gcugcccgagcggc

SEQ ID NO: 844724 - RNA, 14 nt, Mycobacterium avium subsp. paratuberculosis
gcugcccgccgcgg

SEQ ID NO: 844725 - RNA, 14 nt, Mycobacterium avium subsp. paratuberculosis
gcugcccgccgcgu

SEQ ID NO: 844726 - RNA, 13 nt, Mycobacterium avium subsp. paratuberculosis
gcugcccgcccga

SEQ ID NO: 844727 - RNA, 15 nt, Mycobacterium avium subsp. paratuberculosis
gcugcccgcccgaga

SEQ ID NO: 844728 - RNA, 14 nt, Mycobacterium avium subsp. paratuberculosis
gcugcccgccgacg

SEQ ID NO: 844729 - RNA, 14 nt, Mycobacterium avium subsp. paratuberculosis
gcugcccgcgacgg

SEQ ID NO: 844730 - RNA, 15 nt, Mycobacterium avium subsp. paratuberculosis
gcugcccgcgacggc

SEQ ID NO: 844731 - RNA, 16 nt, Mycobacterium avium subsp. paratuberculosis
gcugcccgcgacggcg

SEQ ID NO: 844732 - RNA, 22 nt, Mycobacterium avium subsp. paratuberculosis
gcugcccgcgacggcgagccgg

SEQ ID NO: 844733 - RNA, 23 nt, Mycobacterium avium subsp. paratuberculosis
gcugcccgcgacugucggcgccc

SEQ ID NO: 844734 - RNA, 21 nt, Mycobacterium avium subsp. paratuberculosis
gcugcccgcgaucgccagcgc

SEQ ID NO: 844735 - RNA, 16 nt, Mycobacterium avium subsp. paratuberculosis
gcugccguagcgcugg

SEQ ID NO: 844736 - RNA, 15 nt, Mycobacterium avium subsp. paratuberculosis
gcugccguccacccg

SEQ ID NO: 844737 - RNA, 17 nt, Mycobacterium avium subsp. paratuberculosis
gcugccguccacccggc

SEQ ID NO: 844738 - RNA, 20 nt, Mycobacterium avium subsp. paratuberculosis
gcugccguccacccggccca

SEQ ID NO: 844739 - RNA, 12 nt, Mycobacterium avium subsp. paratuberculosis
gcugcccgcggc

SEQ ID NO: 844740 - RNA, 18 nt, Mycobacterium avium subsp. paratuberculosis
gcugcccgcggccgccgc

SEQ ID NO: 844741 - RNA, 19 nt, Mycobacterium avium subsp. paratuberculosis
gcugcccgcggccgccgcc

SEQ ID NO: 844742 - RNA, 20 nt, Mycobacterium avium subsp. paratuberculosis
gcugcccgcggccgccgccg

SEQ ID NO: 844743 - RNA, 17 nt, Mycobacterium avium subsp. paratuberculosis
gcugcccggaguccggc

SEQ ID NO: 844744 - RNA, 15 nt, Mycobacterium avium subsp. paratuberculosis
gcugcccggcaaccg

SEQ ID NO: 844745 - RNA, 13 nt, Mycobacterium avium subsp. paratuberculosis
gcugcccggcgcg

SEQ ID NO: 844746 - RNA, 15 nt, Mycobacterium avium subsp. paratuberculosis
gcugccucgacgaug

SEQ ID NO: 844747 - RNA, 18 nt, Mycobacterium avium subsp. paratuberculosis
gcugccguucgccgguac

SEQ ID NO: 844748 - RNA, 17 nt, Mycobacterium avium subsp. paratuberculosis
gcugccguugcgccagc

SEQ ID NO: 844749 - RNA, 12 nt, Mycobacterium avium subsp. paratuberculosis
gcugccguccgg

SEQ ID NO: 844750 - RNA, 15 nt, Mycobacterium avium subsp. paratuberculosis
gcugccguccggcgg

SEQ ID NO: 844751 - RNA, 17 nt, Mycobacterium avium subsp. paratuberculosis
gcugcgacaggucggcg

SEQ ID NO: 844752 - RNA, 18 nt, Mycobacterium avium subsp. paratuberculosis
gcugcgacaggucggcgg

SEQ ID NO: 844753 - RNA, 17 nt, Mycobacterium avium subsp. paratuberculosis
gcugcgaaucgucggcg

SEQ ID NO: 844754 - RNA, 20 nt, Mycobacterium avium subsp. paratuberculosis
gcugcgaaucgucggcgaug

SEQ ID NO: 844755 - RNA, 15 nt, Mycobacterium avium subsp. paratuberculosis
gcugcgacagcacgg

SEQ ID NO: 844756 - RNA, 17 nt, Mycobacterium avium subsp. paratuberculosis
gcugcgacagcacgggc

SEQ ID NO: 844757 - RNA, 19 nt, Mycobacterium avium subsp. paratuberculosis
gcugcgacagcacgggcgg

SEQ ID NO: 844758 - RNA, 19 nt, Mycobacterium avium subsp. paratuberculosis
gcugcgcaacaccucggcg

SEQ ID NO: 844759 - RNA, 20 nt, Mycobacterium avium subsp. paratuberculosis
gcugcgcaacaccucggcga

SEQ ID NO: 844760 - RNA, 22 nt, Mycobacterium avium subsp. paratuberculosis
gcugcgcaacaccucggcgacg

SEQ ID NO: 844761 - RNA, 21 nt, Mycobacterium avium subsp. paratuberculosis
gcugcgcacguagcccagcgc

SEQ ID NO: 844762 - RNA, 22 nt, Mycobacterium avium subsp. paratuberculosis
gcugcgcacguagcccagcgcg

SEQ ID NO: 844763 - RNA, 21 nt, Mycobacterium avium subsp. paratuberculosis
gcugcgcagacccgguggccg

SEQ ID NO: 844764 - RNA, 14 nt, Mycobacterium avium subsp. paratuberculosis
gcugcgcagcaccg

SEQ ID NO: 844765 - RNA, 14 nt, Mycobacterium avium subsp. paratuberculosis
gcugcgaggcgggc

SEQ ID NO: 844766 - RNA, 16 nt, Mycobacterium avium subsp. paratuberculosis
gcugcgaggcgggcac

SEQ ID NO: 844767 - RNA, 15 nt, Mycobacterium avium subsp. paratuberculosis
gcugcgagaucggca

SEQ ID NO: 844768 - RNA, 21 nt, Mycobacterium avium subsp. paratuberculosis
gcugcgaugauggucaccguc

SEQ ID NO: 844769 - RNA, 22 nt, Mycobacterium avium subsp. paratuberculosis
gcugcgaugauggucaccgucg

SEQ ID NO: 844770 - RNA, 14 nt, Mycobacterium avium subsp. paratuberculosis
gcugcgcacccggu

SEQ ID NO: 844771 - RNA, 23 nt, Mycobacterium avium subsp. paratuberculosis
gcugcgccacaacuggccgggau

SEQ ID NO: 844772 - RNA, 15 nt, Mycobacterium avium subsp. paratuberculosis
gcugcgcguucggcg

SEQ ID NO: 844773 - RNA, 15 nt, Mycobacterium avium subsp. paratuberculosis
gcugcgcgucgagca

SEQ ID NO: 844774 - RNA, 20 nt, Mycobacterium avium subsp. paratuberculosis
gcugcgcgucgagcagcacc

SEQ ID NO: 844775 - RNA, 22 nt, Mycobacterium avium subsp. paratuberculosis
gcugcgcgucgagcagcaccac

SEQ ID NO: 844776 - RNA, 14 nt, Mycobacterium avium subsp. paratuberculosis
gcugcgcgucggcc

SEQ ID NO: 844777 - RNA, 22 nt, Mycobacterium avium subsp. paratuberculosis
gcugcgcgucggccgcacaaca

SEQ ID NO: 844778 - RNA, 20 nt, Mycobacterium avium subsp. paratuberculosis
gcugcggaaaugcccgcgcc

SEQ ID NO: 844779 - RNA, 21 nt, Mycobacterium avium subsp. paratuberculosis
gcugcggaaaugcccgcgccc

SEQ ID NO: 844780 - RNA, 23 nt, Mycobacterium avium subsp. paratuberculosis
gcugcggaaucacuuccgcggca

SEQ ID NO: 844781 - RNA, 14 nt, Mycobacterium avium subsp. paratuberculosis
gcugcgcgucgagc

SEQ ID NO: 844782 - RNA, 13 nt, Mycobacterium avium subsp. paratuberculosis
gcugcggaucggg

SEQ ID NO: 844783 - RNA, 14 nt, Mycobacterium avium subsp. paratuberculosis
gcugcggaucgggc

SEQ ID NO: 844784 - RNA, 14 nt, Mycobacterium avium subsp. paratuberculosis
gcugcggcgccggg

SEQ ID NO: 844785 - RNA, 15 nt, Mycobacterium avium subsp. paratuberculosis
gcugcggcgccgggc

SEQ ID NO: 844786 - RNA, 22 nt, Mycobacterium avium subsp. paratuberculosis
aaggacaagccggagaaggcga

SEQ ID NO: 844787 - RNA, 17 nt, Mycobacterium avium subsp. paratuberculosis
gcgugcagcgcggcgau

SEQ ID NO: 844788 - RNA, 19 nt, Mycobacterium avium subsp. paratuberculosis
gcgugcagcgcggcgauga

SEQ ID NO: 844789 - RNA, 17 nt, Mycobacterium avium subsp. paratuberculosis
gcgugccagggcagcgc

SEQ ID NO: 844790 - RNA, 23 nt, Mycobacterium avium subsp. paratuberculosis
gcgugccagggcagcgcgaccag

SEQ ID NO: 844791 - RNA, 20 nt, Mycobacterium avium subsp. paratuberculosis
gcgugcauucagugcgagaa

SEQ ID NO: 844792 - RNA, 20 nt, Mycobacterium avium subsp. paratuberculosis
gcgugccaagcguauccggc

SEQ ID NO: 844793 - RNA, 21 nt, Mycobacterium avium subsp. paratuberculosis
gcgugccaagcguauccggcc

SEQ ID NO: 844794 - RNA, 12 nt, Mycobacterium avium subsp. paratuberculosis
gcgugccaccgc

SEQ ID NO: 844795 - RNA, 15 nt, Mycobacterium avium subsp. paratuberculosis
gcgugccaccgcugg

SEQ ID NO: 844796 - RNA, 16 nt, Mycobacterium avium subsp. paratuberculosis
gcgugccaccgcuggg

SEQ ID NO: 844797 - RNA, 22 nt, Mycobacterium avium subsp. paratuberculosis
gcgugccaccgcugggcggcgc

SEQ ID NO: 844798 - RNA, 19 nt, Mycobacterium avium subsp. paratuberculosis
gcgugcgagccgagcacgc

SEQ ID NO: 844799 - RNA, 18 nt, Mycobacterium avium subsp. paratuberculosis
gcgugcgacucggucacg

SEQ ID NO: 844800 - RNA, 13 nt, Mycobacterium avium subsp. paratuberculosis
gcgugccgcuggg

SEQ ID NO: 844801 - RNA, 19 nt, Mycobacterium avium subsp. paratuberculosis
gcgugccggacaccggcac

SEQ ID NO: 844802 - RNA, 22 nt, Mycobacterium avium subsp. paratuberculosis
gcgugccggaugcggucgauga

SEQ ID NO: 844803 - RNA, 15 nt, Mycobacterium avium subsp. paratuberculosis
gcgugccggcccggc

SEQ ID NO: 844804 - RNA, 12 nt, Mycobacterium avium subsp. paratuberculosis
gcgugccggcgg

SEQ ID NO: 844805 - RNA, 13 nt, Mycobacterium avium subsp. paratuberculosis
gcgugccggcggc

SEQ ID NO: 844806 - RNA, 16 nt, Mycobacterium avium subsp. paratuberculosis
gcgugccggcggcgga

SEQ ID NO: 844807 - RNA, 17 nt, Mycobacterium avium subsp. paratuberculosis
gcgugccgggauagccg

SEQ ID NO: 844808 - RNA, 13 nt, Mycobacterium avium subsp. paratuberculosis
gcgugccgggcgg

SEQ ID NO: 844809 - RNA, 20 nt, Mycobacterium avium subsp. paratuberculosis
gcgugccuugcacccagcgg

SEQ ID NO: 844810 - RNA, 16 nt, Mycobacterium avium subsp. paratuberculosis
gcgugccgcccggacc

SEQ ID NO: 844811 - RNA, 14 nt, Mycobacterium avium subsp. paratuberculosis
gcgugccgaccagc

SEQ ID NO: 844812 - RNA, 17 nt, Mycobacterium avium subsp. paratuberculosis
gcgugccgaccagccga

SEQ ID NO: 844813 - RNA, 12 nt, Mycobacterium avium subsp. paratuberculosis
gcgugcccggcc

SEQ ID NO: 844814 - RNA, 15 nt, Mycobacterium avium subsp. paratuberculosis
gcgugcccggccagc

SEQ ID NO: 844815 - RNA, 16 nt, Mycobacterium avium subsp. paratuberculosis
gcgugcccggcgcaca

SEQ ID NO: 844816 - RNA, 17 nt, Mycobacterium avium subsp. paratuberculosis
gcgugcccggcgcacag

SEQ ID NO: 844817 - RNA, 21 nt, Mycobacterium avium subsp. paratuberculosis
gcgugcaggccgcggguggcg

SEQ ID NO: 844818 - RNA, 14 nt, Mycobacterium avium subsp. paratuberculosis
gcgugcccgccgaa

SEQ ID NO: 844819 - RNA, 15 nt, Mycobacterium avium subsp. paratuberculosis
gcgugcccgccgaau

SEQ ID NO: 844820 - RNA, 15 nt, Mycobacterium avium subsp. paratuberculosis
gcgugcccgcgccca

SEQ ID NO: 844821 - RNA, 16 nt, Mycobacterium avium subsp. paratuberculosis
gcgugcccgcgcccac

SEQ ID NO: 844822 - RNA, 13 nt, Mycobacterium avium subsp. paratuberculosis
gcgugcccgcggu

SEQ ID NO: 844823 - RNA, 11 nt, Mycobacterium avium subsp. paratuberculosis
gcgugcgccgc

SEQ ID NO: 844824 - RNA, 15 nt, Mycobacterium avium subsp. paratuberculosis
gcgugcgccgcggcg

SEQ ID NO: 844825 - RNA, 18 nt, Mycobacterium avium subsp. paratuberculosis
gcgugcgccgcggcggcu

SEQ ID NO: 844826 - RNA, 13 nt, Mycobacterium avium subsp. paratuberculosis
gcguggccgccag

SEQ ID NO: 844827 - RNA, 13 nt, Mycobacterium avium subsp. paratuberculosis
gcgugcggccgca

SEQ ID NO: 844828 - RNA, 15 nt, Mycobacterium avium subsp. paratuberculosis
gcgugcggccgcagc

SEQ ID NO: 844829 - RNA, 12 nt, Mycobacterium avium subsp. paratuberculosis
gcgugcggccuc

SEQ ID NO: 844830 - RNA, 21 nt, Mycobacterium avium subsp. paratuberculosis
gcgugcgcguggggcgucgcc

SEQ ID NO: 844831 - RNA, 17 nt, Mycobacterium avium subsp. paratuberculosis
gcgugcgcguggguguc

SEQ ID NO: 844832 - RNA, 12 nt, Mycobacterium avium subsp. paratuberculosis
gcgugcgcucga

SEQ ID NO: 844833 - RNA, 14 nt, Mycobacterium avium subsp. paratuberculosis
gcgugcgcucgacc

SEQ ID NO: 844834 - RNA, 18 nt, Mycobacterium avium subsp. paratuberculosis
gcgugcgcucgaccucgg

SEQ ID NO: 844835 - RNA, 21 nt, Mycobacterium avium subsp. paratuberculosis
gcgugcgcucgaccucggcgg

SEQ ID NO: 844836 - RNA, 13 nt, Mycobacterium avium subsp. paratuberculosis
gcgugcgcgacga

SEQ ID NO: 844837 - RNA, 13 nt, Mycobacterium avium subsp. paratuberculosis
gcgugcgcccgac

SEQ ID NO: 844838 - RNA, 14 nt, Mycobacterium avium subsp. paratuberculosis
gcgugcgcccgacg

SEQ ID NO: 844839 - RNA, 19 nt, Mycobacterium avium subsp. paratuberculosis
gcguggccugggcgaccag

SEQ ID NO: 844840 - RNA, 12 nt, Mycobacterium avium subsp. paratuberculosis
gcguggccggca

SEQ ID NO: 844841 - RNA, 17 nt, Mycobacterium avium subsp. paratuberculosis
gcguggcggaagcgcgu

SEQ ID NO: 844842 - RNA, 13 nt, Mycobacterium avium subsp. paratuberculosis
gcguggcgcgccc

SEQ ID NO: 844843 - RNA, 17 nt, Mycobacterium avium subsp. paratuberculosis
gcguggcgcgccccggc

SEQ ID NO: 844844 - RNA, 15 nt, Mycobacterium avium subsp. paratuberculosis
gcgugguucaggcgu

SEQ ID NO: 844845 - RNA, 21 nt, Mycobacterium avium subsp. paratuberculosis
gcguguagccugcggccugca

SEQ ID NO: 844846 - RNA, 19 nt, Mycobacterium avium subsp. paratuberculosis
gcguguaguacaggccgua

SEQ ID NO: 844847 - RNA, 22 nt, Mycobacterium avium subsp. paratuberculosis
gcgugguggaaggugacgucgc

SEQ ID NO: 844848 - RNA, 23 nt, Mycobacterium avium subsp. paratuberculosis
gcgugguggaaggugacgucgcc

SEQ ID NO: 844849 - RNA, 18 nt, Mycobacterium avium subsp. paratuberculosis
gcgugguggggccgauga

SEQ ID NO: 844850 - RNA, 16 nt, Mycobacterium avium subsp. paratuberculosis
gcguggugcgcccguc

SEQ ID NO: 844851 - RNA, 14 nt, Mycobacterium avium subsp. paratuberculosis
gcguggucggcgaa

SEQ ID NO: 844852 - RNA, 15 nt, Mycobacterium avium subsp. paratuberculosis
gcguggucggcgaag

SEQ ID NO: 844853 - RNA, 17 nt, Mycobacterium avium subsp. paratuberculosis
gcguggucgccguuggc

SEQ ID NO: 844854 - RNA, 22 nt, Mycobacterium avium subsp. paratuberculosis
gcguggucgccguuggcgugga

SEQ ID NO: 844855 - RNA, 14 nt, Mycobacterium avium subsp. paratuberculosis
gcguggcgguggcg

SEQ ID NO: 844856 - RNA, 20 nt, Mycobacterium avium subsp. paratuberculosis
gcgugguccagcacgugccc

SEQ ID NO: 844857 - RNA, 19 nt, Mycobacterium avium subsp. paratuberculosis
gcguggcggucggugcgca

SEQ ID NO: 844858 - RNA, 14 nt, Mycobacterium avium subsp. paratuberculosis
gcguggucacccgc

SEQ ID NO: 844859 - RNA, 20 nt, Mycobacterium avium subsp. paratuberculosis
gcguggucacccgcagcccg

SEQ ID NO: 844860 - RNA, 22 nt, Mycobacterium avium subsp. paratuberculosis
gcguggucacccgcagcccgac

SEQ ID NO: 844861 - RNA, 19 nt, Mycobacterium avium subsp. paratuberculosis
gcguggcgggccaggcgga

SEQ ID NO: 844862 - RNA, 15 nt, Mycobacterium avium subsp. paratuberculosis
gcguggcgccggcgc

SEQ ID NO: 844863 - RNA, 16 nt, Mycobacterium avium subsp. paratuberculosis
gcguggcgccggcgcg

SEQ ID NO: 844864 - RNA, 18 nt, Mycobacterium avium subsp. paratuberculosis
gcgucguggucgacgccg

SEQ ID NO: 844865 - RNA, 15 nt, Mycobacterium avium subsp. paratuberculosis
gcgucguguccgggc

SEQ ID NO: 844866 - RNA, 22 nt, Mycobacterium avium subsp. paratuberculosis
gcgucgugcaacucccgcgccg

SEQ ID NO: 844867 - RNA, 17 nt, Mycobacterium avium subsp. paratuberculosis
gcgucgugccgagcgug

SEQ ID NO: 844868 - RNA, 15 nt, Mycobacterium avium subsp. paratuberculosis
gcgucgucgucgcag

SEQ ID NO: 844869 - RNA, 20 nt, Mycobacterium avium subsp. paratuberculosis
gcgucgucgucgcagugccc

SEQ ID NO: 844870 - RNA, 22 nt, Mycobacterium avium subsp. paratuberculosis
gcgucgucgucgcagugcccgc

SEQ ID NO: 844871 - RNA, 13 nt, Mycobacterium avium subsp. paratuberculosis
gcgucgucgucga

SEQ ID NO: 844872 - RNA, 16 nt, Mycobacterium avium subsp. paratuberculosis
gcgucgucgucgaccg

SEQ ID NO: 844873 - RNA, 22 nt, Mycobacterium avium subsp. paratuberculosis
gcgucgucgucgaccgucaggu

SEQ ID NO: 844874 - RNA, 14 nt, Mycobacterium avium subsp. paratuberculosis
gcgucgugcggccg

SEQ ID NO: 844875 - RNA, 15 nt, Mycobacterium avium subsp. paratuberculosis
gcgucgugcggccgg

SEQ ID NO: 844876 - RNA, 18 nt, Mycobacterium avium subsp. paratuberculosis
gcgucgugcggccggcgc

SEQ ID NO: 844877 - RNA, 19 nt, Mycobacterium avium subsp. paratuberculosis
gcgucgugcggccggcgcc

SEQ ID NO: 844878 - RNA, 20 nt, Mycobacterium avium subsp. paratuberculosis
gcgucgugcggccggcgccg

SEQ ID NO: 844879 - RNA, 22 nt, Mycobacterium avium subsp. paratuberculosis
gcgucgugcggccggcgccggc

SEQ ID NO: 844880 - RNA, 19 nt, Mycobacterium avium subsp. paratuberculosis
gcgucguggcccugcucgu

SEQ ID NO: 844881 - RNA, 20 nt, Mycobacterium avium subsp. paratuberculosis
gcgucguggcccugcucguc

SEQ ID NO: 844882 - RNA, 13 nt, Mycobacterium avium subsp. paratuberculosis
gcgucucccgggu

SEQ ID NO: 844883 - RNA, 22 nt, Mycobacterium avium subsp. paratuberculosis
gcgucucccgggugcgcgucgc

SEQ ID NO: 844884 - RNA, 13 nt, Mycobacterium avium subsp. paratuberculosis
gcgucuccggcgg

SEQ ID NO: 844885 - RNA, 14 nt, Mycobacterium avium subsp. paratuberculosis
gcgucuccggcggg

SEQ ID NO: 844886 - RNA, 18 nt, Mycobacterium avium subsp. paratuberculosis
gcgucuccggcgggcugg

SEQ ID NO: 844887 - RNA, 20 nt, Mycobacterium avium subsp. paratuberculosis
gcgucuccggcgggcuggug

SEQ ID NO: 844888 - RNA, 15 nt, Mycobacterium avium subsp. paratuberculosis
gcgucucgaaccguc

SEQ ID NO: 844889 - RNA, 14 nt, Mycobacterium avium subsp. paratuberculosis
gcgucucgaccgcg

SEQ ID NO: 844890 - RNA, 13 nt, Mycobacterium avium subsp. paratuberculosis
gcgucucgacggc

SEQ ID NO: 844891 - RNA, 19 nt, Mycobacterium avium subsp. paratuberculosis
gcgucucgacggcgccgac

SEQ ID NO: 844892 - RNA, 19 nt, Mycobacterium avium subsp. paratuberculosis
gcgucucgaugaccucgcg

SEQ ID NO: 844893 - RNA, 17 nt, Mycobacterium avium subsp. paratuberculosis
gcgucguugucgucgcc

SEQ ID NO: 844894 - RNA, 19 nt, Mycobacterium avium subsp. paratuberculosis
gcgucguugucgucgccgg

SEQ ID NO: 844895 - RNA, 18 nt, Mycobacterium avium subsp. paratuberculosis
gcgucguuggcgccgucc

SEQ ID NO: 844896 - RNA, 18 nt, Mycobacterium avium subsp. paratuberculosis
gcgucguugaacgcgcgg

SEQ ID NO: 844897 - RNA, 18 nt, Mycobacterium avium subsp. paratuberculosis
gcgucgucgcccgaacuc

SEQ ID NO: 844898 - RNA, 16 nt, Mycobacterium avium subsp. paratuberculosis
gcgucgucggcgggcu

SEQ ID NO: 844899 - RNA, 23 nt, Mycobacterium avium subsp. paratuberculosis
gcgucgucggcgggcugcagcga

SEQ ID NO: 844900 - RNA, 12 nt, Mycobacterium avium subsp. paratuberculosis
gcgucgucggcc

SEQ ID NO: 844901 - RNA, 13 nt, Mycobacterium avium subsp. paratuberculosis
gcgucgucggccg

SEQ ID NO: 844902 - RNA, 18 nt, Mycobacterium avium subsp. paratuberculosis
gcgucgucggccggcucg

SEQ ID NO: 844903 - RNA, 15 nt, Mycobacterium avium subsp. paratuberculosis
gcgucgucggcggcg

SEQ ID NO: 844904 - RNA, 16 nt, Mycobacterium avium subsp. paratuberculosis
gcgucgucgauggcca

SEQ ID NO: 844905 - RNA, 23 nt, Mycobacterium avium subsp. paratuberculosis
gcgucgucgauggccaccagguc

SEQ ID NO: 844906 - RNA, 12 nt, Mycobacterium avium subsp. paratuberculosis
gcgucggcgccg

SEQ ID NO: 844907 - RNA, 19 nt, Mycobacterium avium subsp. paratuberculosis
gcgucggcgccggaucggc

SEQ ID NO: 844908 - RNA, 15 nt, Mycobacterium avium subsp. paratuberculosis
gcgucggcgccggcc

SEQ ID NO: 844909 - RNA, 17 nt, Mycobacterium avium subsp. paratuberculosis
gcgucggcgccggccaa

SEQ ID NO: 844910 - RNA, 19 nt, Mycobacterium avium subsp. paratuberculosis
gcgucggcgccguagucga

SEQ ID NO: 844911 - RNA, 13 nt, Mycobacterium avium subsp. paratuberculosis
gcgucggccgcac

SEQ ID NO: 844912 - RNA, 15 nt, Mycobacterium avium subsp. paratuberculosis
gcgucggcgagcggu

SEQ ID NO: 844913 - RNA, 12 nt, Mycobacterium avium subsp. paratuberculosis
gcgucggcgauc

SEQ ID NO: 844914 - RNA, 18 nt, Mycobacterium avium subsp. paratuberculosis
gcgucggcgaucucgguc

SEQ ID NO: 844915 - RNA, 16 nt, Mycobacterium avium subsp. paratuberculosis
gcgucggccugcccgc

SEQ ID NO: 844916 - RNA, 20 nt, Mycobacterium avium subsp. paratuberculosis
gcgucggccugcccgcgggu

SEQ ID NO: 844917 - RNA, 21 nt, Mycobacterium avium subsp. paratuberculosis
gcgucggccugcccgcgggug

SEQ ID NO: 844918 - RNA, 12 nt, Mycobacterium avium subsp. paratuberculosis
gcgucggccccc

SEQ ID NO: 844919 - RNA, 13 nt, Mycobacterium avium subsp. paratuberculosis
gcgucggccccca

SEQ ID NO: 844920 - RNA, 19 nt, Mycobacterium avium subsp. paratuberculosis
gcgucggccgggcugccca

SEQ ID NO: 844921 - RNA, 22 nt, Mycobacterium avium subsp. paratuberculosis
gcgucggccgggggcgcgggcg

SEQ ID NO: 844922 - RNA, 11 nt, Mycobacterium avium subsp. paratuberculosis
gcgucggcgac

SEQ ID NO: 844923 - RNA, 13 nt, Mycobacterium avium subsp. paratuberculosis
gcgucggcgaccg

SEQ ID NO: 844924 - RNA, 20 nt, Mycobacterium avium subsp. paratuberculosis
gcgucggcgaccgcgcgcgg

SEQ ID NO: 844925 - RNA, 16 nt, Mycobacterium avium subsp. paratuberculosis
gcgucggcgacggcgu

SEQ ID NO: 844926 - RNA, 19 nt, Mycobacterium avium subsp. paratuberculosis
gcgucggcgacggcgucca

SEQ ID NO: 844927 - RNA, 15 nt, Mycobacterium avium subsp. paratuberculosis
gcgucucagucggcc

SEQ ID NO: 844928 - RNA, 18 nt, Mycobacterium avium subsp. paratuberculosis
gcgucucagucggccacc

SEQ ID NO: 844929 - RNA, 12 nt, Mycobacterium avium subsp. paratuberculosis
gcgucucggcga

SEQ ID NO: 844930 - RNA, 13 nt, Mycobacterium avium subsp. paratuberculosis
gcgucucggcgau

SEQ ID NO: 844931 - RNA, 22 nt, Mycobacterium avium subsp. paratuberculosis
gcgucucggcgaucagcugccc

SEQ ID NO: 844932 - RNA, 16 nt, Mycobacterium avium subsp. paratuberculosis
gcgucucggcggccga

SEQ ID NO: 844933 - RNA, 19 nt, Mycobacterium avium subsp. paratuberculosis
gcgucucggcggccgagcg

SEQ ID NO: 844934 - RNA, 17 nt, Mycobacterium avium subsp. paratuberculosis
gcgucucggcgucucgg

SEQ ID NO: 844935 - RNA, 18 nt, Mycobacterium avium subsp. paratuberculosis
gcgucucggcgucucggc

SEQ ID NO: 844936 - RNA, 19 nt, Mycobacterium avium subsp. paratuberculosis
gcgucucggcgucucggcg

SEQ ID NO: 844937 - RNA, 20 nt, Mycobacterium avium subsp. paratuberculosis
gcgucucggcgucucggcgu

SEQ ID NO: 844938 - RNA, 21 nt, Mycobacterium avium subsp. paratuberculosis
gcgucugcauccggaaccggg

SEQ ID NO: 844939 - RNA, 15 nt, Mycobacterium avium subsp. paratuberculosis
gcgucucgccgggga

SEQ ID NO: 844940 - RNA, 24 nt, Mycobacterium avium subsp. paratuberculosis
gcgugaacuuaacuucacgcucgg

SEQ ID NO: 844941 - RNA, 16 nt, Mycobacterium avium subsp. paratuberculosis
gcgucugcucgccggc

SEQ ID NO: 844942 - RNA, 17 nt, Mycobacterium avium subsp. paratuberculosis
gcgucugcucgccggcu

SEQ ID NO: 844943 - RNA, 16 nt, Mycobacterium avium subsp. paratuberculosis
gcgucugcucgccguc

SEQ ID NO: 844944 - RNA, 17 nt, Mycobacterium avium subsp. paratuberculosis
gcgucugcucgccguca

SEQ ID NO: 844945 - RNA, 16 nt, Mycobacterium avium subsp. paratuberculosis
gcgucugcgccagcug

SEQ ID NO: 844946 - RNA, 20 nt, Mycobacterium avium subsp. paratuberculosis
gcgucugcgccccggcgucg

SEQ ID NO: 844947 - RNA, 19 nt, Mycobacterium avium subsp. paratuberculosis
gcgugaaucuuggccagca

SEQ ID NO: 844948 - RNA, 23 nt, Mycobacterium avium subsp. paratuberculosis
gcgugacaagccggcgucgauga

SEQ ID NO: 844949 - RNA, 20 nt, Mycobacterium avium subsp. paratuberculosis
gcgugaagcuagcuucacgc

SEQ ID NO: 844950 - RNA, 24 nt, Mycobacterium avium subsp. paratuberculosis
gcgugaagcuagcuucacgcucgg

SEQ ID NO: 844951 - RNA, 19 nt, Mycobacterium avium subsp. paratuberculosis
gcgugacacuacgguagcc

SEQ ID NO: 844952 - RNA, 13 nt, Mycobacterium avium subsp. paratuberculosis
gcgugacacucgg

SEQ ID NO: 844953 - RNA, 22 nt, Mycobacterium avium subsp. paratuberculosis
gcgugacacucggucaccggug

SEQ ID NO: 844954 - RNA, 22 nt, Mycobacterium avium subsp. paratuberculosis
gcgugacaggggcagcagcaga

SEQ ID NO: 844955 - RNA, 19 nt, Mycobacterium avium subsp. paratuberculosis
gcgugacagucgaccucgc

SEQ ID NO: 844956 - RNA, 16 nt, Mycobacterium avium subsp. paratuberculosis
aagcuguugaccacca

SEQ ID NO: 844957 - RNA, 13 nt, Mycobacterium avium subsp. paratuberculosis
gcgugaccccggc

SEQ ID NO: 844958 - RNA, 16 nt, Mycobacterium avium subsp. paratuberculosis
gcgugaccccggcgac

SEQ ID NO: 844959 - RNA, 22 nt, Mycobacterium avium subsp. paratuberculosis
gcgugaccccggcgaccagcag

SEQ ID NO: 844960 - RNA, 14 nt, Mycobacterium avium subsp. paratuberculosis
gcgucggacaugcc

SEQ ID NO: 844961 - RNA, 16 nt, Mycobacterium avium subsp. paratuberculosis
gcgucgcugucggcga

SEQ ID NO: 844962 - RNA, 17 nt, Mycobacterium avium subsp. paratuberculosis
gcgucgcugucggcgaa

SEQ ID NO: 844963 - RNA, 19 nt, Mycobacterium avium subsp. paratuberculosis
gcgucgcugucggcgaaac

SEQ ID NO: 844964 - RNA, 18 nt, Mycobacterium avium subsp. paratuberculosis
gcgucggagaucaccggc

SEQ ID NO: 844965 - RNA, 18 nt, Mycobacterium avium subsp. paratuberculosis
gcgucggagaugcgggcc

SEQ ID NO: 844966 - RNA, 16 nt, Mycobacterium avium subsp. paratuberculosis
gcgucggaggccauga

SEQ ID NO: 844967 - RNA, 15 nt, Mycobacterium avium subsp. paratuberculosis
gcgucggaggcggcg

SEQ ID NO: 844968 - RNA, 22 nt, Mycobacterium avium subsp. paratuberculosis
gcgucggagucgcuguuggcga

SEQ ID NO: 844969 - RNA, 13 nt, Mycobacterium avium subsp. paratuberculosis
gcgucggcaauga

SEQ ID NO: 844970 - RNA, 20 nt, Mycobacterium avium subsp. paratuberculosis
gcgucggcaaugaccggcac

SEQ ID NO: 844971 - RNA, 14 nt, Mycobacterium avium subsp. paratuberculosis
gcgucggccaccgc

SEQ ID NO: 844972 - RNA, 19 nt, Mycobacterium avium subsp. paratuberculosis
gcgucggacaugccggcgc

SEQ ID NO: 844973 - RNA, 14 nt, Mycobacterium avium subsp. paratuberculosis
gcgucggacgccag

SEQ ID NO: 844974 - RNA, 13 nt, Mycobacterium avium subsp. paratuberculosis
gcgucggccagca

SEQ ID NO: 844975 - RNA, 14 nt, Mycobacterium avium subsp. paratuberculosis
gcgucggccagcac

SEQ ID NO: 844976 - RNA, 17 nt, Mycobacterium avium subsp. paratuberculosis
gcgucggccagcaccac

SEQ ID NO: 844977 - RNA, 15 nt, Mycobacterium avium subsp. paratuberculosis
gcgucggccagcgcg

SEQ ID NO: 844978 - RNA, 18 nt, Mycobacterium avium subsp. paratuberculosis
gcgucggccagcgcgcgg

SEQ ID NO: 844979 - RNA, 16 nt, Mycobacterium avium subsp. paratuberculosis
gcgucggccagcggca

SEQ ID NO: 844980 - RNA, 18 nt, Mycobacterium avium subsp. paratuberculosis
gcgucggccagcggcagc

SEQ ID NO: 844981 - RNA, 17 nt, Mycobacterium avium subsp. paratuberculosis
gcgucgcugggcagccg

SEQ ID NO: 844982 - RNA, 17 nt, Mycobacterium avium subsp. paratuberculosis
gcgucgccgugccggac

SEQ ID NO: 844983 - RNA, 22 nt, Mycobacterium avium subsp. paratuberculosis
gcgucgccgugccggaccgcgc

SEQ ID NO: 844984 - RNA, 20 nt, Mycobacterium avium subsp. paratuberculosis
gcgucgccuuccugcgcgug

SEQ ID NO: 844985 - RNA, 13 nt, Mycobacterium avium subsp. paratuberculosis
gcgucgcgaucag

SEQ ID NO: 844986 - RNA, 15 nt, Mycobacterium avium subsp. paratuberculosis
gcgucgcgaugccca

SEQ ID NO: 844987 - RNA, 15 nt, Mycobacterium avium subsp. paratuberculosis
gcgucgcgcagcgaa

SEQ ID NO: 844988 - RNA, 13 nt, Mycobacterium avium subsp. paratuberculosis
gcgucgccgccgg

SEQ ID NO: 844989 - RNA, 14 nt, Mycobacterium avium subsp. paratuberculosis
gcgucgccgcuggu

SEQ ID NO: 844990 - RNA, 15 nt, Mycobacterium avium subsp. paratuberculosis
gcgucgccgcuggug

SEQ ID NO: 844991 - RNA, 18 nt, Mycobacterium avium subsp. paratuberculosis
gcgucgaugaccucgcgc

SEQ ID NO: 844992 - RNA, 19 nt, Mycobacterium avium subsp. paratuberculosis
gcgucgaugaccucgcgca

SEQ ID NO: 844993 - RNA, 21 nt, Mycobacterium avium subsp. paratuberculosis
gcgucgaugaccucgcgcagc

SEQ ID NO: 844994 - RNA, 21 nt, Mycobacterium avium subsp. paratuberculosis
gcgucgaguucgccgucgacg

SEQ ID NO: 844995 - RNA, 14 nt, Mycobacterium avium subsp. paratuberculosis
gcgucgagcguggg

SEQ ID NO: 844996 - RNA, 16 nt, Mycobacterium avium subsp. paratuberculosis
gcgucgagcgugggcc

SEQ ID NO: 844997 - RNA, 14 nt, Mycobacterium avium subsp. paratuberculosis
gcgucgaggucgcg

SEQ ID NO: 844998 - RNA, 16 nt, Mycobacterium avium subsp. paratuberculosis
gcgucgaggucgucgg

SEQ ID NO: 844999 - RNA, 16 nt, Mycobacterium avium subsp. paratuberculosis
gcgucgaugaugccgg

SEQ ID NO: 845000 - RNA, 19 nt, Mycobacterium avium subsp. paratuberculosis
gcgucgaugccgaucacgg

SEQ ID NO: 845001 - RNA, 15 nt, Mycobacterium avium subsp. paratuberculosis
gcgucgaugcgcgcc

SEQ ID NO: 845002 - RNA, 22 nt, Mycobacterium avium subsp. paratuberculosis
gcgucgaugcgcgccaccaggc

SEQ ID NO: 845003 - RNA, 15 nt, Mycobacterium avium subsp. paratuberculosis
gcgucgccgaccagc

SEQ ID NO: 845004 - RNA, 17 nt, Mycobacterium avium subsp. paratuberculosis
gcgucgccgaccagcag

SEQ ID NO: 845005 - RNA, 12 nt, Mycobacterium avium subsp. paratuberculosis
gcgucgccgacg

SEQ ID NO: 845006 - RNA, 23 nt, Mycobacterium avium subsp. paratuberculosis
gcgucgccgacgggcccagcgcg

SEQ ID NO: 845007 - RNA, 18 nt, Mycobacterium avium subsp. paratuberculosis
gcgucgccgagccgcgcc

SEQ ID NO: 845008 - RNA, 16 nt, Mycobacterium avium subsp. paratuberculosis
gcgucgccgagcucgu

SEQ ID NO: 845009 - RNA, 21 nt, Mycobacterium avium subsp. paratuberculosis
gcgucgccgagcucgugaugg

SEQ ID NO: 845010 - RNA, 17 nt, Mycobacterium avium subsp. paratuberculosis
gcgucgaugcgugacac

SEQ ID NO: 845011 - RNA, 19 nt, Mycobacterium avium subsp. paratuberculosis
gcgucgcccgccgacggcu

SEQ ID NO: 845012 - RNA, 19 nt, Mycobacterium avium subsp. paratuberculosis
gcgucgccgaucgcccggu

SEQ ID NO: 845013 - RNA, 16 nt, Mycobacterium avium subsp. paratuberculosis
gcgucgccgcccccga

SEQ ID NO: 845014 - RNA, 12 nt, Mycobacterium avium subsp. paratuberculosis
gcgucgccgccg

SEQ ID NO: 845015 - RNA, 15 nt, Mycobacterium avium subsp. paratuberculosis
gcgucgccgccgggc

SEQ ID NO: 845016 - RNA, 19 nt, Mycobacterium avium subsp. paratuberculosis
gcgucgccgccgggcgcca

SEQ ID NO: 845017 - RNA, 14 nt, Mycobacterium avium subsp. paratuberculosis
gcgucgccgccggu

SEQ ID NO: 845018 - RNA, 15 nt, Mycobacterium avium subsp. paratuberculosis
gcgucgccgccggug

SEQ ID NO: 845019 - RNA, 17 nt, Mycobacterium avium subsp. paratuberculosis
gcgucgccgccggugcc

SEQ ID NO: 845020 - RNA, 20 nt, Mycobacterium avium subsp. paratuberculosis
gcgucgccgcucuucgacga

SEQ ID NO: 845021 - RNA, 21 nt, Mycobacterium avium subsp. paratuberculosis
gcgucgccgcucuucgacgac

SEQ ID NO: 845022 - RNA, 19 nt, Mycobacterium avium subsp. paratuberculosis
gcguccacgaccccggcgg

SEQ ID NO: 845023 - RNA, 16 nt, Mycobacterium avium subsp. paratuberculosis
gcguccaaccgcggac

SEQ ID NO: 845024 - RNA, 22 nt, Mycobacterium avium subsp. paratuberculosis
gcguccacuccaauacggcccg

SEQ ID NO: 845025 - RNA, 13 nt, Mycobacterium avium subsp. paratuberculosis
gcguccagcgagg

SEQ ID NO: 845026 - RNA, 22 nt, Mycobacterium avium subsp. paratuberculosis
gcguccagcgaggggguggguc

SEQ ID NO: 845027 - RNA, 12 nt, Mycobacterium avium subsp. paratuberculosis
gcguccagcgcc

SEQ ID NO: 845028 - RNA, 15 nt, Mycobacterium avium subsp. paratuberculosis
gcguccagcgccgcc

SEQ ID NO: 845029 - RNA, 16 nt, Mycobacterium avium subsp. paratuberculosis
gcguccagcgccgcca

SEQ ID NO: 845030 - RNA, 18 nt, Mycobacterium avium subsp. paratuberculosis
gcguccgauaccagccgc

SEQ ID NO: 845031 - RNA, 21 nt, Mycobacterium avium subsp. paratuberculosis
gcguccgauaccagccgcgga

SEQ ID NO: 845032 - RNA, 21 nt, Mycobacterium avium subsp. paratuberculosis
gcguccagcaugcccacgccg

SEQ ID NO: 845033 - RNA, 16 nt, Mycobacterium avium subsp. paratuberculosis
gcguccagccagcguu

SEQ ID NO: 845034 - RNA, 22 nt, Mycobacterium avium subsp. paratuberculosis
gcguccgccggcggugcgggug

SEQ ID NO: 845035 - RNA, 13 nt, Mycobacterium avium subsp. paratuberculosis
gcguccgcggccg

SEQ ID NO: 845036 - RNA, 18 nt, Mycobacterium avium subsp. paratuberculosis
gcguccggaggugccggc

SEQ ID NO: 845037 - RNA, 20 nt, Mycobacterium avium subsp. paratuberculosis
gcguccggaggugccggccg

SEQ ID NO: 845038 - RNA, 15 nt, Mycobacterium avium subsp. paratuberculosis
gcguccgcaagcacc

SEQ ID NO: 845039 - RNA, 19 nt, Mycobacterium avium subsp. paratuberculosis
gcguccgcaagcaccucgc

SEQ ID NO: 845040 - RNA, 16 nt, Mycobacterium avium subsp. paratuberculosis
gcguccuucuccgccg

SEQ ID NO: 845041 - RNA, 19 nt, Mycobacterium avium subsp. paratuberculosis
gcguccuucuccgccgggc

SEQ ID NO: 845042 - RNA, 16 nt, Mycobacterium avium subsp. paratuberculosis
gcguccuugaccagcu

SEQ ID NO: 845043 - RNA, 17 nt, Mycobacterium avium subsp. paratuberculosis
gcguccuugaccagcug

SEQ ID NO: 845044 - RNA, 21 nt, Mycobacterium avium subsp. paratuberculosis
gcguccuugauccgggcgcca

SEQ ID NO: 845045 - RNA, 16 nt, Mycobacterium avium subsp. paratuberculosis
gcguccgcgucgucga

SEQ ID NO: 845046 - RNA, 13 nt, Mycobacterium avium subsp. paratuberculosis
gcguccggcccgg

SEQ ID NO: 845047 - RNA, 15 nt, Mycobacterium avium subsp. paratuberculosis
gcguccggcccggcg

SEQ ID NO: 845048 - RNA, 19 nt, Mycobacterium avium subsp. paratuberculosis
gcguccggcccggcguccg

SEQ ID NO: 845049 - RNA, 16 nt, Mycobacterium avium subsp. paratuberculosis
gcgucgagcagcacca

SEQ ID NO: 845050 - RNA, 13 nt, Mycobacterium avium subsp. paratuberculosis
gcgucgacacccc

SEQ ID NO: 845051 - RNA, 18 nt, Mycobacterium avium subsp. paratuberculosis
gcgucgacaccccgcucg

SEQ ID NO: 845052 - RNA, 19 nt, Mycobacterium avium subsp. paratuberculosis
gcgucgacaccccgcucgg

SEQ ID NO: 845053 - RNA, 22 nt, Mycobacterium avium subsp. paratuberculosis
gcgucgacaccccgcucggcca

SEQ ID NO: 845054 - RNA, 23 nt, Mycobacterium avium subsp. paratuberculosis
gcgucgacaccccgcucggccag

SEQ ID NO: 845055 - RNA, 14 nt, Mycobacterium avium subsp. paratuberculosis
gcgucgagcaccuc

SEQ ID NO: 845056 - RNA, 21 nt, Mycobacterium avium subsp. paratuberculosis
gcgucgaacggcgucuggccg

SEQ ID NO: 845057 - RNA, 15 nt, Mycobacterium avium subsp. paratuberculosis
gcgucgaacagccgg

SEQ ID NO: 845058 - RNA, 16 nt, Mycobacterium avium subsp. paratuberculosis
gcgucgaacagccggg

SEQ ID NO: 845059 - RNA, 17 nt, Mycobacterium avium subsp. paratuberculosis
gcgucgaacagccgggc

SEQ ID NO: 845060 - RNA, 18 nt, Mycobacterium avium subsp. paratuberculosis
gcgucgaacagccgggcc

SEQ ID NO: 845061 - RNA, 19 nt, Mycobacterium avium subsp. paratuberculosis
gcgucgaacagccgggccg

SEQ ID NO: 845062 - RNA, 20 nt, Mycobacterium avium subsp. paratuberculosis
gcgucgaacagccgggccgc

SEQ ID NO: 845063 - RNA, 21 nt, Mycobacterium avium subsp. paratuberculosis
gcgucgaacagccgggccgcc

SEQ ID NO: 845064 - RNA, 15 nt, Mycobacterium avium subsp. paratuberculosis
gcgucaucacgugcu

SEQ ID NO: 845065 - RNA, 18 nt, Mycobacterium avium subsp. paratuberculosis
gcgucaucgacuugccgc

SEQ ID NO: 845066 - RNA, 20 nt, Mycobacterium avium subsp. paratuberculosis
gcgucaucgacuugccgccg

SEQ ID NO: 845067 - RNA, 22 nt, Mycobacterium avium subsp. paratuberculosis
gcgucauggagaucaccgcgua

SEQ ID NO: 845068 - RNA, 21 nt, Mycobacterium avium subsp. paratuberculosis
gcgucauggccgucgggucgg

SEQ ID NO: 845069 - RNA, 15 nt, Mycobacterium avium subsp. paratuberculosis
gcgucaucgggcccg

SEQ ID NO: 845070 - RNA, 19 nt, Mycobacterium avium subsp. paratuberculosis
gcgucaucgggcccgacga

SEQ ID NO: 845071 - RNA, 21 nt, Mycobacterium avium subsp. paratuberculosis
gcguccaccagcacgccguug

SEQ ID NO: 845072 - RNA, 21 nt, Mycobacterium avium subsp. paratuberculosis
gcgucauuccgccgcgcccgu

SEQ ID NO: 845073 - RNA, 14 nt, Mycobacterium avium subsp. paratuberculosis
gcgucauggugcgc

SEQ ID NO: 845074 - RNA, 16 nt, Mycobacterium avium subsp. paratuberculosis
gcgucagagguuggcg

SEQ ID NO: 845075 - RNA, 17 nt, Mycobacterium avium subsp. paratuberculosis
gcgucagcaccgcgacg

SEQ ID NO: 845076 - RNA, 18 nt, Mycobacterium avium subsp. paratuberculosis
gcgucagcaccgcgacgg

SEQ ID NO: 845077 - RNA, 12 nt, Mycobacterium avium subsp. paratuberculosis
gcgucagcagcg

SEQ ID NO: 845078 - RNA, 16 nt, Mycobacterium avium subsp. paratuberculosis
gcgucagcagcgcgac

SEQ ID NO: 845079 - RNA, 18 nt, Mycobacterium avium subsp. paratuberculosis
gcgucagcagcgcgacgc

SEQ ID NO: 845080 - RNA, 19 nt, Mycobacterium avium subsp. paratuberculosis
gcgucaggucaccgagcgg

SEQ ID NO: 845081 - RNA, 20 nt, Mycobacterium avium subsp. paratuberculosis
gcgucaggucaccgagcggg

SEQ ID NO: 845082 - RNA, 13 nt, Mycobacterium avium subsp. paratuberculosis
gcgucagguccgc

SEQ ID NO: 845083 - RNA, 19 nt, Mycobacterium avium subsp. paratuberculosis
gcgucacgcaucagggcca

SEQ ID NO: 845084 - RNA, 21 nt, Mycobacterium avium subsp. paratuberculosis
gcgucacgccaguguggccgc

SEQ ID NO: 845085 - RNA, 20 nt, Mycobacterium avium subsp. paratuberculosis
gcgucacgccgcgcccgucg

SEQ ID NO: 845086 - RNA, 23 nt, Mycobacterium avium subsp. paratuberculosis
gcgucacguccaucauggcgcug

SEQ ID NO: 845087 - RNA, 15 nt, Mycobacterium avium subsp. paratuberculosis
gcgucacgucgacgg

SEQ ID NO: 845088 - RNA, 13 nt, Mycobacterium avium subsp. paratuberculosis
gcgucacgucggc

SEQ ID NO: 845089 - RNA, 15 nt, Mycobacterium avium subsp. paratuberculosis
gcgucacgucggccu

SEQ ID NO: 845090 - RNA, 17 nt, Mycobacterium avium subsp. paratuberculosis
gcgucacgucggccugc

SEQ ID NO: 845091 - RNA, 16 nt, Mycobacterium avium subsp. paratuberculosis
gcgucacucuggcgug

SEQ ID NO: 845092 - RNA, 13 nt, Mycobacterium avium subsp. paratuberculosis
gcgucagaaccgg

SEQ ID NO: 845093 - RNA, 16 nt, Mycobacterium avium subsp. paratuberculosis
gcgucagaaccggggc

SEQ ID NO: 845094 - RNA, 18 nt, Mycobacterium avium subsp. paratuberculosis
gcgucagaaccggggcca

SEQ ID NO: 845095 - RNA, 21 nt, Mycobacterium avium subsp. paratuberculosis
gcgucagaaccggggccagca

SEQ ID NO: 845096 - RNA, 13 nt, Mycobacterium avium subsp. paratuberculosis
gcgucacgcuggc

SEQ ID NO: 845097 - RNA, 20 nt, Mycobacterium avium subsp. paratuberculosis
gcgucacgcuggcgugacag

SEQ ID NO: 845098 - RNA, 20 nt, Mycobacterium avium subsp. paratuberculosis
gcgucacgcuggcgugacgc

SEQ ID NO: 845099 - RNA, 23 nt, Mycobacterium avium subsp. paratuberculosis
gcgucacgcuggcguggcacccg

SEQ ID NO: 845100 - RNA, 19 nt, Mycobacterium avium subsp. paratuberculosis
gcgucacgcuggcguggcg

SEQ ID NO: 845101 - RNA, 22 nt, Mycobacterium avium subsp. paratuberculosis
gcgucacgcuggcguggcgccg

SEQ ID NO: 845102 - RNA, 18 nt, Mycobacterium avium subsp. paratuberculosis
gcgucaccuucaccacgg

SEQ ID NO: 845103 - RNA, 15 nt, Mycobacterium avium subsp. paratuberculosis
gcgucaaccaccggc

SEQ ID NO: 845104 - RNA, 15 nt, Mycobacterium avium subsp. paratuberculosis
gcguauuccagcgcc

SEQ ID NO: 845105 - RNA, 16 nt, Mycobacterium avium subsp. paratuberculosis
gcguauugcacggcgg

SEQ ID NO: 845106 - RNA, 17 nt, Mycobacterium avium subsp. paratuberculosis
gcguauugcacggcggc

SEQ ID NO: 845107 - RNA, 20 nt, Mycobacterium avium subsp. paratuberculosis
gcguaugccgguggcguccu

SEQ ID NO: 845108 - RNA, 16 nt, Mycobacterium avium subsp. paratuberculosis
gcguauccggccagcc

SEQ ID NO: 845109 - RNA, 17 nt, Mycobacterium avium subsp. paratuberculosis
gcguaggguucgccgau

SEQ ID NO: 845110 - RNA, 21 nt, Mycobacterium avium subsp. paratuberculosis
gcguaggccaggaccgggacg

SEQ ID NO: 845111 - RNA, 22 nt, Mycobacterium avium subsp. paratuberculosis
gcguagcggaagcugccguugc

SEQ ID NO: 845112 - RNA, 16 nt, Mycobacterium avium subsp. paratuberculosis
gcguagcgcagcucca

SEQ ID NO: 845113 - RNA, 14 nt, Mycobacterium avium subsp. paratuberculosis
gcguagcggugaaa

SEQ ID NO: 845114 - RNA, 14 nt, Mycobacterium avium subsp. paratuberculosis
gcguagcucgccgc

SEQ ID NO: 845115 - RNA, 16 nt, Mycobacterium avium subsp. paratuberculosis
gcguagcugcaggcga

SEQ ID NO: 845116 - RNA, 19 nt, Mycobacterium avium subsp. paratuberculosis
gcguagcugcaggcgacga

SEQ ID NO: 845117 - RNA, 18 nt, Mycobacterium avium subsp. paratuberculosis
gcggucgacuggucgucg

SEQ ID NO: 845118 - RNA, 14 nt, Mycobacterium avium subsp. paratuberculosis
gcguagccgccggu

SEQ ID NO: 845119 - RNA, 13 nt, Mycobacterium avium subsp. paratuberculosis
gcguagccgacca

SEQ ID NO: 845120 - RNA, 12 nt, Mycobacterium avium subsp. paratuberculosis
gcggucgagcgu

SEQ ID NO: 845121 - RNA, 14 nt, Mycobacterium avium subsp. paratuberculosis
gcgguccugcggcg

SEQ ID NO: 845122 - RNA, 15 nt, Mycobacterium avium subsp. paratuberculosis
gcgguccugcggcga

SEQ ID NO: 845123 - RNA, 20 nt, Mycobacterium avium subsp. paratuberculosis
gcgguccugcggcgacaacg

SEQ ID NO: 845124 - RNA, 16 nt, Mycobacterium avium subsp. paratuberculosis
gcgguccucgagcugg

SEQ ID NO: 845125 - RNA, 14 nt, Mycobacterium avium subsp. paratuberculosis
gcggucgaacgcgg

SEQ ID NO: 845126 - RNA, 20 nt, Mycobacterium avium subsp. paratuberculosis
gcggucgaacgcggcgccga

SEQ ID NO: 845127 - RNA, 18 nt, Mycobacterium avium subsp. paratuberculosis
gcggucgaagggugcgga

SEQ ID NO: 845128 - RNA, 14 nt, Mycobacterium avium subsp. paratuberculosis
gcggucgacacgau

SEQ ID NO: 845129 - RNA, 16 nt, Mycobacterium avium subsp. paratuberculosis
gcggucgacacgaucg

SEQ ID NO: 845130 - RNA, 17 nt, Mycobacterium avium subsp. paratuberculosis
gcggucgacacgaucgg

SEQ ID NO: 845131 - RNA, 18 nt, Mycobacterium avium subsp. paratuberculosis
gcggucgacacgaucggc

SEQ ID NO: 845132 - RNA, 21 nt, Mycobacterium avium subsp. paratuberculosis
gcggucgacacgaucggcaug

SEQ ID NO: 845133 - RNA, 22 nt, Mycobacterium avium subsp. paratuberculosis
gcggucgacacgaucggcauga

SEQ ID NO: 845134 - RNA, 21 nt, Mycobacterium avium subsp. paratuberculosis
gcuagaccgauggcggcggcc

SEQ ID NO: 845135 - RNA, 17 nt, Mycobacterium avium subsp. paratuberculosis
gcuacucggacgccggc

SEQ ID NO: 845136 - RNA, 18 nt, Mycobacterium avium subsp. paratuberculosis
gcuacucggacgccggca

SEQ ID NO: 845137 - RNA, 15 nt, Mycobacterium avium subsp. paratuberculosis
gcuagcagcuccggu

SEQ ID NO: 845138 - RNA, 19 nt, Mycobacterium avium subsp. paratuberculosis
gcuagcagcuccggucggc

SEQ ID NO: 845139 - RNA, 21 nt, Mycobacterium avium subsp. paratuberculosis
gcuacggacgcauccacggcc

SEQ ID NO: 845140 - RNA, 22 nt, Mycobacterium avium subsp. paratuberculosis
gcuacggacgcauccacggccg

SEQ ID NO: 845141 - RNA, 17 nt, Mycobacterium avium subsp. paratuberculosis
gcuaguuucacguucgc

SEQ ID NO: 845142 - RNA, 19 nt, Mycobacterium avium subsp. paratuberculosis
gcuagucgcccagcagccc

SEQ ID NO: 845143 - RNA, 22 nt, Mycobacterium avium subsp. paratuberculosis
gcuagguuuggccagcaccgcg

SEQ ID NO: 845144 - RNA, 15 nt, Mycobacterium avium subsp. paratuberculosis
gcuaggccagcagcg

SEQ ID NO: 845145 - RNA, 17 nt, Mycobacterium avium subsp. paratuberculosis
gcuaggccagcagcgcg

SEQ ID NO: 845146 - RNA, 15 nt, Mycobacterium avium subsp. paratuberculosis
gcuagguagcagacg

SEQ ID NO: 845147 - RNA, 16 nt, Mycobacterium avium subsp. paratuberculosis
gcuagguagcagacgg

SEQ ID NO: 845148 - RNA, 13 nt, Mycobacterium avium subsp. paratuberculosis
gcuaggucaccgg

SEQ ID NO: 845149 - RNA, 17 nt, Mycobacterium avium subsp. paratuberculosis
gcuagcgggcgcgcagc

SEQ ID NO: 845150 - RNA, 18 nt, Mycobacterium avium subsp. paratuberculosis
gcuagcgggcgcgcagcc

SEQ ID NO: 845151 - RNA, 19 nt, Mycobacterium avium subsp. paratuberculosis
gcuagcgggcgcgcagcca

SEQ ID NO: 845152 - RNA, 21 nt, Mycobacterium avium subsp. paratuberculosis
gcuagcgggcgcgcagccacg

SEQ ID NO: 845153 - RNA, 12 nt, Mycobacterium avium subsp. paratuberculosis
gcuagcgugacg

SEQ ID NO: 845154 - RNA, 19 nt, Mycobacterium avium subsp. paratuberculosis
gcuagcgugacgcucgcgu

SEQ ID NO: 845155 - RNA, 14 nt, Mycobacterium avium subsp. paratuberculosis
gcuagcgagcgggc

SEQ ID NO: 845156 - RNA, 23 nt, Mycobacterium avium subsp. paratuberculosis
gcuagcgagcgggcacgccgccg

SEQ ID NO: 845157 - RNA, 17 nt, Mycobacterium avium subsp. paratuberculosis
gcuaggcucggcagccg

SEQ ID NO: 845158 - RNA, 15 nt, Mycobacterium avium subsp. paratuberculosis
gcuagcuucacgcuc

SEQ ID NO: 845159 - RNA, 19 nt, Mycobacterium avium subsp. paratuberculosis
gcuagcuucacgcucggcg

SEQ ID NO: 845160 - RNA, 23 nt, Mycobacterium avium subsp. paratuberculosis
gcuagcuucacgcucggcgccga

SEQ ID NO: 845161 - RNA, 15 nt, Mycobacterium avium subsp. paratuberculosis
gcuagcugcgccggc

SEQ ID NO: 845162 - RNA, 15 nt, Mycobacterium avium subsp. paratuberculosis
gcuaccgcgcucacc

SEQ ID NO: 845163 - RNA, 18 nt, Mycobacterium avium subsp. paratuberculosis
gcuaccgcgcucaccguc

SEQ ID NO: 845164 - RNA, 19 nt, Mycobacterium avium subsp. paratuberculosis
gcuaccgcgcucaccgucg

SEQ ID NO: 845165 - RNA, 13 nt, Mycobacterium avium subsp. paratuberculosis
gcuacgcgagcug

SEQ ID NO: 845166 - RNA, 17 nt, Mycobacterium avium subsp. paratuberculosis
gcuaccugaccagcggc

SEQ ID NO: 845167 - RNA, 13 nt, Mycobacterium avium subsp. paratuberculosis
gcuaccggcgcug

SEQ ID NO: 845168 - RNA, 17 nt, Mycobacterium avium subsp. paratuberculosis
gcuaccuaggcgucguc

SEQ ID NO: 845169 - RNA, 19 nt, Mycobacterium avium subsp. paratuberculosis
gcuaccuaggcgucgucgg

SEQ ID NO: 845170 - RNA, 21 nt, Mycobacterium avium subsp. paratuberculosis
gcuaccuaggcgucgucggcc

SEQ ID NO: 845171 - RNA, 20 nt, Mycobacterium avium subsp. paratuberculosis
gcuaccucacaaccgaugug

SEQ ID NO: 845172 - RNA, 15 nt, Mycobacterium avium subsp. paratuberculosis
gcuaucgcccggcgc

SEQ ID NO: 845173 - RNA, 15 nt, Mycobacterium avium subsp. paratuberculosis
gcuaucagcucgcgu

SEQ ID NO: 845174 - RNA, 16 nt, Mycobacterium avium subsp. paratuberculosis
gcuauaucgcaccggc

SEQ ID NO: 845175 - RNA, 17 nt, Mycobacterium avium subsp. paratuberculosis
gcuauaucgcaccggcg

SEQ ID NO: 845176 - RNA, 21 nt, Mycobacterium avium subsp. paratuberculosis
gcuauuggccgagccgggcgg

SEQ ID NO: 845177 - RNA, 22 nt, Mycobacterium avium subsp. paratuberculosis
gcucaaugccuuugccguggcg

SEQ ID NO: 845178 - RNA, 20 nt, Mycobacterium avium subsp. paratuberculosis
gcucaacgugauacgccgac

SEQ ID NO: 845179 - RNA, 21 nt, Mycobacterium avium subsp. paratuberculosis
gcucaacgugauacgccgacg

SEQ ID NO: 845180 - RNA, 16 nt, Mycobacterium avium subsp. paratuberculosis
gcucaacggccggcgc

SEQ ID NO: 845181 - RNA, 18 nt, Mycobacterium avium subsp. paratuberculosis
gcucaacggccggcgccg

SEQ ID NO: 845182 - RNA, 21 nt, Mycobacterium avium subsp. paratuberculosis
gcucaacggccggcgccgccg

SEQ ID NO: 845183 - RNA, 17 nt, Mycobacterium avium subsp. paratuberculosis
gcucaacgauuuccggu

SEQ ID NO: 845184 - RNA, 23 nt, Mycobacterium avium subsp. paratuberculosis
gcucaacgauuuccgguuccucg

SEQ ID NO: 845185 - RNA, 19 nt, Mycobacterium avium subsp. paratuberculosis
gcucaacacguccuggcgc

SEQ ID NO: 845186 - RNA, 21 nt, Mycobacterium avium subsp. paratuberculosis
gcucaacccgggccggacacg

SEQ ID NO: 845187 - RNA, 21 nt, Mycobacterium avium subsp. paratuberculosis
gcucaacccgucgcgggucag

SEQ ID NO: 845188 - RNA, 22 nt, Mycobacterium avium subsp. paratuberculosis
gcucacccaaaaaggcgcgggu

SEQ ID NO: 845189 - RNA, 20 nt, Mycobacterium avium subsp. paratuberculosis
gcucacacagccgcuuggcg

SEQ ID NO: 845190 - RNA, 18 nt, Mycobacterium avium subsp. paratuberculosis
gcucacagcgcggcggug

SEQ ID NO: 845191 - RNA, 18 nt, Mycobacterium avium subsp. paratuberculosis
gcucacaugggcgcguug

SEQ ID NO: 845192 - RNA, 21 nt, Mycobacterium avium subsp. paratuberculosis
gcucaccgagcugggccggcg

SEQ ID NO: 845193 - RNA, 21 nt, Mycobacterium avium subsp. paratuberculosis
gcucaccgcaucgaaccgccg

SEQ ID NO: 845194 - RNA, 11 nt, Mycobacterium avium subsp. paratuberculosis
gcucaccgccg

SEQ ID NO: 845195 - RNA, 16 nt, Mycobacterium avium subsp. paratuberculosis
gcucaccgccgagccg

SEQ ID NO: 845196 - RNA, 17 nt, Mycobacterium avium subsp. paratuberculosis
gcucaccgccgagccgc

SEQ ID NO: 845197 - RNA, 23 nt, Mycobacterium avium subsp. paratuberculosis
gcucaccgccgagccgcuccacc

SEQ ID NO: 845198 - RNA, 15 nt, Mycobacterium avium subsp. paratuberculosis
gcucaccgccgauga

SEQ ID NO: 845199 - RNA, 22 nt, Mycobacterium avium subsp. paratuberculosis
gcucaccgccgaugaugguggc

SEQ ID NO: 845200 - RNA, 17 nt, Mycobacterium avium subsp. paratuberculosis
gcucacccggcccaccg

SEQ ID NO: 845201 - RNA, 19 nt, Mycobacterium avium subsp. paratuberculosis
gcucacccggcccaccggc

SEQ ID NO: 845202 - RNA, 13 nt, Mycobacterium avium subsp. paratuberculosis
gcucaccccggcc

SEQ ID NO: 845203 - RNA, 15 nt, Mycobacterium avium subsp. paratuberculosis
gcguuguugcucggc

SEQ ID NO: 845204 - RNA, 18 nt, Mycobacterium avium subsp. paratuberculosis
gcguuguugcucggcggc

SEQ ID NO: 845205 - RNA, 19 nt, Mycobacterium avium subsp. paratuberculosis
gcguugucggcgacggcgg

SEQ ID NO: 845206 - RNA, 17 nt, Mycobacterium avium subsp. paratuberculosis
gcguuucagcaacccga

SEQ ID NO: 845207 - RNA, 20 nt, Mycobacterium avium subsp. paratuberculosis
gcguuucagcaacccgaaag

SEQ ID NO: 845208 - RNA, 17 nt, Mycobacterium avium subsp. paratuberculosis
gcguugguugcggcccc

SEQ ID NO: 845209 - RNA, 15 nt, Mycobacterium avium subsp. paratuberculosis
gcguuggcgccgacg

SEQ ID NO: 845210 - RNA, 23 nt, Mycobacterium avium subsp. paratuberculosis
gcguuggcggcgucgaguucgcc

SEQ ID NO: 845211 - RNA, 15 nt, Mycobacterium avium subsp. paratuberculosis
gcguugcggaucucg

SEQ ID NO: 845212 - RNA, 19 nt, Mycobacterium avium subsp. paratuberculosis
gcguugcgucccgcgccgg

SEQ ID NO: 845213 - RNA, 16 nt, Mycobacterium avium subsp. paratuberculosis
gcguuggacagcucga

SEQ ID NO: 845214 - RNA, 22 nt, Mycobacterium avium subsp. paratuberculosis
gcguuggacuccaccgccaccg

SEQ ID NO: 845215 - RNA, 17 nt, Mycobacterium avium subsp. paratuberculosis
gcguuggagccgaccag

SEQ ID NO: 845216 - RNA, 19 nt, Mycobacterium avium subsp. paratuberculosis
gcguuggagccgaccagcg

SEQ ID NO: 845217 - RNA, 13 nt, Mycobacterium avium subsp. paratuberculosis
gcguuggcccgug

SEQ ID NO: 845218 - RNA, 13 nt, Mycobacterium avium subsp. paratuberculosis
gcguuggccagcg

SEQ ID NO: 845219 - RNA, 16 nt, Mycobacterium avium subsp. paratuberculosis
gcguuggccagcgccu

SEQ ID NO: 845220 - RNA, 19 nt, Mycobacterium avium subsp. paratuberculosis
gcguuggccagcgccucca

SEQ ID NO: 845221 - RNA, 17 nt, Mycobacterium avium subsp. paratuberculosis
gcuaaagccgaccgccc

SEQ ID NO: 845222 - RNA, 18 nt, Mycobacterium avium subsp. paratuberculosis
gcguuuggccugcggcaa

SEQ ID NO: 845223 - RNA, 18 nt, Mycobacterium avium subsp. paratuberculosis
gcguuuuugugggugguc

SEQ ID NO: 845224 - RNA, 17 nt, Mycobacterium avium subsp. paratuberculosis
gcuaagccggcgucggg

SEQ ID NO: 845225 - RNA, 20 nt, Mycobacterium avium subsp. paratuberculosis
gcuaaggccgcugcccggcg

SEQ ID NO: 845226 - RNA, 17 nt, Mycobacterium avium subsp. paratuberculosis
gcuaaccaccggugacg

SEQ ID NO: 845227 - RNA, 23 nt, Mycobacterium avium subsp. paratuberculosis
gcuaaccaccggugacgaccggc

SEQ ID NO: 845228 - RNA, 19 nt, Mycobacterium avium subsp. paratuberculosis
gcguugaccaacgccgccu

SEQ ID NO: 845229 - RNA, 14 nt, Mycobacterium avium subsp. paratuberculosis
gcguucugcaccga

SEQ ID NO: 845230 - RNA, 19 nt, Mycobacterium avium subsp. paratuberculosis
gcguugaccgggccgcugg

SEQ ID NO: 845231 - RNA, 20 nt, Mycobacterium avium subsp. paratuberculosis
gcguugaccgggccgcuggu

SEQ ID NO: 845232 - RNA, 13 nt, Mycobacterium avium subsp. paratuberculosis
gcguucgggcagc

SEQ ID NO: 845233 - RNA, 17 nt, Mycobacterium avium subsp. paratuberculosis
gcguucgggcagcgccu

SEQ ID NO: 845234 - RNA, 18 nt, Mycobacterium avium subsp. paratuberculosis
gcguucgggcccggccgc

SEQ ID NO: 845235 - RNA, 20 nt, Mycobacterium avium subsp. paratuberculosis
gcguucgggcccggccgcca

SEQ ID NO: 845236 - RNA, 23 nt, Mycobacterium avium subsp. paratuberculosis
gcguucgggcccggccgccagca

SEQ ID NO: 845237 - RNA, 18 nt, Mycobacterium avium subsp. paratuberculosis
gcguucggcgauccgggc

SEQ ID NO: 845238 - RNA, 23 nt, Mycobacterium avium subsp. paratuberculosis
gcguucggcgauccgggcacgca

SEQ ID NO: 845239 - RNA, 13 nt, Mycobacterium avium subsp. paratuberculosis
gcguucggcgcca

SEQ ID NO: 845240 - RNA, 16 nt, Mycobacterium avium subsp. paratuberculosis
gcguucggcgccaccc

SEQ ID NO: 845241 - RNA, 19 nt, Mycobacterium avium subsp. paratuberculosis
gcguucggcgccaccccgg

SEQ ID NO: 845242 - RNA, 17 nt, Mycobacterium avium subsp. paratuberculosis
gcguucggcgcggaucg

SEQ ID NO: 845243 - RNA, 23 nt, Mycobacterium avium subsp. paratuberculosis
gcguucggcgcggaucgucaccg

SEQ ID NO: 845244 - RNA, 15 nt, Mycobacterium avium subsp. paratuberculosis
gcguucuccacccgc

SEQ ID NO: 845245 - RNA, 17 nt, Mycobacterium avium subsp. paratuberculosis
gcguucuccaccgcgcg

SEQ ID NO: 845246 - RNA, 20 nt, Mycobacterium avium subsp. paratuberculosis
gcguucuccaccgcgcgcgg

SEQ ID NO: 845247 - RNA, 16 nt, Mycobacterium avium subsp. paratuberculosis
gcguucuccagcaccc

SEQ ID NO: 845248 - RNA, 22 nt, Mycobacterium avium subsp. paratuberculosis
gcguucuccagcacccgcaacg

SEQ ID NO: 845249 - RNA, 16 nt, Mycobacterium avium subsp. paratuberculosis
gcguucuccucgaaca

SEQ ID NO: 845250 - RNA, 17 nt, Mycobacterium avium subsp. paratuberculosis
gcguucggugcccgggg

SEQ ID NO: 845251 - RNA, 18 nt, Mycobacterium avium subsp. paratuberculosis
gcguucggugcccggggu

SEQ ID NO: 845252 - RNA, 12 nt, Mycobacterium avium subsp. paratuberculosis
gcguucgucgcc

SEQ ID NO: 845253 - RNA, 14 nt, Mycobacterium avium subsp. paratuberculosis
gcguucgucggcgc

SEQ ID NO: 845254 - RNA, 16 nt, Mycobacterium avium subsp. paratuberculosis
gcguugaucagcgcca

SEQ ID NO: 845255 - RNA, 17 nt, Mycobacterium avium subsp. paratuberculosis
gcguugaucagcgccag

SEQ ID NO: 845256 - RNA, 18 nt, Mycobacterium avium subsp. paratuberculosis
gcguugaucagcgccagg

SEQ ID NO: 845257 - RNA, 13 nt, Mycobacterium avium subsp. paratuberculosis
gcguugagccggc

SEQ ID NO: 845258 - RNA, 15 nt, Mycobacterium avium subsp. paratuberculosis
gcguugagccggcgc

SEQ ID NO: 845259 - RNA, 16 nt, Mycobacterium avium subsp. paratuberculosis
gcguugagcgucgcca

SEQ ID NO: 845260 - RNA, 18 nt, Mycobacterium avium subsp. paratuberculosis
gcguugcagaacgcgcgg

SEQ ID NO: 845261 - RNA, 13 nt, Mycobacterium avium subsp. paratuberculosis
gcguugagcacgc

SEQ ID NO: 845262 - RNA, 21 nt, Mycobacterium avium subsp. paratuberculosis
gcguugaugcgggcgugcggu

SEQ ID NO: 845263 - RNA, 20 nt, Mycobacterium avium subsp. paratuberculosis
gcguugccgcgcgcccgcgg

SEQ ID NO: 845264 - RNA, 16 nt, Mycobacterium avium subsp. paratuberculosis
gcguugcauuucggcg

SEQ ID NO: 845265 - RNA, 15 nt, Mycobacterium avium subsp. paratuberculosis
gcguugccgccggcg

SEQ ID NO: 845266 - RNA, 17 nt, Mycobacterium avium subsp. paratuberculosis
gcguugccgccggcgcg

SEQ ID NO: 845267 - RNA, 22 nt, Mycobacterium avium subsp. paratuberculosis
gcguugcagcgccgcggcgccc

SEQ ID NO: 845268 - RNA, 16 nt, Mycobacterium avium subsp. paratuberculosis
gcguugcccgccgcgg

SEQ ID NO: 845269 - RNA, 18 nt, Mycobacterium avium subsp. paratuberculosis
gcguugcccgccgcggcg

SEQ ID NO: 845270 - RNA, 16 nt, Mycobacterium avium subsp. paratuberculosis
gcguugcggccgucca

SEQ ID NO: 845271 - RNA, 16 nt, Mycobacterium avium subsp. paratuberculosis
gcguugcgggcgaacg

SEQ ID NO: 845272 - RNA, 17 nt, Mycobacterium avium subsp. paratuberculosis
gcguugcgcggaccggc

SEQ ID NO: 845273 - RNA, 15 nt, Mycobacterium avium subsp. paratuberculosis
gcguugcgcggcggc

SEQ ID NO: 845274 - RNA, 17 nt, Mycobacterium avium subsp. paratuberculosis
gcguugcgcggcggcca

SEQ ID NO: 845275 - RNA, 18 nt, Mycobacterium avium subsp. paratuberculosis
gcgugucggcgaucgcgc

SEQ ID NO: 845276 - RNA, 16 nt, Mycobacterium avium subsp. paratuberculosis
gcgugucggcgccacc

SEQ ID NO: 845277 - RNA, 21 nt, Mycobacterium avium subsp. paratuberculosis
gcgugugcccagcacgacgcc

SEQ ID NO: 845278 - RNA, 16 nt, Mycobacterium avium subsp. paratuberculosis
gcgugugcccgccucg

SEQ ID NO: 845279 - RNA, 20 nt, Mycobacterium avium subsp. paratuberculosis
gcgugugcccgccucgcagc

SEQ ID NO: 845280 - RNA, 14 nt, Mycobacterium avium subsp. paratuberculosis
gcgugugcccagca

SEQ ID NO: 845281 - RNA, 15 nt, Mycobacterium avium subsp. paratuberculosis
gcgugugcccagcac

SEQ ID NO: 845282 - RNA, 16 nt, Mycobacterium avium subsp. paratuberculosis
gcgugucacuacccgc

SEQ ID NO: 845283 - RNA, 20 nt, Mycobacterium avium subsp. paratuberculosis
gcgugucacuacccgcgaug

SEQ ID NO: 845284 - RNA, 21 nt, Mycobacterium avium subsp. paratuberculosis
gcgugucacuacccgcgaugg

SEQ ID NO: 845285 - RNA, 16 nt, Mycobacterium avium subsp. paratuberculosis
gcgugucgccggggcg

SEQ ID NO: 845286 - RNA, 17 nt, Mycobacterium avium subsp. paratuberculosis
gcgugucgccggggcgg

SEQ ID NO: 845287 - RNA, 19 nt, Mycobacterium avium subsp. paratuberculosis
gcgugucgugugcgugacg

SEQ ID NO: 845288 - RNA, 20 nt, Mycobacterium avium subsp. paratuberculosis
gcgugucgugugcgugacgu

SEQ ID NO: 845289 - RNA, 13 nt, Mycobacterium avium subsp. paratuberculosis
gcguguggcccug

SEQ ID NO: 845290 - RNA, 18 nt, Mycobacterium avium subsp. paratuberculosis
gcguuccagcacccggcc

SEQ ID NO: 845291 - RNA, 23 nt, Mycobacterium avium subsp. paratuberculosis
gcguuccagcacccggcccacgc

SEQ ID NO: 845292 - RNA, 18 nt, Mycobacterium avium subsp. paratuberculosis
gcguuccagcacgcccag

SEQ ID NO: 845293 - RNA, 15 nt, Mycobacterium avium subsp. paratuberculosis
gcguuccagguccgc

SEQ ID NO: 845294 - RNA, 20 nt, Mycobacterium avium subsp. paratuberculosis
gcguuccagguucagcccgg

SEQ ID NO: 845295 - RNA, 21 nt, Mycobacterium avium subsp. paratuberculosis
gcguuccagguucagcccggc

SEQ ID NO: 845296 - RNA, 22 nt, Mycobacterium avium subsp. paratuberculosis
gcguuccaucagcgcccgcgcg

SEQ ID NO: 845297 - RNA, 23 nt, Mycobacterium avium subsp. paratuberculosis
gcguuccaucagcgcccgcgcgg

SEQ ID NO: 845298 - RNA, 20 nt, Mycobacterium avium subsp. paratuberculosis
gcguuccaucugcucguggu

SEQ ID NO: 845299 - RNA, 19 nt, Mycobacterium avium subsp. paratuberculosis
gcguucccagcccggccag

SEQ ID NO: 845300 - RNA, 13 nt, Mycobacterium avium subsp. paratuberculosis
gcguucccgcgcg

SEQ ID NO: 845301 - RNA, 15 nt, Mycobacterium avium subsp. paratuberculosis
gcguucccgggcccg

SEQ ID NO: 845302 - RNA, 22 nt, Mycobacterium avium subsp. paratuberculosis
gcguucccgggcccgcugcagc

SEQ ID NO: 845303 - RNA, 17 nt, Mycobacterium avium subsp. paratuberculosis
gcguuccuuacgccgac

SEQ ID NO: 845304 - RNA, 16 nt, Mycobacterium avium subsp. paratuberculosis
gcguuccgccacggcg

SEQ ID NO: 845305 - RNA, 15 nt, Mycobacterium avium subsp. paratuberculosis
gcguuccgccguccu

SEQ ID NO: 845306 - RNA, 15 nt, Mycobacterium avium subsp. paratuberculosis
gcguuccggcggccg

SEQ ID NO: 845307 - RNA, 17 nt, Mycobacterium avium subsp. paratuberculosis
gcguuccgucggcgagu

SEQ ID NO: 845308 - RNA, 15 nt, Mycobacterium avium subsp. paratuberculosis
gcguuccucgacggc

SEQ ID NO: 845309 - RNA, 18 nt, Mycobacterium avium subsp. paratuberculosis
gcguuccucgacggcgaa

SEQ ID NO: 845310 - RNA, 20 nt, Mycobacterium avium subsp. paratuberculosis
gcguuccucgacggcgaagc

SEQ ID NO: 845311 - RNA, 20 nt, Mycobacterium avium subsp. paratuberculosis
gcguucggacaccucggcca

SEQ ID NO: 845312 - RNA, 21 nt, Mycobacterium avium subsp. paratuberculosis
gcguucggacaccucggccag

SEQ ID NO: 845313 - RNA, 13 nt, Mycobacterium avium subsp. paratuberculosis
gcguucggccgca

SEQ ID NO: 845314 - RNA, 17 nt, Mycobacterium avium subsp. paratuberculosis
gcguucggccgcagcgg

SEQ ID NO: 845315 - RNA, 19 nt, Mycobacterium avium subsp. paratuberculosis
gcguucggccgcagcggga

SEQ ID NO: 845316 - RNA, 19 nt, Mycobacterium avium subsp. paratuberculosis
gcguucgacccacaccucg

SEQ ID NO: 845317 - RNA, 19 nt, Mycobacterium avium subsp. paratuberculosis
gcguucgaguucgucgacc

SEQ ID NO: 845318 - RNA, 12 nt, Mycobacterium avium subsp. paratuberculosis
gcguucgccgag

SEQ ID NO: 845319 - RNA, 13 nt, Mycobacterium avium subsp. paratuberculosis
aagcagcggcagc

SEQ ID NO: 845320 - RNA, 16 nt, Mycobacterium avium subsp. paratuberculosis
gccggccuucucgcgc

SEQ ID NO: 845321 - RNA, 18 nt, Mycobacterium avium subsp. paratuberculosis
gccggccuucucgcgcac

SEQ ID NO: 845322 - RNA, 20 nt, Mycobacterium avium subsp. paratuberculosis
gccggccuucucgcgcaccg

SEQ ID NO: 845323 - RNA, 23 nt, Mycobacterium avium subsp. paratuberculosis
gccggccuucucgcgcaccgcgg

SEQ ID NO: 845324 - RNA, 21 nt, Mycobacterium avium subsp. paratuberculosis
gccggccugcuuuucggccga

SEQ ID NO: 845325 - RNA, 12 nt, Mycobacterium avium subsp. paratuberculosis
gccggccuggcc

SEQ ID NO: 845326 - RNA, 17 nt, Mycobacterium avium subsp. paratuberculosis
gccggccuggcccagcc

SEQ ID NO: 845327 - RNA, 17 nt, Mycobacterium avium subsp. paratuberculosis
gccggccugccaccgcg

SEQ ID NO: 845328 - RNA, 18 nt, Mycobacterium avium subsp. paratuberculosis
gccggccugccaccgcga

SEQ ID NO: 845329 - RNA, 21 nt, Mycobacterium avium subsp. paratuberculosis
gccggccugcccgccgcggcc

SEQ ID NO: 845330 - RNA, 23 nt, Mycobacterium avium subsp. paratuberculosis
gccggccugccggaugccgcgcg

SEQ ID NO: 845331 - RNA, 20 nt, Mycobacterium avium subsp. paratuberculosis
gccggccucgaugucgucga

SEQ ID NO: 845332 - RNA, 21 nt, Mycobacterium avium subsp. paratuberculosis
gccggccucgaugucgucgau

SEQ ID NO: 845333 - RNA, 16 nt, Mycobacterium avium subsp. paratuberculosis
gccggccucgucggcg

SEQ ID NO: 845334 - RNA, 17 nt, Mycobacterium avium subsp. paratuberculosis
gccggccucgucggcga

SEQ ID NO: 845335 - RNA, 19 nt, Mycobacterium avium subsp. paratuberculosis
gccggccucucgucgacga

SEQ ID NO: 845336 - RNA, 20 nt, Mycobacterium avium subsp. paratuberculosis
gccggccucucgucgacgau

SEQ ID NO: 845337 - RNA, 22 nt, Mycobacterium avium subsp. paratuberculosis
gccggccucucgucgacgaugg

SEQ ID NO: 845338 - RNA, 16 nt, Mycobacterium avium subsp. paratuberculosis
gccggccuccagcugu

SEQ ID NO: 845339 - RNA, 19 nt, Mycobacterium avium subsp. paratuberculosis
gccggccuccagcuguuga

SEQ ID NO: 845340 - RNA, 14 nt, Mycobacterium avium subsp. paratuberculosis
gccggccucgccgg

SEQ ID NO: 845341 - RNA, 15 nt, Mycobacterium avium subsp. paratuberculosis
gccggccucgccggc

SEQ ID NO: 845342 - RNA, 16 nt, Mycobacterium avium subsp. paratuberculosis
gccggccucgccggcg

SEQ ID NO: 845343 - RNA, 19 nt, Mycobacterium avium subsp. paratuberculosis
gccggccucgccggcgccg

SEQ ID NO: 845344 - RNA, 18 nt, Mycobacterium avium subsp. paratuberculosis
gccggccgugccggcucg

SEQ ID NO: 845345 - RNA, 21 nt, Mycobacterium avium subsp. paratuberculosis
gccggccgugccggcucggcg

SEQ ID NO: 845346 - RNA, 14 nt, Mycobacterium avium subsp. paratuberculosis
gccggccguucgcc

SEQ ID NO: 845347 - RNA, 19 nt, Mycobacterium avium subsp. paratuberculosis
gccggccguucgccggcca

SEQ ID NO: 845348 - RNA, 23 nt, Mycobacterium avium subsp. paratuberculosis
gccggccguucgccggccagcac

SEQ ID NO: 845349 - RNA, 14 nt, Mycobacterium avium subsp. paratuberculosis
gccggccguugcgg

SEQ ID NO: 845350 - RNA, 18 nt, Mycobacterium avium subsp. paratuberculosis
gccggccguugcgggugu

SEQ ID NO: 845351 - RNA, 12 nt, Mycobacterium avium subsp. paratuberculosis
gccggccuaccu

SEQ ID NO: 845352 - RNA, 15 nt, Mycobacterium avium subsp. paratuberculosis
gccggccgccggauc

SEQ ID NO: 845353 - RNA, 15 nt, Mycobacterium avium subsp. paratuberculosis
gccggccgucacgcu

SEQ ID NO: 845354 - RNA, 17 nt, Mycobacterium avium subsp. paratuberculosis
gccggccgucacgcugg

SEQ ID NO: 845355 - RNA, 17 nt, Mycobacterium avium subsp. paratuberculosis
gccggccguccacggcg

SEQ ID NO: 845356 - RNA, 20 nt, Mycobacterium avium subsp. paratuberculosis
gccggccguccacggcggug

SEQ ID NO: 845357 - RNA, 13 nt, Mycobacterium avium subsp. paratuberculosis
gccggccggucga

SEQ ID NO: 845358 - RNA, 13 nt, Mycobacterium avium subsp. paratuberculosis
gccggccggggcg

SEQ ID NO: 845359 - RNA, 14 nt, Mycobacterium avium subsp. paratuberculosis
gccggccggggcgg

SEQ ID NO: 845360 - RNA, 18 nt, Mycobacterium avium subsp. paratuberculosis
gccggccggggcggcggu

SEQ ID NO: 845361 - RNA, 13 nt, Mycobacterium avium subsp. paratuberculosis
gccggccggguca

SEQ ID NO: 845362 - RNA, 14 nt, Mycobacterium avium subsp. paratuberculosis
gccggccgggucga

SEQ ID NO: 845363 - RNA, 15 nt, Mycobacterium avium subsp. paratuberculosis
aagcauuggcccaca

SEQ ID NO: 845364 - RNA, 17 nt, Mycobacterium avium subsp. paratuberculosis
gccggccuuggcccgcg

SEQ ID NO: 845365 - RNA, 19 nt, Mycobacterium avium subsp. paratuberculosis
gccggccuuggcccgcgcc

SEQ ID NO: 845366 - RNA, 22 nt, Mycobacterium avium subsp. paratuberculosis
gccggccuuggcccgcgcccgc

SEQ ID NO: 845367 - RNA, 23 nt, Mycobacterium avium subsp. paratuberculosis
gccggccuuggcccgcgcccgcu

SEQ ID NO: 845368 - RNA, 17 nt, Mycobacterium avium subsp. paratuberculosis
gccggcgaaacacagca

SEQ ID NO: 845369 - RNA, 18 nt, Mycobacterium avium subsp. paratuberculosis
gccggcgaaacacagcag

SEQ ID NO: 845370 - RNA, 20 nt, Mycobacterium avium subsp. paratuberculosis
gccggcgaaacacagcagca

SEQ ID NO: 845371 - RNA, 21 nt, Mycobacterium avium subsp. paratuberculosis
gccggcgaaacacagcagcac

SEQ ID NO: 845372 - RNA, 23 nt, Mycobacterium avium subsp. paratuberculosis
gccggcgaaacacagcagcacgc

SEQ ID NO: 845373 - RNA, 19 nt, Mycobacterium avium subsp. paratuberculosis
gccggccuugcucgccgcg

SEQ ID NO: 845374 - RNA, 16 nt, Mycobacterium avium subsp. paratuberculosis
gccggcgaagcucgac

SEQ ID NO: 845375 - RNA, 17 nt, Mycobacterium avium subsp. paratuberculosis
gccggcgaagcucgacg

SEQ ID NO: 845376 - RNA, 18 nt, Mycobacterium avium subsp. paratuberculosis
gccggcgaaggacagccg

SEQ ID NO: 845377 - RNA, 21 nt, Mycobacterium avium subsp. paratuberculosis
gccggcgaaggacagccggac

SEQ ID NO: 845378 - RNA, 22 nt, Mycobacterium avium subsp. paratuberculosis
gccggcgaaggacagccggacg

SEQ ID NO: 845379 - RNA, 16 nt, Mycobacterium avium subsp. paratuberculosis
gccggcgaagccgcuc

SEQ ID NO: 845380 - RNA, 18 nt, Mycobacterium avium subsp. paratuberculosis
gccggcgaaccgccgcac

SEQ ID NO: 845381 - RNA, 19 nt, Mycobacterium avium subsp. paratuberculosis
gccggcgaaccgccgcacc

SEQ ID NO: 845382 - RNA, 23 nt, Mycobacterium avium subsp. paratuberculosis
gccggcgaaccgccgcacccagc

SEQ ID NO: 845383 - RNA, 16 nt, Mycobacterium avium subsp. paratuberculosis
gccggcgaacgacguc

SEQ ID NO: 845384 - RNA, 17 nt, Mycobacterium avium subsp. paratuberculosis
gccggcgaacgacgucg

SEQ ID NO: 845385 - RNA, 20 nt, Mycobacterium avium subsp. paratuberculosis
gccggcgaacgacgucgagg

SEQ ID NO: 845386 - RNA, 11 nt, Mycobacterium avium subsp. paratuberculosis
gccggcgaacu

SEQ ID NO: 845387 - RNA, 17 nt, Mycobacterium avium subsp. paratuberculosis
gccggcgaacuccaccc

SEQ ID NO: 845388 - RNA, 19 nt, Mycobacterium avium subsp. paratuberculosis
gccggcgaacuccacccug

SEQ ID NO: 845389 - RNA, 12 nt, Mycobacterium avium subsp. paratuberculosis
gccggcgagucg

SEQ ID NO: 845390 - RNA, 19 nt, Mycobacterium avium subsp. paratuberculosis
gccggcgagugcgaaucau

SEQ ID NO: 845391 - RNA, 14 nt, Mycobacterium avium subsp. paratuberculosis
gccggcgauccgcg

SEQ ID NO: 845392 - RNA, 16 nt, Mycobacterium avium subsp. paratuberculosis
gccggcgauccgcgcg

SEQ ID NO: 845393 - RNA, 20 nt, Mycobacterium avium subsp. paratuberculosis
gccggcgauccgcgcggcga

SEQ ID NO: 845394 - RNA, 23 nt, Mycobacterium avium subsp. paratuberculosis
gccggcgauccgcgcggcgacga

SEQ ID NO: 845395 - RNA, 14 nt, Mycobacterium avium subsp. paratuberculosis
gccggcgaucgacg

SEQ ID NO: 845396 - RNA, 15 nt, Mycobacterium avium subsp. paratuberculosis
gccggcgaucgacgu

SEQ ID NO: 845397 - RNA, 17 nt, Mycobacterium avium subsp. paratuberculosis
gccggcgaucgacguca

SEQ ID NO: 845398 - RNA, 16 nt, Mycobacterium avium subsp. paratuberculosis
gccggcgacgguggcg

SEQ ID NO: 845399 - RNA, 20 nt, Mycobacterium avium subsp. paratuberculosis
gccggcgacgguggcgccca

SEQ ID NO: 845400 - RNA, 22 nt, Mycobacterium avium subsp. paratuberculosis
gccggcgacgguggcgcccagc

SEQ ID NO: 845401 - RNA, 16 nt, Mycobacterium avium subsp. paratuberculosis
gccggcgagcgcgcug

SEQ ID NO: 845402 - RNA, 17 nt, Mycobacterium avium subsp. paratuberculosis
gccggcgagcucgcggc

SEQ ID NO: 845403 - RNA, 18 nt, Mycobacterium avium subsp. paratuberculosis
gccggcgagcucgcggcc

SEQ ID NO: 845404 - RNA, 20 nt, Mycobacterium avium subsp. paratuberculosis
gccggcgagcucgcggccgu

SEQ ID NO: 845405 - RNA, 19 nt, Mycobacterium avium subsp. paratuberculosis
gccggcgacggccagcgcg

SEQ ID NO: 845406 - RNA, 22 nt, Mycobacterium avium subsp. paratuberculosis
gccggcgacggccagcgcggcg

SEQ ID NO: 845407 - RNA, 13 nt, Mycobacterium avium subsp. paratuberculosis
gccggcgacggcg

SEQ ID NO: 845408 - RNA, 17 nt, Mycobacterium avium subsp. paratuberculosis
gccggcgacggcgaguu

SEQ ID NO: 845409 - RNA, 20 nt, Mycobacterium avium subsp. paratuberculosis
gccggcgacgauaucggccg

SEQ ID NO: 845410 - RNA, 22 nt, Mycobacterium avium subsp. paratuberculosis
gccggcgacgauaucggccgcg

SEQ ID NO: 845411 - RNA, 14 nt, Mycobacterium avium subsp. paratuberculosis
gccggcgacgccgg

SEQ ID NO: 845412 - RNA, 17 nt, Mycobacterium avium subsp. paratuberculosis
gccggcgacgaccgcac

SEQ ID NO: 845413 - RNA, 18 nt, Mycobacterium avium subsp. paratuberculosis
gccggcgacgaccgcacc

SEQ ID NO: 845414 - RNA, 19 nt, Mycobacterium avium subsp. paratuberculosis
gccggcgaccgccaccucg

SEQ ID NO: 845415 - RNA, 22 nt, Mycobacterium avium subsp. paratuberculosis
gccggcgaccgccuugucggcg

SEQ ID NO: 845416 - RNA, 14 nt, Mycobacterium avium subsp. paratuberculosis
gccggcgaccagcc

SEQ ID NO: 845417 - RNA, 22 nt, Mycobacterium avium subsp. paratuberculosis
gccggcgaccagccccucgacc

SEQ ID NO: 845418 - RNA, 23 nt, Mycobacterium avium subsp. paratuberculosis
gccggcgaccagccccucgacca

SEQ ID NO: 845419 - RNA, 13 nt, Mycobacterium avium subsp. paratuberculosis
gccggccccgccc

SEQ ID NO: 845420 - RNA, 15 nt, Mycobacterium avium subsp. paratuberculosis
gccggccccgcccgg

SEQ ID NO: 845421 - RNA, 16 nt, Mycobacterium avium subsp. paratuberculosis
gccggccccgcccggc

SEQ ID NO: 845422 - RNA, 18 nt, Mycobacterium avium subsp. paratuberculosis
gccggccccgcccggcgc

SEQ ID NO: 845423 - RNA, 19 nt, Mycobacterium avium subsp. paratuberculosis
gccggccccgcccggcgcg

SEQ ID NO: 845424 - RNA, 21 nt, Mycobacterium avium subsp. paratuberculosis
gccggccccgcccggcgcgca

SEQ ID NO: 845425 - RNA, 20 nt, Mycobacterium avium subsp. paratuberculosis
gccggccccgcccggggcgg

SEQ ID NO: 845426 - RNA, 22 nt, Mycobacterium avium subsp. paratuberculosis
gccggccccgcccggggcggcg

SEQ ID NO: 845427 - RNA, 13 nt, Mycobacterium avium subsp. paratuberculosis
gccggcccagcgc

SEQ ID NO: 845428 - RNA, 17 nt, Mycobacterium avium subsp. paratuberculosis
gccggcccagcgcgcgg

SEQ ID NO: 845429 - RNA, 18 nt, Mycobacterium avium subsp. paratuberculosis
gccggcccagcgcgcggc

SEQ ID NO: 845430 - RNA, 20 nt, Mycobacterium avium subsp. paratuberculosis
gccggcccagcgcgcggcgg

SEQ ID NO: 845431 - RNA, 11 nt, Mycobacterium avium subsp. paratuberculosis
gccggcccagu

SEQ ID NO: 845432 - RNA, 20 nt, Mycobacterium avium subsp. paratuberculosis
gccggcccaguggaucggcc

SEQ ID NO: 845433 - RNA, 22 nt, Mycobacterium avium subsp. paratuberculosis
gccggcccaguggaucggcccg

SEQ ID NO: 845434 - RNA, 18 nt, Mycobacterium avium subsp. paratuberculosis
gccggcccgcccggcggc

SEQ ID NO: 845435 - RNA, 19 nt, Mycobacterium avium subsp. paratuberculosis
gccggcccgcccggcggcg

SEQ ID NO: 845436 - RNA, 14 nt, Mycobacterium avium subsp. paratuberculosis
gccggcccgcccgu

SEQ ID NO: 845437 - RNA, 18 nt, Mycobacterium avium subsp. paratuberculosis
gccggcccgcagccagcg

SEQ ID NO: 845438 - RNA, 16 nt, Mycobacterium avium subsp. paratuberculosis
gccggcccgcagcgcc

SEQ ID NO: 845439 - RNA, 12 nt, Mycobacterium avium subsp. paratuberculosis
gccggcccgcau

SEQ ID NO: 845440 - RNA, 17 nt, Mycobacterium avium subsp. paratuberculosis
gccggcccgcaucgcgg

SEQ ID NO: 845441 - RNA, 17 nt, Mycobacterium avium subsp. paratuberculosis
gccggccccuaccgccg

SEQ ID NO: 845442 - RNA, 18 nt, Mycobacterium avium subsp. paratuberculosis
gccggccccggccgggcg

SEQ ID NO: 845443 - RNA, 13 nt, Mycobacterium avium subsp. paratuberculosis
gccggccccggcg

SEQ ID NO: 845444 - RNA, 15 nt, Mycobacterium avium subsp. paratuberculosis
gccggccccggcgac

SEQ ID NO: 845445 - RNA, 16 nt, Mycobacterium avium subsp. paratuberculosis
gccggccccggcgacg

SEQ ID NO: 845446 - RNA, 19 nt, Mycobacterium avium subsp. paratuberculosis
gccggccccggcgacggcg

SEQ ID NO: 845447 - RNA, 22 nt, Mycobacterium avium subsp. paratuberculosis
gccggccccggcgacggcggcc

SEQ ID NO: 845448 - RNA, 14 nt, Mycobacterium avium subsp. paratuberculosis
gccggccccggggg

SEQ ID NO: 845449 - RNA, 22 nt, Mycobacterium avium subsp. paratuberculosis
gccggccaccucgucccagcgc

SEQ ID NO: 845450 - RNA, 14 nt, Mycobacterium avium subsp. paratuberculosis
gccggccaucucgg

SEQ ID NO: 845451 - RNA, 16 nt, Mycobacterium avium subsp. paratuberculosis
gccggccaucucggcg

SEQ ID NO: 845452 - RNA, 18 nt, Mycobacterium avium subsp. paratuberculosis
gccggccaucucggcggc

SEQ ID NO: 845453 - RNA, 16 nt, Mycobacterium avium subsp. paratuberculosis
gccggccaucugcugg

SEQ ID NO: 845454 - RNA, 20 nt, Mycobacterium avium subsp. paratuberculosis
gccggccaugcccucgaucg

SEQ ID NO: 845455 - RNA, 16 nt, Mycobacterium avium subsp. paratuberculosis
gccggccaguucccgg

SEQ ID NO: 845456 - RNA, 18 nt, Mycobacterium avium subsp. paratuberculosis
gccggccaguucccgggc

SEQ ID NO: 845457 - RNA, 19 nt, Mycobacterium avium subsp. paratuberculosis
gccggccaguucccgggcg

SEQ ID NO: 845458 - RNA, 22 nt, Mycobacterium avium subsp. paratuberculosis
gccggccaguucccgggcgaac

SEQ ID NO: 845459 - RNA, 17 nt, Mycobacterium avium subsp. paratuberculosis
gccggccagguugacca

SEQ ID NO: 845460 - RNA, 19 nt, Mycobacterium avium subsp. paratuberculosis
gccggccagguugaccacc

SEQ ID NO: 845461 - RNA, 22 nt, Mycobacterium avium subsp. paratuberculosis
gccggccagguugaccaccagc

SEQ ID NO: 845462 - RNA, 18 nt, Mycobacterium avium subsp. paratuberculosis
gccggccaguccugggcc

SEQ ID NO: 845463 - RNA, 15 nt, Mycobacterium avium subsp. paratuberculosis
gccggccagcggcca

SEQ ID NO: 845464 - RNA, 22 nt, Mycobacterium avium subsp. paratuberculosis
gccggccagcuuuccggccgcc

SEQ ID NO: 845465 - RNA, 21 nt, Mycobacterium avium subsp. paratuberculosis
gccggccaggcacagcagggc

SEQ ID NO: 845466 - RNA, 23 nt, Mycobacterium avium subsp. paratuberculosis
gccggccaggcacagcagggcac

SEQ ID NO: 845467 - RNA, 15 nt, Mycobacterium avium subsp. paratuberculosis
gccggccaggccggc

SEQ ID NO: 845468 - RNA, 16 nt, Mycobacterium avium subsp. paratuberculosis
gccggccaggccggcc

SEQ ID NO: 845469 - RNA, 17 nt, Mycobacterium avium subsp. paratuberculosis
gccggccaggccggccu

SEQ ID NO: 845470 - RNA, 13 nt, Mycobacterium avium subsp. paratuberculosis
gccggccgggcgg

SEQ ID NO: 845471 - RNA, 14 nt, Mycobacterium avium subsp. paratuberculosis
gccggccgggcgga

SEQ ID NO: 845472 - RNA, 22 nt, Mycobacterium avium subsp. paratuberculosis
gccggccgggcggacggcaccg

SEQ ID NO: 845473 - RNA, 23 nt, Mycobacterium avium subsp. paratuberculosis
gccggccgggcugcgcagcaccg

SEQ ID NO: 845474 - RNA, 16 nt, Mycobacterium avium subsp. paratuberculosis
gccggccgggacgcgg

SEQ ID NO: 845475 - RNA, 21 nt, Mycobacterium avium subsp. paratuberculosis
gccggccgggacgcgguccag

SEQ ID NO: 845476 - RNA, 14 nt, Mycobacterium avium subsp. paratuberculosis
gccggccggcgcgu

SEQ ID NO: 845477 - RNA, 15 nt, Mycobacterium avium subsp. paratuberculosis
gccggccggcgcgug

SEQ ID NO: 845478 - RNA, 16 nt, Mycobacterium avium subsp. paratuberculosis
gccggccggcgcgugc

SEQ ID NO: 845479 - RNA, 12 nt, Mycobacterium avium subsp. paratuberculosis
gccggccggcgg

SEQ ID NO: 845480 - RNA, 14 nt, Mycobacterium avium subsp. paratuberculosis
gccggccggcgguc

SEQ ID NO: 845481 - RNA, 15 nt, Mycobacterium avium subsp. paratuberculosis
gccggccggcgguca

SEQ ID NO: 845482 - RNA, 13 nt, Mycobacterium avium subsp. paratuberculosis
gccggccggcgug

SEQ ID NO: 845483 - RNA, 15 nt, Mycobacterium avium subsp. paratuberculosis
gccggccggacaccg

SEQ ID NO: 845484 - RNA, 20 nt, Mycobacterium avium subsp. paratuberculosis
gccggccggagcggauggcg

SEQ ID NO: 845485 - RNA, 13 nt, Mycobacterium avium subsp. paratuberculosis
gccggccggcacg

SEQ ID NO: 845486 - RNA, 23 nt, Mycobacterium avium subsp. paratuberculosis
gccggccggcacgauggcgcggc

SEQ ID NO: 845487 - RNA, 13 nt, Mycobacterium avium subsp. paratuberculosis
gccggccggcagc

SEQ ID NO: 845488 - RNA, 16 nt, Mycobacterium avium subsp. paratuberculosis
gccggccggcagcugc

SEQ ID NO: 845489 - RNA, 17 nt, Mycobacterium avium subsp. paratuberculosis
gccggccggcagcugcc

SEQ ID NO: 845490 - RNA, 14 nt, Mycobacterium avium subsp. paratuberculosis
gccggccggcaggu

SEQ ID NO: 845491 - RNA, 14 nt, Mycobacterium avium subsp. paratuberculosis
gccggccggccgac

SEQ ID NO: 845492 - RNA, 15 nt, Mycobacterium avium subsp. paratuberculosis
gccggccggccgaca

SEQ ID NO: 845493 - RNA, 14 nt, Mycobacterium avium subsp. paratuberculosis
gccggccggccgug

SEQ ID NO: 845494 - RNA, 17 nt, Mycobacterium avium subsp. paratuberculosis
gccggccggccgugccg

SEQ ID NO: 845495 - RNA, 17 nt, Mycobacterium avium subsp. paratuberculosis
gccggccggcgaagccg

SEQ ID NO: 845496 - RNA, 12 nt, Mycobacterium avium subsp. paratuberculosis
gccggccggcgc

SEQ ID NO: 845497 - RNA, 16 nt, Mycobacterium avium subsp. paratuberculosis
gccggccgcuacccgg

SEQ ID NO: 845498 - RNA, 18 nt, Mycobacterium avium subsp. paratuberculosis
gccggccgcuacccggcg

SEQ ID NO: 845499 - RNA, 14 nt, Mycobacterium avium subsp. paratuberculosis
gccggccgcggcgu

SEQ ID NO: 845500 - RNA, 15 nt, Mycobacterium avium subsp. paratuberculosis
gccggccgcucgcgg

SEQ ID NO: 845501 - RNA, 21 nt, Mycobacterium avium subsp. paratuberculosis
gccggccgcucgcgggccaca

SEQ ID NO: 845502 - RNA, 15 nt, Mycobacterium avium subsp. paratuberculosis
gccggccgcgggcga

SEQ ID NO: 845503 - RNA, 12 nt, Mycobacterium avium subsp. paratuberculosis
gccggccgcggu

SEQ ID NO: 845504 - RNA, 16 nt, Mycobacterium avium subsp. paratuberculosis
gccggccgcggugugc

SEQ ID NO: 845505 - RNA, 21 nt, Mycobacterium avium subsp. paratuberculosis
gccggccgcggugugcccggc

SEQ ID NO: 845506 - RNA, 13 nt, Mycobacterium avium subsp. paratuberculosis
gccggccgcgucg

SEQ ID NO: 845507 - RNA, 16 nt, Mycobacterium avium subsp. paratuberculosis
gccggccgcgucgccg

SEQ ID NO: 845508 - RNA, 19 nt, Mycobacterium avium subsp. paratuberculosis
gccggccgcgucgccgacc

SEQ ID NO: 845509 - RNA, 20 nt, Mycobacterium avium subsp. paratuberculosis
gccggccgcgucgccgacca

SEQ ID NO: 845510 - RNA, 13 nt, Mycobacterium avium subsp. paratuberculosis
gccggccgcgcgu

SEQ ID NO: 845511 - RNA, 16 nt, Mycobacterium avium subsp. paratuberculosis
gccggccgcgcagauc

SEQ ID NO: 845512 - RNA, 19 nt, Mycobacterium avium subsp. paratuberculosis
gccggccgcgcagaucgag

SEQ ID NO: 845513 - RNA, 22 nt, Mycobacterium avium subsp. paratuberculosis
gccggccgcgcagaucgagauc

SEQ ID NO: 845514 - RNA, 13 nt, Mycobacterium avium subsp. paratuberculosis
gccggccgcggcg

SEQ ID NO: 845515 - RNA, 15 nt, Mycobacterium avium subsp. paratuberculosis
gccggccgcgcgcgg

SEQ ID NO: 845516 - RNA, 17 nt, Mycobacterium avium subsp. paratuberculosis
gccggccgcgcgcggcg

SEQ ID NO: 845517 - RNA, 14 nt, Mycobacterium avium subsp. paratuberculosis
gccggccgccgugg

SEQ ID NO: 845518 - RNA, 16 nt, Mycobacterium avium subsp. paratuberculosis
gccggccgccuggacg

SEQ ID NO: 845519 - RNA, 22 nt, Mycobacterium avium subsp. paratuberculosis
gccggccgccuggacgacgucg

SEQ ID NO: 845520 - RNA, 23 nt, Mycobacterium avium subsp. paratuberculosis
gccggccgccuggacgacgucga

SEQ ID NO: 845521 - RNA, 20 nt, Mycobacterium avium subsp. paratuberculosis
gccggccgccggcggccaau

SEQ ID NO: 845522 - RNA, 14 nt, Mycobacterium avium subsp. paratuberculosis
gccggccgccggcg

SEQ ID NO: 845523 - RNA, 15 nt, Mycobacterium avium subsp. paratuberculosis
gccggccgccggcgg

SEQ ID NO: 845524 - RNA, 12 nt, Mycobacterium avium subsp. paratuberculosis
gccggccgccag

SEQ ID NO: 845525 - RNA, 13 nt, Mycobacterium avium subsp. paratuberculosis
gccggccgccagc

SEQ ID NO: 845526 - RNA, 24 nt, Mycobacterium avium subsp. paratuberculosis
gccggcccgauaggccgacuggug

SEQ ID NO: 845527 - RNA, 12 nt, Mycobacterium avium subsp. paratuberculosis
gccggccgccgc

SEQ ID NO: 845528 - RNA, 21 nt, Mycobacterium avium subsp. paratuberculosis
gccggccgccgaagccggcuc

SEQ ID NO: 845529 - RNA, 23 nt, Mycobacterium avium subsp. paratuberculosis
gccggccgaugaccucgcacagc

SEQ ID NO: 845530 - RNA, 15 nt, Mycobacterium avium subsp. paratuberculosis
gccggccgagccgag

SEQ ID NO: 845531 - RNA, 13 nt, Mycobacterium avium subsp. paratuberculosis
gccggccgagcga

SEQ ID NO: 845532 - RNA, 16 nt, Mycobacterium avium subsp. paratuberculosis
gccggccgagcgaagg

SEQ ID NO: 845533 - RNA, 23 nt, Mycobacterium avium subsp. paratuberculosis
gccggccgacaacgacagcaccc

SEQ ID NO: 845534 - RNA, 20 nt, Mycobacterium avium subsp. paratuberculosis
gccggccgacauggacgcgg

SEQ ID NO: 845535 - RNA, 15 nt, Mycobacterium avium subsp. paratuberculosis
gccggcccgcggcgg

SEQ ID NO: 845536 - RNA, 16 nt, Mycobacterium avium subsp. paratuberculosis
gccggcccgcggcgga

SEQ ID NO: 845537 - RNA, 15 nt, Mycobacterium avium subsp. paratuberculosis
gccggcccggucgac

SEQ ID NO: 845538 - RNA, 14 nt, Mycobacterium avium subsp. paratuberculosis
gccggcccugcggc

SEQ ID NO: 845539 - RNA, 12 nt, Mycobacterium avium subsp. paratuberculosis
gccggcccggcc

SEQ ID NO: 845540 - RNA, 14 nt, Mycobacterium avium subsp. paratuberculosis
gccggcccggcggg

SEQ ID NO: 845541 - RNA, 13 nt, Mycobacterium avium subsp. paratuberculosis
gccggcccggcgu

SEQ ID NO: 845542 - RNA, 14 nt, Mycobacterium avium subsp. paratuberculosis
gccggcccggcguu

SEQ ID NO: 845543 - RNA, 22 nt, Mycobacterium avium subsp. paratuberculosis
gccggcccggggugugcccgaa

SEQ ID NO: 845544 - RNA, 19 nt, Mycobacterium avium subsp. paratuberculosis
gccggcccgaccggagccg

SEQ ID NO: 845545 - RNA, 19 nt, Mycobacterium avium subsp. paratuberculosis
gccgggauauucgcccagc

SEQ ID NO: 845546 - RNA, 23 nt, Mycobacterium avium subsp. paratuberculosis
gccgggauauucgcccagcggca

SEQ ID NO: 845547 - RNA, 18 nt, Mycobacterium avium subsp. paratuberculosis
gccgggaucacacgcgcg

SEQ ID NO: 845548 - RNA, 17 nt, Mycobacterium avium subsp. paratuberculosis
gccgggaucggcagcgc

SEQ ID NO: 845549 - RNA, 15 nt, Mycobacterium avium subsp. paratuberculosis
gccgggaucggcggg

SEQ ID NO: 845550 - RNA, 19 nt, Mycobacterium avium subsp. paratuberculosis
gccgggaucggcggggcgc

SEQ ID NO: 845551 - RNA, 23 nt, Mycobacterium avium subsp. paratuberculosis
gccgggaugccaguccugggccg

SEQ ID NO: 845552 - RNA, 20 nt, Mycobacterium avium subsp. paratuberculosis
gccgggauagagcaccgcgc

SEQ ID NO: 845553 - RNA, 15 nt, Mycobacterium avium subsp. paratuberculosis
gccggcugcagccgg

SEQ ID NO: 845554 - RNA, 19 nt, Mycobacterium avium subsp. paratuberculosis
gccggcugcagccgggcgg

SEQ ID NO: 845555 - RNA, 19 nt, Mycobacterium avium subsp. paratuberculosis
gccggcugaaccugcuggg

SEQ ID NO: 845556 - RNA, 22 nt, Mycobacterium avium subsp. paratuberculosis
gccggcugaaccugcugggcgg

SEQ ID NO: 845557 - RNA, 14 nt, Mycobacterium avium subsp. paratuberculosis
gccggcugcccgcg

SEQ ID NO: 845558 - RNA, 15 nt, Mycobacterium avium subsp. paratuberculosis
gccggcugcccgcga

SEQ ID NO: 845559 - RNA, 18 nt, Mycobacterium avium subsp. paratuberculosis
gccggcugacugccggcg

SEQ ID NO: 845560 - RNA, 19 nt, Mycobacterium avium subsp. paratuberculosis
gccggcugacugccggcga

SEQ ID NO: 845561 - RNA, 20 nt, Mycobacterium avium subsp. paratuberculosis
gccggcuccaccgcgccggc

SEQ ID NO: 845562 - RNA, 21 nt, Mycobacterium avium subsp. paratuberculosis
gccggcuccaccgcgccggcg

SEQ ID NO: 845563 - RNA, 23 nt, Mycobacterium avium subsp. paratuberculosis
gccggcucgguaugcggcgacga

SEQ ID NO: 845564 - RNA, 20 nt, Mycobacterium avium subsp. paratuberculosis
gccggcuccgcaugcccggg

SEQ ID NO: 845565 - RNA, 22 nt, Mycobacterium avium subsp. paratuberculosis
gccggcuccgcaugcccgggcg

SEQ ID NO: 845566 - RNA, 21 nt, Mycobacterium avium subsp. paratuberculosis
gccggcucgaccucaccccgc

SEQ ID NO: 845567 - RNA, 15 nt, Mycobacterium avium subsp. paratuberculosis
gccggcgugucggcg

SEQ ID NO: 845568 - RNA, 22 nt, Mycobacterium avium subsp. paratuberculosis
gccggcgugucggcgccaccgg

SEQ ID NO: 845569 - RNA, 23 nt, Mycobacterium avium subsp. paratuberculosis
gccggcgucuugaucucggcggc

SEQ ID NO: 845570 - RNA, 18 nt, Mycobacterium avium subsp. paratuberculosis
gccggcgugcacaggccg

SEQ ID NO: 845571 - RNA, 20 nt, Mycobacterium avium subsp. paratuberculosis
gccggcgugcacaggccgcc

SEQ ID NO: 845572 - RNA, 21 nt, Mycobacterium avium subsp. paratuberculosis
gccggcgugcacaggccgccg

SEQ ID NO: 845573 - RNA, 14 nt, Mycobacterium avium subsp. paratuberculosis
gccggcggugcggc

SEQ ID NO: 845574 - RNA, 14 nt, Mycobacterium avium subsp. paratuberculosis
gccggcggugcggg

SEQ ID NO: 845575 - RNA, 16 nt, Mycobacterium avium subsp. paratuberculosis
gccggcggugcgggug

SEQ ID NO: 845576 - RNA, 16 nt, Mycobacterium avium subsp. paratuberculosis
gccggcggugcgucga

SEQ ID NO: 845577 - RNA, 18 nt, Mycobacterium avium subsp. paratuberculosis
gccggcggugcgucgaau

SEQ ID NO: 845578 - RNA, 21 nt, Mycobacterium avium subsp. paratuberculosis
gccggcgguaugcccgggccg

SEQ ID NO: 845579 - RNA, 17 nt, Mycobacterium avium subsp. paratuberculosis
gccggcgguggccaugc

SEQ ID NO: 845580 - RNA, 13 nt, Mycobacterium avium subsp. paratuberculosis
gccggcgguggug

SEQ ID NO: 845581 - RNA, 20 nt, Mycobacterium avium subsp. paratuberculosis
gccggcgguggugccgccgu

SEQ ID NO: 845582 - RNA, 23 nt, Mycobacterium avium subsp. paratuberculosis
gccggcgguggugccgccgucga

SEQ ID NO: 845583 - RNA, 14 nt, Mycobacterium avium subsp. paratuberculosis
gccggcggugucca

SEQ ID NO: 845584 - RNA, 12 nt, Mycobacterium avium subsp. paratuberculosis
gccggcgucggg

SEQ ID NO: 845585 - RNA, 22 nt, Mycobacterium avium subsp. paratuberculosis
gccggcgucgggaccgucgcgc

SEQ ID NO: 845586 - RNA, 23 nt, Mycobacterium avium subsp. paratuberculosis
gccggcgucgggaccgucgcgca

SEQ ID NO: 845587 - RNA, 13 nt, Mycobacterium avium subsp. paratuberculosis
gccggcgucggug

SEQ ID NO: 845588 - RNA, 15 nt, Mycobacterium avium subsp. paratuberculosis
gccggcgucgguguc

SEQ ID NO: 845589 - RNA, 13 nt, Mycobacterium avium subsp. paratuberculosis
gccggcgucgucg

SEQ ID NO: 845590 - RNA, 14 nt, Mycobacterium avium subsp. paratuberculosis
gccggcgucgucga

SEQ ID NO: 845591 - RNA, 18 nt, Mycobacterium avium subsp. paratuberculosis
gccggcgucgucgagcac

SEQ ID NO: 845592 - RNA, 20 nt, Mycobacterium avium subsp. paratuberculosis
gccggcgucgucgagcaccg

SEQ ID NO: 845593 - RNA, 23 nt, Mycobacterium avium subsp. paratuberculosis
gccggcgucgucgagcaccggca

SEQ ID NO: 845594 - RNA, 14 nt, Mycobacterium avium subsp. paratuberculosis
gccggcgucugcau

SEQ ID NO: 845595 - RNA, 18 nt, Mycobacterium avium subsp. paratuberculosis
gccggcgucugcauccgg

SEQ ID NO: 845596 - RNA, 13 nt, Mycobacterium avium subsp. paratuberculosis
gccggcggucagc

SEQ ID NO: 845597 - RNA, 14 nt, Mycobacterium avium subsp. paratuberculosis
gccggcggucgaca

SEQ ID NO: 845598 - RNA, 16 nt, Mycobacterium avium subsp. paratuberculosis
gccggcggucgacacg

SEQ ID NO: 845599 - RNA, 22 nt, Mycobacterium avium subsp. paratuberculosis
gccggcggucgacacgaucggc

SEQ ID NO: 845600 - RNA, 23 nt, Mycobacterium avium subsp. paratuberculosis
gccggcggucgacacgaucggca

SEQ ID NO: 845601 - RNA, 20 nt, Mycobacterium avium subsp. paratuberculosis
gccggcggguucugauacac

SEQ ID NO: 845602 - RNA, 16 nt, Mycobacterium avium subsp. paratuberculosis
gccggcggguuggccg

SEQ ID NO: 845603 - RNA, 22 nt, Mycobacterium avium subsp. paratuberculosis
gccggcggguuggucccgauca

SEQ ID NO: 845604 - RNA, 16 nt, Mycobacterium avium subsp. paratuberculosis
gccggcgguaccgccg

SEQ ID NO: 845605 - RNA, 19 nt, Mycobacterium avium subsp. paratuberculosis
gccggcgguaccgccgauc

SEQ ID NO: 845606 - RNA, 20 nt, Mycobacterium avium subsp. paratuberculosis
gccggcgguaccgccgaucg

SEQ ID NO: 845607 - RNA, 14 nt, Mycobacterium avium subsp. paratuberculosis
gccggcggggcguc

SEQ ID NO: 845608 - RNA, 23 nt, Mycobacterium avium subsp. paratuberculosis
gccggcggggcgucgcccgccga

SEQ ID NO: 845609 - RNA, 12 nt, Mycobacterium avium subsp. paratuberculosis
gccggcgggggc

SEQ ID NO: 845610 - RNA, 16 nt, Mycobacterium avium subsp. paratuberculosis
gccggcgggggcgcgu

SEQ ID NO: 845611 - RNA, 22 nt, Mycobacterium avium subsp. paratuberculosis
gccggcgggggcgcguccgcgg

SEQ ID NO: 845612 - RNA, 20 nt, Mycobacterium avium subsp. paratuberculosis
gccggcggggguucgacguc

SEQ ID NO: 845613 - RNA, 22 nt, Mycobacterium avium subsp. paratuberculosis
gccggcggggugggcaccuggc

SEQ ID NO: 845614 - RNA, 23 nt, Mycobacterium avium subsp. paratuberculosis
gccggcggggugggcaccuggcc

SEQ ID NO: 845615 - RNA, 18 nt, Mycobacterium avium subsp. paratuberculosis
gccggcgggucagcagcg

SEQ ID NO: 845616 - RNA, 19 nt, Mycobacterium avium subsp. paratuberculosis
gccggcgggugagccgguc

SEQ ID NO: 845617 - RNA, 20 nt, Mycobacterium avium subsp. paratuberculosis
gccggcgggugagccggucg

SEQ ID NO: 845618 - RNA, 14 nt, Mycobacterium avium subsp. paratuberculosis
gccggcggcggugc

SEQ ID NO: 845619 - RNA, 16 nt, Mycobacterium avium subsp. paratuberculosis
gccggcgggcgcucga

SEQ ID NO: 845620 - RNA, 21 nt, Mycobacterium avium subsp. paratuberculosis
gccggcggcgucgugaccgac

SEQ ID NO: 845621 - RNA, 21 nt, Mycobacterium avium subsp. paratuberculosis
gccggcggcugugaucgcuga

SEQ ID NO: 845622 - RNA, 14 nt, Mycobacterium avium subsp. paratuberculosis
gccggcggcguuga

SEQ ID NO: 845623 - RNA, 19 nt, Mycobacterium avium subsp. paratuberculosis
gccggcggcgggcucggag

SEQ ID NO: 845624 - RNA, 14 nt, Mycobacterium avium subsp. paratuberculosis
gccggcggcggcca

SEQ ID NO: 845625 - RNA, 15 nt, Mycobacterium avium subsp. paratuberculosis
gccggcggcggccag

SEQ ID NO: 845626 - RNA, 18 nt, Mycobacterium avium subsp. paratuberculosis
gccggcggcggccagcga

SEQ ID NO: 845627 - RNA, 22 nt, Mycobacterium avium subsp. paratuberculosis
gccggcggcggccagcgagucg

SEQ ID NO: 845628 - RNA, 19 nt, Mycobacterium avium subsp. paratuberculosis
gccggcggcggcggucggc

SEQ ID NO: 845629 - RNA, 12 nt, Mycobacterium avium subsp. paratuberculosis
gccggcggcggg

SEQ ID NO: 845630 - RNA, 14 nt, Mycobacterium avium subsp. paratuberculosis
gccggcgcgugcgc

SEQ ID NO: 845631 - RNA, 12 nt, Mycobacterium avium subsp. paratuberculosis
gccggcggccac

SEQ ID NO: 845632 - RNA, 14 nt, Mycobacterium avium subsp. paratuberculosis
gccggcggccacga

SEQ ID NO: 845633 - RNA, 18 nt, Mycobacterium avium subsp. paratuberculosis
gccggcggcgcccgcggc

SEQ ID NO: 845634 - RNA, 15 nt, Mycobacterium avium subsp. paratuberculosis
gccggcggcgccgga

SEQ ID NO: 845635 - RNA, 14 nt, Mycobacterium avium subsp. paratuberculosis
gccggcggccgccg

SEQ ID NO: 845636 - RNA, 16 nt, Mycobacterium avium subsp. paratuberculosis
gccggcggccgccgcc

SEQ ID NO: 845637 - RNA, 19 nt, Mycobacterium avium subsp. paratuberculosis
gccggcggccgccgcccgc

SEQ ID NO: 845638 - RNA, 21 nt, Mycobacterium avium subsp. paratuberculosis
gccggcggccgccgcccgcgc

SEQ ID NO: 845639 - RNA, 22 nt, Mycobacterium avium subsp. paratuberculosis
gccggcggccgccgcccgcgcg

SEQ ID NO: 845640 - RNA, 15 nt, Mycobacterium avium subsp. paratuberculosis
gccggcggccgccgg

SEQ ID NO: 845641 - RNA, 13 nt, Mycobacterium avium subsp. paratuberculosis
gccggcggccgcg

SEQ ID NO: 845642 - RNA, 15 nt, Mycobacterium avium subsp. paratuberculosis
gccggcggccgcgac

SEQ ID NO: 845643 - RNA, 13 nt, Mycobacterium avium subsp. paratuberculosis
gccggcggccagu

SEQ ID NO: 845644 - RNA, 13 nt, Mycobacterium avium subsp. paratuberculosis
gccggcggccagc

SEQ ID NO: 845645 - RNA, 14 nt, Mycobacterium avium subsp. paratuberculosis
gccggcggccagca

SEQ ID NO: 845646 - RNA, 18 nt, Mycobacterium avium subsp. paratuberculosis
gccggcggccagcaucgg

SEQ ID NO: 845647 - RNA, 21 nt, Mycobacterium avium subsp. paratuberculosis
gccggcggccauggucgcggc

SEQ ID NO: 845648 - RNA, 22 nt, Mycobacterium avium subsp. paratuberculosis
gccggcggccauggucgcggcc

SEQ ID NO: 845649 - RNA, 11 nt, Mycobacterium avium subsp. paratuberculosis
gccggcggccg

SEQ ID NO: 845650 - RNA, 12 nt, Mycobacterium avium subsp. paratuberculosis
gccggcggccga

SEQ ID NO: 845651 - RNA, 14 nt, Mycobacterium avium subsp. paratuberculosis
gccggcggccgaca

SEQ ID NO: 845652 - RNA, 20 nt, Mycobacterium avium subsp. paratuberculosis
gccggcggccgacagggugc

SEQ ID NO: 845653 - RNA, 14 nt, Mycobacterium avium subsp. paratuberculosis
gccggcggccgcca

SEQ ID NO: 845654 - RNA, 20 nt, Mycobacterium avium subsp. paratuberculosis
gccggcggcaguccggcgag

SEQ ID NO: 845655 - RNA, 13 nt, Mycobacterium avium subsp. paratuberculosis
gccggcggcagug

SEQ ID NO: 845656 - RNA, 16 nt, Mycobacterium avium subsp. paratuberculosis
gccggcggcagugcgc

SEQ ID NO: 845657 - RNA, 21 nt, Mycobacterium avium subsp. paratuberculosis
gccggcggaucgcgugcguca

SEQ ID NO: 845658 - RNA, 16 nt, Mycobacterium avium subsp. paratuberculosis
gccggcggacagcccc

SEQ ID NO: 845659 - RNA, 23 nt, Mycobacterium avium subsp. paratuberculosis
gccggcggacagccccgagccgc

SEQ ID NO: 845660 - RNA, 23 nt, Mycobacterium avium subsp. paratuberculosis
gccggcggauauagccgacggga

SEQ ID NO: 845661 - RNA, 14 nt, Mycobacterium avium subsp. paratuberculosis
gccggcgcuucugc

SEQ ID NO: 845662 - RNA, 13 nt, Mycobacterium avium subsp. paratuberculosis
gccggcgcuggcg

SEQ ID NO: 845663 - RNA, 16 nt, Mycobacterium avium subsp. paratuberculosis
gccggcgcuggcgcgc

SEQ ID NO: 845664 - RNA, 17 nt, Mycobacterium avium subsp. paratuberculosis
gccggcgcuggcgcgcc

SEQ ID NO: 845665 - RNA, 21 nt, Mycobacterium avium subsp. paratuberculosis
gccggcgcuggcgcgccguac

SEQ ID NO: 845666 - RNA, 22 nt, Mycobacterium avium subsp. paratuberculosis
gccggcgcuggcgcgccguacc

SEQ ID NO: 845667 - RNA, 14 nt, Mycobacterium avium subsp. paratuberculosis
gccggcgcgggggc

SEQ ID NO: 845668 - RNA, 18 nt, Mycobacterium avium subsp. paratuberculosis
gccggcgcugcccgucga

SEQ ID NO: 845669 - RNA, 20 nt, Mycobacterium avium subsp. paratuberculosis
gccggcgcugcccgucgacc

SEQ ID NO: 845670 - RNA, 21 nt, Mycobacterium avium subsp. paratuberculosis
gccggcgcugcccgucgaccu

SEQ ID NO: 845671 - RNA, 21 nt, Mycobacterium avium subsp. paratuberculosis
gccggcgccgucgauccaccc

SEQ ID NO: 845672 - RNA, 15 nt, Mycobacterium avium subsp. paratuberculosis
gccggcgcgcggugg

SEQ ID NO: 845673 - RNA, 15 nt, Mycobacterium avium subsp. paratuberculosis
gccggcgcgggccgc

SEQ ID NO: 845674 - RNA, 18 nt, Mycobacterium avium subsp. paratuberculosis
gccggcgcgggccgcagc

SEQ ID NO: 845675 - RNA, 17 nt, Mycobacterium avium subsp. paratuberculosis
gccggcgcggcagggcc

SEQ ID NO: 845676 - RNA, 15 nt, Mycobacterium avium subsp. paratuberculosis
gccggcgcggccagc

SEQ ID NO: 845677 - RNA, 13 nt, Mycobacterium avium subsp. paratuberculosis
gccggcgcggcgg

SEQ ID NO: 845678 - RNA, 14 nt, Mycobacterium avium subsp. paratuberculosis
gccggcgcggcggc

SEQ ID NO: 845679 - RNA, 16 nt, Mycobacterium avium subsp. paratuberculosis
gccggcgcggcggcga

SEQ ID NO: 845680 - RNA, 18 nt, Mycobacterium avium subsp. paratuberculosis
gccggcgcggcggcgacg

SEQ ID NO: 845681 - RNA, 19 nt, Mycobacterium avium subsp. paratuberculosis
gccggcgcggcggcgacgu

SEQ ID NO: 845682 - RNA, 20 nt, Mycobacterium avium subsp. paratuberculosis
gccggcgcggcggcgacguc

SEQ ID NO: 845683 - RNA, 22 nt, Mycobacterium avium subsp. paratuberculosis
gccggcgcggcggcgacgucga

SEQ ID NO: 845684 - RNA, 22 nt, Mycobacterium avium subsp. paratuberculosis
gccggcgcggaacagcgucgcc

SEQ ID NO: 845685 - RNA, 23 nt, Mycobacterium avium subsp. paratuberculosis
gccggcgcggaacagcgucgccg

SEQ ID NO: 845686 - RNA, 12 nt, Mycobacterium avium subsp. paratuberculosis
gccggcgcgcga

SEQ ID NO: 845687 - RNA, 18 nt, Mycobacterium avium subsp. paratuberculosis
gccggcgcgcaccccggc

SEQ ID NO: 845688 - RNA, 15 nt, Mycobacterium avium subsp. paratuberculosis
gccggcgcgcacggc

SEQ ID NO: 845689 - RNA, 21 nt, Mycobacterium avium subsp. paratuberculosis
gccggcgcgcacggcagcccg

SEQ ID NO: 845690 - RNA, 14 nt, Mycobacterium avium subsp. paratuberculosis
gccggcgcgcagcc

SEQ ID NO: 845691 - RNA, 20 nt, Mycobacterium avium subsp. paratuberculosis
gccggcgcgcagccagucgc

SEQ ID NO: 845692 - RNA, 14 nt, Mycobacterium avium subsp. paratuberculosis
gccggcgccggcgg

SEQ ID NO: 845693 - RNA, 17 nt, Mycobacterium avium subsp. paratuberculosis
gccggcgccggcgguca

SEQ ID NO: 845694 - RNA, 20 nt, Mycobacterium avium subsp. paratuberculosis
gccggcgccggaggggcgac

SEQ ID NO: 845695 - RNA, 21 nt, Mycobacterium avium subsp. paratuberculosis
gccggcgccggaggggcgacg

SEQ ID NO: 845696 - RNA, 20 nt, Mycobacterium avium subsp. paratuberculosis
gccggcgccggugccgcagc

SEQ ID NO: 845697 - RNA, 14 nt, Mycobacterium avium subsp. paratuberculosis
gccggcgccgggcg

SEQ ID NO: 845698 - RNA, 15 nt, Mycobacterium avium subsp. paratuberculosis
gccggcgccgggcgg

SEQ ID NO: 845699 - RNA, 12 nt, Mycobacterium avium subsp. paratuberculosis
gccggcgccggu

SEQ ID NO: 845700 - RNA, 16 nt, Mycobacterium avium subsp. paratuberculosis
gccggcgccggugccg

SEQ ID NO: 845701 - RNA, 13 nt, Mycobacterium avium subsp. paratuberculosis
gccggcgccgcgg

SEQ ID NO: 845702 - RNA, 15 nt, Mycobacterium avium subsp. paratuberculosis
gccggcgccgauucc

SEQ ID NO: 845703 - RNA, 20 nt, Mycobacterium avium subsp. paratuberculosis
gccggcgccgccggggcguc

SEQ ID NO: 845704 - RNA, 22 nt, Mycobacterium avium subsp. paratuberculosis
gccggcgccgccggggcgucgg

SEQ ID NO: 845705 - RNA, 13 nt, Mycobacterium avium subsp. paratuberculosis
gccggcgcccguc

SEQ ID NO: 845706 - RNA, 17 nt, Mycobacterium avium subsp. paratuberculosis
gccggcgccgaagccgu

SEQ ID NO: 845707 - RNA, 15 nt, Mycobacterium avium subsp. paratuberculosis
gccggcgccgaccga

SEQ ID NO: 845708 - RNA, 17 nt, Mycobacterium avium subsp. paratuberculosis
gccggcgccgaccgagg

SEQ ID NO: 845709 - RNA, 13 nt, Mycobacterium avium subsp. paratuberculosis
gccggcgccgacg

SEQ ID NO: 845710 - RNA, 16 nt, Mycobacterium avium subsp. paratuberculosis
gccggcgccgacgacg

SEQ ID NO: 845711 - RNA, 23 nt, Mycobacterium avium subsp. paratuberculosis
gccggcgccgacgacgucgcgca

SEQ ID NO: 845712 - RNA, 12 nt, Mycobacterium avium subsp. paratuberculosis
gccggcgcccgc

SEQ ID NO: 845713 - RNA, 17 nt, Mycobacterium avium subsp. paratuberculosis
gccggcgcccgcaggcc

SEQ ID NO: 845714 - RNA, 22 nt, Mycobacterium avium subsp. paratuberculosis
gccggcgcccgcaggccgcgag

SEQ ID NO: 845715 - RNA, 13 nt, Mycobacterium avium subsp. paratuberculosis
gccggcgcccagc

SEQ ID NO: 845716 - RNA, 15 nt, Mycobacterium avium subsp. paratuberculosis
gccggcgcccagcgg

SEQ ID NO: 845717 - RNA, 19 nt, Mycobacterium avium subsp. paratuberculosis
gccggcgcccagcggcgau

SEQ ID NO: 845718 - RNA, 17 nt, Mycobacterium avium subsp. paratuberculosis
gccggcgcagcggcccg

SEQ ID NO: 845719 - RNA, 14 nt, Mycobacterium avium subsp. paratuberculosis
gccggcgcagucca

SEQ ID NO: 845720 - RNA, 18 nt, Mycobacterium avium subsp. paratuberculosis
gccggcgcaucaucucgg

SEQ ID NO: 845721 - RNA, 20 nt, Mycobacterium avium subsp. paratuberculosis
gccggcgcaucaucucggcg

SEQ ID NO: 845722 - RNA, 14 nt, Mycobacterium avium subsp. paratuberculosis
gccggcgcacaucg

SEQ ID NO: 845723 - RNA, 12 nt, Mycobacterium avium subsp. paratuberculosis
gccggcgcacca

SEQ ID NO: 845724 - RNA, 19 nt, Mycobacterium avium subsp. paratuberculosis
gccggcgauaggcggccag

SEQ ID NO: 845725 - RNA, 16 nt, Mycobacterium avium subsp. paratuberculosis
gccggcgaucaccggg

SEQ ID NO: 845726 - RNA, 19 nt, Mycobacterium avium subsp. paratuberculosis
gccggcgcaccaggguguc

SEQ ID NO: 845727 - RNA, 12 nt, Mycobacterium avium subsp. paratuberculosis
gccggcgcaccc

SEQ ID NO: 845728 - RNA, 13 nt, Mycobacterium avium subsp. paratuberculosis
gccggcgcacccg

SEQ ID NO: 845729 - RNA, 14 nt, Mycobacterium avium subsp. paratuberculosis
gccggcgcacccgc

SEQ ID NO: 845730 - RNA, 15 nt, Mycobacterium avium subsp. paratuberculosis
gccggcgcacccgca

SEQ ID NO: 845731 - RNA, 16 nt, Mycobacterium avium subsp. paratuberculosis
gccggcgcacccgcac

SEQ ID NO: 845732 - RNA, 13 nt, Mycobacterium avium subsp. paratuberculosis
gccggcgcaccgc

SEQ ID NO: 845733 - RNA, 15 nt, Mycobacterium avium subsp. paratuberculosis
gccggcgcaccgcgu

SEQ ID NO: 845734 - RNA, 18 nt, Mycobacterium avium subsp. paratuberculosis
gccggcgcaccgcgucga

SEQ ID NO: 845735 - RNA, 19 nt, Mycobacterium avium subsp. paratuberculosis
gccggcgcaccgcgucgac

SEQ ID NO: 845736 - RNA, 20 nt, Mycobacterium avium subsp. paratuberculosis
gccggcgcaccgcgucgacc

SEQ ID NO: 845737 - RNA, 21 nt, Mycobacterium avium subsp. paratuberculosis
gccggcgcaccgcgucgacca

SEQ ID NO: 845738 - RNA, 23 nt, Mycobacterium avium subsp. paratuberculosis
gccggcgcaccgcgucgaccacc

SEQ ID NO: 845739 - RNA, 19 nt, Mycobacterium avium subsp. paratuberculosis
gccggcgauggcgcggccg

SEQ ID NO: 845740 - RNA, 22 nt, Mycobacterium avium subsp. paratuberculosis
gccggcgauggcgcggccggcc

SEQ ID NO: 845741 - RNA, 13 nt, Mycobacterium avium subsp. paratuberculosis
gccggcgauggug

SEQ ID NO: 845742 - RNA, 19 nt, Mycobacterium avium subsp. paratuberculosis
gccggcgaugcccgugauc

SEQ ID NO: 845743 - RNA, 15 nt, Mycobacterium avium subsp. paratuberculosis
gccggcgaugcgcgc

SEQ ID NO: 845744 - RNA, 20 nt, Mycobacterium avium subsp. paratuberculosis
gccggcgaugcgcgccuccg

SEQ ID NO: 845745 - RNA, 23 nt, Mycobacterium avium subsp. paratuberculosis
gccggcgaugcgcgccuccgacg

SEQ ID NO: 845746 - RNA, 17 nt, Mycobacterium avium subsp. paratuberculosis
gccggcgaucucgucgc

SEQ ID NO: 845747 - RNA, 22 nt, Mycobacterium avium subsp. paratuberculosis
gccggcgaucucgucgcgcagc

SEQ ID NO: 845748 - RNA, 17 nt, Mycobacterium avium subsp. paratuberculosis
gccggcgaugaacacgc

SEQ ID NO: 845749 - RNA, 19 nt, Mycobacterium avium subsp. paratuberculosis
gccggcgaugaacacgccg

SEQ ID NO: 845750 - RNA, 20 nt, Mycobacterium avium subsp. paratuberculosis
gccggcgaugaacacgccga

SEQ ID NO: 845751 - RNA, 14 nt, Mycobacterium avium subsp. paratuberculosis
gccggcgaucgucg

SEQ ID NO: 845752 - RNA, 15 nt, Mycobacterium avium subsp. paratuberculosis
gccggcgaucgucgc

SEQ ID NO: 845753 - RNA, 19 nt, Mycobacterium avium subsp. paratuberculosis
gccggcgaucuccaccgug

SEQ ID NO: 845754 - RNA, 16 nt, Mycobacterium avium subsp. paratuberculosis
gccggaugggcgcacg

SEQ ID NO: 845755 - RNA, 19 nt, Mycobacterium avium subsp. paratuberculosis
gccggaugggcgcacgauc

SEQ ID NO: 845756 - RNA, 22 nt, Mycobacterium avium subsp. paratuberculosis
gccggaugggcgcacgaucggg

SEQ ID NO: 845757 - RNA, 18 nt, Mycobacterium avium subsp. paratuberculosis
gccggaugcggucgauga

SEQ ID NO: 845758 - RNA, 16 nt, Mycobacterium avium subsp. paratuberculosis
gccggaugguccgcau

SEQ ID NO: 845759 - RNA, 20 nt, Mycobacterium avium subsp. paratuberculosis
gccggauguccuacggcggg

SEQ ID NO: 845760 - RNA, 22 nt, Mycobacterium avium subsp. paratuberculosis
gccggauguccuacggcgggug

SEQ ID NO: 845761 - RNA, 23 nt, Mycobacterium avium subsp. paratuberculosis
gccggauguccuacggcgggugc

SEQ ID NO: 845762 - RNA, 16 nt, Mycobacterium avium subsp. paratuberculosis
gccggauuggcgucgg

SEQ ID NO: 845763 - RNA, 18 nt, Mycobacterium avium subsp. paratuberculosis
gccggauuggcgucggug

SEQ ID NO: 845764 - RNA, 19 nt, Mycobacterium avium subsp. paratuberculosis
gccggauuggcgucggugg

SEQ ID NO: 845765 - RNA, 20 nt, Mycobacterium avium subsp. paratuberculosis
gccggauuggcgucgguggc

SEQ ID NO: 845766 - RNA, 21 nt, Mycobacterium avium subsp. paratuberculosis
gccggauuggcgucgguggcg

SEQ ID NO: 845767 - RNA, 18 nt, Mycobacterium avium subsp. paratuberculosis
gccggauucucgcccggc

SEQ ID NO: 845768 - RNA, 19 nt, Mycobacterium avium subsp. paratuberculosis
gccggauucucgcccggcu

SEQ ID NO: 845769 - RNA, 16 nt, Mycobacterium avium subsp. paratuberculosis
gccggcaacaacgcca

SEQ ID NO: 845770 - RNA, 18 nt, Mycobacterium avium subsp. paratuberculosis
gccggcaacaacgccagc

SEQ ID NO: 845771 - RNA, 18 nt, Mycobacterium avium subsp. paratuberculosis
gccggauuacucgccggc

SEQ ID NO: 845772 - RNA, 19 nt, Mycobacterium avium subsp. paratuberculosis
gccggauuacucgccggcg

SEQ ID NO: 845773 - RNA, 21 nt, Mycobacterium avium subsp. paratuberculosis
gccggauuacucgccggcggc

SEQ ID NO: 845774 - RNA, 22 nt, Mycobacterium avium subsp. paratuberculosis
gccggauuacucgccggcggcg

SEQ ID NO: 845775 - RNA, 23 nt, Mycobacterium avium subsp. paratuberculosis
gccggauuacucgccggcggcgc

SEQ ID NO: 845776 - RNA, 14 nt, Mycobacterium avium subsp. paratuberculosis
gccggcaccagcag

SEQ ID NO: 845777 - RNA, 17 nt, Mycobacterium avium subsp. paratuberculosis
gccggcaccagcagccg

SEQ ID NO: 845778 - RNA, 12 nt, Mycobacterium avium subsp. paratuberculosis
gccggcacccgg

SEQ ID NO: 845779 - RNA, 13 nt, Mycobacterium avium subsp. paratuberculosis
gccggcaccagca

SEQ ID NO: 845780 - RNA, 15 nt, Mycobacterium avium subsp. paratuberculosis
gccggcacaccgagc

SEQ ID NO: 845781 - RNA, 20 nt, Mycobacterium avium subsp. paratuberculosis
gccggcaacucccgaucgcc

SEQ ID NO: 845782 - RNA, 12 nt, Mycobacterium avium subsp. paratuberculosis
gccggcaaccgc

SEQ ID NO: 845783 - RNA, 16 nt, Mycobacterium avium subsp. paratuberculosis
gccggcaaccgcugcg

SEQ ID NO: 845784 - RNA, 16 nt, Mycobacterium avium subsp. paratuberculosis
gccggcaacgacccgu

SEQ ID NO: 845785 - RNA, 20 nt, Mycobacterium avium subsp. paratuberculosis
gccggcaacgacccgucggg

SEQ ID NO: 845786 - RNA, 16 nt, Mycobacterium avium subsp. paratuberculosis
gccggcaacuggccgc

SEQ ID NO: 845787 - RNA, 21 nt, Mycobacterium avium subsp. paratuberculosis
gccggcaacuggccgcccggg

SEQ ID NO: 845788 - RNA, 15 nt, Mycobacterium avium subsp. paratuberculosis
gccggaugccgcgcg

SEQ ID NO: 845789 - RNA, 16 nt, Mycobacterium avium subsp. paratuberculosis
gccggaugccgcgcgg

SEQ ID NO: 845790 - RNA, 19 nt, Mycobacterium avium subsp. paratuberculosis
gccggaugccgcgcggcgc

SEQ ID NO: 845791 - RNA, 20 nt, Mycobacterium avium subsp. paratuberculosis
gccggaugccgcgcggcgcc

SEQ ID NO: 845792 - RNA, 21 nt, Mycobacterium avium subsp. paratuberculosis
gccggaugccgcgcggcgcca

SEQ ID NO: 845793 - RNA, 15 nt, Mycobacterium avium subsp. paratuberculosis
gccggaugcggccga

SEQ ID NO: 845794 - RNA, 13 nt, Mycobacterium avium subsp. paratuberculosis
gccggaucgcgca

SEQ ID NO: 845795 - RNA, 21 nt, Mycobacterium avium subsp. paratuberculosis
gccggaucggcagcgcguuga

SEQ ID NO: 845796 - RNA, 17 nt, Mycobacterium avium subsp. paratuberculosis
gccggaucggcccccgg

SEQ ID NO: 845797 - RNA, 22 nt, Mycobacterium avium subsp. paratuberculosis
gccggaucggcccccgggcccg

SEQ ID NO: 845798 - RNA, 13 nt, Mycobacterium avium subsp. paratuberculosis
gccggaucgggac

SEQ ID NO: 845799 - RNA, 15 nt, Mycobacterium avium subsp. paratuberculosis
gccggaucggggugg

SEQ ID NO: 845800 - RNA, 18 nt, Mycobacterium avium subsp. paratuberculosis
gccggaucgggguggacg

SEQ ID NO: 845801 - RNA, 22 nt, Mycobacterium avium subsp. paratuberculosis
gccggaucgggguggacgcgac

SEQ ID NO: 845802 - RNA, 15 nt, Mycobacterium avium subsp. paratuberculosis
gccggaucucgucgg

SEQ ID NO: 845803 - RNA, 16 nt, Mycobacterium avium subsp. paratuberculosis
gccggaucucgucggg

SEQ ID NO: 845804 - RNA, 21 nt, Mycobacterium avium subsp. paratuberculosis
gccggaucucgucgggcaccg

SEQ ID NO: 845805 - RNA, 22 nt, Mycobacterium avium subsp. paratuberculosis
gccggaucucgucgggcaccgc

SEQ ID NO: 845806 - RNA, 12 nt, Mycobacterium avium subsp. paratuberculosis
gccggaucgccg

SEQ ID NO: 845807 - RNA, 18 nt, Mycobacterium avium subsp. paratuberculosis
gccggaucgagcacccgg

SEQ ID NO: 845808 - RNA, 20 nt, Mycobacterium avium subsp. paratuberculosis
gccggaucgagcacccggcg

SEQ ID NO: 845809 - RNA, 23 nt, Mycobacterium avium subsp. paratuberculosis
gccggaucccgguacggcucaac

SEQ ID NO: 845810 - RNA, 22 nt, Mycobacterium avium subsp. paratuberculosis
gccggaucgaaaaggucgaaca

SEQ ID NO: 845811 - RNA, 13 nt, Mycobacterium avium subsp. paratuberculosis
gccggaucgaauc

SEQ ID NO: 845812 - RNA, 19 nt, Mycobacterium avium subsp. paratuberculosis
gccggaucgaauccggcgg

SEQ ID NO: 845813 - RNA, 15 nt, Mycobacterium avium subsp. paratuberculosis
gccggaguugccgau

SEQ ID NO: 845814 - RNA, 18 nt, Mycobacterium avium subsp. paratuberculosis
gccggaucaugucguuga

SEQ ID NO: 845815 - RNA, 13 nt, Mycobacterium avium subsp. paratuberculosis
gccggaucaccug

SEQ ID NO: 845816 - RNA, 14 nt, Mycobacterium avium subsp. paratuberculosis
gccggaucaccugg

SEQ ID NO: 845817 - RNA, 16 nt, Mycobacterium avium subsp. paratuberculosis
gccggaucaccuggug

SEQ ID NO: 845818 - RNA, 13 nt, Mycobacterium avium subsp. paratuberculosis
gccggaucagcag

SEQ ID NO: 845819 - RNA, 14 nt, Mycobacterium avium subsp. paratuberculosis
gccggccagcggcc

SEQ ID NO: 845820 - RNA, 12 nt, Mycobacterium avium subsp. paratuberculosis
gccggccagcgg

SEQ ID NO: 845821 - RNA, 14 nt, Mycobacterium avium subsp. paratuberculosis
gccggccagcgggu

SEQ ID NO: 845822 - RNA, 17 nt, Mycobacterium avium subsp. paratuberculosis
gccggccagcgggucgu

SEQ ID NO: 845823 - RNA, 18 nt, Mycobacterium avium subsp. paratuberculosis
gccggccagcgucgcgcc

SEQ ID NO: 845824 - RNA, 14 nt, Mycobacterium avium subsp. paratuberculosis
gccggccagcucga

SEQ ID NO: 845825 - RNA, 19 nt, Mycobacterium avium subsp. paratuberculosis
gccggccagcucgagcauc

SEQ ID NO: 845826 - RNA, 15 nt, Mycobacterium avium subsp. paratuberculosis
gccggccagcucgcc

SEQ ID NO: 845827 - RNA, 18 nt, Mycobacterium avium subsp. paratuberculosis
gccggccagcucgccgcc

SEQ ID NO: 845828 - RNA, 22 nt, Mycobacterium avium subsp. paratuberculosis
gccggccagcucgccgccgacg

SEQ ID NO: 845829 - RNA, 16 nt, Mycobacterium avium subsp. paratuberculosis
gccggccagcgcgcgg

SEQ ID NO: 845830 - RNA, 13 nt, Mycobacterium avium subsp. paratuberculosis
gccggccagccgc

SEQ ID NO: 845831 - RNA, 17 nt, Mycobacterium avium subsp. paratuberculosis
gccggccagccgcgcga

SEQ ID NO: 845832 - RNA, 22 nt, Mycobacterium avium subsp. paratuberculosis
gccggccagccgcgcgacgccg

SEQ ID NO: 845833 - RNA, 14 nt, Mycobacterium avium subsp. paratuberculosis
gccggccagcagcg

SEQ ID NO: 845834 - RNA, 13 nt, Mycobacterium avium subsp. paratuberculosis
gccggccagcagc

SEQ ID NO: 845835 - RNA, 14 nt, Mycobacterium avium subsp. paratuberculosis
gccggccagcagca

SEQ ID NO: 845836 - RNA, 12 nt, Mycobacterium avium subsp. paratuberculosis
gccggccagcag

SEQ ID NO: 845837 - RNA, 14 nt, Mycobacterium avium subsp. paratuberculosis
gccggccagcacgc

SEQ ID NO: 845838 - RNA, 16 nt, Mycobacterium avium subsp. paratuberculosis
gccggccagcacgccg

SEQ ID NO: 845839 - RNA, 16 nt, Mycobacterium avium subsp. paratuberculosis
gccggccagcacggcc

SEQ ID NO: 845840 - RNA, 24 nt, Mycobacterium avium subsp. paratuberculosis
gccggccagcacggccagccagcc

SEQ ID NO: 845841 - RNA, 17 nt, Mycobacterium avium subsp. paratuberculosis
gccggccagcacggcgg

SEQ ID NO: 845842 - RNA, 19 nt, Mycobacterium avium subsp. paratuberculosis
gccggccagcacggcggcg

SEQ ID NO: 845843 - RNA, 14 nt, Mycobacterium avium subsp. paratuberculosis
gccggccagcacac

SEQ ID NO: 845844 - RNA, 16 nt, Mycobacterium avium subsp. paratuberculosis
gccggccagaucgacg

SEQ ID NO: 845845 - RNA, 19 nt, Mycobacterium avium subsp. paratuberculosis
gccggccagaucgacgccg

SEQ ID NO: 845846 - RNA, 20 nt, Mycobacterium avium subsp. paratuberculosis
gccggccagaucgacgccgc

SEQ ID NO: 845847 - RNA, 21 nt, Mycobacterium avium subsp. paratuberculosis
gccggccagaucgacgccgcg

SEQ ID NO: 845848 - RNA, 23 nt, Mycobacterium avium subsp. paratuberculosis
gccggccagaucgacgccgcggu

SEQ ID NO: 845849 - RNA, 15 nt, Mycobacterium avium subsp. paratuberculosis
gccggccacgcucgg

SEQ ID NO: 845850 - RNA, 17 nt, Mycobacterium avium subsp. paratuberculosis
gccggccacgcucggcg

SEQ ID NO: 845851 - RNA, 19 nt, Mycobacterium avium subsp. paratuberculosis
gccggccacgcucggcggc

SEQ ID NO: 845852 - RNA, 24 nt, Mycobacterium avium subsp. paratuberculosis
gccggccacgcucggcggcgcgca

SEQ ID NO: 845853 - RNA, 23 nt, Mycobacterium avium subsp. paratuberculosis
gccggccacguaguccgacgauc

SEQ ID NO: 845854 - RNA, 15 nt, Mycobacterium avium subsp. paratuberculosis
gccggccaccagguc

SEQ ID NO: 845855 - RNA, 23 nt, Mycobacterium avium subsp. paratuberculosis
gccggccaccaggucgcacacca

SEQ ID NO: 845856 - RNA, 13 nt, Mycobacterium avium subsp. paratuberculosis
gccggccaccagc

SEQ ID NO: 845857 - RNA, 14 nt, Mycobacterium avium subsp. paratuberculosis
gccggccaccagcg

SEQ ID NO: 845858 - RNA, 17 nt, Mycobacterium avium subsp. paratuberculosis
gccggccaccagcggcc

SEQ ID NO: 845859 - RNA, 20 nt, Mycobacterium avium subsp. paratuberculosis
gccggccaccagcggccgga

SEQ ID NO: 845860 - RNA, 13 nt, Mycobacterium avium subsp. paratuberculosis
gccggccaccgcc

SEQ ID NO: 845861 - RNA, 19 nt, Mycobacterium avium subsp. paratuberculosis
gccggccaccgccccagcc

SEQ ID NO: 845862 - RNA, 21 nt, Mycobacterium avium subsp. paratuberculosis
gccggccaccgccccagccga

SEQ ID NO: 845863 - RNA, 23 nt, Mycobacterium avium subsp. paratuberculosis
gccggccaccgccccagccgacc

SEQ ID NO: 845864 - RNA, 16 nt, Mycobacterium avium subsp. paratuberculosis
gccggccaccggcgcg

SEQ ID NO: 845865 - RNA, 17 nt, Mycobacterium avium subsp. paratuberculosis
gccggccaccggcgcga

SEQ ID NO: 845866 - RNA, 19 nt, Mycobacterium avium subsp. paratuberculosis
gccggccaccggcgcgacg

SEQ ID NO: 845867 - RNA, 20 nt, Mycobacterium avium subsp. paratuberculosis
gccggccaccggcgcgacgg

SEQ ID NO: 845868 - RNA, 21 nt, Mycobacterium avium subsp. paratuberculosis
gccggccaccggcgcgacggc

SEQ ID NO: 845869 - RNA, 16 nt, Mycobacterium avium subsp. paratuberculosis
gccggccaacagcagc

SEQ ID NO: 845870 - RNA, 17 nt, Mycobacterium avium subsp. paratuberculosis
gccggccaacagcagcg

SEQ ID NO: 845871 - RNA, 24 nt, Mycobacterium avium subsp. paratuberculosis
gccggccaacagcagcgccgcggc

SEQ ID NO: 845872 - RNA, 18 nt, Mycobacterium avium subsp. paratuberculosis
gccggccaaggcaagucg

SEQ ID NO: 845873 - RNA, 13 nt, Mycobacterium avium subsp. paratuberculosis
gccggccaccaac

SEQ ID NO: 845874 - RNA, 22 nt, Mycobacterium avium subsp. paratuberculosis
gccggccaccaacaggucggcg

SEQ ID NO: 845875 - RNA, 19 nt, Mycobacterium avium subsp. paratuberculosis
gccggcaucgaccgcccgc

SEQ ID NO: 845876 - RNA, 20 nt, Mycobacterium avium subsp. paratuberculosis
gccggcagguuguugacgac

SEQ ID NO: 845877 - RNA, 16 nt, Mycobacterium avium subsp. paratuberculosis
gccggcaggucgaggc

SEQ ID NO: 845878 - RNA, 18 nt, Mycobacterium avium subsp. paratuberculosis
gccggcaguccggacacg

SEQ ID NO: 845879 - RNA, 23 nt, Mycobacterium avium subsp. paratuberculosis
gccggcaguccggacacggccag

SEQ ID NO: 845880 - RNA, 13 nt, Mycobacterium avium subsp. paratuberculosis
gccggcaggccgc

SEQ ID NO: 845881 - RNA, 19 nt, Mycobacterium avium subsp. paratuberculosis
gccggcaggccgcccgacc

SEQ ID NO: 845882 - RNA, 17 nt, Mycobacterium avium subsp. paratuberculosis
gccggcauaggccagca

SEQ ID NO: 845883 - RNA, 18 nt, Mycobacterium avium subsp. paratuberculosis
gccggcauaggccagcac

SEQ ID NO: 845884 - RNA, 19 nt, Mycobacterium avium subsp. paratuberculosis
gccggcauaggccagcacc

SEQ ID NO: 845885 - RNA, 22 nt, Mycobacterium avium subsp. paratuberculosis
gccggcauaggccagcaccagc

SEQ ID NO: 845886 - RNA, 16 nt, Mycobacterium avium subsp. paratuberculosis
gccggcagcggccgca

SEQ ID NO: 845887 - RNA, 17 nt, Mycobacterium avium subsp. paratuberculosis
gccggcagcugcccguc

SEQ ID NO: 845888 - RNA, 21 nt, Mycobacterium avium subsp. paratuberculosis
gccggcagcggcugcugcagc

SEQ ID NO: 845889 - RNA, 15 nt, Mycobacterium avium subsp. paratuberculosis
gccggcagcggugcc

SEQ ID NO: 845890 - RNA, 17 nt, Mycobacterium avium subsp. paratuberculosis
gccggcagcggugccgc

SEQ ID NO: 845891 - RNA, 13 nt, Mycobacterium avium subsp. paratuberculosis
gccggcagccgcu

SEQ ID NO: 845892 - RNA, 16 nt, Mycobacterium avium subsp. paratuberculosis
gccggcagccggccac

SEQ ID NO: 845893 - RNA, 17 nt, Mycobacterium avium subsp. paratuberculosis
gccggcagccggccacc

SEQ ID NO: 845894 - RNA, 19 nt, Mycobacterium avium subsp. paratuberculosis
gccggcagccggcgcggug

SEQ ID NO: 845895 - RNA, 19 nt, Mycobacterium avium subsp. paratuberculosis
gccggcagauugguucggc

SEQ ID NO: 845896 - RNA, 20 nt, Mycobacterium avium subsp. paratuberculosis
gccggcagauugguucggcc

SEQ ID NO: 845897 - RNA, 19 nt, Mycobacterium avium subsp. paratuberculosis
gccggcagcaaccggcggc

SEQ ID NO: 845898 - RNA, 21 nt, Mycobacterium avium subsp. paratuberculosis
gccggcagcaaccggcggcug

SEQ ID NO: 845899 - RNA, 23 nt, Mycobacterium avium subsp. paratuberculosis
gccggcagcauucgccggggucg

SEQ ID NO: 845900 - RNA, 19 nt, Mycobacterium avium subsp. paratuberculosis
gccggcacuaccgccucgc

SEQ ID NO: 845901 - RNA, 17 nt, Mycobacterium avium subsp. paratuberculosis
gccggcacucgccucgg

SEQ ID NO: 845902 - RNA, 14 nt, Mycobacterium avium subsp. paratuberculosis
gccggcacucgucg

SEQ ID NO: 845903 - RNA, 15 nt, Mycobacterium avium subsp. paratuberculosis
gccggcacugcugcc

SEQ ID NO: 845904 - RNA, 19 nt, Mycobacterium avium subsp. paratuberculosis
gccggcacugcugcccgcg

SEQ ID NO: 845905 - RNA, 20 nt, Mycobacterium avium subsp. paratuberculosis
gccggcacugcugcccgcga

SEQ ID NO: 845906 - RNA, 15 nt, Mycobacterium avium subsp. paratuberculosis
gccggcacgcgcgcc

SEQ ID NO: 845907 - RNA, 16 nt, Mycobacterium avium subsp. paratuberculosis
gccggcaccguccggc

SEQ ID NO: 845908 - RNA, 15 nt, Mycobacterium avium subsp. paratuberculosis
gccggcaccucgaag

SEQ ID NO: 845909 - RNA, 22 nt, Mycobacterium avium subsp. paratuberculosis
gccggcaccucgaagggcgcca

SEQ ID NO: 845910 - RNA, 22 nt, Mycobacterium avium subsp. paratuberculosis
gccggcacgauggcgcggcgca

SEQ ID NO: 845911 - RNA, 20 nt, Mycobacterium avium subsp. paratuberculosis
gccggcacgcaccuuggacg

SEQ ID NO: 845912 - RNA, 19 nt, Mycobacterium avium subsp. paratuberculosis
gccggacuauacacgccug

SEQ ID NO: 845913 - RNA, 18 nt, Mycobacterium avium subsp. paratuberculosis
gccggacgcuaagcgcug

SEQ ID NO: 845914 - RNA, 13 nt, Mycobacterium avium subsp. paratuberculosis
gccggaccgcgcg

SEQ ID NO: 845915 - RNA, 14 nt, Mycobacterium avium subsp. paratuberculosis
gccggaccgcgcgg

SEQ ID NO: 845916 - RNA, 17 nt, Mycobacterium avium subsp. paratuberculosis
gccggaccgcgcgggcc

SEQ ID NO: 845917 - RNA, 19 nt, Mycobacterium avium subsp. paratuberculosis
gccggacgaacgaguugcc

SEQ ID NO: 845918 - RNA, 17 nt, Mycobacterium avium subsp. paratuberculosis
gccggacgggaucggcg

SEQ ID NO: 845919 - RNA, 23 nt, Mycobacterium avium subsp. paratuberculosis
gccggacgggaucggcgcgucgg

SEQ ID NO: 845920 - RNA, 14 nt, Mycobacterium avium subsp. paratuberculosis
gccggacgggucga

SEQ ID NO: 845921 - RNA, 18 nt, Mycobacterium avium subsp. paratuberculosis
gccggacgggucgaccgc

SEQ ID NO: 845922 - RNA, 17 nt, Mycobacterium avium subsp. paratuberculosis
gccggacggugacgccg

SEQ ID NO: 845923 - RNA, 18 nt, Mycobacterium avium subsp. paratuberculosis
gccggacggugacgccgg

SEQ ID NO: 845924 - RNA, 19 nt, Mycobacterium avium subsp. paratuberculosis
gccggaccgcuugacgccg

SEQ ID NO: 845925 - RNA, 22 nt, Mycobacterium avium subsp. paratuberculosis
gccggaccgcuugacgccgccg

SEQ ID NO: 845926 - RNA, 23 nt, Mycobacterium avium subsp. paratuberculosis
gccggaccgcuugacgccgccga

SEQ ID NO: 845927 - RNA, 15 nt, Mycobacterium avium subsp. paratuberculosis
gccggaccguucggu

SEQ ID NO: 845928 - RNA, 17 nt, Mycobacterium avium subsp. paratuberculosis
gccggaccucgaccagc

SEQ ID NO: 845929 - RNA, 20 nt, Mycobacterium avium subsp. paratuberculosis
gccggaccucgaccagccgg

SEQ ID NO: 845930 - RNA, 21 nt, Mycobacterium avium subsp. paratuberculosis
gccggaccgauccggcgcccg

SEQ ID NO: 845931 - RNA, 23 nt, Mycobacterium avium subsp. paratuberculosis
gccggaccagguauucaucgcgg

SEQ ID NO: 845932 - RNA, 16 nt, Mycobacterium avium subsp. paratuberculosis
gccggaccccacagcg

SEQ ID NO: 845933 - RNA, 18 nt, Mycobacterium avium subsp. paratuberculosis
gccggaccccacagcgcg

SEQ ID NO: 845934 - RNA, 19 nt, Mycobacterium avium subsp. paratuberculosis
gccggaccccacagcgcgc

SEQ ID NO: 845935 - RNA, 13 nt, Mycobacterium avium subsp. paratuberculosis
gccggagagcccg

SEQ ID NO: 845936 - RNA, 19 nt, Mycobacterium avium subsp. paratuberculosis
gccggagagcccgucgucg

SEQ ID NO: 845937 - RNA, 20 nt, Mycobacterium avium subsp. paratuberculosis
gccggagagcccgucgucgg

SEQ ID NO: 845938 - RNA, 22 nt, Mycobacterium avium subsp. paratuberculosis
gccggagaucaauucugcugcc

SEQ ID NO: 845939 - RNA, 20 nt, Mycobacterium avium subsp. paratuberculosis
gccggagaucccguaggucg

SEQ ID NO: 845940 - RNA, 22 nt, Mycobacterium avium subsp. paratuberculosis
gccggagaucccguaggucgcc

SEQ ID NO: 845941 - RNA, 15 nt, Mycobacterium avium subsp. paratuberculosis
gccggacucgaagau

SEQ ID NO: 845942 - RNA, 21 nt, Mycobacterium avium subsp. paratuberculosis
gccggacucgaagaucgccug

SEQ ID NO: 845943 - RNA, 20 nt, Mycobacterium avium subsp. paratuberculosis
gccggacucgaucgccaccg

SEQ ID NO: 845944 - RNA, 13 nt, Mycobacterium avium subsp. paratuberculosis
gccggagaccagc

SEQ ID NO: 845945 - RNA, 18 nt, Mycobacterium avium subsp. paratuberculosis
gccggagaccagcagcuu

SEQ ID NO: 845946 - RNA, 14 nt, Mycobacterium avium subsp. paratuberculosis
gccggagaccgccg

SEQ ID NO: 845947 - RNA, 18 nt, Mycobacterium avium subsp. paratuberculosis
gccggagaccgccguggc

SEQ ID NO: 845948 - RNA, 22 nt, Mycobacterium avium subsp. paratuberculosis
gccggagcggauggcgccgucg

SEQ ID NO: 845949 - RNA, 23 nt, Mycobacterium avium subsp. paratuberculosis
gccggagcggauggcgccgucga

SEQ ID NO: 845950 - RNA, 16 nt, Mycobacterium avium subsp. paratuberculosis
gccggagcggugcggc

SEQ ID NO: 845951 - RNA, 21 nt, Mycobacterium avium subsp. paratuberculosis
gccggagccggccucgccggc

SEQ ID NO: 845952 - RNA, 20 nt, Mycobacterium avium subsp. paratuberculosis
gccggagccuucuucgccgc

SEQ ID NO: 845953 - RNA, 21 nt, Mycobacterium avium subsp. paratuberculosis
gccggagccuugcuggcggcc

SEQ ID NO: 845954 - RNA, 19 nt, Mycobacterium avium subsp. paratuberculosis
gccggagcgccccagggcc

SEQ ID NO: 845955 - RNA, 13 nt, Mycobacterium avium subsp. paratuberculosis
gccggagccgacc

SEQ ID NO: 845956 - RNA, 15 nt, Mycobacterium avium subsp. paratuberculosis
gccggagccgaucgc

SEQ ID NO: 845957 - RNA, 16 nt, Mycobacterium avium subsp. paratuberculosis
gccggagccgaucgcc

SEQ ID NO: 845958 - RNA, 21 nt, Mycobacterium avium subsp. paratuberculosis
gccggagaugaauucggcgau

SEQ ID NO: 845959 - RNA, 23 nt, Mycobacterium avium subsp. paratuberculosis
gccggaggccagcucgaccgcgg

SEQ ID NO: 845960 - RNA, 14 nt, Mycobacterium avium subsp. paratuberculosis
gccggaggugcggg

SEQ ID NO: 845961 - RNA, 20 nt, Mycobacterium avium subsp. paratuberculosis
gccggaggugcgggucucga

SEQ ID NO: 845962 - RNA, 22 nt, Mycobacterium avium subsp. paratuberculosis
gccggaggcggcguagucggcg

SEQ ID NO: 845963 - RNA, 16 nt, Mycobacterium avium subsp. paratuberculosis
gccggacagcuggcgg

SEQ ID NO: 845964 - RNA, 17 nt, Mycobacterium avium subsp. paratuberculosis
gccggacagcuggcggu

SEQ ID NO: 845965 - RNA, 19 nt, Mycobacterium avium subsp. paratuberculosis
gccggacagaucgcccauc

SEQ ID NO: 845966 - RNA, 13 nt, Mycobacterium avium subsp. paratuberculosis
gccggacagccgg

SEQ ID NO: 845967 - RNA, 15 nt, Mycobacterium avium subsp. paratuberculosis
gccggacagccgggg

SEQ ID NO: 845968 - RNA, 19 nt, Mycobacterium avium subsp. paratuberculosis
gccggacagccggggcagc

SEQ ID NO: 845969 - RNA, 14 nt, Mycobacterium avium subsp. paratuberculosis
gccggacagcgggc

SEQ ID NO: 845970 - RNA, 17 nt, Mycobacterium avium subsp. paratuberculosis
gccggacagcgggccga

SEQ ID NO: 845971 - RNA, 19 nt, Mycobacterium avium subsp. paratuberculosis
gccggacagcgggccgacc

SEQ ID NO: 845972 - RNA, 15 nt, Mycobacterium avium subsp. paratuberculosis
gccggacaccaccgc

SEQ ID NO: 845973 - RNA, 20 nt, Mycobacterium avium subsp. paratuberculosis
gccggacaccaccgcggugg

SEQ ID NO: 845974 - RNA, 13 nt, Mycobacterium avium subsp. paratuberculosis
gccggacaccccg

SEQ ID NO: 845975 - RNA, 16 nt, Mycobacterium avium subsp. paratuberculosis
gccggacaccccggcc

SEQ ID NO: 845976 - RNA, 17 nt, Mycobacterium avium subsp. paratuberculosis
gccggacaccccggcca

SEQ ID NO: 845977 - RNA, 24 nt, Mycobacterium avium subsp. paratuberculosis
gccggacaccccggccaguccgcg

SEQ ID NO: 845978 - RNA, 22 nt, Mycobacterium avium subsp. paratuberculosis
gccggacaccgaaccgccccgc

SEQ ID NO: 845979 - RNA, 23 nt, Mycobacterium avium subsp. paratuberculosis
gccggacaccgaaccgccccgcg

SEQ ID NO: 845980 - RNA, 14 nt, Mycobacterium avium subsp. paratuberculosis
gccggacaccggca

SEQ ID NO: 845981 - RNA, 17 nt, Mycobacterium avium subsp. paratuberculosis
gccggacaccggcacgu

SEQ ID NO: 845982 - RNA, 14 nt, Mycobacterium avium subsp. paratuberculosis
gccggacacggcug

SEQ ID NO: 845983 - RNA, 21 nt, Mycobacterium avium subsp. paratuberculosis
gccggacacggcugcacccuc

SEQ ID NO: 845984 - RNA, 18 nt, Mycobacterium avium subsp. paratuberculosis
gccggaaggccaaggcca

SEQ ID NO: 845985 - RNA, 21 nt, Mycobacterium avium subsp. paratuberculosis
gccggaaggccaaggccagca

SEQ ID NO: 845986 - RNA, 23 nt, Mycobacterium avium subsp. paratuberculosis
gccggaaggccaaggccagcaac

SEQ ID NO: 845987 - RNA, 21 nt, Mycobacterium avium subsp. paratuberculosis
gccggaacgggaagaucgucg

SEQ ID NO: 845988 - RNA, 17 nt, Mycobacterium avium subsp. paratuberculosis
gccggaacucggccggc

SEQ ID NO: 845989 - RNA, 18 nt, Mycobacterium avium subsp. paratuberculosis
gccggaacucggccggca

SEQ ID NO: 845990 - RNA, 18 nt, Mycobacterium avium subsp. paratuberculosis
gccggaagaccguugacg

SEQ ID NO: 845991 - RNA, 18 nt, Mycobacterium avium subsp. paratuberculosis
gccggaauggcaaggcca

SEQ ID NO: 845992 - RNA, 21 nt, Mycobacterium avium subsp. paratuberculosis
gccggaauggcaaggccagca

SEQ ID NO: 845993 - RNA, 23 nt, Mycobacterium avium subsp. paratuberculosis
gccggaauugaagaagcgggcca

SEQ ID NO: 845994 - RNA, 20 nt, Mycobacterium avium subsp. paratuberculosis
gccggaaucgauuggugcgc

SEQ ID NO: 845995 - RNA, 20 nt, Mycobacterium avium subsp. paratuberculosis
gccggaaguucucgccgugc

SEQ ID NO: 845996 - RNA, 21 nt, Mycobacterium avium subsp. paratuberculosis
gccggaaguucucgccgugca

SEQ ID NO: 845997 - RNA, 16 nt, Mycobacterium avium subsp. paratuberculosis
gccgcuuggcgcgccg

SEQ ID NO: 845998 - RNA, 19 nt, Mycobacterium avium subsp. paratuberculosis
gccgcuugguggcgccggu

SEQ ID NO: 845999 - RNA, 15 nt, Mycobacterium avium subsp. paratuberculosis
gccgcuuuccacccc

SEQ ID NO: 846000 - RNA, 17 nt, Mycobacterium avium subsp. paratuberculosis
gccgcuuggccgggcgg

SEQ ID NO: 846001 - RNA, 21 nt, Mycobacterium avium subsp. paratuberculosis
gccgcuugcagcuuggcggug

SEQ ID NO: 846002 - RNA, 23 nt, Mycobacterium avium subsp. paratuberculosis
gccgcuugcagcuuggcgguggc

SEQ ID NO: 846003 - RNA, 11 nt, Mycobacterium avium subsp. paratuberculosis
gccggaaccgu

SEQ ID NO: 846004 - RNA, 13 nt, Mycobacterium avium subsp. paratuberculosis
gccggaacgagcc

SEQ ID NO: 846005 - RNA, 15 nt, Mycobacterium avium subsp. paratuberculosis
gccggaaaggcguga

SEQ ID NO: 846006 - RNA, 17 nt, Mycobacterium avium subsp. paratuberculosis
gccggaaaaguucggcg

SEQ ID NO: 846007 - RNA, 18 nt, Mycobacterium avium subsp. paratuberculosis
gccggaaaaguucggcgg

SEQ ID NO: 846008 - RNA, 19 nt, Mycobacterium avium subsp. paratuberculosis
gccggaaaaguucggcggg

SEQ ID NO: 846009 - RNA, 17 nt, Mycobacterium avium subsp. paratuberculosis
gccgccgcgcgcggcca

SEQ ID NO: 846010 - RNA, 12 nt, Mycobacterium avium subsp. paratuberculosis
gccgccgcgcgc

SEQ ID NO: 846011 - RNA, 15 nt, Mycobacterium avium subsp. paratuberculosis
gccgccgcgcgcggc

SEQ ID NO: 846012 - RNA, 14 nt, Mycobacterium avium subsp. paratuberculosis
gccgccgcgcgggu

SEQ ID NO: 846013 - RNA, 16 nt, Mycobacterium avium subsp. paratuberculosis
gccgccgcgcggguac

SEQ ID NO: 846014 - RNA, 22 nt, Mycobacterium avium subsp. paratuberculosis
gccgccgcgcggguacggcggc

SEQ ID NO: 846015 - RNA, 15 nt, Mycobacterium avium subsp. paratuberculosis
gccgcugcauccgca

SEQ ID NO: 846016 - RNA, 17 nt, Mycobacterium avium subsp. paratuberculosis
gccgcugcauccgcagc

SEQ ID NO: 846017 - RNA, 14 nt, Mycobacterium avium subsp. paratuberculosis
gccgcugcauccgc

SEQ ID NO: 846018 - RNA, 19 nt, Mycobacterium avium subsp. paratuberculosis
gccgccgcgcauccgcacc

SEQ ID NO: 846019 - RNA, 21 nt, Mycobacterium avium subsp. paratuberculosis
gccgccgcgcauccgcaccga

SEQ ID NO: 846020 - RNA, 23 nt, Mycobacterium avium subsp. paratuberculosis
gccgccgcgcauccgcaccgaga

SEQ ID NO: 846021 - RNA, 13 nt, Mycobacterium avium subsp. paratuberculosis
gccgccgcgcagg

SEQ ID NO: 846022 - RNA, 19 nt, Mycobacterium avium subsp. paratuberculosis
gccgccgcgaucagggccc

SEQ ID NO: 846023 - RNA, 20 nt, Mycobacterium avium subsp. paratuberculosis
gccgccgcgacgaugccggc

SEQ ID NO: 846024 - RNA, 21 nt, Mycobacterium avium subsp. paratuberculosis
gccgccgcgacgaugccggcg

SEQ ID NO: 846025 - RNA, 23 nt, Mycobacterium avium subsp. paratuberculosis
gccgccgcgacgaugccggcguc

SEQ ID NO: 846026 - RNA, 14 nt, Mycobacterium avium subsp. paratuberculosis
gccgccgcgacgcc

SEQ ID NO: 846027 - RNA, 15 nt, Mycobacterium avium subsp. paratuberculosis
gccgccgcgacgccg

SEQ ID NO: 846028 - RNA, 17 nt, Mycobacterium avium subsp. paratuberculosis
gccgcugcgcccagcgc

SEQ ID NO: 846029 - RNA, 21 nt, Mycobacterium avium subsp. paratuberculosis
gccgcugcgacaggucggcgg

SEQ ID NO: 846030 - RNA, 16 nt, Mycobacterium avium subsp. paratuberculosis
gccgcugcgccggcgc

SEQ ID NO: 846031 - RNA, 21 nt, Mycobacterium avium subsp. paratuberculosis
gccgcugcgccggcgcggcca

SEQ ID NO: 846032 - RNA, 13 nt, Mycobacterium avium subsp. paratuberculosis
gccgcugccguuc

SEQ ID NO: 846033 - RNA, 13 nt, Mycobacterium avium subsp. paratuberculosis
gccgcugccgggg

SEQ ID NO: 846034 - RNA, 16 nt, Mycobacterium avium subsp. paratuberculosis
gccgcugccggggugc

SEQ ID NO: 846035 - RNA, 23 nt, Mycobacterium avium subsp. paratuberculosis
gccgcugccggggugcagcacca

SEQ ID NO: 846036 - RNA, 14 nt, Mycobacterium avium subsp. paratuberculosis
gccgcugcccggcg

SEQ ID NO: 846037 - RNA, 15 nt, Mycobacterium avium subsp. paratuberculosis
gccgcugcccggcgc

SEQ ID NO: 846038 - RNA, 16 nt, Mycobacterium avium subsp. paratuberculosis
gccgcugcccggcgcu

SEQ ID NO: 846039 - RNA, 15 nt, Mycobacterium avium subsp. paratuberculosis
gccgcugcugggugc

SEQ ID NO: 846040 - RNA, 17 nt, Mycobacterium avium subsp. paratuberculosis
gccgcugcugggugccg

SEQ ID NO: 846041 - RNA, 14 nt, Mycobacterium avium subsp. paratuberculosis
gccgcugcgggcca

SEQ ID NO: 846042 - RNA, 14 nt, Mycobacterium avium subsp. paratuberculosis
gccgcugcgggcgg

SEQ ID NO: 846043 - RNA, 18 nt, Mycobacterium avium subsp. paratuberculosis
gccgcugcgggcgggccg

SEQ ID NO: 846044 - RNA, 20 nt, Mycobacterium avium subsp. paratuberculosis
gccgcugcgggcgggccgcc

SEQ ID NO: 846045 - RNA, 22 nt, Mycobacterium avium subsp. paratuberculosis
gccgcugcgggcgggccgccag

SEQ ID NO: 846046 - RNA, 22 nt, Mycobacterium avium subsp. paratuberculosis
gccgcugggcguggugcggugc

SEQ ID NO: 846047 - RNA, 14 nt, Mycobacterium avium subsp. paratuberculosis
gccgcugguaggcg

SEQ ID NO: 846048 - RNA, 17 nt, Mycobacterium avium subsp. paratuberculosis
gccgcugguaggcggcg

SEQ ID NO: 846049 - RNA, 18 nt, Mycobacterium avium subsp. paratuberculosis
gccgcugguaggcggcgc

SEQ ID NO: 846050 - RNA, 22 nt, Mycobacterium avium subsp. paratuberculosis
gccgcuggugaacucgccgauc

SEQ ID NO: 846051 - RNA, 24 nt, Mycobacterium avium subsp. paratuberculosis
gccgcuggugaacucgccgaucgg

SEQ ID NO: 846052 - RNA, 19 nt, Mycobacterium avium subsp. paratuberculosis
gccgcuggugaggucgcgc

SEQ ID NO: 846053 - RNA, 20 nt, Mycobacterium avium subsp. paratuberculosis
gccgcuggugaggucgcgca

SEQ ID NO: 846054 - RNA, 14 nt, Mycobacterium avium subsp. paratuberculosis
gccgcuggcgucga

SEQ ID NO: 846055 - RNA, 17 nt, Mycobacterium avium subsp. paratuberculosis
gccgcuggcgucgaucg

SEQ ID NO: 846056 - RNA, 13 nt, Mycobacterium avium subsp. paratuberculosis
gccgcuggccgcg

SEQ ID NO: 846057 - RNA, 14 nt, Mycobacterium avium subsp. paratuberculosis
gccgcuggccgcgc

SEQ ID NO: 846058 - RNA, 23 nt, Mycobacterium avium subsp. paratuberculosis
gccgcuggauuccaccguggucg

SEQ ID NO: 846059 - RNA, 16 nt, Mycobacterium avium subsp. paratuberculosis
gccgcugucugcgugc

SEQ ID NO: 846060 - RNA, 13 nt, Mycobacterium avium subsp. paratuberculosis
gccgcugucgucg

SEQ ID NO: 846061 - RNA, 17 nt, Mycobacterium avium subsp. paratuberculosis
gccgcugucgucgaaga

SEQ ID NO: 846062 - RNA, 21 nt, Mycobacterium avium subsp. paratuberculosis
gccgcugucgucgaagagcug

SEQ ID NO: 846063 - RNA, 23 nt, Mycobacterium avium subsp. paratuberculosis
gccgcugucgucgaagagcuggu

SEQ ID NO: 846064 - RNA, 15 nt, Mycobacterium avium subsp. paratuberculosis
gccgcuucggggugg

SEQ ID NO: 846065 - RNA, 22 nt, Mycobacterium avium subsp. paratuberculosis
gccgcuucggggugguugauca

SEQ ID NO: 846066 - RNA, 18 nt, Mycobacterium avium subsp. paratuberculosis
gccgcuucgucgccggcc

SEQ ID NO: 846067 - RNA, 19 nt, Mycobacterium avium subsp. paratuberculosis
gccgcuucgucgccggccg

SEQ ID NO: 846068 - RNA, 21 nt, Mycobacterium avium subsp. paratuberculosis
gccgcuucgucgccggccgcc

SEQ ID NO: 846069 - RNA, 15 nt, Mycobacterium avium subsp. paratuberculosis
gccgcuucgaggugc

SEQ ID NO: 846070 - RNA, 23 nt, Mycobacterium avium subsp. paratuberculosis
gccgcugguggugaucacccagc

SEQ ID NO: 846071 - RNA, 14 nt, Mycobacterium avium subsp. paratuberculosis
gccgcuucccaccc

SEQ ID NO: 846072 - RNA, 16 nt, Mycobacterium avium subsp. paratuberculosis
gccgcuucccacccgg

SEQ ID NO: 846073 - RNA, 18 nt, Mycobacterium avium subsp. paratuberculosis
gccgcuucccacccgguc

SEQ ID NO: 846074 - RNA, 13 nt, Mycobacterium avium subsp. paratuberculosis
aagccauggcggc

SEQ ID NO: 846075 - RNA, 16 nt, Mycobacterium avium subsp. paratuberculosis
aagccauggcggcccg

SEQ ID NO: 846076 - RNA, 23 nt, Mycobacterium avium subsp. paratuberculosis
aagcccacgaucacgucggugac

SEQ ID NO: 846077 - RNA, 15 nt, Mycobacterium avium subsp. paratuberculosis
aagccauuucagcag

SEQ ID NO: 846078 - RNA, 15 nt, Mycobacterium avium subsp. paratuberculosis
aagcccaccgccguu

SEQ ID NO: 846079 - RNA, 20 nt, Mycobacterium avium subsp. paratuberculosis
gccuacaggugccggcggcg

SEQ ID NO: 846080 - RNA, 16 nt, Mycobacterium avium subsp. paratuberculosis
gccuaccggguggcca

SEQ ID NO: 846081 - RNA, 16 nt, Mycobacterium avium subsp. paratuberculosis
gccguugggcagcucg

SEQ ID NO: 846082 - RNA, 17 nt, Mycobacterium avium subsp. paratuberculosis
gccguugggcagcucgg

SEQ ID NO: 846083 - RNA, 18 nt, Mycobacterium avium subsp. paratuberculosis
gccguugggcagcucggc

SEQ ID NO: 846084 - RNA, 15 nt, Mycobacterium avium subsp. paratuberculosis
gccguugggccagcg

SEQ ID NO: 846085 - RNA, 18 nt, Mycobacterium avium subsp. paratuberculosis
gccguugggccagcggcg

SEQ ID NO: 846086 - RNA, 19 nt, Mycobacterium avium subsp. paratuberculosis
gccguuggucugcgcgagc

SEQ ID NO: 846087 - RNA, 23 nt, Mycobacterium avium subsp. paratuberculosis
gccguuggucugcgcgagcagau

SEQ ID NO: 846088 - RNA, 21 nt, Mycobacterium avium subsp. paratuberculosis
gccguuggugacgcucacccg

SEQ ID NO: 846089 - RNA, 22 nt, Mycobacterium avium subsp. paratuberculosis
gccguuggugacgcucacccgg

SEQ ID NO: 846090 - RNA, 23 nt, Mycobacterium avium subsp. paratuberculosis
gccguuggugacgcucacccggc

SEQ ID NO: 846091 - RNA, 17 nt, Mycobacterium avium subsp. paratuberculosis
gccuaauucguuguugg

SEQ ID NO: 846092 - RNA, 22 nt, Mycobacterium avium subsp. paratuberculosis
gccuacacagcccccacgcucg

SEQ ID NO: 846093 - RNA, 23 nt, Mycobacterium avium subsp. paratuberculosis
gccuacacagcccccacgcucgg

SEQ ID NO: 846094 - RNA, 16 nt, Mycobacterium avium subsp. paratuberculosis
gccucgaucaacgccg

SEQ ID NO: 846095 - RNA, 18 nt, Mycobacterium avium subsp. paratuberculosis
gccucgaucaacgccggg

SEQ ID NO: 846096 - RNA, 18 nt, Mycobacterium avium subsp. paratuberculosis
gccucgaucagagcgggc

SEQ ID NO: 846097 - RNA, 19 nt, Mycobacterium avium subsp. paratuberculosis
gccucgaucagagcgggcc

SEQ ID NO: 846098 - RNA, 24 nt, Mycobacterium avium subsp. paratuberculosis
gccucgaucagagcgggccgaccg

SEQ ID NO: 846099 - RNA, 15 nt, Mycobacterium avium subsp. paratuberculosis
gccucgagcgcccgg

SEQ ID NO: 846100 - RNA, 15 nt, Mycobacterium avium subsp. paratuberculosis
gccucgaggaucgcg

SEQ ID NO: 846101 - RNA, 16 nt, Mycobacterium avium subsp. paratuberculosis
gccucgaggaucgcgg

SEQ ID NO: 846102 - RNA, 22 nt, Mycobacterium avium subsp. paratuberculosis
gccucgcgcagcgcgucgggcu

SEQ ID NO: 846103 - RNA, 15 nt, Mycobacterium avium subsp. paratuberculosis
gccucgcgcaucagc

SEQ ID NO: 846104 - RNA, 15 nt, Mycobacterium avium subsp. paratuberculosis
gccucgacggugacc

SEQ ID NO: 846105 - RNA, 22 nt, Mycobacterium avium subsp. paratuberculosis
gccucgacggugaccucgucgg

SEQ ID NO: 846106 - RNA, 21 nt, Mycobacterium avium subsp. paratuberculosis
gccucgagcaacggccgcagc

SEQ ID NO: 846107 - RNA, 16 nt, Mycobacterium avium subsp. paratuberculosis
gccucgagcaccacgg

SEQ ID NO: 846108 - RNA, 21 nt, Mycobacterium avium subsp. paratuberculosis
gccucgagcaccacggcccgc

SEQ ID NO: 846109 - RNA, 21 nt, Mycobacterium avium subsp. paratuberculosis
gccuccggcaguacgcgccgg

SEQ ID NO: 846110 - RNA, 23 nt, Mycobacterium avium subsp. paratuberculosis
gccuccggcaguacgcgccggcc

SEQ ID NO: 846111 - RNA, 14 nt, Mycobacterium avium subsp. paratuberculosis
gccucgaccagcac

SEQ ID NO: 846112 - RNA, 17 nt, Mycobacterium avium subsp. paratuberculosis
gccuccggauggcgguc

SEQ ID NO: 846113 - RNA, 23 nt, Mycobacterium avium subsp. paratuberculosis
gccuccggauggcggucgcgcca

SEQ ID NO: 846114 - RNA, 17 nt, Mycobacterium avium subsp. paratuberculosis
gccucggaggccaccgc

SEQ ID NO: 846115 - RNA, 18 nt, Mycobacterium avium subsp. paratuberculosis
gccucggaggccaccgcg

SEQ ID NO: 846116 - RNA, 20 nt, Mycobacterium avium subsp. paratuberculosis
gccucggaggccaccgcgcc

SEQ ID NO: 846117 - RNA, 22 nt, Mycobacterium avium subsp. paratuberculosis
gccucggauuccgcggaacccg

SEQ ID NO: 846118 - RNA, 21 nt, Mycobacterium avium subsp. paratuberculosis
gccucggcaccgugccgcgcg

SEQ ID NO: 846119 - RNA, 23 nt, Mycobacterium avium subsp. paratuberculosis
gccucggcaccgugccgcgcggc

SEQ ID NO: 846120 - RNA, 16 nt, Mycobacterium avium subsp. paratuberculosis
gccucggccucgucga

SEQ ID NO: 846121 - RNA, 18 nt, Mycobacterium avium subsp. paratuberculosis
gccucggccucgucgacg

SEQ ID NO: 846122 - RNA, 21 nt, Mycobacterium avium subsp. paratuberculosis
gccucggccucgucgacgucg

SEQ ID NO: 846123 - RNA, 13 nt, Mycobacterium avium subsp. paratuberculosis
gccucggccacca

SEQ ID NO: 846124 - RNA, 15 nt, Mycobacterium avium subsp. paratuberculosis
gccucggccagcacc

SEQ ID NO: 846125 - RNA, 20 nt, Mycobacterium avium subsp. paratuberculosis
gccucgcgggugcugggcgg

SEQ ID NO: 846126 - RNA, 18 nt, Mycobacterium avium subsp. paratuberculosis
gccucgcuaaucgccgcg

SEQ ID NO: 846127 - RNA, 20 nt, Mycobacterium avium subsp. paratuberculosis
gccucgcuaaucgccgcgcg

SEQ ID NO: 846128 - RNA, 21 nt, Mycobacterium avium subsp. paratuberculosis
gccucgcuaaucgccgcgcgu

SEQ ID NO: 846129 - RNA, 22 nt, Mycobacterium avium subsp. paratuberculosis
gccugaccaaggacaagcuggu

SEQ ID NO: 846130 - RNA, 12 nt, Mycobacterium avium subsp. paratuberculosis
gccugaccgcgg

SEQ ID NO: 846131 - RNA, 15 nt, Mycobacterium avium subsp. paratuberculosis
gccugaccgcgggug

SEQ ID NO: 846132 - RNA, 19 nt, Mycobacterium avium subsp. paratuberculosis
gccugacccggccgugcgc

SEQ ID NO: 846133 - RNA, 14 nt, Mycobacterium avium subsp. paratuberculosis
gccucgggccggca

SEQ ID NO: 846134 - RNA, 15 nt, Mycobacterium avium subsp. paratuberculosis
gccucgggccggcag

SEQ ID NO: 846135 - RNA, 17 nt, Mycobacterium avium subsp. paratuberculosis
gccucgggccggcagcc

SEQ ID NO: 846136 - RNA, 18 nt, Mycobacterium avium subsp. paratuberculosis
gccucgggccggcagccg

SEQ ID NO: 846137 - RNA, 23 nt, Mycobacterium avium subsp. paratuberculosis
gccucgggccggcagccggccac

SEQ ID NO: 846138 - RNA, 14 nt, Mycobacterium avium subsp. paratuberculosis
gccucgggcgacga

SEQ ID NO: 846139 - RNA, 19 nt, Mycobacterium avium subsp. paratuberculosis
gccucgggcgacgacgcgg

SEQ ID NO: 846140 - RNA, 16 nt, Mycobacterium avium subsp. paratuberculosis
gccugacgggagucgg

SEQ ID NO: 846141 - RNA, 17 nt, Mycobacterium avium subsp. paratuberculosis
gccugacuaagucacca

SEQ ID NO: 846142 - RNA, 12 nt, Mycobacterium avium subsp. paratuberculosis
gccucggcgucc

SEQ ID NO: 846143 - RNA, 17 nt, Mycobacterium avium subsp. paratuberculosis
gccucggcgucccggcg

SEQ ID NO: 846144 - RNA, 14 nt, Mycobacterium avium subsp. paratuberculosis
gccucggcguccgc

SEQ ID NO: 846145 - RNA, 18 nt, Mycobacterium avium subsp. paratuberculosis
gccucggcguccgcggcg

SEQ ID NO: 846146 - RNA, 19 nt, Mycobacterium avium subsp. paratuberculosis
gccucggcguccgcggcgg

SEQ ID NO: 846147 - RNA, 20 nt, Mycobacterium avium subsp. paratuberculosis
gccucggcguccgcggcgga

SEQ ID NO: 846148 - RNA, 21 nt, Mycobacterium avium subsp. paratuberculosis
gccucggcguccgcggcggag

SEQ ID NO: 846149 - RNA, 14 nt, Mycobacterium avium subsp. paratuberculosis
gccucggcgguggc

SEQ ID NO: 846150 - RNA, 16 nt, Mycobacterium avium subsp. paratuberculosis
gccucggcgggccgcc

SEQ ID NO: 846151 - RNA, 20 nt, Mycobacterium avium subsp. paratuberculosis
gccucggcgggccgcccggc

SEQ ID NO: 846152 - RNA, 21 nt, Mycobacterium avium subsp. paratuberculosis
gccucggcgggccgcccggcg

SEQ ID NO: 846153 - RNA, 13 nt, Mycobacterium avium subsp. paratuberculosis
gccucggcggccg

SEQ ID NO: 846154 - RNA, 23 nt, Mycobacterium avium subsp. paratuberculosis
gccucggcggccgggaugccgcc

SEQ ID NO: 846155 - RNA, 16 nt, Mycobacterium avium subsp. paratuberculosis
gccucggcgccucggc

SEQ ID NO: 846156 - RNA, 18 nt, Mycobacterium avium subsp. paratuberculosis
gccucggcgccucggcgu

SEQ ID NO: 846157 - RNA, 13 nt, Mycobacterium avium subsp. paratuberculosis
gccucggcgcugc

SEQ ID NO: 846158 - RNA, 17 nt, Mycobacterium avium subsp. paratuberculosis
gccucggcgcugcccgc

SEQ ID NO: 846159 - RNA, 21 nt, Mycobacterium avium subsp. paratuberculosis
gccucggcggagucguagucg

SEQ ID NO: 846160 - RNA, 15 nt, Mycobacterium avium subsp. paratuberculosis
gccucggcgagccgc

SEQ ID NO: 846161 - RNA, 17 nt, Mycobacterium avium subsp. paratuberculosis
gccucggcgagccgcuc

SEQ ID NO: 846162 - RNA, 19 nt, Mycobacterium avium subsp. paratuberculosis
gccucggcgaggucgucga

SEQ ID NO: 846163 - RNA, 14 nt, Mycobacterium avium subsp. paratuberculosis
gccucggcgaucgg

SEQ ID NO: 846164 - RNA, 17 nt, Mycobacterium avium subsp. paratuberculosis
gccucggcgaucggccg

SEQ ID NO: 846165 - RNA, 17 nt, Mycobacterium avium subsp. paratuberculosis
gccucggcgaugccgag

SEQ ID NO: 846166 - RNA, 23 nt, Mycobacterium avium subsp. paratuberculosis
gccugauugacggcccacgucgc

SEQ ID NO: 846167 - RNA, 20 nt, Mycobacterium avium subsp. paratuberculosis
gccugcgacuucuacggcgg

SEQ ID NO: 846168 - RNA, 14 nt, Mycobacterium avium subsp. paratuberculosis
gccugccggcgccg

SEQ ID NO: 846169 - RNA, 15 nt, Mycobacterium avium subsp. paratuberculosis
gccugccggcgccgg

SEQ ID NO: 846170 - RNA, 22 nt, Mycobacterium avium subsp. paratuberculosis
gccugccggaugccgcgcggcg

SEQ ID NO: 846171 - RNA, 13 nt, Mycobacterium avium subsp. paratuberculosis
gccugccggccgc

SEQ ID NO: 846172 - RNA, 16 nt, Mycobacterium avium subsp. paratuberculosis
gccugccggccgccgc

SEQ ID NO: 846173 - RNA, 17 nt, Mycobacterium avium subsp. paratuberculosis
gccugcccgggcgccga

SEQ ID NO: 846174 - RNA, 14 nt, Mycobacterium avium subsp. paratuberculosis
gccugcccagcggc

SEQ ID NO: 846175 - RNA, 21 nt, Mycobacterium avium subsp. paratuberculosis
gccugcccagcggcacgggca

SEQ ID NO: 846176 - RNA, 15 nt, Mycobacterium avium subsp. paratuberculosis
gccugcccgccgcgg

SEQ ID NO: 846177 - RNA, 15 nt, Mycobacterium avium subsp. paratuberculosis
gccugcccgcgcagg

SEQ ID NO: 846178 - RNA, 15 nt, Mycobacterium avium subsp. paratuberculosis
gccugcccgcgggug

SEQ ID NO: 846179 - RNA, 22 nt, Mycobacterium avium subsp. paratuberculosis
gccugcccggagaaaccgucgg

SEQ ID NO: 846180 - RNA, 21 nt, Mycobacterium avium subsp. paratuberculosis
gccugcggccugcacaggggc

SEQ ID NO: 846181 - RNA, 19 nt, Mycobacterium avium subsp. paratuberculosis
gccugcgggaaguugccca

SEQ ID NO: 846182 - RNA, 12 nt, Mycobacterium avium subsp. paratuberculosis
gccugcgggccc

SEQ ID NO: 846183 - RNA, 13 nt, Mycobacterium avium subsp. paratuberculosis
gccugcgggccca

SEQ ID NO: 846184 - RNA, 17 nt, Mycobacterium avium subsp. paratuberculosis
gccugcgggcccagcuc

SEQ ID NO: 846185 - RNA, 20 nt, Mycobacterium avium subsp. paratuberculosis
gccugcggguucuggccgug

SEQ ID NO: 846186 - RNA, 20 nt, Mycobacterium avium subsp. paratuberculosis
gccugcggugagcugaucgc

SEQ ID NO: 846187 - RNA, 13 nt, Mycobacterium avium subsp. paratuberculosis
gccugcggugaug

SEQ ID NO: 846188 - RNA, 14 nt, Mycobacterium avium subsp. paratuberculosis
gccugcggugaugc

SEQ ID NO: 846189 - RNA, 19 nt, Mycobacterium avium subsp. paratuberculosis
gccugcggugaugcgcggc

SEQ ID NO: 846190 - RNA, 21 nt, Mycobacterium avium subsp. paratuberculosis
gccugcggugaugcgcggcga

SEQ ID NO: 846191 - RNA, 15 nt, Mycobacterium avium subsp. paratuberculosis
gccugcggcgcggcc

SEQ ID NO: 846192 - RNA, 18 nt, Mycobacterium avium subsp. paratuberculosis
gccugcggcgcggccacc

SEQ ID NO: 846193 - RNA, 12 nt, Mycobacterium avium subsp. paratuberculosis
gccugcggcggc

SEQ ID NO: 846194 - RNA, 13 nt, Mycobacterium avium subsp. paratuberculosis
gccugcggcggca

SEQ ID NO: 846195 - RNA, 15 nt, Mycobacterium avium subsp. paratuberculosis
gccugcggcggcaac

SEQ ID NO: 846196 - RNA, 13 nt, Mycobacterium avium subsp. paratuberculosis
gccugcggcggcc

SEQ ID NO: 846197 - RNA, 19 nt, Mycobacterium avium subsp. paratuberculosis
gccugcggcaacagcacca

SEQ ID NO: 846198 - RNA, 22 nt, Mycobacterium avium subsp. paratuberculosis
gccugcggcaacagcaccagca

SEQ ID NO: 846199 - RNA, 16 nt, Mycobacterium avium subsp. paratuberculosis
gccugcgcgccgucgg

SEQ ID NO: 846200 - RNA, 16 nt, Mycobacterium avium subsp. paratuberculosis
gccugcgcgccgaugu

SEQ ID NO: 846201 - RNA, 22 nt, Mycobacterium avium subsp. paratuberculosis
gccugcgcgccgauguggccgg

SEQ ID NO: 846202 - RNA, 16 nt, Mycobacterium avium subsp. paratuberculosis
gccugcgcgucgucgc

SEQ ID NO: 846203 - RNA, 21 nt, Mycobacterium avium subsp. paratuberculosis
gccugcgcgucgucgcccgaa

SEQ ID NO: 846204 - RNA, 14 nt, Mycobacterium avium subsp. paratuberculosis
gccugcgcggcggc

SEQ ID NO: 846205 - RNA, 15 nt, Mycobacterium avium subsp. paratuberculosis
gccugcgcgaucgcc

SEQ ID NO: 846206 - RNA, 11 nt, Mycobacterium avium subsp. paratuberculosis
gccugcgccgc

SEQ ID NO: 846207 - RNA, 13 nt, Mycobacterium avium subsp. paratuberculosis
gccugcgccgccg

SEQ ID NO: 846208 - RNA, 17 nt, Mycobacterium avium subsp. paratuberculosis
gccugcgccaggauccg

SEQ ID NO: 846209 - RNA, 13 nt, Mycobacterium avium subsp. paratuberculosis
gccugcgcccggc

SEQ ID NO: 846210 - RNA, 21 nt, Mycobacterium avium subsp. paratuberculosis
gccuggaaaccccucagccgg

SEQ ID NO: 846211 - RNA, 22 nt, Mycobacterium avium subsp. paratuberculosis
gccugcuugggcagcagcucga

SEQ ID NO: 846212 - RNA, 22 nt, Mycobacterium avium subsp. paratuberculosis
gccugcuuggucgccugcacga

SEQ ID NO: 846213 - RNA, 18 nt, Mycobacterium avium subsp. paratuberculosis
gccugcuugaccgccaga

SEQ ID NO: 846214 - RNA, 22 nt, Mycobacterium avium subsp. paratuberculosis
gccugcuugagguugacgugca

SEQ ID NO: 846215 - RNA, 21 nt, Mycobacterium avium subsp. paratuberculosis
gccugcuugaugaugccggcc

SEQ ID NO: 846216 - RNA, 23 nt, Mycobacterium avium subsp. paratuberculosis
gccugcuugaugaugccggccgc

SEQ ID NO: 846217 - RNA, 18 nt, Mycobacterium avium subsp. paratuberculosis
gccugcucgcuugccagc

SEQ ID NO: 846218 - RNA, 21 nt, Mycobacterium avium subsp. paratuberculosis
gccuggacagggucguucagc

SEQ ID NO: 846219 - RNA, 21 nt, Mycobacterium avium subsp. paratuberculosis
gccuggcccaaaaacaucguc

SEQ ID NO: 846220 - RNA, 21 nt, Mycobacterium avium subsp. paratuberculosis
gccuggcccagacaggccggc

SEQ ID NO: 846221 - RNA, 15 nt, Mycobacterium avium subsp. paratuberculosis
gccuggcacgacgcc

SEQ ID NO: 846222 - RNA, 12 nt, Mycobacterium avium subsp. paratuberculosis
gccuggccaccu

SEQ ID NO: 846223 - RNA, 14 nt, Mycobacterium avium subsp. paratuberculosis
gccuggccaccucg

SEQ ID NO: 846224 - RNA, 17 nt, Mycobacterium avium subsp. paratuberculosis
gccuggccacguggucg

SEQ ID NO: 846225 - RNA, 20 nt, Mycobacterium avium subsp. paratuberculosis
gccuggcggaaggccgcgcg

SEQ ID NO: 846226 - RNA, 22 nt, Mycobacterium avium subsp. paratuberculosis
gccuggcggaaggccgcgcggg

SEQ ID NO: 846227 - RNA, 15 nt, Mycobacterium avium subsp. paratuberculosis
gccuggcuccccggc

SEQ ID NO: 846228 - RNA, 16 nt, Mycobacterium avium subsp. paratuberculosis
gccuggcgcuccagcc

SEQ ID NO: 846229 - RNA, 13 nt, Mycobacterium avium subsp. paratuberculosis
gccuggcgaacuc

SEQ ID NO: 846230 - RNA, 13 nt, Mycobacterium avium subsp. paratuberculosis
gccuggccgucgc

SEQ ID NO: 846231 - RNA, 16 nt, Mycobacterium avium subsp. paratuberculosis
gccugguacagcaccg

SEQ ID NO: 846232 - RNA, 19 nt, Mycobacterium avium subsp. paratuberculosis
gccugguacagcaccgccg

SEQ ID NO: 846233 - RNA, 21 nt, Mycobacterium avium subsp. paratuberculosis
gccugguacagcaccgccgcg

SEQ ID NO: 846234 - RNA, 22 nt, Mycobacterium avium subsp. paratuberculosis
gccugggugaccgagucgucgc

SEQ ID NO: 846235 - RNA, 18 nt, Mycobacterium avium subsp. paratuberculosis
gccugguagcugagcagc

SEQ ID NO: 846236 - RNA, 20 nt, Mycobacterium avium subsp. paratuberculosis
gccuggguacgaaccucguu

SEQ ID NO: 846237 - RNA, 17 nt, Mycobacterium avium subsp. paratuberculosis
gccugggcgaccacguc

SEQ ID NO: 846238 - RNA, 22 nt, Mycobacterium avium subsp. paratuberculosis
gccugggauugccgggcaccag

SEQ ID NO: 846239 - RNA, 21 nt, Mycobacterium avium subsp. paratuberculosis
gccugggcaauggccgcgacu

SEQ ID NO: 846240 - RNA, 16 nt, Mycobacterium avium subsp. paratuberculosis
gccuggucggccggca

SEQ ID NO: 846241 - RNA, 14 nt, Mycobacterium avium subsp. paratuberculosis
gccuggucggcgac

SEQ ID NO: 846242 - RNA, 15 nt, Mycobacterium avium subsp. paratuberculosis
gccuggucggcgacc

SEQ ID NO: 846243 - RNA, 19 nt, Mycobacterium avium subsp. paratuberculosis
gccuggucgaacagcacgc

SEQ ID NO: 846244 - RNA, 21 nt, Mycobacterium avium subsp. paratuberculosis
gccuggucgaacagcacgccg

SEQ ID NO: 846245 - RNA, 22 nt, Mycobacterium avium subsp. paratuberculosis
gccuggucgaacagcacgccgg

SEQ ID NO: 846246 - RNA, 14 nt, Mycobacterium avium subsp. paratuberculosis
gccugguccucccg

SEQ ID NO: 846247 - RNA, 17 nt, Mycobacterium avium subsp. paratuberculosis
gccugguccucccgggu

SEQ ID NO: 846248 - RNA, 20 nt, Mycobacterium avium subsp. paratuberculosis
gccugguccucccggguggg

SEQ ID NO: 846249 - RNA, 20 nt, Mycobacterium avium subsp. paratuberculosis
gccugucaguuugcgcgacg

SEQ ID NO: 846250 - RNA, 21 nt, Mycobacterium avium subsp. paratuberculosis
gccugucaguuugcgcgacgg

SEQ ID NO: 846251 - RNA, 23 nt, Mycobacterium avium subsp. paratuberculosis
gccugguuggucaauccgggcac

SEQ ID NO: 846252 - RNA, 16 nt, Mycobacterium avium subsp. paratuberculosis
gccuuacaaagccggu

SEQ ID NO: 846253 - RNA, 14 nt, Mycobacterium avium subsp. paratuberculosis
gccuuagcccggcc

SEQ ID NO: 846254 - RNA, 16 nt, Mycobacterium avium subsp. paratuberculosis
gccuuagcccggccgc

SEQ ID NO: 846255 - RNA, 18 nt, Mycobacterium avium subsp. paratuberculosis
gccuuagcccggccgcgg

SEQ ID NO: 846256 - RNA, 18 nt, Mycobacterium avium subsp. paratuberculosis
gccuguccgaccagcggu

SEQ ID NO: 846257 - RNA, 14 nt, Mycobacterium avium subsp. paratuberculosis
gccguugccgccgc

SEQ ID NO: 846258 - RNA, 13 nt, Mycobacterium avium subsp. paratuberculosis
gccguugcgggug

SEQ ID NO: 846259 - RNA, 12 nt, Mycobacterium avium subsp. paratuberculosis
gccguugcggug

SEQ ID NO: 846260 - RNA, 13 nt, Mycobacterium avium subsp. paratuberculosis
gccguugcggccc

SEQ ID NO: 846261 - RNA, 15 nt, Mycobacterium avium subsp. paratuberculosis
gccguugccgccgcg

SEQ ID NO: 846262 - RNA, 16 nt, Mycobacterium avium subsp. paratuberculosis
gccguugccgccgcgc

SEQ ID NO: 846263 - RNA, 19 nt, Mycobacterium avium subsp. paratuberculosis
gccguugccggcccgcagc

SEQ ID NO: 846264 - RNA, 15 nt, Mycobacterium avium subsp. paratuberculosis
gccguugacaccggg

SEQ ID NO: 846265 - RNA, 17 nt, Mycobacterium avium subsp. paratuberculosis
gccguugacaccgggug

SEQ ID NO: 846266 - RNA, 21 nt, Mycobacterium avium subsp. paratuberculosis
gccguugaucgagcaccgggc

SEQ ID NO: 846267 - RNA, 19 nt, Mycobacterium avium subsp. paratuberculosis
gccguugaugcgcaccgcg

SEQ ID NO: 846268 - RNA, 20 nt, Mycobacterium avium subsp. paratuberculosis
gccguugaugcgcaccgcgg

SEQ ID NO: 846269 - RNA, 18 nt, Mycobacterium avium subsp. paratuberculosis
gccguugauugcgcccgc

SEQ ID NO: 846270 - RNA, 20 nt, Mycobacterium avium subsp. paratuberculosis
gccguugauugcgcccgccg

SEQ ID NO: 846271 - RNA, 21 nt, Mycobacterium avium subsp. paratuberculosis
gccguugauugcgcccgccga

SEQ ID NO: 846272 - RNA, 22 nt, Mycobacterium avium subsp. paratuberculosis
gccguugauugcgcccgccgaa

SEQ ID NO: 846273 - RNA, 16 nt, Mycobacterium avium subsp. paratuberculosis
gccguugccaggccgc

SEQ ID NO: 846274 - RNA, 17 nt, Mycobacterium avium subsp. paratuberculosis
gccguugccaggccgcg

SEQ ID NO: 846275 - RNA, 19 nt, Mycobacterium avium subsp. paratuberculosis
gccguugccaggccgcgag

SEQ ID NO: 846276 - RNA, 20 nt, Mycobacterium avium subsp. paratuberculosis
gccguugccaggccgcgagc

SEQ ID NO: 846277 - RNA, 12 nt, Mycobacterium avium subsp. paratuberculosis
gccguugccgcc

SEQ ID NO: 846278 - RNA, 13 nt, Mycobacterium avium subsp. paratuberculosis
gccguugccgccg

SEQ ID NO: 846279 - RNA, 14 nt, Mycobacterium avium subsp. paratuberculosis
gccguucucguccu

SEQ ID NO: 846280 - RNA, 20 nt, Mycobacterium avium subsp. paratuberculosis
gccguucucguccugggccg

SEQ ID NO: 846281 - RNA, 21 nt, Mycobacterium avium subsp. paratuberculosis
gccguucucguccugggccgg

SEQ ID NO: 846282 - RNA, 17 nt, Mycobacterium avium subsp. paratuberculosis
gccgugguuggcgauca

SEQ ID NO: 846283 - RNA, 19 nt, Mycobacterium avium subsp. paratuberculosis
gccguguaggccgcgcugg

SEQ ID NO: 846284 - RNA, 18 nt, Mycobacterium avium subsp. paratuberculosis
gccguugaccccgacggc

SEQ ID NO: 846285 - RNA, 22 nt, Mycobacterium avium subsp. paratuberculosis
gccguugaccccgacggcgccg

SEQ ID NO: 846286 - RNA, 13 nt, Mycobacterium avium subsp. paratuberculosis
gccguugaccgcg

SEQ ID NO: 846287 - RNA, 16 nt, Mycobacterium avium subsp. paratuberculosis
gccguugaccgcggcg

SEQ ID NO: 846288 - RNA, 19 nt, Mycobacterium avium subsp. paratuberculosis
gccguugaccgcggcgaug

SEQ ID NO: 846289 - RNA, 16 nt, Mycobacterium avium subsp. paratuberculosis
gccguugaccggccgg

SEQ ID NO: 846290 - RNA, 16 nt, Mycobacterium avium subsp. paratuberculosis
gccguugaccggugcg

SEQ ID NO: 846291 - RNA, 17 nt, Mycobacterium avium subsp. paratuberculosis
gccguugaccggugcgc

SEQ ID NO: 846292 - RNA, 18 nt, Mycobacterium avium subsp. paratuberculosis
gccguugaccggugcgcc

SEQ ID NO: 846293 - RNA, 21 nt, Mycobacterium avium subsp. paratuberculosis
gccguugaccggugcgcccgc

SEQ ID NO: 846294 - RNA, 20 nt, Mycobacterium avium subsp. paratuberculosis
gccguugagcguggacaccg

SEQ ID NO: 846295 - RNA, 23 nt, Mycobacterium avium subsp. paratuberculosis
gccguugagcguggacaccgcac

SEQ ID NO: 846296 - RNA, 13 nt, Mycobacterium avium subsp. paratuberculosis
gccguggucggcg

SEQ ID NO: 846297 - RNA, 22 nt, Mycobacterium avium subsp. paratuberculosis
gccguggucggcgaacgcccgg

SEQ ID NO: 846298 - RNA, 23 nt, Mycobacterium avium subsp. paratuberculosis
gccguggucggcgaacgcccggu

SEQ ID NO: 846299 - RNA, 17 nt, Mycobacterium avium subsp. paratuberculosis
gccguggucggugcccu

SEQ ID NO: 846300 - RNA, 13 nt, Mycobacterium avium subsp. paratuberculosis
gccgugggugccg

SEQ ID NO: 846301 - RNA, 14 nt, Mycobacterium avium subsp. paratuberculosis
gccgugggugccga

SEQ ID NO: 846302 - RNA, 17 nt, Mycobacterium avium subsp. paratuberculosis
gccgugggugucggcga

SEQ ID NO: 846303 - RNA, 18 nt, Mycobacterium avium subsp. paratuberculosis
gccgugggugucggcgaa

SEQ ID NO: 846304 - RNA, 19 nt, Mycobacterium avium subsp. paratuberculosis
gccgugggugucggcgaag

SEQ ID NO: 846305 - RNA, 15 nt, Mycobacterium avium subsp. paratuberculosis
gccguggucaacggc

SEQ ID NO: 846306 - RNA, 17 nt, Mycobacterium avium subsp. paratuberculosis
gccgugguccagccggu

SEQ ID NO: 846307 - RNA, 20 nt, Mycobacterium avium subsp. paratuberculosis
gccgugguccagccggucgc

SEQ ID NO: 846308 - RNA, 14 nt, Mycobacterium avium subsp. paratuberculosis
gccguggcaccggg

SEQ ID NO: 846309 - RNA, 19 nt, Mycobacterium avium subsp. paratuberculosis
gccgugggggucgacccgc

SEQ ID NO: 846310 - RNA, 21 nt, Mycobacterium avium subsp. paratuberculosis
gccgugggggucgacccgccg

SEQ ID NO: 846311 - RNA, 14 nt, Mycobacterium avium subsp. paratuberculosis
gccgugccggcucg

SEQ ID NO: 846312 - RNA, 16 nt, Mycobacterium avium subsp. paratuberculosis
gccgugccggcucggc

SEQ ID NO: 846313 - RNA, 17 nt, Mycobacterium avium subsp. paratuberculosis
gccgugccggcucggcg

SEQ ID NO: 846314 - RNA, 20 nt, Mycobacterium avium subsp. paratuberculosis
gccgugccggcucggcggcu

SEQ ID NO: 846315 - RNA, 16 nt, Mycobacterium avium subsp. paratuberculosis
gccgugccgcgcggcg

SEQ ID NO: 846316 - RNA, 14 nt, Mycobacterium avium subsp. paratuberculosis
gccgugacgccgau

SEQ ID NO: 846317 - RNA, 16 nt, Mycobacterium avium subsp. paratuberculosis
gccgugacgccgaucc

SEQ ID NO: 846318 - RNA, 15 nt, Mycobacterium avium subsp. paratuberculosis
gccgugcgccagcga

SEQ ID NO: 846319 - RNA, 21 nt, Mycobacterium avium subsp. paratuberculosis
gccgugcgccagcgaccgcag

SEQ ID NO: 846320 - RNA, 21 nt, Mycobacterium avium subsp. paratuberculosis
gccgugccguggucggugccc

SEQ ID NO: 846321 - RNA, 14 nt, Mycobacterium avium subsp. paratuberculosis
gccgugaaccggcg

SEQ ID NO: 846322 - RNA, 16 nt, Mycobacterium avium subsp. paratuberculosis
gccgugaaccggcguu

SEQ ID NO: 846323 - RNA, 17 nt, Mycobacterium avium subsp. paratuberculosis
gccgugaagggcccgcc

SEQ ID NO: 846324 - RNA, 19 nt, Mycobacterium avium subsp. paratuberculosis
gccgugaagggcccgccgg

SEQ ID NO: 846325 - RNA, 21 nt, Mycobacterium avium subsp. paratuberculosis
gccgugaagggcccgccggug

SEQ ID NO: 846326 - RNA, 15 nt, Mycobacterium avium subsp. paratuberculosis
gccgucuuccgggcc

SEQ ID NO: 846327 - RNA, 15 nt, Mycobacterium avium subsp. paratuberculosis
gccgucuugcccggc

SEQ ID NO: 846328 - RNA, 17 nt, Mycobacterium avium subsp. paratuberculosis
gccgucuugcccggcga

SEQ ID NO: 846329 - RNA, 18 nt, Mycobacterium avium subsp. paratuberculosis
gccgucuugcccggcgag

SEQ ID NO: 846330 - RNA, 15 nt, Mycobacterium avium subsp. paratuberculosis
gccguggacccgccc

SEQ ID NO: 846331 - RNA, 20 nt, Mycobacterium avium subsp. paratuberculosis
gccguggacccgccccgaca

SEQ ID NO: 846332 - RNA, 20 nt, Mycobacterium avium subsp. paratuberculosis
gccguggacgagucccaugg

SEQ ID NO: 846333 - RNA, 22 nt, Mycobacterium avium subsp. paratuberculosis
gccguggaagauguugccgcca

SEQ ID NO: 846334 - RNA, 15 nt, Mycobacterium avium subsp. paratuberculosis
gccguggaauucgaa

SEQ ID NO: 846335 - RNA, 23 nt, Mycobacterium avium subsp. paratuberculosis
gccgugcugccggaacgagccgg

SEQ ID NO: 846336 - RNA, 18 nt, Mycobacterium avium subsp. paratuberculosis
gccgugcugggacagcga

SEQ ID NO: 846337 - RNA, 16 nt, Mycobacterium avium subsp. paratuberculosis
gccgugcgccccgccc

SEQ ID NO: 846338 - RNA, 19 nt, Mycobacterium avium subsp. paratuberculosis
gccgugcggcuugcccguu

SEQ ID NO: 846339 - RNA, 12 nt, Mycobacterium avium subsp. paratuberculosis
gccgugcucggc

SEQ ID NO: 846340 - RNA, 14 nt, Mycobacterium avium subsp. paratuberculosis
gccgugcucggcgg

SEQ ID NO: 846341 - RNA, 15 nt, Mycobacterium avium subsp. paratuberculosis
gccgugcucggcggc

SEQ ID NO: 846342 - RNA, 16 nt, Mycobacterium avium subsp. paratuberculosis
gccgugcucggcggcg

SEQ ID NO: 846343 - RNA, 14 nt, Mycobacterium avium subsp. paratuberculosis
gccgugcgcgucga

SEQ ID NO: 846344 - RNA, 22 nt, Mycobacterium avium subsp. paratuberculosis
gccgugcgcgucgacaccccgc

SEQ ID NO: 846345 - RNA, 16 nt, Mycobacterium avium subsp. paratuberculosis
gccgugcgcgcuggug

SEQ ID NO: 846346 - RNA, 16 nt, Mycobacterium avium subsp. paratuberculosis
gccgugcgcggcgacc

SEQ ID NO: 846347 - RNA, 19 nt, Mycobacterium avium subsp. paratuberculosis
gccgugcgcggcgaccacc

SEQ ID NO: 846348 - RNA, 22 nt, Mycobacterium avium subsp. paratuberculosis
gccgugcgcggcgaccaccucg

SEQ ID NO: 846349 - RNA, 17 nt, Mycobacterium avium subsp. paratuberculosis
gccgugcggcacgccgc

SEQ ID NO: 846350 - RNA, 18 nt, Mycobacterium avium subsp. paratuberculosis
gccgugcggcacgccgca

SEQ ID NO: 846351 - RNA, 13 nt, Mycobacterium avium subsp. paratuberculosis
gccgugcggcggc

SEQ ID NO: 846352 - RNA, 14 nt, Mycobacterium avium subsp. paratuberculosis
gccgucgaccagcu

SEQ ID NO: 846353 - RNA, 21 nt, Mycobacterium avium subsp. paratuberculosis
gccgucgacccguuccccggc

SEQ ID NO: 846354 - RNA, 23 nt, Mycobacterium avium subsp. paratuberculosis
gccgucgacccguuccccggccg

SEQ ID NO: 846355 - RNA, 12 nt, Mycobacterium avium subsp. paratuberculosis
gccgucgaccgg

SEQ ID NO: 846356 - RNA, 12 nt, Mycobacterium avium subsp. paratuberculosis
gccgucgacgaa

SEQ ID NO: 846357 - RNA, 14 nt, Mycobacterium avium subsp. paratuberculosis
gccgucgacgaacu

SEQ ID NO: 846358 - RNA, 12 nt, Mycobacterium avium subsp. paratuberculosis
gccgucgacgac

SEQ ID NO: 846359 - RNA, 13 nt, Mycobacterium avium subsp. paratuberculosis
gccgucgacgacc

SEQ ID NO: 846360 - RNA, 16 nt, Mycobacterium avium subsp. paratuberculosis
gccgucgacgaccacc

SEQ ID NO: 846361 - RNA, 17 nt, Mycobacterium avium subsp. paratuberculosis
gccgucgacgaccacca

SEQ ID NO: 846362 - RNA, 19 nt, Mycobacterium avium subsp. paratuberculosis
gccgucgacgaccaccacc

SEQ ID NO: 846363 - RNA, 17 nt, Mycobacterium avium subsp. paratuberculosis
gccgucgccaccaccgc

SEQ ID NO: 846364 - RNA, 20 nt, Mycobacterium avium subsp. paratuberculosis
gccgucgccaccaccgcgcc

SEQ ID NO: 846365 - RNA, 21 nt, Mycobacterium avium subsp. paratuberculosis
gccgucgccaccaccgcgccg

SEQ ID NO: 846366 - RNA, 15 nt, Mycobacterium avium subsp. paratuberculosis
gccgucgccaccgag

SEQ ID NO: 846367 - RNA, 18 nt, Mycobacterium avium subsp. paratuberculosis
gccgucgccaccgagucg

SEQ ID NO: 846368 - RNA, 16 nt, Mycobacterium avium subsp. paratuberculosis
gccgucgacggugauc

SEQ ID NO: 846369 - RNA, 17 nt, Mycobacterium avium subsp. paratuberculosis
gccgucgacggugauca

SEQ ID NO: 846370 - RNA, 18 nt, Mycobacterium avium subsp. paratuberculosis
gccgucgcaucagcucgg

SEQ ID NO: 846371 - RNA, 20 nt, Mycobacterium avium subsp. paratuberculosis
gccgucgcaucagcucggca

SEQ ID NO: 846372 - RNA, 21 nt, Mycobacterium avium subsp. paratuberculosis
gccgucgcaucagcucggcag

SEQ ID NO: 846373 - RNA, 17 nt, Mycobacterium avium subsp. paratuberculosis
gccgucgaaggccgggc

SEQ ID NO: 846374 - RNA, 18 nt, Mycobacterium avium subsp. paratuberculosis
gccgucgaaggccgggcu

SEQ ID NO: 846375 - RNA, 13 nt, Mycobacterium avium subsp. paratuberculosis
gccgucgaccacg

SEQ ID NO: 846376 - RNA, 14 nt, Mycobacterium avium subsp. paratuberculosis
gccgucgaccacga

SEQ ID NO: 846377 - RNA, 16 nt, Mycobacterium avium subsp. paratuberculosis
gccgucgaccacgaag

SEQ ID NO: 846378 - RNA, 19 nt, Mycobacterium avium subsp. paratuberculosis
gccgucgaccacgaucguc

SEQ ID NO: 846379 - RNA, 14 nt, Mycobacterium avium subsp. paratuberculosis
gccgucgaccccgc

SEQ ID NO: 846380 - RNA, 17 nt, Mycobacterium avium subsp. paratuberculosis
gccgucgaccccgccgg

SEQ ID NO: 846381 - RNA, 18 nt, Mycobacterium avium subsp. paratuberculosis
gccgucgaccccgccggc

SEQ ID NO: 846382 - RNA, 22 nt, Mycobacterium avium subsp. paratuberculosis
gccgucgaccccgccggcccgg

SEQ ID NO: 846383 - RNA, 16 nt, Mycobacterium avium subsp. paratuberculosis
gccgucgaacugcagc

SEQ ID NO: 846384 - RNA, 22 nt, Mycobacterium avium subsp. paratuberculosis
gccgucgaacugcagccggcca

SEQ ID NO: 846385 - RNA, 17 nt, Mycobacterium avium subsp. paratuberculosis
gccguccuugucgcgca

SEQ ID NO: 846386 - RNA, 21 nt, Mycobacterium avium subsp. paratuberculosis
gccguccuugucgcgcaccgc

SEQ ID NO: 846387 - RNA, 22 nt, Mycobacterium avium subsp. paratuberculosis
gccguccuugucgcgcaccgcg

SEQ ID NO: 846388 - RNA, 23 nt, Mycobacterium avium subsp. paratuberculosis
gccguccuugucgcgcaccgcgg

SEQ ID NO: 846389 - RNA, 16 nt, Mycobacterium avium subsp. paratuberculosis
gccgucgaaacggcug

SEQ ID NO: 846390 - RNA, 20 nt, Mycobacterium avium subsp. paratuberculosis
gccgucgaaacggcugcugc

SEQ ID NO: 846391 - RNA, 22 nt, Mycobacterium avium subsp. paratuberculosis
gccgucgaaacggcugcugcgc

SEQ ID NO: 846392 - RNA, 14 nt, Mycobacterium avium subsp. paratuberculosis
gccgucccggacgc

SEQ ID NO: 846393 - RNA, 18 nt, Mycobacterium avium subsp. paratuberculosis
gccgucccgccgucucga

SEQ ID NO: 846394 - RNA, 16 nt, Mycobacterium avium subsp. paratuberculosis
gccgucccgucacggc

SEQ ID NO: 846395 - RNA, 19 nt, Mycobacterium avium subsp. paratuberculosis
gccgucccgucacggcugc

SEQ ID NO: 846396 - RNA, 21 nt, Mycobacterium avium subsp. paratuberculosis
gccgucccgucacggcugccg

SEQ ID NO: 846397 - RNA, 14 nt, Mycobacterium avium subsp. paratuberculosis
gccgucccguccga

SEQ ID NO: 846398 - RNA, 18 nt, Mycobacterium avium subsp. paratuberculosis
gccgucccuguucgcgcc

SEQ ID NO: 846399 - RNA, 19 nt, Mycobacterium avium subsp. paratuberculosis
gccgucccuguucgcgccg

SEQ ID NO: 846400 - RNA, 20 nt, Mycobacterium avium subsp. paratuberculosis
gccgucccuguucgcgccgg

SEQ ID NO: 846401 - RNA, 21 nt, Mycobacterium avium subsp. paratuberculosis
gccgucccuguucgcgccggu

SEQ ID NO: 846402 - RNA, 22 nt, Mycobacterium avium subsp. paratuberculosis
gccgucccuguucgcgccggua

SEQ ID NO: 846403 - RNA, 23 nt, Mycobacterium avium subsp. paratuberculosis
gccguccgaaucguugagcacca

SEQ ID NO: 846404 - RNA, 19 nt, Mycobacterium avium subsp. paratuberculosis
gccguccggauagccgucg

SEQ ID NO: 846405 - RNA, 22 nt, Mycobacterium avium subsp. paratuberculosis
gccguccggauagccgucggcg

SEQ ID NO: 846406 - RNA, 13 nt, Mycobacterium avium subsp. paratuberculosis
gccguccggccac

SEQ ID NO: 846407 - RNA, 21 nt, Mycobacterium avium subsp. paratuberculosis
gccguccggccacgaccucgg

SEQ ID NO: 846408 - RNA, 13 nt, Mycobacterium avium subsp. paratuberculosis
gccguccgcaccg

SEQ ID NO: 846409 - RNA, 17 nt, Mycobacterium avium subsp. paratuberculosis
gccguccgcaccgcgac

SEQ ID NO: 846410 - RNA, 18 nt, Mycobacterium avium subsp. paratuberculosis
gccguccgcaccgcgacg

SEQ ID NO: 846411 - RNA, 22 nt, Mycobacterium avium subsp. paratuberculosis
gccguccgcaccgcgacgagau

SEQ ID NO: 846412 - RNA, 14 nt, Mycobacterium avium subsp. paratuberculosis
gccguccuggucgu

SEQ ID NO: 846413 - RNA, 17 nt, Mycobacterium avium subsp. paratuberculosis
gccguccuucucgaacc

SEQ ID NO: 846414 - RNA, 20 nt, Mycobacterium avium subsp. paratuberculosis
gccguccuucucgaaccggg

SEQ ID NO: 846415 - RNA, 22 nt, Mycobacterium avium subsp. paratuberculosis
gccguccuucucgaaccggggc

SEQ ID NO: 846416 - RNA, 19 nt, Mycobacterium avium subsp. paratuberculosis
gccguccuugacgaacgac

SEQ ID NO: 846417 - RNA, 22 nt, Mycobacterium avium subsp. paratuberculosis
gccguccuugacgaacgacgug

SEQ ID NO: 846418 - RNA, 22 nt, Mycobacterium avium subsp. paratuberculosis
gccguccgggcacccgacgucg

SEQ ID NO: 846419 - RNA, 21 nt, Mycobacterium avium subsp. paratuberculosis
gccguccugagguauucgucg

SEQ ID NO: 846420 - RNA, 17 nt, Mycobacterium avium subsp. paratuberculosis
gccguccuuggccgcca

SEQ ID NO: 846421 - RNA, 19 nt, Mycobacterium avium subsp. paratuberculosis
gccguccuuggccgccagc

SEQ ID NO: 846422 - RNA, 20 nt, Mycobacterium avium subsp. paratuberculosis
gccguccuuggccgccagca

SEQ ID NO: 846423 - RNA, 21 nt, Mycobacterium avium subsp. paratuberculosis
gccguccuuggccgccagcac

SEQ ID NO: 846424 - RNA, 15 nt, Mycobacterium avium subsp. paratuberculosis
gccguccucgcgucg

SEQ ID NO: 846425 - RNA, 21 nt, Mycobacterium avium subsp. paratuberculosis
gccguccucgcgucgcgcggu

SEQ ID NO: 846426 - RNA, 20 nt, Mycobacterium avium subsp. paratuberculosis
gccguccucggccgccaccg

SEQ ID NO: 846427 - RNA, 21 nt, Mycobacterium avium subsp. paratuberculosis
gccguccucggccgccaccgc

SEQ ID NO: 846428 - RNA, 15 nt, Mycobacterium avium subsp. paratuberculosis
gccguccggcggcaa

SEQ ID NO: 846429 - RNA, 15 nt, Mycobacterium avium subsp. paratuberculosis
gccguccggggccgg

SEQ ID NO: 846430 - RNA, 23 nt, Mycobacterium avium subsp. paratuberculosis
gccguccgggguguaggcgucgg

SEQ ID NO: 846431 - RNA, 20 nt, Mycobacterium avium subsp. paratuberculosis
gccguccggguccggcuuca

SEQ ID NO: 846432 - RNA, 23 nt, Mycobacterium avium subsp. paratuberculosis
gccguccggguucgacgccucgg

SEQ ID NO: 846433 - RNA, 12 nt, Mycobacterium avium subsp. paratuberculosis
gccgucgucguc

SEQ ID NO: 846434 - RNA, 18 nt, Mycobacterium avium subsp. paratuberculosis
gccgucgucgucgcucca

SEQ ID NO: 846435 - RNA, 21 nt, Mycobacterium avium subsp. paratuberculosis
gccgucucgucggccgcgacg

SEQ ID NO: 846436 - RNA, 21 nt, Mycobacterium avium subsp. paratuberculosis
gccgucgucgucggccgggcc

SEQ ID NO: 846437 - RNA, 17 nt, Mycobacterium avium subsp. paratuberculosis
gccgucgucgugcacca

SEQ ID NO: 846438 - RNA, 16 nt, Mycobacterium avium subsp. paratuberculosis
gccgucgucgcugcag

SEQ ID NO: 846439 - RNA, 21 nt, Mycobacterium avium subsp. paratuberculosis
gccgucgguguagcgagugcc

SEQ ID NO: 846440 - RNA, 22 nt, Mycobacterium avium subsp. paratuberculosis
gccgucgguguagcgagugccg

SEQ ID NO: 846441 - RNA, 20 nt, Mycobacterium avium subsp. paratuberculosis
gccgucgguuucggucgcgg

SEQ ID NO: 846442 - RNA, 21 nt, Mycobacterium avium subsp. paratuberculosis
gccgucgguuucggucgcggu

SEQ ID NO: 846443 - RNA, 12 nt, Mycobacterium avium subsp. paratuberculosis
gccgucggugcg

SEQ ID NO: 846444 - RNA, 16 nt, Mycobacterium avium subsp. paratuberculosis
gccgucggugggggcc

SEQ ID NO: 846445 - RNA, 18 nt, Mycobacterium avium subsp. paratuberculosis
gccgucggugggggccag

SEQ ID NO: 846446 - RNA, 20 nt, Mycobacterium avium subsp. paratuberculosis
gccgucggugggggccaggc

SEQ ID NO: 846447 - RNA, 16 nt, Mycobacterium avium subsp. paratuberculosis
gccgucguagccgcgg

SEQ ID NO: 846448 - RNA, 17 nt, Mycobacterium avium subsp. paratuberculosis
gccgucguagccgcggg

SEQ ID NO: 846449 - RNA, 19 nt, Mycobacterium avium subsp. paratuberculosis
gccgucguagccgcgggug

SEQ ID NO: 846450 - RNA, 17 nt, Mycobacterium avium subsp. paratuberculosis
gccgucguaggcgcgga

SEQ ID NO: 846451 - RNA, 17 nt, Mycobacterium avium subsp. paratuberculosis
gccgucgucagccgggc

SEQ ID NO: 846452 - RNA, 18 nt, Mycobacterium avium subsp. paratuberculosis
gccgucgucagccgggcc

SEQ ID NO: 846453 - RNA, 19 nt, Mycobacterium avium subsp. paratuberculosis
gccgucgucagccgggcca

SEQ ID NO: 846454 - RNA, 22 nt, Mycobacterium avium subsp. paratuberculosis
gccgucgucagccgggccagcc

SEQ ID NO: 846455 - RNA, 23 nt, Mycobacterium avium subsp. paratuberculosis
gccgucgguaucgagguccaugu

SEQ ID NO: 846456 - RNA, 20 nt, Mycobacterium avium subsp. paratuberculosis
gccgucggcuuccuccucgg

SEQ ID NO: 846457 - RNA, 15 nt, Mycobacterium avium subsp. paratuberculosis
gccgucgggacgcgg

SEQ ID NO: 846458 - RNA, 17 nt, Mycobacterium avium subsp. paratuberculosis
gccgucgggucggcgag

SEQ ID NO: 846459 - RNA, 19 nt, Mycobacterium avium subsp. paratuberculosis
gccgucgggucggcgagca

SEQ ID NO: 846460 - RNA, 21 nt, Mycobacterium avium subsp. paratuberculosis
gccgucgggucggcgagcagc

SEQ ID NO: 846461 - RNA, 15 nt, Mycobacterium avium subsp. paratuberculosis
gccgucgccgccgug

SEQ ID NO: 846462 - RNA, 15 nt, Mycobacterium avium subsp. paratuberculosis
gccgucggcgggaug

SEQ ID NO: 846463 - RNA, 14 nt, Mycobacterium avium subsp. paratuberculosis
gccgucggcgucga

SEQ ID NO: 846464 - RNA, 15 nt, Mycobacterium avium subsp. paratuberculosis
gccgucggcgucggg

SEQ ID NO: 846465 - RNA, 17 nt, Mycobacterium avium subsp. paratuberculosis
gccgucgccgacguugu

SEQ ID NO: 846466 - RNA, 14 nt, Mycobacterium avium subsp. paratuberculosis
gccgucggcguuca

SEQ ID NO: 846467 - RNA, 20 nt, Mycobacterium avium subsp. paratuberculosis
gccgucggggaugccgaacc

SEQ ID NO: 846468 - RNA, 22 nt, Mycobacterium avium subsp. paratuberculosis
gccgucggggaugccgaaccgc

SEQ ID NO: 846469 - RNA, 17 nt, Mycobacterium avium subsp. paratuberculosis
gccgucggggcgucggc

SEQ ID NO: 846470 - RNA, 19 nt, Mycobacterium avium subsp. paratuberculosis
gccgucggggcgucggcgg

SEQ ID NO: 846471 - RNA, 21 nt, Mycobacterium avium subsp. paratuberculosis
gccgucggggcgucggcggcc

SEQ ID NO: 846472 - RNA, 13 nt, Mycobacterium avium subsp. paratuberculosis
gccgucggggcug

SEQ ID NO: 846473 - RNA, 16 nt, Mycobacterium avium subsp. paratuberculosis
gccgucggggcugagu

SEQ ID NO: 846474 - RNA, 22 nt, Mycobacterium avium subsp. paratuberculosis
gccgucgggguaguccgacuuc

SEQ ID NO: 846475 - RNA, 19 nt, Mycobacterium avium subsp. paratuberculosis
gccgucggggucgcgccgg

SEQ ID NO: 846476 - RNA, 22 nt, Mycobacterium avium subsp. paratuberculosis
gccgucggggugcggucggcga

SEQ ID NO: 846477 - RNA, 23 nt, Mycobacterium avium subsp. paratuberculosis
gccgucggggugcggucggcgac

SEQ ID NO: 846478 - RNA, 14 nt, Mycobacterium avium subsp. paratuberculosis
gccgucgccgcgcc

SEQ ID NO: 846479 - RNA, 17 nt, Mycobacterium avium subsp. paratuberculosis
gccgucgccgcgcccgc

SEQ ID NO: 846480 - RNA, 20 nt, Mycobacterium avium subsp. paratuberculosis
gccgucgccgcgcccgccgg

SEQ ID NO: 846481 - RNA, 12 nt, Mycobacterium avium subsp. paratuberculosis
gccgucgccgcc

SEQ ID NO: 846482 - RNA, 14 nt, Mycobacterium avium subsp. paratuberculosis
gccgucgccgccgu

SEQ ID NO: 846483 - RNA, 13 nt, Mycobacterium avium subsp. paratuberculosis
gccgucgccgauc

SEQ ID NO: 846484 - RNA, 13 nt, Mycobacterium avium subsp. paratuberculosis
gccgucgccgccg

SEQ ID NO: 846485 - RNA, 12 nt, Mycobacterium avium subsp. paratuberculosis
gccgucgacgcg

SEQ ID NO: 846486 - RNA, 15 nt, Mycobacterium avium subsp. paratuberculosis
gccguauucgccgac

SEQ ID NO: 846487 - RNA, 17 nt, Mycobacterium avium subsp. paratuberculosis
gccguauucgccgacgg

SEQ ID NO: 846488 - RNA, 17 nt, Mycobacterium avium subsp. paratuberculosis
gccgucacugucggcgc

SEQ ID NO: 846489 - RNA, 20 nt, Mycobacterium avium subsp. paratuberculosis
gccgucacaccgcggccagc

SEQ ID NO: 846490 - RNA, 18 nt, Mycobacterium avium subsp. paratuberculosis
gccgucaucgacaccgaa

SEQ ID NO: 846491 - RNA, 16 nt, Mycobacterium avium subsp. paratuberculosis
gccgucaucgccgacg

SEQ ID NO: 846492 - RNA, 19 nt, Mycobacterium avium subsp. paratuberculosis
gccgucaucgccgacggug

SEQ ID NO: 846493 - RNA, 21 nt, Mycobacterium avium subsp. paratuberculosis
gccgucaucgccgacggugag

SEQ ID NO: 846494 - RNA, 16 nt, Mycobacterium avium subsp. paratuberculosis
gccgucaucaccgccg

SEQ ID NO: 846495 - RNA, 17 nt, Mycobacterium avium subsp. paratuberculosis
gccgucaucaccgccga

SEQ ID NO: 846496 - RNA, 18 nt, Mycobacterium avium subsp. paratuberculosis
gccgucaucaccgccgag

SEQ ID NO: 846497 - RNA, 17 nt, Mycobacterium avium subsp. paratuberculosis
gccguccccaccgauca

SEQ ID NO: 846498 - RNA, 18 nt, Mycobacterium avium subsp. paratuberculosis
gccgucccccgagcgggc

SEQ ID NO: 846499 - RNA, 14 nt, Mycobacterium avium subsp. paratuberculosis
gccguccccgcgcg

SEQ ID NO: 846500 - RNA, 15 nt, Mycobacterium avium subsp. paratuberculosis
gccguccccgcgcgg

SEQ ID NO: 846501 - RNA, 17 nt, Mycobacterium avium subsp. paratuberculosis
gccguccccgcgcggcu

SEQ ID NO: 846502 - RNA, 13 nt, Mycobacterium avium subsp. paratuberculosis
gccgucccaccgg

SEQ ID NO: 846503 - RNA, 15 nt, Mycobacterium avium subsp. paratuberculosis
gccgucccaccggcg

SEQ ID NO: 846504 - RNA, 20 nt, Mycobacterium avium subsp. paratuberculosis
gccgucccaccggcgaugug

SEQ ID NO: 846505 - RNA, 16 nt, Mycobacterium avium subsp. paratuberculosis
gccgucccagccggac

SEQ ID NO: 846506 - RNA, 13 nt, Mycobacterium avium subsp. paratuberculosis
gccguccaggccg

SEQ ID NO: 846507 - RNA, 17 nt, Mycobacterium avium subsp. paratuberculosis
gccguccagccgugcgg

SEQ ID NO: 846508 - RNA, 17 nt, Mycobacterium avium subsp. paratuberculosis
gccguccagcgucaccu

SEQ ID NO: 846509 - RNA, 12 nt, Mycobacterium avium subsp. paratuberculosis
gccguccagcuc

SEQ ID NO: 846510 - RNA, 14 nt, Mycobacterium avium subsp. paratuberculosis
gccguccagcuccg

SEQ ID NO: 846511 - RNA, 20 nt, Mycobacterium avium subsp. paratuberculosis
gccguccagcuccgccgaca

SEQ ID NO: 846512 - RNA, 16 nt, Mycobacterium avium subsp. paratuberculosis
gccguccagcucgcgu

SEQ ID NO: 846513 - RNA, 21 nt, Mycobacterium avium subsp. paratuberculosis
gccguccagcucgcguucggg

SEQ ID NO: 846514 - RNA, 14 nt, Mycobacterium avium subsp. paratuberculosis
gccguccacggcgg

SEQ ID NO: 846515 - RNA, 16 nt, Mycobacterium avium subsp. paratuberculosis
gccguccacggcggug

SEQ ID NO: 846516 - RNA, 18 nt, Mycobacterium avium subsp. paratuberculosis
gccguccacgggucgccg

SEQ ID NO: 846517 - RNA, 15 nt, Mycobacterium avium subsp. paratuberculosis
gccguccagcaacgc

SEQ ID NO: 846518 - RNA, 19 nt, Mycobacterium avium subsp. paratuberculosis
gccguccagcaacgccgac

SEQ ID NO: 846519 - RNA, 20 nt, Mycobacterium avium subsp. paratuberculosis
gccguccagcaacgccgaca

SEQ ID NO: 846520 - RNA, 20 nt, Mycobacterium avium subsp. paratuberculosis
gccguccagcagcagcgcgc

SEQ ID NO: 846521 - RNA, 13 nt, Mycobacterium avium subsp. paratuberculosis
gccguccaccacc

SEQ ID NO: 846522 - RNA, 22 nt, Mycobacterium avium subsp. paratuberculosis
gccguccaccagaucgccccgc

SEQ ID NO: 846523 - RNA, 14 nt, Mycobacterium avium subsp. paratuberculosis
gccguccacccggc

SEQ ID NO: 846524 - RNA, 18 nt, Mycobacterium avium subsp. paratuberculosis
gccguccacccggcccac

SEQ ID NO: 846525 - RNA, 19 nt, Mycobacterium avium subsp. paratuberculosis
gccguccacccggcccacc

SEQ ID NO: 846526 - RNA, 21 nt, Mycobacterium avium subsp. paratuberculosis
gccguccacccggcccaccac

SEQ ID NO: 846527 - RNA, 17 nt, Mycobacterium avium subsp. paratuberculosis
gccguaucggccccggc

SEQ ID NO: 846528 - RNA, 21 nt, Mycobacterium avium subsp. paratuberculosis
gccguaucggccccggccgag

SEQ ID NO: 846529 - RNA, 14 nt, Mycobacterium avium subsp. paratuberculosis
gccguagagcacga

SEQ ID NO: 846530 - RNA, 22 nt, Mycobacterium avium subsp. paratuberculosis
gccguagagccguuuggcgccg

SEQ ID NO: 846531 - RNA, 15 nt, Mycobacterium avium subsp. paratuberculosis
gccguagaucacgcc

SEQ ID NO: 846532 - RNA, 17 nt, Mycobacterium avium subsp. paratuberculosis
gccguagaucacgccgg

SEQ ID NO: 846533 - RNA, 19 nt, Mycobacterium avium subsp. paratuberculosis
gccguagaucacgccggug

SEQ ID NO: 846534 - RNA, 16 nt, Mycobacterium avium subsp. paratuberculosis
gccguagaucgucgag

SEQ ID NO: 846535 - RNA, 17 nt, Mycobacterium avium subsp. paratuberculosis
gccguagaucucgcgcc

SEQ ID NO: 846536 - RNA, 19 nt, Mycobacterium avium subsp. paratuberculosis
gccguagaucucgcgccgc

SEQ ID NO: 846537 - RNA, 20 nt, Mycobacterium avium subsp. paratuberculosis
gccguagaucucgcgccgcg

SEQ ID NO: 846538 - RNA, 15 nt, Mycobacterium avium subsp. paratuberculosis
gccguacgcgccggc

SEQ ID NO: 846539 - RNA, 16 nt, Mycobacterium avium subsp. paratuberculosis
gccguacgcgccggcc

SEQ ID NO: 846540 - RNA, 19 nt, Mycobacterium avium subsp. paratuberculosis
gccguacgcgccggccagc

SEQ ID NO: 846541 - RNA, 20 nt, Mycobacterium avium subsp. paratuberculosis
gccguacgcgguucgugcgc

SEQ ID NO: 846542 - RNA, 16 nt, Mycobacterium avium subsp. paratuberculosis
gccguaccgauccgcg

SEQ ID NO: 846543 - RNA, 16 nt, Mycobacterium avium subsp. paratuberculosis
gccguaccgcaacacc

SEQ ID NO: 846544 - RNA, 17 nt, Mycobacterium avium subsp. paratuberculosis
gccguaccgcaacaccg

SEQ ID NO: 846545 - RNA, 19 nt, Mycobacterium avium subsp. paratuberculosis
gccguaccgcaacaccgaa

SEQ ID NO: 846546 - RNA, 12 nt, Mycobacterium avium subsp. paratuberculosis
gccguaccggcg

SEQ ID NO: 846547 - RNA, 20 nt, Mycobacterium avium subsp. paratuberculosis
gccggugucggggucgucga

SEQ ID NO: 846548 - RNA, 21 nt, Mycobacterium avium subsp. paratuberculosis
gccggugucggugcgacccgg

SEQ ID NO: 846549 - RNA, 14 nt, Mycobacterium avium subsp. paratuberculosis
gccggugucggcga

SEQ ID NO: 846550 - RNA, 17 nt, Mycobacterium avium subsp. paratuberculosis
gccggugucggcgacca

SEQ ID NO: 846551 - RNA, 23 nt, Mycobacterium avium subsp. paratuberculosis
gccgguguaucccaucagugcgg

SEQ ID NO: 846552 - RNA, 18 nt, Mycobacterium avium subsp. paratuberculosis
gccggugucauaccagcc

SEQ ID NO: 846553 - RNA, 19 nt, Mycobacterium avium subsp. paratuberculosis
gccggugucauaccagccg

SEQ ID NO: 846554 - RNA, 20 nt, Mycobacterium avium subsp. paratuberculosis
gccggugucauaccagccgu

SEQ ID NO: 846555 - RNA, 13 nt, Mycobacterium avium subsp. paratuberculosis
gccgguggugcac

SEQ ID NO: 846556 - RNA, 19 nt, Mycobacterium avium subsp. paratuberculosis
gccgguggugcaccgguuc

SEQ ID NO: 846557 - RNA, 14 nt, Mycobacterium avium subsp. paratuberculosis
gccgguggugucga

SEQ ID NO: 846558 - RNA, 18 nt, Mycobacterium avium subsp. paratuberculosis
gccgguggugucgacggu

SEQ ID NO: 846559 - RNA, 15 nt, Mycobacterium avium subsp. paratuberculosis
gccgguggcagcccg

SEQ ID NO: 846560 - RNA, 18 nt, Mycobacterium avium subsp. paratuberculosis
gccgguggcagcccggcu

SEQ ID NO: 846561 - RNA, 16 nt, Mycobacterium avium subsp. paratuberculosis
gccgguggcggcgaca

SEQ ID NO: 846562 - RNA, 16 nt, Mycobacterium avium subsp. paratuberculosis
gccgguggcggcgagg

SEQ ID NO: 846563 - RNA, 13 nt, Mycobacterium avium subsp. paratuberculosis
gccgguggccgcc

SEQ ID NO: 846564 - RNA, 15 nt, Mycobacterium avium subsp. paratuberculosis
gccgguggccgcgaa

SEQ ID NO: 846565 - RNA, 14 nt, Mycobacterium avium subsp. paratuberculosis
gccgguggccggug

SEQ ID NO: 846566 - RNA, 18 nt, Mycobacterium avium subsp. paratuberculosis
gccgguggccggugggcg

SEQ ID NO: 846567 - RNA, 14 nt, Mycobacterium avium subsp. paratuberculosis
gccgguggcgacaa

SEQ ID NO: 846568 - RNA, 16 nt, Mycobacterium avium subsp. paratuberculosis
gccgguggcgacaaca

SEQ ID NO: 846569 - RNA, 15 nt, Mycobacterium avium subsp. paratuberculosis
gccgguggcggccac

SEQ ID NO: 846570 - RNA, 13 nt, Mycobacterium avium subsp. paratuberculosis
gccgguggcggcg

SEQ ID NO: 846571 - RNA, 13 nt, Mycobacterium avium subsp. paratuberculosis
gccgguggcgucc

SEQ ID NO: 846572 - RNA, 17 nt, Mycobacterium avium subsp. paratuberculosis
gccgguggcgucgguga

SEQ ID NO: 846573 - RNA, 16 nt, Mycobacterium avium subsp. paratuberculosis
gccggugggcggcgcc

SEQ ID NO: 846574 - RNA, 18 nt, Mycobacterium avium subsp. paratuberculosis
gccggugggcggcgcccg

SEQ ID NO: 846575 - RNA, 22 nt, Mycobacterium avium subsp. paratuberculosis
gccggugggcggcgcccgacau

SEQ ID NO: 846576 - RNA, 11 nt, Mycobacterium avium subsp. paratuberculosis
gccggugguca

SEQ ID NO: 846577 - RNA, 20 nt, Mycobacterium avium subsp. paratuberculosis
gccgguggucaacgcgcaca

SEQ ID NO: 846578 - RNA, 23 nt, Mycobacterium avium subsp. paratuberculosis
gccggugauccacuccagcaccg

SEQ ID NO: 846579 - RNA, 23 nt, Mycobacterium avium subsp. paratuberculosis
gccggugaggguuuccacgugca

SEQ ID NO: 846580 - RNA, 15 nt, Mycobacterium avium subsp. paratuberculosis
gccggugagguggcg

SEQ ID NO: 846581 - RNA, 21 nt, Mycobacterium avium subsp. paratuberculosis
gccggugagguggcguagucg

SEQ ID NO: 846582 - RNA, 14 nt, Mycobacterium avium subsp. paratuberculosis
gccggugaccgcgc

SEQ ID NO: 846583 - RNA, 16 nt, Mycobacterium avium subsp. paratuberculosis
gccggugaccgcgccg

SEQ ID NO: 846584 - RNA, 13 nt, Mycobacterium avium subsp. paratuberculosis
gccggugaccugc

SEQ ID NO: 846585 - RNA, 19 nt, Mycobacterium avium subsp. paratuberculosis
gccggugaccugcagcgcc

SEQ ID NO: 846586 - RNA, 20 nt, Mycobacterium avium subsp. paratuberculosis
gccggugaagaucagcgcgu

SEQ ID NO: 846587 - RNA, 23 nt, Mycobacterium avium subsp. paratuberculosis
gccggugaagaucagcgcgucgg

SEQ ID NO: 846588 - RNA, 22 nt, Mycobacterium avium subsp. paratuberculosis
gccggugaagaucgcccgccgc

SEQ ID NO: 846589 - RNA, 13 nt, Mycobacterium avium subsp. paratuberculosis
gccggugaagcgg

SEQ ID NO: 846590 - RNA, 20 nt, Mycobacterium avium subsp. paratuberculosis
gccggucgcccccucggccg

SEQ ID NO: 846591 - RNA, 13 nt, Mycobacterium avium subsp. paratuberculosis
gccggucgccgau

SEQ ID NO: 846592 - RNA, 23 nt, Mycobacterium avium subsp. paratuberculosis
gccggugaacacgaacggcgccu

SEQ ID NO: 846593 - RNA, 21 nt, Mycobacterium avium subsp. paratuberculosis
gccgguccugggccuccggcg

SEQ ID NO: 846594 - RNA, 20 nt, Mycobacterium avium subsp. paratuberculosis
gccggucuuggacagcagca

SEQ ID NO: 846595 - RNA, 20 nt, Mycobacterium avium subsp. paratuberculosis
gccggucuugggcucggcgc

SEQ ID NO: 846596 - RNA, 20 nt, Mycobacterium avium subsp. paratuberculosis
gccggucuuguagucgacca

SEQ ID NO: 846597 - RNA, 16 nt, Mycobacterium avium subsp. paratuberculosis
gccggugaaaccggcg

SEQ ID NO: 846598 - RNA, 19 nt, Mycobacterium avium subsp. paratuberculosis
gccggugaaaccggcgccg

SEQ ID NO: 846599 - RNA, 20 nt, Mycobacterium avium subsp. paratuberculosis
gccggugaaaccggcgccga

SEQ ID NO: 846600 - RNA, 20 nt, Mycobacterium avium subsp. paratuberculosis
gccggucgaacgccagcgcc

SEQ ID NO: 846601 - RNA, 13 nt, Mycobacterium avium subsp. paratuberculosis
gccggucgaaggc

SEQ ID NO: 846602 - RNA, 19 nt, Mycobacterium avium subsp. paratuberculosis
gccggucgaaggccccggu

SEQ ID NO: 846603 - RNA, 13 nt, Mycobacterium avium subsp. paratuberculosis
gccggucgacgaa

SEQ ID NO: 846604 - RNA, 13 nt, Mycobacterium avium subsp. paratuberculosis
gccggucgacgcg

SEQ ID NO: 846605 - RNA, 14 nt, Mycobacterium avium subsp. paratuberculosis
gccggucgacgcgg

SEQ ID NO: 846606 - RNA, 15 nt, Mycobacterium avium subsp. paratuberculosis
gccggucgacgcggg

SEQ ID NO: 846607 - RNA, 21 nt, Mycobacterium avium subsp. paratuberculosis
gccggucgacgcggggcggcg

SEQ ID NO: 846608 - RNA, 17 nt, Mycobacterium avium subsp. paratuberculosis
gccggucgaggucgccg

SEQ ID NO: 846609 - RNA, 17 nt, Mycobacterium avium subsp. paratuberculosis
gccggucgaugucggcg

SEQ ID NO: 846610 - RNA, 23 nt, Mycobacterium avium subsp. paratuberculosis
gccggugccgacgauccgggcgc

SEQ ID NO: 846611 - RNA, 16 nt, Mycobacterium avium subsp. paratuberculosis
gccggugccagcaaca

SEQ ID NO: 846612 - RNA, 15 nt, Mycobacterium avium subsp. paratuberculosis
gccggugcggccgcg

SEQ ID NO: 846613 - RNA, 15 nt, Mycobacterium avium subsp. paratuberculosis
gccggugcagcacgu

SEQ ID NO: 846614 - RNA, 21 nt, Mycobacterium avium subsp. paratuberculosis
gccggugcagcacgugcgcgg

SEQ ID NO: 846615 - RNA, 20 nt, Mycobacterium avium subsp. paratuberculosis
gccggugccacggucaggcg

SEQ ID NO: 846616 - RNA, 20 nt, Mycobacterium avium subsp. paratuberculosis
gccgguggaauucuggccga

SEQ ID NO: 846617 - RNA, 21 nt, Mycobacterium avium subsp. paratuberculosis
gccgguggaauucuggccgac

SEQ ID NO: 846618 - RNA, 18 nt, Mycobacterium avium subsp. paratuberculosis
gccggugcuuggcguuga

SEQ ID NO: 846619 - RNA, 23 nt, Mycobacterium avium subsp. paratuberculosis
gccgguggauauuucgcggccga

SEQ ID NO: 846620 - RNA, 16 nt, Mycobacterium avium subsp. paratuberculosis
gccggugcugacccgg

SEQ ID NO: 846621 - RNA, 21 nt, Mycobacterium avium subsp. paratuberculosis
gccggugcugacccggucgcg

SEQ ID NO: 846622 - RNA, 18 nt, Mycobacterium avium subsp. paratuberculosis
gccggugcguccgccggc

SEQ ID NO: 846623 - RNA, 20 nt, Mycobacterium avium subsp. paratuberculosis
gccggugcguccgccggcgg

SEQ ID NO: 846624 - RNA, 22 nt, Mycobacterium avium subsp. paratuberculosis
gccggugcguccgccggcggug

SEQ ID NO: 846625 - RNA, 15 nt, Mycobacterium avium subsp. paratuberculosis
gccggugcugcucga

SEQ ID NO: 846626 - RNA, 20 nt, Mycobacterium avium subsp. paratuberculosis
gccggugaugacgucgccca

SEQ ID NO: 846627 - RNA, 15 nt, Mycobacterium avium subsp. paratuberculosis
gccggugcaccacga

SEQ ID NO: 846628 - RNA, 13 nt, Mycobacterium avium subsp. paratuberculosis
gccggugcagauc

SEQ ID NO: 846629 - RNA, 13 nt, Mycobacterium avium subsp. paratuberculosis
gccggugcagcac

SEQ ID NO: 846630 - RNA, 17 nt, Mycobacterium avium subsp. paratuberculosis
gccggugcagcaccucg

SEQ ID NO: 846631 - RNA, 14 nt, Mycobacterium avium subsp. paratuberculosis
gccggugcagcacg

SEQ ID NO: 846632 - RNA, 17 nt, Mycobacterium avium subsp. paratuberculosis
gccggugaugaacgcgc

SEQ ID NO: 846633 - RNA, 23 nt, Mycobacterium avium subsp. paratuberculosis
gccggugauggugaucucgccgc

SEQ ID NO: 846634 - RNA, 13 nt, Mycobacterium avium subsp. paratuberculosis
gccggugaucgcg

SEQ ID NO: 846635 - RNA, 14 nt, Mycobacterium avium subsp. paratuberculosis
gccggugaucgcgg

SEQ ID NO: 846636 - RNA, 21 nt, Mycobacterium avium subsp. paratuberculosis
gccggugaucucccgugcggu

SEQ ID NO: 846637 - RNA, 19 nt, Mycobacterium avium subsp. paratuberculosis
gccgggauuucccgggcga

SEQ ID NO: 846638 - RNA, 16 nt, Mycobacterium avium subsp. paratuberculosis
gccgggaugccgccgg

SEQ ID NO: 846639 - RNA, 18 nt, Mycobacterium avium subsp. paratuberculosis
gccgggaugcgccaccga

SEQ ID NO: 846640 - RNA, 23 nt, Mycobacterium avium subsp. paratuberculosis
gccgggauggugagcccgaugcu

SEQ ID NO: 846641 - RNA, 17 nt, Mycobacterium avium subsp. paratuberculosis
gccgggcaacagcgcgc

SEQ ID NO: 846642 - RNA, 18 nt, Mycobacterium avium subsp. paratuberculosis
gccgggcaacagcgcgcc

SEQ ID NO: 846643 - RNA, 19 nt, Mycobacterium avium subsp. paratuberculosis
gccgggcaacagcgcgccg

SEQ ID NO: 846644 - RNA, 23 nt, Mycobacterium avium subsp. paratuberculosis
gccgggcaacagcgcgccggccg

SEQ ID NO: 846645 - RNA, 22 nt, Mycobacterium avium subsp. paratuberculosis
gccgggcaaccacagcggcgca

SEQ ID NO: 846646 - RNA, 21 nt, Mycobacterium avium subsp. paratuberculosis
gccggguguugcggcagggcc

SEQ ID NO: 846647 - RNA, 17 nt, Mycobacterium avium subsp. paratuberculosis
gccgggugggcagcccc

SEQ ID NO: 846648 - RNA, 18 nt, Mycobacterium avium subsp. paratuberculosis
gccgggugggcagcccca

SEQ ID NO: 846649 - RNA, 17 nt, Mycobacterium avium subsp. paratuberculosis
gccggguggcggggcgu

SEQ ID NO: 846650 - RNA, 22 nt, Mycobacterium avium subsp. paratuberculosis
gccggguuuguccggccagguc

SEQ ID NO: 846651 - RNA, 20 nt, Mycobacterium avium subsp. paratuberculosis
gccggguuuucgggccgguc

SEQ ID NO: 846652 - RNA, 15 nt, Mycobacterium avium subsp. paratuberculosis
gccggguuucggccc

SEQ ID NO: 846653 - RNA, 16 nt, Mycobacterium avium subsp. paratuberculosis
gccggguugggcggcg

SEQ ID NO: 846654 - RNA, 21 nt, Mycobacterium avium subsp. paratuberculosis
gccggguuguagcaggcggug

SEQ ID NO: 846655 - RNA, 22 nt, Mycobacterium avium subsp. paratuberculosis
gccggguuguagcaggcggugg

SEQ ID NO: 846656 - RNA, 16 nt, Mycobacterium avium subsp. paratuberculosis
gccggguugcaggcgc

SEQ ID NO: 846657 - RNA, 16 nt, Mycobacterium avium subsp. paratuberculosis
gccgguagggccgguc

SEQ ID NO: 846658 - RNA, 16 nt, Mycobacterium avium subsp. paratuberculosis
gccgguauacccccgg

SEQ ID NO: 846659 - RNA, 19 nt, Mycobacterium avium subsp. paratuberculosis
gccgguauacccccgguga

SEQ ID NO: 846660 - RNA, 17 nt, Mycobacterium avium subsp. paratuberculosis
gccgguauauucgcgau

SEQ ID NO: 846661 - RNA, 16 nt, Mycobacterium avium subsp. paratuberculosis
gccggucaccggucgc

SEQ ID NO: 846662 - RNA, 18 nt, Mycobacterium avium subsp. paratuberculosis
gccggucacccaggccga

SEQ ID NO: 846663 - RNA, 17 nt, Mycobacterium avium subsp. paratuberculosis
gccgguauuggccacgc

SEQ ID NO: 846664 - RNA, 20 nt, Mycobacterium avium subsp. paratuberculosis
gccgguaucgggucaccgug

SEQ ID NO: 846665 - RNA, 16 nt, Mycobacterium avium subsp. paratuberculosis
gccgguaugcgaucgc

SEQ ID NO: 846666 - RNA, 17 nt, Mycobacterium avium subsp. paratuberculosis
gccgguaugcgaucgcg

SEQ ID NO: 846667 - RNA, 21 nt, Mycobacterium avium subsp. paratuberculosis
gccgguaugcgaucgcgucga

SEQ ID NO: 846668 - RNA, 15 nt, Mycobacterium avium subsp. paratuberculosis
gccgguccgaucguc

SEQ ID NO: 846669 - RNA, 19 nt, Mycobacterium avium subsp. paratuberculosis
gccgguccgaucguccggc

SEQ ID NO: 846670 - RNA, 23 nt, Mycobacterium avium subsp. paratuberculosis
gccgguccgaucguccggcgcca

SEQ ID NO: 846671 - RNA, 19 nt, Mycobacterium avium subsp. paratuberculosis
gccgguccgcccagacgcg

SEQ ID NO: 846672 - RNA, 20 nt, Mycobacterium avium subsp. paratuberculosis
gccgguccgcccagacgcgg

SEQ ID NO: 846673 - RNA, 22 nt, Mycobacterium avium subsp. paratuberculosis
gccgguccggcccuggucggcc

SEQ ID NO: 846674 - RNA, 15 nt, Mycobacterium avium subsp. paratuberculosis
gccgguccggcggca

SEQ ID NO: 846675 - RNA, 16 nt, Mycobacterium avium subsp. paratuberculosis
gccgguccggcggcac

SEQ ID NO: 846676 - RNA, 17 nt, Mycobacterium avium subsp. paratuberculosis
gccgguccggcggcacc

SEQ ID NO: 846677 - RNA, 18 nt, Mycobacterium avium subsp. paratuberculosis
gccgguccggcggcacca

SEQ ID NO: 846678 - RNA, 21 nt, Mycobacterium avium subsp. paratuberculosis
gccgguccggcggcaccaccc

SEQ ID NO: 846679 - RNA, 20 nt, Mycobacterium avium subsp. paratuberculosis
gccgguccgugcacggccaa

SEQ ID NO: 846680 - RNA, 15 nt, Mycobacterium avium subsp. paratuberculosis
gccggucagcgacga

SEQ ID NO: 846681 - RNA, 13 nt, Mycobacterium avium subsp. paratuberculosis
gccggucagcgcg

SEQ ID NO: 846682 - RNA, 15 nt, Mycobacterium avium subsp. paratuberculosis
gccggucccgcggcg

SEQ ID NO: 846683 - RNA, 19 nt, Mycobacterium avium subsp. paratuberculosis
gccggucccgcggcggcgc

SEQ ID NO: 846684 - RNA, 21 nt, Mycobacterium avium subsp. paratuberculosis
gccggucccgcggcggcgcca

SEQ ID NO: 846685 - RNA, 16 nt, Mycobacterium avium subsp. paratuberculosis
gccggucccguugauc

SEQ ID NO: 846686 - RNA, 21 nt, Mycobacterium avium subsp. paratuberculosis
gccgguccgaccagcggccca

SEQ ID NO: 846687 - RNA, 22 nt, Mycobacterium avium subsp. paratuberculosis
gccgguccgaccagcggcccac

SEQ ID NO: 846688 - RNA, 14 nt, Mycobacterium avium subsp. paratuberculosis
gccgguccgaccgc

SEQ ID NO: 846689 - RNA, 16 nt, Mycobacterium avium subsp. paratuberculosis
gccgguccgaccgcca

SEQ ID NO: 846690 - RNA, 18 nt, Mycobacterium avium subsp. paratuberculosis
gccgguccgaccgccacc

SEQ ID NO: 846691 - RNA, 17 nt, Mycobacterium avium subsp. paratuberculosis
gccggucaccuugacca

SEQ ID NO: 846692 - RNA, 20 nt, Mycobacterium avium subsp. paratuberculosis
gccggucacgcugaucgacc

SEQ ID NO: 846693 - RNA, 13 nt, Mycobacterium avium subsp. paratuberculosis
gccggucagcacc

SEQ ID NO: 846694 - RNA, 19 nt, Mycobacterium avium subsp. paratuberculosis
gccggucagcaccauggcg

SEQ ID NO: 846695 - RNA, 14 nt, Mycobacterium avium subsp. paratuberculosis
gccggucagcacgu

SEQ ID NO: 846696 - RNA, 18 nt, Mycobacterium avium subsp. paratuberculosis
gccggucagcacgucggu

SEQ ID NO: 846697 - RNA, 12 nt, Mycobacterium avium subsp. paratuberculosis
gccggucacggc

SEQ ID NO: 846698 - RNA, 13 nt, Mycobacterium avium subsp. paratuberculosis
gccggucacggcg

SEQ ID NO: 846699 - RNA, 16 nt, Mycobacterium avium subsp. paratuberculosis
gcgaucgacaccagcg

SEQ ID NO: 846700 - RNA, 17 nt, Mycobacterium avium subsp. paratuberculosis
gcgaucgacaccagcgu

SEQ ID NO: 846701 - RNA, 22 nt, Mycobacterium avium subsp. paratuberculosis
gcgaucgacagcuccaacagcc

SEQ ID NO: 846702 - RNA, 21 nt, Mycobacterium avium subsp. paratuberculosis
gcgaucgaucccuuggcggcg

SEQ ID NO: 846703 - RNA, 19 nt, Mycobacterium avium subsp. paratuberculosis
gcgaucgagggggucauca

SEQ ID NO: 846704 - RNA, 19 nt, Mycobacterium avium subsp. paratuberculosis
gcgaucgaggugauguugg

SEQ ID NO: 846705 - RNA, 19 nt, Mycobacterium avium subsp. paratuberculosis
gcgaucgaugaauccgcgc

SEQ ID NO: 846706 - RNA, 21 nt, Mycobacterium avium subsp. paratuberculosis
gcgaucgaugaauccgcgcag

SEQ ID NO: 846707 - RNA, 21 nt, Mycobacterium avium subsp. paratuberculosis
gcgaucgaugcccagcgcgcg

SEQ ID NO: 846708 - RNA, 13 nt, Mycobacterium avium subsp. paratuberculosis
gcgauccgcgcgg

SEQ ID NO: 846709 - RNA, 19 nt, Mycobacterium avium subsp. paratuberculosis
gcgauccgcgcggcgacga

SEQ ID NO: 846710 - RNA, 19 nt, Mycobacterium avium subsp. paratuberculosis
gcgauccgcaggccgucgc

SEQ ID NO: 846711 - RNA, 15 nt, Mycobacterium avium subsp. paratuberculosis
gcgauccggccggcg

SEQ ID NO: 846712 - RNA, 16 nt, Mycobacterium avium subsp. paratuberculosis
gcgauccggccggcgg

SEQ ID NO: 846713 - RNA, 18 nt, Mycobacterium avium subsp. paratuberculosis
gcgauccggccggcggcg

SEQ ID NO: 846714 - RNA, 14 nt, Mycobacterium avium subsp. paratuberculosis
gcgauccgggcacg

SEQ ID NO: 846715 - RNA, 16 nt, Mycobacterium avium subsp. paratuberculosis
gcgauccgggcacgca

SEQ ID NO: 846716 - RNA, 23 nt, Mycobacterium avium subsp. paratuberculosis
gcgauccgggcauggucaccgga

SEQ ID NO: 846717 - RNA, 17 nt, Mycobacterium avium subsp. paratuberculosis
gcgauccgggcgccggc

SEQ ID NO: 846718 - RNA, 18 nt, Mycobacterium avium subsp. paratuberculosis
gcgauccgggcgccggcc

SEQ ID NO: 846719 - RNA, 16 nt, Mycobacterium avium subsp. paratuberculosis
gcgaucggauggugcc

SEQ ID NO: 846720 - RNA, 18 nt, Mycobacterium avium subsp. paratuberculosis
gcgaucggauggugccca

SEQ ID NO: 846721 - RNA, 13 nt, Mycobacterium avium subsp. paratuberculosis
gcgaucgcggcca

SEQ ID NO: 846722 - RNA, 13 nt, Mycobacterium avium subsp. paratuberculosis
gcgaucgcgucga

SEQ ID NO: 846723 - RNA, 12 nt, Mycobacterium avium subsp. paratuberculosis
gcgaucggcgag

SEQ ID NO: 846724 - RNA, 14 nt, Mycobacterium avium subsp. paratuberculosis
gcgaucggcgagcc

SEQ ID NO: 846725 - RNA, 16 nt, Mycobacterium avium subsp. paratuberculosis
gcgaucggcgagccgg

SEQ ID NO: 846726 - RNA, 18 nt, Mycobacterium avium subsp. paratuberculosis
gcgaucggcgagccggga

SEQ ID NO: 846727 - RNA, 13 nt, Mycobacterium avium subsp. paratuberculosis
gcgaucggcgcca

SEQ ID NO: 846728 - RNA, 21 nt, Mycobacterium avium subsp. paratuberculosis
gcgaucggcgccacgaccagc

SEQ ID NO: 846729 - RNA, 15 nt, Mycobacterium avium subsp. paratuberculosis
gcgaucggcgcggcg

SEQ ID NO: 846730 - RNA, 13 nt, Mycobacterium avium subsp. paratuberculosis
gcgaucggcggcu

SEQ ID NO: 846731 - RNA, 20 nt, Mycobacterium avium subsp. paratuberculosis
gcgaucggcggcucgccggc

SEQ ID NO: 846732 - RNA, 21 nt, Mycobacterium avium subsp. paratuberculosis
gcgaucggcggcucgccggcg

SEQ ID NO: 846733 - RNA, 19 nt, Mycobacterium avium subsp. paratuberculosis
gcgaucggcgguccgccgc

SEQ ID NO: 846734 - RNA, 20 nt, Mycobacterium avium subsp. paratuberculosis
gcgaucggcgguccgccgca

SEQ ID NO: 846735 - RNA, 16 nt, Mycobacterium avium subsp. paratuberculosis
gcgaucgccagcacgg

SEQ ID NO: 846736 - RNA, 12 nt, Mycobacterium avium subsp. paratuberculosis
gcgaucgccgcg

SEQ ID NO: 846737 - RNA, 19 nt, Mycobacterium avium subsp. paratuberculosis
gcgaucgccggaucggucu

SEQ ID NO: 846738 - RNA, 12 nt, Mycobacterium avium subsp. paratuberculosis
gcgaucgccgug

SEQ ID NO: 846739 - RNA, 13 nt, Mycobacterium avium subsp. paratuberculosis
gcgaucgccucgg

SEQ ID NO: 846740 - RNA, 16 nt, Mycobacterium avium subsp. paratuberculosis
gcgaucgccagcgcgg

SEQ ID NO: 846741 - RNA, 14 nt, Mycobacterium avium subsp. paratuberculosis
gcgaucgccgacgc

SEQ ID NO: 846742 - RNA, 15 nt, Mycobacterium avium subsp. paratuberculosis
gcgaucgccgacguc

SEQ ID NO: 846743 - RNA, 19 nt, Mycobacterium avium subsp. paratuberculosis
gcgaucgccgauccggcgc

SEQ ID NO: 846744 - RNA, 18 nt, Mycobacterium avium subsp. paratuberculosis
gcgaucaccgccgcggcg

SEQ ID NO: 846745 - RNA, 13 nt, Mycobacterium avium subsp. paratuberculosis
gcgaucaccgcgg

SEQ ID NO: 846746 - RNA, 15 nt, Mycobacterium avium subsp. paratuberculosis
gcgaucaccgcggcc

SEQ ID NO: 846747 - RNA, 22 nt, Mycobacterium avium subsp. paratuberculosis
gcgaucaccgcggccaccaccg

SEQ ID NO: 846748 - RNA, 18 nt, Mycobacterium avium subsp. paratuberculosis
gcgaucaccuugcggccg

SEQ ID NO: 846749 - RNA, 20 nt, Mycobacterium avium subsp. paratuberculosis
gcgaucaccuugcggccggc

SEQ ID NO: 846750 - RNA, 22 nt, Mycobacterium avium subsp. paratuberculosis
gcgaucaccuugcggccggcgg

SEQ ID NO: 846751 - RNA, 18 nt, Mycobacterium avium subsp. paratuberculosis
gcgaucacaccaccacgc

SEQ ID NO: 846752 - RNA, 16 nt, Mycobacterium avium subsp. paratuberculosis
gcgaucaccccggcga

SEQ ID NO: 846753 - RNA, 22 nt, Mycobacterium avium subsp. paratuberculosis
gcgaucaccccggcgacggcgg

SEQ ID NO: 846754 - RNA, 20 nt, Mycobacterium avium subsp. paratuberculosis
gcgaucaccaccccggugcc

SEQ ID NO: 846755 - RNA, 12 nt, Mycobacterium avium subsp. paratuberculosis
gcgaucagcgcc

SEQ ID NO: 846756 - RNA, 18 nt, Mycobacterium avium subsp. paratuberculosis
gcgaucagcucguggcgg

SEQ ID NO: 846757 - RNA, 23 nt, Mycobacterium avium subsp. paratuberculosis
gcgaucagcuggaucaucucgua

SEQ ID NO: 846758 - RNA, 14 nt, Mycobacterium avium subsp. paratuberculosis
gcgaucaggccggc

SEQ ID NO: 846759 - RNA, 15 nt, Mycobacterium avium subsp. paratuberculosis
gcgaucaggccggcc

SEQ ID NO: 846760 - RNA, 16 nt, Mycobacterium avium subsp. paratuberculosis
gcgaucaggccggcca

SEQ ID NO: 846761 - RNA, 17 nt, Mycobacterium avium subsp. paratuberculosis
gcgaucaggccggccac

SEQ ID NO: 846762 - RNA, 21 nt, Mycobacterium avium subsp. paratuberculosis
gcgaucaggccggccaccagg

SEQ ID NO: 846763 - RNA, 19 nt, Mycobacterium avium subsp. paratuberculosis
gcgaucacguucucggcga

SEQ ID NO: 846764 - RNA, 21 nt, Mycobacterium avium subsp. paratuberculosis
gcgaucagaugcucgucgguc

SEQ ID NO: 846765 - RNA, 13 nt, Mycobacterium avium subsp. paratuberculosis
gcgaucagcagca

SEQ ID NO: 846766 - RNA, 17 nt, Mycobacterium avium subsp. paratuberculosis
gcgaucagcagcacccg

SEQ ID NO: 846767 - RNA, 19 nt, Mycobacterium avium subsp. paratuberculosis
gcgaucagcagcacccggg

SEQ ID NO: 846768 - RNA, 22 nt, Mycobacterium avium subsp. paratuberculosis
gcgaucagcagcacccgggccu

SEQ ID NO: 846769 - RNA, 18 nt, Mycobacterium avium subsp. paratuberculosis
gcgaucagccccagggug

SEQ ID NO: 846770 - RNA, 21 nt, Mycobacterium avium subsp. paratuberculosis
gcgaucagccccagggugcgc

SEQ ID NO: 846771 - RNA, 13 nt, Mycobacterium avium subsp. paratuberculosis
gcgaucagcccgc

SEQ ID NO: 846772 - RNA, 14 nt, Mycobacterium avium subsp. paratuberculosis
gcgaucagcccggc

SEQ ID NO: 846773 - RNA, 16 nt, Mycobacterium avium subsp. paratuberculosis
gcgaucagcccggccc

SEQ ID NO: 846774 - RNA, 22 nt, Mycobacterium avium subsp. paratuberculosis
gcgauccacuccgaggucagcg

SEQ ID NO: 846775 - RNA, 17 nt, Mycobacterium avium subsp. paratuberculosis
gcgauccagcgcuggcc

SEQ ID NO: 846776 - RNA, 19 nt, Mycobacterium avium subsp. paratuberculosis
gcgauccagcgcuggccgg

SEQ ID NO: 846777 - RNA, 20 nt, Mycobacterium avium subsp. paratuberculosis
gcgauccagcgcuggccggc

SEQ ID NO: 846778 - RNA, 22 nt, Mycobacterium avium subsp. paratuberculosis
gcgauccagcgcuggccggcca

SEQ ID NO: 846779 - RNA, 17 nt, Mycobacterium avium subsp. paratuberculosis
gcgaucagcgcgcacag

SEQ ID NO: 846780 - RNA, 19 nt, Mycobacterium avium subsp. paratuberculosis
gcgaucagggccgcggccg

SEQ ID NO: 846781 - RNA, 15 nt, Mycobacterium avium subsp. paratuberculosis
gcgaucaucgucguc

SEQ ID NO: 846782 - RNA, 16 nt, Mycobacterium avium subsp. paratuberculosis
gcgaucauuccgccga

SEQ ID NO: 846783 - RNA, 17 nt, Mycobacterium avium subsp. paratuberculosis
gcgaucauuccgccgaa

SEQ ID NO: 846784 - RNA, 16 nt, Mycobacterium avium subsp. paratuberculosis
gcgaugcuauucgggc

SEQ ID NO: 846785 - RNA, 18 nt, Mycobacterium avium subsp. paratuberculosis
gcgaugcuauucgggcca

SEQ ID NO: 846786 - RNA, 19 nt, Mycobacterium avium subsp. paratuberculosis
gcgaugcuauucgggccag

SEQ ID NO: 846787 - RNA, 22 nt, Mycobacterium avium subsp. paratuberculosis
gcgaugcgggucacggucaggc

SEQ ID NO: 846788 - RNA, 21 nt, Mycobacterium avium subsp. paratuberculosis
gcgaugcgguggucgaacacg

SEQ ID NO: 846789 - RNA, 14 nt, Mycobacterium avium subsp. paratuberculosis
gcgaugcgggcgcc

SEQ ID NO: 846790 - RNA, 15 nt, Mycobacterium avium subsp. paratuberculosis
gcgaugcgggcgccg

SEQ ID NO: 846791 - RNA, 18 nt, Mycobacterium avium subsp. paratuberculosis
gcgaugcgggcgccgaac

SEQ ID NO: 846792 - RNA, 21 nt, Mycobacterium avium subsp. paratuberculosis
gcgaugcgggcgccgaacguc

SEQ ID NO: 846793 - RNA, 17 nt, Mycobacterium avium subsp. paratuberculosis
gcgaugcgcgccuccga

SEQ ID NO: 846794 - RNA, 14 nt, Mycobacterium avium subsp. paratuberculosis
gcgaugcggcccgg

SEQ ID NO: 846795 - RNA, 15 nt, Mycobacterium avium subsp. paratuberculosis
gcgaugcggcccggc

SEQ ID NO: 846796 - RNA, 16 nt, Mycobacterium avium subsp. paratuberculosis
gcgaugcggcccggcc

SEQ ID NO: 846797 - RNA, 19 nt, Mycobacterium avium subsp. paratuberculosis
gcgaugcggcccggccacu

SEQ ID NO: 846798 - RNA, 17 nt, Mycobacterium avium subsp. paratuberculosis
gcgaugcgcggcccguu

SEQ ID NO: 846799 - RNA, 21 nt, Mycobacterium avium subsp. paratuberculosis
gcgaugcgcaccaucaccugu

SEQ ID NO: 846800 - RNA, 12 nt, Mycobacterium avium subsp. paratuberculosis
gcgaugcgcacg

SEQ ID NO: 846801 - RNA, 14 nt, Mycobacterium avium subsp. paratuberculosis
gcgaugcgcacguc

SEQ ID NO: 846802 - RNA, 16 nt, Mycobacterium avium subsp. paratuberculosis
gcgaugcgcacgucgg

SEQ ID NO: 846803 - RNA, 20 nt, Mycobacterium avium subsp. paratuberculosis
gcgaugcgcacgucggccgc

SEQ ID NO: 846804 - RNA, 21 nt, Mycobacterium avium subsp. paratuberculosis
gcgaugcgcacgucggccgcc

SEQ ID NO: 846805 - RNA, 14 nt, Mycobacterium avium subsp. paratuberculosis
gcgaugccggccag

SEQ ID NO: 846806 - RNA, 19 nt, Mycobacterium avium subsp. paratuberculosis
gcgaugcccgugaucgcca

SEQ ID NO: 846807 - RNA, 20 nt, Mycobacterium avium subsp. paratuberculosis
gcgaugccggaaaaguucgg

SEQ ID NO: 846808 - RNA, 16 nt, Mycobacterium avium subsp. paratuberculosis
gcgaugcgacaccgcg

SEQ ID NO: 846809 - RNA, 14 nt, Mycobacterium avium subsp. paratuberculosis
gcgaugcaacaccg

SEQ ID NO: 846810 - RNA, 22 nt, Mycobacterium avium subsp. paratuberculosis
gcgaugcaacaccgaacgccga

SEQ ID NO: 846811 - RNA, 17 nt, Mycobacterium avium subsp. paratuberculosis
gcgaugccagcgcaccg

SEQ ID NO: 846812 - RNA, 23 nt, Mycobacterium avium subsp. paratuberculosis
gcgaugccagcgcaccgggcccg

SEQ ID NO: 846813 - RNA, 18 nt, Mycobacterium avium subsp. paratuberculosis
gcgaugcagaacagccgg

SEQ ID NO: 846814 - RNA, 19 nt, Mycobacterium avium subsp. paratuberculosis
gcgaugcagaucaccacgg

SEQ ID NO: 846815 - RNA, 20 nt, Mycobacterium avium subsp. paratuberculosis
gcgaugaucgggaugucgug

SEQ ID NO: 846816 - RNA, 21 nt, Mycobacterium avium subsp. paratuberculosis
gcgaugaucgggaugucgugg

SEQ ID NO: 846817 - RNA, 22 nt, Mycobacterium avium subsp. paratuberculosis
gcgaugaugagcaagucggcgg

SEQ ID NO: 846818 - RNA, 16 nt, Mycobacterium avium subsp. paratuberculosis
gcgaugauggcgucga

SEQ ID NO: 846819 - RNA, 19 nt, Mycobacterium avium subsp. paratuberculosis
gcgaugauggcgucgacgu

SEQ ID NO: 846820 - RNA, 21 nt, Mycobacterium avium subsp. paratuberculosis
gcgaugauggcgucgacgugc

SEQ ID NO: 846821 - RNA, 15 nt, Mycobacterium avium subsp. paratuberculosis
gcgaugccgacaccc

SEQ ID NO: 846822 - RNA, 18 nt, Mycobacterium avium subsp. paratuberculosis
gcgaugccgacaccccac

SEQ ID NO: 846823 - RNA, 21 nt, Mycobacterium avium subsp. paratuberculosis
gcgaugccgaggauuucgcga

SEQ ID NO: 846824 - RNA, 14 nt, Mycobacterium avium subsp. paratuberculosis
gcgaugccgccgac

SEQ ID NO: 846825 - RNA, 16 nt, Mycobacterium avium subsp. paratuberculosis
gcgaugccgccgacga

SEQ ID NO: 846826 - RNA, 17 nt, Mycobacterium avium subsp. paratuberculosis
gcgaugcccaagccggc

SEQ ID NO: 846827 - RNA, 15 nt, Mycobacterium avium subsp. paratuberculosis
gcgaugcccacagcc

SEQ ID NO: 846828 - RNA, 19 nt, Mycobacterium avium subsp. paratuberculosis
gcgaugcccacagccaggu

SEQ ID NO: 846829 - RNA, 19 nt, Mycobacterium avium subsp. paratuberculosis
gcgaucgggaacagcccgc

SEQ ID NO: 846830 - RNA, 19 nt, Mycobacterium avium subsp. paratuberculosis
gcgaucggcaggucgucga

SEQ ID NO: 846831 - RNA, 16 nt, Mycobacterium avium subsp. paratuberculosis
gcgaucggcgugccgg

SEQ ID NO: 846832 - RNA, 19 nt, Mycobacterium avium subsp. paratuberculosis
gcgaucgggucaccggccg

SEQ ID NO: 846833 - RNA, 21 nt, Mycobacterium avium subsp. paratuberculosis
gcgaucggugaacccgccggc

SEQ ID NO: 846834 - RNA, 13 nt, Mycobacterium avium subsp. paratuberculosis
gcgaucggugucc

SEQ ID NO: 846835 - RNA, 13 nt, Mycobacterium avium subsp. paratuberculosis
gcgaucgucgacc

SEQ ID NO: 846836 - RNA, 14 nt, Mycobacterium avium subsp. paratuberculosis
gcgaucgucgacca

SEQ ID NO: 846837 - RNA, 17 nt, Mycobacterium avium subsp. paratuberculosis
gcgaucgucgaccacca

SEQ ID NO: 846838 - RNA, 16 nt, Mycobacterium avium subsp. paratuberculosis
gcgaucuccagcggcc

SEQ ID NO: 846839 - RNA, 18 nt, Mycobacterium avium subsp. paratuberculosis
gcgaucgucucgucgaga

SEQ ID NO: 846840 - RNA, 20 nt, Mycobacterium avium subsp. paratuberculosis
gcgaucucggucaccgagcg

SEQ ID NO: 846841 - RNA, 23 nt, Mycobacterium avium subsp. paratuberculosis
gcgaucucggucaccgagcggcc

SEQ ID NO: 846842 - RNA, 15 nt, Mycobacterium avium subsp. paratuberculosis
gcgaucucgguuucc

SEQ ID NO: 846843 - RNA, 19 nt, Mycobacterium avium subsp. paratuberculosis
gcgaucucgucccacggcg

SEQ ID NO: 846844 - RNA, 14 nt, Mycobacterium avium subsp. paratuberculosis
gcgaucucggcgga

SEQ ID NO: 846845 - RNA, 16 nt, Mycobacterium avium subsp. paratuberculosis
gcgaucucggcggacu

SEQ ID NO: 846846 - RNA, 21 nt, Mycobacterium avium subsp. paratuberculosis
gcgaucucggcggacucggcg

SEQ ID NO: 846847 - RNA, 22 nt, Mycobacterium avium subsp. paratuberculosis
gcgaucucggcggacucggcga

SEQ ID NO: 846848 - RNA, 17 nt, Mycobacterium avium subsp. paratuberculosis
gcgaucucggcggccgc

SEQ ID NO: 846849 - RNA, 22 nt, Mycobacterium avium subsp. paratuberculosis
gcgaucucggcggccgcguccu

SEQ ID NO: 846850 - RNA, 14 nt, Mycobacterium avium subsp. paratuberculosis
gcgaucucgucgcg

SEQ ID NO: 846851 - RNA, 23 nt, Mycobacterium avium subsp. paratuberculosis
gcgaucucgccgaaggccggguc

SEQ ID NO: 846852 - RNA, 22 nt, Mycobacterium avium subsp. paratuberculosis
gcgaucucgauggacaggcacu

SEQ ID NO: 846853 - RNA, 15 nt, Mycobacterium avium subsp. paratuberculosis
gcgaucucgauggcc

SEQ ID NO: 846854 - RNA, 16 nt, Mycobacterium avium subsp. paratuberculosis
gcgaucucgauggcca

SEQ ID NO: 846855 - RNA, 19 nt, Mycobacterium avium subsp. paratuberculosis
gcgaucucgauggccacgc

SEQ ID NO: 846856 - RNA, 19 nt, Mycobacterium avium subsp. paratuberculosis
gcgaucucgauggccucgu

SEQ ID NO: 846857 - RNA, 16 nt, Mycobacterium avium subsp. paratuberculosis
gcgaucuccgucaccg

SEQ ID NO: 846858 - RNA, 19 nt, Mycobacterium avium subsp. paratuberculosis
gcgaucuccgucaccgugg

SEQ ID NO: 846859 - RNA, 21 nt, Mycobacterium avium subsp. paratuberculosis
gcgaugacgaauuccgcaccg

SEQ ID NO: 846860 - RNA, 13 nt, Mycobacterium avium subsp. paratuberculosis
gcgaugaccaccc

SEQ ID NO: 846861 - RNA, 13 nt, Mycobacterium avium subsp. paratuberculosis
gcgaugaccggac

SEQ ID NO: 846862 - RNA, 22 nt, Mycobacterium avium subsp. paratuberculosis
gcgaugaccggacgauucgcga

SEQ ID NO: 846863 - RNA, 14 nt, Mycobacterium avium subsp. paratuberculosis
gcgaugaccgggac

SEQ ID NO: 846864 - RNA, 16 nt, Mycobacterium avium subsp. paratuberculosis
gcgaugacgucgucgc

SEQ ID NO: 846865 - RNA, 17 nt, Mycobacterium avium subsp. paratuberculosis
gcgaugaucaacaggau

SEQ ID NO: 846866 - RNA, 19 nt, Mycobacterium avium subsp. paratuberculosis
gcgaugaucacacccacga

SEQ ID NO: 846867 - RNA, 16 nt, Mycobacterium avium subsp. paratuberculosis
gcgaugaucaccucgg

SEQ ID NO: 846868 - RNA, 15 nt, Mycobacterium avium subsp. paratuberculosis
gcgaugauccgcggc

SEQ ID NO: 846869 - RNA, 24 nt, Mycobacterium avium subsp. paratuberculosis
gcgaugauccgcggcgccgggcgg

SEQ ID NO: 846870 - RNA, 22 nt, Mycobacterium avium subsp. paratuberculosis
gcgaucugcuccucggucagcg

SEQ ID NO: 846871 - RNA, 23 nt, Mycobacterium avium subsp. paratuberculosis
gcgaucuggguuugggucaucga

SEQ ID NO: 846872 - RNA, 22 nt, Mycobacterium avium subsp. paratuberculosis
gcgaucuugucccgcauggccu

SEQ ID NO: 846873 - RNA, 13 nt, Mycobacterium avium subsp. paratuberculosis
gcgaugaagcccc

SEQ ID NO: 846874 - RNA, 14 nt, Mycobacterium avium subsp. paratuberculosis
gcgaugaagccggc

SEQ ID NO: 846875 - RNA, 15 nt, Mycobacterium avium subsp. paratuberculosis
gcgaugaagccggcg

SEQ ID NO: 846876 - RNA, 16 nt, Mycobacterium avium subsp. paratuberculosis
gcgaugaagccggcga

SEQ ID NO: 846877 - RNA, 18 nt, Mycobacterium avium subsp. paratuberculosis
gcgauguggguggucagc

SEQ ID NO: 846878 - RNA, 15 nt, Mycobacterium avium subsp. paratuberculosis
gcgaugugaucgcgg

SEQ ID NO: 846879 - RNA, 20 nt, Mycobacterium avium subsp. paratuberculosis
gcgaugugaucgcggcccac

SEQ ID NO: 846880 - RNA, 14 nt, Mycobacterium avium subsp. paratuberculosis
gcgaugucgacggu

SEQ ID NO: 846881 - RNA, 16 nt, Mycobacterium avium subsp. paratuberculosis
gcgaugucgggcaccu

SEQ ID NO: 846882 - RNA, 22 nt, Mycobacterium avium subsp. paratuberculosis
gcgaugucggugggccgcaccu

SEQ ID NO: 846883 - RNA, 13 nt, Mycobacterium avium subsp. paratuberculosis
gcgaugucgucga

SEQ ID NO: 846884 - RNA, 15 nt, Mycobacterium avium subsp. paratuberculosis
gcgaugucgucgacg

SEQ ID NO: 846885 - RNA, 20 nt, Mycobacterium avium subsp. paratuberculosis
gcgaugggcaauaccggcag

SEQ ID NO: 846886 - RNA, 13 nt, Mycobacterium avium subsp. paratuberculosis
gcgauggugcugc

SEQ ID NO: 846887 - RNA, 22 nt, Mycobacterium avium subsp. paratuberculosis
gcgauggugaugcggaugcccg

SEQ ID NO: 846888 - RNA, 16 nt, Mycobacterium avium subsp. paratuberculosis
gcgauggugcccucgu

SEQ ID NO: 846889 - RNA, 19 nt, Mycobacterium avium subsp. paratuberculosis
gcgauggugcccucguggu

SEQ ID NO: 846890 - RNA, 18 nt, Mycobacterium avium subsp. paratuberculosis
gcgauggugccgccggug

SEQ ID NO: 846891 - RNA, 17 nt, Mycobacterium avium subsp. paratuberculosis
gcgauggugccggccau

SEQ ID NO: 846892 - RNA, 21 nt, Mycobacterium avium subsp. paratuberculosis
gcgauguccgacagcccgccc

SEQ ID NO: 846893 - RNA, 23 nt, Mycobacterium avium subsp. paratuberculosis
gcgauguccuugucgcucaacgg

SEQ ID NO: 846894 - RNA, 15 nt, Mycobacterium avium subsp. paratuberculosis
gcgauggugggcagc

SEQ ID NO: 846895 - RNA, 18 nt, Mycobacterium avium subsp. paratuberculosis
gcgaugguggucgccguc

SEQ ID NO: 846896 - RNA, 20 nt, Mycobacterium avium subsp. paratuberculosis
gcgauggccauggccaggaa

SEQ ID NO: 846897 - RNA, 16 nt, Mycobacterium avium subsp. paratuberculosis
gcgauggcccgcgcga

SEQ ID NO: 846898 - RNA, 20 nt, Mycobacterium avium subsp. paratuberculosis
gcgauggcccgcugcgccga

SEQ ID NO: 846899 - RNA, 19 nt, Mycobacterium avium subsp. paratuberculosis
gcgauggaggucccgagga

SEQ ID NO: 846900 - RNA, 16 nt, Mycobacterium avium subsp. paratuberculosis
gcgauggacagcagcc

SEQ ID NO: 846901 - RNA, 17 nt, Mycobacterium avium subsp. paratuberculosis
gcgauggacagcagcca

SEQ ID NO: 846902 - RNA, 18 nt, Mycobacterium avium subsp. paratuberculosis
gcgauggaagcgcccgcg

SEQ ID NO: 846903 - RNA, 20 nt, Mycobacterium avium subsp. paratuberculosis
gcgauggaagcgcccgcgcg

SEQ ID NO: 846904 - RNA, 17 nt, Mycobacterium avium subsp. paratuberculosis
gcgaugggcgcgaucag

SEQ ID NO: 846905 - RNA, 20 nt, Mycobacterium avium subsp. paratuberculosis
gcgaugggugaucgcggccc

SEQ ID NO: 846906 - RNA, 13 nt, Mycobacterium avium subsp. paratuberculosis
gcgauggcgucgg

SEQ ID NO: 846907 - RNA, 20 nt, Mycobacterium avium subsp. paratuberculosis
gcgauggcgucggccagcgg

SEQ ID NO: 846908 - RNA, 15 nt, Mycobacterium avium subsp. paratuberculosis
gcgauggcggcgcgc

SEQ ID NO: 846909 - RNA, 13 nt, Mycobacterium avium subsp. paratuberculosis
gcgauggcggcgu

SEQ ID NO: 846910 - RNA, 16 nt, Mycobacterium avium subsp. paratuberculosis
gcgauggcggcgucga

SEQ ID NO: 846911 - RNA, 17 nt, Mycobacterium avium subsp. paratuberculosis
gcgauggcgcggccggc

SEQ ID NO: 846912 - RNA, 19 nt, Mycobacterium avium subsp. paratuberculosis
gcgauggcgcggccggccg

SEQ ID NO: 846913 - RNA, 21 nt, Mycobacterium avium subsp. paratuberculosis
gcgauggcgcggccggccgac

SEQ ID NO: 846914 - RNA, 14 nt, Mycobacterium avium subsp. paratuberculosis
gcgauggccuccga

SEQ ID NO: 846915 - RNA, 18 nt, Mycobacterium avium subsp. paratuberculosis
gcgauggccugcucgcga

SEQ ID NO: 846916 - RNA, 17 nt, Mycobacterium avium subsp. paratuberculosis
gcgcaaccgcggcggcg

SEQ ID NO: 846917 - RNA, 22 nt, Mycobacterium avium subsp. paratuberculosis
gcgcaaccgcggcggcggcccg

SEQ ID NO: 846918 - RNA, 23 nt, Mycobacterium avium subsp. paratuberculosis
gcgcaaccgcggcggcggcccgu

SEQ ID NO: 846919 - RNA, 14 nt, Mycobacterium avium subsp. paratuberculosis
gcgcaacagcaccu

SEQ ID NO: 846920 - RNA, 15 nt, Mycobacterium avium subsp. paratuberculosis
gcgcaacagcaccuc

SEQ ID NO: 846921 - RNA, 16 nt, Mycobacterium avium subsp. paratuberculosis
gcgcaacagcaccucg

SEQ ID NO: 846922 - RNA, 22 nt, Mycobacterium avium subsp. paratuberculosis
gcgcaacagcauuucgcgcggc

SEQ ID NO: 846923 - RNA, 18 nt, Mycobacterium avium subsp. paratuberculosis
gcgcaaccaacucgcgau

SEQ ID NO: 846924 - RNA, 20 nt, Mycobacterium avium subsp. paratuberculosis
gcgcaaccaacucgcgaugu

SEQ ID NO: 846925 - RNA, 15 nt, Mycobacterium avium subsp. paratuberculosis
gcgcaacaccucggc

SEQ ID NO: 846926 - RNA, 17 nt, Mycobacterium avium subsp. paratuberculosis
gcgcaacaccucggcga

SEQ ID NO: 846927 - RNA, 18 nt, Mycobacterium avium subsp. paratuberculosis
gcgcaacaccucggcgac

SEQ ID NO: 846928 - RNA, 21 nt, Mycobacterium avium subsp. paratuberculosis
gcgcaacaccucggcgacguc

SEQ ID NO: 846929 - RNA, 14 nt, Mycobacterium avium subsp. paratuberculosis
gcgauugguggccc

SEQ ID NO: 846930 - RNA, 15 nt, Mycobacterium avium subsp. paratuberculosis
gcgauuucgucggcg

SEQ ID NO: 846931 - RNA, 13 nt, Mycobacterium avium subsp. paratuberculosis
gcgauuucggccg

SEQ ID NO: 846932 - RNA, 18 nt, Mycobacterium avium subsp. paratuberculosis
gcgauucgguaccagggc

SEQ ID NO: 846933 - RNA, 13 nt, Mycobacterium avium subsp. paratuberculosis
gcgauucgucguc

SEQ ID NO: 846934 - RNA, 18 nt, Mycobacterium avium subsp. paratuberculosis
gcgauucucgcugcggcg

SEQ ID NO: 846935 - RNA, 16 nt, Mycobacterium avium subsp. paratuberculosis
gcgauugcacaccgcu

SEQ ID NO: 846936 - RNA, 16 nt, Mycobacterium avium subsp. paratuberculosis
gcgauugcggccgccg

SEQ ID NO: 846937 - RNA, 17 nt, Mycobacterium avium subsp. paratuberculosis
gcgauugcggccgccgg

SEQ ID NO: 846938 - RNA, 21 nt, Mycobacterium avium subsp. paratuberculosis
gcgauugcggccgccggccag

SEQ ID NO: 846939 - RNA, 14 nt, Mycobacterium avium subsp. paratuberculosis
gcgauucccgccgg

SEQ ID NO: 846940 - RNA, 15 nt, Mycobacterium avium subsp. paratuberculosis
gcgauucccgccgga

SEQ ID NO: 846941 - RNA, 12 nt, Mycobacterium avium subsp. paratuberculosis
gcgcaccgccac

SEQ ID NO: 846942 - RNA, 15 nt, Mycobacterium avium subsp. paratuberculosis
gcgcaccgccaccgc

SEQ ID NO: 846943 - RNA, 17 nt, Mycobacterium avium subsp. paratuberculosis
gcgcaccgccaccgccc

SEQ ID NO: 846944 - RNA, 17 nt, Mycobacterium avium subsp. paratuberculosis
gcgcaccgccagcaccg

SEQ ID NO: 846945 - RNA, 22 nt, Mycobacterium avium subsp. paratuberculosis
gcgcaccgccagcaccgacgcg

SEQ ID NO: 846946 - RNA, 15 nt, Mycobacterium avium subsp. paratuberculosis
gcgcaccgcccgcgg

SEQ ID NO: 846947 - RNA, 17 nt, Mycobacterium avium subsp. paratuberculosis
gcgcaccgcccgcggug

SEQ ID NO: 846948 - RNA, 12 nt, Mycobacterium avium subsp. paratuberculosis
gcgcaccgccgc

SEQ ID NO: 846949 - RNA, 12 nt, Mycobacterium avium subsp. paratuberculosis
gcgcaccgccgu

SEQ ID NO: 846950 - RNA, 19 nt, Mycobacterium avium subsp. paratuberculosis
gcgcaccgccgucggggcg

SEQ ID NO: 846951 - RNA, 12 nt, Mycobacterium avium subsp. paratuberculosis
gcgcaccgccug

SEQ ID NO: 846952 - RNA, 12 nt, Mycobacterium avium subsp. paratuberculosis
gcgcaccgcgcg

SEQ ID NO: 846953 - RNA, 13 nt, Mycobacterium avium subsp. paratuberculosis
gcgcaccgcgcgc

SEQ ID NO: 846954 - RNA, 15 nt, Mycobacterium avium subsp. paratuberculosis
gcgcaccgcgcgcca

SEQ ID NO: 846955 - RNA, 16 nt, Mycobacterium avium subsp. paratuberculosis
gcgcaccgcgcgccag

SEQ ID NO: 846956 - RNA, 21 nt, Mycobacterium avium subsp. paratuberculosis
gcgcaccgcgcgccaggucga

SEQ ID NO: 846957 - RNA, 15 nt, Mycobacterium avium subsp. paratuberculosis
gcgcaccgcggcggg

SEQ ID NO: 846958 - RNA, 14 nt, Mycobacterium avium subsp. paratuberculosis
gcgcaccgcggcgu

SEQ ID NO: 846959 - RNA, 16 nt, Mycobacterium avium subsp. paratuberculosis
gcgcaccgcggcgugc

SEQ ID NO: 846960 - RNA, 14 nt, Mycobacterium avium subsp. paratuberculosis
gcgcaccgcgggcu

SEQ ID NO: 846961 - RNA, 12 nt, Mycobacterium avium subsp. paratuberculosis
gcgcaccgcguc

SEQ ID NO: 846962 - RNA, 14 nt, Mycobacterium avium subsp. paratuberculosis
gcgcaccgcgucga

SEQ ID NO: 846963 - RNA, 15 nt, Mycobacterium avium subsp. paratuberculosis
gcgcaccgcgucgau

SEQ ID NO: 846964 - RNA, 14 nt, Mycobacterium avium subsp. paratuberculosis
gcgcaccaggcgcc

SEQ ID NO: 846965 - RNA, 15 nt, Mycobacterium avium subsp. paratuberculosis
gcgcaccaggcgcca

SEQ ID NO: 846966 - RNA, 19 nt, Mycobacterium avium subsp. paratuberculosis
gcgcaccaggccgacgcug

SEQ ID NO: 846967 - RNA, 20 nt, Mycobacterium avium subsp. paratuberculosis
gcgcaccaggccgacgcugg

SEQ ID NO: 846968 - RNA, 19 nt, Mycobacterium avium subsp. paratuberculosis
gcgcaccagcucgaggccg

SEQ ID NO: 846969 - RNA, 14 nt, Mycobacterium avium subsp. paratuberculosis
gcgcaccagcucgg

SEQ ID NO: 846970 - RNA, 12 nt, Mycobacterium avium subsp. paratuberculosis
gcgcaccagcug

SEQ ID NO: 846971 - RNA, 13 nt, Mycobacterium avium subsp. paratuberculosis
gcgcaccagcuga

SEQ ID NO: 846972 - RNA, 12 nt, Mycobacterium avium subsp. paratuberculosis
gcgcaccaccuc

SEQ ID NO: 846973 - RNA, 19 nt, Mycobacterium avium subsp. paratuberculosis
gcgcaccaccucgaucggg

SEQ ID NO: 846974 - RNA, 14 nt, Mycobacterium avium subsp. paratuberculosis
gcgcaccaccucgg

SEQ ID NO: 846975 - RNA, 15 nt, Mycobacterium avium subsp. paratuberculosis
gcgcaccaccucggc

SEQ ID NO: 846976 - RNA, 16 nt, Mycobacterium avium subsp. paratuberculosis
gcgcaccaccucggcg

SEQ ID NO: 846977 - RNA, 19 nt, Mycobacterium avium subsp. paratuberculosis
gcgcaccaccucggcgauc

SEQ ID NO: 846978 - RNA, 17 nt, Mycobacterium avium subsp. paratuberculosis
gcgcaccacgcccgacg

SEQ ID NO: 846979 - RNA, 21 nt, Mycobacterium avium subsp. paratuberculosis
gcgcaccacgcccgacgacga

SEQ ID NO: 846980 - RNA, 23 nt, Mycobacterium avium subsp. paratuberculosis
gcgcaccacgguggcgccgcgca

SEQ ID NO: 846981 - RNA, 13 nt, Mycobacterium avium subsp. paratuberculosis
gcgcaccacgucg

SEQ ID NO: 846982 - RNA, 14 nt, Mycobacterium avium subsp. paratuberculosis
gcgcacgaacggcg

SEQ ID NO: 846983 - RNA, 20 nt, Mycobacterium avium subsp. paratuberculosis
gcgcacgaacggcgcgaacc

SEQ ID NO: 846984 - RNA, 18 nt, Mycobacterium avium subsp. paratuberculosis
gcgcaccuucccggccgc

SEQ ID NO: 846985 - RNA, 19 nt, Mycobacterium avium subsp. paratuberculosis
gcgcaccuucccggccgcc

SEQ ID NO: 846986 - RNA, 21 nt, Mycobacterium avium subsp. paratuberculosis
gcgcaccuucccggccgccaa

SEQ ID NO: 846987 - RNA, 17 nt, Mycobacterium avium subsp. paratuberculosis
gcgcaccuggucgguca

SEQ ID NO: 846988 - RNA, 16 nt, Mycobacterium avium subsp. paratuberculosis
gcgcaccgcauagcgg

SEQ ID NO: 846989 - RNA, 23 nt, Mycobacterium avium subsp. paratuberculosis
gcgcaccgcggauuccagcgcgu

SEQ ID NO: 846990 - RNA, 18 nt, Mycobacterium avium subsp. paratuberculosis
gcgcaccgcggccucggc

SEQ ID NO: 846991 - RNA, 13 nt, Mycobacterium avium subsp. paratuberculosis
gcgcaccgcggcg

SEQ ID NO: 846992 - RNA, 17 nt, Mycobacterium avium subsp. paratuberculosis
gcgcacguuggcggcca

SEQ ID NO: 846993 - RNA, 18 nt, Mycobacterium avium subsp. paratuberculosis
gcgcacguuggcggccag

SEQ ID NO: 846994 - RNA, 22 nt, Mycobacterium avium subsp. paratuberculosis
gcgcacguuggcggccagcgcg

SEQ ID NO: 846995 - RNA, 19 nt, Mycobacterium avium subsp. paratuberculosis
gcgcacgcggacacgaacg

SEQ ID NO: 846996 - RNA, 22 nt, Mycobacterium avium subsp. paratuberculosis
gcgcacgucgaggucggacgcc

SEQ ID NO: 846997 - RNA, 18 nt, Mycobacterium avium subsp. paratuberculosis
gcgcacgucgccgccgca

SEQ ID NO: 846998 - RNA, 12 nt, Mycobacterium avium subsp. paratuberculosis
gcgcacgucggc

SEQ ID NO: 846999 - RNA, 13 nt, Mycobacterium avium subsp. paratuberculosis
gcgcacgucggcc

SEQ ID NO: 847000 - RNA, 17 nt, Mycobacterium avium subsp. paratuberculosis
gcgcacgucggccgcca

SEQ ID NO: 847001 - RNA, 19 nt, Mycobacterium avium subsp. paratuberculosis
gcgcacgucggccgccagg

SEQ ID NO: 847002 - RNA, 13 nt, Mycobacterium avium subsp. paratuberculosis
gcgcacgccaucg

SEQ ID NO: 847003 - RNA, 15 nt, Mycobacterium avium subsp. paratuberculosis
gcgcacgccaucgcc

SEQ ID NO: 847004 - RNA, 22 nt, Mycobacterium avium subsp. paratuberculosis
gcgcacgcccaugaucacaccg

SEQ ID NO: 847005 - RNA, 22 nt, Mycobacterium avium subsp. paratuberculosis
gcgcaaucggggccgacccgca

SEQ ID NO: 847006 - RNA, 16 nt, Mycobacterium avium subsp. paratuberculosis
gcgcaaucaaaaaccc

SEQ ID NO: 847007 - RNA, 22 nt, Mycobacterium avium subsp. paratuberculosis
gcgcaccaaggcaaucaggcgg

SEQ ID NO: 847008 - RNA, 20 nt, Mycobacterium avium subsp. paratuberculosis
gcgcaccaccagcucgucgc

SEQ ID NO: 847009 - RNA, 22 nt, Mycobacterium avium subsp. paratuberculosis
gcgcaauacccgaccagcaccg

SEQ ID NO: 847010 - RNA, 23 nt, Mycobacterium avium subsp. paratuberculosis
gcgcaauacccgaccagcaccgc

SEQ ID NO: 847011 - RNA, 14 nt, Mycobacterium avium subsp. paratuberculosis
gcgcaaguagcgcu

SEQ ID NO: 847012 - RNA, 17 nt, Mycobacterium avium subsp. paratuberculosis
gcgcaagggccgacauc

SEQ ID NO: 847013 - RNA, 14 nt, Mycobacterium avium subsp. paratuberculosis
gcgcaagcaccggc

SEQ ID NO: 847014 - RNA, 20 nt, Mycobacterium avium subsp. paratuberculosis
gcgcaagcaccggcuggccg

SEQ ID NO: 847015 - RNA, 17 nt, Mycobacterium avium subsp. paratuberculosis
gcgcaacucguccacca

SEQ ID NO: 847016 - RNA, 20 nt, Mycobacterium avium subsp. paratuberculosis
gcgcaacguguacucggcgu

SEQ ID NO: 847017 - RNA, 21 nt, Mycobacterium avium subsp. paratuberculosis
gcgcaacguguacucggcguc

SEQ ID NO: 847018 - RNA, 17 nt, Mycobacterium avium subsp. paratuberculosis
gcgcaacggcgucgaca

SEQ ID NO: 847019 - RNA, 20 nt, Mycobacterium avium subsp. paratuberculosis
gcgcaaccgggccgcacccc

SEQ ID NO: 847020 - RNA, 12 nt, Mycobacterium avium subsp. paratuberculosis
gcgcaaccgcgg

SEQ ID NO: 847021 - RNA, 20 nt, Mycobacterium avium subsp. paratuberculosis
gcgcaaccucuucgggggug

SEQ ID NO: 847022 - RNA, 15 nt, Mycobacterium avium subsp. paratuberculosis
gcgacuccagcagcg

SEQ ID NO: 847023 - RNA, 18 nt, Mycobacterium avium subsp. paratuberculosis
gcgacuccagcagcgcca

SEQ ID NO: 847024 - RNA, 19 nt, Mycobacterium avium subsp. paratuberculosis
gcgacuccagcagcgccag

SEQ ID NO: 847025 - RNA, 18 nt, Mycobacterium avium subsp. paratuberculosis
gcgacugcgugcugggca

SEQ ID NO: 847026 - RNA, 19 nt, Mycobacterium avium subsp. paratuberculosis
gcgacugggcgcccacccg

SEQ ID NO: 847027 - RNA, 18 nt, Mycobacterium avium subsp. paratuberculosis
gcgacugucggcucgccc

SEQ ID NO: 847028 - RNA, 19 nt, Mycobacterium avium subsp. paratuberculosis
gcgacugucggcucgcccg

SEQ ID NO: 847029 - RNA, 22 nt, Mycobacterium avium subsp. paratuberculosis
gcgacugucggcucgcccgcga

SEQ ID NO: 847030 - RNA, 14 nt, Mycobacterium avium subsp. paratuberculosis
gcgacgucugcggc

SEQ ID NO: 847031 - RNA, 15 nt, Mycobacterium avium subsp. paratuberculosis
gcgacgucugcggcu

SEQ ID NO: 847032 - RNA, 18 nt, Mycobacterium avium subsp. paratuberculosis
gcgacgucugcggcucgg

SEQ ID NO: 847033 - RNA, 18 nt, Mycobacterium avium subsp. paratuberculosis
gcgacgugaucggcggcc

SEQ ID NO: 847034 - RNA, 21 nt, Mycobacterium avium subsp. paratuberculosis
gcgacgugaucggcggccugc

SEQ ID NO: 847035 - RNA, 19 nt, Mycobacterium avium subsp. paratuberculosis
gcgacgugauggucgucgu

SEQ ID NO: 847036 - RNA, 15 nt, Mycobacterium avium subsp. paratuberculosis
gcgacgugccggcga

SEQ ID NO: 847037 - RNA, 15 nt, Mycobacterium avium subsp. paratuberculosis
gcgacguggcgcagu

SEQ ID NO: 847038 - RNA, 18 nt, Mycobacterium avium subsp. paratuberculosis
gcgacggcgucggcgagc

SEQ ID NO: 847039 - RNA, 18 nt, Mycobacterium avium subsp. paratuberculosis
gcgacggcgucggcggcc

SEQ ID NO: 847040 - RNA, 21 nt, Mycobacterium avium subsp. paratuberculosis
gcgacggcgucggcggccugc

SEQ ID NO: 847041 - RNA, 19 nt, Mycobacterium avium subsp. paratuberculosis
gcgacggcguugcuggcgc

SEQ ID NO: 847042 - RNA, 13 nt, Mycobacterium avium subsp. paratuberculosis
gcgacgucgucgc

SEQ ID NO: 847043 - RNA, 22 nt, Mycobacterium avium subsp. paratuberculosis
gcgacgucgucgcccacccgcc

SEQ ID NO: 847044 - RNA, 12 nt, Mycobacterium avium subsp. paratuberculosis
gcgacgucgugc

SEQ ID NO: 847045 - RNA, 16 nt, Mycobacterium avium subsp. paratuberculosis
gcgacgucgugcacgc

SEQ ID NO: 847046 - RNA, 19 nt, Mycobacterium avium subsp. paratuberculosis
gcgacgucgugcacgccgu

SEQ ID NO: 847047 - RNA, 21 nt, Mycobacterium avium subsp. paratuberculosis
gcgacgucgugcacgccgugg

SEQ ID NO: 847048 - RNA, 16 nt, Mycobacterium avium subsp. paratuberculosis
gcgacggcggcgaaga

SEQ ID NO: 847049 - RNA, 15 nt, Mycobacterium avium subsp. paratuberculosis
gcgacggcggcgacg

SEQ ID NO: 847050 - RNA, 19 nt, Mycobacterium avium subsp. paratuberculosis
gcgacggcgcccgccccga

SEQ ID NO: 847051 - RNA, 13 nt, Mycobacterium avium subsp. paratuberculosis
gcgacggcgccug

SEQ ID NO: 847052 - RNA, 23 nt, Mycobacterium avium subsp. paratuberculosis
gcgacggcgccugauccgcgguc

SEQ ID NO: 847053 - RNA, 18 nt, Mycobacterium avium subsp. paratuberculosis
gcgacggcgcucaccggc

SEQ ID NO: 847054 - RNA, 15 nt, Mycobacterium avium subsp. paratuberculosis
gcgacggcggggugc

SEQ ID NO: 847055 - RNA, 17 nt, Mycobacterium avium subsp. paratuberculosis
gcgacggcggggugcgc

SEQ ID NO: 847056 - RNA, 18 nt, Mycobacterium avium subsp. paratuberculosis
gcgacggcgggucgauga

SEQ ID NO: 847057 - RNA, 15 nt, Mycobacterium avium subsp. paratuberculosis
gcgacggcguccagc

SEQ ID NO: 847058 - RNA, 13 nt, Mycobacterium avium subsp. paratuberculosis
gcgacggcguccg

SEQ ID NO: 847059 - RNA, 17 nt, Mycobacterium avium subsp. paratuberculosis
gcgacggcguccgggcg

SEQ ID NO: 847060 - RNA, 13 nt, Mycobacterium avium subsp. paratuberculosis
gcgacggcgucgg

SEQ ID NO: 847061 - RNA, 14 nt, Mycobacterium avium subsp. paratuberculosis
gcgacggcgucggc

SEQ ID NO: 847062 - RNA, 15 nt, Mycobacterium avium subsp. paratuberculosis
gcgacggccucgccg

SEQ ID NO: 847063 - RNA, 15 nt, Mycobacterium avium subsp. paratuberculosis
gcgacggccggggcc

SEQ ID NO: 847064 - RNA, 18 nt, Mycobacterium avium subsp. paratuberculosis
gcgacggccggggccagc

SEQ ID NO: 847065 - RNA, 14 nt, Mycobacterium avium subsp. paratuberculosis
gcgacggccguccg

SEQ ID NO: 847066 - RNA, 22 nt, Mycobacterium avium subsp. paratuberculosis
gcgacggccguccggucgcugg

SEQ ID NO: 847067 - RNA, 13 nt, Mycobacterium avium subsp. paratuberculosis
gcgacggcgacga

SEQ ID NO: 847068 - RNA, 16 nt, Mycobacterium avium subsp. paratuberculosis
gcgacggcgacgaccg

SEQ ID NO: 847069 - RNA, 13 nt, Mycobacterium avium subsp. paratuberculosis
gcgacggcgacgg

SEQ ID NO: 847070 - RNA, 15 nt, Mycobacterium avium subsp. paratuberculosis
gcgacggcgacggcc

SEQ ID NO: 847071 - RNA, 16 nt, Mycobacterium avium subsp. paratuberculosis
gcgacggcgagccggg

SEQ ID NO: 847072 - RNA, 17 nt, Mycobacterium avium subsp. paratuberculosis
gcgacggcgagccgggc

SEQ ID NO: 847073 - RNA, 15 nt, Mycobacterium avium subsp. paratuberculosis
gcgacggcccgccgg

SEQ ID NO: 847074 - RNA, 12 nt, Mycobacterium avium subsp. paratuberculosis
gcgacggcccgg

SEQ ID NO: 847075 - RNA, 14 nt, Mycobacterium avium subsp. paratuberculosis
gcgacggccgccga

SEQ ID NO: 847076 - RNA, 22 nt, Mycobacterium avium subsp. paratuberculosis
gcgagcaucaccgucaucucgg

SEQ ID NO: 847077 - RNA, 19 nt, Mycobacterium avium subsp. paratuberculosis
gcgagcagggcgggcaggc

SEQ ID NO: 847078 - RNA, 23 nt, Mycobacterium avium subsp. paratuberculosis
gcgagcagggcgggcaggcccga

SEQ ID NO: 847079 - RNA, 14 nt, Mycobacterium avium subsp. paratuberculosis
gcgagcagcgcccg

SEQ ID NO: 847080 - RNA, 16 nt, Mycobacterium avium subsp. paratuberculosis
gcgagcagcgcccggg

SEQ ID NO: 847081 - RNA, 20 nt, Mycobacterium avium subsp. paratuberculosis
gcgagcagcgcccgggugcg

SEQ ID NO: 847082 - RNA, 15 nt, Mycobacterium avium subsp. paratuberculosis
gcgagcagcgcgaug

SEQ ID NO: 847083 - RNA, 20 nt, Mycobacterium avium subsp. paratuberculosis
gcgagcagcgcgaugccggc

SEQ ID NO: 847084 - RNA, 22 nt, Mycobacterium avium subsp. paratuberculosis
gcgagcagcgcgaugccggcca

SEQ ID NO: 847085 - RNA, 23 nt, Mycobacterium avium subsp. paratuberculosis
gcgagcagcucgacaucggccgc

SEQ ID NO: 847086 - RNA, 15 nt, Mycobacterium avium subsp. paratuberculosis
gcgagcagcugcagc

SEQ ID NO: 847087 - RNA, 18 nt, Mycobacterium avium subsp. paratuberculosis
gcgagcagcugcagcguc

SEQ ID NO: 847088 - RNA, 14 nt, Mycobacterium avium subsp. paratuberculosis
gcgagcagcccggc

SEQ ID NO: 847089 - RNA, 13 nt, Mycobacterium avium subsp. paratuberculosis
gcgagcagcagcg

SEQ ID NO: 847090 - RNA, 18 nt, Mycobacterium avium subsp. paratuberculosis
gcgagcagcagcgcggug

SEQ ID NO: 847091 - RNA, 21 nt, Mycobacterium avium subsp. paratuberculosis
gcgagcagcagcgcggugccg

SEQ ID NO: 847092 - RNA, 18 nt, Mycobacterium avium subsp. paratuberculosis
gcgagcagacgcgaaagc

SEQ ID NO: 847093 - RNA, 13 nt, Mycobacterium avium subsp. paratuberculosis
gcgagcagcccgg

SEQ ID NO: 847094 - RNA, 13 nt, Mycobacterium avium subsp. paratuberculosis
gcgagcagccgcg

SEQ ID NO: 847095 - RNA, 14 nt, Mycobacterium avium subsp. paratuberculosis
gcgagcagccgcgc

SEQ ID NO: 847096 - RNA, 16 nt, Mycobacterium avium subsp. paratuberculosis
gcgagcagccgcgccg

SEQ ID NO: 847097 - RNA, 17 nt, Mycobacterium avium subsp. paratuberculosis
gcgagcagccgcgccgg

SEQ ID NO: 847098 - RNA, 18 nt, Mycobacterium avium subsp. paratuberculosis
gcgagcagccgcgccggg

SEQ ID NO: 847099 - RNA, 19 nt, Mycobacterium avium subsp. paratuberculosis
gcgagcagccgcgccgggc

SEQ ID NO: 847100 - RNA, 20 nt, Mycobacterium avium subsp. paratuberculosis
gcgagcagccgcgccgggcg

SEQ ID NO: 847101 - RNA, 14 nt, Mycobacterium avium subsp. paratuberculosis
gcgagaucagcgcc

SEQ ID NO: 847102 - RNA, 16 nt, Mycobacterium avium subsp. paratuberculosis
gcgagaucagcgccau

SEQ ID NO: 847103 - RNA, 22 nt, Mycobacterium avium subsp. paratuberculosis
gcgagaguaucgccacgccgac

SEQ ID NO: 847104 - RNA, 18 nt, Mycobacterium avium subsp. paratuberculosis
gcgagacguaagccaugg

SEQ ID NO: 847105 - RNA, 15 nt, Mycobacterium avium subsp. paratuberculosis
gcgagaccucccggc

SEQ ID NO: 847106 - RNA, 16 nt, Mycobacterium avium subsp. paratuberculosis
gcgagaccucccggcg

SEQ ID NO: 847107 - RNA, 17 nt, Mycobacterium avium subsp. paratuberculosis
gcgagaccucccggcgc

SEQ ID NO: 847108 - RNA, 14 nt, Mycobacterium avium subsp. paratuberculosis
gcgacuugccgccg

SEQ ID NO: 847109 - RNA, 17 nt, Mycobacterium avium subsp. paratuberculosis
gcgacuucuacggcggg

SEQ ID NO: 847110 - RNA, 21 nt, Mycobacterium avium subsp. paratuberculosis
gcgacuucuacggcgggccgg

SEQ ID NO: 847111 - RNA, 23 nt, Mycobacterium avium subsp. paratuberculosis
gcgacuucuacggcgggccggcg

SEQ ID NO: 847112 - RNA, 17 nt, Mycobacterium avium subsp. paratuberculosis
gcgacuucuucgccggc

SEQ ID NO: 847113 - RNA, 15 nt, Mycobacterium avium subsp. paratuberculosis
gcgacuugaccagca

SEQ ID NO: 847114 - RNA, 15 nt, Mycobacterium avium subsp. paratuberculosis
gcgacuggcccucgg

SEQ ID NO: 847115 - RNA, 14 nt, Mycobacterium avium subsp. paratuberculosis
gcgagccgucgacc

SEQ ID NO: 847116 - RNA, 16 nt, Mycobacterium avium subsp. paratuberculosis
gcgagccgucgaccgg

SEQ ID NO: 847117 - RNA, 13 nt, Mycobacterium avium subsp. paratuberculosis
gcgagccgggccg

SEQ ID NO: 847118 - RNA, 23 nt, Mycobacterium avium subsp. paratuberculosis
gcgagccggucugggcgaccaug

SEQ ID NO: 847119 - RNA, 13 nt, Mycobacterium avium subsp. paratuberculosis
gcgagccggcacg

SEQ ID NO: 847120 - RNA, 16 nt, Mycobacterium avium subsp. paratuberculosis
gcgagccggcacgcgc

SEQ ID NO: 847121 - RNA, 23 nt, Mycobacterium avium subsp. paratuberculosis
gcgagccggcacgcgcgccggag

SEQ ID NO: 847122 - RNA, 13 nt, Mycobacterium avium subsp. paratuberculosis
gcgagccggcccg

SEQ ID NO: 847123 - RNA, 12 nt, Mycobacterium avium subsp. paratuberculosis
gcgagccggccg

SEQ ID NO: 847124 - RNA, 13 nt, Mycobacterium avium subsp. paratuberculosis
gcgagccggccgu

SEQ ID NO: 847125 - RNA, 20 nt, Mycobacterium avium subsp. paratuberculosis
gcgagccggccguagcggac

SEQ ID NO: 847126 - RNA, 13 nt, Mycobacterium avium subsp. paratuberculosis
gcgagccgcccag

SEQ ID NO: 847127 - RNA, 15 nt, Mycobacterium avium subsp. paratuberculosis
gcgagccgcccaggc

SEQ ID NO: 847128 - RNA, 12 nt, Mycobacterium avium subsp. paratuberculosis
gcgagcccggcc

SEQ ID NO: 847129 - RNA, 13 nt, Mycobacterium avium subsp. paratuberculosis
gcgagcccggcca

SEQ ID NO: 847130 - RNA, 14 nt, Mycobacterium avium subsp. paratuberculosis
gcgagcccggccag

SEQ ID NO: 847131 - RNA, 20 nt, Mycobacterium avium subsp. paratuberculosis
gcgagcccggccaguccggc

SEQ ID NO: 847132 - RNA, 22 nt, Mycobacterium avium subsp. paratuberculosis
gcgagcccggccaguccggcag

SEQ ID NO: 847133 - RNA, 18 nt, Mycobacterium avium subsp. paratuberculosis
gcgagcccggcgacgucg

SEQ ID NO: 847134 - RNA, 22 nt, Mycobacterium avium subsp. paratuberculosis
gcgagcccggcgacgucgucga

SEQ ID NO: 847135 - RNA, 17 nt, Mycobacterium avium subsp. paratuberculosis
gcgagcccuucgcggug

SEQ ID NO: 847136 - RNA, 21 nt, Mycobacterium avium subsp. paratuberculosis
gcgagccgaaacggugcccgc

SEQ ID NO: 847137 - RNA, 13 nt, Mycobacterium avium subsp. paratuberculosis
gcgagccgaagcg

SEQ ID NO: 847138 - RNA, 19 nt, Mycobacterium avium subsp. paratuberculosis
gcgagccgacagucgcggg

SEQ ID NO: 847139 - RNA, 20 nt, Mycobacterium avium subsp. paratuberculosis
gcgagccgacagucgcgggc

SEQ ID NO: 847140 - RNA, 22 nt, Mycobacterium avium subsp. paratuberculosis
gcgagccgacagucgcgggcgg

SEQ ID NO: 847141 - RNA, 14 nt, Mycobacterium avium subsp. paratuberculosis
gcgagccgagccgg

SEQ ID NO: 847142 - RNA, 20 nt, Mycobacterium avium subsp. paratuberculosis
gcgagccgagccgguccgac

SEQ ID NO: 847143 - RNA, 22 nt, Mycobacterium avium subsp. paratuberculosis
gcgagccgagccgguccgacca

SEQ ID NO: 847144 - RNA, 23 nt, Mycobacterium avium subsp. paratuberculosis
gcgagccgagccgguccgaccag

SEQ ID NO: 847145 - RNA, 20 nt, Mycobacterium avium subsp. paratuberculosis
gcgagccaccucgaucagcg

SEQ ID NO: 847146 - RNA, 12 nt, Mycobacterium avium subsp. paratuberculosis
gcgagcccagcu

SEQ ID NO: 847147 - RNA, 15 nt, Mycobacterium avium subsp. paratuberculosis
gcgagcuuggcggug

SEQ ID NO: 847148 - RNA, 22 nt, Mycobacterium avium subsp. paratuberculosis
gcgagcuuggcgguguucuugc

SEQ ID NO: 847149 - RNA, 14 nt, Mycobacterium avium subsp. paratuberculosis
gcgaggacgucgag

SEQ ID NO: 847150 - RNA, 16 nt, Mycobacterium avium subsp. paratuberculosis
gcgaggacgucgucga

SEQ ID NO: 847151 - RNA, 18 nt, Mycobacterium avium subsp. paratuberculosis
gcgaggacgucgucgacg

SEQ ID NO: 847152 - RNA, 19 nt, Mycobacterium avium subsp. paratuberculosis
gcgaggacgucgucgacgu

SEQ ID NO: 847153 - RNA, 14 nt, Mycobacterium avium subsp. paratuberculosis
gcgaggaucgcgau

SEQ ID NO: 847154 - RNA, 23 nt, Mycobacterium avium subsp. paratuberculosis
gcgaggccaucaucccguacucg

SEQ ID NO: 847155 - RNA, 14 nt, Mycobacterium avium subsp. paratuberculosis
gcgaggaccgagau

SEQ ID NO: 847156 - RNA, 16 nt, Mycobacterium avium subsp. paratuberculosis
gcgaggacgauggacg

SEQ ID NO: 847157 - RNA, 14 nt, Mycobacterium avium subsp. paratuberculosis
gcgaggaacccgac

SEQ ID NO: 847158 - RNA, 19 nt, Mycobacterium avium subsp. paratuberculosis
gcgaggaacccgaccgcga

SEQ ID NO: 847159 - RNA, 15 nt, Mycobacterium avium subsp. paratuberculosis
gcgagcgacgccacg

SEQ ID NO: 847160 - RNA, 23 nt, Mycobacterium avium subsp. paratuberculosis
gcgagcgacgccacggggcugcg

SEQ ID NO: 847161 - RNA, 23 nt, Mycobacterium avium subsp. paratuberculosis
gcgagcgaggccaucaucccgua

SEQ ID NO: 847162 - RNA, 19 nt, Mycobacterium avium subsp. paratuberculosis
gcgaucaacaccgguccgg

SEQ ID NO: 847163 - RNA, 20 nt, Mycobacterium avium subsp. paratuberculosis
gcgaucaacaccgguccggc

SEQ ID NO: 847164 - RNA, 23 nt, Mycobacterium avium subsp. paratuberculosis
gcgaucaacaccgguccggccgu

SEQ ID NO: 847165 - RNA, 22 nt, Mycobacterium avium subsp. paratuberculosis
gcgaucaacgggucgagcacgu

SEQ ID NO: 847166 - RNA, 17 nt, Mycobacterium avium subsp. paratuberculosis
gcgauacccguugcgcc

SEQ ID NO: 847167 - RNA, 14 nt, Mycobacterium avium subsp. paratuberculosis
gcgauacgacggga

SEQ ID NO: 847168 - RNA, 19 nt, Mycobacterium avium subsp. paratuberculosis
gcgauaaccucggcggcgg

SEQ ID NO: 847169 - RNA, 20 nt, Mycobacterium avium subsp. paratuberculosis
gcgauaaccucggcggcggc

SEQ ID NO: 847170 - RNA, 16 nt, Mycobacterium avium subsp. paratuberculosis
gcgaggugggcaccag

SEQ ID NO: 847171 - RNA, 13 nt, Mycobacterium avium subsp. paratuberculosis
gcgaggugucgac

SEQ ID NO: 847172 - RNA, 22 nt, Mycobacterium avium subsp. paratuberculosis
gcgaggugucgacgcugagcac

SEQ ID NO: 847173 - RNA, 22 nt, Mycobacterium avium subsp. paratuberculosis
gcgaggucgucgagggccaccg

SEQ ID NO: 847174 - RNA, 15 nt, Mycobacterium avium subsp. paratuberculosis
gcgaggucguucgac

SEQ ID NO: 847175 - RNA, 14 nt, Mycobacterium avium subsp. paratuberculosis
gcgaggucucccgg

SEQ ID NO: 847176 - RNA, 15 nt, Mycobacterium avium subsp. paratuberculosis
gcgagguagaccgcc

SEQ ID NO: 847177 - RNA, 16 nt, Mycobacterium avium subsp. paratuberculosis
gcgagguagaccgccg

SEQ ID NO: 847178 - RNA, 14 nt, Mycobacterium avium subsp. paratuberculosis
gcgacccaccgucg

SEQ ID NO: 847179 - RNA, 14 nt, Mycobacterium avium subsp. paratuberculosis
gcgacccaggccgc

SEQ ID NO: 847180 - RNA, 20 nt, Mycobacterium avium subsp. paratuberculosis
gcgacccaggccgccgccac

SEQ ID NO: 847181 - RNA, 21 nt, Mycobacterium avium subsp. paratuberculosis
gcgacccaggccgccgccacc

SEQ ID NO: 847182 - RNA, 14 nt, Mycobacterium avium subsp. paratuberculosis
gcgaccccgccguc

SEQ ID NO: 847183 - RNA, 15 nt, Mycobacterium avium subsp. paratuberculosis
gcgaccccgccgucg

SEQ ID NO: 847184 - RNA, 16 nt, Mycobacterium avium subsp. paratuberculosis
gcgaccccgccgucga

SEQ ID NO: 847185 - RNA, 18 nt, Mycobacterium avium subsp. paratuberculosis
gcgaccccgccgucgacg

SEQ ID NO: 847186 - RNA, 20 nt, Mycobacterium avium subsp. paratuberculosis
gcgaccccgccgucgacgcg

SEQ ID NO: 847187 - RNA, 19 nt, Mycobacterium avium subsp. paratuberculosis
gcgaccccguucgccgaca

SEQ ID NO: 847188 - RNA, 23 nt, Mycobacterium avium subsp. paratuberculosis
gcgaccccuacgggcgcaccgcg

SEQ ID NO: 847189 - RNA, 23 nt, Mycobacterium avium subsp. paratuberculosis
gcgaccccuccaacggccgcacg

SEQ ID NO: 847190 - RNA, 13 nt, Mycobacterium avium subsp. paratuberculosis
gcgaccgcccggg

SEQ ID NO: 847191 - RNA, 14 nt, Mycobacterium avium subsp. paratuberculosis
gcgaccgcccgggg

SEQ ID NO: 847192 - RNA, 15 nt, Mycobacterium avium subsp. paratuberculosis
gcgaccgcccggggc

SEQ ID NO: 847193 - RNA, 16 nt, Mycobacterium avium subsp. paratuberculosis
gcgaccgcccggggcg

SEQ ID NO: 847194 - RNA, 20 nt, Mycobacterium avium subsp. paratuberculosis
gcgaccgcccggggcgcgga

SEQ ID NO: 847195 - RNA, 22 nt, Mycobacterium avium subsp. paratuberculosis
gcgaccgcccggggcgcggacc

SEQ ID NO: 847196 - RNA, 18 nt, Mycobacterium avium subsp. paratuberculosis
gcgaccgccgccgcgacc

SEQ ID NO: 847197 - RNA, 21 nt, Mycobacterium avium subsp. paratuberculosis
gcgaccgcagcaggcggacgg

SEQ ID NO: 847198 - RNA, 15 nt, Mycobacterium avium subsp. paratuberculosis
gcgaccgcaggucga

SEQ ID NO: 847199 - RNA, 19 nt, Mycobacterium avium subsp. paratuberculosis
gcgaccgcaggucgauggc

SEQ ID NO: 847200 - RNA, 20 nt, Mycobacterium avium subsp. paratuberculosis
gcgaccgcaggucgauggcg

SEQ ID NO: 847201 - RNA, 17 nt, Mycobacterium avium subsp. paratuberculosis
gcgaccgccaccucgag

SEQ ID NO: 847202 - RNA, 17 nt, Mycobacterium avium subsp. paratuberculosis
gcgaccgaggucgacgc

SEQ ID NO: 847203 - RNA, 18 nt, Mycobacterium avium subsp. paratuberculosis
gcgaccgaggucgacgcc

SEQ ID NO: 847204 - RNA, 19 nt, Mycobacterium avium subsp. paratuberculosis
gcgaccgaggucgacgccc

SEQ ID NO: 847205 - RNA, 15 nt, Mycobacterium avium subsp. paratuberculosis
gcgaccgugcccacc

SEQ ID NO: 847206 - RNA, 22 nt, Mycobacterium avium subsp. paratuberculosis
gcgaccgugcccaccagccggc

SEQ ID NO: 847207 - RNA, 16 nt, Mycobacterium avium subsp. paratuberculosis
gcgaccgccucgucgg

SEQ ID NO: 847208 - RNA, 13 nt, Mycobacterium avium subsp. paratuberculosis
gcgaccgccuugu

SEQ ID NO: 847209 - RNA, 20 nt, Mycobacterium avium subsp. paratuberculosis
gcgaccgccuugucggcgau

SEQ ID NO: 847210 - RNA, 20 nt, Mycobacterium avium subsp. paratuberculosis
gcgaccgccgcguacagcca

SEQ ID NO: 847211 - RNA, 13 nt, Mycobacterium avium subsp. paratuberculosis
gcgaccgccggac

SEQ ID NO: 847212 - RNA, 19 nt, Mycobacterium avium subsp. paratuberculosis
gcgaccgcgacgaucacgg

SEQ ID NO: 847213 - RNA, 17 nt, Mycobacterium avium subsp. paratuberculosis
gcgaccgcgacggugga

SEQ ID NO: 847214 - RNA, 23 nt, Mycobacterium avium subsp. paratuberculosis
gcgaccgcgacgguggacccgac

SEQ ID NO: 847215 - RNA, 20 nt, Mycobacterium avium subsp. paratuberculosis
gcgaccgucgggacggccag

SEQ ID NO: 847216 - RNA, 22 nt, Mycobacterium avium subsp. paratuberculosis
gcgaccgucgggacggccagca

SEQ ID NO: 847217 - RNA, 12 nt, Mycobacterium avium subsp. paratuberculosis
gcgaccugcggc

SEQ ID NO: 847218 - RNA, 19 nt, Mycobacterium avium subsp. paratuberculosis
gcgaccugcggcucgucgg

SEQ ID NO: 847219 - RNA, 13 nt, Mycobacterium avium subsp. paratuberculosis
gcgaccugcgggc

SEQ ID NO: 847220 - RNA, 16 nt, Mycobacterium avium subsp. paratuberculosis
gcgaccugcgggccca

SEQ ID NO: 847221 - RNA, 17 nt, Mycobacterium avium subsp. paratuberculosis
gcgaccugcgggcccac

SEQ ID NO: 847222 - RNA, 12 nt, Mycobacterium avium subsp. paratuberculosis
gcgaccucgggu

SEQ ID NO: 847223 - RNA, 13 nt, Mycobacterium avium subsp. paratuberculosis
gcgaccucgggug

SEQ ID NO: 847224 - RNA, 22 nt, Mycobacterium avium subsp. paratuberculosis
gcgaccucggguguaggcccga

SEQ ID NO: 847225 - RNA, 14 nt, Mycobacterium avium subsp. paratuberculosis
gcgaccucgguggu

SEQ ID NO: 847226 - RNA, 20 nt, Mycobacterium avium subsp. paratuberculosis
gcgaccucguggucccagga

SEQ ID NO: 847227 - RNA, 20 nt, Mycobacterium avium subsp. paratuberculosis
gcgaccuccugcaaggcccc

SEQ ID NO: 847228 - RNA, 21 nt, Mycobacterium avium subsp. paratuberculosis
gcgaccuccugcaaggccccc

SEQ ID NO: 847229 - RNA, 15 nt, Mycobacterium avium subsp. paratuberculosis
gcgacggcaccgccg

SEQ ID NO: 847230 - RNA, 17 nt, Mycobacterium avium subsp. paratuberculosis
gcgacggcaccgccggc

SEQ ID NO: 847231 - RNA, 16 nt, Mycobacterium avium subsp. paratuberculosis
gcgacggccagaccgc

SEQ ID NO: 847232 - RNA, 18 nt, Mycobacterium avium subsp. paratuberculosis
gcgacggccagaccgcac

SEQ ID NO: 847233 - RNA, 16 nt, Mycobacterium avium subsp. paratuberculosis
gcgacggcagcaccuc

SEQ ID NO: 847234 - RNA, 15 nt, Mycobacterium avium subsp. paratuberculosis
gcgacggcagcgcga

SEQ ID NO: 847235 - RNA, 19 nt, Mycobacterium avium subsp. paratuberculosis
gcgacggcagcgcgauccg

SEQ ID NO: 847236 - RNA, 15 nt, Mycobacterium avium subsp. paratuberculosis
gcgacggcaggucgg

SEQ ID NO: 847237 - RNA, 15 nt, Mycobacterium avium subsp. paratuberculosis
gcgacggaucggccg

SEQ ID NO: 847238 - RNA, 16 nt, Mycobacterium avium subsp. paratuberculosis
gcgacggaucggccgc

SEQ ID NO: 847239 - RNA, 17 nt, Mycobacterium avium subsp. paratuberculosis
gcgacggaucggccgcg

SEQ ID NO: 847240 - RNA, 18 nt, Mycobacterium avium subsp. paratuberculosis
gcgacggaucggccgcgu

SEQ ID NO: 847241 - RNA, 20 nt, Mycobacterium avium subsp. paratuberculosis
gcgacggaucggccgcgucg

SEQ ID NO: 847242 - RNA, 21 nt, Mycobacterium avium subsp. paratuberculosis
gcgacggaucggccgcgucgg

SEQ ID NO: 847243 - RNA, 17 nt, Mycobacterium avium subsp. paratuberculosis
gcgacggaucugcucgu

SEQ ID NO: 847244 - RNA, 12 nt, Mycobacterium avium subsp. paratuberculosis
gcgacgccagca

SEQ ID NO: 847245 - RNA, 12 nt, Mycobacterium avium subsp. paratuberculosis
gcgacgccagcg

SEQ ID NO: 847246 - RNA, 15 nt, Mycobacterium avium subsp. paratuberculosis
gcgacgcaccucggc

SEQ ID NO: 847247 - RNA, 18 nt, Mycobacterium avium subsp. paratuberculosis
gcgacgcaccucggccgg

SEQ ID NO: 847248 - RNA, 14 nt, Mycobacterium avium subsp. paratuberculosis
gcgacgcacgccgg

SEQ ID NO: 847249 - RNA, 15 nt, Mycobacterium avium subsp. paratuberculosis
gcgacgcacgccggc

SEQ ID NO: 847250 - RNA, 16 nt, Mycobacterium avium subsp. paratuberculosis
gcgacgcacgccggcg

SEQ ID NO: 847251 - RNA, 17 nt, Mycobacterium avium subsp. paratuberculosis
gcgacgcacgccggcgg

SEQ ID NO: 847252 - RNA, 18 nt, Mycobacterium avium subsp. paratuberculosis
gcgacgcacgccggcggg

SEQ ID NO: 847253 - RNA, 17 nt, Mycobacterium avium subsp. paratuberculosis
gcgacgaugccggccgg

SEQ ID NO: 847254 - RNA, 16 nt, Mycobacterium avium subsp. paratuberculosis
gcgacgauggccaggc

SEQ ID NO: 847255 - RNA, 17 nt, Mycobacterium avium subsp. paratuberculosis
gcgacgaugucgacccg

SEQ ID NO: 847256 - RNA, 20 nt, Mycobacterium avium subsp. paratuberculosis
gcgacgaugucgacccgcgg

SEQ ID NO: 847257 - RNA, 23 nt, Mycobacterium avium subsp. paratuberculosis
gcgacgaugucgacccgcggcgc

SEQ ID NO: 847258 - RNA, 18 nt, Mycobacterium avium subsp. paratuberculosis
gcgacgaucgcgacggcc

SEQ ID NO: 847259 - RNA, 19 nt, Mycobacterium avium subsp. paratuberculosis
gcgacgaucgcgacggccg

SEQ ID NO: 847260 - RNA, 20 nt, Mycobacterium avium subsp. paratuberculosis
gcgacgaucgcgacggccgg

SEQ ID NO: 847261 - RNA, 16 nt, Mycobacterium avium subsp. paratuberculosis
gcgacgaucggcucga

SEQ ID NO: 847262 - RNA, 13 nt, Mycobacterium avium subsp. paratuberculosis
gcgacgaccgcac

SEQ ID NO: 847263 - RNA, 15 nt, Mycobacterium avium subsp. paratuberculosis
gcgacgaccgcaccg

SEQ ID NO: 847264 - RNA, 18 nt, Mycobacterium avium subsp. paratuberculosis
gcgacgaccgcaccgacc

SEQ ID NO: 847265 - RNA, 19 nt, Mycobacterium avium subsp. paratuberculosis
gcgacgaccgcaccgacca

SEQ ID NO: 847266 - RNA, 20 nt, Mycobacterium avium subsp. paratuberculosis
gcgacgaccgcaccgaccag

SEQ ID NO: 847267 - RNA, 22 nt, Mycobacterium avium subsp. paratuberculosis
gcgacgaccgcaccgaccagcg

SEQ ID NO: 847268 - RNA, 23 nt, Mycobacterium avium subsp. paratuberculosis
gcgacgaccgcaccgaccagcgg

SEQ ID NO: 847269 - RNA, 14 nt, Mycobacterium avium subsp. paratuberculosis
gcgacgaccaccag

SEQ ID NO: 847270 - RNA, 23 nt, Mycobacterium avium subsp. paratuberculosis
gcgacgaccaccaggagcaccug

SEQ ID NO: 847271 - RNA, 12 nt, Mycobacterium avium subsp. paratuberculosis
gcgacgacacca

SEQ ID NO: 847272 - RNA, 15 nt, Mycobacterium avium subsp. paratuberculosis
gcgacgacaccaccg

SEQ ID NO: 847273 - RNA, 19 nt, Mycobacterium avium subsp. paratuberculosis
gcgacgaagcagcucgcgu

SEQ ID NO: 847274 - RNA, 18 nt, Mycobacterium avium subsp. paratuberculosis
gcgacgaagucgacggcg

SEQ ID NO: 847275 - RNA, 19 nt, Mycobacterium avium subsp. paratuberculosis
gcgacgaagucgacggcgg

SEQ ID NO: 847276 - RNA, 17 nt, Mycobacterium avium subsp. paratuberculosis
gcgacgaauaucccagc

SEQ ID NO: 847277 - RNA, 19 nt, Mycobacterium avium subsp. paratuberculosis
gcgacgaauccggugaccg

SEQ ID NO: 847278 - RNA, 14 nt, Mycobacterium avium subsp. paratuberculosis
gcgacgaacgccgg

SEQ ID NO: 847279 - RNA, 16 nt, Mycobacterium avium subsp. paratuberculosis
gcgacgaagccggugc

SEQ ID NO: 847280 - RNA, 17 nt, Mycobacterium avium subsp. paratuberculosis
gcgacgaagcggucgcg

SEQ ID NO: 847281 - RNA, 13 nt, Mycobacterium avium subsp. paratuberculosis
gcgacagcggccu

SEQ ID NO: 847282 - RNA, 14 nt, Mycobacterium avium subsp. paratuberculosis
gcgacagcggccua

SEQ ID NO: 847283 - RNA, 17 nt, Mycobacterium avium subsp. paratuberculosis
gcgacaggaaccugguc

SEQ ID NO: 847284 - RNA, 22 nt, Mycobacterium avium subsp. paratuberculosis
gcgacaggaaccuggucggggu

SEQ ID NO: 847285 - RNA, 13 nt, Mycobacterium avium subsp. paratuberculosis
gcgacaccgcguc

SEQ ID NO: 847286 - RNA, 14 nt, Mycobacterium avium subsp. paratuberculosis
gcgacaccgcgucc

SEQ ID NO: 847287 - RNA, 15 nt, Mycobacterium avium subsp. paratuberculosis
gcgacaccgcguccu

SEQ ID NO: 847288 - RNA, 12 nt, Mycobacterium avium subsp. paratuberculosis
gcgacaccggac

SEQ ID NO: 847289 - RNA, 22 nt, Mycobacterium avium subsp. paratuberculosis
gcgacaccggacugcuugggcg

SEQ ID NO: 847290 - RNA, 13 nt, Mycobacterium avium subsp. paratuberculosis
gcgacaccggcgu

SEQ ID NO: 847291 - RNA, 23 nt, Mycobacterium avium subsp. paratuberculosis
gcgacaccugcucaccgagcugg

SEQ ID NO: 847292 - RNA, 15 nt, Mycobacterium avium subsp. paratuberculosis
gcgacagcgcgucgg

SEQ ID NO: 847293 - RNA, 16 nt, Mycobacterium avium subsp. paratuberculosis
gcgacagcgcgucggc

SEQ ID NO: 847294 - RNA, 18 nt, Mycobacterium avium subsp. paratuberculosis
gcgacagcgcgucggcca

SEQ ID NO: 847295 - RNA, 20 nt, Mycobacterium avium subsp. paratuberculosis
gcgacagcgcgucggccagc

SEQ ID NO: 847296 - RNA, 21 nt, Mycobacterium avium subsp. paratuberculosis
gcgacacccgcgacgacaccg

SEQ ID NO: 847297 - RNA, 22 nt, Mycobacterium avium subsp. paratuberculosis
gcgacacccgcgacgacaccgu

SEQ ID NO: 847298 - RNA, 20 nt, Mycobacterium avium subsp. paratuberculosis
gcgacaccacggugaacggg

SEQ ID NO: 847299 - RNA, 22 nt, Mycobacterium avium subsp. paratuberculosis
gccuucggcgccagcccgccga

SEQ ID NO: 847300 - RNA, 13 nt, Mycobacterium avium subsp. paratuberculosis
gcgacaccgcaug

SEQ ID NO: 847301 - RNA, 17 nt, Mycobacterium avium subsp. paratuberculosis
gcgacaccgcauggccg

SEQ ID NO: 847302 - RNA, 22 nt, Mycobacterium avium subsp. paratuberculosis
gcgacaccgcauggccggcgaa

SEQ ID NO: 847303 - RNA, 17 nt, Mycobacterium avium subsp. paratuberculosis
gcgacaaucggcucgcc

SEQ ID NO: 847304 - RNA, 17 nt, Mycobacterium avium subsp. paratuberculosis
gccuuccgcaacaucgu

SEQ ID NO: 847305 - RNA, 18 nt, Mycobacterium avium subsp. paratuberculosis
gccuucgacccgguggcc

SEQ ID NO: 847306 - RNA, 19 nt, Mycobacterium avium subsp. paratuberculosis
gccuucgacccgguggccc

SEQ ID NO: 847307 - RNA, 16 nt, Mycobacterium avium subsp. paratuberculosis
gccuucgacggccggc

SEQ ID NO: 847308 - RNA, 18 nt, Mycobacterium avium subsp. paratuberculosis
gccuucgacggccggccc

SEQ ID NO: 847309 - RNA, 13 nt, Mycobacterium avium subsp. paratuberculosis
gcgacaggucggc

SEQ ID NO: 847310 - RNA, 15 nt, Mycobacterium avium subsp. paratuberculosis
gcgacaggucggcgg

SEQ ID NO: 847311 - RNA, 22 nt, Mycobacterium avium subsp. paratuberculosis
gcgaccaauugcgagcaggccg

SEQ ID NO: 847312 - RNA, 17 nt, Mycobacterium avium subsp. paratuberculosis
gcgaccacaccgccggc

SEQ ID NO: 847313 - RNA, 18 nt, Mycobacterium avium subsp. paratuberculosis
gcgaccacaccgccggcc

SEQ ID NO: 847314 - RNA, 19 nt, Mycobacterium avium subsp. paratuberculosis
gcgaccacaccgccggcca

SEQ ID NO: 847315 - RNA, 15 nt, Mycobacterium avium subsp. paratuberculosis
gcgaccacaccgucg

SEQ ID NO: 847316 - RNA, 19 nt, Mycobacterium avium subsp. paratuberculosis
gcgaccacaccgucgacga

SEQ ID NO: 847317 - RNA, 23 nt, Mycobacterium avium subsp. paratuberculosis
gcgaccacaccgucgacgacgaa

SEQ ID NO: 847318 - RNA, 15 nt, Mycobacterium avium subsp. paratuberculosis
gcgaccacagcgccu

SEQ ID NO: 847319 - RNA, 16 nt, Mycobacterium avium subsp. paratuberculosis
gcgaccaccaccgccc

SEQ ID NO: 847320 - RNA, 22 nt, Mycobacterium avium subsp. paratuberculosis
gcgaccaccacggccgcagcgg

SEQ ID NO: 847321 - RNA, 16 nt, Mycobacterium avium subsp. paratuberculosis
gcgaccacccggacga

SEQ ID NO: 847322 - RNA, 13 nt, Mycobacterium avium subsp. paratuberculosis
gcgaccaccgacc

SEQ ID NO: 847323 - RNA, 20 nt, Mycobacterium avium subsp. paratuberculosis
gcgaccaccgaccccugcac

SEQ ID NO: 847324 - RNA, 18 nt, Mycobacterium avium subsp. paratuberculosis
gcgacaucaccgcgggcg

SEQ ID NO: 847325 - RNA, 18 nt, Mycobacterium avium subsp. paratuberculosis
gcgaccacauaccgggac

SEQ ID NO: 847326 - RNA, 13 nt, Mycobacterium avium subsp. paratuberculosis
gcgaccaccaccg

SEQ ID NO: 847327 - RNA, 15 nt, Mycobacterium avium subsp. paratuberculosis
gcgaccaccaccgcc

SEQ ID NO: 847328 - RNA, 16 nt, Mycobacterium avium subsp. paratuberculosis
aagccgaccgccccgc

SEQ ID NO: 847329 - RNA, 18 nt, Mycobacterium avium subsp. paratuberculosis
aagcccuucaccucggcc

SEQ ID NO: 847330 - RNA, 15 nt, Mycobacterium avium subsp. paratuberculosis
gcgaccaccagccgc

SEQ ID NO: 847331 - RNA, 14 nt, Mycobacterium avium subsp. paratuberculosis
gcgaccaccggccg

SEQ ID NO: 847332 - RNA, 14 nt, Mycobacterium avium subsp. paratuberculosis
gcgaccaccucggc

SEQ ID NO: 847333 - RNA, 16 nt, Mycobacterium avium subsp. paratuberculosis
gcgaccaccucggcga

SEQ ID NO: 847334 - RNA, 17 nt, Mycobacterium avium subsp. paratuberculosis
gcgaccaccucggcgac

SEQ ID NO: 847335 - RNA, 14 nt, Mycobacterium avium subsp. paratuberculosis
gcgaccacgccgcg

SEQ ID NO: 847336 - RNA, 16 nt, Mycobacterium avium subsp. paratuberculosis
gcgaccacgccgcggu

SEQ ID NO: 847337 - RNA, 17 nt, Mycobacterium avium subsp. paratuberculosis
gcgaccacgccgcgguc

SEQ ID NO: 847338 - RNA, 20 nt, Mycobacterium avium subsp. paratuberculosis
gcgaccacgccgcggucgcu

SEQ ID NO: 847339 - RNA, 22 nt, Mycobacterium avium subsp. paratuberculosis
gcgaccacgccgcggucgcuga

SEQ ID NO: 847340 - RNA, 20 nt, Mycobacterium avium subsp. paratuberculosis
gcgacccagacuugggcagc

SEQ ID NO: 847341 - RNA, 14 nt, Mycobacterium avium subsp. paratuberculosis
gcgaccagcgcgcc

SEQ ID NO: 847342 - RNA, 15 nt, Mycobacterium avium subsp. paratuberculosis
gcgaccagcgcgccg

SEQ ID NO: 847343 - RNA, 15 nt, Mycobacterium avium subsp. paratuberculosis
gcgaccaugcccagc

SEQ ID NO: 847344 - RNA, 17 nt, Mycobacterium avium subsp. paratuberculosis
gcgaccaugcccagcag

SEQ ID NO: 847345 - RNA, 18 nt, Mycobacterium avium subsp. paratuberculosis
gcgaccaugcccagcagu

SEQ ID NO: 847346 - RNA, 19 nt, Mycobacterium avium subsp. paratuberculosis
gcgaccaugcccagcaguc

SEQ ID NO: 847347 - RNA, 16 nt, Mycobacterium avium subsp. paratuberculosis
gcgaccaugcccggcg

SEQ ID NO: 847348 - RNA, 13 nt, Mycobacterium avium subsp. paratuberculosis
gcgaccaugccgc

SEQ ID NO: 847349 - RNA, 14 nt, Mycobacterium avium subsp. paratuberculosis
gcgaccaugccgcg

SEQ ID NO: 847350 - RNA, 19 nt, Mycobacterium avium subsp. paratuberculosis
gcgaccaugccgcgggcca

SEQ ID NO: 847351 - RNA, 20 nt, Mycobacterium avium subsp. paratuberculosis
gcgaccaugccgcgggccag

SEQ ID NO: 847352 - RNA, 21 nt, Mycobacterium avium subsp. paratuberculosis
gcgaccaugccgcgggccagc

SEQ ID NO: 847353 - RNA, 18 nt, Mycobacterium avium subsp. paratuberculosis
gcgaccagauaggccagc

SEQ ID NO: 847354 - RNA, 19 nt, Mycobacterium avium subsp. paratuberculosis
gcgaccagcaggucgagca

SEQ ID NO: 847355 - RNA, 15 nt, Mycobacterium avium subsp. paratuberculosis
gcgaccagcccggcc

SEQ ID NO: 847356 - RNA, 16 nt, Mycobacterium avium subsp. paratuberculosis
gcgaccagcccggccg

SEQ ID NO: 847357 - RNA, 17 nt, Mycobacterium avium subsp. paratuberculosis
gcgaccagcccggccgc

SEQ ID NO: 847358 - RNA, 19 nt, Mycobacterium avium subsp. paratuberculosis
gcgaccagcccggccgccg

SEQ ID NO: 847359 - RNA, 20 nt, Mycobacterium avium subsp. paratuberculosis
gcgaccagcccggccgccga

SEQ ID NO: 847360 - RNA, 17 nt, Mycobacterium avium subsp. paratuberculosis
gcgaccagcgagcccag

SEQ ID NO: 847361 - RNA, 18 nt, Mycobacterium avium subsp. paratuberculosis
gcgaccagcgagcccagc

SEQ ID NO: 847362 - RNA, 20 nt, Mycobacterium avium subsp. paratuberculosis
gcgaccagcgagcccagcug

SEQ ID NO: 847363 - RNA, 17 nt, Mycobacterium avium subsp. paratuberculosis
gcgcgaccgcccgggcc

SEQ ID NO: 847364 - RNA, 21 nt, Mycobacterium avium subsp. paratuberculosis
gcgcgaucaacgggucgagca

SEQ ID NO: 847365 - RNA, 14 nt, Mycobacterium avium subsp. paratuberculosis
gcgcgaucgguguc

SEQ ID NO: 847366 - RNA, 16 nt, Mycobacterium avium subsp. paratuberculosis
gcgcgaucggugucca

SEQ ID NO: 847367 - RNA, 14 nt, Mycobacterium avium subsp. paratuberculosis
gcgcgaucgucgac

SEQ ID NO: 847368 - RNA, 16 nt, Mycobacterium avium subsp. paratuberculosis
gcgcgauagccgguga

SEQ ID NO: 847369 - RNA, 23 nt, Mycobacterium avium subsp. paratuberculosis
gcgcgauagccggugaucgcggc

SEQ ID NO: 847370 - RNA, 15 nt, Mycobacterium avium subsp. paratuberculosis
gcgcgaugaucgccg

SEQ ID NO: 847371 - RNA, 15 nt, Mycobacterium avium subsp. paratuberculosis
gcgcgaucgucgacc

SEQ ID NO: 847372 - RNA, 20 nt, Mycobacterium avium subsp. paratuberculosis
gcgcgaucuccgucaccgug

SEQ ID NO: 847373 - RNA, 16 nt, Mycobacterium avium subsp. paratuberculosis
gcgcgaugcgggcgcc

SEQ ID NO: 847374 - RNA, 18 nt, Mycobacterium avium subsp. paratuberculosis
gcgcgaugcgggcgccga

SEQ ID NO: 847375 - RNA, 19 nt, Mycobacterium avium subsp. paratuberculosis
gcgcgaugcgggcgccgaa

SEQ ID NO: 847376 - RNA, 21 nt, Mycobacterium avium subsp. paratuberculosis
gcgcgaugcuauucgggccag

SEQ ID NO: 847377 - RNA, 23 nt, Mycobacterium avium subsp. paratuberculosis
gcgcgaugcuauucgggccagcc

SEQ ID NO: 847378 - RNA, 16 nt, Mycobacterium avium subsp. paratuberculosis
gcgcgauguccgacag

SEQ ID NO: 847379 - RNA, 21 nt, Mycobacterium avium subsp. paratuberculosis
gcgcgauguccgacagcccgc

SEQ ID NO: 847380 - RNA, 16 nt, Mycobacterium avium subsp. paratuberculosis
gcgcgaugucgacggu

SEQ ID NO: 847381 - RNA, 16 nt, Mycobacterium avium subsp. paratuberculosis
gcgcgaugccggccag

SEQ ID NO: 847382 - RNA, 15 nt, Mycobacterium avium subsp. paratuberculosis
gcgcgauggacagca

SEQ ID NO: 847383 - RNA, 12 nt, Mycobacterium avium subsp. paratuberculosis
gcgcgagucgag

SEQ ID NO: 847384 - RNA, 14 nt, Mycobacterium avium subsp. paratuberculosis
gcgcgagucgagca

SEQ ID NO: 847385 - RNA, 18 nt, Mycobacterium avium subsp. paratuberculosis
gcgcgagucgagcaccgc

SEQ ID NO: 847386 - RNA, 21 nt, Mycobacterium avium subsp. paratuberculosis
gcgcgagucgagcaccgcgac

SEQ ID NO: 847387 - RNA, 24 nt, Mycobacterium avium subsp. paratuberculosis
gcgcgagucgagcaccgcgaccac

SEQ ID NO: 847388 - RNA, 17 nt, Mycobacterium avium subsp. paratuberculosis
gcgcgaguaggcgaaga

SEQ ID NO: 847389 - RNA, 20 nt, Mycobacterium avium subsp. paratuberculosis
gcgcgaggucgacggagucg

SEQ ID NO: 847390 - RNA, 23 nt, Mycobacterium avium subsp. paratuberculosis
gcgcgaggucgacggagucgucg

SEQ ID NO: 847391 - RNA, 13 nt, Mycobacterium avium subsp. paratuberculosis
gcgcgaggcgggu

SEQ ID NO: 847392 - RNA, 18 nt, Mycobacterium avium subsp. paratuberculosis
gcgcgaggaggggucggu

SEQ ID NO: 847393 - RNA, 19 nt, Mycobacterium avium subsp. paratuberculosis
gcgcgaagcccucgaagca

SEQ ID NO: 847394 - RNA, 22 nt, Mycobacterium avium subsp. paratuberculosis
gcgcgaccccuacgggcgcacc

SEQ ID NO: 847395 - RNA, 17 nt, Mycobacterium avium subsp. paratuberculosis
gcgcgacccgcucgacg

SEQ ID NO: 847396 - RNA, 22 nt, Mycobacterium avium subsp. paratuberculosis
gcgcgacccgcucgacgcgcac

SEQ ID NO: 847397 - RNA, 14 nt, Mycobacterium avium subsp. paratuberculosis
gcgcgaccaucagc

SEQ ID NO: 847398 - RNA, 13 nt, Mycobacterium avium subsp. paratuberculosis
gcgcgaccaguac

SEQ ID NO: 847399 - RNA, 18 nt, Mycobacterium avium subsp. paratuberculosis
gcgcgaccaguaccgggc

SEQ ID NO: 847400 - RNA, 19 nt, Mycobacterium avium subsp. paratuberculosis
gcgcgaccagugcaccucg

SEQ ID NO: 847401 - RNA, 14 nt, Mycobacterium avium subsp. paratuberculosis
gcgcgaccagcccg

SEQ ID NO: 847402 - RNA, 15 nt, Mycobacterium avium subsp. paratuberculosis
gcgcgaccagcccgg

SEQ ID NO: 847403 - RNA, 18 nt, Mycobacterium avium subsp. paratuberculosis
gcgcgaccagcggcagca

SEQ ID NO: 847404 - RNA, 20 nt, Mycobacterium avium subsp. paratuberculosis
gcgcgaccaaacgcagcguc

SEQ ID NO: 847405 - RNA, 13 nt, Mycobacterium avium subsp. paratuberculosis
gcgcgaacaaucg

SEQ ID NO: 847406 - RNA, 22 nt, Mycobacterium avium subsp. paratuberculosis
gcgcgaacaaucgcugcgagcc

SEQ ID NO: 847407 - RNA, 20 nt, Mycobacterium avium subsp. paratuberculosis
gcgcgaaagcagcaacggcg

SEQ ID NO: 847408 - RNA, 23 nt, Mycobacterium avium subsp. paratuberculosis
gcgcgaaagcagcaacggcggcg

SEQ ID NO: 847409 - RNA, 14 nt, Mycobacterium avium subsp. paratuberculosis
gcgcgaaagcgcga

SEQ ID NO: 847410 - RNA, 21 nt, Mycobacterium avium subsp. paratuberculosis
gcgcgaaaggcccaccgcugg

SEQ ID NO: 847411 - RNA, 17 nt, Mycobacterium avium subsp. paratuberculosis
gcgcgaaauacgacgag

SEQ ID NO: 847412 - RNA, 21 nt, Mycobacterium avium subsp. paratuberculosis
gcgcgaacagccgaccgauca

SEQ ID NO: 847413 - RNA, 13 nt, Mycobacterium avium subsp. paratuberculosis
gcgcgaacagcga

SEQ ID NO: 847414 - RNA, 17 nt, Mycobacterium avium subsp. paratuberculosis
gcgcgaacagcgaagcc

SEQ ID NO: 847415 - RNA, 18 nt, Mycobacterium avium subsp. paratuberculosis
gcgcgaacagcgaagcca

SEQ ID NO: 847416 - RNA, 15 nt, Mycobacterium avium subsp. paratuberculosis
gcgcgaacagcgccg

SEQ ID NO: 847417 - RNA, 16 nt, Mycobacterium avium subsp. paratuberculosis
gcgcgaacagcgccga

SEQ ID NO: 847418 - RNA, 21 nt, Mycobacterium avium subsp. paratuberculosis
gcgcgaacagcgccgacuugg

SEQ ID NO: 847419 - RNA, 14 nt, Mycobacterium avium subsp. paratuberculosis
gcgcgaacagcgcg

SEQ ID NO: 847420 - RNA, 16 nt, Mycobacterium avium subsp. paratuberculosis
gcgcgaacagcgcggc

SEQ ID NO: 847421 - RNA, 17 nt, Mycobacterium avium subsp. paratuberculosis
gcgcgaacagcgcggcc

SEQ ID NO: 847422 - RNA, 17 nt, Mycobacterium avium subsp. paratuberculosis
gcgcgacaucaccgcgg

SEQ ID NO: 847423 - RNA, 19 nt, Mycobacterium avium subsp. paratuberculosis
gcgcgacaucaccgcgggc

SEQ ID NO: 847424 - RNA, 12 nt, Mycobacterium avium subsp. paratuberculosis
gcgcgacaucgc

SEQ ID NO: 847425 - RNA, 14 nt, Mycobacterium avium subsp. paratuberculosis
gcgcgacaucgccg

SEQ ID NO: 847426 - RNA, 13 nt, Mycobacterium avium subsp. paratuberculosis
gcgcgaaccgggc

SEQ ID NO: 847427 - RNA, 19 nt, Mycobacterium avium subsp. paratuberculosis
gcgcgaaaaaacggcggcg

SEQ ID NO: 847428 - RNA, 20 nt, Mycobacterium avium subsp. paratuberculosis
gcgcgaaaaaacggcggcgg

SEQ ID NO: 847429 - RNA, 16 nt, Mycobacterium avium subsp. paratuberculosis
gcgccuuuugcacccg

SEQ ID NO: 847430 - RNA, 17 nt, Mycobacterium avium subsp. paratuberculosis
gcgccuuuugcacccgc

SEQ ID NO: 847431 - RNA, 15 nt, Mycobacterium avium subsp. paratuberculosis
gcgcgaaaaccagca

SEQ ID NO: 847432 - RNA, 16 nt, Mycobacterium avium subsp. paratuberculosis
gcgcgaaaaccagcac

SEQ ID NO: 847433 - RNA, 18 nt, Mycobacterium avium subsp. paratuberculosis
gcgcgaaaaccagcaccg

SEQ ID NO: 847434 - RNA, 19 nt, Mycobacterium avium subsp. paratuberculosis
gcgcgaaaaccagcaccgg

SEQ ID NO: 847435 - RNA, 20 nt, Mycobacterium avium subsp. paratuberculosis
gcgcgaaaaccagcaccggc

SEQ ID NO: 847436 - RNA, 21 nt, Mycobacterium avium subsp. paratuberculosis
gcgcgaaaaccagcaccggca

SEQ ID NO: 847437 - RNA, 15 nt, Mycobacterium avium subsp. paratuberculosis
gcgccuuggccucgg

SEQ ID NO: 847438 - RNA, 15 nt, Mycobacterium avium subsp. paratuberculosis
gcgccuugccgacga

SEQ ID NO: 847439 - RNA, 16 nt, Mycobacterium avium subsp. paratuberculosis
gcgccuugccgacgac

SEQ ID NO: 847440 - RNA, 17 nt, Mycobacterium avium subsp. paratuberculosis
gcgccuugccgacgacg

SEQ ID NO: 847441 - RNA, 23 nt, Mycobacterium avium subsp. paratuberculosis
gcgccuugccgacgacgucguag

SEQ ID NO: 847442 - RNA, 24 nt, Mycobacterium avium subsp. paratuberculosis
gcgccuugccgucgagcaggguga

SEQ ID NO: 847443 - RNA, 21 nt, Mycobacterium avium subsp. paratuberculosis
gcgccugggcguacagcggcg

SEQ ID NO: 847444 - RNA, 17 nt, Mycobacterium avium subsp. paratuberculosis
gcgccugguccucccgg

SEQ ID NO: 847445 - RNA, 23 nt, Mycobacterium avium subsp. paratuberculosis
gcgccugguccucccgggugggc

SEQ ID NO: 847446 - RNA, 15 nt, Mycobacterium avium subsp. paratuberculosis
gcgccuucgacccgg

SEQ ID NO: 847447 - RNA, 21 nt, Mycobacterium avium subsp. paratuberculosis
gcgccuugaccgcguuggcgc

SEQ ID NO: 847448 - RNA, 14 nt, Mycobacterium avium subsp. paratuberculosis
gcgccuugaaccgg

SEQ ID NO: 847449 - RNA, 22 nt, Mycobacterium avium subsp. paratuberculosis
gcgccuucuccagcuccucggu

SEQ ID NO: 847450 - RNA, 20 nt, Mycobacterium avium subsp. paratuberculosis
gcgccuucggcgccagcccg

SEQ ID NO: 847451 - RNA, 21 nt, Mycobacterium avium subsp. paratuberculosis
gcgccuucggcgccagcccgc

SEQ ID NO: 847452 - RNA, 19 nt, Mycobacterium avium subsp. paratuberculosis
gcgccuucuugcugcccgc

SEQ ID NO: 847453 - RNA, 21 nt, Mycobacterium avium subsp. paratuberculosis
gcgccuucuugcugcccgcgg

SEQ ID NO: 847454 - RNA, 15 nt, Mycobacterium avium subsp. paratuberculosis
gcgccuucuuggccg

SEQ ID NO: 847455 - RNA, 16 nt, Mycobacterium avium subsp. paratuberculosis
gcgccuucuuggccgc

SEQ ID NO: 847456 - RNA, 17 nt, Mycobacterium avium subsp. paratuberculosis
gcgccuucuuggccgcg

SEQ ID NO: 847457 - RNA, 19 nt, Mycobacterium avium subsp. paratuberculosis
gcgccuucuuggccgcgcc

SEQ ID NO: 847458 - RNA, 21 nt, Mycobacterium avium subsp. paratuberculosis
gcgccuucuuggccgcgcccu

SEQ ID NO: 847459 - RNA, 17 nt, Mycobacterium avium subsp. paratuberculosis
gcgccuucuuggcggcg

SEQ ID NO: 847460 - RNA, 18 nt, Mycobacterium avium subsp. paratuberculosis
gcgccuucuuggcggcgg

SEQ ID NO: 847461 - RNA, 15 nt, Mycobacterium avium subsp. paratuberculosis
gcgccugcaccggcg

SEQ ID NO: 847462 - RNA, 16 nt, Mycobacterium avium subsp. paratuberculosis
gcgccugcaccggcga

SEQ ID NO: 847463 - RNA, 18 nt, Mycobacterium avium subsp. paratuberculosis
gcgccugcaccggcgacg

SEQ ID NO: 847464 - RNA, 17 nt, Mycobacterium avium subsp. paratuberculosis
gcgccugcacgcaggcc

SEQ ID NO: 847465 - RNA, 16 nt, Mycobacterium avium subsp. paratuberculosis
gcgccugcacggugcc

SEQ ID NO: 847466 - RNA, 17 nt, Mycobacterium avium subsp. paratuberculosis
gcgccugcacggugccg

SEQ ID NO: 847467 - RNA, 13 nt, Mycobacterium avium subsp. paratuberculosis
gcgccugcccgga

SEQ ID NO: 847468 - RNA, 21 nt, Mycobacterium avium subsp. paratuberculosis
gcgccucgugcaugugcucgg

SEQ ID NO: 847469 - RNA, 21 nt, Mycobacterium avium subsp. paratuberculosis
gcgccugccuggccacguggu

SEQ ID NO: 847470 - RNA, 20 nt, Mycobacterium avium subsp. paratuberculosis
gcgccugcgagcacacccuc

SEQ ID NO: 847471 - RNA, 14 nt, Mycobacterium avium subsp. paratuberculosis
gcgccugccuggcc

SEQ ID NO: 847472 - RNA, 14 nt, Mycobacterium avium subsp. paratuberculosis
gcgccugauccgcg

SEQ ID NO: 847473 - RNA, 14 nt, Mycobacterium avium subsp. paratuberculosis
gcgccucggcggcc

SEQ ID NO: 847474 - RNA, 21 nt, Mycobacterium avium subsp. paratuberculosis
gcgccucggugaagccgcgga

SEQ ID NO: 847475 - RNA, 17 nt, Mycobacterium avium subsp. paratuberculosis
gcgccucggcgccucgg

SEQ ID NO: 847476 - RNA, 19 nt, Mycobacterium avium subsp. paratuberculosis
gcgccucggcgccucggcg

SEQ ID NO: 847477 - RNA, 20 nt, Mycobacterium avium subsp. paratuberculosis
gcgccucggcgccucggcgu

SEQ ID NO: 847478 - RNA, 15 nt, Mycobacterium avium subsp. paratuberculosis
gcgccucggcggccc

SEQ ID NO: 847479 - RNA, 16 nt, Mycobacterium avium subsp. paratuberculosis
gcgccucggcggcccc

SEQ ID NO: 847480 - RNA, 16 nt, Mycobacterium avium subsp. paratuberculosis
gcgccucggcgggccg

SEQ ID NO: 847481 - RNA, 17 nt, Mycobacterium avium subsp. paratuberculosis
gcgccucggcgggccgc

SEQ ID NO: 847482 - RNA, 23 nt, Mycobacterium avium subsp. paratuberculosis
gcgccucggcgggccgcccggcg

SEQ ID NO: 847483 - RNA, 17 nt, Mycobacterium avium subsp. paratuberculosis
gcgccucggcgucaccg

SEQ ID NO: 847484 - RNA, 18 nt, Mycobacterium avium subsp. paratuberculosis
gcgccucggcgucaccgc

SEQ ID NO: 847485 - RNA, 19 nt, Mycobacterium avium subsp. paratuberculosis
gcgccucggcgucaccgcg

SEQ ID NO: 847486 - RNA, 20 nt, Mycobacterium avium subsp. paratuberculosis
gcgccucggcgucaccgcgg

SEQ ID NO: 847487 - RNA, 14 nt, Mycobacterium avium subsp. paratuberculosis
gcgccucggcgucc

SEQ ID NO: 847488 - RNA, 19 nt, Mycobacterium avium subsp. paratuberculosis
gcgccucggcgucccggcg

SEQ ID NO: 847489 - RNA, 21 nt, Mycobacterium avium subsp. paratuberculosis
gcgccucggcgucccggcguc

SEQ ID NO: 847490 - RNA, 15 nt, Mycobacterium avium subsp. paratuberculosis
gcgccucggcguggc

SEQ ID NO: 847491 - RNA, 21 nt, Mycobacterium avium subsp. paratuberculosis
gcgccucggcguggcaggcga

SEQ ID NO: 847492 - RNA, 14 nt, Mycobacterium avium subsp. paratuberculosis
gcgccucgccgacc

SEQ ID NO: 847493 - RNA, 19 nt, Mycobacterium avium subsp. paratuberculosis
gcgccucgcuaaucgccgc

SEQ ID NO: 847494 - RNA, 12 nt, Mycobacterium avium subsp. paratuberculosis
gcgccucggccu

SEQ ID NO: 847495 - RNA, 14 nt, Mycobacterium avium subsp. paratuberculosis
gcgccucggccucg

SEQ ID NO: 847496 - RNA, 22 nt, Mycobacterium avium subsp. paratuberculosis
gcgccucggccucgucgacguc

SEQ ID NO: 847497 - RNA, 14 nt, Mycobacterium avium subsp. paratuberculosis
gcgccucggccugc

SEQ ID NO: 847498 - RNA, 15 nt, Mycobacterium avium subsp. paratuberculosis
gcgccucggccugcg

SEQ ID NO: 847499 - RNA, 19 nt, Mycobacterium avium subsp. paratuberculosis
gcgccucggccugcgcccg

SEQ ID NO: 847500 - RNA, 23 nt, Mycobacterium avium subsp. paratuberculosis
gcgccucggcgaucggccgcugc

SEQ ID NO: 847501 - RNA, 19 nt, Mycobacterium avium subsp. paratuberculosis
gcgccguuucggacgagcc

SEQ ID NO: 847502 - RNA, 14 nt, Mycobacterium avium subsp. paratuberculosis
gcgccuccagccgc

SEQ ID NO: 847503 - RNA, 17 nt, Mycobacterium avium subsp. paratuberculosis
gcgccucgaugcgggug

SEQ ID NO: 847504 - RNA, 20 nt, Mycobacterium avium subsp. paratuberculosis
gcgccucgagcaacggccgc

SEQ ID NO: 847505 - RNA, 21 nt, Mycobacterium avium subsp. paratuberculosis
gcgccucgagcaacggccgca

SEQ ID NO: 847506 - RNA, 18 nt, Mycobacterium avium subsp. paratuberculosis
gcgccucgagcaccacgg

SEQ ID NO: 847507 - RNA, 22 nt, Mycobacterium avium subsp. paratuberculosis
gcgccucgagcaccacggcccg

SEQ ID NO: 847508 - RNA, 17 nt, Mycobacterium avium subsp. paratuberculosis
gcgccucgaucaacgcc

SEQ ID NO: 847509 - RNA, 14 nt, Mycobacterium avium subsp. paratuberculosis
gcgccucgccgggc

SEQ ID NO: 847510 - RNA, 15 nt, Mycobacterium avium subsp. paratuberculosis
gcgccucgccgggcc

SEQ ID NO: 847511 - RNA, 17 nt, Mycobacterium avium subsp. paratuberculosis
gcgccucccggaccacc

SEQ ID NO: 847512 - RNA, 13 nt, Mycobacterium avium subsp. paratuberculosis
gcgccuccgacga

SEQ ID NO: 847513 - RNA, 14 nt, Mycobacterium avium subsp. paratuberculosis
gcgccuccgcccgg

SEQ ID NO: 847514 - RNA, 17 nt, Mycobacterium avium subsp. paratuberculosis
gcgccucgaacaucggc

SEQ ID NO: 847515 - RNA, 22 nt, Mycobacterium avium subsp. paratuberculosis
gcgccuaccggguggccagcac

SEQ ID NO: 847516 - RNA, 15 nt, Mycobacterium avium subsp. paratuberculosis
gcgccguugaccggc

SEQ ID NO: 847517 - RNA, 16 nt, Mycobacterium avium subsp. paratuberculosis
gcgccguugauugcgc

SEQ ID NO: 847518 - RNA, 19 nt, Mycobacterium avium subsp. paratuberculosis
gcgccguugauugcgcccg

SEQ ID NO: 847519 - RNA, 21 nt, Mycobacterium avium subsp. paratuberculosis
gcgccguugauugcgcccgcc

SEQ ID NO: 847520 - RNA, 22 nt, Mycobacterium avium subsp. paratuberculosis
gcgccguugauugcgcccgccg

SEQ ID NO: 847521 - RNA, 23 nt, Mycobacterium avium subsp. paratuberculosis
gcgccguugauugcgcccgccga

SEQ ID NO: 847522 - RNA, 21 nt, Mycobacterium avium subsp. paratuberculosis
gcgccguuguaggccgcgcgg

SEQ ID NO: 847523 - RNA, 14 nt, Mycobacterium avium subsp. paratuberculosis
gcgccgugcgccag

SEQ ID NO: 847524 - RNA, 15 nt, Mycobacterium avium subsp. paratuberculosis
gcgccgugcgccagc

SEQ ID NO: 847525 - RNA, 18 nt, Mycobacterium avium subsp. paratuberculosis
gcgccgugcgccagcgac

SEQ ID NO: 847526 - RNA, 13 nt, Mycobacterium avium subsp. paratuberculosis
gcgccguggccca

SEQ ID NO: 847527 - RNA, 22 nt, Mycobacterium avium subsp. paratuberculosis
gcgccguggcccauguggccug

SEQ ID NO: 847528 - RNA, 17 nt, Mycobacterium avium subsp. paratuberculosis
gcgccguggcccggucg

SEQ ID NO: 847529 - RNA, 14 nt, Mycobacterium avium subsp. paratuberculosis
gcgccgugccgcgc

SEQ ID NO: 847530 - RNA, 19 nt, Mycobacterium avium subsp. paratuberculosis
gcgccgugccgcgcggcga

SEQ ID NO: 847531 - RNA, 20 nt, Mycobacterium avium subsp. paratuberculosis
gcgccgugccgcgcggcgau

SEQ ID NO: 847532 - RNA, 12 nt, Mycobacterium avium subsp. paratuberculosis
gcgccgucggcg

SEQ ID NO: 847533 - RNA, 13 nt, Mycobacterium avium subsp. paratuberculosis
gcgccgucggcga

SEQ ID NO: 847534 - RNA, 21 nt, Mycobacterium avium subsp. paratuberculosis
gcgccgugcagcacgccgcgg

SEQ ID NO: 847535 - RNA, 22 nt, Mycobacterium avium subsp. paratuberculosis
gcgccgugcagcacgccgcgga

SEQ ID NO: 847536 - RNA, 13 nt, Mycobacterium avium subsp. paratuberculosis
gcgccgugcagga

SEQ ID NO: 847537 - RNA, 18 nt, Mycobacterium avium subsp. paratuberculosis
gcgccgugcaggaugacc

SEQ ID NO: 847538 - RNA, 20 nt, Mycobacterium avium subsp. paratuberculosis
gcgccgugcaggaugaccgc

SEQ ID NO: 847539 - RNA, 16 nt, Mycobacterium avium subsp. paratuberculosis
gcgccgugcccaacac

SEQ ID NO: 847540 - RNA, 18 nt, Mycobacterium avium subsp. paratuberculosis
gcgccgucgccgacguug

SEQ ID NO: 847541 - RNA, 15 nt, Mycobacterium avium subsp. paratuberculosis
gcgccgucgccgccg

SEQ ID NO: 847542 - RNA, 18 nt, Mycobacterium avium subsp. paratuberculosis
gcgccgucgccgccguga

SEQ ID NO: 847543 - RNA, 14 nt, Mycobacterium avium subsp. paratuberculosis
gcgccgucgccgga

SEQ ID NO: 847544 - RNA, 16 nt, Mycobacterium avium subsp. paratuberculosis
gcgccgucggcccacg

SEQ ID NO: 847545 - RNA, 23 nt, Mycobacterium avium subsp. paratuberculosis
gcgccgucggcgaugcggugguc

SEQ ID NO: 847546 - RNA, 13 nt, Mycobacterium avium subsp. paratuberculosis
gcgccgucggcgg

SEQ ID NO: 847547 - RNA, 14 nt, Mycobacterium avium subsp. paratuberculosis
gcgccgucggcggg

SEQ ID NO: 847548 - RNA, 15 nt, Mycobacterium avium subsp. paratuberculosis
gcgccgugacgccga

SEQ ID NO: 847549 - RNA, 22 nt, Mycobacterium avium subsp. paratuberculosis
gcgccgucgauccacccaccgg

SEQ ID NO: 847550 - RNA, 23 nt, Mycobacterium avium subsp. paratuberculosis
gcgccgucgauccacccaccggc

SEQ ID NO: 847551 - RNA, 14 nt, Mycobacterium avium subsp. paratuberculosis
gcgccgucgauggc

SEQ ID NO: 847552 - RNA, 18 nt, Mycobacterium avium subsp. paratuberculosis
gcgccgucgauggcgcgg

SEQ ID NO: 847553 - RNA, 23 nt, Mycobacterium avium subsp. paratuberculosis
gcgccgucgauggcgcggcccag

SEQ ID NO: 847554 - RNA, 13 nt, Mycobacterium avium subsp. paratuberculosis
gcgccgucgacca

SEQ ID NO: 847555 - RNA, 17 nt, Mycobacterium avium subsp. paratuberculosis
gcgccgucgaccagcuu

SEQ ID NO: 847556 - RNA, 13 nt, Mycobacterium avium subsp. paratuberculosis
gcgccgucgagga

SEQ ID NO: 847557 - RNA, 17 nt, Mycobacterium avium subsp. paratuberculosis
gcgccguccuuggucac

SEQ ID NO: 847558 - RNA, 18 nt, Mycobacterium avium subsp. paratuberculosis
gcgccgucgaacacguug

SEQ ID NO: 847559 - RNA, 22 nt, Mycobacterium avium subsp. paratuberculosis
gcgccgucgaacacguugcgca

SEQ ID NO: 847560 - RNA, 21 nt, Mycobacterium avium subsp. paratuberculosis
gcgccguccuccucgucggcu

SEQ ID NO: 847561 - RNA, 13 nt, Mycobacterium avium subsp. paratuberculosis
gcgccggucggcg

SEQ ID NO: 847562 - RNA, 14 nt, Mycobacterium avium subsp. paratuberculosis
gcgccggucggcgg

SEQ ID NO: 847563 - RNA, 15 nt, Mycobacterium avium subsp. paratuberculosis
gcgccggucggcgga

SEQ ID NO: 847564 - RNA, 12 nt, Mycobacterium avium subsp. paratuberculosis
gcgccggucggu

SEQ ID NO: 847565 - RNA, 14 nt, Mycobacterium avium subsp. paratuberculosis
gcgccggucggugc

SEQ ID NO: 847566 - RNA, 17 nt, Mycobacterium avium subsp. paratuberculosis
gcgccggucggugcgau

SEQ ID NO: 847567 - RNA, 15 nt, Mycobacterium avium subsp. paratuberculosis
gcgccguccgcaccg

SEQ ID NO: 847568 - RNA, 16 nt, Mycobacterium avium subsp. paratuberculosis
gcgccguccgcaccgc

SEQ ID NO: 847569 - RNA, 21 nt, Mycobacterium avium subsp. paratuberculosis
gcgccguccgcaccgcgacga

SEQ ID NO: 847570 - RNA, 14 nt, Mycobacterium avium subsp. paratuberculosis
gcgccguccgcggc

SEQ ID NO: 847571 - RNA, 18 nt, Mycobacterium avium subsp. paratuberculosis
gcgccguccgcggcggcc

SEQ ID NO: 847572 - RNA, 20 nt, Mycobacterium avium subsp. paratuberculosis
gcgccguccgcggcggccag

SEQ ID NO: 847573 - RNA, 13 nt, Mycobacterium avium subsp. paratuberculosis
gcgccguccggcc

SEQ ID NO: 847574 - RNA, 21 nt, Mycobacterium avium subsp. paratuberculosis
gcgccguccggccacgaccuc

SEQ ID NO: 847575 - RNA, 15 nt, Mycobacterium avium subsp. paratuberculosis
gcgccggucccgcgg

SEQ ID NO: 847576 - RNA, 15 nt, Mycobacterium avium subsp. paratuberculosis
gcgccggucagcggc

SEQ ID NO: 847577 - RNA, 21 nt, Mycobacterium avium subsp. paratuberculosis
gcgccggucagcggcaacacg

SEQ ID NO: 847578 - RNA, 20 nt, Mycobacterium avium subsp. paratuberculosis
gcgccgggaucacacgcgcg

SEQ ID NO: 847579 - RNA, 17 nt, Mycobacterium avium subsp. paratuberculosis
gcgccgggaucggcagc

SEQ ID NO: 847580 - RNA, 21 nt, Mycobacterium avium subsp. paratuberculosis
gcgccggguuguagcaggcgg

SEQ ID NO: 847581 - RNA, 18 nt, Mycobacterium avium subsp. paratuberculosis
gcgccgguaaugggcgau

SEQ ID NO: 847582 - RNA, 18 nt, Mycobacterium avium subsp. paratuberculosis
gcgccgguagagcgccag

SEQ ID NO: 847583 - RNA, 15 nt, Mycobacterium avium subsp. paratuberculosis
gcgccgguagcgaca

SEQ ID NO: 847584 - RNA, 15 nt, Mycobacterium avium subsp. paratuberculosis
gcgccgguaggccgc

SEQ ID NO: 847585 - RNA, 18 nt, Mycobacterium avium subsp. paratuberculosis
gcgccgguaggccgcgcc

SEQ ID NO: 847586 - RNA, 19 nt, Mycobacterium avium subsp. paratuberculosis
gcgccgguaggccgcgccg

SEQ ID NO: 847587 - RNA, 17 nt, Mycobacterium avium subsp. paratuberculosis
gcgccgguaggcgcggg

SEQ ID NO: 847588 - RNA, 17 nt, Mycobacterium avium subsp. paratuberculosis
gcgccgguaggcggcca

SEQ ID NO: 847589 - RNA, 23 nt, Mycobacterium avium subsp. paratuberculosis
gcgccgguaggcggccagcgccc

SEQ ID NO: 847590 - RNA, 19 nt, Mycobacterium avium subsp. paratuberculosis
gcgccgguauauucgcgau

SEQ ID NO: 847591 - RNA, 16 nt, Mycobacterium avium subsp. paratuberculosis
gcgccgguaucgagca

SEQ ID NO: 847592 - RNA, 22 nt, Mycobacterium avium subsp. paratuberculosis
gcgccggguugcaggcgcccag

SEQ ID NO: 847593 - RNA, 12 nt, Mycobacterium avium subsp. paratuberculosis
gcgccgggcgga

SEQ ID NO: 847594 - RNA, 16 nt, Mycobacterium avium subsp. paratuberculosis
gcgccgggcggcccgc

SEQ ID NO: 847595 - RNA, 15 nt, Mycobacterium avium subsp. paratuberculosis
gcgccgggcggccuc

SEQ ID NO: 847596 - RNA, 18 nt, Mycobacterium avium subsp. paratuberculosis
gcgccgggcggccucggc

SEQ ID NO: 847597 - RNA, 14 nt, Mycobacterium avium subsp. paratuberculosis
gcgccggguggccg

SEQ ID NO: 847598 - RNA, 19 nt, Mycobacterium avium subsp. paratuberculosis
gcgccggguggccggggcc

SEQ ID NO: 847599 - RNA, 22 nt, Mycobacterium avium subsp. paratuberculosis
gcgccggguggccggggccauc

SEQ ID NO: 847600 - RNA, 13 nt, Mycobacterium avium subsp. paratuberculosis
gcgccggguggcg

SEQ ID NO: 847601 - RNA, 14 nt, Mycobacterium avium subsp. paratuberculosis
gcgccgggcgaagu

SEQ ID NO: 847602 - RNA, 19 nt, Mycobacterium avium subsp. paratuberculosis
gcgccgggcgaagucgccg

SEQ ID NO: 847603 - RNA, 23 nt, Mycobacterium avium subsp. paratuberculosis
gcgccgggcgaagucgccggcca

SEQ ID NO: 847604 - RNA, 23 nt, Mycobacterium avium subsp. paratuberculosis
gcgccgggcccggucccgcguca

SEQ ID NO: 847605 - RNA, 23 nt, Mycobacterium avium subsp. paratuberculosis
gcgccgggcagcccgccgcggau

SEQ ID NO: 847606 - RNA, 16 nt, Mycobacterium avium subsp. paratuberculosis
gcgccgggcagcccgg

SEQ ID NO: 847607 - RNA, 18 nt, Mycobacterium avium subsp. paratuberculosis
gcgccgggcagcccgggu

SEQ ID NO: 847608 - RNA, 23 nt, Mycobacterium avium subsp. paratuberculosis
gcgccgggaaaguuguagcgcag

SEQ ID NO: 847609 - RNA, 13 nt, Mycobacterium avium subsp. paratuberculosis
gcgccggcugccc

SEQ ID NO: 847610 - RNA, 15 nt, Mycobacterium avium subsp. paratuberculosis
gcgccggcugcccgc

SEQ ID NO: 847611 - RNA, 18 nt, Mycobacterium avium subsp. paratuberculosis
gcgccggcugcccgcgac

SEQ ID NO: 847612 - RNA, 18 nt, Mycobacterium avium subsp. paratuberculosis
gcgccggcuccgcaugcc

SEQ ID NO: 847613 - RNA, 23 nt, Mycobacterium avium subsp. paratuberculosis
gcgccggcuccgcaugcccgggc

SEQ ID NO: 847614 - RNA, 17 nt, Mycobacterium avium subsp. paratuberculosis
gcgccggcuccaccgcg

SEQ ID NO: 847615 - RNA, 21 nt, Mycobacterium avium subsp. paratuberculosis
gcgccggcuccaccgcgccgg

SEQ ID NO: 847616 - RNA, 22 nt, Mycobacterium avium subsp. paratuberculosis
gcgccggcuccaccgcgccggc

SEQ ID NO: 847617 - RNA, 13 nt, Mycobacterium avium subsp. paratuberculosis
gcgccggcgcggg

SEQ ID NO: 847618 - RNA, 13 nt, Mycobacterium avium subsp. paratuberculosis
gcgccggcguguc

SEQ ID NO: 847619 - RNA, 15 nt, Mycobacterium avium subsp. paratuberculosis
gcgccggcgcggcca

SEQ ID NO: 847620 - RNA, 16 nt, Mycobacterium avium subsp. paratuberculosis
gcgccggcgcggccag

SEQ ID NO: 847621 - RNA, 19 nt, Mycobacterium avium subsp. paratuberculosis
gcgccggcgcggccagcug

SEQ ID NO: 847622 - RNA, 14 nt, Mycobacterium avium subsp. paratuberculosis
gcgccggcgcgcga

SEQ ID NO: 847623 - RNA, 19 nt, Mycobacterium avium subsp. paratuberculosis
gcgccggcgcgcgagcguc

SEQ ID NO: 847624 - RNA, 21 nt, Mycobacterium avium subsp. paratuberculosis
gcgccggcgcgcgagcgucac

SEQ ID NO: 847625 - RNA, 16 nt, Mycobacterium avium subsp. paratuberculosis
gcgccggcgcgcagcc

SEQ ID NO: 847626 - RNA, 13 nt, Mycobacterium avium subsp. paratuberculosis
gcgccggccggcg

SEQ ID NO: 847627 - RNA, 21 nt, Mycobacterium avium subsp. paratuberculosis
gcgccggcgauaggcggccag

SEQ ID NO: 847628 - RNA, 16 nt, Mycobacterium avium subsp. paratuberculosis
gcgccggcgcagcggc

SEQ ID NO: 847629 - RNA, 19 nt, Mycobacterium avium subsp. paratuberculosis
gcgccggcgcagcggcccg

SEQ ID NO: 847630 - RNA, 13 nt, Mycobacterium avium subsp. paratuberculosis
gcgccggccguca

SEQ ID NO: 847631 - RNA, 21 nt, Mycobacterium avium subsp. paratuberculosis
gcgccggccgucacgcuggcg

SEQ ID NO: 847632 - RNA, 15 nt, Mycobacterium avium subsp. paratuberculosis
gcgccggccggcgcg

SEQ ID NO: 847633 - RNA, 20 nt, Mycobacterium avium subsp. paratuberculosis
gcgccggccggcggucaggc

SEQ ID NO: 847634 - RNA, 12 nt, Mycobacterium avium subsp. paratuberculosis
gcgccggccggg

SEQ ID NO: 847635 - RNA, 12 nt, Mycobacterium avium subsp. paratuberculosis
gcgccggccgcc

SEQ ID NO: 847636 - RNA, 14 nt, Mycobacterium avium subsp. paratuberculosis
gcgccggcccgcgg

SEQ ID NO: 847637 - RNA, 14 nt, Mycobacterium avium subsp. paratuberculosis
gcgccggccagcgg

SEQ ID NO: 847638 - RNA, 13 nt, Mycobacterium avium subsp. paratuberculosis
gcgccggccagca

SEQ ID NO: 847639 - RNA, 14 nt, Mycobacterium avium subsp. paratuberculosis
gcgccggccagcac

SEQ ID NO: 847640 - RNA, 15 nt, Mycobacterium avium subsp. paratuberculosis
gcgccggccagcacg

SEQ ID NO: 847641 - RNA, 16 nt, Mycobacterium avium subsp. paratuberculosis
gcgccggccagcacgg

SEQ ID NO: 847642 - RNA, 17 nt, Mycobacterium avium subsp. paratuberculosis
gcgccggccagcacggc

SEQ ID NO: 847643 - RNA, 20 nt, Mycobacterium avium subsp. paratuberculosis
gcgccggccagcacggcggc

SEQ ID NO: 847644 - RNA, 23 nt, Mycobacterium avium subsp. paratuberculosis
gcgccggccagcacggcggcgug

SEQ ID NO: 847645 - RNA, 15 nt, Mycobacterium avium subsp. paratuberculosis
gcgccggccagcagc

SEQ ID NO: 847646 - RNA, 14 nt, Mycobacterium avium subsp. paratuberculosis
gcgccggccagccg

SEQ ID NO: 847647 - RNA, 17 nt, Mycobacterium avium subsp. paratuberculosis
gcgccggccagccggcu

SEQ ID NO: 847648 - RNA, 12 nt, Mycobacterium avium subsp. paratuberculosis
gcgccggcaucc

SEQ ID NO: 847649 - RNA, 19 nt, Mycobacterium avium subsp. paratuberculosis
gcgccggcauccagcacgg

SEQ ID NO: 847650 - RNA, 16 nt, Mycobacterium avium subsp. paratuberculosis
gcgccggcagcgccuc

SEQ ID NO: 847651 - RNA, 14 nt, Mycobacterium avium subsp. paratuberculosis
gcgccggcagcggc

SEQ ID NO: 847652 - RNA, 21 nt, Mycobacterium avium subsp. paratuberculosis
gcgccgcuucgucgccggccg

SEQ ID NO: 847653 - RNA, 23 nt, Mycobacterium avium subsp. paratuberculosis
gcgccgcuucgucgccggccgcc

SEQ ID NO: 847654 - RNA, 16 nt, Mycobacterium avium subsp. paratuberculosis
gcgccgcugcgggcca

SEQ ID NO: 847655 - RNA, 22 nt, Mycobacterium avium subsp. paratuberculosis
gcgccgcucgaccccucggcau

SEQ ID NO: 847656 - RNA, 15 nt, Mycobacterium avium subsp. paratuberculosis
gcgccgcucggccag

SEQ ID NO: 847657 - RNA, 16 nt, Mycobacterium avium subsp. paratuberculosis
gcgccgcucggccagc

SEQ ID NO: 847658 - RNA, 17 nt, Mycobacterium avium subsp. paratuberculosis
gcgccgcucggccagca

SEQ ID NO: 847659 - RNA, 18 nt, Mycobacterium avium subsp. paratuberculosis
gcgccgcucggccagcag

SEQ ID NO: 847660 - RNA, 19 nt, Mycobacterium avium subsp. paratuberculosis
gcgccgcucggccagcagc

SEQ ID NO: 847661 - RNA, 14 nt, Mycobacterium avium subsp. paratuberculosis
gcgccgcucggccg

SEQ ID NO: 847662 - RNA, 14 nt, Mycobacterium avium subsp. paratuberculosis
gcgccgcucgucgg

SEQ ID NO: 847663 - RNA, 15 nt, Mycobacterium avium subsp. paratuberculosis
gcgccgcucgucggc

SEQ ID NO: 847664 - RNA, 16 nt, Mycobacterium avium subsp. paratuberculosis
gcgccgcucgucggcc

SEQ ID NO: 847665 - RNA, 19 nt, Mycobacterium avium subsp. paratuberculosis
gcgccgcucgucggccagc

SEQ ID NO: 847666 - RNA, 22 nt, Mycobacterium avium subsp. paratuberculosis
gcgccgcucgucggccagcgag

SEQ ID NO: 847667 - RNA, 16 nt, Mycobacterium avium subsp. paratuberculosis
gcgccgcguucggcgg

SEQ ID NO: 847668 - RNA, 19 nt, Mycobacterium avium subsp. paratuberculosis
gcgccgcguucggcggcgc

SEQ ID NO: 847669 - RNA, 19 nt, Mycobacterium avium subsp. paratuberculosis
gcgccgcguugucggcguc

SEQ ID NO: 847670 - RNA, 18 nt, Mycobacterium avium subsp. paratuberculosis
gcgccgcgucgcgccgcc

SEQ ID NO: 847671 - RNA, 12 nt, Mycobacterium avium subsp. paratuberculosis
gcgccgcgucgu

SEQ ID NO: 847672 - RNA, 18 nt, Mycobacterium avium subsp. paratuberculosis
gcgccgcgucgucgucga

SEQ ID NO: 847673 - RNA, 22 nt, Mycobacterium avium subsp. paratuberculosis
gcgccgcgucgucgucgaccgu

SEQ ID NO: 847674 - RNA, 18 nt, Mycobacterium avium subsp. paratuberculosis
gcgccgcguaccagcgcc

SEQ ID NO: 847675 - RNA, 19 nt, Mycobacterium avium subsp. paratuberculosis
gcgccgcguaccagcgcca

SEQ ID NO: 847676 - RNA, 20 nt, Mycobacterium avium subsp. paratuberculosis
gcgccgcguaccagcgccac

SEQ ID NO: 847677 - RNA, 16 nt, Mycobacterium avium subsp. paratuberculosis
gcgccgcgucgacgcc

SEQ ID NO: 847678 - RNA, 17 nt, Mycobacterium avium subsp. paratuberculosis
gcgccgcgucgacgccg

SEQ ID NO: 847679 - RNA, 19 nt, Mycobacterium avium subsp. paratuberculosis
gcgccgcgggugcggcacg

SEQ ID NO: 847680 - RNA, 21 nt, Mycobacterium avium subsp. paratuberculosis
gcgccgcgggugcggcacggc

SEQ ID NO: 847681 - RNA, 19 nt, Mycobacterium avium subsp. paratuberculosis
gcgccgcgguagaaccaac

SEQ ID NO: 847682 - RNA, 15 nt, Mycobacterium avium subsp. paratuberculosis
gcgccgcggugcgcc

SEQ ID NO: 847683 - RNA, 16 nt, Mycobacterium avium subsp. paratuberculosis
gcgccgcggugcgcca

SEQ ID NO: 847684 - RNA, 14 nt, Mycobacterium avium subsp. paratuberculosis
gcgccgccagccgc

SEQ ID NO: 847685 - RNA, 22 nt, Mycobacterium avium subsp. paratuberculosis
gcgccgccagcaaccccgcggu

SEQ ID NO: 847686 - RNA, 13 nt, Mycobacterium avium subsp. paratuberculosis
gcgccgccaccgg

SEQ ID NO: 847687 - RNA, 15 nt, Mycobacterium avium subsp. paratuberculosis
gcgccgccaccggcc

SEQ ID NO: 847688 - RNA, 16 nt, Mycobacterium avium subsp. paratuberculosis
gcgccgccaccggccg

SEQ ID NO: 847689 - RNA, 17 nt, Mycobacterium avium subsp. paratuberculosis
gcgccgccaccggccgg

SEQ ID NO: 847690 - RNA, 11 nt, Mycobacterium avium subsp. paratuberculosis
gcgccgccacg

SEQ ID NO: 847691 - RNA, 14 nt, Mycobacterium avium subsp. paratuberculosis
gcgccgccacgcgg

SEQ ID NO: 847692 - RNA, 19 nt, Mycobacterium avium subsp. paratuberculosis
gcgccgccacggccaccgc

SEQ ID NO: 847693 - RNA, 22 nt, Mycobacterium avium subsp. paratuberculosis
gcgccgccaccccaggcgaugc

SEQ ID NO: 847694 - RNA, 19 nt, Mycobacterium avium subsp. paratuberculosis
gcgccgccacaccucggcg

SEQ ID NO: 847695 - RNA, 21 nt, Mycobacterium avium subsp. paratuberculosis
gcgccgccacaccucggcgac

SEQ ID NO: 847696 - RNA, 22 nt, Mycobacterium avium subsp. paratuberculosis
gcgccgcaugaugcggccauga

SEQ ID NO: 847697 - RNA, 12 nt, Mycobacterium avium subsp. paratuberculosis
gcgccgcaugcc

SEQ ID NO: 847698 - RNA, 17 nt, Mycobacterium avium subsp. paratuberculosis
gcgccgcauuggugccg

SEQ ID NO: 847699 - RNA, 20 nt, Mycobacterium avium subsp. paratuberculosis
gcgccgcauuggugccggcc

SEQ ID NO: 847700 - RNA, 19 nt, Mycobacterium avium subsp. paratuberculosis
gcgccacagcagcaccagc

SEQ ID NO: 847701 - RNA, 22 nt, Mycobacterium avium subsp. paratuberculosis
gcgccacaacagguucgacagc

SEQ ID NO: 847702 - RNA, 23 nt, Mycobacterium avium subsp. paratuberculosis
gcgccacaacagguucgacagcg

SEQ ID NO: 847703 - RNA, 16 nt, Mycobacterium avium subsp. paratuberculosis
gcgccacgcacaccgc

SEQ ID NO: 847704 - RNA, 19 nt, Mycobacterium avium subsp. paratuberculosis
gcgccacgcacaccgcgcg

SEQ ID NO: 847705 - RNA, 20 nt, Mycobacterium avium subsp. paratuberculosis
gcgccacgcacaccgcgcgc

SEQ ID NO: 847706 - RNA, 16 nt, Mycobacterium avium subsp. paratuberculosis
gcgccacgacugcgcg

SEQ ID NO: 847707 - RNA, 19 nt, Mycobacterium avium subsp. paratuberculosis
gcgccacaacuggucgugc

SEQ ID NO: 847708 - RNA, 17 nt, Mycobacterium avium subsp. paratuberculosis
gcgccacaauggauccg

SEQ ID NO: 847709 - RNA, 22 nt, Mycobacterium avium subsp. paratuberculosis
gcgccacaccgaagaaccccga

SEQ ID NO: 847710 - RNA, 15 nt, Mycobacterium avium subsp. paratuberculosis
gcgccacgaccagcg

SEQ ID NO: 847711 - RNA, 19 nt, Mycobacterium avium subsp. paratuberculosis
gcgccagaucgcugaugcg

SEQ ID NO: 847712 - RNA, 19 nt, Mycobacterium avium subsp. paratuberculosis
gcgccacgccgcccccgcc

SEQ ID NO: 847713 - RNA, 18 nt, Mycobacterium avium subsp. paratuberculosis
gcgccacgcgcagggcga

SEQ ID NO: 847714 - RNA, 22 nt, Mycobacterium avium subsp. paratuberculosis
gcgccacgcucaugcccgccac

SEQ ID NO: 847715 - RNA, 13 nt, Mycobacterium avium subsp. paratuberculosis
gcgccacgcuggc

SEQ ID NO: 847716 - RNA, 20 nt, Mycobacterium avium subsp. paratuberculosis
gcgccacgcuggcgugacgc

SEQ ID NO: 847717 - RNA, 16 nt, Mycobacterium avium subsp. paratuberculosis
gcgccacgccccggcg

SEQ ID NO: 847718 - RNA, 17 nt, Mycobacterium avium subsp. paratuberculosis
gcgccacgccccggcgc

SEQ ID NO: 847719 - RNA, 19 nt, Mycobacterium avium subsp. paratuberculosis
gcgccacgccccggcgccg

SEQ ID NO: 847720 - RNA, 12 nt, Mycobacterium avium subsp. paratuberculosis
gcgccagcagcg

SEQ ID NO: 847721 - RNA, 16 nt, Mycobacterium avium subsp. paratuberculosis
gcgccagcagcaacgc

SEQ ID NO: 847722 - RNA, 17 nt, Mycobacterium avium subsp. paratuberculosis
gcgccagcagcaccuga

SEQ ID NO: 847723 - RNA, 13 nt, Mycobacterium avium subsp. paratuberculosis
gcgccagcacggc

SEQ ID NO: 847724 - RNA, 15 nt, Mycobacterium avium subsp. paratuberculosis
gcgccagcacggcca

SEQ ID NO: 847725 - RNA, 16 nt, Mycobacterium avium subsp. paratuberculosis
gcgccagcacggccac

SEQ ID NO: 847726 - RNA, 18 nt, Mycobacterium avium subsp. paratuberculosis
gcgccagcacggccacca

SEQ ID NO: 847727 - RNA, 19 nt, Mycobacterium avium subsp. paratuberculosis
gcgccagcacggccaccag

SEQ ID NO: 847728 - RNA, 20 nt, Mycobacterium avium subsp. paratuberculosis
gcgccagcacggccaccagc

SEQ ID NO: 847729 - RNA, 21 nt, Mycobacterium avium subsp. paratuberculosis
gcgccagcacggccaccagca

SEQ ID NO: 847730 - RNA, 20 nt, Mycobacterium avium subsp. paratuberculosis
gcgccagcaccgccuggguc

SEQ ID NO: 847731 - RNA, 12 nt, Mycobacterium avium subsp. paratuberculosis
gcgccagcaccu

SEQ ID NO: 847732 - RNA, 16 nt, Mycobacterium avium subsp. paratuberculosis
gcgccagcaccucgaa

SEQ ID NO: 847733 - RNA, 20 nt, Mycobacterium avium subsp. paratuberculosis
gcgccagcaccucgaacgcc

SEQ ID NO: 847734 - RNA, 17 nt, Mycobacterium avium subsp. paratuberculosis
gcgccagcaccucggcg

SEQ ID NO: 847735 - RNA, 18 nt, Mycobacterium avium subsp. paratuberculosis
gcgccagcaccucggcga

SEQ ID NO: 847736 - RNA, 19 nt, Mycobacterium avium subsp. paratuberculosis
gcgccagcaccucggcgac

SEQ ID NO: 847737 - RNA, 21 nt, Mycobacterium avium subsp. paratuberculosis
gcgccagcaccucggcgacca

SEQ ID NO: 847738 - RNA, 23 nt, Mycobacterium avium subsp. paratuberculosis
gcgccagcaccucggcgaccacg

SEQ ID NO: 847739 - RNA, 16 nt, Mycobacterium avium subsp. paratuberculosis
gcgccagcccgcccag

SEQ ID NO: 847740 - RNA, 19 nt, Mycobacterium avium subsp. paratuberculosis
gcgccagcccgcccagcgc

SEQ ID NO: 847741 - RNA, 13 nt, Mycobacterium avium subsp. paratuberculosis
gcgccagcagcgc

SEQ ID NO: 847742 - RNA, 17 nt, Mycobacterium avium subsp. paratuberculosis
gcgccagcagcgcgccg

SEQ ID NO: 847743 - RNA, 21 nt, Mycobacterium avium subsp. paratuberculosis
gcgccagcagcgcgccgcgcu

SEQ ID NO: 847744 - RNA, 14 nt, Mycobacterium avium subsp. paratuberculosis
gcgccagcagcggc

SEQ ID NO: 847745 - RNA, 19 nt, Mycobacterium avium subsp. paratuberculosis
gcgccagcagcggcacccg

SEQ ID NO: 847746 - RNA, 17 nt, Mycobacterium avium subsp. paratuberculosis
gcgccagcgccagcgug

SEQ ID NO: 847747 - RNA, 19 nt, Mycobacterium avium subsp. paratuberculosis
gcgccagcgccagcguggc

SEQ ID NO: 847748 - RNA, 24 nt, Mycobacterium avium subsp. paratuberculosis
gcgccagcgccggguugcaggcgc

SEQ ID NO: 847749 - RNA, 16 nt, Mycobacterium avium subsp. paratuberculosis
gcgccagcgccagcgu

SEQ ID NO: 847750 - RNA, 14 nt, Mycobacterium avium subsp. paratuberculosis
gcgccagcgaccgc

SEQ ID NO: 847751 - RNA, 15 nt, Mycobacterium avium subsp. paratuberculosis
gcgccagcgaccgca

SEQ ID NO: 847752 - RNA, 18 nt, Mycobacterium avium subsp. paratuberculosis
gcgccagcgaccgcaggu

SEQ ID NO: 847753 - RNA, 12 nt, Mycobacterium avium subsp. paratuberculosis
gcgccagcgacg

SEQ ID NO: 847754 - RNA, 15 nt, Mycobacterium avium subsp. paratuberculosis
gcgccagcgacggcc

SEQ ID NO: 847755 - RNA, 20 nt, Mycobacterium avium subsp. paratuberculosis
gcgccagcccgccgaaccag

SEQ ID NO: 847756 - RNA, 13 nt, Mycobacterium avium subsp. paratuberculosis
gcgccagcccggu

SEQ ID NO: 847757 - RNA, 17 nt, Mycobacterium avium subsp. paratuberculosis
gcgccagccgcaccgcg

SEQ ID NO: 847758 - RNA, 18 nt, Mycobacterium avium subsp. paratuberculosis
gcgccagccgcaccgcga

SEQ ID NO: 847759 - RNA, 19 nt, Mycobacterium avium subsp. paratuberculosis
gcgccagccgcaccgcgac

SEQ ID NO: 847760 - RNA, 16 nt, Mycobacterium avium subsp. paratuberculosis
gcgccagccgccgccg

SEQ ID NO: 847761 - RNA, 17 nt, Mycobacterium avium subsp. paratuberculosis
gcgccagccgccgccga

SEQ ID NO: 847762 - RNA, 23 nt, Mycobacterium avium subsp. paratuberculosis
gcgccaggaccagcgggucgaug

SEQ ID NO: 847763 - RNA, 14 nt, Mycobacterium avium subsp. paratuberculosis
gcgccagcucggcg

SEQ ID NO: 847764 - RNA, 16 nt, Mycobacterium avium subsp. paratuberculosis
gcgccagcucggcggc

SEQ ID NO: 847765 - RNA, 17 nt, Mycobacterium avium subsp. paratuberculosis
gcgccagcugggugguc

SEQ ID NO: 847766 - RNA, 23 nt, Mycobacterium avium subsp. paratuberculosis
gcgccagcuggguggucaccagc

SEQ ID NO: 847767 - RNA, 16 nt, Mycobacterium avium subsp. paratuberculosis
gcgccagcuccagcag

SEQ ID NO: 847768 - RNA, 23 nt, Mycobacterium avium subsp. paratuberculosis
gcgccagcuccagcagcccgggc

SEQ ID NO: 847769 - RNA, 19 nt, Mycobacterium avium subsp. paratuberculosis
gcgccagcgucugcugcgc

SEQ ID NO: 847770 - RNA, 21 nt, Mycobacterium avium subsp. paratuberculosis
gcgccagcgugaacagcgccc

SEQ ID NO: 847771 - RNA, 22 nt, Mycobacterium avium subsp. paratuberculosis
gcgccagcgugaacagcgcccg

SEQ ID NO: 847772 - RNA, 17 nt, Mycobacterium avium subsp. paratuberculosis
gcgccagcguggccagc

SEQ ID NO: 847773 - RNA, 16 nt, Mycobacterium avium subsp. paratuberculosis
gcgccagcgggauacc

SEQ ID NO: 847774 - RNA, 13 nt, Mycobacterium avium subsp. paratuberculosis
gcgccagcggccg

SEQ ID NO: 847775 - RNA, 13 nt, Mycobacterium avium subsp. paratuberculosis
gcgccagcgcgcc

SEQ ID NO: 847776 - RNA, 14 nt, Mycobacterium avium subsp. paratuberculosis
gcgccagcgcggug

SEQ ID NO: 847777 - RNA, 15 nt, Mycobacterium avium subsp. paratuberculosis
gcgccagcgcggugc

SEQ ID NO: 847778 - RNA, 20 nt, Mycobacterium avium subsp. paratuberculosis
gcgccagcgcggugcccagc

SEQ ID NO: 847779 - RNA, 23 nt, Mycobacterium avium subsp. paratuberculosis
gcgccagcgcggugcccagccag

SEQ ID NO: 847780 - RNA, 15 nt, Mycobacterium avium subsp. paratuberculosis
gcgccagcgcgugcg

SEQ ID NO: 847781 - RNA, 16 nt, Mycobacterium avium subsp. paratuberculosis
gcgccagcgcgugcgg

SEQ ID NO: 847782 - RNA, 22 nt, Mycobacterium avium subsp. paratuberculosis
gcgccaacgaggcacggcccgc

SEQ ID NO: 847783 - RNA, 21 nt, Mycobacterium avium subsp. paratuberculosis
gcgccaacgcuuuugcggguc

SEQ ID NO: 847784 - RNA, 22 nt, Mycobacterium avium subsp. paratuberculosis
gcgccaacugaauuccuggccg

SEQ ID NO: 847785 - RNA, 21 nt, Mycobacterium avium subsp. paratuberculosis
gcgccaacaacucgacgcucg

SEQ ID NO: 847786 - RNA, 15 nt, Mycobacterium avium subsp. paratuberculosis
gcgccaacauggcgc

SEQ ID NO: 847787 - RNA, 21 nt, Mycobacterium avium subsp. paratuberculosis
gcgccaacauggcgcagaaca

SEQ ID NO: 847788 - RNA, 19 nt, Mycobacterium avium subsp. paratuberculosis
gcgcaugcccuggacgagu

SEQ ID NO: 847789 - RNA, 14 nt, Mycobacterium avium subsp. paratuberculosis
gcgcauggcgugcu

SEQ ID NO: 847790 - RNA, 23 nt, Mycobacterium avium subsp. paratuberculosis
gcgcauggucagguaggcgucga

SEQ ID NO: 847791 - RNA, 20 nt, Mycobacterium avium subsp. paratuberculosis
gcgcauggucagguaggcgu

SEQ ID NO: 847792 - RNA, 22 nt, Mycobacterium avium subsp. paratuberculosis
gcgcauggucagguaggcgucg

SEQ ID NO: 847793 - RNA, 21 nt, Mycobacterium avium subsp. paratuberculosis
gcgcaucgacugcgacacccg

SEQ ID NO: 847794 - RNA, 22 nt, Mycobacterium avium subsp. paratuberculosis
gcgcaucgacugcgacacccgc

SEQ ID NO: 847795 - RNA, 14 nt, Mycobacterium avium subsp. paratuberculosis
gcgcaucgagcugc

SEQ ID NO: 847796 - RNA, 15 nt, Mycobacterium avium subsp. paratuberculosis
gcgcaugacggccug

SEQ ID NO: 847797 - RNA, 23 nt, Mycobacterium avium subsp. paratuberculosis
gcgcaugacggccugcaccacca

SEQ ID NO: 847798 - RNA, 16 nt, Mycobacterium avium subsp. paratuberculosis
gcgcaucccgucgacc

SEQ ID NO: 847799 - RNA, 17 nt, Mycobacterium avium subsp. paratuberculosis
gcgcaucccgucgacca

SEQ ID NO: 847800 - RNA, 13 nt, Mycobacterium avium subsp. paratuberculosis
gcgcauccgacac

SEQ ID NO: 847801 - RNA, 18 nt, Mycobacterium avium subsp. paratuberculosis
gcgcauccgacaccgccu

SEQ ID NO: 847802 - RNA, 14 nt, Mycobacterium avium subsp. paratuberculosis
gcgcauccgcaccg

SEQ ID NO: 847803 - RNA, 15 nt, Mycobacterium avium subsp. paratuberculosis
gcgcauccgcaccga

SEQ ID NO: 847804 - RNA, 19 nt, Mycobacterium avium subsp. paratuberculosis
gcgcauccucauagccggc

SEQ ID NO: 847805 - RNA, 20 nt, Mycobacterium avium subsp. paratuberculosis
gcgcauccucauagccggcc

SEQ ID NO: 847806 - RNA, 23 nt, Mycobacterium avium subsp. paratuberculosis
gcgcauccucauagccggccgcg

SEQ ID NO: 847807 - RNA, 19 nt, Mycobacterium avium subsp. paratuberculosis
gcgcagguuguccagccgg

SEQ ID NO: 847808 - RNA, 20 nt, Mycobacterium avium subsp. paratuberculosis
gcgcagguuguccagccggu

SEQ ID NO: 847809 - RNA, 16 nt, Mycobacterium avium subsp. paratuberculosis
gcgcagguugucggcc

SEQ ID NO: 847810 - RNA, 16 nt, Mycobacterium avium subsp. paratuberculosis
gcgcaggugggcggug

SEQ ID NO: 847811 - RNA, 17 nt, Mycobacterium avium subsp. paratuberculosis
gcgcaggugggcggugc

SEQ ID NO: 847812 - RNA, 18 nt, Mycobacterium avium subsp. paratuberculosis
gcgcaggucgggccggcc

SEQ ID NO: 847813 - RNA, 19 nt, Mycobacterium avium subsp. paratuberculosis
gcgcaggucgggccggccg

SEQ ID NO: 847814 - RNA, 15 nt, Mycobacterium avium subsp. paratuberculosis
gcgcaggucguccga

SEQ ID NO: 847815 - RNA, 16 nt, Mycobacterium avium subsp. paratuberculosis
gcgcagaacaccaccg

SEQ ID NO: 847816 - RNA, 19 nt, Mycobacterium avium subsp. paratuberculosis
gcgcacucgaacggcccgg

SEQ ID NO: 847817 - RNA, 22 nt, Mycobacterium avium subsp. paratuberculosis
gcgcacucgaacggcccggacg

SEQ ID NO: 847818 - RNA, 14 nt, Mycobacterium avium subsp. paratuberculosis
gcgcacgaucgggc

SEQ ID NO: 847819 - RNA, 19 nt, Mycobacterium avium subsp. paratuberculosis
gcgcagaaaaaggccgccg

SEQ ID NO: 847820 - RNA, 20 nt, Mycobacterium avium subsp. paratuberculosis
gcgcagaaaccauuccgcca

SEQ ID NO: 847821 - RNA, 21 nt, Mycobacterium avium subsp. paratuberculosis
gcgcagaaaccccacgaucgc

SEQ ID NO: 847822 - RNA, 20 nt, Mycobacterium avium subsp. paratuberculosis
gcgcacuucgcgggcggcgc

SEQ ID NO: 847823 - RNA, 19 nt, Mycobacterium avium subsp. paratuberculosis
gcgcagaacaccaccgcca

SEQ ID NO: 847824 - RNA, 20 nt, Mycobacterium avium subsp. paratuberculosis
gcgcagaacaccaccgccag

SEQ ID NO: 847825 - RNA, 22 nt, Mycobacterium avium subsp. paratuberculosis
gcgcagaacaccaccgccaggu

SEQ ID NO: 847826 - RNA, 19 nt, Mycobacterium avium subsp. paratuberculosis
gcgcagaacaccacggugu

SEQ ID NO: 847827 - RNA, 15 nt, Mycobacterium avium subsp. paratuberculosis
gcgcagucgcaggcc

SEQ ID NO: 847828 - RNA, 18 nt, Mycobacterium avium subsp. paratuberculosis
gcgcagucgcaggccccg

SEQ ID NO: 847829 - RNA, 19 nt, Mycobacterium avium subsp. paratuberculosis
gcgcaguccaggguggugg

SEQ ID NO: 847830 - RNA, 14 nt, Mycobacterium avium subsp. paratuberculosis
gcgcaguagccgac

SEQ ID NO: 847831 - RNA, 22 nt, Mycobacterium avium subsp. paratuberculosis
gcgcaguagccgacgugcccga

SEQ ID NO: 847832 - RNA, 15 nt, Mycobacterium avium subsp. paratuberculosis
gcgcagucgcugguc

SEQ ID NO: 847833 - RNA, 22 nt, Mycobacterium avium subsp. paratuberculosis
gcgcagucggccggauucucgc

SEQ ID NO: 847834 - RNA, 16 nt, Mycobacterium avium subsp. paratuberculosis
gcgcaucaucgcccag

SEQ ID NO: 847835 - RNA, 23 nt, Mycobacterium avium subsp. paratuberculosis
gcgcaucaucgcccagcgcagcg

SEQ ID NO: 847836 - RNA, 13 nt, Mycobacterium avium subsp. paratuberculosis
gcgcaucagcgcc

SEQ ID NO: 847837 - RNA, 22 nt, Mycobacterium avium subsp. paratuberculosis
gcgcaucagcucuucgacgaug

SEQ ID NO: 847838 - RNA, 17 nt, Mycobacterium avium subsp. paratuberculosis
gcgcaucaugucgaaga

SEQ ID NO: 847839 - RNA, 14 nt, Mycobacterium avium subsp. paratuberculosis
gcgcauccaccagg

SEQ ID NO: 847840 - RNA, 17 nt, Mycobacterium avium subsp. paratuberculosis
gcgcauccaccagggcg

SEQ ID NO: 847841 - RNA, 19 nt, Mycobacterium avium subsp. paratuberculosis
gcgcauccaccagggcggu

SEQ ID NO: 847842 - RNA, 20 nt, Mycobacterium avium subsp. paratuberculosis
gcgcauccaccagggcggug

SEQ ID NO: 847843 - RNA, 18 nt, Mycobacterium avium subsp. paratuberculosis
gcgcaucagcggagugac

SEQ ID NO: 847844 - RNA, 16 nt, Mycobacterium avium subsp. paratuberculosis
gcgcaucagcggggcg

SEQ ID NO: 847845 - RNA, 21 nt, Mycobacterium avium subsp. paratuberculosis
gcgcaucagcggggcguccag

SEQ ID NO: 847846 - RNA, 15 nt, Mycobacterium avium subsp. paratuberculosis
gcgcaucagcgccac

SEQ ID NO: 847847 - RNA, 17 nt, Mycobacterium avium subsp. paratuberculosis
gcgcaucagcgccacca

SEQ ID NO: 847848 - RNA, 20 nt, Mycobacterium avium subsp. paratuberculosis
gcgcaucagcgccaccagca

SEQ ID NO: 847849 - RNA, 23 nt, Mycobacterium avium subsp. paratuberculosis
gcgcaucagcgccaccagcaccg

SEQ ID NO: 847850 - RNA, 15 nt, Mycobacterium avium subsp. paratuberculosis
gcgcaucacccggcg

SEQ ID NO: 847851 - RNA, 16 nt, Mycobacterium avium subsp. paratuberculosis
gcgcaucacccggcgc

SEQ ID NO: 847852 - RNA, 17 nt, Mycobacterium avium subsp. paratuberculosis
gcgcaucacccggcgcg

SEQ ID NO: 847853 - RNA, 15 nt, Mycobacterium avium subsp. paratuberculosis
gcgcccgcgccaccc

SEQ ID NO: 847854 - RNA, 19 nt, Mycobacterium avium subsp. paratuberculosis
gcgcccggaaagcgcgggc

SEQ ID NO: 847855 - RNA, 15 nt, Mycobacterium avium subsp. paratuberculosis
gcgcccggcgccggc

SEQ ID NO: 847856 - RNA, 19 nt, Mycobacterium avium subsp. paratuberculosis
gcgcccggcgccggcccgc

SEQ ID NO: 847857 - RNA, 14 nt, Mycobacterium avium subsp. paratuberculosis
gcgcccgcggcgcg

SEQ ID NO: 847858 - RNA, 17 nt, Mycobacterium avium subsp. paratuberculosis
gcgcccgcggcgcgcag

SEQ ID NO: 847859 - RNA, 19 nt, Mycobacterium avium subsp. paratuberculosis
gcgcccgcggcgcgcaggu

SEQ ID NO: 847860 - RNA, 17 nt, Mycobacterium avium subsp. paratuberculosis
gcgcccgcuccggcgga

SEQ ID NO: 847861 - RNA, 17 nt, Mycobacterium avium subsp. paratuberculosis
gcgcccgcugcgcgggu

SEQ ID NO: 847862 - RNA, 19 nt, Mycobacterium avium subsp. paratuberculosis
gcgcccgcugcgcgggucg

SEQ ID NO: 847863 - RNA, 23 nt, Mycobacterium avium subsp. paratuberculosis
gcgcccgcugcgcgggucggcgc

SEQ ID NO: 847864 - RNA, 14 nt, Mycobacterium avium subsp. paratuberculosis
gcgcccgcugcggc

SEQ ID NO: 847865 - RNA, 16 nt, Mycobacterium avium subsp. paratuberculosis
gcgcccgcugcggcgc

SEQ ID NO: 847866 - RNA, 20 nt, Mycobacterium avium subsp. paratuberculosis
gcgcccgcugcggcgcaggu

SEQ ID NO: 847867 - RNA, 17 nt, Mycobacterium avium subsp. paratuberculosis
gcgcccguagccgcggu

SEQ ID NO: 847868 - RNA, 18 nt, Mycobacterium avium subsp. paratuberculosis
gcgcccgucacgcuggcg

SEQ ID NO: 847869 - RNA, 18 nt, Mycobacterium avium subsp. paratuberculosis
gcgcccgucgagcgucac

SEQ ID NO: 847870 - RNA, 16 nt, Mycobacterium avium subsp. paratuberculosis
gcgcccgucgucgccg

SEQ ID NO: 847871 - RNA, 17 nt, Mycobacterium avium subsp. paratuberculosis
gcgcccgucgucgccga

SEQ ID NO: 847872 - RNA, 14 nt, Mycobacterium avium subsp. paratuberculosis
gcgcccgucgucgg

SEQ ID NO: 847873 - RNA, 15 nt, Mycobacterium avium subsp. paratuberculosis
gcgcccgucgucggu

SEQ ID NO: 847874 - RNA, 15 nt, Mycobacterium avium subsp. paratuberculosis
gcgcccuaacgugcc

SEQ ID NO: 847875 - RNA, 19 nt, Mycobacterium avium subsp. paratuberculosis
gcgcccuaacgugcccggc

SEQ ID NO: 847876 - RNA, 20 nt, Mycobacterium avium subsp. paratuberculosis
gcgcccuaacgugcccggcc

SEQ ID NO: 847877 - RNA, 13 nt, Mycobacterium avium subsp. paratuberculosis
gcgcccggguggg

SEQ ID NO: 847878 - RNA, 18 nt, Mycobacterium avium subsp. paratuberculosis
gcgcccgggugggcggga

SEQ ID NO: 847879 - RNA, 21 nt, Mycobacterium avium subsp. paratuberculosis
gcgcccggucaggaacccggc

SEQ ID NO: 847880 - RNA, 22 nt, Mycobacterium avium subsp. paratuberculosis
gcgcccggucaggaacccggcc

SEQ ID NO: 847881 - RNA, 15 nt, Mycobacterium avium subsp. paratuberculosis
gcgcccggcgcgcca

SEQ ID NO: 847882 - RNA, 17 nt, Mycobacterium avium subsp. paratuberculosis
gcgcccggcuucgccgc

SEQ ID NO: 847883 - RNA, 12 nt, Mycobacterium avium subsp. paratuberculosis
gcgcccgggcca

SEQ ID NO: 847884 - RNA, 12 nt, Mycobacterium avium subsp. paratuberculosis
gcgcccgggcgc

SEQ ID NO: 847885 - RNA, 13 nt, Mycobacterium avium subsp. paratuberculosis
gcgcccgggcgcg

SEQ ID NO: 847886 - RNA, 22 nt, Mycobacterium avium subsp. paratuberculosis
gcgcccgggcgcgugcacaccg

SEQ ID NO: 847887 - RNA, 23 nt, Mycobacterium avium subsp. paratuberculosis
gcgcccgggcgcgugcacaccgg

SEQ ID NO: 847888 - RNA, 20 nt, Mycobacterium avium subsp. paratuberculosis
gcgcccgggcguucccgcgc

SEQ ID NO: 847889 - RNA, 19 nt, Mycobacterium avium subsp. paratuberculosis
gcgcccuggugcaacaccg

SEQ ID NO: 847890 - RNA, 17 nt, Mycobacterium avium subsp. paratuberculosis
gcgccgaacgcaccacc

SEQ ID NO: 847891 - RNA, 19 nt, Mycobacterium avium subsp. paratuberculosis
gcgccgaacgcaccaccgc

SEQ ID NO: 847892 - RNA, 22 nt, Mycobacterium avium subsp. paratuberculosis
gcgccgaacgcaccaccgcggu

SEQ ID NO: 847893 - RNA, 16 nt, Mycobacterium avium subsp. paratuberculosis
gcgccgaacucggcgc

SEQ ID NO: 847894 - RNA, 17 nt, Mycobacterium avium subsp. paratuberculosis
gcgccgaagauggccag

SEQ ID NO: 847895 - RNA, 19 nt, Mycobacterium avium subsp. paratuberculosis
gcgccgaagauggccagcg

SEQ ID NO: 847896 - RNA, 21 nt, Mycobacterium avium subsp. paratuberculosis
gcgccgaagauggccagcgcg

SEQ ID NO: 847897 - RNA, 23 nt, Mycobacterium avium subsp. paratuberculosis
gcgccgaagauggccagcgcggc

SEQ ID NO: 847898 - RNA, 14 nt, Mycobacterium avium subsp. paratuberculosis
gcgccgaagcccgc

SEQ ID NO: 847899 - RNA, 15 nt, Mycobacterium avium subsp. paratuberculosis
gcgccgaagcccgca

SEQ ID NO: 847900 - RNA, 21 nt, Mycobacterium avium subsp. paratuberculosis
gcgccgaagccgucgaccccg

SEQ ID NO: 847901 - RNA, 22 nt, Mycobacterium avium subsp. paratuberculosis
gcgcccugcugggagcggccca

SEQ ID NO: 847902 - RNA, 18 nt, Mycobacterium avium subsp. paratuberculosis
gcgcccugcacccagccg

SEQ ID NO: 847903 - RNA, 19 nt, Mycobacterium avium subsp. paratuberculosis
gcgcccugcacccagccgu

SEQ ID NO: 847904 - RNA, 13 nt, Mycobacterium avium subsp. paratuberculosis
gcgcccugcgcgc

SEQ ID NO: 847905 - RNA, 23 nt, Mycobacterium avium subsp. paratuberculosis
gcgcccugcgaauacccgcccag

SEQ ID NO: 847906 - RNA, 13 nt, Mycobacterium avium subsp. paratuberculosis
gcgcccugcgagc

SEQ ID NO: 847907 - RNA, 14 nt, Mycobacterium avium subsp. paratuberculosis
gcgcccugcgagcc

SEQ ID NO: 847908 - RNA, 19 nt, Mycobacterium avium subsp. paratuberculosis
gcgcccugcgagcccggga

SEQ ID NO: 847909 - RNA, 16 nt, Mycobacterium avium subsp. paratuberculosis
gcgcccuccacgucgu

SEQ ID NO: 847910 - RNA, 14 nt, Mycobacterium avium subsp. paratuberculosis
gcgcccucggcgau

SEQ ID NO: 847911 - RNA, 22 nt, Mycobacterium avium subsp. paratuberculosis
gcgcccucgauaauggcggccg

SEQ ID NO: 847912 - RNA, 23 nt, Mycobacterium avium subsp. paratuberculosis
gcgcccucgaugcgcaccgugcc

SEQ ID NO: 847913 - RNA, 12 nt, Mycobacterium avium subsp. paratuberculosis
gcgcccucgccg

SEQ ID NO: 847914 - RNA, 15 nt, Mycobacterium avium subsp. paratuberculosis
gcgcccucgccgacc

SEQ ID NO: 847915 - RNA, 14 nt, Mycobacterium avium subsp. paratuberculosis
gcgcccucgccggc

SEQ ID NO: 847916 - RNA, 19 nt, Mycobacterium avium subsp. paratuberculosis
gcgcccucgccggcggcgc

SEQ ID NO: 847917 - RNA, 22 nt, Mycobacterium avium subsp. paratuberculosis
gcgcccucgccggcggcgcccg

SEQ ID NO: 847918 - RNA, 17 nt, Mycobacterium avium subsp. paratuberculosis
gcgccgacagacccgac

SEQ ID NO: 847919 - RNA, 21 nt, Mycobacterium avium subsp. paratuberculosis
gcgccgacagaugcggcacca

SEQ ID NO: 847920 - RNA, 23 nt, Mycobacterium avium subsp. paratuberculosis
gcgccgacagaugcggcaccagc

SEQ ID NO: 847921 - RNA, 22 nt, Mycobacterium avium subsp. paratuberculosis
gcgccgacgcccacagcgccag

SEQ ID NO: 847922 - RNA, 12 nt, Mycobacterium avium subsp. paratuberculosis
gcgccgaccacg

SEQ ID NO: 847923 - RNA, 18 nt, Mycobacterium avium subsp. paratuberculosis
gcgccgacagucgcgggc

SEQ ID NO: 847924 - RNA, 16 nt, Mycobacterium avium subsp. paratuberculosis
gcgccgaaugccacgc

SEQ ID NO: 847925 - RNA, 19 nt, Mycobacterium avium subsp. paratuberculosis
gcgccgaaugccacgccga

SEQ ID NO: 847926 - RNA, 14 nt, Mycobacterium avium subsp. paratuberculosis
gcgccgagcgucac

SEQ ID NO: 847927 - RNA, 21 nt, Mycobacterium avium subsp. paratuberculosis
gcgccgagcgucacgcuggcg

SEQ ID NO: 847928 - RNA, 16 nt, Mycobacterium avium subsp. paratuberculosis
gcgccgagcaaccggg

SEQ ID NO: 847929 - RNA, 16 nt, Mycobacterium avium subsp. paratuberculosis
gcgccgagcacgaacg

SEQ ID NO: 847930 - RNA, 22 nt, Mycobacterium avium subsp. paratuberculosis
gcgccgagcacgaacgcggccg

SEQ ID NO: 847931 - RNA, 14 nt, Mycobacterium avium subsp. paratuberculosis
gcgccgagcagcug

SEQ ID NO: 847932 - RNA, 19 nt, Mycobacterium avium subsp. paratuberculosis
gcgccgacgggcccgcgcc

SEQ ID NO: 847933 - RNA, 16 nt, Mycobacterium avium subsp. paratuberculosis
gcgccgacggccagca

SEQ ID NO: 847934 - RNA, 15 nt, Mycobacterium avium subsp. paratuberculosis
gcgccgacggccgcg

SEQ ID NO: 847935 - RNA, 16 nt, Mycobacterium avium subsp. paratuberculosis
gcgccgacggccgcgc

SEQ ID NO: 847936 - RNA, 19 nt, Mycobacterium avium subsp. paratuberculosis
gcgccgacggccgcgccgu

SEQ ID NO: 847937 - RNA, 18 nt, Mycobacterium avium subsp. paratuberculosis
gcgccgagacgugguggu

SEQ ID NO: 847938 - RNA, 13 nt, Mycobacterium avium subsp. paratuberculosis
gcgccgcacagcc

SEQ ID NO: 847939 - RNA, 16 nt, Mycobacterium avium subsp. paratuberculosis
gcgccgcacagccggc

SEQ ID NO: 847940 - RNA, 18 nt, Mycobacterium avium subsp. paratuberculosis
gcgccgcacagccggcgg

SEQ ID NO: 847941 - RNA, 19 nt, Mycobacterium avium subsp. paratuberculosis
gcgccgcacagccggcggc

SEQ ID NO: 847942 - RNA, 19 nt, Mycobacterium avium subsp. paratuberculosis
gcgccgcaacggcgcaacg

SEQ ID NO: 847943 - RNA, 20 nt, Mycobacterium avium subsp. paratuberculosis
gcgccgcaacggcgcaacgg

SEQ ID NO: 847944 - RNA, 21 nt, Mycobacterium avium subsp. paratuberculosis
gcgccgcaacggcucccaggc

SEQ ID NO: 847945 - RNA, 23 nt, Mycobacterium avium subsp. paratuberculosis
gcgccgcaacggcucccaggccc

SEQ ID NO: 847946 - RNA, 22 nt, Mycobacterium avium subsp. paratuberculosis
gcgccgauuccgucgguggcgg

SEQ ID NO: 847947 - RNA, 19 nt, Mycobacterium avium subsp. paratuberculosis
gcgccgauguacugggccg

SEQ ID NO: 847948 - RNA, 15 nt, Mycobacterium avium subsp. paratuberculosis
gcgccgauguggccg

SEQ ID NO: 847949 - RNA, 16 nt, Mycobacterium avium subsp. paratuberculosis
gcgccgauggugcccu

SEQ ID NO: 847950 - RNA, 18 nt, Mycobacterium avium subsp. paratuberculosis
gcgccgaggcgcucggcc

SEQ ID NO: 847951 - RNA, 21 nt, Mycobacterium avium subsp. paratuberculosis
gcgccgaggcgcucggcccgc

SEQ ID NO: 847952 - RNA, 15 nt, Mycobacterium avium subsp. paratuberculosis
gcgccgaugccgcgc

SEQ ID NO: 847953 - RNA, 21 nt, Mycobacterium avium subsp. paratuberculosis
gcgccgaugccgcgcugcgcc

SEQ ID NO: 847954 - RNA, 23 nt, Mycobacterium avium subsp. paratuberculosis
gcgccgaugcauuggugcacgcc

SEQ ID NO: 847955 - RNA, 21 nt, Mycobacterium avium subsp. paratuberculosis
gcgccgaggaucuugaucgcg

SEQ ID NO: 847956 - RNA, 15 nt, Mycobacterium avium subsp. paratuberculosis
gcgccgaggccagca

SEQ ID NO: 847957 - RNA, 16 nt, Mycobacterium avium subsp. paratuberculosis
gcgccgaggccagcac

SEQ ID NO: 847958 - RNA, 14 nt, Mycobacterium avium subsp. paratuberculosis
gcgccgagaucgcg

SEQ ID NO: 847959 - RNA, 16 nt, Mycobacterium avium subsp. paratuberculosis
gcgccgagaucgcggu

SEQ ID NO: 847960 - RNA, 17 nt, Mycobacterium avium subsp. paratuberculosis
gcgccgaggaacugcag

SEQ ID NO: 847961 - RNA, 19 nt, Mycobacterium avium subsp. paratuberculosis
gcgccgaggaacugcagcg

SEQ ID NO: 847962 - RNA, 20 nt, Mycobacterium avium subsp. paratuberculosis
gcgccgaggaacugcagcga

SEQ ID NO: 847963 - RNA, 20 nt, Mycobacterium avium subsp. paratuberculosis
gcgccagcucggcggccggg

SEQ ID NO: 847964 - RNA, 14 nt, Mycobacterium avium subsp. paratuberculosis
gcgccaggucgggg

SEQ ID NO: 847965 - RNA, 15 nt, Mycobacterium avium subsp. paratuberculosis
gcgccaggucggggu

SEQ ID NO: 847966 - RNA, 22 nt, Mycobacterium avium subsp. paratuberculosis
gcgccaggucgggguccaggcc

SEQ ID NO: 847967 - RNA, 22 nt, Mycobacterium avium subsp. paratuberculosis
gcgccaggugggugaacgccug

SEQ ID NO: 847968 - RNA, 21 nt, Mycobacterium avium subsp. paratuberculosis
gcgccagguuguaggugcccg

SEQ ID NO: 847969 - RNA, 16 nt, Mycobacterium avium subsp. paratuberculosis
gcgccaugccgccgac

SEQ ID NO: 847970 - RNA, 15 nt, Mycobacterium avium subsp. paratuberculosis
gcgccaugcgccgcg

SEQ ID NO: 847971 - RNA, 20 nt, Mycobacterium avium subsp. paratuberculosis
gcgccauggcccacgacguc

SEQ ID NO: 847972 - RNA, 17 nt, Mycobacterium avium subsp. paratuberculosis
gcgccagggugccccgc

SEQ ID NO: 847973 - RNA, 20 nt, Mycobacterium avium subsp. paratuberculosis
gcgccagggucuggcccggu

SEQ ID NO: 847974 - RNA, 21 nt, Mycobacterium avium subsp. paratuberculosis
gcgccagggucuggcccggug

SEQ ID NO: 847975 - RNA, 22 nt, Mycobacterium avium subsp. paratuberculosis
gcgccaggccggcgacgccggc

SEQ ID NO: 847976 - RNA, 18 nt, Mycobacterium avium subsp. paratuberculosis
gcgccaggcaggcggcca

SEQ ID NO: 847977 - RNA, 18 nt, Mycobacterium avium subsp. paratuberculosis
gcgccaggauccgcccgc

SEQ ID NO: 847978 - RNA, 19 nt, Mycobacterium avium subsp. paratuberculosis
gcgccaggauccgcccgcc

SEQ ID NO: 847979 - RNA, 20 nt, Mycobacterium avium subsp. paratuberculosis
gcgccaggauccgcccgccg

SEQ ID NO: 847980 - RNA, 21 nt, Mycobacterium avium subsp. paratuberculosis
gcgccaggauccgcccgccgg

SEQ ID NO: 847981 - RNA, 14 nt, Mycobacterium avium subsp. paratuberculosis
gcgcccgcgcgggc

SEQ ID NO: 847982 - RNA, 16 nt, Mycobacterium avium subsp. paratuberculosis
gcgcccgcgcgggcug

SEQ ID NO: 847983 - RNA, 18 nt, Mycobacterium avium subsp. paratuberculosis
gcgcccgcgcgggcugca

SEQ ID NO: 847984 - RNA, 22 nt, Mycobacterium avium subsp. paratuberculosis
gcgcccgcgcgugggccaacgc

SEQ ID NO: 847985 - RNA, 12 nt, Mycobacterium avium subsp. paratuberculosis
gcgcccgcggcc

SEQ ID NO: 847986 - RNA, 15 nt, Mycobacterium avium subsp. paratuberculosis
gcgcccgcgcgaucg

SEQ ID NO: 847987 - RNA, 15 nt, Mycobacterium avium subsp. paratuberculosis
gcgcccgccggccca

SEQ ID NO: 847988 - RNA, 21 nt, Mycobacterium avium subsp. paratuberculosis
gcgcccgccggcccagcucca

SEQ ID NO: 847989 - RNA, 12 nt, Mycobacterium avium subsp. paratuberculosis
gcgcccgccggc

SEQ ID NO: 847990 - RNA, 13 nt, Mycobacterium avium subsp. paratuberculosis
gcgcccgccgcgu

SEQ ID NO: 847991 - RNA, 22 nt, Mycobacterium avium subsp. paratuberculosis
gcgcccgccgcguacaccggcu

SEQ ID NO: 847992 - RNA, 13 nt, Mycobacterium avium subsp. paratuberculosis
gcgccccagcccc

SEQ ID NO: 847993 - RNA, 20 nt, Mycobacterium avium subsp. paratuberculosis
gcgccccagccccucgccgg

SEQ ID NO: 847994 - RNA, 13 nt, Mycobacterium avium subsp. paratuberculosis
gcgccccagggcc

SEQ ID NO: 847995 - RNA, 16 nt, Mycobacterium avium subsp. paratuberculosis
gcgccccccugcucgc

SEQ ID NO: 847996 - RNA, 20 nt, Mycobacterium avium subsp. paratuberculosis
gcgccccccugcucgcugug

SEQ ID NO: 847997 - RNA, 22 nt, Mycobacterium avium subsp. paratuberculosis
gcgcccccgaggagacgucggc

SEQ ID NO: 847998 - RNA, 23 nt, Mycobacterium avium subsp. paratuberculosis
gcgcccccgaggagacgucggcc

SEQ ID NO: 847999 - RNA, 14 nt, Mycobacterium avium subsp. paratuberculosis
gcgcccccgcgacg

SEQ ID NO: 848000 - RNA, 14 nt, Mycobacterium avium subsp. paratuberculosis
gcgccccgacaucg

SEQ ID NO: 848001 - RNA, 16 nt, Mycobacterium avium subsp. paratuberculosis
gcgccccgagcagcgg

SEQ ID NO: 848002 - RNA, 22 nt, Mycobacterium avium subsp. paratuberculosis
gcgccccgagcagcgggucguc

SEQ ID NO: 848003 - RNA, 17 nt, Mycobacterium avium subsp. paratuberculosis
gcgccccaacggugauc

SEQ ID NO: 848004 - RNA, 16 nt, Mycobacterium avium subsp. paratuberculosis
gcgcccagcgcgcgau

SEQ ID NO: 848005 - RNA, 21 nt, Mycobacterium avium subsp. paratuberculosis
gcgcccagcgcgcgaucgccg

SEQ ID NO: 848006 - RNA, 15 nt, Mycobacterium avium subsp. paratuberculosis
gcgcccagcggcgau

SEQ ID NO: 848007 - RNA, 17 nt, Mycobacterium avium subsp. paratuberculosis
gcgcccagcggcgaugc

SEQ ID NO: 848008 - RNA, 19 nt, Mycobacterium avium subsp. paratuberculosis
gcgcccagcggcgaugccc

SEQ ID NO: 848009 - RNA, 14 nt, Mycobacterium avium subsp. paratuberculosis
gcgcccagcguggu

SEQ ID NO: 848010 - RNA, 22 nt, Mycobacterium avium subsp. paratuberculosis
gcgcccaugaacgcgucgccgu

SEQ ID NO: 848011 - RNA, 23 nt, Mycobacterium avium subsp. paratuberculosis
gcgcccaugaacgcgucgccgug

SEQ ID NO: 848012 - RNA, 12 nt, Mycobacterium avium subsp. paratuberculosis
gcgcccagcggc

SEQ ID NO: 848013 - RNA, 20 nt, Mycobacterium avium subsp. paratuberculosis
gcgcccagcgagcugccggc

SEQ ID NO: 848014 - RNA, 12 nt, Mycobacterium avium subsp. paratuberculosis
gcgcccagcgag

SEQ ID NO: 848015 - RNA, 19 nt, Mycobacterium avium subsp. paratuberculosis
gcgcccagccccagcacga

SEQ ID NO: 848016 - RNA, 22 nt, Mycobacterium avium subsp. paratuberculosis
gcgcccagcccgagcaccagcg

SEQ ID NO: 848017 - RNA, 16 nt, Mycobacterium avium subsp. paratuberculosis
gcgcccagccgagccg

SEQ ID NO: 848018 - RNA, 21 nt, Mycobacterium avium subsp. paratuberculosis
gcgcccagccgagccgggcca

SEQ ID NO: 848019 - RNA, 13 nt, Mycobacterium avium subsp. paratuberculosis
gcgcccagcaccc

SEQ ID NO: 848020 - RNA, 14 nt, Mycobacterium avium subsp. paratuberculosis
gcgcccagcacccg

SEQ ID NO: 848021 - RNA, 14 nt, Mycobacterium avium subsp. paratuberculosis
gcgcccagcacguc

SEQ ID NO: 848022 - RNA, 19 nt, Mycobacterium avium subsp. paratuberculosis
gcgcccagcacgucaccgc

SEQ ID NO: 848023 - RNA, 18 nt, Mycobacterium avium subsp. paratuberculosis
gcgcccagaagccccggu

SEQ ID NO: 848024 - RNA, 16 nt, Mycobacterium avium subsp. paratuberculosis
gcgcccagaugccgcc

SEQ ID NO: 848025 - RNA, 16 nt, Mycobacterium avium subsp. paratuberculosis
gcgcccagaugccggc

SEQ ID NO: 848026 - RNA, 18 nt, Mycobacterium avium subsp. paratuberculosis
gcgcccagaugccggcgu

SEQ ID NO: 848027 - RNA, 20 nt, Mycobacterium avium subsp. paratuberculosis
gcgcccagcaaacccagcac

SEQ ID NO: 848028 - RNA, 21 nt, Mycobacterium avium subsp. paratuberculosis
gcgcccaccgcggcgcgcggc

SEQ ID NO: 848029 - RNA, 21 nt, Mycobacterium avium subsp. paratuberculosis
gcgcccaccuggaggccaacg

SEQ ID NO: 848030 - RNA, 15 nt, Mycobacterium avium subsp. paratuberculosis
gcgccauguccggca

SEQ ID NO: 848031 - RNA, 16 nt, Mycobacterium avium subsp. paratuberculosis
gcgccauguccggcag

SEQ ID NO: 848032 - RNA, 21 nt, Mycobacterium avium subsp. paratuberculosis
gcgccauguccggcaggcuca

SEQ ID NO: 848033 - RNA, 18 nt, Mycobacterium avium subsp. paratuberculosis
gcgccauguccuugguga

SEQ ID NO: 848034 - RNA, 23 nt, Mycobacterium avium subsp. paratuberculosis
gucaauugccaacugcagcaacg

SEQ ID NO: 848035 - RNA, 16 nt, Mycobacterium avium subsp. paratuberculosis
gucaauugccacagcc

SEQ ID NO: 848036 - RNA, 19 nt, Mycobacterium avium subsp. paratuberculosis
gucaauugccacagccggu

SEQ ID NO: 848037 - RNA, 15 nt, Mycobacterium avium subsp. paratuberculosis
gucacacccucggcc

SEQ ID NO: 848038 - RNA, 18 nt, Mycobacterium avium subsp. paratuberculosis
gucacacccucggcccgc

SEQ ID NO: 848039 - RNA, 23 nt, Mycobacterium avium subsp. paratuberculosis
gucaauccccgcgguucgaggug

SEQ ID NO: 848040 - RNA, 19 nt, Mycobacterium avium subsp. paratuberculosis
gucaacccgcucaggucgg

SEQ ID NO: 848041 - RNA, 13 nt, Mycobacterium avium subsp. paratuberculosis
gucaagccggcca

SEQ ID NO: 848042 - RNA, 15 nt, Mycobacterium avium subsp. paratuberculosis
gucaagccggccagc

SEQ ID NO: 848043 - RNA, 20 nt, Mycobacterium avium subsp. paratuberculosis
gucaagccggccagcagcgg

SEQ ID NO: 848044 - RNA, 16 nt, Mycobacterium avium subsp. paratuberculosis
gucaagauaccggccg

SEQ ID NO: 848045 - RNA, 17 nt, Mycobacterium avium subsp. paratuberculosis
gucaagauaccggccgg

SEQ ID NO: 848046 - RNA, 22 nt, Mycobacterium avium subsp. paratuberculosis
gucaagauaccggccggcgcgg

SEQ ID NO: 848047 - RNA, 14 nt, Mycobacterium avium subsp. paratuberculosis
gucaacggcaccga

SEQ ID NO: 848048 - RNA, 16 nt, Mycobacterium avium subsp. paratuberculosis
gucaacucgacccgca

SEQ ID NO: 848049 - RNA, 16 nt, Mycobacterium avium subsp. paratuberculosis
gucaacucgucggcga

SEQ ID NO: 848050 - RNA, 19 nt, Mycobacterium avium subsp. paratuberculosis
gucaagaacgaaucgucgc

SEQ ID NO: 848051 - RNA, 21 nt, Mycobacterium avium subsp. paratuberculosis
gucaagaacgaaucgucgccg

SEQ ID NO: 848052 - RNA, 23 nt, Mycobacterium avium subsp. paratuberculosis
gucaccggaauugaagcccugcu

SEQ ID NO: 848053 - RNA, 22 nt, Mycobacterium avium subsp. paratuberculosis
gucaccgcgaccaugcccggcg

SEQ ID NO: 848054 - RNA, 19 nt, Mycobacterium avium subsp. paratuberculosis
gucaccggaugcaccggca

SEQ ID NO: 848055 - RNA, 18 nt, Mycobacterium avium subsp. paratuberculosis
gucaccggcaaggugccg

SEQ ID NO: 848056 - RNA, 21 nt, Mycobacterium avium subsp. paratuberculosis
gucaccggcaaggugccgucc

SEQ ID NO: 848057 - RNA, 13 nt, Mycobacterium avium subsp. paratuberculosis
gucaccggcaggc

SEQ ID NO: 848058 - RNA, 15 nt, Mycobacterium avium subsp. paratuberculosis
gucaccggcaggcgg

SEQ ID NO: 848059 - RNA, 16 nt, Mycobacterium avium subsp. paratuberculosis
gucaccggcaggcggu

SEQ ID NO: 848060 - RNA, 21 nt, Mycobacterium avium subsp. paratuberculosis
gucaccgcgcuugccgcgacc

SEQ ID NO: 848061 - RNA, 22 nt, Mycobacterium avium subsp. paratuberculosis
gucaccgcgggaauggccgcgc

SEQ ID NO: 848062 - RNA, 23 nt, Mycobacterium avium subsp. paratuberculosis
gucaccgcgggaauggccgcgcc

SEQ ID NO: 848063 - RNA, 22 nt, Mycobacterium avium subsp. paratuberculosis
gucaccgcgggugaucugcgcc

SEQ ID NO: 848064 - RNA, 17 nt, Mycobacterium avium subsp. paratuberculosis
gucacccgugggccgac

SEQ ID NO: 848065 - RNA, 22 nt, Mycobacterium avium subsp. paratuberculosis
gucacccgugggccgaccggcc

SEQ ID NO: 848066 - RNA, 23 nt, Mycobacterium avium subsp. paratuberculosis
gucacccgugggccgaccggccg

SEQ ID NO: 848067 - RNA, 18 nt, Mycobacterium avium subsp. paratuberculosis
gucacccuccucgcggcg

SEQ ID NO: 848068 - RNA, 15 nt, Mycobacterium avium subsp. paratuberculosis
gucacccucgaggcc

SEQ ID NO: 848069 - RNA, 15 nt, Mycobacterium avium subsp. paratuberculosis
gucaccgagcggccg

SEQ ID NO: 848070 - RNA, 17 nt, Mycobacterium avium subsp. paratuberculosis
gucaccgagcggccguc

SEQ ID NO: 848071 - RNA, 21 nt, Mycobacterium avium subsp. paratuberculosis
gucaccgagguagggccgggu

SEQ ID NO: 848072 - RNA, 18 nt, Mycobacterium avium subsp. paratuberculosis
gucaccgacgccagcggg

SEQ ID NO: 848073 - RNA, 12 nt, Mycobacterium avium subsp. paratuberculosis
gucaccgacggc

SEQ ID NO: 848074 - RNA, 12 nt, Mycobacterium avium subsp. paratuberculosis
gucaccgccgca

SEQ ID NO: 848075 - RNA, 22 nt, Mycobacterium avium subsp. paratuberculosis
gucaccgccgcaccgucgugcc

SEQ ID NO: 848076 - RNA, 21 nt, Mycobacterium avium subsp. paratuberculosis
gucaccgaccccucggcggcc

SEQ ID NO: 848077 - RNA, 13 nt, Mycobacterium avium subsp. paratuberculosis
gucaccgacgcca

SEQ ID NO: 848078 - RNA, 11 nt, Mycobacterium avium subsp. paratuberculosis
gucaccacggu

SEQ ID NO: 848079 - RNA, 16 nt, Mycobacterium avium subsp. paratuberculosis
gucaccacggucaccc

SEQ ID NO: 848080 - RNA, 13 nt, Mycobacterium avium subsp. paratuberculosis
gucaccaccgagc

SEQ ID NO: 848081 - RNA, 13 nt, Mycobacterium avium subsp. paratuberculosis
gucacagccgcga

SEQ ID NO: 848082 - RNA, 14 nt, Mycobacterium avium subsp. paratuberculosis
gucacaccgcggcc

SEQ ID NO: 848083 - RNA, 17 nt, Mycobacterium avium subsp. paratuberculosis
gucacaccgcggccagc

SEQ ID NO: 848084 - RNA, 20 nt, Mycobacterium avium subsp. paratuberculosis
gucacaccgcggccagcgcg

SEQ ID NO: 848085 - RNA, 16 nt, Mycobacterium avium subsp. paratuberculosis
gucacauacgccucac

SEQ ID NO: 848086 - RNA, 17 nt, Mycobacterium avium subsp. paratuberculosis
gucacauacgccucacc

SEQ ID NO: 848087 - RNA, 20 nt, Mycobacterium avium subsp. paratuberculosis
gucaccaacaugaucggcgc

SEQ ID NO: 848088 - RNA, 17 nt, Mycobacterium avium subsp. paratuberculosis
gucaccaacgcgaaggu

SEQ ID NO: 848089 - RNA, 20 nt, Mycobacterium avium subsp. paratuberculosis
gucaccaaugcgccggcggc

SEQ ID NO: 848090 - RNA, 16 nt, Mycobacterium avium subsp. paratuberculosis
gucacccgcagcccga

SEQ ID NO: 848091 - RNA, 17 nt, Mycobacterium avium subsp. paratuberculosis
gucacccgcagcccgac

SEQ ID NO: 848092 - RNA, 22 nt, Mycobacterium avium subsp. paratuberculosis
gucaccccggagauccggccgc

SEQ ID NO: 848093 - RNA, 13 nt, Mycobacterium avium subsp. paratuberculosis
gucaccccgaguu

SEQ ID NO: 848094 - RNA, 21 nt, Mycobacterium avium subsp. paratuberculosis
gucacccccggcgcgacggca

SEQ ID NO: 848095 - RNA, 17 nt, Mycobacterium avium subsp. paratuberculosis
gucaccaggucgcggua

SEQ ID NO: 848096 - RNA, 18 nt, Mycobacterium avium subsp. paratuberculosis
gucacccacuggcggccg

SEQ ID NO: 848097 - RNA, 13 nt, Mycobacterium avium subsp. paratuberculosis
gucaccagcgcgg

SEQ ID NO: 848098 - RNA, 16 nt, Mycobacterium avium subsp. paratuberculosis
gucaccagcggcccgc

SEQ ID NO: 848099 - RNA, 19 nt, Mycobacterium avium subsp. paratuberculosis
gucaccagcggcccgcugu

SEQ ID NO: 848100 - RNA, 22 nt, Mycobacterium avium subsp. paratuberculosis
gucaccaggcugcucggcgggc

SEQ ID NO: 848101 - RNA, 20 nt, Mycobacterium avium subsp. paratuberculosis
guaucgcgccugcaccggcg

SEQ ID NO: 848102 - RNA, 15 nt, Mycobacterium avium subsp. paratuberculosis
guaucgggucaccgu

SEQ ID NO: 848103 - RNA, 21 nt, Mycobacterium avium subsp. paratuberculosis
guaucgggucaccgugcgggu

SEQ ID NO: 848104 - RNA, 15 nt, Mycobacterium avium subsp. paratuberculosis
guaugcgguccucga

SEQ ID NO: 848105 - RNA, 16 nt, Mycobacterium avium subsp. paratuberculosis
guaugccuuggcccgc

SEQ ID NO: 848106 - RNA, 18 nt, Mycobacterium avium subsp. paratuberculosis
guaugccuuggcccgcgc

SEQ ID NO: 848107 - RNA, 19 nt, Mycobacterium avium subsp. paratuberculosis
guaugcccgccgcgucagc

SEQ ID NO: 848108 - RNA, 15 nt, Mycobacterium avium subsp. paratuberculosis
guaugcccgccgcug

SEQ ID NO: 848109 - RNA, 14 nt, Mycobacterium avium subsp. paratuberculosis
guauuccagcgcca

SEQ ID NO: 848110 - RNA, 22 nt, Mycobacterium avium subsp. paratuberculosis
guauucgcgggaggacagcgcg

SEQ ID NO: 848111 - RNA, 14 nt, Mycobacterium avium subsp. paratuberculosis
guauucgacggcga

SEQ ID NO: 848112 - RNA, 15 nt, Mycobacterium avium subsp. paratuberculosis
guauucgacggcgac

SEQ ID NO: 848113 - RNA, 17 nt, Mycobacterium avium subsp. paratuberculosis
guauugcacggcggcga

SEQ ID NO: 848114 - RNA, 16 nt, Mycobacterium avium subsp. paratuberculosis
guauucaucgcggccg

SEQ ID NO: 848115 - RNA, 19 nt, Mycobacterium avium subsp. paratuberculosis
gucaaagccguucgcgccg

SEQ ID NO: 848116 - RNA, 13 nt, Mycobacterium avium subsp. paratuberculosis
gucacugcccagc

SEQ ID NO: 848117 - RNA, 16 nt, Mycobacterium avium subsp. paratuberculosis
gucacugucggcgcgg

SEQ ID NO: 848118 - RNA, 18 nt, Mycobacterium avium subsp. paratuberculosis
gucacucgaccuucgagc

SEQ ID NO: 848119 - RNA, 20 nt, Mycobacterium avium subsp. paratuberculosis
gucacucuggcgugacgcuc

SEQ ID NO: 848120 - RNA, 20 nt, Mycobacterium avium subsp. paratuberculosis
gucacucuggcgugacguuc

SEQ ID NO: 848121 - RNA, 13 nt, Mycobacterium avium subsp. paratuberculosis
gucagaccccgua

SEQ ID NO: 848122 - RNA, 19 nt, Mycobacterium avium subsp. paratuberculosis
gucagaccccguaccagcg

SEQ ID NO: 848123 - RNA, 15 nt, Mycobacterium avium subsp. paratuberculosis
gucagaccgcggcgg

SEQ ID NO: 848124 - RNA, 19 nt, Mycobacterium avium subsp. paratuberculosis
gucagaccgcggcggucgc

SEQ ID NO: 848125 - RNA, 23 nt, Mycobacterium avium subsp. paratuberculosis
gucagaaccggggccagcacgcc

SEQ ID NO: 848126 - RNA, 19 nt, Mycobacterium avium subsp. paratuberculosis
gucagacgaugggccgccc

SEQ ID NO: 848127 - RNA, 22 nt, Mycobacterium avium subsp. paratuberculosis
gucagacgaugggccgcccgcu

SEQ ID NO: 848128 - RNA, 23 nt, Mycobacterium avium subsp. paratuberculosis
gucagagcccgaacacgggcggc

SEQ ID NO: 848129 - RNA, 22 nt, Mycobacterium avium subsp. paratuberculosis
gucagaucguugaugucggugg

SEQ ID NO: 848130 - RNA, 13 nt, Mycobacterium avium subsp. paratuberculosis
gucagcaccacca

SEQ ID NO: 848131 - RNA, 17 nt, Mycobacterium avium subsp. paratuberculosis
gucacguugaugaucgc

SEQ ID NO: 848132 - RNA, 16 nt, Mycobacterium avium subsp. paratuberculosis
gucacguucaccaccg

SEQ ID NO: 848133 - RNA, 18 nt, Mycobacterium avium subsp. paratuberculosis
gucacggauacccgcggc

SEQ ID NO: 848134 - RNA, 15 nt, Mycobacterium avium subsp. paratuberculosis
gucacgucgacggcc

SEQ ID NO: 848135 - RNA, 15 nt, Mycobacterium avium subsp. paratuberculosis
gucacgucggccugc

SEQ ID NO: 848136 - RNA, 16 nt, Mycobacterium avium subsp. paratuberculosis
gucacgucggccugca

SEQ ID NO: 848137 - RNA, 21 nt, Mycobacterium avium subsp. paratuberculosis
gucacgugcacccacgccagc

SEQ ID NO: 848138 - RNA, 23 nt, Mycobacterium avium subsp. paratuberculosis
gucacguagugcuucuugaagaa

SEQ ID NO: 848139 - RNA, 16 nt, Mycobacterium avium subsp. paratuberculosis
gucacgucauuucggu

SEQ ID NO: 848140 - RNA, 22 nt, Mycobacterium avium subsp. paratuberculosis
gucacgucauuucggucggcag

SEQ ID NO: 848141 - RNA, 18 nt, Mycobacterium avium subsp. paratuberculosis
gucacguccacgccgcgg

SEQ ID NO: 848142 - RNA, 19 nt, Mycobacterium avium subsp. paratuberculosis
gucacguccaucauggcgc

SEQ ID NO: 848143 - RNA, 20 nt, Mycobacterium avium subsp. paratuberculosis
gucacguccaucauggcgcu

SEQ ID NO: 848144 - RNA, 14 nt, Mycobacterium avium subsp. paratuberculosis
gucacguagcgcgg

SEQ ID NO: 848145 - RNA, 16 nt, Mycobacterium avium subsp. paratuberculosis
gucacguagcgcggcc

SEQ ID NO: 848146 - RNA, 20 nt, Mycobacterium avium subsp. paratuberculosis
gucacguagcgcggccgccc

SEQ ID NO: 848147 - RNA, 17 nt, Mycobacterium avium subsp. paratuberculosis
gucacggaucgcccacc

SEQ ID NO: 848148 - RNA, 19 nt, Mycobacterium avium subsp. paratuberculosis
gucacggaucgcccacccg

SEQ ID NO: 848149 - RNA, 23 nt, Mycobacterium avium subsp. paratuberculosis
gucacggcgaggauggcgaucau

SEQ ID NO: 848150 - RNA, 15 nt, Mycobacterium avium subsp. paratuberculosis
gucacggcgggucgg

SEQ ID NO: 848151 - RNA, 16 nt, Mycobacterium avium subsp. paratuberculosis
gucacggcugccgacc

SEQ ID NO: 848152 - RNA, 17 nt, Mycobacterium avium subsp. paratuberculosis
gucacggcugccgaccu

SEQ ID NO: 848153 - RNA, 16 nt, Mycobacterium avium subsp. paratuberculosis
gucacgggccaggcgc

SEQ ID NO: 848154 - RNA, 17 nt, Mycobacterium avium subsp. paratuberculosis
gucacgggccaggcgcg

SEQ ID NO: 848155 - RNA, 18 nt, Mycobacterium avium subsp. paratuberculosis
gucacgggccaggcgcgc

SEQ ID NO: 848156 - RNA, 21 nt, Mycobacterium avium subsp. paratuberculosis
gucacgggcugaccgccagga

SEQ ID NO: 848157 - RNA, 15 nt, Mycobacterium avium subsp. paratuberculosis
gucacgguccagguc

SEQ ID NO: 848158 - RNA, 21 nt, Mycobacterium avium subsp. paratuberculosis
gucacggucuggcuggugacc

SEQ ID NO: 848159 - RNA, 19 nt, Mycobacterium avium subsp. paratuberculosis
gucaccgucguacucgacc

SEQ ID NO: 848160 - RNA, 22 nt, Mycobacterium avium subsp. paratuberculosis
gucaccgggugaugucgccgac

SEQ ID NO: 848161 - RNA, 23 nt, Mycobacterium avium subsp. paratuberculosis
gucaccgggugaugucgccgacc

SEQ ID NO: 848162 - RNA, 24 nt, Mycobacterium avium subsp. paratuberculosis
gucaccgggugaugucgccgacca

SEQ ID NO: 848163 - RNA, 15 nt, Mycobacterium avium subsp. paratuberculosis
gucaccggcucggga

SEQ ID NO: 848164 - RNA, 17 nt, Mycobacterium avium subsp. paratuberculosis
gucaccggcugcccgac

SEQ ID NO: 848165 - RNA, 13 nt, Mycobacterium avium subsp. paratuberculosis
gucaccggggugc

SEQ ID NO: 848166 - RNA, 15 nt, Mycobacterium avium subsp. paratuberculosis
gucaccggggugccg

SEQ ID NO: 848167 - RNA, 21 nt, Mycobacterium avium subsp. paratuberculosis
gucaccggggugccgcccaac

SEQ ID NO: 848168 - RNA, 14 nt, Mycobacterium avium subsp. paratuberculosis
gucaccggccaucc

SEQ ID NO: 848169 - RNA, 23 nt, Mycobacterium avium subsp. paratuberculosis
gucaccggccauccgcugcgcgu

SEQ ID NO: 848170 - RNA, 16 nt, Mycobacterium avium subsp. paratuberculosis
gucaccgugccgucgc

SEQ ID NO: 848171 - RNA, 19 nt, Mycobacterium avium subsp. paratuberculosis
gucaccgugcgggucgcgc

SEQ ID NO: 848172 - RNA, 21 nt, Mycobacterium avium subsp. paratuberculosis
gucaccgugcgggucgcgcug

SEQ ID NO: 848173 - RNA, 17 nt, Mycobacterium avium subsp. paratuberculosis
gucaccgugggcggcgc

SEQ ID NO: 848174 - RNA, 18 nt, Mycobacterium avium subsp. paratuberculosis
gucaccgugggcggcgcg

SEQ ID NO: 848175 - RNA, 23 nt, Mycobacterium avium subsp. paratuberculosis
gucaccgugggcggcgcgaucgu

SEQ ID NO: 848176 - RNA, 18 nt, Mycobacterium avium subsp. paratuberculosis
gucaccgugucggcgggc

SEQ ID NO: 848177 - RNA, 15 nt, Mycobacterium avium subsp. paratuberculosis
gucaccucgaccaga

SEQ ID NO: 848178 - RNA, 17 nt, Mycobacterium avium subsp. paratuberculosis
gucaccuucaccacggc

SEQ ID NO: 848179 - RNA, 22 nt, Mycobacterium avium subsp. paratuberculosis
gucaccuucaccacggccauca

SEQ ID NO: 848180 - RNA, 21 nt, Mycobacterium avium subsp. paratuberculosis
gucacgaagaaguauucgccg

SEQ ID NO: 848181 - RNA, 22 nt, Mycobacterium avium subsp. paratuberculosis
gucacgacggucacggccgcca

SEQ ID NO: 848182 - RNA, 20 nt, Mycobacterium avium subsp. paratuberculosis
gucacgcaucagggccagcc

SEQ ID NO: 848183 - RNA, 22 nt, Mycobacterium avium subsp. paratuberculosis
gucacgcaucagggccagccga

SEQ ID NO: 848184 - RNA, 22 nt, Mycobacterium avium subsp. paratuberculosis
gucacgccagcgugacgccggg

SEQ ID NO: 848185 - RNA, 20 nt, Mycobacterium avium subsp. paratuberculosis
gucacgccagcgugacgcuc

SEQ ID NO: 848186 - RNA, 22 nt, Mycobacterium avium subsp. paratuberculosis
gucacgccagcgugacgcucgg

SEQ ID NO: 848187 - RNA, 17 nt, Mycobacterium avium subsp. paratuberculosis
gucacgccaguguggcc

SEQ ID NO: 848188 - RNA, 21 nt, Mycobacterium avium subsp. paratuberculosis
gucacgccaguguggccgcgg

SEQ ID NO: 848189 - RNA, 22 nt, Mycobacterium avium subsp. paratuberculosis
gucaccugacgcucggucgcca

SEQ ID NO: 848190 - RNA, 22 nt, Mycobacterium avium subsp. paratuberculosis
gucacgcccggguacaccgacu

SEQ ID NO: 848191 - RNA, 18 nt, Mycobacterium avium subsp. paratuberculosis
gucacgcccguugacgcc

SEQ ID NO: 848192 - RNA, 13 nt, Mycobacterium avium subsp. paratuberculosis
gucacgccgcgcc

SEQ ID NO: 848193 - RNA, 16 nt, Mycobacterium avium subsp. paratuberculosis
gucacgccgcgcccgu

SEQ ID NO: 848194 - RNA, 20 nt, Mycobacterium avium subsp. paratuberculosis
gucacgcuagcgugacaguc

SEQ ID NO: 848195 - RNA, 13 nt, Mycobacterium avium subsp. paratuberculosis
gucacggccgcca

SEQ ID NO: 848196 - RNA, 16 nt, Mycobacterium avium subsp. paratuberculosis
gucacggccgccagca

SEQ ID NO: 848197 - RNA, 13 nt, Mycobacterium avium subsp. paratuberculosis
gucacggccgucc

SEQ ID NO: 848198 - RNA, 17 nt, Mycobacterium avium subsp. paratuberculosis
gucacggccguccaggc

SEQ ID NO: 848199 - RNA, 19 nt, Mycobacterium avium subsp. paratuberculosis
gucacggccguccaggcgc

SEQ ID NO: 848200 - RNA, 22 nt, Mycobacterium avium subsp. paratuberculosis
gucacggccguccaggcgccau

SEQ ID NO: 848201 - RNA, 14 nt, Mycobacterium avium subsp. paratuberculosis
gucacgccggggua

SEQ ID NO: 848202 - RNA, 19 nt, Mycobacterium avium subsp. paratuberculosis
gucacgcugaacggugccg

SEQ ID NO: 848203 - RNA, 21 nt, Mycobacterium avium subsp. paratuberculosis
gucacgcugaacggugccguc

SEQ ID NO: 848204 - RNA, 18 nt, Mycobacterium avium subsp. paratuberculosis
gucacgcugcgcgccgau

SEQ ID NO: 848205 - RNA, 20 nt, Mycobacterium avium subsp. paratuberculosis
gucacgcuggcgugacaguc

SEQ ID NO: 848206 - RNA, 23 nt, Mycobacterium avium subsp. paratuberculosis
gucacgcuggcgugacgcucggc

SEQ ID NO: 848207 - RNA, 20 nt, Mycobacterium avium subsp. paratuberculosis
gucacgcuggcgugacgguc

SEQ ID NO: 848208 - RNA, 20 nt, Mycobacterium avium subsp. paratuberculosis
gucacgcuggcgugacguuc

SEQ ID NO: 848209 - RNA, 22 nt, Mycobacterium avium subsp. paratuberculosis
gucacgcuggcguggcacccgg

SEQ ID NO: 848210 - RNA, 18 nt, Mycobacterium avium subsp. paratuberculosis
gucacgcuggcguggcgc

SEQ ID NO: 848211 - RNA, 23 nt, Mycobacterium avium subsp. paratuberculosis
gucacgcuggcguggcgccggcg

SEQ ID NO: 848212 - RNA, 18 nt, Mycobacterium avium subsp. paratuberculosis
gucacgcuggugacgugc

SEQ ID NO: 848213 - RNA, 15 nt, Mycobacterium avium subsp. paratuberculosis
gucagcgucucggcg

SEQ ID NO: 848214 - RNA, 16 nt, Mycobacterium avium subsp. paratuberculosis
gucagcgucucggcga

SEQ ID NO: 848215 - RNA, 23 nt, Mycobacterium avium subsp. paratuberculosis
gucagcgucucggcgaucagcug

SEQ ID NO: 848216 - RNA, 13 nt, Mycobacterium avium subsp. paratuberculosis
gucagcggcguca

SEQ ID NO: 848217 - RNA, 20 nt, Mycobacterium avium subsp. paratuberculosis
gucagcggcgucaggauggu

SEQ ID NO: 848218 - RNA, 17 nt, Mycobacterium avium subsp. paratuberculosis
gucagcggcgccaccgg

SEQ ID NO: 848219 - RNA, 16 nt, Mycobacterium avium subsp. paratuberculosis
gucagcuccaccugcg

SEQ ID NO: 848220 - RNA, 20 nt, Mycobacterium avium subsp. paratuberculosis
gucagcuccaccugcggcac

SEQ ID NO: 848221 - RNA, 16 nt, Mycobacterium avium subsp. paratuberculosis
gucagcucccccgaca

SEQ ID NO: 848222 - RNA, 15 nt, Mycobacterium avium subsp. paratuberculosis
gucagcguggcgucg

SEQ ID NO: 848223 - RNA, 19 nt, Mycobacterium avium subsp. paratuberculosis
gucagcguggcgucggcgc

SEQ ID NO: 848224 - RNA, 21 nt, Mycobacterium avium subsp. paratuberculosis
gucagcguggcgucggcgcgc

SEQ ID NO: 848225 - RNA, 21 nt, Mycobacterium avium subsp. paratuberculosis
gucagcguccaguccggcgug

SEQ ID NO: 848226 - RNA, 16 nt, Mycobacterium avium subsp. paratuberculosis
gucagcgucgccgccc

SEQ ID NO: 848227 - RNA, 23 nt, Mycobacterium avium subsp. paratuberculosis
gucagcuaggaagccagccgucc

SEQ ID NO: 848228 - RNA, 13 nt, Mycobacterium avium subsp. paratuberculosis
gucagcggccucg

SEQ ID NO: 848229 - RNA, 13 nt, Mycobacterium avium subsp. paratuberculosis
gucagcggcccga

SEQ ID NO: 848230 - RNA, 15 nt, Mycobacterium avium subsp. paratuberculosis
gucagcggcaacacg

SEQ ID NO: 848231 - RNA, 14 nt, Mycobacterium avium subsp. paratuberculosis
gucagcgcgggcca

SEQ ID NO: 848232 - RNA, 18 nt, Mycobacterium avium subsp. paratuberculosis
gucagcgcggucagcccg

SEQ ID NO: 848233 - RNA, 22 nt, Mycobacterium avium subsp. paratuberculosis
gucagcgcguccaggugcgccg

SEQ ID NO: 848234 - RNA, 16 nt, Mycobacterium avium subsp. paratuberculosis
gucagcgcgucggcga

SEQ ID NO: 848235 - RNA, 21 nt, Mycobacterium avium subsp. paratuberculosis
gucagcgcgucggcgaccgcg

SEQ ID NO: 848236 - RNA, 17 nt, Mycobacterium avium subsp. paratuberculosis
gucagcgcuccuggccg

SEQ ID NO: 848237 - RNA, 16 nt, Mycobacterium avium subsp. paratuberculosis
gucagcgcuuccagcg

SEQ ID NO: 848238 - RNA, 18 nt, Mycobacterium avium subsp. paratuberculosis
gucagcgcuuccagcgcg

SEQ ID NO: 848239 - RNA, 23 nt, Mycobacterium avium subsp. paratuberculosis
gucagcgcuuccagcgcggcgau

SEQ ID NO: 848240 - RNA, 13 nt, Mycobacterium avium subsp. paratuberculosis
gucagcgcgccgu

SEQ ID NO: 848241 - RNA, 15 nt, Mycobacterium avium subsp. paratuberculosis
gucagcgcgccgucg

SEQ ID NO: 848242 - RNA, 16 nt, Mycobacterium avium subsp. paratuberculosis
gucagcgcgccgucgg

SEQ ID NO: 848243 - RNA, 16 nt, Mycobacterium avium subsp. paratuberculosis
gucagcgcgaccucgg

SEQ ID NO: 848244 - RNA, 19 nt, Mycobacterium avium subsp. paratuberculosis
gucagcgcggcccgcggcg

SEQ ID NO: 848245 - RNA, 17 nt, Mycobacterium avium subsp. paratuberculosis
gucaggcauuccaccgc

SEQ ID NO: 848246 - RNA, 22 nt, Mycobacterium avium subsp. paratuberculosis
gucaggcauuccaccgcgcggc

SEQ ID NO: 848247 - RNA, 17 nt, Mycobacterium avium subsp. paratuberculosis
gucaggccgucucgagc

SEQ ID NO: 848248 - RNA, 22 nt, Mycobacterium avium subsp. paratuberculosis
gucaggccgugaucggccagcc

SEQ ID NO: 848249 - RNA, 19 nt, Mycobacterium avium subsp. paratuberculosis
gucaggccggucagcgacg

SEQ ID NO: 848250 - RNA, 14 nt, Mycobacterium avium subsp. paratuberculosis
gucaggccguagcg

SEQ ID NO: 848251 - RNA, 19 nt, Mycobacterium avium subsp. paratuberculosis
gucaggccguagcggcucg

SEQ ID NO: 848252 - RNA, 14 nt, Mycobacterium avium subsp. paratuberculosis
gucaggcccagcga

SEQ ID NO: 848253 - RNA, 14 nt, Mycobacterium avium subsp. paratuberculosis
gucauaucgacggc

SEQ ID NO: 848254 - RNA, 16 nt, Mycobacterium avium subsp. paratuberculosis
gucauaggccgcgcag

SEQ ID NO: 848255 - RNA, 17 nt, Mycobacterium avium subsp. paratuberculosis
gucauaggccgcgcaga

SEQ ID NO: 848256 - RNA, 23 nt, Mycobacterium avium subsp. paratuberculosis
gucaggccgggaaugucgcgcag

SEQ ID NO: 848257 - RNA, 21 nt, Mycobacterium avium subsp. paratuberculosis
gucaggccucgaggaucgcgg

SEQ ID NO: 848258 - RNA, 20 nt, Mycobacterium avium subsp. paratuberculosis
gucaggccugguaggccgcc

SEQ ID NO: 848259 - RNA, 17 nt, Mycobacterium avium subsp. paratuberculosis
gucagccacucgccgug

SEQ ID NO: 848260 - RNA, 16 nt, Mycobacterium avium subsp. paratuberculosis
gucagcccccaccgcg

SEQ ID NO: 848261 - RNA, 17 nt, Mycobacterium avium subsp. paratuberculosis
gucagcccccaccgcgc

SEQ ID NO: 848262 - RNA, 21 nt, Mycobacterium avium subsp. paratuberculosis
gucagcccccaccgcgccgug

SEQ ID NO: 848263 - RNA, 21 nt, Mycobacterium avium subsp. paratuberculosis
gucagccccgaguccacgacg

SEQ ID NO: 848264 - RNA, 17 nt, Mycobacterium avium subsp. paratuberculosis
gucagcccgcgucgcgc

SEQ ID NO: 848265 - RNA, 13 nt, Mycobacterium avium subsp. paratuberculosis
gucagccgcacca

SEQ ID NO: 848266 - RNA, 21 nt, Mycobacterium avium subsp. paratuberculosis
gucagccgcccuuguugaugg

SEQ ID NO: 848267 - RNA, 14 nt, Mycobacterium avium subsp. paratuberculosis
gucagccgcggcgg

SEQ ID NO: 848268 - RNA, 15 nt, Mycobacterium avium subsp. paratuberculosis
gucagccgcggcucg

SEQ ID NO: 848269 - RNA, 20 nt, Mycobacterium avium subsp. paratuberculosis
gucagccgcggcucgaugga

SEQ ID NO: 848270 - RNA, 16 nt, Mycobacterium avium subsp. paratuberculosis
gucagcgacaacggcc

SEQ ID NO: 848271 - RNA, 14 nt, Mycobacterium avium subsp. paratuberculosis
gucagccgucgucg

SEQ ID NO: 848272 - RNA, 19 nt, Mycobacterium avium subsp. paratuberculosis
gucagccgggccagcccgg

SEQ ID NO: 848273 - RNA, 13 nt, Mycobacterium avium subsp. paratuberculosis
gucagccgggcgg

SEQ ID NO: 848274 - RNA, 12 nt, Mycobacterium avium subsp. paratuberculosis
gucagcgccgcc

SEQ ID NO: 848275 - RNA, 15 nt, Mycobacterium avium subsp. paratuberculosis
gucagcgccgcccgc

SEQ ID NO: 848276 - RNA, 16 nt, Mycobacterium avium subsp. paratuberculosis
gucagcgccgcccgca

SEQ ID NO: 848277 - RNA, 13 nt, Mycobacterium avium subsp. paratuberculosis
gucagcaccgcgc

SEQ ID NO: 848278 - RNA, 14 nt, Mycobacterium avium subsp. paratuberculosis
gucagcaccgcgcg

SEQ ID NO: 848279 - RNA, 15 nt, Mycobacterium avium subsp. paratuberculosis
gucagcaccgcgcgg

SEQ ID NO: 848280 - RNA, 15 nt, Mycobacterium avium subsp. paratuberculosis
gucagcaccggggcc

SEQ ID NO: 848281 - RNA, 18 nt, Mycobacterium avium subsp. paratuberculosis
gucagcaccgucaccgcc

SEQ ID NO: 848282 - RNA, 18 nt, Mycobacterium avium subsp. paratuberculosis
gucagcacgcugaucacc

SEQ ID NO: 848283 - RNA, 13 nt, Mycobacterium avium subsp. paratuberculosis
gucagcacgucgg

SEQ ID NO: 848284 - RNA, 19 nt, Mycobacterium avium subsp. paratuberculosis
gucagcacgucggucagcg

SEQ ID NO: 848285 - RNA, 20 nt, Mycobacterium avium subsp. paratuberculosis
gucagcacgucggucagcga

SEQ ID NO: 848286 - RNA, 14 nt, Mycobacterium avium subsp. paratuberculosis
gucagcagcagcgc

SEQ ID NO: 848287 - RNA, 15 nt, Mycobacterium avium subsp. paratuberculosis
gucagcagcacccgg

SEQ ID NO: 848288 - RNA, 18 nt, Mycobacterium avium subsp. paratuberculosis
gucagcagggccucgccg

SEQ ID NO: 848289 - RNA, 23 nt, Mycobacterium avium subsp. paratuberculosis
gucagccacgggcggucggacgc

SEQ ID NO: 848290 - RNA, 20 nt, Mycobacterium avium subsp. paratuberculosis
gucagcauggcgaugacguc

SEQ ID NO: 848291 - RNA, 17 nt, Mycobacterium avium subsp. paratuberculosis
gucagcagggugacguc

SEQ ID NO: 848292 - RNA, 22 nt, Mycobacterium avium subsp. paratuberculosis
gucagcagggugacgucguuga

SEQ ID NO: 848293 - RNA, 17 nt, Mycobacterium avium subsp. paratuberculosis
gucagcagcgucugcgc

SEQ ID NO: 848294 - RNA, 17 nt, Mycobacterium avium subsp. paratuberculosis
gucagcaggcgccgcag

SEQ ID NO: 848295 - RNA, 21 nt, Mycobacterium avium subsp. paratuberculosis
gucagcagcgacaugaccacc

SEQ ID NO: 848296 - RNA, 17 nt, Mycobacterium avium subsp. paratuberculosis
guaaguggcgccgcggu

SEQ ID NO: 848297 - RNA, 19 nt, Mycobacterium avium subsp. paratuberculosis
guaaguggcgccgcggucg

SEQ ID NO: 848298 - RNA, 16 nt, Mycobacterium avium subsp. paratuberculosis
guaaauugaacgccgc

SEQ ID NO: 848299 - RNA, 14 nt, Mycobacterium avium subsp. paratuberculosis
gguuuucggcgcgc

SEQ ID NO: 848300 - RNA, 17 nt, Mycobacterium avium subsp. paratuberculosis
gguuuucccggccgccg

SEQ ID NO: 848301 - RNA, 15 nt, Mycobacterium avium subsp. paratuberculosis
gguuuucgccucggu

SEQ ID NO: 848302 - RNA, 23 nt, Mycobacterium avium subsp. paratuberculosis
gguuuucgccucggucugggcga

SEQ ID NO: 848303 - RNA, 15 nt, Mycobacterium avium subsp. paratuberculosis
gguuuguccggccag

SEQ ID NO: 848304 - RNA, 18 nt, Mycobacterium avium subsp. paratuberculosis
gguggcccgccacgugcg

SEQ ID NO: 848305 - RNA, 15 nt, Mycobacterium avium subsp. paratuberculosis
gguggcccgcccggg

SEQ ID NO: 848306 - RNA, 15 nt, Mycobacterium avium subsp. paratuberculosis
gguggcccggucguc

SEQ ID NO: 848307 - RNA, 14 nt, Mycobacterium avium subsp. paratuberculosis
gguuuggccgcggg

SEQ ID NO: 848308 - RNA, 19 nt, Mycobacterium avium subsp. paratuberculosis
gguuuggccgcgggcgggc

SEQ ID NO: 848309 - RNA, 19 nt, Mycobacterium avium subsp. paratuberculosis
gguuuggucagcgcccccg

SEQ ID NO: 848310 - RNA, 19 nt, Mycobacterium avium subsp. paratuberculosis
gguggccagccgggcgacc

SEQ ID NO: 848311 - RNA, 23 nt, Mycobacterium avium subsp. paratuberculosis
gguggccaguucgucgcgcgacu

SEQ ID NO: 848312 - RNA, 16 nt, Mycobacterium avium subsp. paratuberculosis
gguggccaucgcggcc

SEQ ID NO: 848313 - RNA, 20 nt, Mycobacterium avium subsp. paratuberculosis
gguggccaucgcggccccca

SEQ ID NO: 848314 - RNA, 19 nt, Mycobacterium avium subsp. paratuberculosis
gguggccaugcgcgagucg

SEQ ID NO: 848315 - RNA, 16 nt, Mycobacterium avium subsp. paratuberculosis
gguggcccaaucggug

SEQ ID NO: 848316 - RNA, 14 nt, Mycobacterium avium subsp. paratuberculosis
gguggcccagccgc

SEQ ID NO: 848317 - RNA, 22 nt, Mycobacterium avium subsp. paratuberculosis
gguggcccagccggccgacgcg

SEQ ID NO: 848318 - RNA, 16 nt, Mycobacterium avium subsp. paratuberculosis
gguggccccagcccgg

SEQ ID NO: 848319 - RNA, 17 nt, Mycobacterium avium subsp. paratuberculosis
gguggccccgggccgca

SEQ ID NO: 848320 - RNA, 23 nt, Mycobacterium avium subsp. paratuberculosis
gguggccccgggccgcagggugg

SEQ ID NO: 848321 - RNA, 13 nt, Mycobacterium avium subsp. paratuberculosis
gguggcccgaccc

SEQ ID NO: 848322 - RNA, 21 nt, Mycobacterium avium subsp. paratuberculosis
gguggccagcuucaccggucg

SEQ ID NO: 848323 - RNA, 13 nt, Mycobacterium avium subsp. paratuberculosis
gguggccacggcg

SEQ ID NO: 848324 - RNA, 19 nt, Mycobacterium avium subsp. paratuberculosis
gguggccagcaccgcgucg

SEQ ID NO: 848325 - RNA, 14 nt, Mycobacterium avium subsp. paratuberculosis
gguggccagcacga

SEQ ID NO: 848326 - RNA, 14 nt, Mycobacterium avium subsp. paratuberculosis
gguggccagcacgc

SEQ ID NO: 848327 - RNA, 20 nt, Mycobacterium avium subsp. paratuberculosis
gguggccagcacgcugcgga

SEQ ID NO: 848328 - RNA, 15 nt, Mycobacterium avium subsp. paratuberculosis
gguggccagccaggu

SEQ ID NO: 848329 - RNA, 14 nt, Mycobacterium avium subsp. paratuberculosis
gguggccaccgcga

SEQ ID NO: 848330 - RNA, 15 nt, Mycobacterium avium subsp. paratuberculosis
guaaucggcgguggu

SEQ ID NO: 848331 - RNA, 16 nt, Mycobacterium avium subsp. paratuberculosis
guaaucggcgguggug

SEQ ID NO: 848332 - RNA, 21 nt, Mycobacterium avium subsp. paratuberculosis
guacacagggcggcgacacgc

SEQ ID NO: 848333 - RNA, 20 nt, Mycobacterium avium subsp. paratuberculosis
guacaccagggugccgccgg

SEQ ID NO: 848334 - RNA, 14 nt, Mycobacterium avium subsp. paratuberculosis
guacaucguucccu

SEQ ID NO: 848335 - RNA, 21 nt, Mycobacterium avium subsp. paratuberculosis
guacaucguucccugcgcggc

SEQ ID NO: 848336 - RNA, 16 nt, Mycobacterium avium subsp. paratuberculosis
guacaucgacgcgacc

SEQ ID NO: 848337 - RNA, 17 nt, Mycobacterium avium subsp. paratuberculosis
guacaucgacgcgaccg

SEQ ID NO: 848338 - RNA, 20 nt, Mycobacterium avium subsp. paratuberculosis
guacaucgacgcgaccggcc

SEQ ID NO: 848339 - RNA, 17 nt, Mycobacterium avium subsp. paratuberculosis
guacaggugcagcagca

SEQ ID NO: 848340 - RNA, 14 nt, Mycobacterium avium subsp. paratuberculosis
guacagggcgucgg

SEQ ID NO: 848341 - RNA, 18 nt, Mycobacterium avium subsp. paratuberculosis
guacagggucaucgcgcc

SEQ ID NO: 848342 - RNA, 14 nt, Mycobacterium avium subsp. paratuberculosis
guacaggccgucgg

SEQ ID NO: 848343 - RNA, 23 nt, Mycobacterium avium subsp. paratuberculosis
guacaggccgucggggaugccga

SEQ ID NO: 848344 - RNA, 13 nt, Mycobacterium avium subsp. paratuberculosis
guacacggcccgc

SEQ ID NO: 848345 - RNA, 15 nt, Mycobacterium avium subsp. paratuberculosis
guacacggcccgcgg

SEQ ID NO: 848346 - RNA, 14 nt, Mycobacterium avium subsp. paratuberculosis
guacaccucggucg

SEQ ID NO: 848347 - RNA, 21 nt, Mycobacterium avium subsp. paratuberculosis
guacaccgcgaguucgcgcac

SEQ ID NO: 848348 - RNA, 24 nt, Mycobacterium avium subsp. paratuberculosis
guacaccgcgaguucgcgcacgcu

SEQ ID NO: 848349 - RNA, 11 nt, Mycobacterium avium subsp. paratuberculosis
guacaccggcu

SEQ ID NO: 848350 - RNA, 19 nt, Mycobacterium avium subsp. paratuberculosis
guacaccgggcuggugucc

SEQ ID NO: 848351 - RNA, 20 nt, Mycobacterium avium subsp. paratuberculosis
guacaccgguugcgccgagg

SEQ ID NO: 848352 - RNA, 14 nt, Mycobacterium avium subsp. paratuberculosis
guacgggcgcagcg

SEQ ID NO: 848353 - RNA, 23 nt, Mycobacterium avium subsp. paratuberculosis
guacgggcgcagcgccgucucga

SEQ ID NO: 848354 - RNA, 15 nt, Mycobacterium avium subsp. paratuberculosis
guacggcggccgcgg

SEQ ID NO: 848355 - RNA, 18 nt, Mycobacterium avium subsp. paratuberculosis
guacggcggccgcggacc

SEQ ID NO: 848356 - RNA, 20 nt, Mycobacterium avium subsp. paratuberculosis
guacggcggccgcggacccg

SEQ ID NO: 848357 - RNA, 20 nt, Mycobacterium avium subsp. paratuberculosis
guacggcucaacggccggcg

SEQ ID NO: 848358 - RNA, 14 nt, Mycobacterium avium subsp. paratuberculosis
guacgaccgcgacg

SEQ ID NO: 848359 - RNA, 20 nt, Mycobacterium avium subsp. paratuberculosis
guacgaccgcgacguggcgc

SEQ ID NO: 848360 - RNA, 22 nt, Mycobacterium avium subsp. paratuberculosis
guacgaccguagccggucggcc

SEQ ID NO: 848361 - RNA, 16 nt, Mycobacterium avium subsp. paratuberculosis
guaccucugcgcgagc

SEQ ID NO: 848362 - RNA, 20 nt, Mycobacterium avium subsp. paratuberculosis
guaccucugcgcgagcagcu

SEQ ID NO: 848363 - RNA, 21 nt, Mycobacterium avium subsp. paratuberculosis
guaccagugcaagcucgccag

SEQ ID NO: 848364 - RNA, 14 nt, Mycobacterium avium subsp. paratuberculosis
guacaugucgucgc

SEQ ID NO: 848365 - RNA, 16 nt, Mycobacterium avium subsp. paratuberculosis
guacccaggucggcgu

SEQ ID NO: 848366 - RNA, 17 nt, Mycobacterium avium subsp. paratuberculosis
guacccaggucggcgug

SEQ ID NO: 848367 - RNA, 20 nt, Mycobacterium avium subsp. paratuberculosis
guaccccagcaaaaccccgc

SEQ ID NO: 848368 - RNA, 19 nt, Mycobacterium avium subsp. paratuberculosis
guacccgauggugaaccac

SEQ ID NO: 848369 - RNA, 12 nt, Mycobacterium avium subsp. paratuberculosis
guacccgccgca

SEQ ID NO: 848370 - RNA, 12 nt, Mycobacterium avium subsp. paratuberculosis
guacccgcgcgg

SEQ ID NO: 848371 - RNA, 16 nt, Mycobacterium avium subsp. paratuberculosis
guacccgcgcggcguc

SEQ ID NO: 848372 - RNA, 13 nt, Mycobacterium avium subsp. paratuberculosis
guaccgcaacacc

SEQ ID NO: 848373 - RNA, 20 nt, Mycobacterium avium subsp. paratuberculosis
guaccgaggaugaccgcggc

SEQ ID NO: 848374 - RNA, 16 nt, Mycobacterium avium subsp. paratuberculosis
guaccgaacgacgagc

SEQ ID NO: 848375 - RNA, 17 nt, Mycobacterium avium subsp. paratuberculosis
guaccgaacgacgagcc

SEQ ID NO: 848376 - RNA, 22 nt, Mycobacterium avium subsp. paratuberculosis
guacccggucugaucgcccagc

SEQ ID NO: 848377 - RNA, 22 nt, Mycobacterium avium subsp. paratuberculosis
guagaugccgguacggccgacg

SEQ ID NO: 848378 - RNA, 16 nt, Mycobacterium avium subsp. paratuberculosis
guagaucucgcgccgc

SEQ ID NO: 848379 - RNA, 20 nt, Mycobacterium avium subsp. paratuberculosis
guagacgagcucaccgccga

SEQ ID NO: 848380 - RNA, 16 nt, Mycobacterium avium subsp. paratuberculosis
guagacgaugcccagc

SEQ ID NO: 848381 - RNA, 14 nt, Mycobacterium avium subsp. paratuberculosis
guagacgccgccgu

SEQ ID NO: 848382 - RNA, 19 nt, Mycobacterium avium subsp. paratuberculosis
guagacgccgccguggacg

SEQ ID NO: 848383 - RNA, 14 nt, Mycobacterium avium subsp. paratuberculosis
guagacgcgggccg

SEQ ID NO: 848384 - RNA, 19 nt, Mycobacterium avium subsp. paratuberculosis
guagacgcgggccggcacc

SEQ ID NO: 848385 - RNA, 19 nt, Mycobacterium avium subsp. paratuberculosis
guagacggcaugccgggcc

SEQ ID NO: 848386 - RNA, 15 nt, Mycobacterium avium subsp. paratuberculosis
guagaccuugaccac

SEQ ID NO: 848387 - RNA, 14 nt, Mycobacterium avium subsp. paratuberculosis
guagacgacgggca

SEQ ID NO: 848388 - RNA, 16 nt, Mycobacterium avium subsp. paratuberculosis
guagacgacgucgacc

SEQ ID NO: 848389 - RNA, 14 nt, Mycobacterium avium subsp. paratuberculosis
guagaccgccgagu

SEQ ID NO: 848390 - RNA, 20 nt, Mycobacterium avium subsp. paratuberculosis
guagaccgccgaguccuuga

SEQ ID NO: 848391 - RNA, 15 nt, Mycobacterium avium subsp. paratuberculosis
guacuucucgaagaa

SEQ ID NO: 848392 - RNA, 17 nt, Mycobacterium avium subsp. paratuberculosis
guacucggcgucgccga

SEQ ID NO: 848393 - RNA, 23 nt, Mycobacterium avium subsp. paratuberculosis
guacucgggugaguaguccagca

SEQ ID NO: 848394 - RNA, 21 nt, Mycobacterium avium subsp. paratuberculosis
guacucgggugggggcguggu

SEQ ID NO: 848395 - RNA, 22 nt, Mycobacterium avium subsp. paratuberculosis
guacucgggugggggcguggug

SEQ ID NO: 848396 - RNA, 20 nt, Mycobacterium avium subsp. paratuberculosis
guacucggucaccucgucga

SEQ ID NO: 848397 - RNA, 18 nt, Mycobacterium avium subsp. paratuberculosis
guacucgugggccaccac

SEQ ID NO: 848398 - RNA, 15 nt, Mycobacterium avium subsp. paratuberculosis
guacggucggccgua

SEQ ID NO: 848399 - RNA, 16 nt, Mycobacterium avium subsp. paratuberculosis
guacgucuugcgcacc

SEQ ID NO: 848400 - RNA, 23 nt, Mycobacterium avium subsp. paratuberculosis
guacugguugcagaugucggugg

SEQ ID NO: 848401 - RNA, 15 nt, Mycobacterium avium subsp. paratuberculosis
guacugcucggcgcg

SEQ ID NO: 848402 - RNA, 18 nt, Mycobacterium avium subsp. paratuberculosis
guacugcucggcgcggcu

SEQ ID NO: 848403 - RNA, 19 nt, Mycobacterium avium subsp. paratuberculosis
guagcgacgcgacgcgcuc

SEQ ID NO: 848404 - RNA, 14 nt, Mycobacterium avium subsp. paratuberculosis
guagcgagguguga

SEQ ID NO: 848405 - RNA, 19 nt, Mycobacterium avium subsp. paratuberculosis
guagcgagugccggccagc

SEQ ID NO: 848406 - RNA, 23 nt, Mycobacterium avium subsp. paratuberculosis
guagcagucggccugcagcucgg

SEQ ID NO: 848407 - RNA, 20 nt, Mycobacterium avium subsp. paratuberculosis
guagccgguauccauccgcc

SEQ ID NO: 848408 - RNA, 20 nt, Mycobacterium avium subsp. paratuberculosis
guagccgguggucaacgcgc

SEQ ID NO: 848409 - RNA, 18 nt, Mycobacterium avium subsp. paratuberculosis
guagccguaacgaugccg

SEQ ID NO: 848410 - RNA, 16 nt, Mycobacterium avium subsp. paratuberculosis
guagcagcgcggcuug

SEQ ID NO: 848411 - RNA, 16 nt, Mycobacterium avium subsp. paratuberculosis
guagcagcgucugcgc

SEQ ID NO: 848412 - RNA, 17 nt, Mycobacterium avium subsp. paratuberculosis
guagcaggcgcgcagca

SEQ ID NO: 848413 - RNA, 13 nt, Mycobacterium avium subsp. paratuberculosis
guagcaggcggug

SEQ ID NO: 848414 - RNA, 16 nt, Mycobacterium avium subsp. paratuberculosis
guagcacccggccggc

SEQ ID NO: 848415 - RNA, 18 nt, Mycobacterium avium subsp. paratuberculosis
guagcacccggccggcga

SEQ ID NO: 848416 - RNA, 23 nt, Mycobacterium avium subsp. paratuberculosis
guagcagacggacacccgcgcgg

SEQ ID NO: 848417 - RNA, 15 nt, Mycobacterium avium subsp. paratuberculosis
guagcgccagucgcg

SEQ ID NO: 848418 - RNA, 12 nt, Mycobacterium avium subsp. paratuberculosis
guagcgccgccc

SEQ ID NO: 848419 - RNA, 17 nt, Mycobacterium avium subsp. paratuberculosis
guagcgccgcccgucca

SEQ ID NO: 848420 - RNA, 12 nt, Mycobacterium avium subsp. paratuberculosis
guagcgccggca

SEQ ID NO: 848421 - RNA, 21 nt, Mycobacterium avium subsp. paratuberculosis
guagcgccggcaacaacgcca

SEQ ID NO: 848422 - RNA, 13 nt, Mycobacterium avium subsp. paratuberculosis
guagcgcaacacc

SEQ ID NO: 848423 - RNA, 15 nt, Mycobacterium avium subsp. paratuberculosis
guagcgcaccgguca

SEQ ID NO: 848424 - RNA, 13 nt, Mycobacterium avium subsp. paratuberculosis
guagcgcagcacc

SEQ ID NO: 848425 - RNA, 14 nt, Mycobacterium avium subsp. paratuberculosis
guagcgcagcacca

SEQ ID NO: 848426 - RNA, 17 nt, Mycobacterium avium subsp. paratuberculosis
guagcgcagcaccaggc

SEQ ID NO: 848427 - RNA, 19 nt, Mycobacterium avium subsp. paratuberculosis
guagcgcauaggccgcgag

SEQ ID NO: 848428 - RNA, 13 nt, Mycobacterium avium subsp. paratuberculosis
guagcgcagcccg

SEQ ID NO: 848429 - RNA, 14 nt, Mycobacterium avium subsp. paratuberculosis
guagcgcagcccgg

SEQ ID NO: 848430 - RNA, 17 nt, Mycobacterium avium subsp. paratuberculosis
guagcgcagcccgguuu

SEQ ID NO: 848431 - RNA, 13 nt, Mycobacterium avium subsp. paratuberculosis
guagcucagccac

SEQ ID NO: 848432 - RNA, 19 nt, Mycobacterium avium subsp. paratuberculosis
guagcucagccacgccggc

SEQ ID NO: 848433 - RNA, 22 nt, Mycobacterium avium subsp. paratuberculosis
guagcucagccacgccggcaca

SEQ ID NO: 848434 - RNA, 20 nt, Mycobacterium avium subsp. paratuberculosis
guagcggaagcugccguugc

SEQ ID NO: 848435 - RNA, 21 nt, Mycobacterium avium subsp. paratuberculosis
guagcggaaguacaccgguug

SEQ ID NO: 848436 - RNA, 15 nt, Mycobacterium avium subsp. paratuberculosis
guagcggacgacggc

SEQ ID NO: 848437 - RNA, 19 nt, Mycobacterium avium subsp. paratuberculosis
guagcggacgacggccagc

SEQ ID NO: 848438 - RNA, 13 nt, Mycobacterium avium subsp. paratuberculosis
guagcgcgccggg

SEQ ID NO: 848439 - RNA, 14 nt, Mycobacterium avium subsp. paratuberculosis
guagcgcucgguca

SEQ ID NO: 848440 - RNA, 13 nt, Mycobacterium avium subsp. paratuberculosis
guagcgcggccgc

SEQ ID NO: 848441 - RNA, 15 nt, Mycobacterium avium subsp. paratuberculosis
guagcgcggccgccc

SEQ ID NO: 848442 - RNA, 21 nt, Mycobacterium avium subsp. paratuberculosis
guaggccuugcugagccggcc

SEQ ID NO: 848443 - RNA, 22 nt, Mycobacterium avium subsp. paratuberculosis
guaggccuugcugagccggccc

SEQ ID NO: 848444 - RNA, 20 nt, Mycobacterium avium subsp. paratuberculosis
guaggcgaaauaacccaccc

SEQ ID NO: 848445 - RNA, 14 nt, Mycobacterium avium subsp. paratuberculosis
aagucgaccgcggc

SEQ ID NO: 848446 - RNA, 15 nt, Mycobacterium avium subsp. paratuberculosis
aaguccuucucgggc

SEQ ID NO: 848447 - RNA, 23 nt, Mycobacterium avium subsp. paratuberculosis
aaguccugcgccgcggugcgcca

SEQ ID NO: 848448 - RNA, 21 nt, Mycobacterium avium subsp. paratuberculosis
aagucggugugggucagcgag

SEQ ID NO: 848449 - RNA, 13 nt, Mycobacterium avium subsp. paratuberculosis
aagucgaugccgc

SEQ ID NO: 848450 - RNA, 16 nt, Mycobacterium avium subsp. paratuberculosis
aagucgauugccgcgg

SEQ ID NO: 848451 - RNA, 22 nt, Mycobacterium avium subsp. paratuberculosis
aagucgccguccggggccggug

SEQ ID NO: 848452 - RNA, 15 nt, Mycobacterium avium subsp. paratuberculosis
guaggccgcgccgau

SEQ ID NO: 848453 - RNA, 17 nt, Mycobacterium avium subsp. paratuberculosis
guaggccgcgccgauca

SEQ ID NO: 848454 - RNA, 21 nt, Mycobacterium avium subsp. paratuberculosis
guaggccgcgccgaucacgaa

SEQ ID NO: 848455 - RNA, 17 nt, Mycobacterium avium subsp. paratuberculosis
aaguaguacgaccgcga

SEQ ID NO: 848456 - RNA, 23 nt, Mycobacterium avium subsp. paratuberculosis
guagcugggccccuccagccgcc

SEQ ID NO: 848457 - RNA, 16 nt, Mycobacterium avium subsp. paratuberculosis
guagcuggugcgcagc

SEQ ID NO: 848458 - RNA, 19 nt, Mycobacterium avium subsp. paratuberculosis
guagcuggugcgcagcccg

SEQ ID NO: 848459 - RNA, 20 nt, Mycobacterium avium subsp. paratuberculosis
guagcuggugcgcagcccgc

SEQ ID NO: 848460 - RNA, 17 nt, Mycobacterium avium subsp. paratuberculosis
guagcugcaggcgacga

SEQ ID NO: 848461 - RNA, 13 nt, Mycobacterium avium subsp. paratuberculosis
guagcggauggcg

SEQ ID NO: 848462 - RNA, 21 nt, Mycobacterium avium subsp. paratuberculosis
guagcugcgggucucgcccac

SEQ ID NO: 848463 - RNA, 20 nt, Mycobacterium avium subsp. paratuberculosis
guagcugcugucgaacaccg

SEQ ID NO: 848464 - RNA, 13 nt, Mycobacterium avium subsp. paratuberculosis
guagcugaccgau

SEQ ID NO: 848465 - RNA, 14 nt, Mycobacterium avium subsp. paratuberculosis
guagcucgccgcgg

SEQ ID NO: 848466 - RNA, 16 nt, Mycobacterium avium subsp. paratuberculosis
guagcucgccgcggcc

SEQ ID NO: 848467 - RNA, 14 nt, Mycobacterium avium subsp. paratuberculosis
guagcucgcgccga

SEQ ID NO: 848468 - RNA, 15 nt, Mycobacterium avium subsp. paratuberculosis
guagcucgcgccgac

SEQ ID NO: 848469 - RNA, 16 nt, Mycobacterium avium subsp. paratuberculosis
guagcucgcgccgacc

SEQ ID NO: 848470 - RNA, 22 nt, Mycobacterium avium subsp. paratuberculosis
aagucguucagcugcagccggc

SEQ ID NO: 848471 - RNA, 20 nt, Mycobacterium avium subsp. paratuberculosis
guaggugcccgggucgugcg

SEQ ID NO: 848472 - RNA, 17 nt, Mycobacterium avium subsp. paratuberculosis
guaguacgaccgcgacg

SEQ ID NO: 848473 - RNA, 16 nt, Mycobacterium avium subsp. paratuberculosis
aagucguugcccgcca

SEQ ID NO: 848474 - RNA, 15 nt, Mycobacterium avium subsp. paratuberculosis
guaguaacgcgagau

SEQ ID NO: 848475 - RNA, 23 nt, Mycobacterium avium subsp. paratuberculosis
guagucggccuccuccucgcugc

SEQ ID NO: 848476 - RNA, 13 nt, Mycobacterium avium subsp. paratuberculosis
guagucggcgauc

SEQ ID NO: 848477 - RNA, 16 nt, Mycobacterium avium subsp. paratuberculosis
guagucggcgaucggc

SEQ ID NO: 848478 - RNA, 21 nt, Mycobacterium avium subsp. paratuberculosis
guagucggcgcagcgcacguc

SEQ ID NO: 848479 - RNA, 12 nt, Mycobacterium avium subsp. paratuberculosis
guagucgcgcac

SEQ ID NO: 848480 - RNA, 13 nt, Mycobacterium avium subsp. paratuberculosis
guagucgcgcacc

SEQ ID NO: 848481 - RNA, 14 nt, Mycobacterium avium subsp. paratuberculosis
guagucgcgcacca

SEQ ID NO: 848482 - RNA, 17 nt, Mycobacterium avium subsp. paratuberculosis
guagucgauggccucgu

SEQ ID NO: 848483 - RNA, 21 nt, Mycobacterium avium subsp. paratuberculosis
guagucgauucaucgccgaac

SEQ ID NO: 848484 - RNA, 15 nt, Mycobacterium avium subsp. paratuberculosis
guaguccaggguguc

SEQ ID NO: 848485 - RNA, 18 nt, Mycobacterium avium subsp. paratuberculosis
guaguccagcacggcgaa

SEQ ID NO: 848486 - RNA, 19 nt, Mycobacterium avium subsp. paratuberculosis
guagucgaccacccgcagc

SEQ ID NO: 848487 - RNA, 16 nt, Mycobacterium avium subsp. paratuberculosis
guauauuugccugacu

SEQ ID NO: 848488 - RNA, 15 nt, Mycobacterium avium subsp. paratuberculosis
guaguggcgugcggc

SEQ ID NO: 848489 - RNA, 19 nt, Mycobacterium avium subsp. paratuberculosis
guaucaacugagcgcccgg

SEQ ID NO: 848490 - RNA, 19 nt, Mycobacterium avium subsp. paratuberculosis
guagugguccaccgccgcg

SEQ ID NO: 848491 - RNA, 16 nt, Mycobacterium avium subsp. paratuberculosis
guaguggugcaggugc

SEQ ID NO: 848492 - RNA, 14 nt, Mycobacterium avium subsp. paratuberculosis
guagugcagccgcc

SEQ ID NO: 848493 - RNA, 19 nt, Mycobacterium avium subsp. paratuberculosis
guagugcagcugcagcgac

SEQ ID NO: 848494 - RNA, 13 nt, Mycobacterium avium subsp. paratuberculosis
guagugcaucggc

SEQ ID NO: 848495 - RNA, 14 nt, Mycobacterium avium subsp. paratuberculosis
guagugcucggcgu

SEQ ID NO: 848496 - RNA, 16 nt, Mycobacterium avium subsp. paratuberculosis
guagucgcucggcggc

SEQ ID NO: 848497 - RNA, 13 nt, Mycobacterium avium subsp. paratuberculosis
guagucgucgacc

SEQ ID NO: 848498 - RNA, 16 nt, Mycobacterium avium subsp. paratuberculosis
guagucgucgaccgcc

SEQ ID NO: 848499 - RNA, 13 nt, Mycobacterium avium subsp. paratuberculosis
guagucggcgucc

SEQ ID NO: 848500 - RNA, 18 nt, Mycobacterium avium subsp. paratuberculosis
guagucggcguccgugcc

SEQ ID NO: 848501 - RNA, 16 nt, Mycobacterium avium subsp. paratuberculosis
guagucggcgucggcc

SEQ ID NO: 848502 - RNA, 17 nt, Mycobacterium avium subsp. paratuberculosis
gucccaguucccggcgg

SEQ ID NO: 848503 - RNA, 23 nt, Mycobacterium avium subsp. paratuberculosis
gucccaguucccggcgggcaggu

SEQ ID NO: 848504 - RNA, 13 nt, Mycobacterium avium subsp. paratuberculosis
gucccagcgccac

SEQ ID NO: 848505 - RNA, 20 nt, Mycobacterium avium subsp. paratuberculosis
gucccagcgcaacggcgucg

SEQ ID NO: 848506 - RNA, 16 nt, Mycobacterium avium subsp. paratuberculosis
gucccagcacaacgcc

SEQ ID NO: 848507 - RNA, 14 nt, Mycobacterium avium subsp. paratuberculosis
gucccaggccagga

SEQ ID NO: 848508 - RNA, 14 nt, Mycobacterium avium subsp. paratuberculosis
gucccaggcguggu

SEQ ID NO: 848509 - RNA, 21 nt, Mycobacterium avium subsp. paratuberculosis
gucccaggcguggucggcgcg

SEQ ID NO: 848510 - RNA, 20 nt, Mycobacterium avium subsp. paratuberculosis
gucccaggguuggucggagc

SEQ ID NO: 848511 - RNA, 18 nt, Mycobacterium avium subsp. paratuberculosis
gucccaggugggcgcgca

SEQ ID NO: 848512 - RNA, 21 nt, Mycobacterium avium subsp. paratuberculosis
gucccaggugggcgcgcagca

SEQ ID NO: 848513 - RNA, 14 nt, Mycobacterium avium subsp. paratuberculosis
gucccgacgcggcg

SEQ ID NO: 848514 - RNA, 15 nt, Mycobacterium avium subsp. paratuberculosis
gucccgacgcggcgc

SEQ ID NO: 848515 - RNA, 16 nt, Mycobacterium avium subsp. paratuberculosis
gucccgacgcggcgcg

SEQ ID NO: 848516 - RNA, 17 nt, Mycobacterium avium subsp. paratuberculosis
gucccgacgcggcgcga

SEQ ID NO: 848517 - RNA, 21 nt, Mycobacterium avium subsp. paratuberculosis
gucccgacagggagccgacga

SEQ ID NO: 848518 - RNA, 15 nt, Mycobacterium avium subsp. paratuberculosis
guccccgggcccagc

SEQ ID NO: 848519 - RNA, 12 nt, Mycobacterium avium subsp. paratuberculosis
guccccgggugg

SEQ ID NO: 848520 - RNA, 14 nt, Mycobacterium avium subsp. paratuberculosis
guccccaccaccga

SEQ ID NO: 848521 - RNA, 15 nt, Mycobacterium avium subsp. paratuberculosis
guccccaccaccgac

SEQ ID NO: 848522 - RNA, 18 nt, Mycobacterium avium subsp. paratuberculosis
guccccaccaccgacagc

SEQ ID NO: 848523 - RNA, 14 nt, Mycobacterium avium subsp. paratuberculosis
gucccggcgggggc

SEQ ID NO: 848524 - RNA, 19 nt, Mycobacterium avium subsp. paratuberculosis
gucccggcgggggcggcgg

SEQ ID NO: 848525 - RNA, 23 nt, Mycobacterium avium subsp. paratuberculosis
gucccggauggagcgcgacgggc

SEQ ID NO: 848526 - RNA, 19 nt, Mycobacterium avium subsp. paratuberculosis
gucccggcaacaccggcgg

SEQ ID NO: 848527 - RNA, 20 nt, Mycobacterium avium subsp. paratuberculosis
gucccggcaacaccggcggc

SEQ ID NO: 848528 - RNA, 19 nt, Mycobacterium avium subsp. paratuberculosis
gucccggcgcaccaggcgc

SEQ ID NO: 848529 - RNA, 23 nt, Mycobacterium avium subsp. paratuberculosis
gucccggcgcaccaggcgccaca

SEQ ID NO: 848530 - RNA, 13 nt, Mycobacterium avium subsp. paratuberculosis
gucccggcgcccu

SEQ ID NO: 848531 - RNA, 17 nt, Mycobacterium avium subsp. paratuberculosis
gucccggcggacccgga

SEQ ID NO: 848532 - RNA, 13 nt, Mycobacterium avium subsp. paratuberculosis
gucccgcgcggcg

SEQ ID NO: 848533 - RNA, 14 nt, Mycobacterium avium subsp. paratuberculosis
gucccgcgcggcgc

SEQ ID NO: 848534 - RNA, 19 nt, Mycobacterium avium subsp. paratuberculosis
gucccgcgcgggggccgcc

SEQ ID NO: 848535 - RNA, 20 nt, Mycobacterium avium subsp. paratuberculosis
gucccgcgcgggggccgccg

SEQ ID NO: 848536 - RNA, 23 nt, Mycobacterium avium subsp. paratuberculosis
gucccgcgcgggggccgccgcga

SEQ ID NO: 848537 - RNA, 14 nt, Mycobacterium avium subsp. paratuberculosis
gucccgcggcggcg

SEQ ID NO: 848538 - RNA, 14 nt, Mycobacterium avium subsp. paratuberculosis
gucccgcguggccg

SEQ ID NO: 848539 - RNA, 12 nt, Mycobacterium avium subsp. paratuberculosis
gucccgcgcggc

SEQ ID NO: 848540 - RNA, 20 nt, Mycobacterium avium subsp. paratuberculosis
gucccgcucgaucuggcgga

SEQ ID NO: 848541 - RNA, 19 nt, Mycobacterium avium subsp. paratuberculosis
gucccggaagugccggcga

SEQ ID NO: 848542 - RNA, 12 nt, Mycobacterium avium subsp. paratuberculosis
gucccgccggug

SEQ ID NO: 848543 - RNA, 21 nt, Mycobacterium avium subsp. paratuberculosis
gucccgcgccacguaucgcgc

SEQ ID NO: 848544 - RNA, 13 nt, Mycobacterium avium subsp. paratuberculosis
gucccgcgcccgc

SEQ ID NO: 848545 - RNA, 13 nt, Mycobacterium avium subsp. paratuberculosis
gucccgcgccgga

SEQ ID NO: 848546 - RNA, 13 nt, Mycobacterium avium subsp. paratuberculosis
gucccgcaugucc

SEQ ID NO: 848547 - RNA, 12 nt, Mycobacterium avium subsp. paratuberculosis
gucccgcccggc

SEQ ID NO: 848548 - RNA, 18 nt, Mycobacterium avium subsp. paratuberculosis
gucccgcccggcgccggc

SEQ ID NO: 848549 - RNA, 19 nt, Mycobacterium avium subsp. paratuberculosis
gucccgcccggcgccggcc

SEQ ID NO: 848550 - RNA, 16 nt, Mycobacterium avium subsp. paratuberculosis
guccaguucggccagc

SEQ ID NO: 848551 - RNA, 19 nt, Mycobacterium avium subsp. paratuberculosis
guccaguucggccagcgcg

SEQ ID NO: 848552 - RNA, 21 nt, Mycobacterium avium subsp. paratuberculosis
guccaguugcggcacgccgac

SEQ ID NO: 848553 - RNA, 22 nt, Mycobacterium avium subsp. paratuberculosis
guccaguugcggcacgccgacc

SEQ ID NO: 848554 - RNA, 13 nt, Mycobacterium avium subsp. paratuberculosis
gucaucggcggaa

SEQ ID NO: 848555 - RNA, 12 nt, Mycobacterium avium subsp. paratuberculosis
gucaucgccgac

SEQ ID NO: 848556 - RNA, 14 nt, Mycobacterium avium subsp. paratuberculosis
gucaucgcgccgga

SEQ ID NO: 848557 - RNA, 16 nt, Mycobacterium avium subsp. paratuberculosis
guccaguccggccgug

SEQ ID NO: 848558 - RNA, 18 nt, Mycobacterium avium subsp. paratuberculosis
guccaguccggccgugau

SEQ ID NO: 848559 - RNA, 15 nt, Mycobacterium avium subsp. paratuberculosis
guccaguccggcgug

SEQ ID NO: 848560 - RNA, 17 nt, Mycobacterium avium subsp. paratuberculosis
guccaguccggcgugcc

SEQ ID NO: 848561 - RNA, 13 nt, Mycobacterium avium subsp. paratuberculosis
guccagucgcgcc

SEQ ID NO: 848562 - RNA, 14 nt, Mycobacterium avium subsp. paratuberculosis
guccagucgcgccg

SEQ ID NO: 848563 - RNA, 15 nt, Mycobacterium avium subsp. paratuberculosis
guccagucgcgccga

SEQ ID NO: 848564 - RNA, 18 nt, Mycobacterium avium subsp. paratuberculosis
guccagucggccgugaac

SEQ ID NO: 848565 - RNA, 13 nt, Mycobacterium avium subsp. paratuberculosis
guccaucagcagc

SEQ ID NO: 848566 - RNA, 19 nt, Mycobacterium avium subsp. paratuberculosis
guccauccagcgccgcagc

SEQ ID NO: 848567 - RNA, 12 nt, Mycobacterium avium subsp. paratuberculosis
gucaucauggug

SEQ ID NO: 848568 - RNA, 17 nt, Mycobacterium avium subsp. paratuberculosis
guccaucgggaccgcgg

SEQ ID NO: 848569 - RNA, 21 nt, Mycobacterium avium subsp. paratuberculosis
guccaucgggaccgcgggcgc

SEQ ID NO: 848570 - RNA, 16 nt, Mycobacterium avium subsp. paratuberculosis
guccaucguccucgcg

SEQ ID NO: 848571 - RNA, 13 nt, Mycobacterium avium subsp. paratuberculosis
gucccacucggga

SEQ ID NO: 848572 - RNA, 16 nt, Mycobacterium avium subsp. paratuberculosis
guccaucgccucgacc

SEQ ID NO: 848573 - RNA, 20 nt, Mycobacterium avium subsp. paratuberculosis
guccaucgccucgaccagca

SEQ ID NO: 848574 - RNA, 22 nt, Mycobacterium avium subsp. paratuberculosis
guccaucgccucgaccagcacc

SEQ ID NO: 848575 - RNA, 17 nt, Mycobacterium avium subsp. paratuberculosis
guccaucgccgcgcacc

SEQ ID NO: 848576 - RNA, 20 nt, Mycobacterium avium subsp. paratuberculosis
guccaucgccgcgcacccgg

SEQ ID NO: 848577 - RNA, 18 nt, Mycobacterium avium subsp. paratuberculosis
gucccagaugcgcgacgg

SEQ ID NO: 848578 - RNA, 23 nt, Mycobacterium avium subsp. paratuberculosis
gucccagaugcgcgacggccucg

SEQ ID NO: 848579 - RNA, 16 nt, Mycobacterium avium subsp. paratuberculosis
gucauccucgccgcgc

SEQ ID NO: 848580 - RNA, 17 nt, Mycobacterium avium subsp. paratuberculosis
gucauccucgccgcgcc

SEQ ID NO: 848581 - RNA, 13 nt, Mycobacterium avium subsp. paratuberculosis
gucaucgagccga

SEQ ID NO: 848582 - RNA, 16 nt, Mycobacterium avium subsp. paratuberculosis
gucaucgagccgagca

SEQ ID NO: 848583 - RNA, 19 nt, Mycobacterium avium subsp. paratuberculosis
gucaucgagccgagcaccg

SEQ ID NO: 848584 - RNA, 18 nt, Mycobacterium avium subsp. paratuberculosis
gucaucgccacccgcacc

SEQ ID NO: 848585 - RNA, 16 nt, Mycobacterium avium subsp. paratuberculosis
gucauccgggccacca

SEQ ID NO: 848586 - RNA, 22 nt, Mycobacterium avium subsp. paratuberculosis
gucauccgggccaccaccacgg

SEQ ID NO: 848587 - RNA, 17 nt, Mycobacterium avium subsp. paratuberculosis
gucauccgucgcccgcg

SEQ ID NO: 848588 - RNA, 20 nt, Mycobacterium avium subsp. paratuberculosis
gucauccgucgcccgcgugg

SEQ ID NO: 848589 - RNA, 17 nt, Mycobacterium avium subsp. paratuberculosis
gucaucgacuugccgcc

SEQ ID NO: 848590 - RNA, 19 nt, Mycobacterium avium subsp. paratuberculosis
gucaucgacuugccgccgc

SEQ ID NO: 848591 - RNA, 20 nt, Mycobacterium avium subsp. paratuberculosis
gucaucgacuugccgccgca

SEQ ID NO: 848592 - RNA, 14 nt, Mycobacterium avium subsp. paratuberculosis
gucaucaucaccgg

SEQ ID NO: 848593 - RNA, 16 nt, Mycobacterium avium subsp. paratuberculosis
gucaucaucaccggga

SEQ ID NO: 848594 - RNA, 19 nt, Mycobacterium avium subsp. paratuberculosis
gucaucaccgccgagggcc

SEQ ID NO: 848595 - RNA, 14 nt, Mycobacterium avium subsp. paratuberculosis
gucaucaccgggga

SEQ ID NO: 848596 - RNA, 19 nt, Mycobacterium avium subsp. paratuberculosis
gucccggcuuuccgacggc

SEQ ID NO: 848597 - RNA, 16 nt, Mycobacterium avium subsp. paratuberculosis
gucccuugggcggauu

SEQ ID NO: 848598 - RNA, 18 nt, Mycobacterium avium subsp. paratuberculosis
guccgaaaaacgcgucgc

SEQ ID NO: 848599 - RNA, 22 nt, Mycobacterium avium subsp. paratuberculosis
guccgaaaaacgcgucgcgugg

SEQ ID NO: 848600 - RNA, 15 nt, Mycobacterium avium subsp. paratuberculosis
guccgacagcccgcc

SEQ ID NO: 848601 - RNA, 14 nt, Mycobacterium avium subsp. paratuberculosis
guccgacagcgccu

SEQ ID NO: 848602 - RNA, 12 nt, Mycobacterium avium subsp. paratuberculosis
guccgaccagcg

SEQ ID NO: 848603 - RNA, 14 nt, Mycobacterium avium subsp. paratuberculosis
guccgaccagcggc

SEQ ID NO: 848604 - RNA, 15 nt, Mycobacterium avium subsp. paratuberculosis
guccgaccagcggcc

SEQ ID NO: 848605 - RNA, 15 nt, Mycobacterium avium subsp. paratuberculosis
guccgccccgagauc

SEQ ID NO: 848606 - RNA, 15 nt, Mycobacterium avium subsp. paratuberculosis
guccgccgacagcgg

SEQ ID NO: 848607 - RNA, 16 nt, Mycobacterium avium subsp. paratuberculosis
guccgccgccggcgga

SEQ ID NO: 848608 - RNA, 15 nt, Mycobacterium avium subsp. paratuberculosis
guccgccgccgggcc

SEQ ID NO: 848609 - RNA, 21 nt, Mycobacterium avium subsp. paratuberculosis
guccgccgccgggccugucca

SEQ ID NO: 848610 - RNA, 13 nt, Mycobacterium avium subsp. paratuberculosis
guccgaccgcgua

SEQ ID NO: 848611 - RNA, 15 nt, Mycobacterium avium subsp. paratuberculosis
guccgaccgguugcc

SEQ ID NO: 848612 - RNA, 18 nt, Mycobacterium avium subsp. paratuberculosis
guccgaccgguugcccgg

SEQ ID NO: 848613 - RNA, 18 nt, Mycobacterium avium subsp. paratuberculosis
guccgaccguugaccgac

SEQ ID NO: 848614 - RNA, 17 nt, Mycobacterium avium subsp. paratuberculosis
guccgacgagucgacgc

SEQ ID NO: 848615 - RNA, 21 nt, Mycobacterium avium subsp. paratuberculosis
guccgacgauccgggccgguc

SEQ ID NO: 848616 - RNA, 22 nt, Mycobacterium avium subsp. paratuberculosis
guccgacgauccgggccggucg

SEQ ID NO: 848617 - RNA, 13 nt, Mycobacterium avium subsp. paratuberculosis
guccgaccaggaa

SEQ ID NO: 848618 - RNA, 17 nt, Mycobacterium avium subsp. paratuberculosis
guccgacgccgucgagc

SEQ ID NO: 848619 - RNA, 16 nt, Mycobacterium avium subsp. paratuberculosis
guccgacgcgacgguc

SEQ ID NO: 848620 - RNA, 17 nt, Mycobacterium avium subsp. paratuberculosis
guccgacgcgacggucg

SEQ ID NO: 848621 - RNA, 21 nt, Mycobacterium avium subsp. paratuberculosis
guccgacgcgacggucgugcu

SEQ ID NO: 848622 - RNA, 23 nt, Mycobacterium avium subsp. paratuberculosis
guccgacgcgacggucgugcugg

SEQ ID NO: 848623 - RNA, 13 nt, Mycobacterium avium subsp. paratuberculosis
guccgcggcggcc

SEQ ID NO: 848624 - RNA, 13 nt, Mycobacterium avium subsp. paratuberculosis
guccgcgucggcg

SEQ ID NO: 848625 - RNA, 14 nt, Mycobacterium avium subsp. paratuberculosis
guccgcgucggcgc

SEQ ID NO: 848626 - RNA, 18 nt, Mycobacterium avium subsp. paratuberculosis
guccgcgucggcgccggc

SEQ ID NO: 848627 - RNA, 20 nt, Mycobacterium avium subsp. paratuberculosis
guccgcgugacaagccggcg

SEQ ID NO: 848628 - RNA, 24 nt, Mycobacterium avium subsp. paratuberculosis
guccgcgugacaagccggcgucga

SEQ ID NO: 848629 - RNA, 12 nt, Mycobacterium avium subsp. paratuberculosis
guccgcguggcc

SEQ ID NO: 848630 - RNA, 15 nt, Mycobacterium avium subsp. paratuberculosis
guccgcggcggcgug

SEQ ID NO: 848631 - RNA, 17 nt, Mycobacterium avium subsp. paratuberculosis
guccgcggcggcgugcc

SEQ ID NO: 848632 - RNA, 22 nt, Mycobacterium avium subsp. paratuberculosis
guccgcggcggcgugccgcccg

SEQ ID NO: 848633 - RNA, 23 nt, Mycobacterium avium subsp. paratuberculosis
guccgcggcgucggguagggcgc

SEQ ID NO: 848634 - RNA, 22 nt, Mycobacterium avium subsp. paratuberculosis
guccgcgggaauuggcaccgga

SEQ ID NO: 848635 - RNA, 21 nt, Mycobacterium avium subsp. paratuberculosis
guccgcggugagcaccggauc

SEQ ID NO: 848636 - RNA, 22 nt, Mycobacterium avium subsp. paratuberculosis
guccgcggugagcaccggaucg

SEQ ID NO: 848637 - RNA, 23 nt, Mycobacterium avium subsp. paratuberculosis
guccgcggugagcaccggaucga

SEQ ID NO: 848638 - RNA, 12 nt, Mycobacterium avium subsp. paratuberculosis
guccgcgguggu

SEQ ID NO: 848639 - RNA, 23 nt, Mycobacterium avium subsp. paratuberculosis
guccgcgguuucaccgugcgcgc

SEQ ID NO: 848640 - RNA, 22 nt, Mycobacterium avium subsp. paratuberculosis
guccgcgguuuggucagcgccc

SEQ ID NO: 848641 - RNA, 18 nt, Mycobacterium avium subsp. paratuberculosis
guccgccgucaucggcgg

SEQ ID NO: 848642 - RNA, 17 nt, Mycobacterium avium subsp. paratuberculosis
guccgccuccgaccagc

SEQ ID NO: 848643 - RNA, 20 nt, Mycobacterium avium subsp. paratuberculosis
guccgccuccgaccagccgg

SEQ ID NO: 848644 - RNA, 19 nt, Mycobacterium avium subsp. paratuberculosis
guccgcggaggcgagcagc

SEQ ID NO: 848645 - RNA, 14 nt, Mycobacterium avium subsp. paratuberculosis
guccgccggccggu

SEQ ID NO: 848646 - RNA, 22 nt, Mycobacterium avium subsp. paratuberculosis
guccgccggccgguccucugcg

SEQ ID NO: 848647 - RNA, 11 nt, Mycobacterium avium subsp. paratuberculosis
guccgccggcg

SEQ ID NO: 848648 - RNA, 15 nt, Mycobacterium avium subsp. paratuberculosis
guccgccggcggugc

SEQ ID NO: 848649 - RNA, 14 nt, Mycobacterium avium subsp. paratuberculosis
guccgccggcuggc

SEQ ID NO: 848650 - RNA, 20 nt, Mycobacterium avium subsp. paratuberculosis
guccgccggcuggcgggcga

SEQ ID NO: 848651 - RNA, 17 nt, Mycobacterium avium subsp. paratuberculosis
guccgccgcagcggcgc

SEQ ID NO: 848652 - RNA, 19 nt, Mycobacterium avium subsp. paratuberculosis
guccgccgccgucccaccg

SEQ ID NO: 848653 - RNA, 18 nt, Mycobacterium avium subsp. paratuberculosis
guccggagaaccgcucga

SEQ ID NO: 848654 - RNA, 22 nt, Mycobacterium avium subsp. paratuberculosis
guccggagcgaaggugccgcga

SEQ ID NO: 848655 - RNA, 17 nt, Mycobacterium avium subsp. paratuberculosis
guccggaggugccggcc

SEQ ID NO: 848656 - RNA, 20 nt, Mycobacterium avium subsp. paratuberculosis
guccggauagccgucggcgg

SEQ ID NO: 848657 - RNA, 18 nt, Mycobacterium avium subsp. paratuberculosis
guccggaugcggcgccca

SEQ ID NO: 848658 - RNA, 19 nt, Mycobacterium avium subsp. paratuberculosis
guccgcucaucgucguugg

SEQ ID NO: 848659 - RNA, 22 nt, Mycobacterium avium subsp. paratuberculosis
guccgcucaucgucguuggcgc

SEQ ID NO: 848660 - RNA, 19 nt, Mycobacterium avium subsp. paratuberculosis
guccgcugugcggcccggc

SEQ ID NO: 848661 - RNA, 13 nt, Mycobacterium avium subsp. paratuberculosis
guccggaaccgcg

SEQ ID NO: 848662 - RNA, 16 nt, Mycobacterium avium subsp. paratuberculosis
guccggaaccgcgccu

SEQ ID NO: 848663 - RNA, 14 nt, Mycobacterium avium subsp. paratuberculosis
guccgccgucgagu

SEQ ID NO: 848664 - RNA, 20 nt, Mycobacterium avium subsp. paratuberculosis
guccggacacggccagcgcc

SEQ ID NO: 848665 - RNA, 22 nt, Mycobacterium avium subsp. paratuberculosis
guccggacacggccagcgccgu

SEQ ID NO: 848666 - RNA, 14 nt, Mycobacterium avium subsp. paratuberculosis
guccggcagcagcg

SEQ ID NO: 848667 - RNA, 15 nt, Mycobacterium avium subsp. paratuberculosis
guccggcagcagcga

SEQ ID NO: 848668 - RNA, 13 nt, Mycobacterium avium subsp. paratuberculosis
guccggcagcgcg

SEQ ID NO: 848669 - RNA, 20 nt, Mycobacterium avium subsp. paratuberculosis
guccggcaggcucagcagca

SEQ ID NO: 848670 - RNA, 12 nt, Mycobacterium avium subsp. paratuberculosis
guccggcccgau

SEQ ID NO: 848671 - RNA, 15 nt, Mycobacterium avium subsp. paratuberculosis
guccggcccgaugcg

SEQ ID NO: 848672 - RNA, 13 nt, Mycobacterium avium subsp. paratuberculosis
guccggcccggcg

SEQ ID NO: 848673 - RNA, 18 nt, Mycobacterium avium subsp. paratuberculosis
guccggcccggcguccgc

SEQ ID NO: 848674 - RNA, 18 nt, Mycobacterium avium subsp. paratuberculosis
guccggcccuggucggcc

SEQ ID NO: 848675 - RNA, 15 nt, Mycobacterium avium subsp. paratuberculosis
guccggccaggucgc

SEQ ID NO: 848676 - RNA, 22 nt, Mycobacterium avium subsp. paratuberculosis
guccggccaggucgccgcgcag

SEQ ID NO: 848677 - RNA, 23 nt, Mycobacterium avium subsp. paratuberculosis
guccggguucgacgccucggugc

SEQ ID NO: 848678 - RNA, 15 nt, Mycobacterium avium subsp. paratuberculosis
guccgguucgaccgg

SEQ ID NO: 848679 - RNA, 18 nt, Mycobacterium avium subsp. paratuberculosis
guccgguucgaccggcgu

SEQ ID NO: 848680 - RNA, 19 nt, Mycobacterium avium subsp. paratuberculosis
guccgguucgaccggcguc

SEQ ID NO: 848681 - RNA, 16 nt, Mycobacterium avium subsp. paratuberculosis
guccgguucggcggca

SEQ ID NO: 848682 - RNA, 17 nt, Mycobacterium avium subsp. paratuberculosis
guccggucagcaccgcg

SEQ ID NO: 848683 - RNA, 17 nt, Mycobacterium avium subsp. paratuberculosis
guccgguaggccggccg

SEQ ID NO: 848684 - RNA, 19 nt, Mycobacterium avium subsp. paratuberculosis
guccgguaggccggccgca

SEQ ID NO: 848685 - RNA, 21 nt, Mycobacterium avium subsp. paratuberculosis
guccggucucggucgcggcgu

SEQ ID NO: 848686 - RNA, 18 nt, Mycobacterium avium subsp. paratuberculosis
guccggucuucucggcca

SEQ ID NO: 848687 - RNA, 18 nt, Mycobacterium avium subsp. paratuberculosis
guccguagugcucggcgu

SEQ ID NO: 848688 - RNA, 22 nt, Mycobacterium avium subsp. paratuberculosis
guccguugggggcgccgcggcg

SEQ ID NO: 848689 - RNA, 19 nt, Mycobacterium avium subsp. paratuberculosis
guccguggugaucgccgcg

SEQ ID NO: 848690 - RNA, 20 nt, Mycobacterium avium subsp. paratuberculosis
guccgugcugccggccggca

SEQ ID NO: 848691 - RNA, 22 nt, Mycobacterium avium subsp. paratuberculosis
guccgugcauagcuggcgccga

SEQ ID NO: 848692 - RNA, 16 nt, Mycobacterium avium subsp. paratuberculosis
guccgugccacggccg

SEQ ID NO: 848693 - RNA, 19 nt, Mycobacterium avium subsp. paratuberculosis
guccgugccacggccgcgg

SEQ ID NO: 848694 - RNA, 20 nt, Mycobacterium avium subsp. paratuberculosis
guccgucgaauaggugaugu

SEQ ID NO: 848695 - RNA, 17 nt, Mycobacterium avium subsp. paratuberculosis
gucgacagccggucgcg

SEQ ID NO: 848696 - RNA, 21 nt, Mycobacterium avium subsp. paratuberculosis
gucgacagccggucgcgcauc

SEQ ID NO: 848697 - RNA, 22 nt, Mycobacterium avium subsp. paratuberculosis
gucgacagccggucgcgcaucg

SEQ ID NO: 848698 - RNA, 14 nt, Mycobacterium avium subsp. paratuberculosis
gucgaccaccacga

SEQ ID NO: 848699 - RNA, 19 nt, Mycobacterium avium subsp. paratuberculosis
gucgaccaccacgaccagu

SEQ ID NO: 848700 - RNA, 13 nt, Mycobacterium avium subsp. paratuberculosis
gucgaccaccgcc

SEQ ID NO: 848701 - RNA, 15 nt, Mycobacterium avium subsp. paratuberculosis
gucgaccaccgccgg

SEQ ID NO: 848702 - RNA, 16 nt, Mycobacterium avium subsp. paratuberculosis
gucgaccaccgccggc

SEQ ID NO: 848703 - RNA, 20 nt, Mycobacterium avium subsp. paratuberculosis
gucgaccgcggccuggguga

SEQ ID NO: 848704 - RNA, 23 nt, Mycobacterium avium subsp. paratuberculosis
gucgaccgcggccugggugaccg

SEQ ID NO: 848705 - RNA, 13 nt, Mycobacterium avium subsp. paratuberculosis
gucgaccgcggcu

SEQ ID NO: 848706 - RNA, 17 nt, Mycobacterium avium subsp. paratuberculosis
gucgaccgcgacgaccu

SEQ ID NO: 848707 - RNA, 13 nt, Mycobacterium avium subsp. paratuberculosis
gucgaccgcgcac

SEQ ID NO: 848708 - RNA, 14 nt, Mycobacterium avium subsp. paratuberculosis
gucgaccgcgcacc

SEQ ID NO: 848709 - RNA, 16 nt, Mycobacterium avium subsp. paratuberculosis
gucgaccgcgcaccgg

SEQ ID NO: 848710 - RNA, 18 nt, Mycobacterium avium subsp. paratuberculosis
gucgaccgcgcaccggcg

SEQ ID NO: 848711 - RNA, 19 nt, Mycobacterium avium subsp. paratuberculosis
gucgaccgcgcaccggcgc

SEQ ID NO: 848712 - RNA, 12 nt, Mycobacterium avium subsp. paratuberculosis
gucgaccgcggc

SEQ ID NO: 848713 - RNA, 13 nt, Mycobacterium avium subsp. paratuberculosis
gucgaccgccacc

SEQ ID NO: 848714 - RNA, 14 nt, Mycobacterium avium subsp. paratuberculosis
gucgaccgccacca

SEQ ID NO: 848715 - RNA, 14 nt, Mycobacterium avium subsp. paratuberculosis
gucgaccgccccgc

SEQ ID NO: 848716 - RNA, 19 nt, Mycobacterium avium subsp. paratuberculosis
gucgaccgccccgccggug

SEQ ID NO: 848717 - RNA, 13 nt, Mycobacterium avium subsp. paratuberculosis
gucgacccgcggc

SEQ ID NO: 848718 - RNA, 14 nt, Mycobacterium avium subsp. paratuberculosis
gucgacccgcggcg

SEQ ID NO: 848719 - RNA, 15 nt, Mycobacterium avium subsp. paratuberculosis
gucgacccgcggcgc

SEQ ID NO: 848720 - RNA, 18 nt, Mycobacterium avium subsp. paratuberculosis
gucgacccgcggcgccgc

SEQ ID NO: 848721 - RNA, 22 nt, Mycobacterium avium subsp. paratuberculosis
gucgacccggccgcgccggaug

SEQ ID NO: 848722 - RNA, 21 nt, Mycobacterium avium subsp. paratuberculosis
gucgacccguuccccggccga

SEQ ID NO: 848723 - RNA, 23 nt, Mycobacterium avium subsp. paratuberculosis
gucgacgucgagaaaggccagca

SEQ ID NO: 848724 - RNA, 16 nt, Mycobacterium avium subsp. paratuberculosis
gucgacgucauccggc

SEQ ID NO: 848725 - RNA, 19 nt, Mycobacterium avium subsp. paratuberculosis
gucgacgucauccggcugc

SEQ ID NO: 848726 - RNA, 17 nt, Mycobacterium avium subsp. paratuberculosis
gucgacguccucgaugc

SEQ ID NO: 848727 - RNA, 16 nt, Mycobacterium avium subsp. paratuberculosis
gucgacguccucgccc

SEQ ID NO: 848728 - RNA, 20 nt, Mycobacterium avium subsp. paratuberculosis
gucgacguccucgcccgggu

SEQ ID NO: 848729 - RNA, 19 nt, Mycobacterium avium subsp. paratuberculosis
gucgacgguugccucggcc

SEQ ID NO: 848730 - RNA, 18 nt, Mycobacterium avium subsp. paratuberculosis
gucgacgguuugcccggc

SEQ ID NO: 848731 - RNA, 20 nt, Mycobacterium avium subsp. paratuberculosis
gucgacgguuugcccggcga

SEQ ID NO: 848732 - RNA, 23 nt, Mycobacterium avium subsp. paratuberculosis
gucgacgguuugcccggcgaugu

SEQ ID NO: 848733 - RNA, 14 nt, Mycobacterium avium subsp. paratuberculosis
gucgacgggccacc

SEQ ID NO: 848734 - RNA, 21 nt, Mycobacterium avium subsp. paratuberculosis
gucgacgggccaccagcgcag

SEQ ID NO: 848735 - RNA, 23 nt, Mycobacterium avium subsp. paratuberculosis
gucgacgggccaccagcgcaggu

SEQ ID NO: 848736 - RNA, 14 nt, Mycobacterium avium subsp. paratuberculosis
gucgacggcgguga

SEQ ID NO: 848737 - RNA, 17 nt, Mycobacterium avium subsp. paratuberculosis
gucgacggcguggaaca

SEQ ID NO: 848738 - RNA, 18 nt, Mycobacterium avium subsp. paratuberculosis
gucgacggcguggaacac

SEQ ID NO: 848739 - RNA, 16 nt, Mycobacterium avium subsp. paratuberculosis
gucgacggcgccggac

SEQ ID NO: 848740 - RNA, 15 nt, Mycobacterium avium subsp. paratuberculosis
gucgacggccgcgcc

SEQ ID NO: 848741 - RNA, 18 nt, Mycobacterium avium subsp. paratuberculosis
gucgacggccgcgccgaa

SEQ ID NO: 848742 - RNA, 20 nt, Mycobacterium avium subsp. paratuberculosis
gucgacggccgcgccgaaca

SEQ ID NO: 848743 - RNA, 16 nt, Mycobacterium avium subsp. paratuberculosis
gucgaccucgcgcguc

SEQ ID NO: 848744 - RNA, 13 nt, Mycobacterium avium subsp. paratuberculosis
gucgaccucggcc

SEQ ID NO: 848745 - RNA, 17 nt, Mycobacterium avium subsp. paratuberculosis
gucgacgcugagccgcu

SEQ ID NO: 848746 - RNA, 20 nt, Mycobacterium avium subsp. paratuberculosis
gucgacgcugagccgcucgu

SEQ ID NO: 848747 - RNA, 17 nt, Mycobacterium avium subsp. paratuberculosis
gucgacggaagccgagc

SEQ ID NO: 848748 - RNA, 16 nt, Mycobacterium avium subsp. paratuberculosis
gucgacggacgggucg

SEQ ID NO: 848749 - RNA, 19 nt, Mycobacterium avium subsp. paratuberculosis
gucgaccgucacgcuggcg

SEQ ID NO: 848750 - RNA, 19 nt, Mycobacterium avium subsp. paratuberculosis
gucgaccuccucgaccccg

SEQ ID NO: 848751 - RNA, 18 nt, Mycobacterium avium subsp. paratuberculosis
gucgaccggcucgccguu

SEQ ID NO: 848752 - RNA, 19 nt, Mycobacterium avium subsp. paratuberculosis
gucgaccggcucgccguug

SEQ ID NO: 848753 - RNA, 22 nt, Mycobacterium avium subsp. paratuberculosis
gucgaccgggaucguguggccg

SEQ ID NO: 848754 - RNA, 14 nt, Mycobacterium avium subsp. paratuberculosis
gucgaccggggcgc

SEQ ID NO: 848755 - RNA, 18 nt, Mycobacterium avium subsp. paratuberculosis
gucgaccggggcgccccg

SEQ ID NO: 848756 - RNA, 14 nt, Mycobacterium avium subsp. paratuberculosis
gucgaccggguccg

SEQ ID NO: 848757 - RNA, 16 nt, Mycobacterium avium subsp. paratuberculosis
gucgaggucgccgaca

SEQ ID NO: 848758 - RNA, 19 nt, Mycobacterium avium subsp. paratuberculosis
gucgaggucgccgacagcg

SEQ ID NO: 848759 - RNA, 15 nt, Mycobacterium avium subsp. paratuberculosis
gucgaggucggacgc

SEQ ID NO: 848760 - RNA, 13 nt, Mycobacterium avium subsp. paratuberculosis
gucgaggucggcc

SEQ ID NO: 848761 - RNA, 14 nt, Mycobacterium avium subsp. paratuberculosis
gucgaggucgguga

SEQ ID NO: 848762 - RNA, 20 nt, Mycobacterium avium subsp. paratuberculosis
gucgaggucgucggccaguu

SEQ ID NO: 848763 - RNA, 19 nt, Mycobacterium avium subsp. paratuberculosis
gucgagcuccucggccagc

SEQ ID NO: 848764 - RNA, 21 nt, Mycobacterium avium subsp. paratuberculosis
gucgagcggcuugccgccgca

SEQ ID NO: 848765 - RNA, 22 nt, Mycobacterium avium subsp. paratuberculosis
gucgagcggcuugccgccgcag

SEQ ID NO: 848766 - RNA, 18 nt, Mycobacterium avium subsp. paratuberculosis
gucgagcgucacgccgcg

SEQ ID NO: 848767 - RNA, 19 nt, Mycobacterium avium subsp. paratuberculosis
gucgagcgucacgccgcgc

SEQ ID NO: 848768 - RNA, 20 nt, Mycobacterium avium subsp. paratuberculosis
gucgagcgucacgccgcgcc

SEQ ID NO: 848769 - RNA, 22 nt, Mycobacterium avium subsp. paratuberculosis
gucgagcgucacgccgcgcccg

SEQ ID NO: 848770 - RNA, 21 nt, Mycobacterium avium subsp. paratuberculosis
gucgagcgcggcccgccgaac

SEQ ID NO: 848771 - RNA, 15 nt, Mycobacterium avium subsp. paratuberculosis
gucgagcgcgccgag

SEQ ID NO: 848772 - RNA, 21 nt, Mycobacterium avium subsp. paratuberculosis
gucgagguugaugccgacguc

SEQ ID NO: 848773 - RNA, 22 nt, Mycobacterium avium subsp. paratuberculosis
gucgagguugaugccgacgucg

SEQ ID NO: 848774 - RNA, 19 nt, Mycobacterium avium subsp. paratuberculosis
gucgaguccguggucaggg

SEQ ID NO: 848775 - RNA, 14 nt, Mycobacterium avium subsp. paratuberculosis
gucgagucggccac

SEQ ID NO: 848776 - RNA, 16 nt, Mycobacterium avium subsp. paratuberculosis
gucgagucggccaccg

SEQ ID NO: 848777 - RNA, 20 nt, Mycobacterium avium subsp. paratuberculosis
gucgagugcucgauggccag

SEQ ID NO: 848778 - RNA, 16 nt, Mycobacterium avium subsp. paratuberculosis
gucgaguucgccgucg

SEQ ID NO: 848779 - RNA, 17 nt, Mycobacterium avium subsp. paratuberculosis
gucgaguucgccgucga

SEQ ID NO: 848780 - RNA, 22 nt, Mycobacterium avium subsp. paratuberculosis
gucgaguucgccgucgacggug

SEQ ID NO: 848781 - RNA, 16 nt, Mycobacterium avium subsp. paratuberculosis
gucgaguucgcggcgc

SEQ ID NO: 848782 - RNA, 20 nt, Mycobacterium avium subsp. paratuberculosis
gucgaguucgcggcgcagca

SEQ ID NO: 848783 - RNA, 14 nt, Mycobacterium avium subsp. paratuberculosis
gucgagccggugcc

SEQ ID NO: 848784 - RNA, 15 nt, Mycobacterium avium subsp. paratuberculosis
gucgagccggugccg

SEQ ID NO: 848785 - RNA, 22 nt, Mycobacterium avium subsp. paratuberculosis
gucgagccgggcccggguggcg

SEQ ID NO: 848786 - RNA, 18 nt, Mycobacterium avium subsp. paratuberculosis
gucgacugggccaggucg

SEQ ID NO: 848787 - RNA, 18 nt, Mycobacterium avium subsp. paratuberculosis
gucgacucggcggugccg

SEQ ID NO: 848788 - RNA, 18 nt, Mycobacterium avium subsp. paratuberculosis
gucgacugaucgacgagc

SEQ ID NO: 848789 - RNA, 16 nt, Mycobacterium avium subsp. paratuberculosis
gucgacugcaccgacu

SEQ ID NO: 848790 - RNA, 16 nt, Mycobacterium avium subsp. paratuberculosis
gucgacguucgccgcc

SEQ ID NO: 848791 - RNA, 19 nt, Mycobacterium avium subsp. paratuberculosis
gucgacguucgccgccagc

SEQ ID NO: 848792 - RNA, 16 nt, Mycobacterium avium subsp. paratuberculosis
gucgacgugcgcggcg

SEQ ID NO: 848793 - RNA, 17 nt, Mycobacterium avium subsp. paratuberculosis
gucgacgugcucggcgg

SEQ ID NO: 848794 - RNA, 22 nt, Mycobacterium avium subsp. paratuberculosis
gucgacgugcucggcggccgcc

SEQ ID NO: 848795 - RNA, 17 nt, Mycobacterium avium subsp. paratuberculosis
gucgacguggugcaccg

SEQ ID NO: 848796 - RNA, 21 nt, Mycobacterium avium subsp. paratuberculosis
gucgacguggugcaccgccag

SEQ ID NO: 848797 - RNA, 13 nt, Mycobacterium avium subsp. paratuberculosis
gucgacgucgggc

SEQ ID NO: 848798 - RNA, 16 nt, Mycobacterium avium subsp. paratuberculosis
gucgacgucgggcacg

SEQ ID NO: 848799 - RNA, 14 nt, Mycobacterium avium subsp. paratuberculosis
gucgacgucgucga

SEQ ID NO: 848800 - RNA, 20 nt, Mycobacterium avium subsp. paratuberculosis
gucgacaccccgcucggcca

SEQ ID NO: 848801 - RNA, 14 nt, Mycobacterium avium subsp. paratuberculosis
gucgacacgccggc

SEQ ID NO: 848802 - RNA, 16 nt, Mycobacterium avium subsp. paratuberculosis
gucgacacgccggccg

SEQ ID NO: 848803 - RNA, 17 nt, Mycobacterium avium subsp. paratuberculosis
gucgacacgccggccgu

SEQ ID NO: 848804 - RNA, 14 nt, Mycobacterium avium subsp. paratuberculosis
gucgaagggucggu

SEQ ID NO: 848805 - RNA, 17 nt, Mycobacterium avium subsp. paratuberculosis
gucgaagggucggucga

SEQ ID NO: 848806 - RNA, 20 nt, Mycobacterium avium subsp. paratuberculosis
gucgaaggucugcagcagcc

SEQ ID NO: 848807 - RNA, 22 nt, Mycobacterium avium subsp. paratuberculosis
gucgaaggugaucuuguuguug

SEQ ID NO: 848808 - RNA, 20 nt, Mycobacterium avium subsp. paratuberculosis
gucgaaggugaugaaaaccg

SEQ ID NO: 848809 - RNA, 15 nt, Mycobacterium avium subsp. paratuberculosis
gucgaagggcaucgg

SEQ ID NO: 848810 - RNA, 23 nt, Mycobacterium avium subsp. paratuberculosis
gucgaagggcaucgggucguaga

SEQ ID NO: 848811 - RNA, 18 nt, Mycobacterium avium subsp. paratuberculosis
gucgaaguccugcgccgc

SEQ ID NO: 848812 - RNA, 22 nt, Mycobacterium avium subsp. paratuberculosis
gucgaaguccugcgccgcggug

SEQ ID NO: 848813 - RNA, 17 nt, Mycobacterium avium subsp. paratuberculosis
gucgaagugcucgagca

SEQ ID NO: 848814 - RNA, 12 nt, Mycobacterium avium subsp. paratuberculosis
gucgaaucacaa

SEQ ID NO: 848815 - RNA, 16 nt, Mycobacterium avium subsp. paratuberculosis
guccugggccuggcgc

SEQ ID NO: 848816 - RNA, 13 nt, Mycobacterium avium subsp. paratuberculosis
guccuggcgccag

SEQ ID NO: 848817 - RNA, 16 nt, Mycobacterium avium subsp. paratuberculosis
guccuggaucgcgcag

SEQ ID NO: 848818 - RNA, 14 nt, Mycobacterium avium subsp. paratuberculosis
gucgaagccgucca

SEQ ID NO: 848819 - RNA, 15 nt, Mycobacterium avium subsp. paratuberculosis
gucgaagcccgccgu

SEQ ID NO: 848820 - RNA, 22 nt, Mycobacterium avium subsp. paratuberculosis
gucgaagcccuucaccucggcc

SEQ ID NO: 848821 - RNA, 19 nt, Mycobacterium avium subsp. paratuberculosis
gucgaagccgaucaccggc

SEQ ID NO: 848822 - RNA, 18 nt, Mycobacterium avium subsp. paratuberculosis
gucgaagaagcggccgac

SEQ ID NO: 848823 - RNA, 19 nt, Mycobacterium avium subsp. paratuberculosis
gucgaagaagcggccgacg

SEQ ID NO: 848824 - RNA, 15 nt, Mycobacterium avium subsp. paratuberculosis
gucgaagaccacgaa

SEQ ID NO: 848825 - RNA, 16 nt, Mycobacterium avium subsp. paratuberculosis
gucgaagacggcgagg

SEQ ID NO: 848826 - RNA, 17 nt, Mycobacterium avium subsp. paratuberculosis
gucgaagaggugcucga

SEQ ID NO: 848827 - RNA, 17 nt, Mycobacterium avium subsp. paratuberculosis
gucgaagauggccaggu

SEQ ID NO: 848828 - RNA, 16 nt, Mycobacterium avium subsp. paratuberculosis
gucgaagcgcaugccg

SEQ ID NO: 848829 - RNA, 17 nt, Mycobacterium avium subsp. paratuberculosis
gucgaagcugcgcagcc

SEQ ID NO: 848830 - RNA, 18 nt, Mycobacterium avium subsp. paratuberculosis
gucgaaggccgggcuggu

SEQ ID NO: 848831 - RNA, 22 nt, Mycobacterium avium subsp. paratuberculosis
gucgaaggcgcgggcguccacg

SEQ ID NO: 848832 - RNA, 16 nt, Mycobacterium avium subsp. paratuberculosis
gucgaaggcggccgcg

SEQ ID NO: 848833 - RNA, 17 nt, Mycobacterium avium subsp. paratuberculosis
gucgaaggcggccgcga

SEQ ID NO: 848834 - RNA, 20 nt, Mycobacterium avium subsp. paratuberculosis
gucgaaggcggccgcgagcc

SEQ ID NO: 848835 - RNA, 18 nt, Mycobacterium avium subsp. paratuberculosis
guccucguucuggcccgc

SEQ ID NO: 848836 - RNA, 17 nt, Mycobacterium avium subsp. paratuberculosis
guccucgucggcgaagg

SEQ ID NO: 848837 - RNA, 18 nt, Mycobacterium avium subsp. paratuberculosis
guccucgucggcgaaggu

SEQ ID NO: 848838 - RNA, 18 nt, Mycobacterium avium subsp. paratuberculosis
guccugcagcgccguccg

SEQ ID NO: 848839 - RNA, 19 nt, Mycobacterium avium subsp. paratuberculosis
guccugcagcucgccggcg

SEQ ID NO: 848840 - RNA, 14 nt, Mycobacterium avium subsp. paratuberculosis
guccugcaccgagu

SEQ ID NO: 848841 - RNA, 16 nt, Mycobacterium avium subsp. paratuberculosis
guccugcagcagccgg

SEQ ID NO: 848842 - RNA, 19 nt, Mycobacterium avium subsp. paratuberculosis
guccugcagcagccggacc

SEQ ID NO: 848843 - RNA, 15 nt, Mycobacterium avium subsp. paratuberculosis
guccugcaggcaggc

SEQ ID NO: 848844 - RNA, 16 nt, Mycobacterium avium subsp. paratuberculosis
guccugcaggcaggcc

SEQ ID NO: 848845 - RNA, 16 nt, Mycobacterium avium subsp. paratuberculosis
guccugccgggcgucg

SEQ ID NO: 848846 - RNA, 12 nt, Mycobacterium avium subsp. paratuberculosis
guccugcgccgc

SEQ ID NO: 848847 - RNA, 13 nt, Mycobacterium avium subsp. paratuberculosis
guccugcgccgcg

SEQ ID NO: 848848 - RNA, 18 nt, Mycobacterium avium subsp. paratuberculosis
guccugcggcgacaacgc

SEQ ID NO: 848849 - RNA, 21 nt, Mycobacterium avium subsp. paratuberculosis
guccugcggggaggucgucgc

SEQ ID NO: 848850 - RNA, 17 nt, Mycobacterium avium subsp. paratuberculosis
guccucgcuggcgauca

SEQ ID NO: 848851 - RNA, 18 nt, Mycobacterium avium subsp. paratuberculosis
guccucggacucgucgcu

SEQ ID NO: 848852 - RNA, 13 nt, Mycobacterium avium subsp. paratuberculosis
guccucggcgaug

SEQ ID NO: 848853 - RNA, 16 nt, Mycobacterium avium subsp. paratuberculosis
guccucggucucgucc

SEQ ID NO: 848854 - RNA, 19 nt, Mycobacterium avium subsp. paratuberculosis
guccucggucucguccagu

SEQ ID NO: 848855 - RNA, 17 nt, Mycobacterium avium subsp. paratuberculosis
guccucgguggccaccu

SEQ ID NO: 848856 - RNA, 14 nt, Mycobacterium avium subsp. paratuberculosis
guccucgucaccgu

SEQ ID NO: 848857 - RNA, 16 nt, Mycobacterium avium subsp. paratuberculosis
guccucgucgaugccg

SEQ ID NO: 848858 - RNA, 20 nt, Mycobacterium avium subsp. paratuberculosis
guccucgucggaggcgucga

SEQ ID NO: 848859 - RNA, 19 nt, Mycobacterium avium subsp. paratuberculosis
guccucgccguacgcgccg

SEQ ID NO: 848860 - RNA, 18 nt, Mycobacterium avium subsp. paratuberculosis
guccucgaugacgccgga

SEQ ID NO: 848861 - RNA, 16 nt, Mycobacterium avium subsp. paratuberculosis
guccucgaugccgacc

SEQ ID NO: 848862 - RNA, 18 nt, Mycobacterium avium subsp. paratuberculosis
guccucgaugccgaccga

SEQ ID NO: 848863 - RNA, 23 nt, Mycobacterium avium subsp. paratuberculosis
guccucgaugccgaccgacagcc

SEQ ID NO: 848864 - RNA, 23 nt, Mycobacterium avium subsp. paratuberculosis
guccucgacgaucagcacgucgc

SEQ ID NO: 848865 - RNA, 15 nt, Mycobacterium avium subsp. paratuberculosis
guccucgacgccgcg

SEQ ID NO: 848866 - RNA, 23 nt, Mycobacterium avium subsp. paratuberculosis
guccucgagcgcgucgaccagcc

SEQ ID NO: 848867 - RNA, 20 nt, Mycobacterium avium subsp. paratuberculosis
guccucgaccucuucggcgc

SEQ ID NO: 848868 - RNA, 18 nt, Mycobacterium avium subsp. paratuberculosis
guccucgaucgacaccuc

SEQ ID NO: 848869 - RNA, 22 nt, Mycobacterium avium subsp. paratuberculosis
guccuacggcgggugcgacggc

SEQ ID NO: 848870 - RNA, 21 nt, Mycobacterium avium subsp. paratuberculosis
guccucccagcgcccgggcgc

SEQ ID NO: 848871 - RNA, 22 nt, Mycobacterium avium subsp. paratuberculosis
guccuccccgcuggcgccggcg

SEQ ID NO: 848872 - RNA, 23 nt, Mycobacterium avium subsp. paratuberculosis
guccucccgggugggcagcgcga

SEQ ID NO: 848873 - RNA, 14 nt, Mycobacterium avium subsp. paratuberculosis
guccuccucguccg

SEQ ID NO: 848874 - RNA, 14 nt, Mycobacterium avium subsp. paratuberculosis
gucggaaucggcgc

SEQ ID NO: 848875 - RNA, 15 nt, Mycobacterium avium subsp. paratuberculosis
gucggaaucggcgcc

SEQ ID NO: 848876 - RNA, 23 nt, Mycobacterium avium subsp. paratuberculosis
gucggacaccagcauggcgauca

SEQ ID NO: 848877 - RNA, 13 nt, Mycobacterium avium subsp. paratuberculosis
gucggacagcagc

SEQ ID NO: 848878 - RNA, 19 nt, Mycobacterium avium subsp. paratuberculosis
gucgcuuucggugaccauc

SEQ ID NO: 848879 - RNA, 15 nt, Mycobacterium avium subsp. paratuberculosis
gucggacgcggccga

SEQ ID NO: 848880 - RNA, 17 nt, Mycobacterium avium subsp. paratuberculosis
gucggacaugccggcgc

SEQ ID NO: 848881 - RNA, 18 nt, Mycobacterium avium subsp. paratuberculosis
gucggacaugccggcgcc

SEQ ID NO: 848882 - RNA, 19 nt, Mycobacterium avium subsp. paratuberculosis
gucggaccccgaugcgcuc

SEQ ID NO: 848883 - RNA, 22 nt, Mycobacterium avium subsp. paratuberculosis
gucggacuccuccugcgacggc

SEQ ID NO: 848884 - RNA, 15 nt, Mycobacterium avium subsp. paratuberculosis
gucggacucgcgccg

SEQ ID NO: 848885 - RNA, 18 nt, Mycobacterium avium subsp. paratuberculosis
gucggacucgcgccggau

SEQ ID NO: 848886 - RNA, 23 nt, Mycobacterium avium subsp. paratuberculosis
gucggagacguugccgcacaccg

SEQ ID NO: 848887 - RNA, 20 nt, Mycobacterium avium subsp. paratuberculosis
gucggagaucaccggcaccc

SEQ ID NO: 848888 - RNA, 17 nt, Mycobacterium avium subsp. paratuberculosis
gucggagaucagggugc

SEQ ID NO: 848889 - RNA, 15 nt, Mycobacterium avium subsp. paratuberculosis
gucggagaugcgggc

SEQ ID NO: 848890 - RNA, 22 nt, Mycobacterium avium subsp. paratuberculosis
gucggagcaaauccggcagcgc

SEQ ID NO: 848891 - RNA, 19 nt, Mycobacterium avium subsp. paratuberculosis
gucggagcgcuccaccacc

SEQ ID NO: 848892 - RNA, 16 nt, Mycobacterium avium subsp. paratuberculosis
gucggcaggauccgga

SEQ ID NO: 848893 - RNA, 19 nt, Mycobacterium avium subsp. paratuberculosis
gucggcaggauccggacga

SEQ ID NO: 848894 - RNA, 12 nt, Mycobacterium avium subsp. paratuberculosis
gucggcagcacc

SEQ ID NO: 848895 - RNA, 16 nt, Mycobacterium avium subsp. paratuberculosis
gucggcagcaccggca

SEQ ID NO: 848896 - RNA, 20 nt, Mycobacterium avium subsp. paratuberculosis
gucggcagcaccggcagcaa

SEQ ID NO: 848897 - RNA, 16 nt, Mycobacterium avium subsp. paratuberculosis
gucggcacugcccgca

SEQ ID NO: 848898 - RNA, 20 nt, Mycobacterium avium subsp. paratuberculosis
gucggcacaccagguaggcg

SEQ ID NO: 848899 - RNA, 19 nt, Mycobacterium avium subsp. paratuberculosis
gucggcaccuccugcaccc

SEQ ID NO: 848900 - RNA, 16 nt, Mycobacterium avium subsp. paratuberculosis
gucggcaaugaccggc

SEQ ID NO: 848901 - RNA, 14 nt, Mycobacterium avium subsp. paratuberculosis
gucggcaacgccgg

SEQ ID NO: 848902 - RNA, 16 nt, Mycobacterium avium subsp. paratuberculosis
gucggcaacgccgggu

SEQ ID NO: 848903 - RNA, 17 nt, Mycobacterium avium subsp. paratuberculosis
gucggcaacccgaccuc

SEQ ID NO: 848904 - RNA, 20 nt, Mycobacterium avium subsp. paratuberculosis
gucggaucgcuugaccagca

SEQ ID NO: 848905 - RNA, 17 nt, Mycobacterium avium subsp. paratuberculosis
gucggaguccagcacgc

SEQ ID NO: 848906 - RNA, 16 nt, Mycobacterium avium subsp. paratuberculosis
gucggacgccuccccc

SEQ ID NO: 848907 - RNA, 21 nt, Mycobacterium avium subsp. paratuberculosis
gucggagcugcgcgccccggc

SEQ ID NO: 848908 - RNA, 20 nt, Mycobacterium avium subsp. paratuberculosis
gucggaggacaacgcgucga

SEQ ID NO: 848909 - RNA, 14 nt, Mycobacterium avium subsp. paratuberculosis
gucggaggcgucga

SEQ ID NO: 848910 - RNA, 17 nt, Mycobacterium avium subsp. paratuberculosis
gucggaggcgucgacgc

SEQ ID NO: 848911 - RNA, 20 nt, Mycobacterium avium subsp. paratuberculosis
gucgcucaaaggcgggcacu

SEQ ID NO: 848912 - RNA, 17 nt, Mycobacterium avium subsp. paratuberculosis
gucgcucaacggcucca

SEQ ID NO: 848913 - RNA, 20 nt, Mycobacterium avium subsp. paratuberculosis
gucgcuaguugcacuuucgc

SEQ ID NO: 848914 - RNA, 22 nt, Mycobacterium avium subsp. paratuberculosis
gucgcucaucccgaugucggcg

SEQ ID NO: 848915 - RNA, 24 nt, Mycobacterium avium subsp. paratuberculosis
gucgcucauguugugcaggcagcc

SEQ ID NO: 848916 - RNA, 13 nt, Mycobacterium avium subsp. paratuberculosis
gucgcucggcggc

SEQ ID NO: 848917 - RNA, 16 nt, Mycobacterium avium subsp. paratuberculosis
gucgcucggcggcgac

SEQ ID NO: 848918 - RNA, 17 nt, Mycobacterium avium subsp. paratuberculosis
gucgcucggcggcgacg

SEQ ID NO: 848919 - RNA, 21 nt, Mycobacterium avium subsp. paratuberculosis
gucgcugaucgcgauccgggc

SEQ ID NO: 848920 - RNA, 22 nt, Mycobacterium avium subsp. paratuberculosis
gucgcugagcgggaagcugcug

SEQ ID NO: 848921 - RNA, 20 nt, Mycobacterium avium subsp. paratuberculosis
gucgcugaggcugcgggugg

SEQ ID NO: 848922 - RNA, 22 nt, Mycobacterium avium subsp. paratuberculosis
gucgcugaguaugcagaugaug

SEQ ID NO: 848923 - RNA, 24 nt, Mycobacterium avium subsp. paratuberculosis
gucgcugaguaugcagaugaugcc

SEQ ID NO: 848924 - RNA, 18 nt, Mycobacterium avium subsp. paratuberculosis
gucgcugaccccgcucgg

SEQ ID NO: 848925 - RNA, 19 nt, Mycobacterium avium subsp. paratuberculosis
gucgcugaccccgcucggc

SEQ ID NO: 848926 - RNA, 23 nt, Mycobacterium avium subsp. paratuberculosis
gucgcugaccccgcucggcgugg

SEQ ID NO: 848927 - RNA, 13 nt, Mycobacterium avium subsp. paratuberculosis
gucgcugacccgc

SEQ ID NO: 848928 - RNA, 16 nt, Mycobacterium avium subsp. paratuberculosis
gucgcugacccgccgc

SEQ ID NO: 848929 - RNA, 23 nt, Mycobacterium avium subsp. paratuberculosis
gucgcugacccgccgcaacagcc

SEQ ID NO: 848930 - RNA, 18 nt, Mycobacterium avium subsp. paratuberculosis
gucgcugacccgggcggc

SEQ ID NO: 848931 - RNA, 12 nt, Mycobacterium avium subsp. paratuberculosis
gucgcugaccac

SEQ ID NO: 848932 - RNA, 15 nt, Mycobacterium avium subsp. paratuberculosis
gucgcugaccaccga

SEQ ID NO: 848933 - RNA, 13 nt, Mycobacterium avium subsp. paratuberculosis
gucgcugaccuuc

SEQ ID NO: 848934 - RNA, 12 nt, Mycobacterium avium subsp. paratuberculosis
gucgcugcgcuc

SEQ ID NO: 848935 - RNA, 16 nt, Mycobacterium avium subsp. paratuberculosis
gucgcugcagcggcgg

SEQ ID NO: 848936 - RNA, 17 nt, Mycobacterium avium subsp. paratuberculosis
gucgcugcagcggcggc

SEQ ID NO: 848937 - RNA, 21 nt, Mycobacterium avium subsp. paratuberculosis
gucgcugcccagauacgccgc

SEQ ID NO: 848938 - RNA, 13 nt, Mycobacterium avium subsp. paratuberculosis
gucgcugcccggc

SEQ ID NO: 848939 - RNA, 18 nt, Mycobacterium avium subsp. paratuberculosis
gucgcugccgccgccggc

SEQ ID NO: 848940 - RNA, 19 nt, Mycobacterium avium subsp. paratuberculosis
gucgcugccgccgccggcg

SEQ ID NO: 848941 - RNA, 21 nt, Mycobacterium avium subsp. paratuberculosis
gucgcugccgccgccggcggu

SEQ ID NO: 848942 - RNA, 18 nt, Mycobacterium avium subsp. paratuberculosis
gucgcugcgaggcgggca

SEQ ID NO: 848943 - RNA, 23 nt, Mycobacterium avium subsp. paratuberculosis
gucgcugcgaugauggucaccgu

SEQ ID NO: 848944 - RNA, 18 nt, Mycobacterium avium subsp. paratuberculosis
gucgcuggcguacgccau

SEQ ID NO: 848945 - RNA, 23 nt, Mycobacterium avium subsp. paratuberculosis
gucgcuggccagguacaccacca

SEQ ID NO: 848946 - RNA, 15 nt, Mycobacterium avium subsp. paratuberculosis
gucgcuggccgcgac

SEQ ID NO: 848947 - RNA, 19 nt, Mycobacterium avium subsp. paratuberculosis
gucgcugggcagccguccc

SEQ ID NO: 848948 - RNA, 15 nt, Mycobacterium avium subsp. paratuberculosis
gucgcuggucgaacc

SEQ ID NO: 848949 - RNA, 17 nt, Mycobacterium avium subsp. paratuberculosis
gucgcuguaggccagcc

SEQ ID NO: 848950 - RNA, 19 nt, Mycobacterium avium subsp. paratuberculosis
gucgcuguaggccagcccg

SEQ ID NO: 848951 - RNA, 15 nt, Mycobacterium avium subsp. paratuberculosis
gucgcuguccucgag

SEQ ID NO: 848952 - RNA, 13 nt, Mycobacterium avium subsp. paratuberculosis
gucgcugucggcg

SEQ ID NO: 848953 - RNA, 19 nt, Mycobacterium avium subsp. paratuberculosis
gucgcuguuagccucgcca

SEQ ID NO: 848954 - RNA, 21 nt, Mycobacterium avium subsp. paratuberculosis
gucgcuguuagccucgccagc

SEQ ID NO: 848955 - RNA, 15 nt, Mycobacterium avium subsp. paratuberculosis
gucggcauccacccg

SEQ ID NO: 848956 - RNA, 20 nt, Mycobacterium avium subsp. paratuberculosis
gucggcaguugcacuuucgc

SEQ ID NO: 848957 - RNA, 16 nt, Mycobacterium avium subsp. paratuberculosis
gucggcauagcgccgc

SEQ ID NO: 848958 - RNA, 13 nt, Mycobacterium avium subsp. paratuberculosis
gucggccaccgcg

SEQ ID NO: 848959 - RNA, 14 nt, Mycobacterium avium subsp. paratuberculosis
gucggccaccgcga

SEQ ID NO: 848960 - RNA, 15 nt, Mycobacterium avium subsp. paratuberculosis
gucggccaccgcgcc

SEQ ID NO: 848961 - RNA, 21 nt, Mycobacterium avium subsp. paratuberculosis
gucggccaccgcggucgacgg

SEQ ID NO: 848962 - RNA, 16 nt, Mycobacterium avium subsp. paratuberculosis
gucggccagauagaug

SEQ ID NO: 848963 - RNA, 20 nt, Mycobacterium avium subsp. paratuberculosis
gucggccagcaccaccaacg

SEQ ID NO: 848964 - RNA, 14 nt, Mycobacterium avium subsp. paratuberculosis
gucggccagcagcg

SEQ ID NO: 848965 - RNA, 23 nt, Mycobacterium avium subsp. paratuberculosis
gucggccagcagcgcgucgcggg

SEQ ID NO: 848966 - RNA, 15 nt, Mycobacterium avium subsp. paratuberculosis
gucggccagcagguc

SEQ ID NO: 848967 - RNA, 20 nt, Mycobacterium avium subsp. paratuberculosis
gucggccacguugccgggua

SEQ ID NO: 848968 - RNA, 13 nt, Mycobacterium avium subsp. paratuberculosis
gucggccacgacg

SEQ ID NO: 848969 - RNA, 19 nt, Mycobacterium avium subsp. paratuberculosis
gucggccacgacgcggcgc

SEQ ID NO: 848970 - RNA, 16 nt, Mycobacterium avium subsp. paratuberculosis
gucggccacgcucgcc

SEQ ID NO: 848971 - RNA, 17 nt, Mycobacterium avium subsp. paratuberculosis
gucggccagcugcgggu

SEQ ID NO: 848972 - RNA, 24 nt, Mycobacterium avium subsp. paratuberculosis
gucggccagcgaguccagccagcc

SEQ ID NO: 848973 - RNA, 13 nt, Mycobacterium avium subsp. paratuberculosis
gucggccagcgcg

SEQ ID NO: 848974 - RNA, 16 nt, Mycobacterium avium subsp. paratuberculosis
gucggccagcgcgcgc

SEQ ID NO: 848975 - RNA, 14 nt, Mycobacterium avium subsp. paratuberculosis
gucggccagcgcgg

SEQ ID NO: 848976 - RNA, 19 nt, Mycobacterium avium subsp. paratuberculosis
gucggccagcgcggcggcc

SEQ ID NO: 848977 - RNA, 20 nt, Mycobacterium avium subsp. paratuberculosis
gucggccagcgcggcggcca

SEQ ID NO: 848978 - RNA, 14 nt, Mycobacterium avium subsp. paratuberculosis
gucggccagcgcgu

SEQ ID NO: 848979 - RNA, 13 nt, Mycobacterium avium subsp. paratuberculosis
gucggccagcggc

SEQ ID NO: 848980 - RNA, 14 nt, Mycobacterium avium subsp. paratuberculosis
gucggccagcggca

SEQ ID NO: 848981 - RNA, 13 nt, Mycobacterium avium subsp. paratuberculosis
gucggccgcccgu

SEQ ID NO: 848982 - RNA, 19 nt, Mycobacterium avium subsp. paratuberculosis
gucggccgcccguccgggc

SEQ ID NO: 848983 - RNA, 20 nt, Mycobacterium avium subsp. paratuberculosis
gucggccgcccguccgggcc

SEQ ID NO: 848984 - RNA, 12 nt, Mycobacterium avium subsp. paratuberculosis
gucggccgccga

SEQ ID NO: 848985 - RNA, 19 nt, Mycobacterium avium subsp. paratuberculosis
gucggccgagguccgcggu

SEQ ID NO: 848986 - RNA, 23 nt, Mycobacterium avium subsp. paratuberculosis
gucggccgcacgucccgcccggc

SEQ ID NO: 848987 - RNA, 14 nt, Mycobacterium avium subsp. paratuberculosis
gucggcccgccggg

SEQ ID NO: 848988 - RNA, 16 nt, Mycobacterium avium subsp. paratuberculosis
gucggcccgccgggcc

SEQ ID NO: 848989 - RNA, 20 nt, Mycobacterium avium subsp. paratuberculosis
gucggcccgccgggccggau

SEQ ID NO: 848990 - RNA, 19 nt, Mycobacterium avium subsp. paratuberculosis
gucggcccgcugcggcugg

SEQ ID NO: 848991 - RNA, 15 nt, Mycobacterium avium subsp. paratuberculosis
gucggcccaggccaa

SEQ ID NO: 848992 - RNA, 16 nt, Mycobacterium avium subsp. paratuberculosis
gucggcccaggccaac

SEQ ID NO: 848993 - RNA, 17 nt, Mycobacterium avium subsp. paratuberculosis
gucggcccaggccaaca

SEQ ID NO: 848994 - RNA, 22 nt, Mycobacterium avium subsp. paratuberculosis
gucggcccaggccaacagcagc

SEQ ID NO: 848995 - RNA, 21 nt, Mycobacterium avium subsp. paratuberculosis
gucggcccaguccagucgcgc

SEQ ID NO: 848996 - RNA, 14 nt, Mycobacterium avium subsp. paratuberculosis
gucggccccgcgca

SEQ ID NO: 848997 - RNA, 14 nt, Mycobacterium avium subsp. paratuberculosis
gucggccagggcgu

SEQ ID NO: 848998 - RNA, 17 nt, Mycobacterium avium subsp. paratuberculosis
gucggccagggcgugga

SEQ ID NO: 848999 - RNA, 16 nt, Mycobacterium avium subsp. paratuberculosis
gucggccagucguacu

SEQ ID NO: 849000 - RNA, 17 nt, Mycobacterium avium subsp. paratuberculosis
gucggccaguucaccgc

SEQ ID NO: 849001 - RNA, 18 nt, Mycobacterium avium subsp. paratuberculosis
gucggccaguucaccgcg

SEQ ID NO: 849002 - RNA, 16 nt, Mycobacterium avium subsp. paratuberculosis
gucggccaucagcacc

SEQ ID NO: 849003 - RNA, 20 nt, Mycobacterium avium subsp. paratuberculosis
gucggccaucagcaccgaau

SEQ ID NO: 849004 - RNA, 16 nt, Mycobacterium avium subsp. paratuberculosis
gucggcgcgguccacg

SEQ ID NO: 849005 - RNA, 14 nt, Mycobacterium avium subsp. paratuberculosis
gucggcgcuggcca

SEQ ID NO: 849006 - RNA, 18 nt, Mycobacterium avium subsp. paratuberculosis
gucggcgcuggccagcgc

SEQ ID NO: 849007 - RNA, 14 nt, Mycobacterium avium subsp. paratuberculosis
gucggcgcggucgc

SEQ ID NO: 849008 - RNA, 20 nt, Mycobacterium avium subsp. paratuberculosis
gucggcgcgguugucguuga

SEQ ID NO: 849009 - RNA, 16 nt, Mycobacterium avium subsp. paratuberculosis
gucggcgcgugccaac

SEQ ID NO: 849010 - RNA, 14 nt, Mycobacterium avium subsp. paratuberculosis
gucggcgcucgcgg

SEQ ID NO: 849011 - RNA, 13 nt, Mycobacterium avium subsp. paratuberculosis
gucggcgcggcga

SEQ ID NO: 849012 - RNA, 19 nt, Mycobacterium avium subsp. paratuberculosis
gucggcgcggcgacgugau

SEQ ID NO: 849013 - RNA, 17 nt, Mycobacterium avium subsp. paratuberculosis
gucggcgcgcucggugc

SEQ ID NO: 849014 - RNA, 17 nt, Mycobacterium avium subsp. paratuberculosis
gucggcgcggacgugau

SEQ ID NO: 849015 - RNA, 15 nt, Mycobacterium avium subsp. paratuberculosis
gucggcgcggccgga

SEQ ID NO: 849016 - RNA, 12 nt, Mycobacterium avium subsp. paratuberculosis
gucggcgaugga

SEQ ID NO: 849017 - RNA, 19 nt, Mycobacterium avium subsp. paratuberculosis
gucggcgcgccacccgacg

SEQ ID NO: 849018 - RNA, 20 nt, Mycobacterium avium subsp. paratuberculosis
gucggcgcagcgcacgucgc

SEQ ID NO: 849019 - RNA, 19 nt, Mycobacterium avium subsp. paratuberculosis
gucggcgauggcggcgugc

SEQ ID NO: 849020 - RNA, 20 nt, Mycobacterium avium subsp. paratuberculosis
gucggcgauggcggcgugca

SEQ ID NO: 849021 - RNA, 17 nt, Mycobacterium avium subsp. paratuberculosis
gucggcgaugcgguggu

SEQ ID NO: 849022 - RNA, 19 nt, Mycobacterium avium subsp. paratuberculosis
gucggcgaugcgguggucg

SEQ ID NO: 849023 - RNA, 20 nt, Mycobacterium avium subsp. paratuberculosis
gucggcgaugcgguggucga

SEQ ID NO: 849024 - RNA, 23 nt, Mycobacterium avium subsp. paratuberculosis
gucggcgaguucgaccuccaccc

SEQ ID NO: 849025 - RNA, 16 nt, Mycobacterium avium subsp. paratuberculosis
gucggcgaucgccagc

SEQ ID NO: 849026 - RNA, 17 nt, Mycobacterium avium subsp. paratuberculosis
gucggcgaucgccagca

SEQ ID NO: 849027 - RNA, 20 nt, Mycobacterium avium subsp. paratuberculosis
gucggcgaucgccagcacgg

SEQ ID NO: 849028 - RNA, 16 nt, Mycobacterium avium subsp. paratuberculosis
gucggccuugaccagg

SEQ ID NO: 849029 - RNA, 18 nt, Mycobacterium avium subsp. paratuberculosis
gucggcgacggcggggug

SEQ ID NO: 849030 - RNA, 19 nt, Mycobacterium avium subsp. paratuberculosis
gucggcgacggcggggugc

SEQ ID NO: 849031 - RNA, 17 nt, Mycobacterium avium subsp. paratuberculosis
gucggccuugcgccacu

SEQ ID NO: 849032 - RNA, 14 nt, Mycobacterium avium subsp. paratuberculosis
gucggcgagcagcc

SEQ ID NO: 849033 - RNA, 18 nt, Mycobacterium avium subsp. paratuberculosis
gucggcgagcagccgcgc

SEQ ID NO: 849034 - RNA, 21 nt, Mycobacterium avium subsp. paratuberculosis
gucggcgagcuuggcgguguu

SEQ ID NO: 849035 - RNA, 22 nt, Mycobacterium avium subsp. paratuberculosis
gucggccuucagcguccacgau

SEQ ID NO: 849036 - RNA, 20 nt, Mycobacterium avium subsp. paratuberculosis
gucggccugcacgucggcgc

SEQ ID NO: 849037 - RNA, 20 nt, Mycobacterium avium subsp. paratuberculosis
gucggccugcagcucggugc

SEQ ID NO: 849038 - RNA, 23 nt, Mycobacterium avium subsp. paratuberculosis
gucggccugcccgcggguggccu

SEQ ID NO: 849039 - RNA, 21 nt, Mycobacterium avium subsp. paratuberculosis
gucggccugcgcugcggccaa

SEQ ID NO: 849040 - RNA, 15 nt, Mycobacterium avium subsp. paratuberculosis
gucggccucggcggc

SEQ ID NO: 849041 - RNA, 16 nt, Mycobacterium avium subsp. paratuberculosis
gucggccucggcggcc

SEQ ID NO: 849042 - RNA, 19 nt, Mycobacterium avium subsp. paratuberculosis
gucggccucggcggccggg

SEQ ID NO: 849043 - RNA, 20 nt, Mycobacterium avium subsp. paratuberculosis
gucggccucggcgguggccu

SEQ ID NO: 849044 - RNA, 17 nt, Mycobacterium avium subsp. paratuberculosis
gucggccggcugcagcc

SEQ ID NO: 849045 - RNA, 18 nt, Mycobacterium avium subsp. paratuberculosis
gucggccgggccggcggu

SEQ ID NO: 849046 - RNA, 21 nt, Mycobacterium avium subsp. paratuberculosis
gucggccgggccggcggugau

SEQ ID NO: 849047 - RNA, 17 nt, Mycobacterium avium subsp. paratuberculosis
gucggccgggcugccca

SEQ ID NO: 849048 - RNA, 20 nt, Mycobacterium avium subsp. paratuberculosis
gucggccgggcugcccacca

SEQ ID NO: 849049 - RNA, 22 nt, Mycobacterium avium subsp. paratuberculosis
gucggccgggcugcccaccacc

SEQ ID NO: 849050 - RNA, 22 nt, Mycobacterium avium subsp. paratuberculosis
gucggccgggggcgcgggcggc

SEQ ID NO: 849051 - RNA, 23 nt, Mycobacterium avium subsp. paratuberculosis
gucggccgggggcgcgggcggca

SEQ ID NO: 849052 - RNA, 19 nt, Mycobacterium avium subsp. paratuberculosis
gucggccguacacaaggaa

SEQ ID NO: 849053 - RNA, 17 nt, Mycobacterium avium subsp. paratuberculosis
gucggccgucggcgccg

SEQ ID NO: 849054 - RNA, 19 nt, Mycobacterium avium subsp. paratuberculosis
gucggccgucggcgccgcc

SEQ ID NO: 849055 - RNA, 17 nt, Mycobacterium avium subsp. paratuberculosis
gucggccuccagccggc

SEQ ID NO: 849056 - RNA, 19 nt, Mycobacterium avium subsp. paratuberculosis
gucggccuccagccggcgg

SEQ ID NO: 849057 - RNA, 22 nt, Mycobacterium avium subsp. paratuberculosis
gucggccggauucucgcccggc

SEQ ID NO: 849058 - RNA, 16 nt, Mycobacterium avium subsp. paratuberculosis
gucggccggcucgacc

SEQ ID NO: 849059 - RNA, 17 nt, Mycobacterium avium subsp. paratuberculosis
gucggccggcaggccgc

SEQ ID NO: 849060 - RNA, 19 nt, Mycobacterium avium subsp. paratuberculosis
gucggccggcaggccgccc

SEQ ID NO: 849061 - RNA, 23 nt, Mycobacterium avium subsp. paratuberculosis
gucggccggcaguugcggccgcu

SEQ ID NO: 849062 - RNA, 12 nt, Mycobacterium avium subsp. paratuberculosis
gucggccggcgg

SEQ ID NO: 849063 - RNA, 17 nt, Mycobacterium avium subsp. paratuberculosis
gucgccccggccgcggu

SEQ ID NO: 849064 - RNA, 13 nt, Mycobacterium avium subsp. paratuberculosis
gucgcccgcccag

SEQ ID NO: 849065 - RNA, 15 nt, Mycobacterium avium subsp. paratuberculosis
gucgcccgcccaggc

SEQ ID NO: 849066 - RNA, 13 nt, Mycobacterium avium subsp. paratuberculosis
gucgcccgccgac

SEQ ID NO: 849067 - RNA, 16 nt, Mycobacterium avium subsp. paratuberculosis
gucgcccgccgacggc

SEQ ID NO: 849068 - RNA, 21 nt, Mycobacterium avium subsp. paratuberculosis
gucgcccgccgacggcugccc

SEQ ID NO: 849069 - RNA, 19 nt, Mycobacterium avium subsp. paratuberculosis
gucgccaugccgucgcgca

SEQ ID NO: 849070 - RNA, 20 nt, Mycobacterium avium subsp. paratuberculosis
gucgccaugccgucgcgcac

SEQ ID NO: 849071 - RNA, 22 nt, Mycobacterium avium subsp. paratuberculosis
gucgccaugccgucgcgcaccg

SEQ ID NO: 849072 - RNA, 13 nt, Mycobacterium avium subsp. paratuberculosis
gucgcccggguag

SEQ ID NO: 849073 - RNA, 17 nt, Mycobacterium avium subsp. paratuberculosis
gucgcccgcguugcggc

SEQ ID NO: 849074 - RNA, 23 nt, Mycobacterium avium subsp. paratuberculosis
gucgcccgcguugcggcgcagcg

SEQ ID NO: 849075 - RNA, 12 nt, Mycobacterium avium subsp. paratuberculosis
gucgcccggcgc

SEQ ID NO: 849076 - RNA, 15 nt, Mycobacterium avium subsp. paratuberculosis
gucgcccggcgcggc

SEQ ID NO: 849077 - RNA, 13 nt, Mycobacterium avium subsp. paratuberculosis
gucgcccggcggc

SEQ ID NO: 849078 - RNA, 17 nt, Mycobacterium avium subsp. paratuberculosis
gucgcccggcggcaccg

SEQ ID NO: 849079 - RNA, 19 nt, Mycobacterium avium subsp. paratuberculosis
gucgcccggcggcaccgag

SEQ ID NO: 849080 - RNA, 20 nt, Mycobacterium avium subsp. paratuberculosis
gucgcccggcggcaccgagu

SEQ ID NO: 849081 - RNA, 14 nt, Mycobacterium avium subsp. paratuberculosis
gucgcccggcgucc

SEQ ID NO: 849082 - RNA, 14 nt, Mycobacterium avium subsp. paratuberculosis
gucgcccggcucgc

SEQ ID NO: 849083 - RNA, 15 nt, Mycobacterium avium subsp. paratuberculosis
gucgcccguggccca

SEQ ID NO: 849084 - RNA, 14 nt, Mycobacterium avium subsp. paratuberculosis
gucgcccucgaucg

SEQ ID NO: 849085 - RNA, 15 nt, Mycobacterium avium subsp. paratuberculosis
gucgcccucgaucgc

SEQ ID NO: 849086 - RNA, 13 nt, Mycobacterium avium subsp. paratuberculosis
gucgcccucgcgc

SEQ ID NO: 849087 - RNA, 20 nt, Mycobacterium avium subsp. paratuberculosis
gucgcccucgcgcagggcca

SEQ ID NO: 849088 - RNA, 17 nt, Mycobacterium avium subsp. paratuberculosis
gucgcccugacacagca

SEQ ID NO: 849089 - RNA, 18 nt, Mycobacterium avium subsp. paratuberculosis
gucgcccugacacagcac

SEQ ID NO: 849090 - RNA, 23 nt, Mycobacterium avium subsp. paratuberculosis
gucgcccugacacagcaccggcg

SEQ ID NO: 849091 - RNA, 13 nt, Mycobacterium avium subsp. paratuberculosis
gucgccgcgccgc

SEQ ID NO: 849092 - RNA, 16 nt, Mycobacterium avium subsp. paratuberculosis
gucgccgcgccgccgg

SEQ ID NO: 849093 - RNA, 13 nt, Mycobacterium avium subsp. paratuberculosis
gucgccgcgcccg

SEQ ID NO: 849094 - RNA, 14 nt, Mycobacterium avium subsp. paratuberculosis
gucgccgcgcccgc

SEQ ID NO: 849095 - RNA, 16 nt, Mycobacterium avium subsp. paratuberculosis
gucgccgcgcagaucg

SEQ ID NO: 849096 - RNA, 19 nt, Mycobacterium avium subsp. paratuberculosis
gucgccgcgcagaucgaug

SEQ ID NO: 849097 - RNA, 14 nt, Mycobacterium avium subsp. paratuberculosis
gucgccgcgcagca

SEQ ID NO: 849098 - RNA, 16 nt, Mycobacterium avium subsp. paratuberculosis
gucgccgcgcagcacc

SEQ ID NO: 849099 - RNA, 12 nt, Mycobacterium avium subsp. paratuberculosis
gucgccgcgcca

SEQ ID NO: 849100 - RNA, 13 nt, Mycobacterium avium subsp. paratuberculosis
gucgccgcgccag

SEQ ID NO: 849101 - RNA, 14 nt, Mycobacterium avium subsp. paratuberculosis
gucgccgcgccagc

SEQ ID NO: 849102 - RNA, 16 nt, Mycobacterium avium subsp. paratuberculosis
gucgccgccgcgcacc

SEQ ID NO: 849103 - RNA, 13 nt, Mycobacterium avium subsp. paratuberculosis
gucgccgccggug

SEQ ID NO: 849104 - RNA, 22 nt, Mycobacterium avium subsp. paratuberculosis
gucgccgccggugccgacgaug

SEQ ID NO: 849105 - RNA, 14 nt, Mycobacterium avium subsp. paratuberculosis
gucgccgccgucca

SEQ ID NO: 849106 - RNA, 15 nt, Mycobacterium avium subsp. paratuberculosis
gucgccgaucucggc

SEQ ID NO: 849107 - RNA, 14 nt, Mycobacterium avium subsp. paratuberculosis
gucgccgaugcgcc

SEQ ID NO: 849108 - RNA, 18 nt, Mycobacterium avium subsp. paratuberculosis
gucgccgaugcgccgcac

SEQ ID NO: 849109 - RNA, 17 nt, Mycobacterium avium subsp. paratuberculosis
gucgccgauggagaccu

SEQ ID NO: 849110 - RNA, 13 nt, Mycobacterium avium subsp. paratuberculosis
gucgccgauggcg

SEQ ID NO: 849111 - RNA, 22 nt, Mycobacterium avium subsp. paratuberculosis
gucgccgauguaguccagccca

SEQ ID NO: 849112 - RNA, 20 nt, Mycobacterium avium subsp. paratuberculosis
gucgccgauuucggugucga

SEQ ID NO: 849113 - RNA, 14 nt, Mycobacterium avium subsp. paratuberculosis
gucgccgcacgccc

SEQ ID NO: 849114 - RNA, 13 nt, Mycobacterium avium subsp. paratuberculosis
gucgccgcagauc

SEQ ID NO: 849115 - RNA, 15 nt, Mycobacterium avium subsp. paratuberculosis
gucgccgcagaucag

SEQ ID NO: 849116 - RNA, 21 nt, Mycobacterium avium subsp. paratuberculosis
gucgccgcagaucagggcgau

SEQ ID NO: 849117 - RNA, 17 nt, Mycobacterium avium subsp. paratuberculosis
gucgccgcccacgccgu

SEQ ID NO: 849118 - RNA, 14 nt, Mycobacterium avium subsp. paratuberculosis
gucgccgaucagca

SEQ ID NO: 849119 - RNA, 20 nt, Mycobacterium avium subsp. paratuberculosis
gucgccgaucagcaccaggu

SEQ ID NO: 849120 - RNA, 23 nt, Mycobacterium avium subsp. paratuberculosis
gucgccgaucgcccgguaggccg

SEQ ID NO: 849121 - RNA, 14 nt, Mycobacterium avium subsp. paratuberculosis
gucgccgcccgggc

SEQ ID NO: 849122 - RNA, 13 nt, Mycobacterium avium subsp. paratuberculosis
gucgccagcacca

SEQ ID NO: 849123 - RNA, 14 nt, Mycobacterium avium subsp. paratuberculosis
gucgccagcaccac

SEQ ID NO: 849124 - RNA, 16 nt, Mycobacterium avium subsp. paratuberculosis
gucgccagcaccaccu

SEQ ID NO: 849125 - RNA, 13 nt, Mycobacterium avium subsp. paratuberculosis
gucgccagcaccg

SEQ ID NO: 849126 - RNA, 22 nt, Mycobacterium avium subsp. paratuberculosis
gucgccagcaccgugcugaucc

SEQ ID NO: 849127 - RNA, 13 nt, Mycobacterium avium subsp. paratuberculosis
gucgccagccgcc

SEQ ID NO: 849128 - RNA, 15 nt, Mycobacterium avium subsp. paratuberculosis
gucgccagccgccgg

SEQ ID NO: 849129 - RNA, 16 nt, Mycobacterium avium subsp. paratuberculosis
gucgccagccgccggc

SEQ ID NO: 849130 - RNA, 17 nt, Mycobacterium avium subsp. paratuberculosis
gucgccagccgccggcu

SEQ ID NO: 849131 - RNA, 13 nt, Mycobacterium avium subsp. paratuberculosis
gucgccagcgcca

SEQ ID NO: 849132 - RNA, 20 nt, Mycobacterium avium subsp. paratuberculosis
gucgccaaggucgucaacga

SEQ ID NO: 849133 - RNA, 14 nt, Mycobacterium avium subsp. paratuberculosis
gucgccaggccacc

SEQ ID NO: 849134 - RNA, 16 nt, Mycobacterium avium subsp. paratuberculosis
gucgccaggccaccgc

SEQ ID NO: 849135 - RNA, 20 nt, Mycobacterium avium subsp. paratuberculosis
gucgccaggccaccgcacgu

SEQ ID NO: 849136 - RNA, 21 nt, Mycobacterium avium subsp. paratuberculosis
gucgccaggccaccgcacguc

SEQ ID NO: 849137 - RNA, 20 nt, Mycobacterium avium subsp. paratuberculosis
gucgccaguugcacuuucgg

SEQ ID NO: 849138 - RNA, 22 nt, Mycobacterium avium subsp. paratuberculosis
gucgcauaugcgugggcccuca

SEQ ID NO: 849139 - RNA, 15 nt, Mycobacterium avium subsp. paratuberculosis
gucgcaucagcucgg

SEQ ID NO: 849140 - RNA, 22 nt, Mycobacterium avium subsp. paratuberculosis
gucgcaggcagcagcaccccga

SEQ ID NO: 849141 - RNA, 14 nt, Mycobacterium avium subsp. paratuberculosis
gucgcaggccgccc

SEQ ID NO: 849142 - RNA, 20 nt, Mycobacterium avium subsp. paratuberculosis
gucgcaggccgcccggccca

SEQ ID NO: 849143 - RNA, 18 nt, Mycobacterium avium subsp. paratuberculosis
gucgcagugcccgcccag

SEQ ID NO: 849144 - RNA, 21 nt, Mycobacterium avium subsp. paratuberculosis
gucgauaugcugcaacggcug

SEQ ID NO: 849145 - RNA, 21 nt, Mycobacterium avium subsp. paratuberculosis
gucgaucagcgacggcccgcc

SEQ ID NO: 849146 - RNA, 21 nt, Mycobacterium avium subsp. paratuberculosis
gucgaucaacaccaacgacag

SEQ ID NO: 849147 - RNA, 23 nt, Mycobacterium avium subsp. paratuberculosis
gucgaucaacaccaacgacagcg

SEQ ID NO: 849148 - RNA, 13 nt, Mycobacterium avium subsp. paratuberculosis
gucgaucaccucg

SEQ ID NO: 849149 - RNA, 14 nt, Mycobacterium avium subsp. paratuberculosis
gucgaucagcgcgc

SEQ ID NO: 849150 - RNA, 15 nt, Mycobacterium avium subsp. paratuberculosis
gucgaucagcgcgcc

SEQ ID NO: 849151 - RNA, 20 nt, Mycobacterium avium subsp. paratuberculosis
gucgaucagcgcgccgccca

SEQ ID NO: 849152 - RNA, 18 nt, Mycobacterium avium subsp. paratuberculosis
gucgaucagcgguccacc

SEQ ID NO: 849153 - RNA, 21 nt, Mycobacterium avium subsp. paratuberculosis
gucgaucagcgguccacccga

SEQ ID NO: 849154 - RNA, 22 nt, Mycobacterium avium subsp. paratuberculosis
gucgaucagcgguccacccgaa

SEQ ID NO: 849155 - RNA, 21 nt, Mycobacterium avium subsp. paratuberculosis
gucgaucauguagcgcuggua

SEQ ID NO: 849156 - RNA, 19 nt, Mycobacterium avium subsp. paratuberculosis
gucgauccacccaccggca

SEQ ID NO: 849157 - RNA, 18 nt, Mycobacterium avium subsp. paratuberculosis
gucgauccacucccgcgc

SEQ ID NO: 849158 - RNA, 19 nt, Mycobacterium avium subsp. paratuberculosis
gucgauccacucccgcgcg

SEQ ID NO: 849159 - RNA, 20 nt, Mycobacterium avium subsp. paratuberculosis
gucgauccacucccgcgcgc

SEQ ID NO: 849160 - RNA, 17 nt, Mycobacterium avium subsp. paratuberculosis
gucgcgaucgcggucca

SEQ ID NO: 849161 - RNA, 13 nt, Mycobacterium avium subsp. paratuberculosis
gucgcgcaccacc

SEQ ID NO: 849162 - RNA, 16 nt, Mycobacterium avium subsp. paratuberculosis
gucgcgcaccagcucg

SEQ ID NO: 849163 - RNA, 17 nt, Mycobacterium avium subsp. paratuberculosis
gucgcgcaccauccgcg

SEQ ID NO: 849164 - RNA, 15 nt, Mycobacterium avium subsp. paratuberculosis
gucgcgcacccgcac

SEQ ID NO: 849165 - RNA, 15 nt, Mycobacterium avium subsp. paratuberculosis
gucgcgcagcaccuc

SEQ ID NO: 849166 - RNA, 23 nt, Mycobacterium avium subsp. paratuberculosis
gucgcgcagcaccuccuggguga

SEQ ID NO: 849167 - RNA, 14 nt, Mycobacterium avium subsp. paratuberculosis
gucgcgcagcagcg

SEQ ID NO: 849168 - RNA, 19 nt, Mycobacterium avium subsp. paratuberculosis
gucgcgcagcagcgggauc

SEQ ID NO: 849169 - RNA, 13 nt, Mycobacterium avium subsp. paratuberculosis
gucgcgcaccgcg

SEQ ID NO: 849170 - RNA, 14 nt, Mycobacterium avium subsp. paratuberculosis
gucgcgcaccgcgg

SEQ ID NO: 849171 - RNA, 17 nt, Mycobacterium avium subsp. paratuberculosis
gucgcgcaccgcggcgg

SEQ ID NO: 849172 - RNA, 22 nt, Mycobacterium avium subsp. paratuberculosis
gucgcgcaccgcggcggggucc

SEQ ID NO: 849173 - RNA, 16 nt, Mycobacterium avium subsp. paratuberculosis
gucgcgaugugcucga

SEQ ID NO: 849174 - RNA, 17 nt, Mycobacterium avium subsp. paratuberculosis
gucgcgaugugcucgau

SEQ ID NO: 849175 - RNA, 18 nt, Mycobacterium avium subsp. paratuberculosis
gucgcgaugugcucgauc

SEQ ID NO: 849176 - RNA, 20 nt, Mycobacterium avium subsp. paratuberculosis
gucgcgcaggaugcccagca

SEQ ID NO: 849177 - RNA, 23 nt, Mycobacterium avium subsp. paratuberculosis
gucgcgcaggaugcccagcacca

SEQ ID NO: 849178 - RNA, 22 nt, Mycobacterium avium subsp. paratuberculosis
gucgcggacccuggccagcacc

SEQ ID NO: 849179 - RNA, 16 nt, Mycobacterium avium subsp. paratuberculosis
gucgcgcagcauggcc

SEQ ID NO: 849180 - RNA, 15 nt, Mycobacterium avium subsp. paratuberculosis
gucgcgcagcccgau

SEQ ID NO: 849181 - RNA, 20 nt, Mycobacterium avium subsp. paratuberculosis
gucgcgcagcccgaucgcca

SEQ ID NO: 849182 - RNA, 16 nt, Mycobacterium avium subsp. paratuberculosis
gucgcgcagccgccgg

SEQ ID NO: 849183 - RNA, 13 nt, Mycobacterium avium subsp. paratuberculosis
gucgcgcagccgg

SEQ ID NO: 849184 - RNA, 15 nt, Mycobacterium avium subsp. paratuberculosis
gucgcgcagccgggc

SEQ ID NO: 849185 - RNA, 15 nt, Mycobacterium avium subsp. paratuberculosis
gucgcggacuggugg

SEQ ID NO: 849186 - RNA, 18 nt, Mycobacterium avium subsp. paratuberculosis
gucgcggacuggugggcg

SEQ ID NO: 849187 - RNA, 15 nt, Mycobacterium avium subsp. paratuberculosis
gucgcggagcggguc

SEQ ID NO: 849188 - RNA, 18 nt, Mycobacterium avium subsp. paratuberculosis
gucgcggaggaugccggc

SEQ ID NO: 849189 - RNA, 18 nt, Mycobacterium avium subsp. paratuberculosis
gucgcggauacgcccggc

SEQ ID NO: 849190 - RNA, 19 nt, Mycobacterium avium subsp. paratuberculosis
gucgcggauacgcccggcc

SEQ ID NO: 849191 - RNA, 22 nt, Mycobacterium avium subsp. paratuberculosis
gucgcgaagacgcuggccacga

SEQ ID NO: 849192 - RNA, 20 nt, Mycobacterium avium subsp. paratuberculosis
gucgcgaagcguaugccggu

SEQ ID NO: 849193 - RNA, 16 nt, Mycobacterium avium subsp. paratuberculosis
gucgcgaccgccggac

SEQ ID NO: 849194 - RNA, 18 nt, Mycobacterium avium subsp. paratuberculosis
gucgcgacgagcgggccg

SEQ ID NO: 849195 - RNA, 23 nt, Mycobacterium avium subsp. paratuberculosis
gucgcgacgagcgggccgaucag

SEQ ID NO: 849196 - RNA, 18 nt, Mycobacterium avium subsp. paratuberculosis
gucgcgauagggccggcc

SEQ ID NO: 849197 - RNA, 15 nt, Mycobacterium avium subsp. paratuberculosis
gucgcgaucacacca

SEQ ID NO: 849198 - RNA, 12 nt, Mycobacterium avium subsp. paratuberculosis
gucgcgaucgcg

SEQ ID NO: 849199 - RNA, 14 nt, Mycobacterium avium subsp. paratuberculosis
gucgccgcugguga

SEQ ID NO: 849200 - RNA, 23 nt, Mycobacterium avium subsp. paratuberculosis
gucgccgcuggugaacucgccga

SEQ ID NO: 849201 - RNA, 18 nt, Mycobacterium avium subsp. paratuberculosis
gucgccggacucgaucgc

SEQ ID NO: 849202 - RNA, 20 nt, Mycobacterium avium subsp. paratuberculosis
gucgccggacucgaucgcca

SEQ ID NO: 849203 - RNA, 17 nt, Mycobacterium avium subsp. paratuberculosis
gucgccggaggcgauca

SEQ ID NO: 849204 - RNA, 19 nt, Mycobacterium avium subsp. paratuberculosis
gucgcgaaaaucgguggug

SEQ ID NO: 849205 - RNA, 17 nt, Mycobacterium avium subsp. paratuberculosis
gucgcggaugcgggcgc

SEQ ID NO: 849206 - RNA, 17 nt, Mycobacterium avium subsp. paratuberculosis
gucgcggaucucgucgg

SEQ ID NO: 849207 - RNA, 17 nt, Mycobacterium avium subsp. paratuberculosis
gucgcggcccagcacca

SEQ ID NO: 849208 - RNA, 21 nt, Mycobacterium avium subsp. paratuberculosis
gucgcggcaucccuggugacc

SEQ ID NO: 849209 - RNA, 14 nt, Mycobacterium avium subsp. paratuberculosis
gucgcggcccaccg

SEQ ID NO: 849210 - RNA, 17 nt, Mycobacterium avium subsp. paratuberculosis
gucgcggcccaccgcgu

SEQ ID NO: 849211 - RNA, 21 nt, Mycobacterium avium subsp. paratuberculosis
gucgcggccuucuuggccgga

SEQ ID NO: 849212 - RNA, 13 nt, Mycobacterium avium subsp. paratuberculosis
gucgcggcgcacg

SEQ ID NO: 849213 - RNA, 16 nt, Mycobacterium avium subsp. paratuberculosis
gucgcgggcccgggcc

SEQ ID NO: 849214 - RNA, 23 nt, Mycobacterium avium subsp. paratuberculosis
gucgcgggcccgggccacccgcg

SEQ ID NO: 849215 - RNA, 18 nt, Mycobacterium avium subsp. paratuberculosis
gucgcgggucuggcucgg

SEQ ID NO: 849216 - RNA, 14 nt, Mycobacterium avium subsp. paratuberculosis
gucgcgggugaccg

SEQ ID NO: 849217 - RNA, 17 nt, Mycobacterium avium subsp. paratuberculosis
gucgcgggugaccggcg

SEQ ID NO: 849218 - RNA, 12 nt, Mycobacterium avium subsp. paratuberculosis
gucgcgggcgaa

SEQ ID NO: 849219 - RNA, 14 nt, Mycobacterium avium subsp. paratuberculosis
gucgcgggcgaaag

SEQ ID NO: 849220 - RNA, 17 nt, Mycobacterium avium subsp. paratuberculosis
gucgcgggcgccgaaga

SEQ ID NO: 849221 - RNA, 14 nt, Mycobacterium avium subsp. paratuberculosis
gucgcgggcggggc

SEQ ID NO: 849222 - RNA, 18 nt, Mycobacterium avium subsp. paratuberculosis
gucgcgggcggggcgccg

SEQ ID NO: 849223 - RNA, 20 nt, Mycobacterium avium subsp. paratuberculosis
gucgcgggcggggcgccgac

SEQ ID NO: 849224 - RNA, 21 nt, Mycobacterium avium subsp. paratuberculosis
gucgcgggcggggcgccgaca

SEQ ID NO: 849225 - RNA, 22 nt, Mycobacterium avium subsp. paratuberculosis
gucgcgguaguuguccccgauu

SEQ ID NO: 849226 - RNA, 22 nt, Mycobacterium avium subsp. paratuberculosis
gucgcggucagcucgaucgccg

SEQ ID NO: 849227 - RNA, 15 nt, Mycobacterium avium subsp. paratuberculosis
gucgcggucggcgcc

SEQ ID NO: 849228 - RNA, 14 nt, Mycobacterium avium subsp. paratuberculosis
gucgcggucggcgu

SEQ ID NO: 849229 - RNA, 16 nt, Mycobacterium avium subsp. paratuberculosis
gucgcggucggcgucg

SEQ ID NO: 849230 - RNA, 22 nt, Mycobacterium avium subsp. paratuberculosis
gucgcggugaaguugccgccgc

SEQ ID NO: 849231 - RNA, 19 nt, Mycobacterium avium subsp. paratuberculosis
gucgcggugcccagccgca

SEQ ID NO: 849232 - RNA, 18 nt, Mycobacterium avium subsp. paratuberculosis
gucgcgguccacgccggc

SEQ ID NO: 849233 - RNA, 22 nt, Mycobacterium avium subsp. paratuberculosis
gucgcguacgggaugaucagca

SEQ ID NO: 849234 - RNA, 16 nt, Mycobacterium avium subsp. paratuberculosis
gucgcguagggcaggg

SEQ ID NO: 849235 - RNA, 15 nt, Mycobacterium avium subsp. paratuberculosis
gucgcggugucggcg

SEQ ID NO: 849236 - RNA, 18 nt, Mycobacterium avium subsp. paratuberculosis
gucgcggugucggcgucg

SEQ ID NO: 849237 - RNA, 16 nt, Mycobacterium avium subsp. paratuberculosis
gucgcgguugaucaca

SEQ ID NO: 849238 - RNA, 23 nt, Mycobacterium avium subsp. paratuberculosis
gucgcgguugaucacaccgucgg

SEQ ID NO: 849239 - RNA, 17 nt, Mycobacterium avium subsp. paratuberculosis
gucgcguccagcaugcc

SEQ ID NO: 849240 - RNA, 22 nt, Mycobacterium avium subsp. paratuberculosis
gucgcguccagcaugcccacgc

SEQ ID NO: 849241 - RNA, 15 nt, Mycobacterium avium subsp. paratuberculosis
gucgcgucccuggcg

SEQ ID NO: 849242 - RNA, 22 nt, Mycobacterium avium subsp. paratuberculosis
gucgcgucccuggcgaugauca

SEQ ID NO: 849243 - RNA, 20 nt, Mycobacterium avium subsp. paratuberculosis
gucgcguccgagcagcagcc

SEQ ID NO: 849244 - RNA, 14 nt, Mycobacterium avium subsp. paratuberculosis
gucgcguccgcgau

SEQ ID NO: 849245 - RNA, 14 nt, Mycobacterium avium subsp. paratuberculosis
gucgcuaccucacc

SEQ ID NO: 849246 - RNA, 21 nt, Mycobacterium avium subsp. paratuberculosis
gucgcuaccucaccacgugcc

SEQ ID NO: 849247 - RNA, 23 nt, Mycobacterium avium subsp. paratuberculosis
gucgcuaccucaccacgugccac

SEQ ID NO: 849248 - RNA, 18 nt, Mycobacterium avium subsp. paratuberculosis
gucgcguugaaagccgcg

SEQ ID NO: 849249 - RNA, 19 nt, Mycobacterium avium subsp. paratuberculosis
gucgcguugaaagccgcga

SEQ ID NO: 849250 - RNA, 17 nt, Mycobacterium avium subsp. paratuberculosis
gucgcgucgucggcggg

SEQ ID NO: 849251 - RNA, 18 nt, Mycobacterium avium subsp. paratuberculosis
gucgcgucgucggcgggc

SEQ ID NO: 849252 - RNA, 13 nt, Mycobacterium avium subsp. paratuberculosis
gucgcgucgugcg

SEQ ID NO: 849253 - RNA, 19 nt, Mycobacterium avium subsp. paratuberculosis
gucgcgucgugcggccggc

SEQ ID NO: 849254 - RNA, 16 nt, Mycobacterium avium subsp. paratuberculosis
gucgcgugaccggcgg

SEQ ID NO: 849255 - RNA, 18 nt, Mycobacterium avium subsp. paratuberculosis
gucgcgugaccggcggug

SEQ ID NO: 849256 - RNA, 19 nt, Mycobacterium avium subsp. paratuberculosis
gucgcgugaccggcggugc

SEQ ID NO: 849257 - RNA, 23 nt, Mycobacterium avium subsp. paratuberculosis
gucgcguucccgggcccgcugca

SEQ ID NO: 849258 - RNA, 18 nt, Mycobacterium avium subsp. paratuberculosis
ggugaaguuggcggcggu

SEQ ID NO: 849259 - RNA, 20 nt, Mycobacterium avium subsp. paratuberculosis
ggugaaguuggcggcgguga

SEQ ID NO: 849260 - RNA, 14 nt, Mycobacterium avium subsp. paratuberculosis
ggugaagguccggu

SEQ ID NO: 849261 - RNA, 19 nt, Mycobacterium avium subsp. paratuberculosis
ggugaaggugccccacgcc

SEQ ID NO: 849262 - RNA, 14 nt, Mycobacterium avium subsp. paratuberculosis
ggugaaggugcccu

SEQ ID NO: 849263 - RNA, 17 nt, Mycobacterium avium subsp. paratuberculosis
ggugaaggccuggaugc

SEQ ID NO: 849264 - RNA, 20 nt, Mycobacterium avium subsp. paratuberculosis
ggugaaggccuggaugccgc

SEQ ID NO: 849265 - RNA, 12 nt, Mycobacterium avium subsp. paratuberculosis
ggugaagucguu

SEQ ID NO: 849266 - RNA, 21 nt, Mycobacterium avium subsp. paratuberculosis
ggugaagugccgguccagccg

SEQ ID NO: 849267 - RNA, 19 nt, Mycobacterium avium subsp. paratuberculosis
ggugacccaauccggcuga

SEQ ID NO: 849268 - RNA, 16 nt, Mycobacterium avium subsp. paratuberculosis
ggugaccaccugcacc

SEQ ID NO: 849269 - RNA, 23 nt, Mycobacterium avium subsp. paratuberculosis
ggugaccaccugcaccugcggca

SEQ ID NO: 849270 - RNA, 19 nt, Mycobacterium avium subsp. paratuberculosis
ggugaccacgccgugcccg

SEQ ID NO: 849271 - RNA, 15 nt, Mycobacterium avium subsp. paratuberculosis
ggugacaacgguggu

SEQ ID NO: 849272 - RNA, 19 nt, Mycobacterium avium subsp. paratuberculosis
ggugacaugcccgggcucg

SEQ ID NO: 849273 - RNA, 14 nt, Mycobacterium avium subsp. paratuberculosis
ggugagcaccgccg

SEQ ID NO: 849274 - RNA, 13 nt, Mycobacterium avium subsp. paratuberculosis
ggugagcaccgcg

SEQ ID NO: 849275 - RNA, 15 nt, Mycobacterium avium subsp. paratuberculosis
ggugagcaccgcgau

SEQ ID NO: 849276 - RNA, 15 nt, Mycobacterium avium subsp. paratuberculosis
ggugagcaccgggaa

SEQ ID NO: 849277 - RNA, 13 nt, Mycobacterium avium subsp. paratuberculosis
ggugagcaccguu

SEQ ID NO: 849278 - RNA, 16 nt, Mycobacterium avium subsp. paratuberculosis
ggugagcacgaccgcc

SEQ ID NO: 849279 - RNA, 16 nt, Mycobacterium avium subsp. paratuberculosis
ggugagcagcaugccg

SEQ ID NO: 849280 - RNA, 13 nt, Mycobacterium avium subsp. paratuberculosis
ggugagcaucggg

SEQ ID NO: 849281 - RNA, 18 nt, Mycobacterium avium subsp. paratuberculosis
ggugagcccgaugcuggc

SEQ ID NO: 849282 - RNA, 14 nt, Mycobacterium avium subsp. paratuberculosis
ggugagccgccaca

SEQ ID NO: 849283 - RNA, 14 nt, Mycobacterium avium subsp. paratuberculosis
ggugagccgggugc

SEQ ID NO: 849284 - RNA, 19 nt, Mycobacterium avium subsp. paratuberculosis
ggugagccgggugcccgcg

SEQ ID NO: 849285 - RNA, 19 nt, Mycobacterium avium subsp. paratuberculosis
ggugagccggucgaacgcc

SEQ ID NO: 849286 - RNA, 22 nt, Mycobacterium avium subsp. paratuberculosis
ggugagccucagggcgcgcugu

SEQ ID NO: 849287 - RNA, 16 nt, Mycobacterium avium subsp. paratuberculosis
ggugagcgcgccggcc

SEQ ID NO: 849288 - RNA, 17 nt, Mycobacterium avium subsp. paratuberculosis
ggugagcaacaccggca

SEQ ID NO: 849289 - RNA, 20 nt, Mycobacterium avium subsp. paratuberculosis
ggugagcaacaccggcacga

SEQ ID NO: 849290 - RNA, 18 nt, Mycobacterium avium subsp. paratuberculosis
ggugaccccgucgaacga

SEQ ID NO: 849291 - RNA, 14 nt, Mycobacterium avium subsp. paratuberculosis
ggugaccggcgccg

SEQ ID NO: 849292 - RNA, 17 nt, Mycobacterium avium subsp. paratuberculosis
ggugaccggcgccgggu

SEQ ID NO: 849293 - RNA, 19 nt, Mycobacterium avium subsp. paratuberculosis
ggugaccggcgcgcccgag

SEQ ID NO: 849294 - RNA, 16 nt, Mycobacterium avium subsp. paratuberculosis
ggugaccgacgacgug

SEQ ID NO: 849295 - RNA, 20 nt, Mycobacterium avium subsp. paratuberculosis
ggugaccgacgacgugacga

SEQ ID NO: 849296 - RNA, 18 nt, Mycobacterium avium subsp. paratuberculosis
ggugaccgagucgucgcg

SEQ ID NO: 849297 - RNA, 15 nt, Mycobacterium avium subsp. paratuberculosis
ggugaccgcccgcuc

SEQ ID NO: 849298 - RNA, 19 nt, Mycobacterium avium subsp. paratuberculosis
ggugaccgccuuggcgcgc

SEQ ID NO: 849299 - RNA, 16 nt, Mycobacterium avium subsp. paratuberculosis
ggugaccgcgccgcgg

SEQ ID NO: 849300 - RNA, 16 nt, Mycobacterium avium subsp. paratuberculosis
ggugcaacgccgccga

SEQ ID NO: 849301 - RNA, 11 nt, Mycobacterium avium subsp. paratuberculosis
ggugcaacacu

SEQ ID NO: 849302 - RNA, 20 nt, Mycobacterium avium subsp. paratuberculosis
ggugcaacacucgagcgcgc

SEQ ID NO: 849303 - RNA, 21 nt, Mycobacterium avium subsp. paratuberculosis
ggugcacccgaugcucccggu

SEQ ID NO: 849304 - RNA, 14 nt, Mycobacterium avium subsp. paratuberculosis
ggugcaccacccag

SEQ ID NO: 849305 - RNA, 16 nt, Mycobacterium avium subsp. paratuberculosis
ggugauguuggccgcg

SEQ ID NO: 849306 - RNA, 18 nt, Mycobacterium avium subsp. paratuberculosis
ggugauucgcgcggcgcc

SEQ ID NO: 849307 - RNA, 22 nt, Mycobacterium avium subsp. paratuberculosis
ggugauuguaggugugcagcca

SEQ ID NO: 849308 - RNA, 21 nt, Mycobacterium avium subsp. paratuberculosis
ggugcagcaccacgaacgcug

SEQ ID NO: 849309 - RNA, 16 nt, Mycobacterium avium subsp. paratuberculosis
ggugcagaccccggcg

SEQ ID NO: 849310 - RNA, 18 nt, Mycobacterium avium subsp. paratuberculosis
ggugcagaccggacagcu

SEQ ID NO: 849311 - RNA, 16 nt, Mycobacterium avium subsp. paratuberculosis
ggugcaccgcggcgcg

SEQ ID NO: 849312 - RNA, 17 nt, Mycobacterium avium subsp. paratuberculosis
ggugcaccgcggcgcgc

SEQ ID NO: 849313 - RNA, 23 nt, Mycobacterium avium subsp. paratuberculosis
ggugcacgaacggcacguugccc

SEQ ID NO: 849314 - RNA, 16 nt, Mycobacterium avium subsp. paratuberculosis
ggugcacggucagcuc

SEQ ID NO: 849315 - RNA, 22 nt, Mycobacterium avium subsp. paratuberculosis
ggugcacggucagcucgcgccc

SEQ ID NO: 849316 - RNA, 20 nt, Mycobacterium avium subsp. paratuberculosis
ggugcaccgccagcgcggcg

SEQ ID NO: 849317 - RNA, 16 nt, Mycobacterium avium subsp. paratuberculosis
ggugcaccgcgcgcac

SEQ ID NO: 849318 - RNA, 14 nt, Mycobacterium avium subsp. paratuberculosis
ggugcacggcgcca

SEQ ID NO: 849319 - RNA, 15 nt, Mycobacterium avium subsp. paratuberculosis
ggugcacggcgccac

SEQ ID NO: 849320 - RNA, 20 nt, Mycobacterium avium subsp. paratuberculosis
ggugaugucacccucgaggc

SEQ ID NO: 849321 - RNA, 22 nt, Mycobacterium avium subsp. paratuberculosis
ggugaugucgacgucgucgacc

SEQ ID NO: 849322 - RNA, 16 nt, Mycobacterium avium subsp. paratuberculosis
ggugaugucgccgacc

SEQ ID NO: 849323 - RNA, 19 nt, Mycobacterium avium subsp. paratuberculosis
ggugaugucgccggcggcg

SEQ ID NO: 849324 - RNA, 16 nt, Mycobacterium avium subsp. paratuberculosis
ggugaucugcaccagc

SEQ ID NO: 849325 - RNA, 19 nt, Mycobacterium avium subsp. paratuberculosis
ggugaugucggugagcgcc

SEQ ID NO: 849326 - RNA, 16 nt, Mycobacterium avium subsp. paratuberculosis
ggugaugugcggcgcg

SEQ ID NO: 849327 - RNA, 13 nt, Mycobacterium avium subsp. paratuberculosis
ggugaucgcggcg

SEQ ID NO: 849328 - RNA, 15 nt, Mycobacterium avium subsp. paratuberculosis
ggugaucgcggcggc

SEQ ID NO: 849329 - RNA, 17 nt, Mycobacterium avium subsp. paratuberculosis
ggugaucgcggcggcgu

SEQ ID NO: 849330 - RNA, 14 nt, Mycobacterium avium subsp. paratuberculosis
ggugaucggccagg

SEQ ID NO: 849331 - RNA, 16 nt, Mycobacterium avium subsp. paratuberculosis
ggugaucucaccggcg

SEQ ID NO: 849332 - RNA, 18 nt, Mycobacterium avium subsp. paratuberculosis
ggugaucucaccggcggc

SEQ ID NO: 849333 - RNA, 19 nt, Mycobacterium avium subsp. paratuberculosis
ggugaucucaccggcggcg

SEQ ID NO: 849334 - RNA, 16 nt, Mycobacterium avium subsp. paratuberculosis
ggugaucucgccgagc

SEQ ID NO: 849335 - RNA, 15 nt, Mycobacterium avium subsp. paratuberculosis
ggugaucucgccgcg

SEQ ID NO: 849336 - RNA, 17 nt, Mycobacterium avium subsp. paratuberculosis
ggugaucucgccgcggu

SEQ ID NO: 849337 - RNA, 20 nt, Mycobacterium avium subsp. paratuberculosis
ggugaucagccccgccucgu

SEQ ID NO: 849338 - RNA, 15 nt, Mycobacterium avium subsp. paratuberculosis
ggugaucaggcccuc

SEQ ID NO: 849339 - RNA, 15 nt, Mycobacterium avium subsp. paratuberculosis
ggugaucaggguccc

SEQ ID NO: 849340 - RNA, 14 nt, Mycobacterium avium subsp. paratuberculosis
ggugaucgccagcc

SEQ ID NO: 849341 - RNA, 18 nt, Mycobacterium avium subsp. paratuberculosis
ggugaucgccagcccggc

SEQ ID NO: 849342 - RNA, 13 nt, Mycobacterium avium subsp. paratuberculosis
ggugaucgccgac

SEQ ID NO: 849343 - RNA, 16 nt, Mycobacterium avium subsp. paratuberculosis
ggugaucgccgacguc

SEQ ID NO: 849344 - RNA, 17 nt, Mycobacterium avium subsp. paratuberculosis
ggugaucgccgacgucu

SEQ ID NO: 849345 - RNA, 14 nt, Mycobacterium avium subsp. paratuberculosis
ggugaucgccgcgg

SEQ ID NO: 849346 - RNA, 15 nt, Mycobacterium avium subsp. paratuberculosis
ggugaucgccgcgga

SEQ ID NO: 849347 - RNA, 20 nt, Mycobacterium avium subsp. paratuberculosis
ggugaucgccggaucgccga

SEQ ID NO: 849348 - RNA, 16 nt, Mycobacterium avium subsp. paratuberculosis
ggugagcgugucgcgc

SEQ ID NO: 849349 - RNA, 19 nt, Mycobacterium avium subsp. paratuberculosis
ggugagcgcgucgagcacc

SEQ ID NO: 849350 - RNA, 21 nt, Mycobacterium avium subsp. paratuberculosis
ggugaucccaggaacgcgccc

SEQ ID NO: 849351 - RNA, 18 nt, Mycobacterium avium subsp. paratuberculosis
ggugaucccgaugccgcg

SEQ ID NO: 849352 - RNA, 19 nt, Mycobacterium avium subsp. paratuberculosis
ggugauccggugccacgcg

SEQ ID NO: 849353 - RNA, 23 nt, Mycobacterium avium subsp. paratuberculosis
ggugauccucgucuccggcggca

SEQ ID NO: 849354 - RNA, 12 nt, Mycobacterium avium subsp. paratuberculosis
ggucggucagcu

SEQ ID NO: 849355 - RNA, 16 nt, Mycobacterium avium subsp. paratuberculosis
ggucggucagcucgaa

SEQ ID NO: 849356 - RNA, 11 nt, Mycobacterium avium subsp. paratuberculosis
ggucggucagu

SEQ ID NO: 849357 - RNA, 17 nt, Mycobacterium avium subsp. paratuberculosis
ggucggucagucgcgcc

SEQ ID NO: 849358 - RNA, 21 nt, Mycobacterium avium subsp. paratuberculosis
ggucggucagucgcgccgcca

SEQ ID NO: 849359 - RNA, 19 nt, Mycobacterium avium subsp. paratuberculosis
ggucgugcggcggcggugc

SEQ ID NO: 849360 - RNA, 19 nt, Mycobacterium avium subsp. paratuberculosis
ggucgugcgggaugccgag

SEQ ID NO: 849361 - RNA, 15 nt, Mycobacterium avium subsp. paratuberculosis
ggucgugcucgucgg

SEQ ID NO: 849362 - RNA, 18 nt, Mycobacterium avium subsp. paratuberculosis
ggucgggugcggcggugu

SEQ ID NO: 849363 - RNA, 15 nt, Mycobacterium avium subsp. paratuberculosis
ggucgugcugggccg

SEQ ID NO: 849364 - RNA, 19 nt, Mycobacterium avium subsp. paratuberculosis
ggucgugcugggccgggcg

SEQ ID NO: 849365 - RNA, 20 nt, Mycobacterium avium subsp. paratuberculosis
ggucguugcacacccggugc

SEQ ID NO: 849366 - RNA, 22 nt, Mycobacterium avium subsp. paratuberculosis
ggucguucagcugaacggugcc

SEQ ID NO: 849367 - RNA, 15 nt, Mycobacterium avium subsp. paratuberculosis
ggucggcgagcagcc

SEQ ID NO: 849368 - RNA, 18 nt, Mycobacterium avium subsp. paratuberculosis
ggucggcuuccagaugcg

SEQ ID NO: 849369 - RNA, 21 nt, Mycobacterium avium subsp. paratuberculosis
ggucggcuuccagaugcguca

SEQ ID NO: 849370 - RNA, 14 nt, Mycobacterium avium subsp. paratuberculosis
ggucgggaucgauc

SEQ ID NO: 849371 - RNA, 18 nt, Mycobacterium avium subsp. paratuberculosis
ggucgggaucugcgguga

SEQ ID NO: 849372 - RNA, 20 nt, Mycobacterium avium subsp. paratuberculosis
ggucgggaucugcggugagc

SEQ ID NO: 849373 - RNA, 14 nt, Mycobacterium avium subsp. paratuberculosis
ggucgggacgucgg

SEQ ID NO: 849374 - RNA, 20 nt, Mycobacterium avium subsp. paratuberculosis
ggucgggguggaucgcccau

SEQ ID NO: 849375 - RNA, 16 nt, Mycobacterium avium subsp. paratuberculosis
ggucggggaauuccgg

SEQ ID NO: 849376 - RNA, 21 nt, Mycobacterium avium subsp. paratuberculosis
ggucgggcaugccggccggca

SEQ ID NO: 849377 - RNA, 14 nt, Mycobacterium avium subsp. paratuberculosis
ggucgggccggaca

SEQ ID NO: 849378 - RNA, 13 nt, Mycobacterium avium subsp. paratuberculosis
ggucgggccggcc

SEQ ID NO: 849379 - RNA, 14 nt, Mycobacterium avium subsp. paratuberculosis
ggucgggccggccg

SEQ ID NO: 849380 - RNA, 15 nt, Mycobacterium avium subsp. paratuberculosis
ggucgggccggccga

SEQ ID NO: 849381 - RNA, 14 nt, Mycobacterium avium subsp. paratuberculosis
ggucgggcgcacca

SEQ ID NO: 849382 - RNA, 14 nt, Mycobacterium avium subsp. paratuberculosis
ggucggccuggccc

SEQ ID NO: 849383 - RNA, 18 nt, Mycobacterium avium subsp. paratuberculosis
ggucggcgaacgcccggu

SEQ ID NO: 849384 - RNA, 14 nt, Mycobacterium avium subsp. paratuberculosis
ggucggcgaccaug

SEQ ID NO: 849385 - RNA, 17 nt, Mycobacterium avium subsp. paratuberculosis
ggucggccggcaggccg

SEQ ID NO: 849386 - RNA, 13 nt, Mycobacterium avium subsp. paratuberculosis
ggucggcccgcug

SEQ ID NO: 849387 - RNA, 18 nt, Mycobacterium avium subsp. paratuberculosis
ggucggcccgcugcggcu

SEQ ID NO: 849388 - RNA, 17 nt, Mycobacterium avium subsp. paratuberculosis
ggucggccgcggccggc

SEQ ID NO: 849389 - RNA, 13 nt, Mycobacterium avium subsp. paratuberculosis
ggucggccggauc

SEQ ID NO: 849390 - RNA, 12 nt, Mycobacterium avium subsp. paratuberculosis
ggucggccagcg

SEQ ID NO: 849391 - RNA, 15 nt, Mycobacterium avium subsp. paratuberculosis
ggucggccagcgccg

SEQ ID NO: 849392 - RNA, 21 nt, Mycobacterium avium subsp. paratuberculosis
ggucggccagcgccgcccggg

SEQ ID NO: 849393 - RNA, 15 nt, Mycobacterium avium subsp. paratuberculosis
ggucgccguggccga

SEQ ID NO: 849394 - RNA, 18 nt, Mycobacterium avium subsp. paratuberculosis
ggucggccagggcgugga

SEQ ID NO: 849395 - RNA, 20 nt, Mycobacterium avium subsp. paratuberculosis
ggucggccccgcgcaucggu

SEQ ID NO: 849396 - RNA, 19 nt, Mycobacterium avium subsp. paratuberculosis
ggucgccggugugaucgag

SEQ ID NO: 849397 - RNA, 14 nt, Mycobacterium avium subsp. paratuberculosis
ggucgccggugugc

SEQ ID NO: 849398 - RNA, 18 nt, Mycobacterium avium subsp. paratuberculosis
ggucgccggugugcagcc

SEQ ID NO: 849399 - RNA, 22 nt, Mycobacterium avium subsp. paratuberculosis
ggucgccgggcagguggucggc

SEQ ID NO: 849400 - RNA, 15 nt, Mycobacterium avium subsp. paratuberculosis
ggucgccgggccggc

SEQ ID NO: 849401 - RNA, 16 nt, Mycobacterium avium subsp. paratuberculosis
ggucuccaugucgucg

SEQ ID NO: 849402 - RNA, 23 nt, Mycobacterium avium subsp. paratuberculosis
ggucugcagcgacggaucggccg

SEQ ID NO: 849403 - RNA, 16 nt, Mycobacterium avium subsp. paratuberculosis
ggucguuggcggcggu

SEQ ID NO: 849404 - RNA, 17 nt, Mycobacterium avium subsp. paratuberculosis
ggucguuggcggcggug

SEQ ID NO: 849405 - RNA, 18 nt, Mycobacterium avium subsp. paratuberculosis
ggucguuggcggcggugg

SEQ ID NO: 849406 - RNA, 19 nt, Mycobacterium avium subsp. paratuberculosis
ggucguuucggccggcccc

SEQ ID NO: 849407 - RNA, 20 nt, Mycobacterium avium subsp. paratuberculosis
ggucguuucggccggccccg

SEQ ID NO: 849408 - RNA, 21 nt, Mycobacterium avium subsp. paratuberculosis
ggucguuuggugguggcgugg

SEQ ID NO: 849409 - RNA, 15 nt, Mycobacterium avium subsp. paratuberculosis
ggucuggcucggcac

SEQ ID NO: 849410 - RNA, 20 nt, Mycobacterium avium subsp. paratuberculosis
ggucuggcccggugcgacgc

SEQ ID NO: 849411 - RNA, 21 nt, Mycobacterium avium subsp. paratuberculosis
ggucuggcccggugcgacgcc

SEQ ID NO: 849412 - RNA, 14 nt, Mycobacterium avium subsp. paratuberculosis
ggucugcgcccgau

SEQ ID NO: 849413 - RNA, 17 nt, Mycobacterium avium subsp. paratuberculosis
ggucugcuccccguuga

SEQ ID NO: 849414 - RNA, 16 nt, Mycobacterium avium subsp. paratuberculosis
ggucugcccgccgccg

SEQ ID NO: 849415 - RNA, 14 nt, Mycobacterium avium subsp. paratuberculosis
ggucugcgccggcg

SEQ ID NO: 849416 - RNA, 16 nt, Mycobacterium avium subsp. paratuberculosis
ggucugcgccggcggu

SEQ ID NO: 849417 - RNA, 14 nt, Mycobacterium avium subsp. paratuberculosis
ggucugcggccgcg

SEQ ID NO: 849418 - RNA, 17 nt, Mycobacterium avium subsp. paratuberculosis
ggucugcggccgcgacu

SEQ ID NO: 849419 - RNA, 19 nt, Mycobacterium avium subsp. paratuberculosis
ggucugcggccgcgacugc

SEQ ID NO: 849420 - RNA, 13 nt, Mycobacterium avium subsp. paratuberculosis
ggucugcggccgg

SEQ ID NO: 849421 - RNA, 17 nt, Mycobacterium avium subsp. paratuberculosis
ggucugcggccggggca

SEQ ID NO: 849422 - RNA, 20 nt, Mycobacterium avium subsp. paratuberculosis
ggucuucucgaagcgcagca

SEQ ID NO: 849423 - RNA, 16 nt, Mycobacterium avium subsp. paratuberculosis
ggucuucucggccagg

SEQ ID NO: 849424 - RNA, 17 nt, Mycobacterium avium subsp. paratuberculosis
ggucuucucguccgcgc

SEQ ID NO: 849425 - RNA, 20 nt, Mycobacterium avium subsp. paratuberculosis
ggucuucucguccgcgcugg

SEQ ID NO: 849426 - RNA, 13 nt, Mycobacterium avium subsp. paratuberculosis
ggucuuccacgcc

SEQ ID NO: 849427 - RNA, 14 nt, Mycobacterium avium subsp. paratuberculosis
ggucuucggucccg

SEQ ID NO: 849428 - RNA, 12 nt, Mycobacterium avium subsp. paratuberculosis
ggucugguggca

SEQ ID NO: 849429 - RNA, 14 nt, Mycobacterium avium subsp. paratuberculosis
ggucuugucgucgu

SEQ ID NO: 849430 - RNA, 14 nt, Mycobacterium avium subsp. paratuberculosis
ggucuuggcguugc

SEQ ID NO: 849431 - RNA, 20 nt, Mycobacterium avium subsp. paratuberculosis
ggugaagccgcggacggcga

SEQ ID NO: 849432 - RNA, 16 nt, Mycobacterium avium subsp. paratuberculosis
ggugaagccguagacg

SEQ ID NO: 849433 - RNA, 17 nt, Mycobacterium avium subsp. paratuberculosis
ggugaagccgugcacgc

SEQ ID NO: 849434 - RNA, 19 nt, Mycobacterium avium subsp. paratuberculosis
ggugaagccguugucgagu

SEQ ID NO: 849435 - RNA, 14 nt, Mycobacterium avium subsp. paratuberculosis
ggucuuggcggcca

SEQ ID NO: 849436 - RNA, 20 nt, Mycobacterium avium subsp. paratuberculosis
ggugcguuccagguccgcgg

SEQ ID NO: 849437 - RNA, 15 nt, Mycobacterium avium subsp. paratuberculosis
gguggacggucagcg

SEQ ID NO: 849438 - RNA, 18 nt, Mycobacterium avium subsp. paratuberculosis
gguggacgucaggccgua

SEQ ID NO: 849439 - RNA, 15 nt, Mycobacterium avium subsp. paratuberculosis
gguggacuccagcac

SEQ ID NO: 849440 - RNA, 20 nt, Mycobacterium avium subsp. paratuberculosis
gguggacuccagcaccagca

SEQ ID NO: 849441 - RNA, 17 nt, Mycobacterium avium subsp. paratuberculosis
gguggagauggccagca

SEQ ID NO: 849442 - RNA, 19 nt, Mycobacterium avium subsp. paratuberculosis
gguggauauuucgcggccg

SEQ ID NO: 849443 - RNA, 20 nt, Mycobacterium avium subsp. paratuberculosis
gguggauauuucgcggccga

SEQ ID NO: 849444 - RNA, 18 nt, Mycobacterium avium subsp. paratuberculosis
gguggcagcggacccggu

SEQ ID NO: 849445 - RNA, 14 nt, Mycobacterium avium subsp. paratuberculosis
gguggcaccccgcg

SEQ ID NO: 849446 - RNA, 16 nt, Mycobacterium avium subsp. paratuberculosis
gguggcaccccgcgcc

SEQ ID NO: 849447 - RNA, 22 nt, Mycobacterium avium subsp. paratuberculosis
gguggauugucggccgcccguc

SEQ ID NO: 849448 - RNA, 23 nt, Mycobacterium avium subsp. paratuberculosis
gguggaucuugacggcgacggcg

SEQ ID NO: 849449 - RNA, 17 nt, Mycobacterium avium subsp. paratuberculosis
gguggaugaugccggcg

SEQ ID NO: 849450 - RNA, 17 nt, Mycobacterium avium subsp. paratuberculosis
gguggauggucaccggg

SEQ ID NO: 849451 - RNA, 21 nt, Mycobacterium avium subsp. paratuberculosis
ggugcgggugguguggcgucg

SEQ ID NO: 849452 - RNA, 15 nt, Mycobacterium avium subsp. paratuberculosis
ggugcgggcgcugca

SEQ ID NO: 849453 - RNA, 16 nt, Mycobacterium avium subsp. paratuberculosis
ggugcgggcggggccc

SEQ ID NO: 849454 - RNA, 19 nt, Mycobacterium avium subsp. paratuberculosis
ggugcgggcggggcccggg

SEQ ID NO: 849455 - RNA, 16 nt, Mycobacterium avium subsp. paratuberculosis
ggugcgggcugcacca

SEQ ID NO: 849456 - RNA, 20 nt, Mycobacterium avium subsp. paratuberculosis
ggugcggggacagugcgggc

SEQ ID NO: 849457 - RNA, 22 nt, Mycobacterium avium subsp. paratuberculosis
ggugcggggccgcggccggcac

SEQ ID NO: 849458 - RNA, 20 nt, Mycobacterium avium subsp. paratuberculosis
ggugcgggucacacccucgg

SEQ ID NO: 849459 - RNA, 15 nt, Mycobacterium avium subsp. paratuberculosis
ggugcggcgcucggu

SEQ ID NO: 849460 - RNA, 18 nt, Mycobacterium avium subsp. paratuberculosis
ggugcggcgcucggugug

SEQ ID NO: 849461 - RNA, 20 nt, Mycobacterium avium subsp. paratuberculosis
ggugcgggccagcagccgcg

SEQ ID NO: 849462 - RNA, 17 nt, Mycobacterium avium subsp. paratuberculosis
ggugcggccucgacgau

SEQ ID NO: 849463 - RNA, 13 nt, Mycobacterium avium subsp. paratuberculosis
ggugcggucgaug

SEQ ID NO: 849464 - RNA, 14 nt, Mycobacterium avium subsp. paratuberculosis
ggugcggucgauga

SEQ ID NO: 849465 - RNA, 15 nt, Mycobacterium avium subsp. paratuberculosis
ggugcggucgaugac

SEQ ID NO: 849466 - RNA, 13 nt, Mycobacterium avium subsp. paratuberculosis
ggugcggucgcgc

SEQ ID NO: 849467 - RNA, 14 nt, Mycobacterium avium subsp. paratuberculosis
ggugcggucgcgca

SEQ ID NO: 849468 - RNA, 16 nt, Mycobacterium avium subsp. paratuberculosis
ggugcggucggcgacg

SEQ ID NO: 849469 - RNA, 16 nt, Mycobacterium avium subsp. paratuberculosis
ggugcggugcaccgcg

SEQ ID NO: 849470 - RNA, 17 nt, Mycobacterium avium subsp. paratuberculosis
ggugcggugcaccgcgg

SEQ ID NO: 849471 - RNA, 23 nt, Mycobacterium avium subsp. paratuberculosis
ggugcggugcaccgcggcgcgca

SEQ ID NO: 849472 - RNA, 18 nt, Mycobacterium avium subsp. paratuberculosis
ggugcggugcagccgcgg

SEQ ID NO: 849473 - RNA, 13 nt, Mycobacterium avium subsp. paratuberculosis
ggugcggugcgcc

SEQ ID NO: 849474 - RNA, 22 nt, Mycobacterium avium subsp. paratuberculosis
ggugcggugcgccgcauuggug

SEQ ID NO: 849475 - RNA, 13 nt, Mycobacterium avium subsp. paratuberculosis
ggugcggugcggc

SEQ ID NO: 849476 - RNA, 17 nt, Mycobacterium avium subsp. paratuberculosis
ggugcggugcggccgcg

SEQ ID NO: 849477 - RNA, 12 nt, Mycobacterium avium subsp. paratuberculosis
ggugcgguguca

SEQ ID NO: 849478 - RNA, 16 nt, Mycobacterium avium subsp. paratuberculosis
ggugcgguugagcacc

SEQ ID NO: 849479 - RNA, 20 nt, Mycobacterium avium subsp. paratuberculosis
ggugcgguugagcaccagcc

SEQ ID NO: 849480 - RNA, 16 nt, Mycobacterium avium subsp. paratuberculosis
ggugcguccagaccgg

SEQ ID NO: 849481 - RNA, 19 nt, Mycobacterium avium subsp. paratuberculosis
ggugcguccagaccggccg

SEQ ID NO: 849482 - RNA, 21 nt, Mycobacterium avium subsp. paratuberculosis
ggugcguccagaccggccggg

SEQ ID NO: 849483 - RNA, 16 nt, Mycobacterium avium subsp. paratuberculosis
ggugcguccgccggcg

SEQ ID NO: 849484 - RNA, 17 nt, Mycobacterium avium subsp. paratuberculosis
ggugcguccgccggcgg

SEQ ID NO: 849485 - RNA, 19 nt, Mycobacterium avium subsp. paratuberculosis
ggugcguccgccggcggug

SEQ ID NO: 849486 - RNA, 16 nt, Mycobacterium avium subsp. paratuberculosis
ggugcgucgggcgccg

SEQ ID NO: 849487 - RNA, 15 nt, Mycobacterium avium subsp. paratuberculosis
ggugcgacgcccacu

SEQ ID NO: 849488 - RNA, 16 nt, Mycobacterium avium subsp. paratuberculosis
ggugcgacgccgcgca

SEQ ID NO: 849489 - RNA, 12 nt, Mycobacterium avium subsp. paratuberculosis
ggugcgacggca

SEQ ID NO: 849490 - RNA, 14 nt, Mycobacterium avium subsp. paratuberculosis
ggugcgacggcaau

SEQ ID NO: 849491 - RNA, 14 nt, Mycobacterium avium subsp. paratuberculosis
ggugcgcaccgaca

SEQ ID NO: 849492 - RNA, 23 nt, Mycobacterium avium subsp. paratuberculosis
ggugcgcaauggcgaacaugguc

SEQ ID NO: 849493 - RNA, 14 nt, Mycobacterium avium subsp. paratuberculosis
ggugcgcaccagca

SEQ ID NO: 849494 - RNA, 16 nt, Mycobacterium avium subsp. paratuberculosis
ggugcgcaccagcagg

SEQ ID NO: 849495 - RNA, 15 nt, Mycobacterium avium subsp. paratuberculosis
ggugcgagccgcuga

SEQ ID NO: 849496 - RNA, 15 nt, Mycobacterium avium subsp. paratuberculosis
ggugcgcagucgcug

SEQ ID NO: 849497 - RNA, 22 nt, Mycobacterium avium subsp. paratuberculosis
ggugcgcccagguacuccucgg

SEQ ID NO: 849498 - RNA, 14 nt, Mycobacterium avium subsp. paratuberculosis
ggugcgcccgucgg

SEQ ID NO: 849499 - RNA, 22 nt, Mycobacterium avium subsp. paratuberculosis
ggugcgccgcucgucggccagc

SEQ ID NO: 849500 - RNA, 12 nt, Mycobacterium avium subsp. paratuberculosis
ggugcgccggca

SEQ ID NO: 849501 - RNA, 18 nt, Mycobacterium avium subsp. paratuberculosis
ggugcgccggcagcggcc

SEQ ID NO: 849502 - RNA, 12 nt, Mycobacterium avium subsp. paratuberculosis
ggugcgccacgc

SEQ ID NO: 849503 - RNA, 13 nt, Mycobacterium avium subsp. paratuberculosis
ggugcgccacugc

SEQ ID NO: 849504 - RNA, 14 nt, Mycobacterium avium subsp. paratuberculosis
ggugcgccacugcg

SEQ ID NO: 849505 - RNA, 16 nt, Mycobacterium avium subsp. paratuberculosis
ggugcgccagaucagc

SEQ ID NO: 849506 - RNA, 22 nt, Mycobacterium avium subsp. paratuberculosis
ggugcgccagaucagcgugguc

SEQ ID NO: 849507 - RNA, 14 nt, Mycobacterium avium subsp. paratuberculosis
ggugcgccagaucg

SEQ ID NO: 849508 - RNA, 17 nt, Mycobacterium avium subsp. paratuberculosis
ggugcgccagaucgcug

SEQ ID NO: 849509 - RNA, 21 nt, Mycobacterium avium subsp. paratuberculosis
ggugcgccagaucgcugaugc

SEQ ID NO: 849510 - RNA, 18 nt, Mycobacterium avium subsp. paratuberculosis
ggugcgccagcgccgggu

SEQ ID NO: 849511 - RNA, 16 nt, Mycobacterium avium subsp. paratuberculosis
ggugcgcagcccgccg

SEQ ID NO: 849512 - RNA, 17 nt, Mycobacterium avium subsp. paratuberculosis
ggugcgcagcccgccgg

SEQ ID NO: 849513 - RNA, 14 nt, Mycobacterium avium subsp. paratuberculosis
ggugcgcagcacgu

SEQ ID NO: 849514 - RNA, 13 nt, Mycobacterium avium subsp. paratuberculosis
ggugcggccgcgc

SEQ ID NO: 849515 - RNA, 14 nt, Mycobacterium avium subsp. paratuberculosis
ggugcggccgcgca

SEQ ID NO: 849516 - RNA, 14 nt, Mycobacterium avium subsp. paratuberculosis
ggugcggccagcgc

SEQ ID NO: 849517 - RNA, 19 nt, Mycobacterium avium subsp. paratuberculosis
ggugcggaugaagugcgcc

SEQ ID NO: 849518 - RNA, 22 nt, Mycobacterium avium subsp. paratuberculosis
ggugcggaugaagugcgccagc

SEQ ID NO: 849519 - RNA, 13 nt, Mycobacterium avium subsp. paratuberculosis
ggugcggaugaug

SEQ ID NO: 849520 - RNA, 20 nt, Mycobacterium avium subsp. paratuberculosis
ggugcggaugaugguggcca

SEQ ID NO: 849521 - RNA, 20 nt, Mycobacterium avium subsp. paratuberculosis
ggugcggacggucgccgacg

SEQ ID NO: 849522 - RNA, 14 nt, Mycobacterium avium subsp. paratuberculosis
ggugcgcucaccgc

SEQ ID NO: 849523 - RNA, 19 nt, Mycobacterium avium subsp. paratuberculosis
ggugcgcucaccgcaucga

SEQ ID NO: 849524 - RNA, 19 nt, Mycobacterium avium subsp. paratuberculosis
ggugcgcucgugaccggcg

SEQ ID NO: 849525 - RNA, 20 nt, Mycobacterium avium subsp. paratuberculosis
ggugcgcucgugaccggcgg

SEQ ID NO: 849526 - RNA, 13 nt, Mycobacterium avium subsp. paratuberculosis
ggugcggacccgu

SEQ ID NO: 849527 - RNA, 16 nt, Mycobacterium avium subsp. paratuberculosis
ggugcgcgucgcggug

SEQ ID NO: 849528 - RNA, 15 nt, Mycobacterium avium subsp. paratuberculosis
ggugcgcggcgaagg

SEQ ID NO: 849529 - RNA, 15 nt, Mycobacterium avium subsp. paratuberculosis
ggugcgcggcgagcg

SEQ ID NO: 849530 - RNA, 14 nt, Mycobacterium avium subsp. paratuberculosis
ggugcgcggcgccg

SEQ ID NO: 849531 - RNA, 16 nt, Mycobacterium avium subsp. paratuberculosis
ggugcgcgggcgcccg

SEQ ID NO: 849532 - RNA, 14 nt, Mycobacterium avium subsp. paratuberculosis
ggugcgcggggugg

SEQ ID NO: 849533 - RNA, 14 nt, Mycobacterium avium subsp. paratuberculosis
ggugcgccgggucg

SEQ ID NO: 849534 - RNA, 19 nt, Mycobacterium avium subsp. paratuberculosis
ggugccggugacggucagg

SEQ ID NO: 849535 - RNA, 14 nt, Mycobacterium avium subsp. paratuberculosis
ggugccgcggcgca

SEQ ID NO: 849536 - RNA, 16 nt, Mycobacterium avium subsp. paratuberculosis
ggugccguccgggucg

SEQ ID NO: 849537 - RNA, 17 nt, Mycobacterium avium subsp. paratuberculosis
ggugccguccgggucgc

SEQ ID NO: 849538 - RNA, 21 nt, Mycobacterium avium subsp. paratuberculosis
ggugccguugaucagggcggc

SEQ ID NO: 849539 - RNA, 22 nt, Mycobacterium avium subsp. paratuberculosis
ggugccgucgcgcucgacgaug

SEQ ID NO: 849540 - RNA, 18 nt, Mycobacterium avium subsp. paratuberculosis
ggugccggccaccggcgc

SEQ ID NO: 849541 - RNA, 13 nt, Mycobacterium avium subsp. paratuberculosis
ggugccggccaga

SEQ ID NO: 849542 - RNA, 15 nt, Mycobacterium avium subsp. paratuberculosis
ggugccggccgcgau

SEQ ID NO: 849543 - RNA, 16 nt, Mycobacterium avium subsp. paratuberculosis
ggugccggccgggucg

SEQ ID NO: 849544 - RNA, 17 nt, Mycobacterium avium subsp. paratuberculosis
ggugccggccgggucga

SEQ ID NO: 849545 - RNA, 19 nt, Mycobacterium avium subsp. paratuberculosis
ggugccggccggucgaagg

SEQ ID NO: 849546 - RNA, 19 nt, Mycobacterium avium subsp. paratuberculosis
ggugccggccucgucggcg

SEQ ID NO: 849547 - RNA, 16 nt, Mycobacterium avium subsp. paratuberculosis
ggugccgcugcccgcc

SEQ ID NO: 849548 - RNA, 19 nt, Mycobacterium avium subsp. paratuberculosis
ggugccgcgaugcccgccg

SEQ ID NO: 849549 - RNA, 14 nt, Mycobacterium avium subsp. paratuberculosis
ggugccgccgggca

SEQ ID NO: 849550 - RNA, 21 nt, Mycobacterium avium subsp. paratuberculosis
ggugccgccgaugacggcgcg

SEQ ID NO: 849551 - RNA, 16 nt, Mycobacterium avium subsp. paratuberculosis
ggugccgaucaccucg

SEQ ID NO: 849552 - RNA, 14 nt, Mycobacterium avium subsp. paratuberculosis
ggugccgacggugc

SEQ ID NO: 849553 - RNA, 20 nt, Mycobacterium avium subsp. paratuberculosis
ggugccgacggugcgugcca

SEQ ID NO: 849554 - RNA, 16 nt, Mycobacterium avium subsp. paratuberculosis
ggugccgagcacgcgg

SEQ ID NO: 849555 - RNA, 14 nt, Mycobacterium avium subsp. paratuberculosis
ggugccgaccgcgu

SEQ ID NO: 849556 - RNA, 15 nt, Mycobacterium avium subsp. paratuberculosis
ggugccgagcccgcc

SEQ ID NO: 849557 - RNA, 23 nt, Mycobacterium avium subsp. paratuberculosis
ggugccgagcccgccggcggcga

SEQ ID NO: 849558 - RNA, 15 nt, Mycobacterium avium subsp. paratuberculosis
ggugccgcagccguc

SEQ ID NO: 849559 - RNA, 15 nt, Mycobacterium avium subsp. paratuberculosis
ggugccgcagcggcg

SEQ ID NO: 849560 - RNA, 17 nt, Mycobacterium avium subsp. paratuberculosis
ggugccgcagcggcggc

SEQ ID NO: 849561 - RNA, 18 nt, Mycobacterium avium subsp. paratuberculosis
ggugccgcagcggcggca

SEQ ID NO: 849562 - RNA, 20 nt, Mycobacterium avium subsp. paratuberculosis
ggugccgcagugccggcgca

SEQ ID NO: 849563 - RNA, 16 nt, Mycobacterium avium subsp. paratuberculosis
ggugcccugugaggcg

SEQ ID NO: 849564 - RNA, 23 nt, Mycobacterium avium subsp. paratuberculosis
ggugcccuucgaguugccguugu

SEQ ID NO: 849565 - RNA, 21 nt, Mycobacterium avium subsp. paratuberculosis
ggugccgaacagcgacgucug

SEQ ID NO: 849566 - RNA, 17 nt, Mycobacterium avium subsp. paratuberculosis
ggugccgaagcgccgca

SEQ ID NO: 849567 - RNA, 15 nt, Mycobacterium avium subsp. paratuberculosis
ggugccgacgaccuc

SEQ ID NO: 849568 - RNA, 16 nt, Mycobacterium avium subsp. paratuberculosis
ggugccgacgaccucg

SEQ ID NO: 849569 - RNA, 23 nt, Mycobacterium avium subsp. paratuberculosis
ggugccgacgaccucgucgucga

SEQ ID NO: 849570 - RNA, 18 nt, Mycobacterium avium subsp. paratuberculosis
ggugccgacgauccgggc

SEQ ID NO: 849571 - RNA, 21 nt, Mycobacterium avium subsp. paratuberculosis
ggugccgacgauccgggcgcc

SEQ ID NO: 849572 - RNA, 23 nt, Mycobacterium avium subsp. paratuberculosis
ggugccaaugaaauucaggccac

SEQ ID NO: 849573 - RNA, 23 nt, Mycobacterium avium subsp. paratuberculosis
ggugcccagcgcgaggucgacgg

SEQ ID NO: 849574 - RNA, 17 nt, Mycobacterium avium subsp. paratuberculosis
ggugccaucgugggcgc

SEQ ID NO: 849575 - RNA, 18 nt, Mycobacterium avium subsp. paratuberculosis
ggugccaucgugggcgcc

SEQ ID NO: 849576 - RNA, 15 nt, Mycobacterium avium subsp. paratuberculosis
ggugccccgcaccgc

SEQ ID NO: 849577 - RNA, 23 nt, Mycobacterium avium subsp. paratuberculosis
ggugccccgccguuucagcagcg

SEQ ID NO: 849578 - RNA, 14 nt, Mycobacterium avium subsp. paratuberculosis
ggugccccgcgacc

SEQ ID NO: 849579 - RNA, 17 nt, Mycobacterium avium subsp. paratuberculosis
ggugccccgcgaccgca

SEQ ID NO: 849580 - RNA, 16 nt, Mycobacterium avium subsp. paratuberculosis
ggugcccccgcccggc

SEQ ID NO: 849581 - RNA, 19 nt, Mycobacterium avium subsp. paratuberculosis
ggugcccaggucgcccaga

SEQ ID NO: 849582 - RNA, 15 nt, Mycobacterium avium subsp. paratuberculosis
ggugccccacgccau

SEQ ID NO: 849583 - RNA, 17 nt, Mycobacterium avium subsp. paratuberculosis
ggugcccagcaccgccg

SEQ ID NO: 849584 - RNA, 18 nt, Mycobacterium avium subsp. paratuberculosis
ggugcccgcaucgccgaa

SEQ ID NO: 849585 - RNA, 12 nt, Mycobacterium avium subsp. paratuberculosis
ggugcccgccga

SEQ ID NO: 849586 - RNA, 18 nt, Mycobacterium avium subsp. paratuberculosis
ggugcccgccgaucgauc

SEQ ID NO: 849587 - RNA, 12 nt, Mycobacterium avium subsp. paratuberculosis
ggugcccgccgc

SEQ ID NO: 849588 - RNA, 18 nt, Mycobacterium avium subsp. paratuberculosis
ggugcccgccgcgaccgc

SEQ ID NO: 849589 - RNA, 16 nt, Mycobacterium avium subsp. paratuberculosis
ggugcccgcggguagc

SEQ ID NO: 849590 - RNA, 20 nt, Mycobacterium avium subsp. paratuberculosis
ggugcccgagcugaucgcgg

SEQ ID NO: 849591 - RNA, 20 nt, Mycobacterium avium subsp. paratuberculosis
ggugcccggcugggcgcgca

SEQ ID NO: 849592 - RNA, 16 nt, Mycobacterium avium subsp. paratuberculosis
ggugcagcagggcgcg

SEQ ID NO: 849593 - RNA, 21 nt, Mycobacterium avium subsp. paratuberculosis
ggugcagcgacucguuggccg

SEQ ID NO: 849594 - RNA, 22 nt, Mycobacterium avium subsp. paratuberculosis
ggugcagcgacucguuggccgg

SEQ ID NO: 849595 - RNA, 18 nt, Mycobacterium avium subsp. paratuberculosis
ggugcagcacgugcgcgg

SEQ ID NO: 849596 - RNA, 13 nt, Mycobacterium avium subsp. paratuberculosis
ggugcagcagcug

SEQ ID NO: 849597 - RNA, 16 nt, Mycobacterium avium subsp. paratuberculosis
ggugcaggcccagcug

SEQ ID NO: 849598 - RNA, 19 nt, Mycobacterium avium subsp. paratuberculosis
ggugcaggcccgggcggcg

SEQ ID NO: 849599 - RNA, 13 nt, Mycobacterium avium subsp. paratuberculosis
ggugcaggccgcg

SEQ ID NO: 849600 - RNA, 24 nt, Mycobacterium avium subsp. paratuberculosis
ggugcaggcgaaggugggcagcgc

SEQ ID NO: 849601 - RNA, 14 nt, Mycobacterium avium subsp. paratuberculosis
ggugcagccggggg

SEQ ID NO: 849602 - RNA, 19 nt, Mycobacterium avium subsp. paratuberculosis
ggugcagccgggggcggug

SEQ ID NO: 849603 - RNA, 19 nt, Mycobacterium avium subsp. paratuberculosis
ggugcaucgucgcggcggu

SEQ ID NO: 849604 - RNA, 21 nt, Mycobacterium avium subsp. paratuberculosis
ggugcaucgucgcggcgguca

SEQ ID NO: 849605 - RNA, 15 nt, Mycobacterium avium subsp. paratuberculosis
ggugccacggucagg

SEQ ID NO: 849606 - RNA, 16 nt, Mycobacterium avium subsp. paratuberculosis
ggugccacggucaggc

SEQ ID NO: 849607 - RNA, 17 nt, Mycobacterium avium subsp. paratuberculosis
ggugcaggugcccgucg

SEQ ID NO: 849608 - RNA, 18 nt, Mycobacterium avium subsp. paratuberculosis
ggugcaucgaccggcgga

SEQ ID NO: 849609 - RNA, 21 nt, Mycobacterium avium subsp. paratuberculosis
ggugcaucgaccggcggaagu

SEQ ID NO: 849610 - RNA, 18 nt, Mycobacterium avium subsp. paratuberculosis
ggugcaucgccaccgucg

SEQ ID NO: 849611 - RNA, 18 nt, Mycobacterium avium subsp. paratuberculosis
aaguacaccaccgcggcg

SEQ ID NO: 849612 - RNA, 20 nt, Mycobacterium avium subsp. paratuberculosis
aaguagccggcgaucgucgc

SEQ ID NO: 849613 - RNA, 15 nt, Mycobacterium avium subsp. paratuberculosis
ggguggucagcgcgg

SEQ ID NO: 849614 - RNA, 16 nt, Mycobacterium avium subsp. paratuberculosis
gggugguccacccaga

SEQ ID NO: 849615 - RNA, 14 nt, Mycobacterium avium subsp. paratuberculosis
ggguggucaccagc

SEQ ID NO: 849616 - RNA, 15 nt, Mycobacterium avium subsp. paratuberculosis
ggguggucaccagcg

SEQ ID NO: 849617 - RNA, 16 nt, Mycobacterium avium subsp. paratuberculosis
ggguggucaccagcgc

SEQ ID NO: 849618 - RNA, 21 nt, Mycobacterium avium subsp. paratuberculosis
ggguggucaccagcgcgguca

SEQ ID NO: 849619 - RNA, 15 nt, Mycobacterium avium subsp. paratuberculosis
ggguggcgucgacgg

SEQ ID NO: 849620 - RNA, 15 nt, Mycobacterium avium subsp. paratuberculosis
gggugggcagcgcga

SEQ ID NO: 849621 - RNA, 13 nt, Mycobacterium avium subsp. paratuberculosis
gggugggcgaacg

SEQ ID NO: 849622 - RNA, 14 nt, Mycobacterium avium subsp. paratuberculosis
gggugggcgacgag

SEQ ID NO: 849623 - RNA, 19 nt, Mycobacterium avium subsp. paratuberculosis
ggguggggacgacgccgaa

SEQ ID NO: 849624 - RNA, 13 nt, Mycobacterium avium subsp. paratuberculosis
ggguucucgcggc

SEQ ID NO: 849625 - RNA, 14 nt, Mycobacterium avium subsp. paratuberculosis
ggguucucgcggcg

SEQ ID NO: 849626 - RNA, 18 nt, Mycobacterium avium subsp. paratuberculosis
ggguucucgcggcggccg

SEQ ID NO: 849627 - RNA, 17 nt, Mycobacterium avium subsp. paratuberculosis
ggguucuucgaccacgc

SEQ ID NO: 849628 - RNA, 18 nt, Mycobacterium avium subsp. paratuberculosis
ggguucuucgaccacgcg

SEQ ID NO: 849629 - RNA, 20 nt, Mycobacterium avium subsp. paratuberculosis
ggguucuucgaccacgcgcc

SEQ ID NO: 849630 - RNA, 15 nt, Mycobacterium avium subsp. paratuberculosis
ggguugaccuugacc

SEQ ID NO: 849631 - RNA, 12 nt, Mycobacterium avium subsp. paratuberculosis
ggguucgcccuc

SEQ ID NO: 849632 - RNA, 14 nt, Mycobacterium avium subsp. paratuberculosis
ggguucccggccgg

SEQ ID NO: 849633 - RNA, 19 nt, Mycobacterium avium subsp. paratuberculosis
ggguuccgccgucgaugcg

SEQ ID NO: 849634 - RNA, 16 nt, Mycobacterium avium subsp. paratuberculosis
ggguucggcggcgcgg

SEQ ID NO: 849635 - RNA, 22 nt, Mycobacterium avium subsp. paratuberculosis
ggguucggcggcgcggcccagg

SEQ ID NO: 849636 - RNA, 20 nt, Mycobacterium avium subsp. paratuberculosis
ggguuccaccguucgggugc

SEQ ID NO: 849637 - RNA, 16 nt, Mycobacterium avium subsp. paratuberculosis
ggguguauucgcccac

SEQ ID NO: 849638 - RNA, 20 nt, Mycobacterium avium subsp. paratuberculosis
gggugguuuugcgucugcuc

SEQ ID NO: 849639 - RNA, 20 nt, Mycobacterium avium subsp. paratuberculosis
ggguguaacgcgucgacggc

SEQ ID NO: 849640 - RNA, 18 nt, Mycobacterium avium subsp. paratuberculosis
gguaaccgcccgagcaga

SEQ ID NO: 849641 - RNA, 17 nt, Mycobacterium avium subsp. paratuberculosis
ggguugccgucgacgaa

SEQ ID NO: 849642 - RNA, 15 nt, Mycobacterium avium subsp. paratuberculosis
gguaacccuccggcg

SEQ ID NO: 849643 - RNA, 18 nt, Mycobacterium avium subsp. paratuberculosis
gguaacccuccggcgccu

SEQ ID NO: 849644 - RNA, 17 nt, Mycobacterium avium subsp. paratuberculosis
gguaccgaugaccaccg

SEQ ID NO: 849645 - RNA, 13 nt, Mycobacterium avium subsp. paratuberculosis
gguacccccgccg

SEQ ID NO: 849646 - RNA, 18 nt, Mycobacterium avium subsp. paratuberculosis
gguacccccgccggggcc

SEQ ID NO: 849647 - RNA, 14 nt, Mycobacterium avium subsp. paratuberculosis
gguaccagaucgag

SEQ ID NO: 849648 - RNA, 19 nt, Mycobacterium avium subsp. paratuberculosis
gguaccagaucgagcuggg

SEQ ID NO: 849649 - RNA, 18 nt, Mycobacterium avium subsp. paratuberculosis
gguaccagggcagcgccu

SEQ ID NO: 849650 - RNA, 13 nt, Mycobacterium avium subsp. paratuberculosis
gguaccccagcaa

SEQ ID NO: 849651 - RNA, 23 nt, Mycobacterium avium subsp. paratuberculosis
gguauuggccacgcuggcgucca

SEQ ID NO: 849652 - RNA, 22 nt, Mycobacterium avium subsp. paratuberculosis
ggucaagauaccggccggcgcg

SEQ ID NO: 849653 - RNA, 17 nt, Mycobacterium avium subsp. paratuberculosis
ggucaacgugucgagca

SEQ ID NO: 849654 - RNA, 14 nt, Mycobacterium avium subsp. paratuberculosis
ggucaacggcaccg

SEQ ID NO: 849655 - RNA, 22 nt, Mycobacterium avium subsp. paratuberculosis
ggucaacggcucggucaagccg

SEQ ID NO: 849656 - RNA, 16 nt, Mycobacterium avium subsp. paratuberculosis
ggucaaguccgcgagg

SEQ ID NO: 849657 - RNA, 19 nt, Mycobacterium avium subsp. paratuberculosis
ggucaaaacaacgcgcagc

SEQ ID NO: 849658 - RNA, 15 nt, Mycobacterium avium subsp. paratuberculosis
ggucaccaaggcgau

SEQ ID NO: 849659 - RNA, 11 nt, Mycobacterium avium subsp. paratuberculosis
ggucaccacca

SEQ ID NO: 849660 - RNA, 19 nt, Mycobacterium avium subsp. paratuberculosis
ggucacacccucggcccgc

SEQ ID NO: 849661 - RNA, 19 nt, Mycobacterium avium subsp. paratuberculosis
ggucacacccuugucggug

SEQ ID NO: 849662 - RNA, 16 nt, Mycobacterium avium subsp. paratuberculosis
ggucacaaagcccggg

SEQ ID NO: 849663 - RNA, 20 nt, Mycobacterium avium subsp. paratuberculosis
ggucacaaagcccgggauga

SEQ ID NO: 849664 - RNA, 22 nt, Mycobacterium avium subsp. paratuberculosis
ggucacaaagcccgggaugaug

SEQ ID NO: 849665 - RNA, 19 nt, Mycobacterium avium subsp. paratuberculosis
gguaucgggucaccgugcg

SEQ ID NO: 849666 - RNA, 19 nt, Mycobacterium avium subsp. paratuberculosis
gguaugccuuggcccgcgc

SEQ ID NO: 849667 - RNA, 14 nt, Mycobacterium avium subsp. paratuberculosis
gguaugcggcgacg

SEQ ID NO: 849668 - RNA, 12 nt, Mycobacterium avium subsp. paratuberculosis
gguauucgcgca

SEQ ID NO: 849669 - RNA, 23 nt, Mycobacterium avium subsp. paratuberculosis
gguaggccggccgcagcugcugc

SEQ ID NO: 849670 - RNA, 24 nt, Mycobacterium avium subsp. paratuberculosis
gguaggcgagaucaacaccgcgca

SEQ ID NO: 849671 - RNA, 16 nt, Mycobacterium avium subsp. paratuberculosis
gguaggcgcaccgccg

SEQ ID NO: 849672 - RNA, 20 nt, Mycobacterium avium subsp. paratuberculosis
gguaggcgcaccgccgggca

SEQ ID NO: 849673 - RNA, 20 nt, Mycobacterium avium subsp. paratuberculosis
gguaggcgccgaugcccgcc

SEQ ID NO: 849674 - RNA, 15 nt, Mycobacterium avium subsp. paratuberculosis
gguaggcgccgcucg

SEQ ID NO: 849675 - RNA, 14 nt, Mycobacterium avium subsp. paratuberculosis
gguaggcggccagc

SEQ ID NO: 849676 - RNA, 13 nt, Mycobacterium avium subsp. paratuberculosis
gguaggcggccgg

SEQ ID NO: 849677 - RNA, 15 nt, Mycobacterium avium subsp. paratuberculosis
gguaggcggccggga

SEQ ID NO: 849678 - RNA, 23 nt, Mycobacterium avium subsp. paratuberculosis
gguaggccgccuugggccggucg

SEQ ID NO: 849679 - RNA, 15 nt, Mycobacterium avium subsp. paratuberculosis
gguaggcgaccaugc

SEQ ID NO: 849680 - RNA, 13 nt, Mycobacterium avium subsp. paratuberculosis
gguaggacaccga

SEQ ID NO: 849681 - RNA, 14 nt, Mycobacterium avium subsp. paratuberculosis
gguaggccaccggg

SEQ ID NO: 849682 - RNA, 18 nt, Mycobacterium avium subsp. paratuberculosis
gguaggccaccgggucgc

SEQ ID NO: 849683 - RNA, 14 nt, Mycobacterium avium subsp. paratuberculosis
gguagaugguggcc

SEQ ID NO: 849684 - RNA, 22 nt, Mycobacterium avium subsp. paratuberculosis
gguagaugguggccgucggccu

SEQ ID NO: 849685 - RNA, 14 nt, Mycobacterium avium subsp. paratuberculosis
gguagaugucgcga

SEQ ID NO: 849686 - RNA, 18 nt, Mycobacterium avium subsp. paratuberculosis
gguagaucgccagcgccc

SEQ ID NO: 849687 - RNA, 14 nt, Mycobacterium avium subsp. paratuberculosis
gguagaucgccgga

SEQ ID NO: 849688 - RNA, 17 nt, Mycobacterium avium subsp. paratuberculosis
gguagaucgccggaucg

SEQ ID NO: 849689 - RNA, 21 nt, Mycobacterium avium subsp. paratuberculosis
gguagaucgccggaucgagca

SEQ ID NO: 849690 - RNA, 19 nt, Mycobacterium avium subsp. paratuberculosis
gguagaggcggcgaccgcg

SEQ ID NO: 849691 - RNA, 13 nt, Mycobacterium avium subsp. paratuberculosis
gguagaggcgggc

SEQ ID NO: 849692 - RNA, 15 nt, Mycobacterium avium subsp. paratuberculosis
gguagaggcugucca

SEQ ID NO: 849693 - RNA, 14 nt, Mycobacterium avium subsp. paratuberculosis
gguaccgccggcca

SEQ ID NO: 849694 - RNA, 16 nt, Mycobacterium avium subsp. paratuberculosis
gguaccgccggccagg

SEQ ID NO: 849695 - RNA, 19 nt, Mycobacterium avium subsp. paratuberculosis
gguaccgccgaucgugacg

SEQ ID NO: 849696 - RNA, 15 nt, Mycobacterium avium subsp. paratuberculosis
gguagcaggcgcgca

SEQ ID NO: 849697 - RNA, 18 nt, Mycobacterium avium subsp. paratuberculosis
gguagcaggcgcgcagca

SEQ ID NO: 849698 - RNA, 23 nt, Mycobacterium avium subsp. paratuberculosis
gguagaugccgaagccguugacg

SEQ ID NO: 849699 - RNA, 21 nt, Mycobacterium avium subsp. paratuberculosis
gguagccagcaccgccccggu

SEQ ID NO: 849700 - RNA, 20 nt, Mycobacterium avium subsp. paratuberculosis
gguagcccaugucgccggug

SEQ ID NO: 849701 - RNA, 18 nt, Mycobacterium avium subsp. paratuberculosis
gguagcccgcgugcacac

SEQ ID NO: 849702 - RNA, 13 nt, Mycobacterium avium subsp. paratuberculosis
gguagcccgucga

SEQ ID NO: 849703 - RNA, 16 nt, Mycobacterium avium subsp. paratuberculosis
gguagcccgucgacgg

SEQ ID NO: 849704 - RNA, 20 nt, Mycobacterium avium subsp. paratuberculosis
gguagcccgucgacgggcca

SEQ ID NO: 849705 - RNA, 21 nt, Mycobacterium avium subsp. paratuberculosis
gguagcccgucgacgggccac

SEQ ID NO: 849706 - RNA, 21 nt, Mycobacterium avium subsp. paratuberculosis
gguagccaugggucucggcga

SEQ ID NO: 849707 - RNA, 22 nt, Mycobacterium avium subsp. paratuberculosis
gguagcccaggauucccgaccc

SEQ ID NO: 849708 - RNA, 14 nt, Mycobacterium avium subsp. paratuberculosis
ggucgcaggcagca

SEQ ID NO: 849709 - RNA, 18 nt, Mycobacterium avium subsp. paratuberculosis
ggucgcaggccgcccggc

SEQ ID NO: 849710 - RNA, 15 nt, Mycobacterium avium subsp. paratuberculosis
ggucgcaggcgagcc

SEQ ID NO: 849711 - RNA, 14 nt, Mycobacterium avium subsp. paratuberculosis
ggucgcaggugauc

SEQ ID NO: 849712 - RNA, 18 nt, Mycobacterium avium subsp. paratuberculosis
ggucgaugucggugcggc

SEQ ID NO: 849713 - RNA, 21 nt, Mycobacterium avium subsp. paratuberculosis
ggucgaugucggugcggccgc

SEQ ID NO: 849714 - RNA, 15 nt, Mycobacterium avium subsp. paratuberculosis
ggucgaugugcgcgc

SEQ ID NO: 849715 - RNA, 18 nt, Mycobacterium avium subsp. paratuberculosis
ggucgccgcccacgccgu

SEQ ID NO: 849716 - RNA, 18 nt, Mycobacterium avium subsp. paratuberculosis
ggucgccgcgccgccggu

SEQ ID NO: 849717 - RNA, 19 nt, Mycobacterium avium subsp. paratuberculosis
ggucgccgcgccgccggug

SEQ ID NO: 849718 - RNA, 16 nt, Mycobacterium avium subsp. paratuberculosis
ggucgccaaacugcgc

SEQ ID NO: 849719 - RNA, 12 nt, Mycobacterium avium subsp. paratuberculosis
ggucgccgauca

SEQ ID NO: 849720 - RNA, 14 nt, Mycobacterium avium subsp. paratuberculosis
ggucgaugcccgcg

SEQ ID NO: 849721 - RNA, 24 nt, Mycobacterium avium subsp. paratuberculosis
ggucgaugcccgcgccgaccagcg

SEQ ID NO: 849722 - RNA, 16 nt, Mycobacterium avium subsp. paratuberculosis
ggucgagguccucggc

SEQ ID NO: 849723 - RNA, 19 nt, Mycobacterium avium subsp. paratuberculosis
ggucgagguccucggcgau

SEQ ID NO: 849724 - RNA, 18 nt, Mycobacterium avium subsp. paratuberculosis
ggucgagggucgccaggc

SEQ ID NO: 849725 - RNA, 16 nt, Mycobacterium avium subsp. paratuberculosis
ggucgaggucggccag

SEQ ID NO: 849726 - RNA, 17 nt, Mycobacterium avium subsp. paratuberculosis
ggucgaggucggccagc

SEQ ID NO: 849727 - RNA, 13 nt, Mycobacterium avium subsp. paratuberculosis
ggucgaggccggc

SEQ ID NO: 849728 - RNA, 15 nt, Mycobacterium avium subsp. paratuberculosis
ggucgaggccggcca

SEQ ID NO: 849729 - RNA, 16 nt, Mycobacterium avium subsp. paratuberculosis
ggucgaggccggccag

SEQ ID NO: 849730 - RNA, 13 nt, Mycobacterium avium subsp. paratuberculosis
ggucgagcgcgcc

SEQ ID NO: 849731 - RNA, 13 nt, Mycobacterium avium subsp. paratuberculosis
ggucgaccaagac

SEQ ID NO: 849732 - RNA, 15 nt, Mycobacterium avium subsp. paratuberculosis
ggucgagcggcccgc

SEQ ID NO: 849733 - RNA, 16 nt, Mycobacterium avium subsp. paratuberculosis
ggucgagcggcccgca

SEQ ID NO: 849734 - RNA, 17 nt, Mycobacterium avium subsp. paratuberculosis
ggucgagcggcccgcac

SEQ ID NO: 849735 - RNA, 20 nt, Mycobacterium avium subsp. paratuberculosis
ggucgaggcccucgacaccg

SEQ ID NO: 849736 - RNA, 22 nt, Mycobacterium avium subsp. paratuberculosis
ggucgaggcccucgacaccggu

SEQ ID NO: 849737 - RNA, 13 nt, Mycobacterium avium subsp. paratuberculosis
ggucgaccagcuc

SEQ ID NO: 849738 - RNA, 20 nt, Mycobacterium avium subsp. paratuberculosis
ggucgacgagcccgcgccca

SEQ ID NO: 849739 - RNA, 14 nt, Mycobacterium avium subsp. paratuberculosis
ggucgagccgcagu

SEQ ID NO: 849740 - RNA, 17 nt, Mycobacterium avium subsp. paratuberculosis
ggucgagccuggcgcgc

SEQ ID NO: 849741 - RNA, 19 nt, Mycobacterium avium subsp. paratuberculosis
gguccgguucgaccggcgu

SEQ ID NO: 849742 - RNA, 18 nt, Mycobacterium avium subsp. paratuberculosis
gguccgugccacggccgc

SEQ ID NO: 849743 - RNA, 20 nt, Mycobacterium avium subsp. paratuberculosis
gguccgugccacggccgcgg

SEQ ID NO: 849744 - RNA, 18 nt, Mycobacterium avium subsp. paratuberculosis
gguccuccagcggcaggu

SEQ ID NO: 849745 - RNA, 23 nt, Mycobacterium avium subsp. paratuberculosis
gguccuccccgcuggcgccggcg

SEQ ID NO: 849746 - RNA, 18 nt, Mycobacterium avium subsp. paratuberculosis
gguccguuggaggugauc

SEQ ID NO: 849747 - RNA, 23 nt, Mycobacterium avium subsp. paratuberculosis
gguccguuggaggugaucgccag

SEQ ID NO: 849748 - RNA, 21 nt, Mycobacterium avium subsp. paratuberculosis
gguccucgaccucuucggcgc

SEQ ID NO: 849749 - RNA, 12 nt, Mycobacterium avium subsp. paratuberculosis
gguccucgaucc

SEQ ID NO: 849750 - RNA, 17 nt, Mycobacterium avium subsp. paratuberculosis
gguccucgauggcggcg

SEQ ID NO: 849751 - RNA, 19 nt, Mycobacterium avium subsp. paratuberculosis
gguccucucggcgccgucc

SEQ ID NO: 849752 - RNA, 21 nt, Mycobacterium avium subsp. paratuberculosis
gguccucugcgaccacccgga

SEQ ID NO: 849753 - RNA, 13 nt, Mycobacterium avium subsp. paratuberculosis
ggucgacccgccg

SEQ ID NO: 849754 - RNA, 11 nt, Mycobacterium avium subsp. paratuberculosis
ggucgaccgcc

SEQ ID NO: 849755 - RNA, 15 nt, Mycobacterium avium subsp. paratuberculosis
ggucgaccgcgcacc

SEQ ID NO: 849756 - RNA, 16 nt, Mycobacterium avium subsp. paratuberculosis
ggucgaccgcgcaccg

SEQ ID NO: 849757 - RNA, 19 nt, Mycobacterium avium subsp. paratuberculosis
ggucgaccgcgcaccggcg

SEQ ID NO: 849758 - RNA, 21 nt, Mycobacterium avium subsp. paratuberculosis
ggucgaccgcgcaccggcgcu

SEQ ID NO: 849759 - RNA, 22 nt, Mycobacterium avium subsp. paratuberculosis
ggucgaccgcgcaccggcgcug

SEQ ID NO: 849760 - RNA, 18 nt, Mycobacterium avium subsp. paratuberculosis
ggucgacacgaucggcau

SEQ ID NO: 849761 - RNA, 18 nt, Mycobacterium avium subsp. paratuberculosis
ggucgaagauggccaggu

SEQ ID NO: 849762 - RNA, 15 nt, Mycobacterium avium subsp. paratuberculosis
ggucgaagcgcagca

SEQ ID NO: 849763 - RNA, 15 nt, Mycobacterium avium subsp. paratuberculosis
ggucgaaggccccgg

SEQ ID NO: 849764 - RNA, 18 nt, Mycobacterium avium subsp. paratuberculosis
ggucgaaguccugcgccg

SEQ ID NO: 849765 - RNA, 16 nt, Mycobacterium avium subsp. paratuberculosis
ggucgaagugcucgag

SEQ ID NO: 849766 - RNA, 12 nt, Mycobacterium avium subsp. paratuberculosis
gguccacgcagu

SEQ ID NO: 849767 - RNA, 20 nt, Mycobacterium avium subsp. paratuberculosis
gguccagcacgugcccagcc

SEQ ID NO: 849768 - RNA, 17 nt, Mycobacterium avium subsp. paratuberculosis
gguccagcaccggcgcc

SEQ ID NO: 849769 - RNA, 18 nt, Mycobacterium avium subsp. paratuberculosis
gguccagcaccggcgccc

SEQ ID NO: 849770 - RNA, 19 nt, Mycobacterium avium subsp. paratuberculosis
gguccagcaccggcgcccc

SEQ ID NO: 849771 - RNA, 15 nt, Mycobacterium avium subsp. paratuberculosis
ggucccccgccgacc

SEQ ID NO: 849772 - RNA, 12 nt, Mycobacterium avium subsp. paratuberculosis
gguccccgcgcc

SEQ ID NO: 849773 - RNA, 18 nt, Mycobacterium avium subsp. paratuberculosis
gguccccggagucgucga

SEQ ID NO: 849774 - RNA, 16 nt, Mycobacterium avium subsp. paratuberculosis
ggucccgacgcggcgc

SEQ ID NO: 849775 - RNA, 17 nt, Mycobacterium avium subsp. paratuberculosis
ggucccgacgcggcgcg

SEQ ID NO: 849776 - RNA, 17 nt, Mycobacterium avium subsp. paratuberculosis
ggucccgcggcggcgcc

SEQ ID NO: 849777 - RNA, 18 nt, Mycobacterium avium subsp. paratuberculosis
ggucccgcggcggcgcca

SEQ ID NO: 849778 - RNA, 17 nt, Mycobacterium avium subsp. paratuberculosis
ggucccggucagcgucc

SEQ ID NO: 849779 - RNA, 13 nt, Mycobacterium avium subsp. paratuberculosis
ggucccggucagg

SEQ ID NO: 849780 - RNA, 19 nt, Mycobacterium avium subsp. paratuberculosis
ggucccggcaacaccggcg

SEQ ID NO: 849781 - RNA, 13 nt, Mycobacterium avium subsp. paratuberculosis
ggucccggccgac

SEQ ID NO: 849782 - RNA, 17 nt, Mycobacterium avium subsp. paratuberculosis
ggucccggccgacgggc

SEQ ID NO: 849783 - RNA, 19 nt, Mycobacterium avium subsp. paratuberculosis
ggucccggcgggggcggcg

SEQ ID NO: 849784 - RNA, 16 nt, Mycobacterium avium subsp. paratuberculosis
gguccgaccagcaccc

SEQ ID NO: 849785 - RNA, 15 nt, Mycobacterium avium subsp. paratuberculosis
gguccgaccgccacc

SEQ ID NO: 849786 - RNA, 19 nt, Mycobacterium avium subsp. paratuberculosis
gguccgaccgccaccaccc

SEQ ID NO: 849787 - RNA, 20 nt, Mycobacterium avium subsp. paratuberculosis
gguccgaccgccaccacccg

SEQ ID NO: 849788 - RNA, 18 nt, Mycobacterium avium subsp. paratuberculosis
gguccgaccagcggccca

SEQ ID NO: 849789 - RNA, 14 nt, Mycobacterium avium subsp. paratuberculosis
gguccgacggcugc

SEQ ID NO: 849790 - RNA, 15 nt, Mycobacterium avium subsp. paratuberculosis
gguccggccgugccg

SEQ ID NO: 849791 - RNA, 19 nt, Mycobacterium avium subsp. paratuberculosis
gguccggcugaacgccagc

SEQ ID NO: 849792 - RNA, 15 nt, Mycobacterium avium subsp. paratuberculosis
ggucagccacgggcg

SEQ ID NO: 849793 - RNA, 18 nt, Mycobacterium avium subsp. paratuberculosis
ggucagccacgggcgguc

SEQ ID NO: 849794 - RNA, 17 nt, Mycobacterium avium subsp. paratuberculosis
ggucagcccccaccgcg

SEQ ID NO: 849795 - RNA, 16 nt, Mycobacterium avium subsp. paratuberculosis
ggucagcagggugacg

SEQ ID NO: 849796 - RNA, 17 nt, Mycobacterium avium subsp. paratuberculosis
ggucagcaggcgccgca

SEQ ID NO: 849797 - RNA, 19 nt, Mycobacterium avium subsp. paratuberculosis
ggucagcaggcgccgcagc

SEQ ID NO: 849798 - RNA, 21 nt, Mycobacterium avium subsp. paratuberculosis
ggucagcgacgagagcggauc

SEQ ID NO: 849799 - RNA, 22 nt, Mycobacterium avium subsp. paratuberculosis
ggucagcgagcgguuggcgacg

SEQ ID NO: 849800 - RNA, 23 nt, Mycobacterium avium subsp. paratuberculosis
ggucagcgagugguaccgggugg

SEQ ID NO: 849801 - RNA, 22 nt, Mycobacterium avium subsp. paratuberculosis
ggucagcccgcccuuggccgcg

SEQ ID NO: 849802 - RNA, 13 nt, Mycobacterium avium subsp. paratuberculosis
ggucagcccgcgc

SEQ ID NO: 849803 - RNA, 17 nt, Mycobacterium avium subsp. paratuberculosis
ggucagccgcaccaggu

SEQ ID NO: 849804 - RNA, 21 nt, Mycobacterium avium subsp. paratuberculosis
ggucaguacagcuaggccagc

SEQ ID NO: 849805 - RNA, 22 nt, Mycobacterium avium subsp. paratuberculosis
ggucaguacagcuaggccagca

SEQ ID NO: 849806 - RNA, 22 nt, Mycobacterium avium subsp. paratuberculosis
ggucagucgaucuugcgccaga

SEQ ID NO: 849807 - RNA, 12 nt, Mycobacterium avium subsp. paratuberculosis
ggucagucgcgc

SEQ ID NO: 849808 - RNA, 16 nt, Mycobacterium avium subsp. paratuberculosis
ggucagucgcgccgcc

SEQ ID NO: 849809 - RNA, 20 nt, Mycobacterium avium subsp. paratuberculosis
ggucagucgcgccgccagca

SEQ ID NO: 849810 - RNA, 21 nt, Mycobacterium avium subsp. paratuberculosis
ggucagcgcggucagcccgcc

SEQ ID NO: 849811 - RNA, 17 nt, Mycobacterium avium subsp. paratuberculosis
ggucagcgcguccaggu

SEQ ID NO: 849812 - RNA, 22 nt, Mycobacterium avium subsp. paratuberculosis
ggucagcgcguccaggugcgcc

SEQ ID NO: 849813 - RNA, 16 nt, Mycobacterium avium subsp. paratuberculosis
ggucagcgcgucggcg

SEQ ID NO: 849814 - RNA, 21 nt, Mycobacterium avium subsp. paratuberculosis
ggucagcgcgacaucgccggc

SEQ ID NO: 849815 - RNA, 15 nt, Mycobacterium avium subsp. paratuberculosis
ggucagcgcggcccg

SEQ ID NO: 849816 - RNA, 17 nt, Mycobacterium avium subsp. paratuberculosis
ggucagcgcggcccgcg

SEQ ID NO: 849817 - RNA, 16 nt, Mycobacterium avium subsp. paratuberculosis
ggucagccgcggcggc

SEQ ID NO: 849818 - RNA, 20 nt, Mycobacterium avium subsp. paratuberculosis
ggucagccgcggcucgaugg

SEQ ID NO: 849819 - RNA, 18 nt, Mycobacterium avium subsp. paratuberculosis
gguccacccgccccgccg

SEQ ID NO: 849820 - RNA, 18 nt, Mycobacterium avium subsp. paratuberculosis
gguccaccgccgcgccga

SEQ ID NO: 849821 - RNA, 19 nt, Mycobacterium avium subsp. paratuberculosis
gguccaccgccgcgccgag

SEQ ID NO: 849822 - RNA, 15 nt, Mycobacterium avium subsp. paratuberculosis
gguccaccgcggcgg

SEQ ID NO: 849823 - RNA, 16 nt, Mycobacterium avium subsp. paratuberculosis
gguccaccgcggcggc

SEQ ID NO: 849824 - RNA, 17 nt, Mycobacterium avium subsp. paratuberculosis
gguccaccgcggcggcc

SEQ ID NO: 849825 - RNA, 19 nt, Mycobacterium avium subsp. paratuberculosis
gguccaccgcggcggccag

SEQ ID NO: 849826 - RNA, 18 nt, Mycobacterium avium subsp. paratuberculosis
gguccaacguggguggcc

SEQ ID NO: 849827 - RNA, 17 nt, Mycobacterium avium subsp. paratuberculosis
gguccagaucggcgcgc

SEQ ID NO: 849828 - RNA, 20 nt, Mycobacterium avium subsp. paratuberculosis
gguccagaucggcgcgcggg

SEQ ID NO: 849829 - RNA, 18 nt, Mycobacterium avium subsp. paratuberculosis
gguccacucgucggcggu

SEQ ID NO: 849830 - RNA, 14 nt, Mycobacterium avium subsp. paratuberculosis
gguccacgccggcg

SEQ ID NO: 849831 - RNA, 14 nt, Mycobacterium avium subsp. paratuberculosis
gguccaccggccga

SEQ ID NO: 849832 - RNA, 17 nt, Mycobacterium avium subsp. paratuberculosis
gguccaccguugucucg

SEQ ID NO: 849833 - RNA, 15 nt, Mycobacterium avium subsp. paratuberculosis
ggucaucagcgacgu

SEQ ID NO: 849834 - RNA, 20 nt, Mycobacterium avium subsp. paratuberculosis
ggucaucaccuugucgcuga

SEQ ID NO: 849835 - RNA, 22 nt, Mycobacterium avium subsp. paratuberculosis
ggucauccagccgugggugucg

SEQ ID NO: 849836 - RNA, 20 nt, Mycobacterium avium subsp. paratuberculosis
ggucauccccgugcggggcc

SEQ ID NO: 849837 - RNA, 14 nt, Mycobacterium avium subsp. paratuberculosis
ggucauccgcucca

SEQ ID NO: 849838 - RNA, 15 nt, Mycobacterium avium subsp. paratuberculosis
ggucaguucgucggu

SEQ ID NO: 849839 - RNA, 16 nt, Mycobacterium avium subsp. paratuberculosis
ggucaguucgucgguc

SEQ ID NO: 849840 - RNA, 16 nt, Mycobacterium avium subsp. paratuberculosis
ggucauaucgacggcc

SEQ ID NO: 849841 - RNA, 17 nt, Mycobacterium avium subsp. paratuberculosis
ggucagcagcacccggu

SEQ ID NO: 849842 - RNA, 18 nt, Mycobacterium avium subsp. paratuberculosis
ggucagcagcacccgguc

SEQ ID NO: 849843 - RNA, 16 nt, Mycobacterium avium subsp. paratuberculosis
ggucagcagcagcgcc

SEQ ID NO: 849844 - RNA, 18 nt, Mycobacterium avium subsp. paratuberculosis
ggucagcagcagcgccuc

SEQ ID NO: 849845 - RNA, 17 nt, Mycobacterium avium subsp. paratuberculosis
ggucagcacccgcagcc

SEQ ID NO: 849846 - RNA, 23 nt, Mycobacterium avium subsp. paratuberculosis
ggucagcacccgcagccgcgagu

SEQ ID NO: 849847 - RNA, 18 nt, Mycobacterium avium subsp. paratuberculosis
ggucagcaccgcgcggcg

SEQ ID NO: 849848 - RNA, 20 nt, Mycobacterium avium subsp. paratuberculosis
ggucagcaccgcgcggcggu

SEQ ID NO: 849849 - RNA, 21 nt, Mycobacterium avium subsp. paratuberculosis
ggucagcaccgcgcggcggug

SEQ ID NO: 849850 - RNA, 22 nt, Mycobacterium avium subsp. paratuberculosis
ggucagcaccgcgcggcggugc

SEQ ID NO: 849851 - RNA, 13 nt, Mycobacterium avium subsp. paratuberculosis
ggucagcaccggg

SEQ ID NO: 849852 - RNA, 15 nt, Mycobacterium avium subsp. paratuberculosis
ggucagcaccgucac

SEQ ID NO: 849853 - RNA, 21 nt, Mycobacterium avium subsp. paratuberculosis
ggucagaccgcggcggucgcc

SEQ ID NO: 849854 - RNA, 13 nt, Mycobacterium avium subsp. paratuberculosis
ggucagcaccacc

SEQ ID NO: 849855 - RNA, 15 nt, Mycobacterium avium subsp. paratuberculosis
ggucagagcccgaac

SEQ ID NO: 849856 - RNA, 14 nt, Mycobacterium avium subsp. paratuberculosis
ggucacggugacgg

SEQ ID NO: 849857 - RNA, 15 nt, Mycobacterium avium subsp. paratuberculosis
ggucacggcgucggc

SEQ ID NO: 849858 - RNA, 19 nt, Mycobacterium avium subsp. paratuberculosis
ggucacggauacccgcggc

SEQ ID NO: 849859 - RNA, 21 nt, Mycobacterium avium subsp. paratuberculosis
ggucacggauacccgcggccu

SEQ ID NO: 849860 - RNA, 16 nt, Mycobacterium avium subsp. paratuberculosis
ggucacggccgccagc

SEQ ID NO: 849861 - RNA, 17 nt, Mycobacterium avium subsp. paratuberculosis
ggucacggccgccagca

SEQ ID NO: 849862 - RNA, 13 nt, Mycobacterium avium subsp. paratuberculosis
ggucacgcccggg

SEQ ID NO: 849863 - RNA, 21 nt, Mycobacterium avium subsp. paratuberculosis
ggucacgcccggguacaccga

SEQ ID NO: 849864 - RNA, 12 nt, Mycobacterium avium subsp. paratuberculosis
ggucacgcuggc

SEQ ID NO: 849865 - RNA, 13 nt, Mycobacterium avium subsp. paratuberculosis
ggucacgcuggcg

SEQ ID NO: 849866 - RNA, 19 nt, Mycobacterium avium subsp. paratuberculosis
ggucacgcuggcgugacgc

SEQ ID NO: 849867 - RNA, 13 nt, Mycobacterium avium subsp. paratuberculosis
ggucaccgcgacc

SEQ ID NO: 849868 - RNA, 15 nt, Mycobacterium avium subsp. paratuberculosis
ggucaccgagcggcc

SEQ ID NO: 849869 - RNA, 13 nt, Mycobacterium avium subsp. paratuberculosis
ggucaccgcgcga

SEQ ID NO: 849870 - RNA, 23 nt, Mycobacterium avium subsp. paratuberculosis
ggucaccgcgggaauggccgcgc

SEQ ID NO: 849871 - RNA, 22 nt, Mycobacterium avium subsp. paratuberculosis
ggucaccggcaggcgguagcgg

SEQ ID NO: 849872 - RNA, 15 nt, Mycobacterium avium subsp. paratuberculosis
ggucaccggccgagc

SEQ ID NO: 849873 - RNA, 16 nt, Mycobacterium avium subsp. paratuberculosis
ggucaccggccgagcc

SEQ ID NO: 849874 - RNA, 23 nt, Mycobacterium avium subsp. paratuberculosis
ggucaccggaugcacgugcaccg

SEQ ID NO: 849875 - RNA, 11 nt, Mycobacterium avium subsp. paratuberculosis
ggucaccggcu

SEQ ID NO: 849876 - RNA, 13 nt, Mycobacterium avium subsp. paratuberculosis
ggucaccggggug

SEQ ID NO: 849877 - RNA, 18 nt, Mycobacterium avium subsp. paratuberculosis
ggucaccggggugccgcc

SEQ ID NO: 849878 - RNA, 21 nt, Mycobacterium avium subsp. paratuberculosis
ggucaccgggugaugucgccg

SEQ ID NO: 849879 - RNA, 13 nt, Mycobacterium avium subsp. paratuberculosis
ggucaccgugcgg

SEQ ID NO: 849880 - RNA, 13 nt, Mycobacterium avium subsp. paratuberculosis
ggucaccgugucg

SEQ ID NO: 849881 - RNA, 18 nt, Mycobacterium avium subsp. paratuberculosis
ggucaccgugucggcggg

SEQ ID NO: 849882 - RNA, 13 nt, Mycobacterium avium subsp. paratuberculosis
ggucaccugacgc

SEQ ID NO: 849883 - RNA, 18 nt, Mycobacterium avium subsp. paratuberculosis
ggucaccugacgcucggu

SEQ ID NO: 849884 - RNA, 21 nt, Mycobacterium avium subsp. paratuberculosis
ggucaccccggagauccggcc

SEQ ID NO: 849885 - RNA, 15 nt, Mycobacterium avium subsp. paratuberculosis
ggucaccccggccau

SEQ ID NO: 849886 - RNA, 20 nt, Mycobacterium avium subsp. paratuberculosis
ggucaccccggccaucaugc

SEQ ID NO: 849887 - RNA, 14 nt, Mycobacterium avium subsp. paratuberculosis
ggucacccgcagcc

SEQ ID NO: 849888 - RNA, 20 nt, Mycobacterium avium subsp. paratuberculosis
ggucacccgguugagcaccg

SEQ ID NO: 849889 - RNA, 22 nt, Mycobacterium avium subsp. paratuberculosis
ggucacccgguugagcaccgca

SEQ ID NO: 849890 - RNA, 19 nt, Mycobacterium avium subsp. paratuberculosis
ggucacccgugggccgacc

SEQ ID NO: 849891 - RNA, 19 nt, Mycobacterium avium subsp. paratuberculosis
ggucacccuccucgcggcg

SEQ ID NO: 849892 - RNA, 17 nt, Mycobacterium avium subsp. paratuberculosis
ggucaccacggucaccc

SEQ ID NO: 849893 - RNA, 13 nt, Mycobacterium avium subsp. paratuberculosis
ggucaccagcgcg

SEQ ID NO: 849894 - RNA, 14 nt, Mycobacterium avium subsp. paratuberculosis
ggucaccagcgcgg

SEQ ID NO: 849895 - RNA, 15 nt, Mycobacterium avium subsp. paratuberculosis
ggucaccagcggccc

SEQ ID NO: 849896 - RNA, 17 nt, Mycobacterium avium subsp. paratuberculosis
ggucaccagcggcccgc

SEQ ID NO: 849897 - RNA, 19 nt, Mycobacterium avium subsp. paratuberculosis
ggucaccagcggcccgcug

SEQ ID NO: 849898 - RNA, 15 nt, Mycobacterium avium subsp. paratuberculosis
ggucaccaccgagcc

SEQ ID NO: 849899 - RNA, 24 nt, Mycobacterium avium subsp. paratuberculosis
ggucaccaucagcaccgccucggc

SEQ ID NO: 849900 - RNA, 19 nt, Mycobacterium avium subsp. paratuberculosis
ggucaccaucagcggcucg

SEQ ID NO: 849901 - RNA, 15 nt, Mycobacterium avium subsp. paratuberculosis
ggucacccacuggcg

SEQ ID NO: 849902 - RNA, 22 nt, Mycobacterium avium subsp. paratuberculosis
gggcgaaccacgggucgcugug

SEQ ID NO: 849903 - RNA, 20 nt, Mycobacterium avium subsp. paratuberculosis
gggcgaaguagccggcgauc

SEQ ID NO: 849904 - RNA, 18 nt, Mycobacterium avium subsp. paratuberculosis
gggcgacaugcccgcggu

SEQ ID NO: 849905 - RNA, 17 nt, Mycobacterium avium subsp. paratuberculosis
gggcgacauguccggga

SEQ ID NO: 849906 - RNA, 17 nt, Mycobacterium avium subsp. paratuberculosis
gggcgaccacguccagc

SEQ ID NO: 849907 - RNA, 20 nt, Mycobacterium avium subsp. paratuberculosis
gggcgaccagauaggccagc

SEQ ID NO: 849908 - RNA, 22 nt, Mycobacterium avium subsp. paratuberculosis
gggcgaccaguaggccagcauc

SEQ ID NO: 849909 - RNA, 16 nt, Mycobacterium avium subsp. paratuberculosis
gggcgaccccggccag

SEQ ID NO: 849910 - RNA, 17 nt, Mycobacterium avium subsp. paratuberculosis
gggcgaccccggccagg

SEQ ID NO: 849911 - RNA, 19 nt, Mycobacterium avium subsp. paratuberculosis
gggcgaccccggccaggau

SEQ ID NO: 849912 - RNA, 12 nt, Mycobacterium avium subsp. paratuberculosis
gggcgaccgccg

SEQ ID NO: 849913 - RNA, 13 nt, Mycobacterium avium subsp. paratuberculosis
gggcgaccgccgc

SEQ ID NO: 849914 - RNA, 23 nt, Mycobacterium avium subsp. paratuberculosis
gggcgaccgccgcguacagccag

SEQ ID NO: 849915 - RNA, 16 nt, Mycobacterium avium subsp. paratuberculosis
gggcgagccggcccgg

SEQ ID NO: 849916 - RNA, 19 nt, Mycobacterium avium subsp. paratuberculosis
gggcgacuccggcgccggu

SEQ ID NO: 849917 - RNA, 19 nt, Mycobacterium avium subsp. paratuberculosis
gggcgacuucuucgccggc

SEQ ID NO: 849918 - RNA, 15 nt, Mycobacterium avium subsp. paratuberculosis
gggcgacgucggggu

SEQ ID NO: 849919 - RNA, 24 nt, Mycobacterium avium subsp. paratuberculosis
gggcgacgucggggucgucgcggu

SEQ ID NO: 849920 - RNA, 18 nt, Mycobacterium avium subsp. paratuberculosis
gggcgacgggccgaucac

SEQ ID NO: 849921 - RNA, 17 nt, Mycobacterium avium subsp. paratuberculosis
gggcgacggcggcgacg

SEQ ID NO: 849922 - RNA, 22 nt, Mycobacterium avium subsp. paratuberculosis
gggcgacggcggcgacgugauc

SEQ ID NO: 849923 - RNA, 18 nt, Mycobacterium avium subsp. paratuberculosis
gggcgacgccgcggaagc

SEQ ID NO: 849924 - RNA, 18 nt, Mycobacterium avium subsp. paratuberculosis
gggcgaccuggacgccgc

SEQ ID NO: 849925 - RNA, 17 nt, Mycobacterium avium subsp. paratuberculosis
gggcgaccuugcgcagc

SEQ ID NO: 849926 - RNA, 19 nt, Mycobacterium avium subsp. paratuberculosis
gggcgacgaugccggccgg

SEQ ID NO: 849927 - RNA, 21 nt, Mycobacterium avium subsp. paratuberculosis
gggcgacgaugccggccggga

SEQ ID NO: 849928 - RNA, 17 nt, Mycobacterium avium subsp. paratuberculosis
gggcgauggugccgccg

SEQ ID NO: 849929 - RNA, 18 nt, Mycobacterium avium subsp. paratuberculosis
gggcgauggugccgccgg

SEQ ID NO: 849930 - RNA, 15 nt, Mycobacterium avium subsp. paratuberculosis
gggcgauugcguuga

SEQ ID NO: 849931 - RNA, 17 nt, Mycobacterium avium subsp. paratuberculosis
gggcgauugcguugauc

SEQ ID NO: 849932 - RNA, 19 nt, Mycobacterium avium subsp. paratuberculosis
gggcgauaaccucggcggc

SEQ ID NO: 849933 - RNA, 13 nt, Mycobacterium avium subsp. paratuberculosis
gggcgaucucgau

SEQ ID NO: 849934 - RNA, 19 nt, Mycobacterium avium subsp. paratuberculosis
gggcgaucucuucgaugcc

SEQ ID NO: 849935 - RNA, 19 nt, Mycobacterium avium subsp. paratuberculosis
gggcgaugccgacacccca

SEQ ID NO: 849936 - RNA, 20 nt, Mycobacterium avium subsp. paratuberculosis
gggcgaugcggcccggccac

SEQ ID NO: 849937 - RNA, 19 nt, Mycobacterium avium subsp. paratuberculosis
gggcgaucagcccgcccac

SEQ ID NO: 849938 - RNA, 21 nt, Mycobacterium avium subsp. paratuberculosis
gggcgaucagcccgcccacca

SEQ ID NO: 849939 - RNA, 19 nt, Mycobacterium avium subsp. paratuberculosis
gggcgaucgacaccagcgu

SEQ ID NO: 849940 - RNA, 17 nt, Mycobacterium avium subsp. paratuberculosis
gggcgaucuccagcggc

SEQ ID NO: 849941 - RNA, 16 nt, Mycobacterium avium subsp. paratuberculosis
gggcgaucaccgcggc

SEQ ID NO: 849942 - RNA, 19 nt, Mycobacterium avium subsp. paratuberculosis
gggcgaucaccgcggccac

SEQ ID NO: 849943 - RNA, 20 nt, Mycobacterium avium subsp. paratuberculosis
gggcgaucaccgcggccacc

SEQ ID NO: 849944 - RNA, 22 nt, Mycobacterium avium subsp. paratuberculosis
gggcgaggacggcuugggugug

SEQ ID NO: 849945 - RNA, 16 nt, Mycobacterium avium subsp. paratuberculosis
gggcgagcgucgccgc

SEQ ID NO: 849946 - RNA, 18 nt, Mycobacterium avium subsp. paratuberculosis
gggcgagcuggccgccca

SEQ ID NO: 849947 - RNA, 14 nt, Mycobacterium avium subsp. paratuberculosis
gggcgagggcaacg

SEQ ID NO: 849948 - RNA, 15 nt, Mycobacterium avium subsp. paratuberculosis
gggcgagggcaacgu

SEQ ID NO: 849949 - RNA, 12 nt, Mycobacterium avium subsp. paratuberculosis
gggccucgucca

SEQ ID NO: 849950 - RNA, 14 nt, Mycobacterium avium subsp. paratuberculosis
gggccugcgcgccg

SEQ ID NO: 849951 - RNA, 16 nt, Mycobacterium avium subsp. paratuberculosis
gggccugcgcgccgau

SEQ ID NO: 849952 - RNA, 12 nt, Mycobacterium avium subsp. paratuberculosis
gggccugcggcg

SEQ ID NO: 849953 - RNA, 17 nt, Mycobacterium avium subsp. paratuberculosis
gggccugcggcgcggcc

SEQ ID NO: 849954 - RNA, 17 nt, Mycobacterium avium subsp. paratuberculosis
gggccugcggcggccgc

SEQ ID NO: 849955 - RNA, 18 nt, Mycobacterium avium subsp. paratuberculosis
gggccugcggcggccgca

SEQ ID NO: 849956 - RNA, 19 nt, Mycobacterium avium subsp. paratuberculosis
gggccugcggcggccgcag

SEQ ID NO: 849957 - RNA, 21 nt, Mycobacterium avium subsp. paratuberculosis
gggccugcgggacgccguuga

SEQ ID NO: 849958 - RNA, 14 nt, Mycobacterium avium subsp. paratuberculosis
gggccucggcgacc

SEQ ID NO: 849959 - RNA, 23 nt, Mycobacterium avium subsp. paratuberculosis
gggccucgccguugccggcccgc

SEQ ID NO: 849960 - RNA, 24 nt, Mycobacterium avium subsp. paratuberculosis
gggccucgccguugccggcccgca

SEQ ID NO: 849961 - RNA, 20 nt, Mycobacterium avium subsp. paratuberculosis
gggccuaggaccccggcugc

SEQ ID NO: 849962 - RNA, 14 nt, Mycobacterium avium subsp. paratuberculosis
gggccuaugccgcg

SEQ ID NO: 849963 - RNA, 12 nt, Mycobacterium avium subsp. paratuberculosis
gggccuccacca

SEQ ID NO: 849964 - RNA, 15 nt, Mycobacterium avium subsp. paratuberculosis
gggccuccaccacca

SEQ ID NO: 849965 - RNA, 15 nt, Mycobacterium avium subsp. paratuberculosis
gggccuccaccagcg

SEQ ID NO: 849966 - RNA, 17 nt, Mycobacterium avium subsp. paratuberculosis
gggccuccaccagcggc

SEQ ID NO: 849967 - RNA, 12 nt, Mycobacterium avium subsp. paratuberculosis
gggccuccagcc

SEQ ID NO: 849968 - RNA, 14 nt, Mycobacterium avium subsp. paratuberculosis
gggccuccggcggc

SEQ ID NO: 849969 - RNA, 20 nt, Mycobacterium avium subsp. paratuberculosis
gggccuccggcggcagauag

SEQ ID NO: 849970 - RNA, 15 nt, Mycobacterium avium subsp. paratuberculosis
gggccguccgccggc

SEQ ID NO: 849971 - RNA, 14 nt, Mycobacterium avium subsp. paratuberculosis
gggccguggcaccg

SEQ ID NO: 849972 - RNA, 13 nt, Mycobacterium avium subsp. paratuberculosis
gggccguugcggc

SEQ ID NO: 849973 - RNA, 15 nt, Mycobacterium avium subsp. paratuberculosis
gggccguugcggcca

SEQ ID NO: 849974 - RNA, 13 nt, Mycobacterium avium subsp. paratuberculosis
gggccgucgcccg

SEQ ID NO: 849975 - RNA, 17 nt, Mycobacterium avium subsp. paratuberculosis
gggccguaucggccccg

SEQ ID NO: 849976 - RNA, 16 nt, Mycobacterium avium subsp. paratuberculosis
gggccuggcgcuccag

SEQ ID NO: 849977 - RNA, 20 nt, Mycobacterium avium subsp. paratuberculosis
gggccuuguugcggcgcacc

SEQ ID NO: 849978 - RNA, 14 nt, Mycobacterium avium subsp. paratuberculosis
gggcgaacgaccgg

SEQ ID NO: 849979 - RNA, 22 nt, Mycobacterium avium subsp. paratuberculosis
gggcgaacgaggccgacgugga

SEQ ID NO: 849980 - RNA, 15 nt, Mycobacterium avium subsp. paratuberculosis
gggcgaacggcaacg

SEQ ID NO: 849981 - RNA, 17 nt, Mycobacterium avium subsp. paratuberculosis
gggcgaacagcagcacc

SEQ ID NO: 849982 - RNA, 18 nt, Mycobacterium avium subsp. paratuberculosis
gggcgaacgucgggucga

SEQ ID NO: 849983 - RNA, 15 nt, Mycobacterium avium subsp. paratuberculosis
gggcgaagccgaggu

SEQ ID NO: 849984 - RNA, 19 nt, Mycobacterium avium subsp. paratuberculosis
gggcgaagucgccggccag

SEQ ID NO: 849985 - RNA, 15 nt, Mycobacterium avium subsp. paratuberculosis
gggccuguccagccg

SEQ ID NO: 849986 - RNA, 17 nt, Mycobacterium avium subsp. paratuberculosis
gggccuguuucugcgcc

SEQ ID NO: 849987 - RNA, 18 nt, Mycobacterium avium subsp. paratuberculosis
gggccuucuucucgacgu

SEQ ID NO: 849988 - RNA, 19 nt, Mycobacterium avium subsp. paratuberculosis
gggccuucuucucgacgua

SEQ ID NO: 849989 - RNA, 19 nt, Mycobacterium avium subsp. paratuberculosis
gggccuucuuggcggcggc

SEQ ID NO: 849990 - RNA, 22 nt, Mycobacterium avium subsp. paratuberculosis
gggccuucuuggcggcggccuu

SEQ ID NO: 849991 - RNA, 15 nt, Mycobacterium avium subsp. paratuberculosis
gggccuugacggccu

SEQ ID NO: 849992 - RNA, 17 nt, Mycobacterium avium subsp. paratuberculosis
gggccuggacuugcguc

SEQ ID NO: 849993 - RNA, 18 nt, Mycobacterium avium subsp. paratuberculosis
gggccugcagcaccaggc

SEQ ID NO: 849994 - RNA, 20 nt, Mycobacterium avium subsp. paratuberculosis
gggccugcucgcuugccagc

SEQ ID NO: 849995 - RNA, 21 nt, Mycobacterium avium subsp. paratuberculosis
gggccugcucgcuugccagcc

SEQ ID NO: 849996 - RNA, 11 nt, Mycobacterium avium subsp. paratuberculosis
gggcggccagc

SEQ ID NO: 849997 - RNA, 13 nt, Mycobacterium avium subsp. paratuberculosis
gggcggccagccg

SEQ ID NO: 849998 - RNA, 20 nt, Mycobacterium avium subsp. paratuberculosis
gggcggccagccgcgcggcg

SEQ ID NO: 849999 - RNA, 21 nt, Mycobacterium avium subsp. paratuberculosis
gggcggccagcguggcgcgcc

SEQ ID NO: 850000 - RNA, 13 nt, Mycobacterium avium subsp. paratuberculosis
gggcggcaucgcg

SEQ ID NO: 850001 - RNA, 18 nt, Mycobacterium avium subsp. paratuberculosis
gggcggcaucgcgcgcgg

SEQ ID NO: 850002 - RNA, 20 nt, Mycobacterium avium subsp. paratuberculosis
gggcggcaucgcgcgcggcg

SEQ ID NO: 850003 - RNA, 22 nt, Mycobacterium avium subsp. paratuberculosis
gggcggcaucgcgcgcggcggc

SEQ ID NO: 850004 - RNA, 13 nt, Mycobacterium avium subsp. paratuberculosis
gggcggccaccgc

SEQ ID NO: 850005 - RNA, 14 nt, Mycobacterium avium subsp. paratuberculosis
gggcggcccgcauc

SEQ ID NO: 850006 - RNA, 17 nt, Mycobacterium avium subsp. paratuberculosis
gggcggcagggccagca

SEQ ID NO: 850007 - RNA, 20 nt, Mycobacterium avium subsp. paratuberculosis
gggcggcagggccagcacca

SEQ ID NO: 850008 - RNA, 18 nt, Mycobacterium avium subsp. paratuberculosis
gggcggcaggucggcggg

SEQ ID NO: 850009 - RNA, 19 nt, Mycobacterium avium subsp. paratuberculosis
gggcggcgaacaccagcac

SEQ ID NO: 850010 - RNA, 21 nt, Mycobacterium avium subsp. paratuberculosis
gggcggcgacaucgccgagac

SEQ ID NO: 850011 - RNA, 15 nt, Mycobacterium avium subsp. paratuberculosis
gggcggccucggcgu

SEQ ID NO: 850012 - RNA, 13 nt, Mycobacterium avium subsp. paratuberculosis
gggcggccgcgga

SEQ ID NO: 850013 - RNA, 14 nt, Mycobacterium avium subsp. paratuberculosis
gggcggccggccag

SEQ ID NO: 850014 - RNA, 15 nt, Mycobacterium avium subsp. paratuberculosis
gggcggccgggccgc

SEQ ID NO: 850015 - RNA, 19 nt, Mycobacterium avium subsp. paratuberculosis
gggcggccgggccgcggcg

SEQ ID NO: 850016 - RNA, 18 nt, Mycobacterium avium subsp. paratuberculosis
gggcggcgcgcugcggcg

SEQ ID NO: 850017 - RNA, 14 nt, Mycobacterium avium subsp. paratuberculosis
gggcggcggccacc

SEQ ID NO: 850018 - RNA, 13 nt, Mycobacterium avium subsp. paratuberculosis
gggcggcggcgcc

SEQ ID NO: 850019 - RNA, 20 nt, Mycobacterium avium subsp. paratuberculosis
gggcggcgcagucggccgga

SEQ ID NO: 850020 - RNA, 19 nt, Mycobacterium avium subsp. paratuberculosis
gggcggcgccgcggcccug

SEQ ID NO: 850021 - RNA, 22 nt, Mycobacterium avium subsp. paratuberculosis
gggcgcugccguccuucucgaa

SEQ ID NO: 850022 - RNA, 19 nt, Mycobacterium avium subsp. paratuberculosis
gggcggccugccggccgcc

SEQ ID NO: 850023 - RNA, 23 nt, Mycobacterium avium subsp. paratuberculosis
gggcggcgaccuguuuggccagc

SEQ ID NO: 850024 - RNA, 17 nt, Mycobacterium avium subsp. paratuberculosis
gggcggcgucggcgacg

SEQ ID NO: 850025 - RNA, 13 nt, Mycobacterium avium subsp. paratuberculosis
gggcggcggcggg

SEQ ID NO: 850026 - RNA, 16 nt, Mycobacterium avium subsp. paratuberculosis
gggcggcaagccgagu

SEQ ID NO: 850027 - RNA, 20 nt, Mycobacterium avium subsp. paratuberculosis
gggcggauuggugccgauca

SEQ ID NO: 850028 - RNA, 17 nt, Mycobacterium avium subsp. paratuberculosis
gggcggaugucggugug

SEQ ID NO: 850029 - RNA, 19 nt, Mycobacterium avium subsp. paratuberculosis
gggcggaugucggugugga

SEQ ID NO: 850030 - RNA, 23 nt, Mycobacterium avium subsp. paratuberculosis
gggcggaugugccuggcccagac

SEQ ID NO: 850031 - RNA, 15 nt, Mycobacterium avium subsp. paratuberculosis
gggcggacggcaccg

SEQ ID NO: 850032 - RNA, 21 nt, Mycobacterium avium subsp. paratuberculosis
gggcggacgggaccacccgca

SEQ ID NO: 850033 - RNA, 12 nt, Mycobacterium avium subsp. paratuberculosis
gggcgcugcgcg

SEQ ID NO: 850034 - RNA, 18 nt, Mycobacterium avium subsp. paratuberculosis
gggcgcucaucaggcggc

SEQ ID NO: 850035 - RNA, 22 nt, Mycobacterium avium subsp. paratuberculosis
gggcgcucaucaggcggccggc

SEQ ID NO: 850036 - RNA, 14 nt, Mycobacterium avium subsp. paratuberculosis
gggcgcguccgcgg

SEQ ID NO: 850037 - RNA, 20 nt, Mycobacterium avium subsp. paratuberculosis
gggcgcuagcugcgccggcu

SEQ ID NO: 850038 - RNA, 13 nt, Mycobacterium avium subsp. paratuberculosis
gggcgcucgaugg

SEQ ID NO: 850039 - RNA, 13 nt, Mycobacterium avium subsp. paratuberculosis
gggcgcucggcca

SEQ ID NO: 850040 - RNA, 14 nt, Mycobacterium avium subsp. paratuberculosis
gggcgcucggccag

SEQ ID NO: 850041 - RNA, 15 nt, Mycobacterium avium subsp. paratuberculosis
gggcgcucggccagc

SEQ ID NO: 850042 - RNA, 16 nt, Mycobacterium avium subsp. paratuberculosis
gggcgcucggccagca

SEQ ID NO: 850043 - RNA, 13 nt, Mycobacterium avium subsp. paratuberculosis
gggcgcgggccgc

SEQ ID NO: 850044 - RNA, 14 nt, Mycobacterium avium subsp. paratuberculosis
gggcgcggcgcacc

SEQ ID NO: 850045 - RNA, 15 nt, Mycobacterium avium subsp. paratuberculosis
gggcgcggcgcaccg

SEQ ID NO: 850046 - RNA, 12 nt, Mycobacterium avium subsp. paratuberculosis
gggcgcggcggc

SEQ ID NO: 850047 - RNA, 13 nt, Mycobacterium avium subsp. paratuberculosis
gggcgcggcggca

SEQ ID NO: 850048 - RNA, 15 nt, Mycobacterium avium subsp. paratuberculosis
gggcgcggcguagcc

SEQ ID NO: 850049 - RNA, 13 nt, Mycobacterium avium subsp. paratuberculosis
gggcgcggccagc

SEQ ID NO: 850050 - RNA, 17 nt, Mycobacterium avium subsp. paratuberculosis
gggcgcgcgccgggauc

SEQ ID NO: 850051 - RNA, 15 nt, Mycobacterium avium subsp. paratuberculosis
gggcgcgcgcgccac

SEQ ID NO: 850052 - RNA, 13 nt, Mycobacterium avium subsp. paratuberculosis
gggcgcgcgccgc

SEQ ID NO: 850053 - RNA, 23 nt, Mycobacterium avium subsp. paratuberculosis
gggcgcgcgccgcccccgcggcg

SEQ ID NO: 850054 - RNA, 14 nt, Mycobacterium avium subsp. paratuberculosis
gggcgcgccggcgc

SEQ ID NO: 850055 - RNA, 17 nt, Mycobacterium avium subsp. paratuberculosis
gggcgcgccggcgcgca

SEQ ID NO: 850056 - RNA, 21 nt, Mycobacterium avium subsp. paratuberculosis
gggcgcgaucaggcugccgcu

SEQ ID NO: 850057 - RNA, 17 nt, Mycobacterium avium subsp. paratuberculosis
gggcgcgaucggcaggu

SEQ ID NO: 850058 - RNA, 20 nt, Mycobacterium avium subsp. paratuberculosis
gggcgcgcaucugcucggcg

SEQ ID NO: 850059 - RNA, 12 nt, Mycobacterium avium subsp. paratuberculosis
gggcgcgcccac

SEQ ID NO: 850060 - RNA, 18 nt, Mycobacterium avium subsp. paratuberculosis
gggcgcgcagaucgucga

SEQ ID NO: 850061 - RNA, 15 nt, Mycobacterium avium subsp. paratuberculosis
gggcgcgcagcacca

SEQ ID NO: 850062 - RNA, 14 nt, Mycobacterium avium subsp. paratuberculosis
gggcgcgcagccac

SEQ ID NO: 850063 - RNA, 12 nt, Mycobacterium avium subsp. paratuberculosis
gggcgcgcagcg

SEQ ID NO: 850064 - RNA, 21 nt, Mycobacterium avium subsp. paratuberculosis
gggcgccuucuuggcggcggu

SEQ ID NO: 850065 - RNA, 20 nt, Mycobacterium avium subsp. paratuberculosis
gggcgcgaacagcgccgacu

SEQ ID NO: 850066 - RNA, 21 nt, Mycobacterium avium subsp. paratuberculosis
gggcgcgaagguggcgccggu

SEQ ID NO: 850067 - RNA, 14 nt, Mycobacterium avium subsp. paratuberculosis
gggcgccucgaaca

SEQ ID NO: 850068 - RNA, 15 nt, Mycobacterium avium subsp. paratuberculosis
gggcgccucgccgac

SEQ ID NO: 850069 - RNA, 12 nt, Mycobacterium avium subsp. paratuberculosis
gggcgccguugu

SEQ ID NO: 850070 - RNA, 22 nt, Mycobacterium avium subsp. paratuberculosis
gggcgccuaccggguggccagc

SEQ ID NO: 850071 - RNA, 23 nt, Mycobacterium avium subsp. paratuberculosis
gggcgccuaccggguggccagca

SEQ ID NO: 850072 - RNA, 12 nt, Mycobacterium avium subsp. paratuberculosis
gggcgccggccg

SEQ ID NO: 850073 - RNA, 17 nt, Mycobacterium avium subsp. paratuberculosis
gggcgccggcugcccgc

SEQ ID NO: 850074 - RNA, 22 nt, Mycobacterium avium subsp. paratuberculosis
gggcgccgguaucgagcaccag

SEQ ID NO: 850075 - RNA, 12 nt, Mycobacterium avium subsp. paratuberculosis
gggcgccggucg

SEQ ID NO: 850076 - RNA, 14 nt, Mycobacterium avium subsp. paratuberculosis
gggcgccggucggc

SEQ ID NO: 850077 - RNA, 12 nt, Mycobacterium avium subsp. paratuberculosis
gggcgccgucgc

SEQ ID NO: 850078 - RNA, 15 nt, Mycobacterium avium subsp. paratuberculosis
gggcgccgucgccgc

SEQ ID NO: 850079 - RNA, 15 nt, Mycobacterium avium subsp. paratuberculosis
gggcgccgucggcgg

SEQ ID NO: 850080 - RNA, 16 nt, Mycobacterium avium subsp. paratuberculosis
gggcgccgucggcggg

SEQ ID NO: 850081 - RNA, 12 nt, Mycobacterium avium subsp. paratuberculosis
gggcgccgcggc

SEQ ID NO: 850082 - RNA, 18 nt, Mycobacterium avium subsp. paratuberculosis
gggcgccgcggcgccgcc

SEQ ID NO: 850083 - RNA, 20 nt, Mycobacterium avium subsp. paratuberculosis
gggcgccgacgaucccggcg

SEQ ID NO: 850084 - RNA, 12 nt, Mycobacterium avium subsp. paratuberculosis
gggcgccgccgg

SEQ ID NO: 850085 - RNA, 13 nt, Mycobacterium avium subsp. paratuberculosis
gggcgccgccggc

SEQ ID NO: 850086 - RNA, 12 nt, Mycobacterium avium subsp. paratuberculosis
gggcgcccgcgg

SEQ ID NO: 850087 - RNA, 13 nt, Mycobacterium avium subsp. paratuberculosis
gggcgcccgagcc

SEQ ID NO: 850088 - RNA, 17 nt, Mycobacterium avium subsp. paratuberculosis
gggcgcccacccguugg

SEQ ID NO: 850089 - RNA, 13 nt, Mycobacterium avium subsp. paratuberculosis
gggcgccagcagc

SEQ ID NO: 850090 - RNA, 14 nt, Mycobacterium avium subsp. paratuberculosis
gggcgccagcccgc

SEQ ID NO: 850091 - RNA, 17 nt, Mycobacterium avium subsp. paratuberculosis
gggcgccagcccgccca

SEQ ID NO: 850092 - RNA, 19 nt, Mycobacterium avium subsp. paratuberculosis
gggcgccagcccgcccagc

SEQ ID NO: 850093 - RNA, 12 nt, Mycobacterium avium subsp. paratuberculosis
gggcgccagccg

SEQ ID NO: 850094 - RNA, 19 nt, Mycobacterium avium subsp. paratuberculosis
gggcgcacgaucgggcgca

SEQ ID NO: 850095 - RNA, 15 nt, Mycobacterium avium subsp. paratuberculosis
gggcgcagcccggcg

SEQ ID NO: 850096 - RNA, 16 nt, Mycobacterium avium subsp. paratuberculosis
gggcgcagcccggcgg

SEQ ID NO: 850097 - RNA, 14 nt, Mycobacterium avium subsp. paratuberculosis
gggcgcaccgccug

SEQ ID NO: 850098 - RNA, 17 nt, Mycobacterium avium subsp. paratuberculosis
gggggcuuuugcgucug

SEQ ID NO: 850099 - RNA, 18 nt, Mycobacterium avium subsp. paratuberculosis
gggggcuuuugcgucugc

SEQ ID NO: 850100 - RNA, 12 nt, Mycobacterium avium subsp. paratuberculosis
gggggcgcagcc

SEQ ID NO: 850101 - RNA, 14 nt, Mycobacterium avium subsp. paratuberculosis
ggggcuuuugcguc

SEQ ID NO: 850102 - RNA, 19 nt, Mycobacterium avium subsp. paratuberculosis
ggggcuuuugcgucugcuc

SEQ ID NO: 850103 - RNA, 20 nt, Mycobacterium avium subsp. paratuberculosis
ggggcuuuugcgucugcucg

SEQ ID NO: 850104 - RNA, 16 nt, Mycobacterium avium subsp. paratuberculosis
ggggcuucgaacgccc

SEQ ID NO: 850105 - RNA, 22 nt, Mycobacterium avium subsp. paratuberculosis
ggggcuugagcgcgucgucgcc

SEQ ID NO: 850106 - RNA, 16 nt, Mycobacterium avium subsp. paratuberculosis
gggggagggucggugg

SEQ ID NO: 850107 - RNA, 20 nt, Mycobacterium avium subsp. paratuberculosis
gggggagucggggugcucga

SEQ ID NO: 850108 - RNA, 23 nt, Mycobacterium avium subsp. paratuberculosis
gggggaagcccagcacccgcucg

SEQ ID NO: 850109 - RNA, 20 nt, Mycobacterium avium subsp. paratuberculosis
gggggauuucacgucugcuc

SEQ ID NO: 850110 - RNA, 17 nt, Mycobacterium avium subsp. paratuberculosis
ggggcgcagcccggcgg

SEQ ID NO: 850111 - RNA, 21 nt, Mycobacterium avium subsp. paratuberculosis
ggggcgcagcccggcgguuga

SEQ ID NO: 850112 - RNA, 13 nt, Mycobacterium avium subsp. paratuberculosis
ggggcgcagccga

SEQ ID NO: 850113 - RNA, 20 nt, Mycobacterium avium subsp. paratuberculosis
ggggcgccacuucuccacgc

SEQ ID NO: 850114 - RNA, 15 nt, Mycobacterium avium subsp. paratuberculosis
ggggcgagcuggccg

SEQ ID NO: 850115 - RNA, 19 nt, Mycobacterium avium subsp. paratuberculosis
ggggcgagcuggccgccca

SEQ ID NO: 850116 - RNA, 20 nt, Mycobacterium avium subsp. paratuberculosis
ggggcgagcuggccgcccac

SEQ ID NO: 850117 - RNA, 16 nt, Mycobacterium avium subsp. paratuberculosis
ggggccuucuuggcgg

SEQ ID NO: 850118 - RNA, 20 nt, Mycobacterium avium subsp. paratuberculosis
ggggccuucuuggcggcggc

SEQ ID NO: 850119 - RNA, 19 nt, Mycobacterium avium subsp. paratuberculosis
ggggcgaccuggacgccgc

SEQ ID NO: 850120 - RNA, 14 nt, Mycobacterium avium subsp. paratuberculosis
ggggcgacgggccg

SEQ ID NO: 850121 - RNA, 19 nt, Mycobacterium avium subsp. paratuberculosis
ggggccucgucgccgcggu

SEQ ID NO: 850122 - RNA, 13 nt, Mycobacterium avium subsp. paratuberculosis
ggggccugcggga

SEQ ID NO: 850123 - RNA, 16 nt, Mycobacterium avium subsp. paratuberculosis
ggggccggcgcggugc

SEQ ID NO: 850124 - RNA, 19 nt, Mycobacterium avium subsp. paratuberculosis
ggggccggcgcuggcgugc

SEQ ID NO: 850125 - RNA, 13 nt, Mycobacterium avium subsp. paratuberculosis
ggggccggcggcg

SEQ ID NO: 850126 - RNA, 17 nt, Mycobacterium avium subsp. paratuberculosis
ggggccggcggcggcca

SEQ ID NO: 850127 - RNA, 15 nt, Mycobacterium avium subsp. paratuberculosis
ggggccggcgggggc

SEQ ID NO: 850128 - RNA, 22 nt, Mycobacterium avium subsp. paratuberculosis
ggggccggugcguccgccggcg

SEQ ID NO: 850129 - RNA, 15 nt, Mycobacterium avium subsp. paratuberculosis
ggggccgguuggugc

SEQ ID NO: 850130 - RNA, 13 nt, Mycobacterium avium subsp. paratuberculosis
ggggccggccgcc

SEQ ID NO: 850131 - RNA, 14 nt, Mycobacterium avium subsp. paratuberculosis
ggggccggccgccc

SEQ ID NO: 850132 - RNA, 13 nt, Mycobacterium avium subsp. paratuberculosis
ggggccgcggccg

SEQ ID NO: 850133 - RNA, 15 nt, Mycobacterium avium subsp. paratuberculosis
ggggccgcggccggc

SEQ ID NO: 850134 - RNA, 16 nt, Mycobacterium avium subsp. paratuberculosis
ggggccgcggccggca

SEQ ID NO: 850135 - RNA, 23 nt, Mycobacterium avium subsp. paratuberculosis
ggggccgaugaccgcggcgggca

SEQ ID NO: 850136 - RNA, 22 nt, Mycobacterium avium subsp. paratuberculosis
ggggccgcaccugaucgaugcc

SEQ ID NO: 850137 - RNA, 17 nt, Mycobacterium avium subsp. paratuberculosis
ggggagggucgguggcc

SEQ ID NO: 850138 - RNA, 14 nt, Mycobacterium avium subsp. paratuberculosis
ggggaucaccucgc

SEQ ID NO: 850139 - RNA, 22 nt, Mycobacterium avium subsp. paratuberculosis
ggggaugccgaaccgcugcgga

SEQ ID NO: 850140 - RNA, 14 nt, Mycobacterium avium subsp. paratuberculosis
ggggaugcgcaucc

SEQ ID NO: 850141 - RNA, 14 nt, Mycobacterium avium subsp. paratuberculosis
gggcuggccguccg

SEQ ID NO: 850142 - RNA, 12 nt, Mycobacterium avium subsp. paratuberculosis
gggcuggcggcg

SEQ ID NO: 850143 - RNA, 21 nt, Mycobacterium avium subsp. paratuberculosis
gggcugucgggcaggccggug

SEQ ID NO: 850144 - RNA, 14 nt, Mycobacterium avium subsp. paratuberculosis
gggcugugccggcg

SEQ ID NO: 850145 - RNA, 16 nt, Mycobacterium avium subsp. paratuberculosis
gggcugugccggcggg

SEQ ID NO: 850146 - RNA, 21 nt, Mycobacterium avium subsp. paratuberculosis
gggcugugggcgcagggccgc

SEQ ID NO: 850147 - RNA, 17 nt, Mycobacterium avium subsp. paratuberculosis
gggcugucccggccgcg

SEQ ID NO: 850148 - RNA, 18 nt, Mycobacterium avium subsp. paratuberculosis
gggcugucccggccgcga

SEQ ID NO: 850149 - RNA, 20 nt, Mycobacterium avium subsp. paratuberculosis
gggcugucccggccgcgaca

SEQ ID NO: 850150 - RNA, 18 nt, Mycobacterium avium subsp. paratuberculosis
gggcuugcgcaacagcgu

SEQ ID NO: 850151 - RNA, 14 nt, Mycobacterium avium subsp. paratuberculosis
gggcuuggcgacga

SEQ ID NO: 850152 - RNA, 20 nt, Mycobacterium avium subsp. paratuberculosis
ggggacuuucgcgucugcuc

SEQ ID NO: 850153 - RNA, 21 nt, Mycobacterium avium subsp. paratuberculosis
ggggacuuucgcgucugcucg

SEQ ID NO: 850154 - RNA, 20 nt, Mycobacterium avium subsp. paratuberculosis
ggggagccgaagaucaccgc

SEQ ID NO: 850155 - RNA, 15 nt, Mycobacterium avium subsp. paratuberculosis
ggggacggguugcgg

SEQ ID NO: 850156 - RNA, 15 nt, Mycobacterium avium subsp. paratuberculosis
ggggacggugcagcc

SEQ ID NO: 850157 - RNA, 20 nt, Mycobacterium avium subsp. paratuberculosis
ggggaaguccgggucgcgga

SEQ ID NO: 850158 - RNA, 22 nt, Mycobacterium avium subsp. paratuberculosis
ggggaccagcgcaaccgcggcg

SEQ ID NO: 850159 - RNA, 19 nt, Mycobacterium avium subsp. paratuberculosis
gggcuuuugcgucugcucg

SEQ ID NO: 850160 - RNA, 19 nt, Mycobacterium avium subsp. paratuberculosis
gggcuugggcccgucggcg

SEQ ID NO: 850161 - RNA, 13 nt, Mycobacterium avium subsp. paratuberculosis
gggcgucggcgcc

SEQ ID NO: 850162 - RNA, 19 nt, Mycobacterium avium subsp. paratuberculosis
gggcgucguggucgacgcc

SEQ ID NO: 850163 - RNA, 12 nt, Mycobacterium avium subsp. paratuberculosis
gggcgugacgcc

SEQ ID NO: 850164 - RNA, 14 nt, Mycobacterium avium subsp. paratuberculosis
gggcgucucgaacc

SEQ ID NO: 850165 - RNA, 19 nt, Mycobacterium avium subsp. paratuberculosis
gggcgugcgguuggcccgc

SEQ ID NO: 850166 - RNA, 15 nt, Mycobacterium avium subsp. paratuberculosis
gggcgugcccggcgc

SEQ ID NO: 850167 - RNA, 21 nt, Mycobacterium avium subsp. paratuberculosis
gggcguggaacgcgucgcgcc

SEQ ID NO: 850168 - RNA, 21 nt, Mycobacterium avium subsp. paratuberculosis
gggcgugccggacaccggcac

SEQ ID NO: 850169 - RNA, 22 nt, Mycobacterium avium subsp. paratuberculosis
gggcgugccggacaccggcacg

SEQ ID NO: 850170 - RNA, 16 nt, Mycobacterium avium subsp. paratuberculosis
gggcgugccggcccgg

SEQ ID NO: 850171 - RNA, 18 nt, Mycobacterium avium subsp. paratuberculosis
gggcgugccggcggcgga

SEQ ID NO: 850172 - RNA, 14 nt, Mycobacterium avium subsp. paratuberculosis
gggcgugcgcggcc

SEQ ID NO: 850173 - RNA, 19 nt, Mycobacterium avium subsp. paratuberculosis
gggcgugcgcggccgccca

SEQ ID NO: 850174 - RNA, 18 nt, Mycobacterium avium subsp. paratuberculosis
gggcuaaccaccggugac

SEQ ID NO: 850175 - RNA, 22 nt, Mycobacterium avium subsp. paratuberculosis
gggcuaagucguugcccgccag

SEQ ID NO: 850176 - RNA, 20 nt, Mycobacterium avium subsp. paratuberculosis
gggcguugcccgccgcggcg

SEQ ID NO: 850177 - RNA, 20 nt, Mycobacterium avium subsp. paratuberculosis
gggcguugcccgucgccucc

SEQ ID NO: 850178 - RNA, 20 nt, Mycobacterium avium subsp. paratuberculosis
gggcguggucgccguuggcg

SEQ ID NO: 850179 - RNA, 22 nt, Mycobacterium avium subsp. paratuberculosis
gggcguugcgcucuguuggccg

SEQ ID NO: 850180 - RNA, 18 nt, Mycobacterium avium subsp. paratuberculosis
gggcguugguugcggccc

SEQ ID NO: 850181 - RNA, 20 nt, Mycobacterium avium subsp. paratuberculosis
gggcguuguaauaccugcgu

SEQ ID NO: 850182 - RNA, 14 nt, Mycobacterium avium subsp. paratuberculosis
gggcguggcgucgg

SEQ ID NO: 850183 - RNA, 23 nt, Mycobacterium avium subsp. paratuberculosis
gggcguucaucaccuggucgggu

SEQ ID NO: 850184 - RNA, 21 nt, Mycobacterium avium subsp. paratuberculosis
gggcguucgacguccaccgga

SEQ ID NO: 850185 - RNA, 17 nt, Mycobacterium avium subsp. paratuberculosis
gggcguguagccugcgg

SEQ ID NO: 850186 - RNA, 18 nt, Mycobacterium avium subsp. paratuberculosis
gggcguguagccugcggc

SEQ ID NO: 850187 - RNA, 19 nt, Mycobacterium avium subsp. paratuberculosis
gggcguguagccugcggcc

SEQ ID NO: 850188 - RNA, 20 nt, Mycobacterium avium subsp. paratuberculosis
gggcguguagccugcggccu

SEQ ID NO: 850189 - RNA, 22 nt, Mycobacterium avium subsp. paratuberculosis
gggcguguagccugcggccugc

SEQ ID NO: 850190 - RNA, 15 nt, Mycobacterium avium subsp. paratuberculosis
gggcguccucgucgg

SEQ ID NO: 850191 - RNA, 14 nt, Mycobacterium avium subsp. paratuberculosis
gggcguccugcggg

SEQ ID NO: 850192 - RNA, 18 nt, Mycobacterium avium subsp. paratuberculosis
gggcguccuugaccagcu

SEQ ID NO: 850193 - RNA, 11 nt, Mycobacterium avium subsp. paratuberculosis
gggcgucgacg

SEQ ID NO: 850194 - RNA, 12 nt, Mycobacterium avium subsp. paratuberculosis
gggcgucgacga

SEQ ID NO: 850195 - RNA, 13 nt, Mycobacterium avium subsp. paratuberculosis
gggcgucgcccgc

SEQ ID NO: 850196 - RNA, 15 nt, Mycobacterium avium subsp. paratuberculosis
gggcguacagcggcg

SEQ ID NO: 850197 - RNA, 17 nt, Mycobacterium avium subsp. paratuberculosis
gggcguacagcggcgcc

SEQ ID NO: 850198 - RNA, 18 nt, Mycobacterium avium subsp. paratuberculosis
gggcguacagcggcgcca

SEQ ID NO: 850199 - RNA, 22 nt, Mycobacterium avium subsp. paratuberculosis
gggcguacugcucggcgcggcu

SEQ ID NO: 850200 - RNA, 21 nt, Mycobacterium avium subsp. paratuberculosis
gggcguagucgauggccucgu

SEQ ID NO: 850201 - RNA, 23 nt, Mycobacterium avium subsp. paratuberculosis
gggcguagucgauggccucgucg

SEQ ID NO: 850202 - RNA, 19 nt, Mycobacterium avium subsp. paratuberculosis
gggcgucacgcaucagggc

SEQ ID NO: 850203 - RNA, 12 nt, Mycobacterium avium subsp. paratuberculosis
gggcgucacgcc

SEQ ID NO: 850204 - RNA, 17 nt, Mycobacterium avium subsp. paratuberculosis
gggcgucacgccagcgu

SEQ ID NO: 850205 - RNA, 19 nt, Mycobacterium avium subsp. paratuberculosis
gggcgucacgccagcguga

SEQ ID NO: 850206 - RNA, 20 nt, Mycobacterium avium subsp. paratuberculosis
gggcggugcggugcgccgca

SEQ ID NO: 850207 - RNA, 18 nt, Mycobacterium avium subsp. paratuberculosis
gggcgguggcggcgaacg

SEQ ID NO: 850208 - RNA, 15 nt, Mycobacterium avium subsp. paratuberculosis
gggcgguccgcucca

SEQ ID NO: 850209 - RNA, 19 nt, Mycobacterium avium subsp. paratuberculosis
gggcgguccaccgacgcca

SEQ ID NO: 850210 - RNA, 12 nt, Mycobacterium avium subsp. paratuberculosis
gggcgggcucga

SEQ ID NO: 850211 - RNA, 14 nt, Mycobacterium avium subsp. paratuberculosis
gggcgggucgucga

SEQ ID NO: 850212 - RNA, 16 nt, Mycobacterium avium subsp. paratuberculosis
gggcggggggcgagcc

SEQ ID NO: 850213 - RNA, 13 nt, Mycobacterium avium subsp. paratuberculosis
gggcgggguggcc

SEQ ID NO: 850214 - RNA, 19 nt, Mycobacterium avium subsp. paratuberculosis
gggcggggugugcggcacg

SEQ ID NO: 850215 - RNA, 19 nt, Mycobacterium avium subsp. paratuberculosis
gggcgggcaccucgaugcc

SEQ ID NO: 850216 - RNA, 15 nt, Mycobacterium avium subsp. paratuberculosis
gggcgggcagccgcu

SEQ ID NO: 850217 - RNA, 17 nt, Mycobacterium avium subsp. paratuberculosis
gggcgggccagcucgaa

SEQ ID NO: 850218 - RNA, 13 nt, Mycobacterium avium subsp. paratuberculosis
gggcgggccgcag

SEQ ID NO: 850219 - RNA, 15 nt, Mycobacterium avium subsp. paratuberculosis
gggcgggccgcagca

SEQ ID NO: 850220 - RNA, 22 nt, Mycobacterium avium subsp. paratuberculosis
gggcugcggcgagucccggcgc

SEQ ID NO: 850221 - RNA, 19 nt, Mycobacterium avium subsp. paratuberculosis
gggcugcgcuugcggcgca

SEQ ID NO: 850222 - RNA, 21 nt, Mycobacterium avium subsp. paratuberculosis
gggcugcgcuugcggcgcagc

SEQ ID NO: 850223 - RNA, 16 nt, Mycobacterium avium subsp. paratuberculosis
gggcugcgcagcaccg

SEQ ID NO: 850224 - RNA, 21 nt, Mycobacterium avium subsp. paratuberculosis
gggcugauccgcgacgccaac

SEQ ID NO: 850225 - RNA, 21 nt, Mycobacterium avium subsp. paratuberculosis
gggcugcaacaacuucggggu

SEQ ID NO: 850226 - RNA, 19 nt, Mycobacterium avium subsp. paratuberculosis
gggcugcaucuccagccgc

SEQ ID NO: 850227 - RNA, 22 nt, Mycobacterium avium subsp. paratuberculosis
gggcugcaucuccagccgcggc

SEQ ID NO: 850228 - RNA, 20 nt, Mycobacterium avium subsp. paratuberculosis
gggcugagcugugccgcggu

SEQ ID NO: 850229 - RNA, 14 nt, Mycobacterium avium subsp. paratuberculosis
gggcugaccgccag

SEQ ID NO: 850230 - RNA, 12 nt, Mycobacterium avium subsp. paratuberculosis
gggcugaccucg

SEQ ID NO: 850231 - RNA, 18 nt, Mycobacterium avium subsp. paratuberculosis
gggcugaccucgccgccc

SEQ ID NO: 850232 - RNA, 14 nt, Mycobacterium avium subsp. paratuberculosis
gggcucgugcagcc

SEQ ID NO: 850233 - RNA, 18 nt, Mycobacterium avium subsp. paratuberculosis
gggcucgugcagccggcg

SEQ ID NO: 850234 - RNA, 18 nt, Mycobacterium avium subsp. paratuberculosis
gggcucggccaucccggu

SEQ ID NO: 850235 - RNA, 20 nt, Mycobacterium avium subsp. paratuberculosis
gggcucggccaucccggugc

SEQ ID NO: 850236 - RNA, 14 nt, Mycobacterium avium subsp. paratuberculosis
gggcucggccgccg

SEQ ID NO: 850237 - RNA, 18 nt, Mycobacterium avium subsp. paratuberculosis
gggcucggccgccgacac

SEQ ID NO: 850238 - RNA, 21 nt, Mycobacterium avium subsp. paratuberculosis
gggcucggccgccgacaccac

SEQ ID NO: 850239 - RNA, 23 nt, Mycobacterium avium subsp. paratuberculosis
gggcucggccgccgacaccacca

SEQ ID NO: 850240 - RNA, 19 nt, Mycobacterium avium subsp. paratuberculosis
gggcucccgcuccauggcg

SEQ ID NO: 850241 - RNA, 15 nt, Mycobacterium avium subsp. paratuberculosis
gggcucccgcucgcc

SEQ ID NO: 850242 - RNA, 19 nt, Mycobacterium avium subsp. paratuberculosis
gggcucggcgccgaccucg

SEQ ID NO: 850243 - RNA, 14 nt, Mycobacterium avium subsp. paratuberculosis
gggcucggcgucgu

SEQ ID NO: 850244 - RNA, 17 nt, Mycobacterium avium subsp. paratuberculosis
gggcucgcgcuggcggc

SEQ ID NO: 850245 - RNA, 16 nt, Mycobacterium avium subsp. paratuberculosis
gggcucgcggccugcg

SEQ ID NO: 850246 - RNA, 18 nt, Mycobacterium avium subsp. paratuberculosis
gggcucgcggccugcggg

SEQ ID NO: 850247 - RNA, 22 nt, Mycobacterium avium subsp. paratuberculosis
gggcucgcgggugucgagccac

SEQ ID NO: 850248 - RNA, 22 nt, Mycobacterium avium subsp. paratuberculosis
gggcucgaacaacccggccgcg

SEQ ID NO: 850249 - RNA, 23 nt, Mycobacterium avium subsp. paratuberculosis
gggcucgaacaacccggccgcga

SEQ ID NO: 850250 - RNA, 15 nt, Mycobacterium avium subsp. paratuberculosis
gggcucgagcaacac

SEQ ID NO: 850251 - RNA, 20 nt, Mycobacterium avium subsp. paratuberculosis
gggcucgagggcggcgaccu

SEQ ID NO: 850252 - RNA, 18 nt, Mycobacterium avium subsp. paratuberculosis
gggcucgagugccggcag

SEQ ID NO: 850253 - RNA, 23 nt, Mycobacterium avium subsp. paratuberculosis
gggcucgauguugaucgccaugc

SEQ ID NO: 850254 - RNA, 18 nt, Mycobacterium avium subsp. paratuberculosis
gggcuagacgcgcaccag

SEQ ID NO: 850255 - RNA, 16 nt, Mycobacterium avium subsp. paratuberculosis
gggcuaucgcccggcg

SEQ ID NO: 850256 - RNA, 20 nt, Mycobacterium avium subsp. paratuberculosis
gggcuaucgcccggcgcccg

SEQ ID NO: 850257 - RNA, 12 nt, Mycobacterium avium subsp. paratuberculosis
gggcucaccaca

SEQ ID NO: 850258 - RNA, 17 nt, Mycobacterium avium subsp. paratuberculosis
gggcucaacaggcgagu

SEQ ID NO: 850259 - RNA, 20 nt, Mycobacterium avium subsp. paratuberculosis
gggcucauacggcggcucgg

SEQ ID NO: 850260 - RNA, 21 nt, Mycobacterium avium subsp. paratuberculosis
gggcuccagcggguccagccg

SEQ ID NO: 850261 - RNA, 23 nt, Mycobacterium avium subsp. paratuberculosis
gggcucccagucccagcacagcc

SEQ ID NO: 850262 - RNA, 17 nt, Mycobacterium avium subsp. paratuberculosis
gggauugccgagcaccc

SEQ ID NO: 850263 - RNA, 19 nt, Mycobacterium avium subsp. paratuberculosis
gggauugccgggcaccagc

SEQ ID NO: 850264 - RNA, 16 nt, Mycobacterium avium subsp. paratuberculosis
gggauuggcggccaac

SEQ ID NO: 850265 - RNA, 20 nt, Mycobacterium avium subsp. paratuberculosis
gggauuucacgucugcucgg

SEQ ID NO: 850266 - RNA, 22 nt, Mycobacterium avium subsp. paratuberculosis
gggauuucacgucugcucggcg

SEQ ID NO: 850267 - RNA, 16 nt, Mycobacterium avium subsp. paratuberculosis
gggauggugaccagcg

SEQ ID NO: 850268 - RNA, 18 nt, Mycobacterium avium subsp. paratuberculosis
gggauggugaccagcgcc

SEQ ID NO: 850269 - RNA, 21 nt, Mycobacterium avium subsp. paratuberculosis
gggauguagccgccgguggcg

SEQ ID NO: 850270 - RNA, 14 nt, Mycobacterium avium subsp. paratuberculosis
gggaugggugguca

SEQ ID NO: 850271 - RNA, 14 nt, Mycobacterium avium subsp. paratuberculosis
gggcaacgcgccgg

SEQ ID NO: 850272 - RNA, 18 nt, Mycobacterium avium subsp. paratuberculosis
gggcaacgcgccggcggu

SEQ ID NO: 850273 - RNA, 13 nt, Mycobacterium avium subsp. paratuberculosis
gggcaacagcgcg

SEQ ID NO: 850274 - RNA, 16 nt, Mycobacterium avium subsp. paratuberculosis
gggaugcggucgauca

SEQ ID NO: 850275 - RNA, 13 nt, Mycobacterium avium subsp. paratuberculosis
gggauggacgacg

SEQ ID NO: 850276 - RNA, 14 nt, Mycobacterium avium subsp. paratuberculosis
gggauggacgacgu

SEQ ID NO: 850277 - RNA, 12 nt, Mycobacterium avium subsp. paratuberculosis
gggauggcggcg

SEQ ID NO: 850278 - RNA, 23 nt, Mycobacterium avium subsp. paratuberculosis
gggauggcucagcgcaccgccgu

SEQ ID NO: 850279 - RNA, 17 nt, Mycobacterium avium subsp. paratuberculosis
gggaugccugcccgcgc

SEQ ID NO: 850280 - RNA, 14 nt, Mycobacterium avium subsp. paratuberculosis
gggaugcgccaccg

SEQ ID NO: 850281 - RNA, 21 nt, Mycobacterium avium subsp. paratuberculosis
gggaugcgccaccgacaccac

SEQ ID NO: 850282 - RNA, 22 nt, Mycobacterium avium subsp. paratuberculosis
gggaugaacucgugcggcgccg

SEQ ID NO: 850283 - RNA, 19 nt, Mycobacterium avium subsp. paratuberculosis
gggaugacaccgcggacca

SEQ ID NO: 850284 - RNA, 13 nt, Mycobacterium avium subsp. paratuberculosis
gggaugaucggcg

SEQ ID NO: 850285 - RNA, 15 nt, Mycobacterium avium subsp. paratuberculosis
gggaugcccggggga

SEQ ID NO: 850286 - RNA, 15 nt, Mycobacterium avium subsp. paratuberculosis
gggaugccgagcagc

SEQ ID NO: 850287 - RNA, 13 nt, Mycobacterium avium subsp. paratuberculosis
gggaucgucgccg

SEQ ID NO: 850288 - RNA, 15 nt, Mycobacterium avium subsp. paratuberculosis
gggaucggcggcggg

SEQ ID NO: 850289 - RNA, 12 nt, Mycobacterium avium subsp. paratuberculosis
gggaucggcggg

SEQ ID NO: 850290 - RNA, 18 nt, Mycobacterium avium subsp. paratuberculosis
gggaucggcggggcgcgu

SEQ ID NO: 850291 - RNA, 22 nt, Mycobacterium avium subsp. paratuberculosis
gggaucggcuuggugggcgccg

SEQ ID NO: 850292 - RNA, 16 nt, Mycobacterium avium subsp. paratuberculosis
gggaucggaccgcacc

SEQ ID NO: 850293 - RNA, 20 nt, Mycobacterium avium subsp. paratuberculosis
gggaucggaccgcaccacca

SEQ ID NO: 850294 - RNA, 13 nt, Mycobacterium avium subsp. paratuberculosis
gggaucggccggc

SEQ ID NO: 850295 - RNA, 14 nt, Mycobacterium avium subsp. paratuberculosis
gggaucggccggcg

SEQ ID NO: 850296 - RNA, 15 nt, Mycobacterium avium subsp. paratuberculosis
gggaucggccggcga

SEQ ID NO: 850297 - RNA, 23 nt, Mycobacterium avium subsp. paratuberculosis
gggaucggcgcccaccgcggcgc

SEQ ID NO: 850298 - RNA, 12 nt, Mycobacterium avium subsp. paratuberculosis
gggaucgccgaa

SEQ ID NO: 850299 - RNA, 11 nt, Mycobacterium avium subsp. paratuberculosis
gggaucgcgca

SEQ ID NO: 850300 - RNA, 18 nt, Mycobacterium avium subsp. paratuberculosis
gggaucgcgcagccgcgg

SEQ ID NO: 850301 - RNA, 21 nt, Mycobacterium avium subsp. paratuberculosis
gggaucgcgcagccgcggugg

SEQ ID NO: 850302 - RNA, 22 nt, Mycobacterium avium subsp. paratuberculosis
gggcaauaccggcagcaggugc

SEQ ID NO: 850303 - RNA, 14 nt, Mycobacterium avium subsp. paratuberculosis
gggcaaccgcagca

SEQ ID NO: 850304 - RNA, 16 nt, Mycobacterium avium subsp. paratuberculosis
gggcaaccgcagcauc

SEQ ID NO: 850305 - RNA, 14 nt, Mycobacterium avium subsp. paratuberculosis
gggcaagcagcggc

SEQ ID NO: 850306 - RNA, 16 nt, Mycobacterium avium subsp. paratuberculosis
gggcaccgacggccgc

SEQ ID NO: 850307 - RNA, 23 nt, Mycobacterium avium subsp. paratuberculosis
gggcaccccugccgccaccgcga

SEQ ID NO: 850308 - RNA, 18 nt, Mycobacterium avium subsp. paratuberculosis
gggcacccgacgucgacg

SEQ ID NO: 850309 - RNA, 13 nt, Mycobacterium avium subsp. paratuberculosis
gggcacccgcgcg

SEQ ID NO: 850310 - RNA, 20 nt, Mycobacterium avium subsp. paratuberculosis
gggcacccggguggacaccg

SEQ ID NO: 850311 - RNA, 23 nt, Mycobacterium avium subsp. paratuberculosis
gggcacccggguggacaccgcga

SEQ ID NO: 850312 - RNA, 13 nt, Mycobacterium avium subsp. paratuberculosis
gggcacacgcggu

SEQ ID NO: 850313 - RNA, 13 nt, Mycobacterium avium subsp. paratuberculosis
gggcacagccagc

SEQ ID NO: 850314 - RNA, 11 nt, Mycobacterium avium subsp. paratuberculosis
gggcaccacgg

SEQ ID NO: 850315 - RNA, 11 nt, Mycobacterium avium subsp. paratuberculosis
gggcaccacgu

SEQ ID NO: 850316 - RNA, 12 nt, Mycobacterium avium subsp. paratuberculosis
gggcaccagcac

SEQ ID NO: 850317 - RNA, 12 nt, Mycobacterium avium subsp. paratuberculosis
gggcaccagcga

SEQ ID NO: 850318 - RNA, 17 nt, Mycobacterium avium subsp. paratuberculosis
gggcaccagcgacagca

SEQ ID NO: 850319 - RNA, 18 nt, Mycobacterium avium subsp. paratuberculosis
gggcaccagcgcgacggu

SEQ ID NO: 850320 - RNA, 17 nt, Mycobacterium avium subsp. paratuberculosis
gggcagccaaccgccgg

SEQ ID NO: 850321 - RNA, 13 nt, Mycobacterium avium subsp. paratuberculosis
gggcagccacauc

SEQ ID NO: 850322 - RNA, 15 nt, Mycobacterium avium subsp. paratuberculosis
gggcagccagcccgc

SEQ ID NO: 850323 - RNA, 12 nt, Mycobacterium avium subsp. paratuberculosis
gggcagccccag

SEQ ID NO: 850324 - RNA, 19 nt, Mycobacterium avium subsp. paratuberculosis
gggcagccccagcgagcag

SEQ ID NO: 850325 - RNA, 13 nt, Mycobacterium avium subsp. paratuberculosis
gggcagcagcauc

SEQ ID NO: 850326 - RNA, 16 nt, Mycobacterium avium subsp. paratuberculosis
gggcagcagcaccagc

SEQ ID NO: 850327 - RNA, 20 nt, Mycobacterium avium subsp. paratuberculosis
gggcagcagcagaucggcgu

SEQ ID NO: 850328 - RNA, 20 nt, Mycobacterium avium subsp. paratuberculosis
gggcagcaccagcggcacca

SEQ ID NO: 850329 - RNA, 19 nt, Mycobacterium avium subsp. paratuberculosis
gggcagauaggcggcgacg

SEQ ID NO: 850330 - RNA, 20 nt, Mycobacterium avium subsp. paratuberculosis
gggcagauaggcggcgacgg

SEQ ID NO: 850331 - RNA, 17 nt, Mycobacterium avium subsp. paratuberculosis
gggcagaugcccgcuga

SEQ ID NO: 850332 - RNA, 20 nt, Mycobacterium avium subsp. paratuberculosis
gggcagaccgugugccagcc

SEQ ID NO: 850333 - RNA, 16 nt, Mycobacterium avium subsp. paratuberculosis
gggcacguacgcgcug

SEQ ID NO: 850334 - RNA, 13 nt, Mycobacterium avium subsp. paratuberculosis
gggcacguccagc

SEQ ID NO: 850335 - RNA, 16 nt, Mycobacterium avium subsp. paratuberculosis
gggcacguccagcccg

SEQ ID NO: 850336 - RNA, 18 nt, Mycobacterium avium subsp. paratuberculosis
gggcacguccagcccgcg

SEQ ID NO: 850337 - RNA, 20 nt, Mycobacterium avium subsp. paratuberculosis
gggcacguccccgugcagcc

SEQ ID NO: 850338 - RNA, 13 nt, Mycobacterium avium subsp. paratuberculosis
gggcacgucgacg

SEQ ID NO: 850339 - RNA, 16 nt, Mycobacterium avium subsp. paratuberculosis
gggcacgucgcgcggg

SEQ ID NO: 850340 - RNA, 14 nt, Mycobacterium avium subsp. paratuberculosis
gggcacggcgaugu

SEQ ID NO: 850341 - RNA, 14 nt, Mycobacterium avium subsp. paratuberculosis
gggcacgcgagacg

SEQ ID NO: 850342 - RNA, 15 nt, Mycobacterium avium subsp. paratuberculosis
gggcacgcagcggcg

SEQ ID NO: 850343 - RNA, 20 nt, Mycobacterium avium subsp. paratuberculosis
gggcacgcagcggcgucacg

SEQ ID NO: 850344 - RNA, 16 nt, Mycobacterium avium subsp. paratuberculosis
gggcaccucggccagg

SEQ ID NO: 850345 - RNA, 13 nt, Mycobacterium avium subsp. paratuberculosis
gggcaccucggcg

SEQ ID NO: 850346 - RNA, 22 nt, Mycobacterium avium subsp. paratuberculosis
gggcaccgccagucugagcccg

SEQ ID NO: 850347 - RNA, 12 nt, Mycobacterium avium subsp. paratuberculosis
gggcaccgcgcc

SEQ ID NO: 850348 - RNA, 15 nt, Mycobacterium avium subsp. paratuberculosis
gggcaccgcgcccgc

SEQ ID NO: 850349 - RNA, 20 nt, Mycobacterium avium subsp. paratuberculosis
gggaggucgucgcguccagc

SEQ ID NO: 850350 - RNA, 12 nt, Mycobacterium avium subsp. paratuberculosis
gggauaccgcga

SEQ ID NO: 850351 - RNA, 21 nt, Mycobacterium avium subsp. paratuberculosis
gggauagauguugcggccggc

SEQ ID NO: 850352 - RNA, 13 nt, Mycobacterium avium subsp. paratuberculosis
gggauagggcgcg

SEQ ID NO: 850353 - RNA, 14 nt, Mycobacterium avium subsp. paratuberculosis
gggauagggcgcgu

SEQ ID NO: 850354 - RNA, 23 nt, Mycobacterium avium subsp. paratuberculosis
gggauaguucgccgccgccagca

SEQ ID NO: 850355 - RNA, 18 nt, Mycobacterium avium subsp. paratuberculosis
gggaucacacgcgcgccc

SEQ ID NO: 850356 - RNA, 17 nt, Mycobacterium avium subsp. paratuberculosis
gggaucaccucaucgcc

SEQ ID NO: 850357 - RNA, 19 nt, Mycobacterium avium subsp. paratuberculosis
gggaucaccucaucgccca

SEQ ID NO: 850358 - RNA, 16 nt, Mycobacterium avium subsp. paratuberculosis
gggaucaccucgcuga

SEQ ID NO: 850359 - RNA, 16 nt, Mycobacterium avium subsp. paratuberculosis
gggaucagcagcaccg

SEQ ID NO: 850360 - RNA, 22 nt, Mycobacterium avium subsp. paratuberculosis
gggaucagccguaccgauccgc

SEQ ID NO: 850361 - RNA, 20 nt, Mycobacterium avium subsp. paratuberculosis
gggaucaggaugacgccgcg

SEQ ID NO: 850362 - RNA, 14 nt, Mycobacterium avium subsp. paratuberculosis
gggauccagcggcg

SEQ ID NO: 850363 - RNA, 19 nt, Mycobacterium avium subsp. paratuberculosis
gggauccgccugcgcgggc

SEQ ID NO: 850364 - RNA, 22 nt, Mycobacterium avium subsp. paratuberculosis
gggauccgccugcgcgggcgcg

SEQ ID NO: 850365 - RNA, 22 nt, Mycobacterium avium subsp. paratuberculosis
gggauccggauugccgggcagc

SEQ ID NO: 850366 - RNA, 17 nt, Mycobacterium avium subsp. paratuberculosis
gggauccggcgcgccgc

SEQ ID NO: 850367 - RNA, 18 nt, Mycobacterium avium subsp. paratuberculosis
gggauccggcgcgccgcg

SEQ ID NO: 850368 - RNA, 20 nt, Mycobacterium avium subsp. paratuberculosis
gggauccggcgcgccgcgau

SEQ ID NO: 850369 - RNA, 15 nt, Mycobacterium avium subsp. paratuberculosis
gggauccucgccgcg

SEQ ID NO: 850370 - RNA, 20 nt, Mycobacterium avium subsp. paratuberculosis
gggauccucgccgcgggcca

SEQ ID NO: 850371 - RNA, 22 nt, Mycobacterium avium subsp. paratuberculosis
gggauccucgccgcgggccagc

SEQ ID NO: 850372 - RNA, 17 nt, Mycobacterium avium subsp. paratuberculosis
gggagcuaggcggccgg

SEQ ID NO: 850373 - RNA, 23 nt, Mycobacterium avium subsp. paratuberculosis
gggaggccagcaccuucagcggg

SEQ ID NO: 850374 - RNA, 19 nt, Mycobacterium avium subsp. paratuberculosis
gggaggcccagcccgccgc

SEQ ID NO: 850375 - RNA, 16 nt, Mycobacterium avium subsp. paratuberculosis
gggagggucgguggcc

SEQ ID NO: 850376 - RNA, 23 nt, Mycobacterium avium subsp. paratuberculosis
gggagguacucgagcgugcccgc

SEQ ID NO: 850377 - RNA, 23 nt, Mycobacterium avium subsp. paratuberculosis
gggacggcggcgaguucggcggc

SEQ ID NO: 850378 - RNA, 17 nt, Mycobacterium avium subsp. paratuberculosis
gggacgggucggcggcg

SEQ ID NO: 850379 - RNA, 21 nt, Mycobacterium avium subsp. paratuberculosis
gggacggguugcaggccacgc

SEQ ID NO: 850380 - RNA, 17 nt, Mycobacterium avium subsp. paratuberculosis
gggacugcgccggggcc

SEQ ID NO: 850381 - RNA, 20 nt, Mycobacterium avium subsp. paratuberculosis
gggagacgcugugcgccaga

SEQ ID NO: 850382 - RNA, 13 nt, Mycobacterium avium subsp. paratuberculosis
gggagcacucgau

SEQ ID NO: 850383 - RNA, 17 nt, Mycobacterium avium subsp. paratuberculosis
gggagcacucgauggcg

SEQ ID NO: 850384 - RNA, 22 nt, Mycobacterium avium subsp. paratuberculosis
gggagcagcacgaucgagccgg

SEQ ID NO: 850385 - RNA, 18 nt, Mycobacterium avium subsp. paratuberculosis
gggagcaggacgguggcc

SEQ ID NO: 850386 - RNA, 20 nt, Mycobacterium avium subsp. paratuberculosis
gggagccgaagaucaccgcg

SEQ ID NO: 850387 - RNA, 13 nt, Mycobacterium avium subsp. paratuberculosis
gggagccggcggc

SEQ ID NO: 850388 - RNA, 14 nt, Mycobacterium avium subsp. paratuberculosis
gggagccggcggcg

SEQ ID NO: 850389 - RNA, 18 nt, Mycobacterium avium subsp. paratuberculosis
gggagccgugcagcgccc

SEQ ID NO: 850390 - RNA, 21 nt, Mycobacterium avium subsp. paratuberculosis
gggagccgugcagcgcccagc

SEQ ID NO: 850391 - RNA, 12 nt, Mycobacterium avium subsp. paratuberculosis
ggcgucaggggu

SEQ ID NO: 850392 - RNA, 21 nt, Mycobacterium avium subsp. paratuberculosis
ggcgucaggggugccagccgu

SEQ ID NO: 850393 - RNA, 15 nt, Mycobacterium avium subsp. paratuberculosis
ggcgucagggguugg

SEQ ID NO: 850394 - RNA, 14 nt, Mycobacterium avium subsp. paratuberculosis
ggcgucacgccagc

SEQ ID NO: 850395 - RNA, 15 nt, Mycobacterium avium subsp. paratuberculosis
ggcgucacgccagcg

SEQ ID NO: 850396 - RNA, 22 nt, Mycobacterium avium subsp. paratuberculosis
ggcgucacgccagcgugacgcc

SEQ ID NO: 850397 - RNA, 23 nt, Mycobacterium avium subsp. paratuberculosis
ggcgucacgccagcgugacgccc

SEQ ID NO: 850398 - RNA, 19 nt, Mycobacterium avium subsp. paratuberculosis
ggcgucacucuggcgugac

SEQ ID NO: 850399 - RNA, 22 nt, Mycobacterium avium subsp. paratuberculosis
ggcgucacucuggcgugacgcu

SEQ ID NO: 850400 - RNA, 20 nt, Mycobacterium avium subsp. paratuberculosis
ggcgucacgcuggcgugacg

SEQ ID NO: 850401 - RNA, 23 nt, Mycobacterium avium subsp. paratuberculosis
ggcguaugccuccucggugagcg

SEQ ID NO: 850402 - RNA, 17 nt, Mycobacterium avium subsp. paratuberculosis
ggcguaguggugcaggu

SEQ ID NO: 850403 - RNA, 17 nt, Mycobacterium avium subsp. paratuberculosis
ggcguauucccggggga

SEQ ID NO: 850404 - RNA, 17 nt, Mycobacterium avium subsp. paratuberculosis
ggcguauucggcgcgca

SEQ ID NO: 850405 - RNA, 19 nt, Mycobacterium avium subsp. paratuberculosis
ggcguauucggcgcgcaac

SEQ ID NO: 850406 - RNA, 20 nt, Mycobacterium avium subsp. paratuberculosis
ggcguauucgucgucggccu

SEQ ID NO: 850407 - RNA, 13 nt, Mycobacterium avium subsp. paratuberculosis
ggcgucaccaggc

SEQ ID NO: 850408 - RNA, 22 nt, Mycobacterium avium subsp. paratuberculosis
ggcgucaccaggcugcucggcg

SEQ ID NO: 850409 - RNA, 18 nt, Mycobacterium avium subsp. paratuberculosis
gggacgccacggcgaaca

SEQ ID NO: 850410 - RNA, 13 nt, Mycobacterium avium subsp. paratuberculosis
gggacgaagaccg

SEQ ID NO: 850411 - RNA, 14 nt, Mycobacterium avium subsp. paratuberculosis
gggacgacggcgcc

SEQ ID NO: 850412 - RNA, 15 nt, Mycobacterium avium subsp. paratuberculosis
gggacgacggcgccg

SEQ ID NO: 850413 - RNA, 18 nt, Mycobacterium avium subsp. paratuberculosis
gggaccgaggugccgcgg

SEQ ID NO: 850414 - RNA, 18 nt, Mycobacterium avium subsp. paratuberculosis
gggaccgggcccggcgcc

SEQ ID NO: 850415 - RNA, 18 nt, Mycobacterium avium subsp. paratuberculosis
gggaccgucaccguggcg

SEQ ID NO: 850416 - RNA, 19 nt, Mycobacterium avium subsp. paratuberculosis
gggaccugggucugcggcc

SEQ ID NO: 850417 - RNA, 22 nt, Mycobacterium avium subsp. paratuberculosis
gggaccugggucugcggccggg

SEQ ID NO: 850418 - RNA, 12 nt, Mycobacterium avium subsp. paratuberculosis
ggcguccagcac

SEQ ID NO: 850419 - RNA, 16 nt, Mycobacterium avium subsp. paratuberculosis
ggcguccagcaccugc

SEQ ID NO: 850420 - RNA, 22 nt, Mycobacterium avium subsp. paratuberculosis
ggcguccagcaccugcucgaug

SEQ ID NO: 850421 - RNA, 14 nt, Mycobacterium avium subsp. paratuberculosis
gggacccgcgaccc

SEQ ID NO: 850422 - RNA, 21 nt, Mycobacterium avium subsp. paratuberculosis
ggcgucaucgacuugccgccg

SEQ ID NO: 850423 - RNA, 13 nt, Mycobacterium avium subsp. paratuberculosis
ggcgucaucgugg

SEQ ID NO: 850424 - RNA, 20 nt, Mycobacterium avium subsp. paratuberculosis
ggcguccaaugcgccgaugg

SEQ ID NO: 850425 - RNA, 13 nt, Mycobacterium avium subsp. paratuberculosis
ggcguccaccagc

SEQ ID NO: 850426 - RNA, 14 nt, Mycobacterium avium subsp. paratuberculosis
ggcguccaccgaca

SEQ ID NO: 850427 - RNA, 13 nt, Mycobacterium avium subsp. paratuberculosis
gggacggcggcga

SEQ ID NO: 850428 - RNA, 16 nt, Mycobacterium avium subsp. paratuberculosis
gggacgucagcccgcg

SEQ ID NO: 850429 - RNA, 22 nt, Mycobacterium avium subsp. paratuberculosis
gggacgucgacgugggcggcca

SEQ ID NO: 850430 - RNA, 16 nt, Mycobacterium avium subsp. paratuberculosis
gggacgucggcgcgcu

SEQ ID NO: 850431 - RNA, 22 nt, Mycobacterium avium subsp. paratuberculosis
gggacguugaugucguccaugc

SEQ ID NO: 850432 - RNA, 20 nt, Mycobacterium avium subsp. paratuberculosis
gggacggaaaucgccugucc

SEQ ID NO: 850433 - RNA, 20 nt, Mycobacterium avium subsp. paratuberculosis
gggacgccguugacaccggg

SEQ ID NO: 850434 - RNA, 22 nt, Mycobacterium avium subsp. paratuberculosis
gggccaaaucgcuugcgccgca

SEQ ID NO: 850435 - RNA, 19 nt, Mycobacterium avium subsp. paratuberculosis
gggccaacgguucggccgc

SEQ ID NO: 850436 - RNA, 15 nt, Mycobacterium avium subsp. paratuberculosis
gggccaacuccggcg

SEQ ID NO: 850437 - RNA, 15 nt, Mycobacterium avium subsp. paratuberculosis
gggccaagcaccggg

SEQ ID NO: 850438 - RNA, 17 nt, Mycobacterium avium subsp. paratuberculosis
gggccaccaccacggcc

SEQ ID NO: 850439 - RNA, 19 nt, Mycobacterium avium subsp. paratuberculosis
gggccaccaccacggccgc

SEQ ID NO: 850440 - RNA, 20 nt, Mycobacterium avium subsp. paratuberculosis
gggccaccaccacggccgcc

SEQ ID NO: 850441 - RNA, 14 nt, Mycobacterium avium subsp. paratuberculosis
gggccacggcgcga

SEQ ID NO: 850442 - RNA, 13 nt, Mycobacterium avium subsp. paratuberculosis
gggccaccagcgc

SEQ ID NO: 850443 - RNA, 15 nt, Mycobacterium avium subsp. paratuberculosis
gggccaccagcgcag

SEQ ID NO: 850444 - RNA, 13 nt, Mycobacterium avium subsp. paratuberculosis
gggccaccgcggc

SEQ ID NO: 850445 - RNA, 22 nt, Mycobacterium avium subsp. paratuberculosis
gggccaccgcgucgcugcccag

SEQ ID NO: 850446 - RNA, 12 nt, Mycobacterium avium subsp. paratuberculosis
gggccaccggcg

SEQ ID NO: 850447 - RNA, 13 nt, Mycobacterium avium subsp. paratuberculosis
gggccaccggcgc

SEQ ID NO: 850448 - RNA, 12 nt, Mycobacterium avium subsp. paratuberculosis
gggccaccggcu

SEQ ID NO: 850449 - RNA, 22 nt, Mycobacterium avium subsp. paratuberculosis
gggccagacugcgcaccgccag

SEQ ID NO: 850450 - RNA, 23 nt, Mycobacterium avium subsp. paratuberculosis
gggccagacugcgcaccgccagc

SEQ ID NO: 850451 - RNA, 17 nt, Mycobacterium avium subsp. paratuberculosis
gggccagcaacaccagc

SEQ ID NO: 850452 - RNA, 18 nt, Mycobacterium avium subsp. paratuberculosis
gggccagcaacaccagcu

SEQ ID NO: 850453 - RNA, 15 nt, Mycobacterium avium subsp. paratuberculosis
gggccagcaacagca

SEQ ID NO: 850454 - RNA, 17 nt, Mycobacterium avium subsp. paratuberculosis
gggccagcagccgcgcg

SEQ ID NO: 850455 - RNA, 21 nt, Mycobacterium avium subsp. paratuberculosis
gggccagcagccgcgcgagca

SEQ ID NO: 850456 - RNA, 13 nt, Mycobacterium avium subsp. paratuberculosis
gggccagcaccau

SEQ ID NO: 850457 - RNA, 13 nt, Mycobacterium avium subsp. paratuberculosis
gggccagcaccca

SEQ ID NO: 850458 - RNA, 14 nt, Mycobacterium avium subsp. paratuberculosis
gggccagcacccag

SEQ ID NO: 850459 - RNA, 15 nt, Mycobacterium avium subsp. paratuberculosis
gggccagcacccaga

SEQ ID NO: 850460 - RNA, 22 nt, Mycobacterium avium subsp. paratuberculosis
gggccagcacgaccccgcccac

SEQ ID NO: 850461 - RNA, 14 nt, Mycobacterium avium subsp. paratuberculosis
gggccagcagccag

SEQ ID NO: 850462 - RNA, 17 nt, Mycobacterium avium subsp. paratuberculosis
gggccacgauccgcgcg

SEQ ID NO: 850463 - RNA, 19 nt, Mycobacterium avium subsp. paratuberculosis
gggccacgauccgcgcggc

SEQ ID NO: 850464 - RNA, 22 nt, Mycobacterium avium subsp. paratuberculosis
gggccacgauccgcgcggccac

SEQ ID NO: 850465 - RNA, 15 nt, Mycobacterium avium subsp. paratuberculosis
gggccaccgggccga

SEQ ID NO: 850466 - RNA, 10 nt, Mycobacterium avium subsp. paratuberculosis
gggccaccgu

SEQ ID NO: 850467 - RNA, 19 nt, Mycobacterium avium subsp. paratuberculosis
gggccaccgucccgguguc

SEQ ID NO: 850468 - RNA, 19 nt, Mycobacterium avium subsp. paratuberculosis
gggccagcgccaugccgcc

SEQ ID NO: 850469 - RNA, 20 nt, Mycobacterium avium subsp. paratuberculosis
gggccagcgccaugccgccg

SEQ ID NO: 850470 - RNA, 14 nt, Mycobacterium avium subsp. paratuberculosis
gggccagcgccgag

SEQ ID NO: 850471 - RNA, 17 nt, Mycobacterium avium subsp. paratuberculosis
gggccagcgccgagccg

SEQ ID NO: 850472 - RNA, 22 nt, Mycobacterium avium subsp. paratuberculosis
gggccagcaguucguccacgcu

SEQ ID NO: 850473 - RNA, 23 nt, Mycobacterium avium subsp. paratuberculosis
gggccagcaguucguccacgcug

SEQ ID NO: 850474 - RNA, 22 nt, Mycobacterium avium subsp. paratuberculosis
gggccaggcccaccgucgccac

SEQ ID NO: 850475 - RNA, 15 nt, Mycobacterium avium subsp. paratuberculosis
gggccaggaccggau

SEQ ID NO: 850476 - RNA, 21 nt, Mycobacterium avium subsp. paratuberculosis
gggccaggaccggauccacca

SEQ ID NO: 850477 - RNA, 14 nt, Mycobacterium avium subsp. paratuberculosis
gggccagcgcggug

SEQ ID NO: 850478 - RNA, 15 nt, Mycobacterium avium subsp. paratuberculosis
gggccagcgcgguga

SEQ ID NO: 850479 - RNA, 15 nt, Mycobacterium avium subsp. paratuberculosis
gggccagcgcggugg

SEQ ID NO: 850480 - RNA, 20 nt, Mycobacterium avium subsp. paratuberculosis
gggccagcgcgguggccagc

SEQ ID NO: 850481 - RNA, 21 nt, Mycobacterium avium subsp. paratuberculosis
gggccagcgcgguggccagca

SEQ ID NO: 850482 - RNA, 20 nt, Mycobacterium avium subsp. paratuberculosis
gggccagcggcaacugggcg

SEQ ID NO: 850483 - RNA, 18 nt, Mycobacterium avium subsp. paratuberculosis
gggccagcgccucggcgu

SEQ ID NO: 850484 - RNA, 17 nt, Mycobacterium avium subsp. paratuberculosis
gggccagccguuguuga

SEQ ID NO: 850485 - RNA, 22 nt, Mycobacterium avium subsp. paratuberculosis
gggccagcgccuucggcgccag

SEQ ID NO: 850486 - RNA, 18 nt, Mycobacterium avium subsp. paratuberculosis
gggccaucgacuccagca

SEQ ID NO: 850487 - RNA, 19 nt, Mycobacterium avium subsp. paratuberculosis
gggccaucgacuccagcac

SEQ ID NO: 850488 - RNA, 22 nt, Mycobacterium avium subsp. paratuberculosis
gggccaucgacuccagcaccgg

SEQ ID NO: 850489 - RNA, 22 nt, Mycobacterium avium subsp. paratuberculosis
gggccaucccggggacaccggg

SEQ ID NO: 850490 - RNA, 24 nt, Mycobacterium avium subsp. paratuberculosis
gggccaucccggggacaccgggca

SEQ ID NO: 850491 - RNA, 14 nt, Mycobacterium avium subsp. paratuberculosis
gggccauccggccg

SEQ ID NO: 850492 - RNA, 16 nt, Mycobacterium avium subsp. paratuberculosis
gggccauccggccggc

SEQ ID NO: 850493 - RNA, 12 nt, Mycobacterium avium subsp. paratuberculosis
gggccagcgcgg

SEQ ID NO: 850494 - RNA, 15 nt, Mycobacterium avium subsp. paratuberculosis
gggccaggucgguga

SEQ ID NO: 850495 - RNA, 16 nt, Mycobacterium avium subsp. paratuberculosis
gggccaggucggugac

SEQ ID NO: 850496 - RNA, 21 nt, Mycobacterium avium subsp. paratuberculosis
gggccaggucccaggcguggu

SEQ ID NO: 850497 - RNA, 23 nt, Mycobacterium avium subsp. paratuberculosis
gggccaggucccaggcguggucg

SEQ ID NO: 850498 - RNA, 21 nt, Mycobacterium avium subsp. paratuberculosis
gggccaggucgaagcgcagca

SEQ ID NO: 850499 - RNA, 21 nt, Mycobacterium avium subsp. paratuberculosis
gggccaggcgcgcgcuggugc

SEQ ID NO: 850500 - RNA, 20 nt, Mycobacterium avium subsp. paratuberculosis
gggcauugcccaucgccacg

SEQ ID NO: 850501 - RNA, 15 nt, Mycobacterium avium subsp. paratuberculosis
gggcauggugaagcc

SEQ ID NO: 850502 - RNA, 23 nt, Mycobacterium avium subsp. paratuberculosis
gggcaugucgccgaacgccacca

SEQ ID NO: 850503 - RNA, 18 nt, Mycobacterium avium subsp. paratuberculosis
gggcaugccguucagcgc

SEQ ID NO: 850504 - RNA, 23 nt, Mycobacterium avium subsp. paratuberculosis
gggcaugccguucagcgcggcca

SEQ ID NO: 850505 - RNA, 13 nt, Mycobacterium avium subsp. paratuberculosis
gggcaucgggucg

SEQ ID NO: 850506 - RNA, 20 nt, Mycobacterium avium subsp. paratuberculosis
gggcaugaaccaggccgcgc

SEQ ID NO: 850507 - RNA, 16 nt, Mycobacterium avium subsp. paratuberculosis
gggcaugccggccggc

SEQ ID NO: 850508 - RNA, 17 nt, Mycobacterium avium subsp. paratuberculosis
gggcaugccggccggca

SEQ ID NO: 850509 - RNA, 20 nt, Mycobacterium avium subsp. paratuberculosis
gggcagucugccgguggccu

SEQ ID NO: 850510 - RNA, 15 nt, Mycobacterium avium subsp. paratuberculosis
gggcagugcgcggcg

SEQ ID NO: 850511 - RNA, 20 nt, Mycobacterium avium subsp. paratuberculosis
gggcagguucaucaccacga

SEQ ID NO: 850512 - RNA, 16 nt, Mycobacterium avium subsp. paratuberculosis
gggcaguagcgacgcg

SEQ ID NO: 850513 - RNA, 16 nt, Mycobacterium avium subsp. paratuberculosis
gggcaucaucggcacg

SEQ ID NO: 850514 - RNA, 17 nt, Mycobacterium avium subsp. paratuberculosis
gggcaucaucggcacgc

SEQ ID NO: 850515 - RNA, 20 nt, Mycobacterium avium subsp. paratuberculosis
gggcaucaucggcacgccgg

SEQ ID NO: 850516 - RNA, 14 nt, Mycobacterium avium subsp. paratuberculosis
gggcaucccgccga

SEQ ID NO: 850517 - RNA, 19 nt, Mycobacterium avium subsp. paratuberculosis
gggcauccgggaggccagc

SEQ ID NO: 850518 - RNA, 20 nt, Mycobacterium avium subsp. paratuberculosis
gggcaucgcagcgcgcggcg

SEQ ID NO: 850519 - RNA, 19 nt, Mycobacterium avium subsp. paratuberculosis
gggcagggucgcggagcgg

SEQ ID NO: 850520 - RNA, 22 nt, Mycobacterium avium subsp. paratuberculosis
gggcagcggccccacguugauc

SEQ ID NO: 850521 - RNA, 21 nt, Mycobacterium avium subsp. paratuberculosis
gggcagcggugucaccgacgc

SEQ ID NO: 850522 - RNA, 18 nt, Mycobacterium avium subsp. paratuberculosis
gggcagcgucccgucggc

SEQ ID NO: 850523 - RNA, 14 nt, Mycobacterium avium subsp. paratuberculosis
gggcagcucggcgg

SEQ ID NO: 850524 - RNA, 19 nt, Mycobacterium avium subsp. paratuberculosis
gggcagcucgucggcgcgc

SEQ ID NO: 850525 - RNA, 21 nt, Mycobacterium avium subsp. paratuberculosis
gggcagcucgucggcgcgcca

SEQ ID NO: 850526 - RNA, 23 nt, Mycobacterium avium subsp. paratuberculosis
gggcagcucgucggcgcgccacc

SEQ ID NO: 850527 - RNA, 20 nt, Mycobacterium avium subsp. paratuberculosis
gggcagcugauagcccgccg

SEQ ID NO: 850528 - RNA, 20 nt, Mycobacterium avium subsp. paratuberculosis
gggcagcuuccgccucggcg

SEQ ID NO: 850529 - RNA, 14 nt, Mycobacterium avium subsp. paratuberculosis
gggcagcgcggcca

SEQ ID NO: 850530 - RNA, 18 nt, Mycobacterium avium subsp. paratuberculosis
gggcagcgcggccagcac

SEQ ID NO: 850531 - RNA, 14 nt, Mycobacterium avium subsp. paratuberculosis
gggcagcgcgugcu

SEQ ID NO: 850532 - RNA, 16 nt, Mycobacterium avium subsp. paratuberculosis
gggcagcgccucggcg

SEQ ID NO: 850533 - RNA, 18 nt, Mycobacterium avium subsp. paratuberculosis
gggcagcgccucggcggg

SEQ ID NO: 850534 - RNA, 13 nt, Mycobacterium avium subsp. paratuberculosis
gggcagcgcgaca

SEQ ID NO: 850535 - RNA, 16 nt, Mycobacterium avium subsp. paratuberculosis
gggcagcgcgaccagc

SEQ ID NO: 850536 - RNA, 20 nt, Mycobacterium avium subsp. paratuberculosis
gggcagcaccucgcgcgcga

SEQ ID NO: 850537 - RNA, 13 nt, Mycobacterium avium subsp. paratuberculosis
gggcagcgccccg

SEQ ID NO: 850538 - RNA, 23 nt, Mycobacterium avium subsp. paratuberculosis
gggcagcgccccgguccggcuga

SEQ ID NO: 850539 - RNA, 15 nt, Mycobacterium avium subsp. paratuberculosis
gggcagcccgagcaa

SEQ ID NO: 850540 - RNA, 18 nt, Mycobacterium avium subsp. paratuberculosis
gggcagcccgccgaccac

SEQ ID NO: 850541 - RNA, 12 nt, Mycobacterium avium subsp. paratuberculosis
gggcagcccggg

SEQ ID NO: 850542 - RNA, 21 nt, Mycobacterium avium subsp. paratuberculosis
gggcagccgcacaccgcggcg

SEQ ID NO: 850543 - RNA, 12 nt, Mycobacterium avium subsp. paratuberculosis
gggcagccggcg

SEQ ID NO: 850544 - RNA, 13 nt, Mycobacterium avium subsp. paratuberculosis
gggcagcgagcac

SEQ ID NO: 850545 - RNA, 15 nt, Mycobacterium avium subsp. paratuberculosis
gggcagcgagcacag

SEQ ID NO: 850546 - RNA, 19 nt, Mycobacterium avium subsp. paratuberculosis
gggccggucggucggccgc

SEQ ID NO: 850547 - RNA, 17 nt, Mycobacterium avium subsp. paratuberculosis
gggccggugcagcacgu

SEQ ID NO: 850548 - RNA, 21 nt, Mycobacterium avium subsp. paratuberculosis
gggccggugcguccgccggcg

SEQ ID NO: 850549 - RNA, 23 nt, Mycobacterium avium subsp. paratuberculosis
gggccggugcguccgccggcggu

SEQ ID NO: 850550 - RNA, 21 nt, Mycobacterium avium subsp. paratuberculosis
gggccgggcgugcccggcgca

SEQ ID NO: 850551 - RNA, 17 nt, Mycobacterium avium subsp. paratuberculosis
gggccggguccacgccg

SEQ ID NO: 850552 - RNA, 16 nt, Mycobacterium avium subsp. paratuberculosis
gggccggucagcgcga

SEQ ID NO: 850553 - RNA, 15 nt, Mycobacterium avium subsp. paratuberculosis
gggccgggcaccgcg

SEQ ID NO: 850554 - RNA, 17 nt, Mycobacterium avium subsp. paratuberculosis
gggccgggcaccgcgcc

SEQ ID NO: 850555 - RNA, 20 nt, Mycobacterium avium subsp. paratuberculosis
gggccgggcaccgcgcccgc

SEQ ID NO: 850556 - RNA, 19 nt, Mycobacterium avium subsp. paratuberculosis
gggccgggcacgucgacgc

SEQ ID NO: 850557 - RNA, 14 nt, Mycobacterium avium subsp. paratuberculosis
gggccggcgccggu

SEQ ID NO: 850558 - RNA, 12 nt, Mycobacterium avium subsp. paratuberculosis
gggccggcgaag

SEQ ID NO: 850559 - RNA, 20 nt, Mycobacterium avium subsp. paratuberculosis
gggccggcgaaggacagccg

SEQ ID NO: 850560 - RNA, 14 nt, Mycobacterium avium subsp. paratuberculosis
gggccggcguccag

SEQ ID NO: 850561 - RNA, 16 nt, Mycobacterium avium subsp. paratuberculosis
gggccggcgucgcggu

SEQ ID NO: 850562 - RNA, 22 nt, Mycobacterium avium subsp. paratuberculosis
gggccggcgucgucgagcaccg

SEQ ID NO: 850563 - RNA, 23 nt, Mycobacterium avium subsp. paratuberculosis
gggccggcgugcugggccacgau

SEQ ID NO: 850564 - RNA, 17 nt, Mycobacterium avium subsp. paratuberculosis
gggccggcgcggugcuc

SEQ ID NO: 850565 - RNA, 13 nt, Mycobacterium avium subsp. paratuberculosis
gggccggcggcca

SEQ ID NO: 850566 - RNA, 14 nt, Mycobacterium avium subsp. paratuberculosis
gggccggcggccag

SEQ ID NO: 850567 - RNA, 15 nt, Mycobacterium avium subsp. paratuberculosis
gggccggcggugauc

SEQ ID NO: 850568 - RNA, 20 nt, Mycobacterium avium subsp. paratuberculosis
gggccggcggugauccgccc

SEQ ID NO: 850569 - RNA, 12 nt, Mycobacterium avium subsp. paratuberculosis
gggccggcgccg

SEQ ID NO: 850570 - RNA, 15 nt, Mycobacterium avium subsp. paratuberculosis
gggccggcgccgacg

SEQ ID NO: 850571 - RNA, 17 nt, Mycobacterium avium subsp. paratuberculosis
gggccggcgccgacgac

SEQ ID NO: 850572 - RNA, 19 nt, Mycobacterium avium subsp. paratuberculosis
gggccggcgccgacgacgu

SEQ ID NO: 850573 - RNA, 12 nt, Mycobacterium avium subsp. paratuberculosis
gggccggccaga

SEQ ID NO: 850574 - RNA, 22 nt, Mycobacterium avium subsp. paratuberculosis
gggccggaggugcgggucucga

SEQ ID NO: 850575 - RNA, 17 nt, Mycobacterium avium subsp. paratuberculosis
gggccggaucgcgcagu

SEQ ID NO: 850576 - RNA, 16 nt, Mycobacterium avium subsp. paratuberculosis
gggccgcgccgaggcg

SEQ ID NO: 850577 - RNA, 16 nt, Mycobacterium avium subsp. paratuberculosis
gggccggaacgcccga

SEQ ID NO: 850578 - RNA, 18 nt, Mycobacterium avium subsp. paratuberculosis
gggccggacagcggcccc

SEQ ID NO: 850579 - RNA, 12 nt, Mycobacterium avium subsp. paratuberculosis
gggccgcggcca

SEQ ID NO: 850580 - RNA, 14 nt, Mycobacterium avium subsp. paratuberculosis
gggccgcggccagc

SEQ ID NO: 850581 - RNA, 14 nt, Mycobacterium avium subsp. paratuberculosis
gggccgcggccgcc

SEQ ID NO: 850582 - RNA, 21 nt, Mycobacterium avium subsp. paratuberculosis
gggccgccgcauaccgcccgc

SEQ ID NO: 850583 - RNA, 13 nt, Mycobacterium avium subsp. paratuberculosis
gggccgcgcccag

SEQ ID NO: 850584 - RNA, 14 nt, Mycobacterium avium subsp. paratuberculosis
gggccgcgcccagu

SEQ ID NO: 850585 - RNA, 15 nt, Mycobacterium avium subsp. paratuberculosis
gggccgcggcgucgg

SEQ ID NO: 850586 - RNA, 14 nt, Mycobacterium avium subsp. paratuberculosis
gggccgcgggccca

SEQ ID NO: 850587 - RNA, 18 nt, Mycobacterium avium subsp. paratuberculosis
gggccgcgucggccaacg

SEQ ID NO: 850588 - RNA, 14 nt, Mycobacterium avium subsp. paratuberculosis
gggccgcuacgccg

SEQ ID NO: 850589 - RNA, 15 nt, Mycobacterium avium subsp. paratuberculosis
gggccgccucacgca

SEQ ID NO: 850590 - RNA, 22 nt, Mycobacterium avium subsp. paratuberculosis
gggccgccucacgcagggccaa

SEQ ID NO: 850591 - RNA, 12 nt, Mycobacterium avium subsp. paratuberculosis
gggccgccgcgg

SEQ ID NO: 850592 - RNA, 13 nt, Mycobacterium avium subsp. paratuberculosis
gggccgccgcggc

SEQ ID NO: 850593 - RNA, 15 nt, Mycobacterium avium subsp. paratuberculosis
gggccgccggccgcg

SEQ ID NO: 850594 - RNA, 16 nt, Mycobacterium avium subsp. paratuberculosis
gggccgccggccgcgg

SEQ ID NO: 850595 - RNA, 15 nt, Mycobacterium avium subsp. paratuberculosis
gggccgccggccgcu

SEQ ID NO: 850596 - RNA, 15 nt, Mycobacterium avium subsp. paratuberculosis
gggccgcccgcgcgu

SEQ ID NO: 850597 - RNA, 14 nt, Mycobacterium avium subsp. paratuberculosis
gggccgcccggcgc

SEQ ID NO: 850598 - RNA, 14 nt, Mycobacterium avium subsp. paratuberculosis
gggccgccacggcg

SEQ ID NO: 850599 - RNA, 12 nt, Mycobacterium avium subsp. paratuberculosis
gggccgccagcc

SEQ ID NO: 850600 - RNA, 17 nt, Mycobacterium avium subsp. paratuberculosis
gggccgccagccgguac

SEQ ID NO: 850601 - RNA, 17 nt, Mycobacterium avium subsp. paratuberculosis
gggccgcagccgcgcgg

SEQ ID NO: 850602 - RNA, 22 nt, Mycobacterium avium subsp. paratuberculosis
gggccgcagccgcgcggccggc

SEQ ID NO: 850603 - RNA, 12 nt, Mycobacterium avium subsp. paratuberculosis
gggccgccaacg

SEQ ID NO: 850604 - RNA, 14 nt, Mycobacterium avium subsp. paratuberculosis
gggccgcagcgcgg

SEQ ID NO: 850605 - RNA, 19 nt, Mycobacterium avium subsp. paratuberculosis
gggccgcagcucgcccagc

SEQ ID NO: 850606 - RNA, 17 nt, Mycobacterium avium subsp. paratuberculosis
gggccgcauccagcgcc

SEQ ID NO: 850607 - RNA, 18 nt, Mycobacterium avium subsp. paratuberculosis
gggccgcauccagcgccg

SEQ ID NO: 850608 - RNA, 20 nt, Mycobacterium avium subsp. paratuberculosis
gggccgcauccagcgccgcc

SEQ ID NO: 850609 - RNA, 19 nt, Mycobacterium avium subsp. paratuberculosis
gggccgcauccgcgagccg

SEQ ID NO: 850610 - RNA, 22 nt, Mycobacterium avium subsp. paratuberculosis
gggccgcauccgcgagccgagc

SEQ ID NO: 850611 - RNA, 20 nt, Mycobacterium avium subsp. paratuberculosis
gggccgagcgcgccgccgcc

SEQ ID NO: 850612 - RNA, 21 nt, Mycobacterium avium subsp. paratuberculosis
gggccgagcguucggcgcgga

SEQ ID NO: 850613 - RNA, 14 nt, Mycobacterium avium subsp. paratuberculosis
gggccgaugaccgc

SEQ ID NO: 850614 - RNA, 16 nt, Mycobacterium avium subsp. paratuberculosis
gggccgacccggccga

SEQ ID NO: 850615 - RNA, 15 nt, Mycobacterium avium subsp. paratuberculosis
gggccgaccggccgg

SEQ ID NO: 850616 - RNA, 18 nt, Mycobacterium avium subsp. paratuberculosis
gggccgaccuggcggccg

SEQ ID NO: 850617 - RNA, 16 nt, Mycobacterium avium subsp. paratuberculosis
gggcccggcgccaaca

SEQ ID NO: 850618 - RNA, 22 nt, Mycobacterium avium subsp. paratuberculosis
gggccgaaccggaagaucagca

SEQ ID NO: 850619 - RNA, 18 nt, Mycobacterium avium subsp. paratuberculosis
gggccgaaggcggcgccg

SEQ ID NO: 850620 - RNA, 21 nt, Mycobacterium avium subsp. paratuberculosis
gggccgaaaaaccugcggugc

SEQ ID NO: 850621 - RNA, 14 nt, Mycobacterium avium subsp. paratuberculosis
gggccccuccagcc

SEQ ID NO: 850622 - RNA, 14 nt, Mycobacterium avium subsp. paratuberculosis
gggcccuccgcggc

SEQ ID NO: 850623 - RNA, 12 nt, Mycobacterium avium subsp. paratuberculosis
gggcccggcccg

SEQ ID NO: 850624 - RNA, 13 nt, Mycobacterium avium subsp. paratuberculosis
gggcccggcccgg

SEQ ID NO: 850625 - RNA, 13 nt, Mycobacterium avium subsp. paratuberculosis
gggcccggcccgu

SEQ ID NO: 850626 - RNA, 12 nt, Mycobacterium avium subsp. paratuberculosis
gggcccggccgc

SEQ ID NO: 850627 - RNA, 14 nt, Mycobacterium avium subsp. paratuberculosis
gggcccgugcgggu

SEQ ID NO: 850628 - RNA, 19 nt, Mycobacterium avium subsp. paratuberculosis
gggcccgugcggguggucc

SEQ ID NO: 850629 - RNA, 19 nt, Mycobacterium avium subsp. paratuberculosis
gggcccggguggcguccag

SEQ ID NO: 850630 - RNA, 14 nt, Mycobacterium avium subsp. paratuberculosis
gggcccggucccgc

SEQ ID NO: 850631 - RNA, 19 nt, Mycobacterium avium subsp. paratuberculosis
gggcccggucccgcgucac

SEQ ID NO: 850632 - RNA, 13 nt, Mycobacterium avium subsp. paratuberculosis
gggcccgguccgc

SEQ ID NO: 850633 - RNA, 17 nt, Mycobacterium avium subsp. paratuberculosis
gggcccggucgucgccg

SEQ ID NO: 850634 - RNA, 19 nt, Mycobacterium avium subsp. paratuberculosis
gggcccguagcucgcgccg

SEQ ID NO: 850635 - RNA, 19 nt, Mycobacterium avium subsp. paratuberculosis
gggcccguccccaccaccg

SEQ ID NO: 850636 - RNA, 19 nt, Mycobacterium avium subsp. paratuberculosis
gggcccgccgucgaccacg

SEQ ID NO: 850637 - RNA, 12 nt, Mycobacterium avium subsp. paratuberculosis
gggcccgcgcac

SEQ ID NO: 850638 - RNA, 14 nt, Mycobacterium avium subsp. paratuberculosis
gggcccgcgcaccg

SEQ ID NO: 850639 - RNA, 14 nt, Mycobacterium avium subsp. paratuberculosis
gggcccgcgcaucc

SEQ ID NO: 850640 - RNA, 14 nt, Mycobacterium avium subsp. paratuberculosis
gggcccgcgcggcg

SEQ ID NO: 850641 - RNA, 16 nt, Mycobacterium avium subsp. paratuberculosis
gggcccgcgcggcggu

SEQ ID NO: 850642 - RNA, 17 nt, Mycobacterium avium subsp. paratuberculosis
gggcccgcucaccugcg

SEQ ID NO: 850643 - RNA, 15 nt, Mycobacterium avium subsp. paratuberculosis
gggcccgcugcagcg

SEQ ID NO: 850644 - RNA, 21 nt, Mycobacterium avium subsp. paratuberculosis
gggccccggcaucgacaugcc

SEQ ID NO: 850645 - RNA, 13 nt, Mycobacterium avium subsp. paratuberculosis
gggcccgacgacg

SEQ ID NO: 850646 - RNA, 19 nt, Mycobacterium avium subsp. paratuberculosis
gggcccgauggcggccugc

SEQ ID NO: 850647 - RNA, 19 nt, Mycobacterium avium subsp. paratuberculosis
gggcccgcccgcagcggcg

SEQ ID NO: 850648 - RNA, 12 nt, Mycobacterium avium subsp. paratuberculosis
gggcccgccggu

SEQ ID NO: 850649 - RNA, 23 nt, Mycobacterium avium subsp. paratuberculosis
gggcccgccguagcgccggcaac

SEQ ID NO: 850650 - RNA, 16 nt, Mycobacterium avium subsp. paratuberculosis
gggccaugccggccug

SEQ ID NO: 850651 - RNA, 18 nt, Mycobacterium avium subsp. paratuberculosis
gggcccacagcagccgca

SEQ ID NO: 850652 - RNA, 22 nt, Mycobacterium avium subsp. paratuberculosis
gggccaucaccuccuuggccag

SEQ ID NO: 850653 - RNA, 15 nt, Mycobacterium avium subsp. paratuberculosis
gggccaucgccagga

SEQ ID NO: 850654 - RNA, 16 nt, Mycobacterium avium subsp. paratuberculosis
gggcccaccgccacca

SEQ ID NO: 850655 - RNA, 17 nt, Mycobacterium avium subsp. paratuberculosis
gggcccaccgccaccag

SEQ ID NO: 850656 - RNA, 16 nt, Mycobacterium avium subsp. paratuberculosis
gggcccaccgcgcgcu

SEQ ID NO: 850657 - RNA, 13 nt, Mycobacterium avium subsp. paratuberculosis
gggcccagcacca

SEQ ID NO: 850658 - RNA, 18 nt, Mycobacterium avium subsp. paratuberculosis
gggcccagcaccaccacg

SEQ ID NO: 850659 - RNA, 22 nt, Mycobacterium avium subsp. paratuberculosis
gggcccagcagauagcccagcc

SEQ ID NO: 850660 - RNA, 18 nt, Mycobacterium avium subsp. paratuberculosis
gggcccagcgcgacgucg

SEQ ID NO: 850661 - RNA, 22 nt, Mycobacterium avium subsp. paratuberculosis
gggcccagcuccaaugcggccg

SEQ ID NO: 850662 - RNA, 14 nt, Mycobacterium avium subsp. paratuberculosis
gggccccacgccag

SEQ ID NO: 850663 - RNA, 13 nt, Mycobacterium avium subsp. paratuberculosis
ggaauuugcggcc

SEQ ID NO: 850664 - RNA, 21 nt, Mycobacterium avium subsp. paratuberculosis
ggaauugcuuuuugaccaccg

SEQ ID NO: 850665 - RNA, 18 nt, Mycobacterium avium subsp. paratuberculosis
ggaauucagugaggccag

SEQ ID NO: 850666 - RNA, 17 nt, Mycobacterium avium subsp. paratuberculosis
ggaauuccggcgcgauc

SEQ ID NO: 850667 - RNA, 20 nt, Mycobacterium avium subsp. paratuberculosis
ggaauucgccgacgcgcugc

SEQ ID NO: 850668 - RNA, 14 nt, Mycobacterium avium subsp. paratuberculosis
ggaauucgucggcg

SEQ ID NO: 850669 - RNA, 16 nt, Mycobacterium avium subsp. paratuberculosis
ggaauucgucggcggu

SEQ ID NO: 850670 - RNA, 17 nt, Mycobacterium avium subsp. paratuberculosis
ggaauucgucggcggug

SEQ ID NO: 850671 - RNA, 18 nt, Mycobacterium avium subsp. paratuberculosis
ggaauucgucggcggugu

SEQ ID NO: 850672 - RNA, 18 nt, Mycobacterium avium subsp. paratuberculosis
ggacaagucaugccgcgc

SEQ ID NO: 850673 - RNA, 20 nt, Mycobacterium avium subsp. paratuberculosis
ggacaagucaugccgcgcuc

SEQ ID NO: 850674 - RNA, 17 nt, Mycobacterium avium subsp. paratuberculosis
ggacaccaccgcggugg

SEQ ID NO: 850675 - RNA, 21 nt, Mycobacterium avium subsp. paratuberculosis
ggacaccaccgcggugggcca

SEQ ID NO: 850676 - RNA, 21 nt, Mycobacterium avium subsp. paratuberculosis
ggacaacggaucgagcgcacc

SEQ ID NO: 850677 - RNA, 23 nt, Mycobacterium avium subsp. paratuberculosis
ggacaacggaucgagcgcaccgc

SEQ ID NO: 850678 - RNA, 22 nt, Mycobacterium avium subsp. paratuberculosis
ggacaacgggauaugcgccugc

SEQ ID NO: 850679 - RNA, 17 nt, Mycobacterium avium subsp. paratuberculosis
ggacagcaccaccaggu

SEQ ID NO: 850680 - RNA, 18 nt, Mycobacterium avium subsp. paratuberculosis
ggacagccacagcucggg

SEQ ID NO: 850681 - RNA, 14 nt, Mycobacterium avium subsp. paratuberculosis
ggacagcagcaccg

SEQ ID NO: 850682 - RNA, 17 nt, Mycobacterium avium subsp. paratuberculosis
ggacagcagcaccggca

SEQ ID NO: 850683 - RNA, 14 nt, Mycobacterium avium subsp. paratuberculosis
ggacagcagcagcu

SEQ ID NO: 850684 - RNA, 14 nt, Mycobacterium avium subsp. paratuberculosis
ggacagcaccgcca

SEQ ID NO: 850685 - RNA, 20 nt, Mycobacterium avium subsp. paratuberculosis
ggacagcaccuugcccaggu

SEQ ID NO: 850686 - RNA, 17 nt, Mycobacterium avium subsp. paratuberculosis
ggacaccuuggcggcca

SEQ ID NO: 850687 - RNA, 13 nt, Mycobacterium avium subsp. paratuberculosis
ggacaccgaaccg

SEQ ID NO: 850688 - RNA, 23 nt, Mycobacterium avium subsp. paratuberculosis
ggacagcagccagguccgggcac

SEQ ID NO: 850689 - RNA, 13 nt, Mycobacterium avium subsp. paratuberculosis
ggacagcagccgc

SEQ ID NO: 850690 - RNA, 15 nt, Mycobacterium avium subsp. paratuberculosis
ggacacgcugccgag

SEQ ID NO: 850691 - RNA, 22 nt, Mycobacterium avium subsp. paratuberculosis
ggacacgcugccgagguacgcg

SEQ ID NO: 850692 - RNA, 21 nt, Mycobacterium avium subsp. paratuberculosis
ggacaccucggccagcgccgc

SEQ ID NO: 850693 - RNA, 16 nt, Mycobacterium avium subsp. paratuberculosis
ggacacggcugcaccc

SEQ ID NO: 850694 - RNA, 20 nt, Mycobacterium avium subsp. paratuberculosis
ggacacggcugcacccucug

SEQ ID NO: 850695 - RNA, 14 nt, Mycobacterium avium subsp. paratuberculosis
ggacaccgcgauca

SEQ ID NO: 850696 - RNA, 14 nt, Mycobacterium avium subsp. paratuberculosis
ggacaccgcuggcc

SEQ ID NO: 850697 - RNA, 21 nt, Mycobacterium avium subsp. paratuberculosis
ggacaccgcuggccgaggccu

SEQ ID NO: 850698 - RNA, 14 nt, Mycobacterium avium subsp. paratuberculosis
ggacaccggcacgu

SEQ ID NO: 850699 - RNA, 19 nt, Mycobacterium avium subsp. paratuberculosis
ggacaccggcacgucggcc

SEQ ID NO: 850700 - RNA, 16 nt, Mycobacterium avium subsp. paratuberculosis
ggacaccacgaucagc

SEQ ID NO: 850701 - RNA, 22 nt, Mycobacterium avium subsp. paratuberculosis
ggacaccacgguggcguccagc

SEQ ID NO: 850702 - RNA, 17 nt, Mycobacterium avium subsp. paratuberculosis
ggacaccacgucgucgg

SEQ ID NO: 850703 - RNA, 16 nt, Mycobacterium avium subsp. paratuberculosis
ggacaccccggccagu

SEQ ID NO: 850704 - RNA, 17 nt, Mycobacterium avium subsp. paratuberculosis
ggacacccgcgcggugc

SEQ ID NO: 850705 - RNA, 14 nt, Mycobacterium avium subsp. paratuberculosis
ggaccaccgcgugc

SEQ ID NO: 850706 - RNA, 19 nt, Mycobacterium avium subsp. paratuberculosis
ggaccaccgcgugcgagcc

SEQ ID NO: 850707 - RNA, 18 nt, Mycobacterium avium subsp. paratuberculosis
ggaccacccacucccagc

SEQ ID NO: 850708 - RNA, 19 nt, Mycobacterium avium subsp. paratuberculosis
ggaccacccacucccagcc

SEQ ID NO: 850709 - RNA, 15 nt, Mycobacterium avium subsp. paratuberculosis
ggaccacccaggugg

SEQ ID NO: 850710 - RNA, 21 nt, Mycobacterium avium subsp. paratuberculosis
ggacauucacgaggccgggcu

SEQ ID NO: 850711 - RNA, 22 nt, Mycobacterium avium subsp. paratuberculosis
ggacauucacgaggccgggcug

SEQ ID NO: 850712 - RNA, 13 nt, Mycobacterium avium subsp. paratuberculosis
ggacaugccgagc

SEQ ID NO: 850713 - RNA, 15 nt, Mycobacterium avium subsp. paratuberculosis
ggacaugccgagcag

SEQ ID NO: 850714 - RNA, 20 nt, Mycobacterium avium subsp. paratuberculosis
ggacaugccgagcagcaccg

SEQ ID NO: 850715 - RNA, 21 nt, Mycobacterium avium subsp. paratuberculosis
ggacaugccgagcagcaccgc

SEQ ID NO: 850716 - RNA, 13 nt, Mycobacterium avium subsp. paratuberculosis
ggacaucgccucg

SEQ ID NO: 850717 - RNA, 18 nt, Mycobacterium avium subsp. paratuberculosis
ggaccagcgccucggccu

SEQ ID NO: 850718 - RNA, 22 nt, Mycobacterium avium subsp. paratuberculosis
ggaccagcgccucggccugcgc

SEQ ID NO: 850719 - RNA, 19 nt, Mycobacterium avium subsp. paratuberculosis
ggaccagcgggucgauggc

SEQ ID NO: 850720 - RNA, 15 nt, Mycobacterium avium subsp. paratuberculosis
ggaccagggcggugg

SEQ ID NO: 850721 - RNA, 17 nt, Mycobacterium avium subsp. paratuberculosis
ggaccaggguggcccca

SEQ ID NO: 850722 - RNA, 20 nt, Mycobacterium avium subsp. paratuberculosis
ggaccaggguggccccagcc

SEQ ID NO: 850723 - RNA, 19 nt, Mycobacterium avium subsp. paratuberculosis
ggacaguucgguggggccg

SEQ ID NO: 850724 - RNA, 22 nt, Mycobacterium avium subsp. paratuberculosis
ggacaggugcauccagucggcg

SEQ ID NO: 850725 - RNA, 20 nt, Mycobacterium avium subsp. paratuberculosis
ggacaggugugggcguacgg

SEQ ID NO: 850726 - RNA, 16 nt, Mycobacterium avium subsp. paratuberculosis
ggacagugcgggcucg

SEQ ID NO: 850727 - RNA, 16 nt, Mycobacterium avium subsp. paratuberculosis
ggacagggcgacaucg

SEQ ID NO: 850728 - RNA, 16 nt, Mycobacterium avium subsp. paratuberculosis
ggacagguagcggugc

SEQ ID NO: 850729 - RNA, 12 nt, Mycobacterium avium subsp. paratuberculosis
ggacaggucgag

SEQ ID NO: 850730 - RNA, 23 nt, Mycobacterium avium subsp. paratuberculosis
ggacaggucgagggugacccggg

SEQ ID NO: 850731 - RNA, 16 nt, Mycobacterium avium subsp. paratuberculosis
ggacagggaggacagc

SEQ ID NO: 850732 - RNA, 21 nt, Mycobacterium avium subsp. paratuberculosis
ggacagggaggacagcaccgc

SEQ ID NO: 850733 - RNA, 16 nt, Mycobacterium avium subsp. paratuberculosis
ggacaggaacgggccg

SEQ ID NO: 850734 - RNA, 13 nt, Mycobacterium avium subsp. paratuberculosis
ggacaggcccagc

SEQ ID NO: 850735 - RNA, 23 nt, Mycobacterium avium subsp. paratuberculosis
ggacagcgcggugauguugucga

SEQ ID NO: 850736 - RNA, 20 nt, Mycobacterium avium subsp. paratuberculosis
ggacagcgcgguggucagcg

SEQ ID NO: 850737 - RNA, 14 nt, Mycobacterium avium subsp. paratuberculosis
ggacagcgucacca

SEQ ID NO: 850738 - RNA, 13 nt, Mycobacterium avium subsp. paratuberculosis
ggacagcggcgcg

SEQ ID NO: 850739 - RNA, 15 nt, Mycobacterium avium subsp. paratuberculosis
ggacagcggcgcggu

SEQ ID NO: 850740 - RNA, 14 nt, Mycobacterium avium subsp. paratuberculosis
ggacagcgggccga

SEQ ID NO: 850741 - RNA, 15 nt, Mycobacterium avium subsp. paratuberculosis
ggacagcgcgacgca

SEQ ID NO: 850742 - RNA, 22 nt, Mycobacterium avium subsp. paratuberculosis
ggacagcgcgacgcacgccggc

SEQ ID NO: 850743 - RNA, 17 nt, Mycobacterium avium subsp. paratuberculosis
ggacagcgcgacgggca

SEQ ID NO: 850744 - RNA, 13 nt, Mycobacterium avium subsp. paratuberculosis
ggacagcucaccg

SEQ ID NO: 850745 - RNA, 14 nt, Mycobacterium avium subsp. paratuberculosis
ggacagcucaccgg

SEQ ID NO: 850746 - RNA, 15 nt, Mycobacterium avium subsp. paratuberculosis
ggacagcucaccggg

SEQ ID NO: 850747 - RNA, 15 nt, Mycobacterium avium subsp. paratuberculosis
ggacagcucgccggc

SEQ ID NO: 850748 - RNA, 18 nt, Mycobacterium avium subsp. paratuberculosis
ggacagcucgccggccgc

SEQ ID NO: 850749 - RNA, 15 nt, Mycobacterium avium subsp. paratuberculosis
ggacagcuggcgguc

SEQ ID NO: 850750 - RNA, 16 nt, Mycobacterium avium subsp. paratuberculosis
ggacagcuggcggucg

SEQ ID NO: 850751 - RNA, 13 nt, Mycobacterium avium subsp. paratuberculosis
ggacgaugcgcgc

SEQ ID NO: 850752 - RNA, 15 nt, Mycobacterium avium subsp. paratuberculosis
ggacgaugcggggcc

SEQ ID NO: 850753 - RNA, 18 nt, Mycobacterium avium subsp. paratuberculosis
ggacgauguccgccggcc

SEQ ID NO: 850754 - RNA, 17 nt, Mycobacterium avium subsp. paratuberculosis
ggacgacucguucgacg

SEQ ID NO: 850755 - RNA, 16 nt, Mycobacterium avium subsp. paratuberculosis
ggacgaugacccagcc

SEQ ID NO: 850756 - RNA, 22 nt, Mycobacterium avium subsp. paratuberculosis
ggacgaugacccagcccagcug

SEQ ID NO: 850757 - RNA, 14 nt, Mycobacterium avium subsp. paratuberculosis
ggacgaggcccgca

SEQ ID NO: 850758 - RNA, 14 nt, Mycobacterium avium subsp. paratuberculosis
ggacgaugcgcacc

SEQ ID NO: 850759 - RNA, 12 nt, Mycobacterium avium subsp. paratuberculosis
ggacgaugcgcg

SEQ ID NO: 850760 - RNA, 20 nt, Mycobacterium avium subsp. paratuberculosis
ggacgccgcacgcgaccgcg

SEQ ID NO: 850761 - RNA, 13 nt, Mycobacterium avium subsp. paratuberculosis
ggacgccaguggc

SEQ ID NO: 850762 - RNA, 23 nt, Mycobacterium avium subsp. paratuberculosis
ggacgcccagaacugggccgccg

SEQ ID NO: 850763 - RNA, 12 nt, Mycobacterium avium subsp. paratuberculosis
ggacgcccgcga

SEQ ID NO: 850764 - RNA, 14 nt, Mycobacterium avium subsp. paratuberculosis
ggacgcccgcgacc

SEQ ID NO: 850765 - RNA, 15 nt, Mycobacterium avium subsp. paratuberculosis
ggacgcccgcgaccc

SEQ ID NO: 850766 - RNA, 15 nt, Mycobacterium avium subsp. paratuberculosis
ggacgcccgcgaggu

SEQ ID NO: 850767 - RNA, 20 nt, Mycobacterium avium subsp. paratuberculosis
ggacgcccgcgaggugucga

SEQ ID NO: 850768 - RNA, 16 nt, Mycobacterium avium subsp. paratuberculosis
ggacgcauccacggcc

SEQ ID NO: 850769 - RNA, 13 nt, Mycobacterium avium subsp. paratuberculosis
ggacgccacggcg

SEQ ID NO: 850770 - RNA, 14 nt, Mycobacterium avium subsp. paratuberculosis
ggacgccacggcga

SEQ ID NO: 850771 - RNA, 18 nt, Mycobacterium avium subsp. paratuberculosis
ggacgaggugaccggcga

SEQ ID NO: 850772 - RNA, 19 nt, Mycobacterium avium subsp. paratuberculosis
ggacgaggugaccggcgag

SEQ ID NO: 850773 - RNA, 13 nt, Mycobacterium avium subsp. paratuberculosis
ggacgagcagccg

SEQ ID NO: 850774 - RNA, 14 nt, Mycobacterium avium subsp. paratuberculosis
ggacgaccugggcg

SEQ ID NO: 850775 - RNA, 18 nt, Mycobacterium avium subsp. paratuberculosis
ggacgaccugggcgccgu

SEQ ID NO: 850776 - RNA, 23 nt, Mycobacterium avium subsp. paratuberculosis
ggacgaccugggcgccgucgccg

SEQ ID NO: 850777 - RNA, 11 nt, Mycobacterium avium subsp. paratuberculosis
ggacgacgccg

SEQ ID NO: 850778 - RNA, 14 nt, Mycobacterium avium subsp. paratuberculosis
ggacgacggccagc

SEQ ID NO: 850779 - RNA, 16 nt, Mycobacterium avium subsp. paratuberculosis
ggacgacggcgccgcc

SEQ ID NO: 850780 - RNA, 12 nt, Mycobacterium avium subsp. paratuberculosis
ggacgacggcgg

SEQ ID NO: 850781 - RNA, 13 nt, Mycobacterium avium subsp. paratuberculosis
ggacgacggcggg

SEQ ID NO: 850782 - RNA, 23 nt, Mycobacterium avium subsp. paratuberculosis
ggacgacgugcccuuccccggcg

SEQ ID NO: 850783 - RNA, 15 nt, Mycobacterium avium subsp. paratuberculosis
ggacgaagaccgggu

SEQ ID NO: 850784 - RNA, 17 nt, Mycobacterium avium subsp. paratuberculosis
ggacgaaacccggcgga

SEQ ID NO: 850785 - RNA, 15 nt, Mycobacterium avium subsp. paratuberculosis
ggaccucgaccagcc

SEQ ID NO: 850786 - RNA, 16 nt, Mycobacterium avium subsp. paratuberculosis
ggaccucgaccagccg

SEQ ID NO: 850787 - RNA, 19 nt, Mycobacterium avium subsp. paratuberculosis
ggaccucgaccagccggug

SEQ ID NO: 850788 - RNA, 20 nt, Mycobacterium avium subsp. paratuberculosis
ggaccucgaccagccggugg

SEQ ID NO: 850789 - RNA, 22 nt, Mycobacterium avium subsp. paratuberculosis
ggaccugccggcgaucaccggg

SEQ ID NO: 850790 - RNA, 14 nt, Mycobacterium avium subsp. paratuberculosis
ggaccgucgguguc

SEQ ID NO: 850791 - RNA, 16 nt, Mycobacterium avium subsp. paratuberculosis
ggaccgucggugucga

SEQ ID NO: 850792 - RNA, 17 nt, Mycobacterium avium subsp. paratuberculosis
ggaccgucaccguggcg

SEQ ID NO: 850793 - RNA, 21 nt, Mycobacterium avium subsp. paratuberculosis
ggaccgugcgacuugguggcc

SEQ ID NO: 850794 - RNA, 14 nt, Mycobacterium avium subsp. paratuberculosis
ggaccgucgcgcag

SEQ ID NO: 850795 - RNA, 15 nt, Mycobacterium avium subsp. paratuberculosis
ggaccgucgcgcagc

SEQ ID NO: 850796 - RNA, 19 nt, Mycobacterium avium subsp. paratuberculosis
ggaccgucgcgcagcccga

SEQ ID NO: 850797 - RNA, 20 nt, Mycobacterium avium subsp. paratuberculosis
ggaccgggugaccggcgcgc

SEQ ID NO: 850798 - RNA, 21 nt, Mycobacterium avium subsp. paratuberculosis
ggaccgggugaccggcgcgca

SEQ ID NO: 850799 - RNA, 13 nt, Mycobacterium avium subsp. paratuberculosis
ggaccggguggug

SEQ ID NO: 850800 - RNA, 18 nt, Mycobacterium avium subsp. paratuberculosis
ggaccgguaggcgcaccg

SEQ ID NO: 850801 - RNA, 22 nt, Mycobacterium avium subsp. paratuberculosis
ggaccgggacgacggcgccgcc

SEQ ID NO: 850802 - RNA, 15 nt, Mycobacterium avium subsp. paratuberculosis
ggaccggcgccggcc

SEQ ID NO: 850803 - RNA, 17 nt, Mycobacterium avium subsp. paratuberculosis
ggaccggcgccggccgc

SEQ ID NO: 850804 - RNA, 18 nt, Mycobacterium avium subsp. paratuberculosis
ggaccggcgccggccgcc

SEQ ID NO: 850805 - RNA, 15 nt, Mycobacterium avium subsp. paratuberculosis
ggaccggcggccgcc

SEQ ID NO: 850806 - RNA, 11 nt, Mycobacterium avium subsp. paratuberculosis
ggaccggcguc

SEQ ID NO: 850807 - RNA, 21 nt, Mycobacterium avium subsp. paratuberculosis
ggaccggcucguagcuggugc

SEQ ID NO: 850808 - RNA, 17 nt, Mycobacterium avium subsp. paratuberculosis
ggaccgcgugugcccgc

SEQ ID NO: 850809 - RNA, 19 nt, Mycobacterium avium subsp. paratuberculosis
ggaccgcgugugcccgccu

SEQ ID NO: 850810 - RNA, 20 nt, Mycobacterium avium subsp. paratuberculosis
ggaccgcuugacgccgccga

SEQ ID NO: 850811 - RNA, 23 nt, Mycobacterium avium subsp. paratuberculosis
ggaccggauccaccaauucgcgc

SEQ ID NO: 850812 - RNA, 12 nt, Mycobacterium avium subsp. paratuberculosis
ggaccggccagc

SEQ ID NO: 850813 - RNA, 14 nt, Mycobacterium avium subsp. paratuberculosis
ggaccggccagcag

SEQ ID NO: 850814 - RNA, 19 nt, Mycobacterium avium subsp. paratuberculosis
ggaccggccagcagccgcu

SEQ ID NO: 850815 - RNA, 20 nt, Mycobacterium avium subsp. paratuberculosis
ggaccggccgugcgcgucga

SEQ ID NO: 850816 - RNA, 15 nt, Mycobacterium avium subsp. paratuberculosis
ggaccgcgcgggcca

SEQ ID NO: 850817 - RNA, 16 nt, Mycobacterium avium subsp. paratuberculosis
ggaccgcgcgggccag

SEQ ID NO: 850818 - RNA, 14 nt, Mycobacterium avium subsp. paratuberculosis
ggaccgcgggcgca

SEQ ID NO: 850819 - RNA, 12 nt, Mycobacterium avium subsp. paratuberculosis
ggaccgcgcagu

SEQ ID NO: 850820 - RNA, 14 nt, Mycobacterium avium subsp. paratuberculosis
ggaccgcgcagucg

SEQ ID NO: 850821 - RNA, 17 nt, Mycobacterium avium subsp. paratuberculosis
ggaccgcgcagucggcg

SEQ ID NO: 850822 - RNA, 19 nt, Mycobacterium avium subsp. paratuberculosis
ggaccgcgcagucggcguc

SEQ ID NO: 850823 - RNA, 20 nt, Mycobacterium avium subsp. paratuberculosis
ggaccgcgcgccggccagca

SEQ ID NO: 850824 - RNA, 21 nt, Mycobacterium avium subsp. paratuberculosis
ggaccgcgcgccggccagcac

SEQ ID NO: 850825 - RNA, 16 nt, Mycobacterium avium subsp. paratuberculosis
ggaccgagccgcgcgc

SEQ ID NO: 850826 - RNA, 19 nt, Mycobacterium avium subsp. paratuberculosis
ggaccgagccgcgcgccga

SEQ ID NO: 850827 - RNA, 15 nt, Mycobacterium avium subsp. paratuberculosis
ggaccgaggugccgc

SEQ ID NO: 850828 - RNA, 17 nt, Mycobacterium avium subsp. paratuberculosis
ggaccgaggugccgcgg

SEQ ID NO: 850829 - RNA, 16 nt, Mycobacterium avium subsp. paratuberculosis
ggaccgcacgccgggu

SEQ ID NO: 850830 - RNA, 14 nt, Mycobacterium avium subsp. paratuberculosis
ggaccgccgcggcg

SEQ ID NO: 850831 - RNA, 15 nt, Mycobacterium avium subsp. paratuberculosis
ggaccgccgcggcgc

SEQ ID NO: 850832 - RNA, 16 nt, Mycobacterium avium subsp. paratuberculosis
ggaccgccgcggcggc

SEQ ID NO: 850833 - RNA, 17 nt, Mycobacterium avium subsp. paratuberculosis
ggaccgccgcggcggcc

SEQ ID NO: 850834 - RNA, 20 nt, Mycobacterium avium subsp. paratuberculosis
ggaccgccgcggcggccugc

SEQ ID NO: 850835 - RNA, 22 nt, Mycobacterium avium subsp. paratuberculosis
ggaccgagaugaagacccggcc

SEQ ID NO: 850836 - RNA, 18 nt, Mycobacterium avium subsp. paratuberculosis
ggaccaucuacgaccucg

SEQ ID NO: 850837 - RNA, 15 nt, Mycobacterium avium subsp. paratuberculosis
ggacccgcucgccga

SEQ ID NO: 850838 - RNA, 15 nt, Mycobacterium avium subsp. paratuberculosis
ggacccgccccgaca

SEQ ID NO: 850839 - RNA, 13 nt, Mycobacterium avium subsp. paratuberculosis
ggacccagcuccu

SEQ ID NO: 850840 - RNA, 19 nt, Mycobacterium avium subsp. paratuberculosis
ggacccauucgucggcggu

SEQ ID NO: 850841 - RNA, 13 nt, Mycobacterium avium subsp. paratuberculosis
ggaccccgaugcg

SEQ ID NO: 850842 - RNA, 14 nt, Mycobacterium avium subsp. paratuberculosis
ggaacucccgcgcc

SEQ ID NO: 850843 - RNA, 16 nt, Mycobacterium avium subsp. paratuberculosis
ggaacucccgcgccgc

SEQ ID NO: 850844 - RNA, 13 nt, Mycobacterium avium subsp. paratuberculosis
ggaacucgaugcg

SEQ ID NO: 850845 - RNA, 12 nt, Mycobacterium avium subsp. paratuberculosis
ggaacucggccg

SEQ ID NO: 850846 - RNA, 14 nt, Mycobacterium avium subsp. paratuberculosis
ggaacucggccggc

SEQ ID NO: 850847 - RNA, 19 nt, Mycobacterium avium subsp. paratuberculosis
ggaacucggugaugccggc

SEQ ID NO: 850848 - RNA, 17 nt, Mycobacterium avium subsp. paratuberculosis
ggaacggucagccgcgg

SEQ ID NO: 850849 - RNA, 20 nt, Mycobacterium avium subsp. paratuberculosis
ggaacgggaagaucgucguc

SEQ ID NO: 850850 - RNA, 21 nt, Mycobacterium avium subsp. paratuberculosis
ggaacgggaagaucgucgucc

SEQ ID NO: 850851 - RNA, 14 nt, Mycobacterium avium subsp. paratuberculosis
ggaacggcacccgc

SEQ ID NO: 850852 - RNA, 16 nt, Mycobacterium avium subsp. paratuberculosis
ggaacggcacccgcag

SEQ ID NO: 850853 - RNA, 18 nt, Mycobacterium avium subsp. paratuberculosis
ggaacgcucacucgucuu

SEQ ID NO: 850854 - RNA, 19 nt, Mycobacterium avium subsp. paratuberculosis
ggaacgcucuucagcgcga

SEQ ID NO: 850855 - RNA, 12 nt, Mycobacterium avium subsp. paratuberculosis
ggaacgcgaccg

SEQ ID NO: 850856 - RNA, 20 nt, Mycobacterium avium subsp. paratuberculosis
ggaacgcgacgguggcggcg

SEQ ID NO: 850857 - RNA, 20 nt, Mycobacterium avium subsp. paratuberculosis
ggaacgcggcgaaggccagc

SEQ ID NO: 850858 - RNA, 19 nt, Mycobacterium avium subsp. paratuberculosis
ggaacgcgucgaccgccgc

SEQ ID NO: 850859 - RNA, 16 nt, Mycobacterium avium subsp. paratuberculosis
ggaacgcgucgcccac

SEQ ID NO: 850860 - RNA, 22 nt, Mycobacterium avium subsp. paratuberculosis
ggaacgcgucgcccacgccggu

SEQ ID NO: 850861 - RNA, 17 nt, Mycobacterium avium subsp. paratuberculosis
ggaacgccgaucaccgc

SEQ ID NO: 850862 - RNA, 17 nt, Mycobacterium avium subsp. paratuberculosis
ggaaccggcagccggcg

SEQ ID NO: 850863 - RNA, 12 nt, Mycobacterium avium subsp. paratuberculosis
ggaaccggccac

SEQ ID NO: 850864 - RNA, 22 nt, Mycobacterium avium subsp. paratuberculosis
ggaaccgaaucggucgaccagc

SEQ ID NO: 850865 - RNA, 19 nt, Mycobacterium avium subsp. paratuberculosis
ggaaccacaccccggccac

SEQ ID NO: 850866 - RNA, 15 nt, Mycobacterium avium subsp. paratuberculosis
ggaacccacgugcgg

SEQ ID NO: 850867 - RNA, 21 nt, Mycobacterium avium subsp. paratuberculosis
ggaacccacgugcggcgcccu

SEQ ID NO: 850868 - RNA, 20 nt, Mycobacterium avium subsp. paratuberculosis
ggaacccauucggucaucgg

SEQ ID NO: 850869 - RNA, 13 nt, Mycobacterium avium subsp. paratuberculosis
ggaacgacggugc

SEQ ID NO: 850870 - RNA, 21 nt, Mycobacterium avium subsp. paratuberculosis
ggaacgacggugcgcccgucg

SEQ ID NO: 850871 - RNA, 22 nt, Mycobacterium avium subsp. paratuberculosis
ggaacgaucggcuccagcgccc

SEQ ID NO: 850872 - RNA, 14 nt, Mycobacterium avium subsp. paratuberculosis
ggaacgagccggac

SEQ ID NO: 850873 - RNA, 18 nt, Mycobacterium avium subsp. paratuberculosis
ggaaccgggcacccggcg

SEQ ID NO: 850874 - RNA, 15 nt, Mycobacterium avium subsp. paratuberculosis
ggaaccgggccgcug

SEQ ID NO: 850875 - RNA, 22 nt, Mycobacterium avium subsp. paratuberculosis
ggaacagguaguagcgcgccgg

SEQ ID NO: 850876 - RNA, 19 nt, Mycobacterium avium subsp. paratuberculosis
ggaacagcgggccggcguc

SEQ ID NO: 850877 - RNA, 13 nt, Mycobacterium avium subsp. paratuberculosis
ggaacagcgucgc

SEQ ID NO: 850878 - RNA, 15 nt, Mycobacterium avium subsp. paratuberculosis
ggaacagcgucgccg

SEQ ID NO: 850879 - RNA, 17 nt, Mycobacterium avium subsp. paratuberculosis
ggaacagcgucgccgac

SEQ ID NO: 850880 - RNA, 21 nt, Mycobacterium avium subsp. paratuberculosis
ggaacagcgucgccgacgggc

SEQ ID NO: 850881 - RNA, 15 nt, Mycobacterium avium subsp. paratuberculosis
ggaacagcgacccga

SEQ ID NO: 850882 - RNA, 15 nt, Mycobacterium avium subsp. paratuberculosis
ggaacaccgagccgg

SEQ ID NO: 850883 - RNA, 19 nt, Mycobacterium avium subsp. paratuberculosis
ggaacaccgagccggcggc

SEQ ID NO: 850884 - RNA, 20 nt, Mycobacterium avium subsp. paratuberculosis
ggaacaccgagccggcggcg

SEQ ID NO: 850885 - RNA, 14 nt, Mycobacterium avium subsp. paratuberculosis
ggaacaccacggcc

SEQ ID NO: 850886 - RNA, 14 nt, Mycobacterium avium subsp. paratuberculosis
ggaacaccacgucg

SEQ ID NO: 850887 - RNA, 17 nt, Mycobacterium avium subsp. paratuberculosis
ggaacaccacgucgucc

SEQ ID NO: 850888 - RNA, 16 nt, Mycobacterium avium subsp. paratuberculosis
ggaacacgucggcgau

SEQ ID NO: 850889 - RNA, 18 nt, Mycobacterium avium subsp. paratuberculosis
ggaacacgugauccaggu

SEQ ID NO: 850890 - RNA, 22 nt, Mycobacterium avium subsp. paratuberculosis
ggaacagacucagcccggccca

SEQ ID NO: 850891 - RNA, 14 nt, Mycobacterium avium subsp. paratuberculosis
ggaacacgcccagc

SEQ ID NO: 850892 - RNA, 19 nt, Mycobacterium avium subsp. paratuberculosis
ggaacacgcccagcgccgc

SEQ ID NO: 850893 - RNA, 21 nt, Mycobacterium avium subsp. paratuberculosis
gcuggcgcuggaucugcccga

SEQ ID NO: 850894 - RNA, 23 nt, Mycobacterium avium subsp. paratuberculosis
gcuggcgcugggagcgggccacg

SEQ ID NO: 850895 - RNA, 13 nt, Mycobacterium avium subsp. paratuberculosis
gcuggcgcgcuug

SEQ ID NO: 850896 - RNA, 19 nt, Mycobacterium avium subsp. paratuberculosis
gcuggcgcgauagccggug

SEQ ID NO: 850897 - RNA, 17 nt, Mycobacterium avium subsp. paratuberculosis
gcuggcgccggcgucca

SEQ ID NO: 850898 - RNA, 13 nt, Mycobacterium avium subsp. paratuberculosis
gcuggcgcaggug

SEQ ID NO: 850899 - RNA, 16 nt, Mycobacterium avium subsp. paratuberculosis
gcuggcgcaggcgcug

SEQ ID NO: 850900 - RNA, 14 nt, Mycobacterium avium subsp. paratuberculosis
gcuggcgccgaaca

SEQ ID NO: 850901 - RNA, 15 nt, Mycobacterium avium subsp. paratuberculosis
ggaauggcagcagcc

SEQ ID NO: 850902 - RNA, 16 nt, Mycobacterium avium subsp. paratuberculosis
ggaauggcagcagccg

SEQ ID NO: 850903 - RNA, 21 nt, Mycobacterium avium subsp. paratuberculosis
ggaaugucauuugagcggccg

SEQ ID NO: 850904 - RNA, 19 nt, Mycobacterium avium subsp. paratuberculosis
ggaaugugccugcgggccc

SEQ ID NO: 850905 - RNA, 15 nt, Mycobacterium avium subsp. paratuberculosis
ggaaugaacugccgc

SEQ ID NO: 850906 - RNA, 12 nt, Mycobacterium avium subsp. paratuberculosis
ggaaucgcggca

SEQ ID NO: 850907 - RNA, 21 nt, Mycobacterium avium subsp. paratuberculosis
ggaaucgcggcaggcgacccg

SEQ ID NO: 850908 - RNA, 23 nt, Mycobacterium avium subsp. paratuberculosis
ggaauauccaucgauggcggugu

SEQ ID NO: 850909 - RNA, 14 nt, Mycobacterium avium subsp. paratuberculosis
ggaauccuggccga

SEQ ID NO: 850910 - RNA, 20 nt, Mycobacterium avium subsp. paratuberculosis
ggaaguucgcuggcggggcg

SEQ ID NO: 850911 - RNA, 17 nt, Mycobacterium avium subsp. paratuberculosis
ggaaguccggcgcgccc

SEQ ID NO: 850912 - RNA, 13 nt, Mycobacterium avium subsp. paratuberculosis
ggaagugccggcg

SEQ ID NO: 850913 - RNA, 13 nt, Mycobacterium avium subsp. paratuberculosis
ggaaguggaccgc

SEQ ID NO: 850914 - RNA, 17 nt, Mycobacterium avium subsp. paratuberculosis
ggaaggccgcgcgggcg

SEQ ID NO: 850915 - RNA, 15 nt, Mycobacterium avium subsp. paratuberculosis
ggaaggcgaucacga

SEQ ID NO: 850916 - RNA, 14 nt, Mycobacterium avium subsp. paratuberculosis
ggaaggcgccggcg

SEQ ID NO: 850917 - RNA, 15 nt, Mycobacterium avium subsp. paratuberculosis
ggaaggcgaccgcgu

SEQ ID NO: 850918 - RNA, 21 nt, Mycobacterium avium subsp. paratuberculosis
ggaaggugguccuggcggugg

SEQ ID NO: 850919 - RNA, 15 nt, Mycobacterium avium subsp. paratuberculosis
ggaaguacaccaccg

SEQ ID NO: 850920 - RNA, 19 nt, Mycobacterium avium subsp. paratuberculosis
ggaaguacaccaccgcggc

SEQ ID NO: 850921 - RNA, 17 nt, Mycobacterium avium subsp. paratuberculosis
ggaaguagccggccagc

SEQ ID NO: 850922 - RNA, 20 nt, Mycobacterium avium subsp. paratuberculosis
ggaaguagccggccagcguc

SEQ ID NO: 850923 - RNA, 14 nt, Mycobacterium avium subsp. paratuberculosis
ggaacuugcgccgg

SEQ ID NO: 850924 - RNA, 21 nt, Mycobacterium avium subsp. paratuberculosis
ggaacugcucccaggcgucgu

SEQ ID NO: 850925 - RNA, 17 nt, Mycobacterium avium subsp. paratuberculosis
ggaagaacccggcgugc

SEQ ID NO: 850926 - RNA, 15 nt, Mycobacterium avium subsp. paratuberculosis
ggaagaccguugacg

SEQ ID NO: 850927 - RNA, 18 nt, Mycobacterium avium subsp. paratuberculosis
ggaagacguaggcggcca

SEQ ID NO: 850928 - RNA, 20 nt, Mycobacterium avium subsp. paratuberculosis
ggaagacgugcacgugcagg

SEQ ID NO: 850929 - RNA, 23 nt, Mycobacterium avium subsp. paratuberculosis
ggaagaucgucgucccgucggcg

SEQ ID NO: 850930 - RNA, 16 nt, Mycobacterium avium subsp. paratuberculosis
ggaagaucgcagcggu

SEQ ID NO: 850931 - RNA, 21 nt, Mycobacterium avium subsp. paratuberculosis
ggaaggacgucaggccgguca

SEQ ID NO: 850932 - RNA, 21 nt, Mycobacterium avium subsp. paratuberculosis
ggaagcugccguugcgccagc

SEQ ID NO: 850933 - RNA, 23 nt, Mycobacterium avium subsp. paratuberculosis
ggaagcgaauccgggugucgacg

SEQ ID NO: 850934 - RNA, 14 nt, Mycobacterium avium subsp. paratuberculosis
ggaagcgcccgcgc

SEQ ID NO: 850935 - RNA, 18 nt, Mycobacterium avium subsp. paratuberculosis
ggaagcgcaucgccggcg

SEQ ID NO: 850936 - RNA, 21 nt, Mycobacterium avium subsp. paratuberculosis
ggaagcgcaucgccggcgcgc

SEQ ID NO: 850937 - RNA, 22 nt, Mycobacterium avium subsp. paratuberculosis
ggaagcgcaucgccggcgcgcu

SEQ ID NO: 850938 - RNA, 18 nt, Mycobacterium avium subsp. paratuberculosis
ggaagccgcagcaggugc

SEQ ID NO: 850939 - RNA, 15 nt, Mycobacterium avium subsp. paratuberculosis
ggaagccgucggugc

SEQ ID NO: 850940 - RNA, 14 nt, Mycobacterium avium subsp. paratuberculosis
ggaagcccaccgcg

SEQ ID NO: 850941 - RNA, 23 nt, Mycobacterium avium subsp. paratuberculosis
ggaagccgagcuugggccggugc

SEQ ID NO: 850942 - RNA, 18 nt, Mycobacterium avium subsp. paratuberculosis
ggaagccgaggucgccga

SEQ ID NO: 850943 - RNA, 19 nt, Mycobacterium avium subsp. paratuberculosis
ggaagccgaggucgccgac

SEQ ID NO: 850944 - RNA, 13 nt, Mycobacterium avium subsp. paratuberculosis
ggagcaucggggu

SEQ ID NO: 850945 - RNA, 20 nt, Mycobacterium avium subsp. paratuberculosis
ggagccgaccucggcgacga

SEQ ID NO: 850946 - RNA, 18 nt, Mycobacterium avium subsp. paratuberculosis
ggagccgagcaccaggcg

SEQ ID NO: 850947 - RNA, 23 nt, Mycobacterium avium subsp. paratuberculosis
ggagccgagcaccaggcgcacca

SEQ ID NO: 850948 - RNA, 15 nt, Mycobacterium avium subsp. paratuberculosis
ggagcacucgauggc

SEQ ID NO: 850949 - RNA, 15 nt, Mycobacterium avium subsp. paratuberculosis
ggagcaaauccggca

SEQ ID NO: 850950 - RNA, 17 nt, Mycobacterium avium subsp. paratuberculosis
ggagcaaauccggcagc

SEQ ID NO: 850951 - RNA, 17 nt, Mycobacterium avium subsp. paratuberculosis
ggagcaccugcgcgacg

SEQ ID NO: 850952 - RNA, 14 nt, Mycobacterium avium subsp. paratuberculosis
ggagaucgugcugu

SEQ ID NO: 850953 - RNA, 20 nt, Mycobacterium avium subsp. paratuberculosis
ggagauacggucgcaccgcg

SEQ ID NO: 850954 - RNA, 14 nt, Mycobacterium avium subsp. paratuberculosis
ggagauccggccgc

SEQ ID NO: 850955 - RNA, 18 nt, Mycobacterium avium subsp. paratuberculosis
ggagauccggccgcuggu

SEQ ID NO: 850956 - RNA, 14 nt, Mycobacterium avium subsp. paratuberculosis
ggagaucggcgagu

SEQ ID NO: 850957 - RNA, 20 nt, Mycobacterium avium subsp. paratuberculosis
ggagagcgcgggcaccgucg

SEQ ID NO: 850958 - RNA, 23 nt, Mycobacterium avium subsp. paratuberculosis
ggagagcgcgggcaccgucgucg

SEQ ID NO: 850959 - RNA, 16 nt, Mycobacterium avium subsp. paratuberculosis
ggagagcuugccgcgg

SEQ ID NO: 850960 - RNA, 13 nt, Mycobacterium avium subsp. paratuberculosis
ggagaggcccggc

SEQ ID NO: 850961 - RNA, 16 nt, Mycobacterium avium subsp. paratuberculosis
ggagaggcccggcagc

SEQ ID NO: 850962 - RNA, 21 nt, Mycobacterium avium subsp. paratuberculosis
ggagacugcgacccaccgucg

SEQ ID NO: 850963 - RNA, 15 nt, Mycobacterium avium subsp. paratuberculosis
ggagacgucggccgg

SEQ ID NO: 850964 - RNA, 17 nt, Mycobacterium avium subsp. paratuberculosis
ggagacguggcggcggu

SEQ ID NO: 850965 - RNA, 23 nt, Mycobacterium avium subsp. paratuberculosis
ggagacgaccagguccaccccgc

SEQ ID NO: 850966 - RNA, 13 nt, Mycobacterium avium subsp. paratuberculosis
ggagacgacgacg

SEQ ID NO: 850967 - RNA, 23 nt, Mycobacterium avium subsp. paratuberculosis
ggagaaccgcucgauggcgccga

SEQ ID NO: 850968 - RNA, 16 nt, Mycobacterium avium subsp. paratuberculosis
ggagaaggugucgcac

SEQ ID NO: 850969 - RNA, 19 nt, Mycobacterium avium subsp. paratuberculosis
ggagaaggugucgcacugc

SEQ ID NO: 850970 - RNA, 13 nt, Mycobacterium avium subsp. paratuberculosis
ggagaccagcagc

SEQ ID NO: 850971 - RNA, 16 nt, Mycobacterium avium subsp. paratuberculosis
ggagaccuccugcugg

SEQ ID NO: 850972 - RNA, 17 nt, Mycobacterium avium subsp. paratuberculosis
ggagaccucuucgaccc

SEQ ID NO: 850973 - RNA, 23 nt, Mycobacterium avium subsp. paratuberculosis
ggagcgcaacguguacucggcgu

SEQ ID NO: 850974 - RNA, 16 nt, Mycobacterium avium subsp. paratuberculosis
aaggagaaggccgcgc

SEQ ID NO: 850975 - RNA, 17 nt, Mycobacterium avium subsp. paratuberculosis
ggagccuucuucgccgc

SEQ ID NO: 850976 - RNA, 17 nt, Mycobacterium avium subsp. paratuberculosis
ggagccuucuugaccgc

SEQ ID NO: 850977 - RNA, 17 nt, Mycobacterium avium subsp. paratuberculosis
ggagccuuggucgcggc

SEQ ID NO: 850978 - RNA, 18 nt, Mycobacterium avium subsp. paratuberculosis
ggagccuuggucgcggcc

SEQ ID NO: 850979 - RNA, 23 nt, Mycobacterium avium subsp. paratuberculosis
ggagccguccggguucgacgccu

SEQ ID NO: 850980 - RNA, 17 nt, Mycobacterium avium subsp. paratuberculosis
ggagccgucggugucca

SEQ ID NO: 850981 - RNA, 14 nt, Mycobacterium avium subsp. paratuberculosis
ggagccgugcagcg

SEQ ID NO: 850982 - RNA, 18 nt, Mycobacterium avium subsp. paratuberculosis
ggagccgugcagcgccca

SEQ ID NO: 850983 - RNA, 20 nt, Mycobacterium avium subsp. paratuberculosis
ggagccgugcagcgcccagc

SEQ ID NO: 850984 - RNA, 20 nt, Mycobacterium avium subsp. paratuberculosis
ggagccggccagguugacca

SEQ ID NO: 850985 - RNA, 16 nt, Mycobacterium avium subsp. paratuberculosis
ggagccggccgccgaa

SEQ ID NO: 850986 - RNA, 19 nt, Mycobacterium avium subsp. paratuberculosis
ggagccggccgccgaagcc

SEQ ID NO: 850987 - RNA, 12 nt, Mycobacterium avium subsp. paratuberculosis
ggagccggccag

SEQ ID NO: 850988 - RNA, 16 nt, Mycobacterium avium subsp. paratuberculosis
ggagccggcggcggug

SEQ ID NO: 850989 - RNA, 17 nt, Mycobacterium avium subsp. paratuberculosis
ggagccggcggcggugc

SEQ ID NO: 850990 - RNA, 23 nt, Mycobacterium avium subsp. paratuberculosis
aaggcaugggcgugccggcccgg

SEQ ID NO: 850991 - RNA, 20 nt, Mycobacterium avium subsp. paratuberculosis
aaggccagcaaccgccgugg

SEQ ID NO: 850992 - RNA, 17 nt, Mycobacterium avium subsp. paratuberculosis
aaggccgcugcccggcg

SEQ ID NO: 850993 - RNA, 23 nt, Mycobacterium avium subsp. paratuberculosis
ggacgccagcaugaucaccgcca

SEQ ID NO: 850994 - RNA, 18 nt, Mycobacterium avium subsp. paratuberculosis
ggacgcggcaggcgcccc

SEQ ID NO: 850995 - RNA, 16 nt, Mycobacterium avium subsp. paratuberculosis
ggacgcggucgccgcc

SEQ ID NO: 850996 - RNA, 14 nt, Mycobacterium avium subsp. paratuberculosis
ggacgcggugacgg

SEQ ID NO: 850997 - RNA, 17 nt, Mycobacterium avium subsp. paratuberculosis
ggacgcggugacgguga

SEQ ID NO: 850998 - RNA, 13 nt, Mycobacterium avium subsp. paratuberculosis
ggacgcgguggug

SEQ ID NO: 850999 - RNA, 17 nt, Mycobacterium avium subsp. paratuberculosis
ggacgcgguggugcucg

SEQ ID NO: 851000 - RNA, 13 nt, Mycobacterium avium subsp. paratuberculosis
ggacgcugaacag

SEQ ID NO: 851001 - RNA, 19 nt, Mycobacterium avium subsp. paratuberculosis
ggacgcugaacagcccgag

SEQ ID NO: 851002 - RNA, 19 nt, Mycobacterium avium subsp. paratuberculosis
ggacgcggccucaccgcgg

SEQ ID NO: 851003 - RNA, 19 nt, Mycobacterium avium subsp. paratuberculosis
ggacgcggccagcgcccgc

SEQ ID NO: 851004 - RNA, 14 nt, Mycobacterium avium subsp. paratuberculosis
ggacgcggccgagc

SEQ ID NO: 851005 - RNA, 15 nt, Mycobacterium avium subsp. paratuberculosis
ggacgcggccgagcc

SEQ ID NO: 851006 - RNA, 16 nt, Mycobacterium avium subsp. paratuberculosis
ggacgcggccgagccg

SEQ ID NO: 851007 - RNA, 13 nt, Mycobacterium avium subsp. paratuberculosis
ggacgcgcccggc

SEQ ID NO: 851008 - RNA, 13 nt, Mycobacterium avium subsp. paratuberculosis
ggacgcgauggcg

SEQ ID NO: 851009 - RNA, 15 nt, Mycobacterium avium subsp. paratuberculosis
ggacgcgauggcgcu

SEQ ID NO: 851010 - RNA, 20 nt, Mycobacterium avium subsp. paratuberculosis
ggacgccucgcgcagcgcgu

SEQ ID NO: 851011 - RNA, 13 nt, Mycobacterium avium subsp. paratuberculosis
ggacgccugccgc

SEQ ID NO: 851012 - RNA, 14 nt, Mycobacterium avium subsp. paratuberculosis
ggacgccgugcagg

SEQ ID NO: 851013 - RNA, 20 nt, Mycobacterium avium subsp. paratuberculosis
ggacgccucccccacccgca

SEQ ID NO: 851014 - RNA, 21 nt, Mycobacterium avium subsp. paratuberculosis
ggacgccucccccacccgcac

SEQ ID NO: 851015 - RNA, 12 nt, Mycobacterium avium subsp. paratuberculosis
ggacgccggcag

SEQ ID NO: 851016 - RNA, 13 nt, Mycobacterium avium subsp. paratuberculosis
ggacgccggcagc

SEQ ID NO: 851017 - RNA, 15 nt, Mycobacterium avium subsp. paratuberculosis
ggacgggaucggcgc

SEQ ID NO: 851018 - RNA, 19 nt, Mycobacterium avium subsp. paratuberculosis
ggacgggcauccggcucag

SEQ ID NO: 851019 - RNA, 13 nt, Mycobacterium avium subsp. paratuberculosis
ggacggcgggugg

SEQ ID NO: 851020 - RNA, 14 nt, Mycobacterium avium subsp. paratuberculosis
ggacggggcgaugc

SEQ ID NO: 851021 - RNA, 18 nt, Mycobacterium avium subsp. paratuberculosis
ggacgggggugccgaccg

SEQ ID NO: 851022 - RNA, 17 nt, Mycobacterium avium subsp. paratuberculosis
ggacggguugcaggcca

SEQ ID NO: 851023 - RNA, 17 nt, Mycobacterium avium subsp. paratuberculosis
ggacggguugggcgcca

SEQ ID NO: 851024 - RNA, 15 nt, Mycobacterium avium subsp. paratuberculosis
ggacggucagcgcgc

SEQ ID NO: 851025 - RNA, 13 nt, Mycobacterium avium subsp. paratuberculosis
ggacggucgccga

SEQ ID NO: 851026 - RNA, 12 nt, Mycobacterium avium subsp. paratuberculosis
ggacggcgacgg

SEQ ID NO: 851027 - RNA, 23 nt, Mycobacterium avium subsp. paratuberculosis
ggacggcgagcggcccugcgcgg

SEQ ID NO: 851028 - RNA, 20 nt, Mycobacterium avium subsp. paratuberculosis
ggacggcgaggaucgcgaug

SEQ ID NO: 851029 - RNA, 12 nt, Mycobacterium avium subsp. paratuberculosis
ggacggcccgac

SEQ ID NO: 851030 - RNA, 17 nt, Mycobacterium avium subsp. paratuberculosis
ggacggcccgacgacgc

SEQ ID NO: 851031 - RNA, 19 nt, Mycobacterium avium subsp. paratuberculosis
ggacggcccgacgacgccg

SEQ ID NO: 851032 - RNA, 21 nt, Mycobacterium avium subsp. paratuberculosis
ggacggcccgacgacgccguc

SEQ ID NO: 851033 - RNA, 20 nt, Mycobacterium avium subsp. paratuberculosis
ggacggccgaaacgcccggc

SEQ ID NO: 851034 - RNA, 19 nt, Mycobacterium avium subsp. paratuberculosis
ggacggagccgugcccgag

SEQ ID NO: 851035 - RNA, 13 nt, Mycobacterium avium subsp. paratuberculosis
ggacggaaaucgc

SEQ ID NO: 851036 - RNA, 13 nt, Mycobacterium avium subsp. paratuberculosis
ggacggaucgagu

SEQ ID NO: 851037 - RNA, 22 nt, Mycobacterium avium subsp. paratuberculosis
ggacggaucgagucccgcgcgg

SEQ ID NO: 851038 - RNA, 21 nt, Mycobacterium avium subsp. paratuberculosis
ggacguuggggugguuguuga

SEQ ID NO: 851039 - RNA, 17 nt, Mycobacterium avium subsp. paratuberculosis
ggacucaaucggucagg

SEQ ID NO: 851040 - RNA, 18 nt, Mycobacterium avium subsp. paratuberculosis
ggacucaaucggucaggg

SEQ ID NO: 851041 - RNA, 14 nt, Mycobacterium avium subsp. paratuberculosis
ggacuccaccgcca

SEQ ID NO: 851042 - RNA, 15 nt, Mycobacterium avium subsp. paratuberculosis
ggacucccccaccac

SEQ ID NO: 851043 - RNA, 18 nt, Mycobacterium avium subsp. paratuberculosis
ggacgugucgggguggug

SEQ ID NO: 851044 - RNA, 14 nt, Mycobacterium avium subsp. paratuberculosis
ggacguugaggcgg

SEQ ID NO: 851045 - RNA, 18 nt, Mycobacterium avium subsp. paratuberculosis
ggacguggcucagcggca

SEQ ID NO: 851046 - RNA, 16 nt, Mycobacterium avium subsp. paratuberculosis
ggacgucgucgacguc

SEQ ID NO: 851047 - RNA, 13 nt, Mycobacterium avium subsp. paratuberculosis
ggacgucgucgcu

SEQ ID NO: 851048 - RNA, 12 nt, Mycobacterium avium subsp. paratuberculosis
ggacgugaucgc

SEQ ID NO: 851049 - RNA, 13 nt, Mycobacterium avium subsp. paratuberculosis
ggacgugaucgcg

SEQ ID NO: 851050 - RNA, 15 nt, Mycobacterium avium subsp. paratuberculosis
ggacgugaucgcggu

SEQ ID NO: 851051 - RNA, 16 nt, Mycobacterium avium subsp. paratuberculosis
ggacgugaucgcggug

SEQ ID NO: 851052 - RNA, 17 nt, Mycobacterium avium subsp. paratuberculosis
ggacgugcacgcguucg

SEQ ID NO: 851053 - RNA, 14 nt, Mycobacterium avium subsp. paratuberculosis
ggacgucaggccgg

SEQ ID NO: 851054 - RNA, 18 nt, Mycobacterium avium subsp. paratuberculosis
ggacgucaggccggucag

SEQ ID NO: 851055 - RNA, 19 nt, Mycobacterium avium subsp. paratuberculosis
ggacgucaggccggucagc

SEQ ID NO: 851056 - RNA, 16 nt, Mycobacterium avium subsp. paratuberculosis
ggacgucggccggcug

SEQ ID NO: 851057 - RNA, 15 nt, Mycobacterium avium subsp. paratuberculosis
ggacgguuucaccgc

SEQ ID NO: 851058 - RNA, 19 nt, Mycobacterium avium subsp. paratuberculosis
ggacgguuucaccgccguc

SEQ ID NO: 851059 - RNA, 20 nt, Mycobacterium avium subsp. paratuberculosis
ggacgguuucaccgccgucc

SEQ ID NO: 851060 - RNA, 19 nt, Mycobacterium avium subsp. paratuberculosis
ggacgguuucugccggccg

SEQ ID NO: 851061 - RNA, 20 nt, Mycobacterium avium subsp. paratuberculosis
ggacgguuucugccggccgc

SEQ ID NO: 851062 - RNA, 21 nt, Mycobacterium avium subsp. paratuberculosis
ggacgguuucugccggccgcc

SEQ ID NO: 851063 - RNA, 12 nt, Mycobacterium avium subsp. paratuberculosis
ggacggugcagc

SEQ ID NO: 851064 - RNA, 15 nt, Mycobacterium avium subsp. paratuberculosis
ggacggugcagccgg

SEQ ID NO: 851065 - RNA, 13 nt, Mycobacterium avium subsp. paratuberculosis
ggacugggcgauu

SEQ ID NO: 851066 - RNA, 15 nt, Mycobacterium avium subsp. paratuberculosis
ggacugggcgccgcc

SEQ ID NO: 851067 - RNA, 14 nt, Mycobacterium avium subsp. paratuberculosis
ggagaaaccgucgg

SEQ ID NO: 851068 - RNA, 22 nt, Mycobacterium avium subsp. paratuberculosis
ggagaaaccgucggcccgccaa

SEQ ID NO: 851069 - RNA, 23 nt, Mycobacterium avium subsp. paratuberculosis
ggacuccuccugcgacggcagca

SEQ ID NO: 851070 - RNA, 15 nt, Mycobacterium avium subsp. paratuberculosis
ggacucgaucgccac

SEQ ID NO: 851071 - RNA, 18 nt, Mycobacterium avium subsp. paratuberculosis
ggacucgucgcugaucgc

SEQ ID NO: 851072 - RNA, 19 nt, Mycobacterium avium subsp. paratuberculosis
ggacucguuggggccacca

SEQ ID NO: 851073 - RNA, 23 nt, Mycobacterium avium subsp. paratuberculosis
ggacucuucuuccugcuugacgg

SEQ ID NO: 851074 - RNA, 13 nt, Mycobacterium avium subsp. paratuberculosis
ggacugcccgacc

SEQ ID NO: 851075 - RNA, 14 nt, Mycobacterium avium subsp. paratuberculosis
ggacugcgccgggg

SEQ ID NO: 851076 - RNA, 16 nt, Mycobacterium avium subsp. paratuberculosis
ggacuggaccgugccg

SEQ ID NO: 851077 - RNA, 12 nt, Mycobacterium avium subsp. paratuberculosis
ggagcgcccggc

SEQ ID NO: 851078 - RNA, 18 nt, Mycobacterium avium subsp. paratuberculosis
ggagcgcgguccacggug

SEQ ID NO: 851079 - RNA, 17 nt, Mycobacterium avium subsp. paratuberculosis
ggagcgcuggucggcga

SEQ ID NO: 851080 - RNA, 17 nt, Mycobacterium avium subsp. paratuberculosis
ggagcggcccagcucgg

SEQ ID NO: 851081 - RNA, 17 nt, Mycobacterium avium subsp. paratuberculosis
ggagcgcggcaugccgc

SEQ ID NO: 851082 - RNA, 23 nt, Mycobacterium avium subsp. paratuberculosis
ggagcgggccacgcagucgucga

SEQ ID NO: 851083 - RNA, 16 nt, Mycobacterium avium subsp. paratuberculosis
ggagcuaggcggccgg

SEQ ID NO: 851084 - RNA, 19 nt, Mycobacterium avium subsp. paratuberculosis
ggagcuaggcggccgggcg

SEQ ID NO: 851085 - RNA, 13 nt, Mycobacterium avium subsp. paratuberculosis
ggagcggugcggc

SEQ ID NO: 851086 - RNA, 20 nt, Mycobacterium avium subsp. paratuberculosis
ggagcggugcggcucgggcg

SEQ ID NO: 851087 - RNA, 14 nt, Mycobacterium avium subsp. paratuberculosis
ggagcgggucagcg

SEQ ID NO: 851088 - RNA, 22 nt, Mycobacterium avium subsp. paratuberculosis
ggagcugaaguucaccaccgcg

SEQ ID NO: 851089 - RNA, 17 nt, Mycobacterium avium subsp. paratuberculosis
ggagcugcccgcacugg

SEQ ID NO: 851090 - RNA, 19 nt, Mycobacterium avium subsp. paratuberculosis
ggagcugccggcgaccagc

SEQ ID NO: 851091 - RNA, 17 nt, Mycobacterium avium subsp. paratuberculosis
ggaggaauucgccgacg

SEQ ID NO: 851092 - RNA, 18 nt, Mycobacterium avium subsp. paratuberculosis
ggaggacaagucaugccg

SEQ ID NO: 851093 - RNA, 22 nt, Mycobacterium avium subsp. paratuberculosis
ggaggacaagucaugccgcgcu

SEQ ID NO: 851094 - RNA, 22 nt, Mycobacterium avium subsp. paratuberculosis
ggaggccagcucgaccgcggcg

SEQ ID NO: 851095 - RNA, 15 nt, Mycobacterium avium subsp. paratuberculosis
ggaggcacuggcgcu

SEQ ID NO: 851096 - RNA, 14 nt, Mycobacterium avium subsp. paratuberculosis
ggaggcagcgcgga

SEQ ID NO: 851097 - RNA, 14 nt, Mycobacterium avium subsp. paratuberculosis
ggaggacagcaccg

SEQ ID NO: 851098 - RNA, 15 nt, Mycobacterium avium subsp. paratuberculosis
ggaggaugccggcca

SEQ ID NO: 851099 - RNA, 17 nt, Mycobacterium avium subsp. paratuberculosis
ggaggcccagcccgccg

SEQ ID NO: 851100 - RNA, 20 nt, Mycobacterium avium subsp. paratuberculosis
ggaggcccagcccgccgcgu

SEQ ID NO: 851101 - RNA, 12 nt, Mycobacterium avium subsp. paratuberculosis
ggaggccgcggc

SEQ ID NO: 851102 - RNA, 14 nt, Mycobacterium avium subsp. paratuberculosis
ggaggccgcggcga

SEQ ID NO: 851103 - RNA, 13 nt, Mycobacterium avium subsp. paratuberculosis
ggaggccgcgggu

SEQ ID NO: 851104 - RNA, 12 nt, Mycobacterium avium subsp. paratuberculosis
ggaggccugcgc

SEQ ID NO: 851105 - RNA, 17 nt, Mycobacterium avium subsp. paratuberculosis
ggaggccugcgcggccg

SEQ ID NO: 851106 - RNA, 20 nt, Mycobacterium avium subsp. paratuberculosis
ggaggccugcgcggccgcgu

SEQ ID NO: 851107 - RNA, 22 nt, Mycobacterium avium subsp. paratuberculosis
ggaggccuucuuucguucgaug

SEQ ID NO: 851108 - RNA, 18 nt, Mycobacterium avium subsp. paratuberculosis
ggaggcgagcagccgggu

SEQ ID NO: 851109 - RNA, 23 nt, Mycobacterium avium subsp. paratuberculosis
ggaggcgagcagccgggugccca

SEQ ID NO: 851110 - RNA, 15 nt, Mycobacterium avium subsp. paratuberculosis
ggaggcgaucaggug

SEQ ID NO: 851111 - RNA, 21 nt, Mycobacterium avium subsp. paratuberculosis
ggaguuuuucgggguggugga

SEQ ID NO: 851112 - RNA, 22 nt, Mycobacterium avium subsp. paratuberculosis
ggauaacccagcaccaccacgc

SEQ ID NO: 851113 - RNA, 14 nt, Mycobacterium avium subsp. paratuberculosis
ggagugaccgccag

SEQ ID NO: 851114 - RNA, 15 nt, Mycobacterium avium subsp. paratuberculosis
ggagugaccgccagc

SEQ ID NO: 851115 - RNA, 16 nt, Mycobacterium avium subsp. paratuberculosis
ggagugacgucgcgcg

SEQ ID NO: 851116 - RNA, 17 nt, Mycobacterium avium subsp. paratuberculosis
ggagugcucggcguuga

SEQ ID NO: 851117 - RNA, 13 nt, Mycobacterium avium subsp. paratuberculosis
ggaguggccggcg

SEQ ID NO: 851118 - RNA, 21 nt, Mycobacterium avium subsp. paratuberculosis
ggaguggccggcguccaggcg

SEQ ID NO: 851119 - RNA, 15 nt, Mycobacterium avium subsp. paratuberculosis
ggaggcggccaacaa

SEQ ID NO: 851120 - RNA, 20 nt, Mycobacterium avium subsp. paratuberculosis
ggaggcguagugcgcccaga

SEQ ID NO: 851121 - RNA, 14 nt, Mycobacterium avium subsp. paratuberculosis
ggaggcgucgacgc

SEQ ID NO: 851122 - RNA, 21 nt, Mycobacterium avium subsp. paratuberculosis
ggaggcguugcgucccgcgcc

SEQ ID NO: 851123 - RNA, 20 nt, Mycobacterium avium subsp. paratuberculosis
ggaggguauucgugugcuag

SEQ ID NO: 851124 - RNA, 16 nt, Mycobacterium avium subsp. paratuberculosis
ggagggucgguggccc

SEQ ID NO: 851125 - RNA, 15 nt, Mycobacterium avium subsp. paratuberculosis
ggagggugucggcgg

SEQ ID NO: 851126 - RNA, 18 nt, Mycobacterium avium subsp. paratuberculosis
ggagggugucggcggggc

SEQ ID NO: 851127 - RNA, 17 nt, Mycobacterium avium subsp. paratuberculosis
ggaggugguccgcgaaa

SEQ ID NO: 851128 - RNA, 19 nt, Mycobacterium avium subsp. paratuberculosis
ggaggucgucgcguccagc

SEQ ID NO: 851129 - RNA, 22 nt, Mycobacterium avium subsp. paratuberculosis
ggaggugaucgccagcccggcg

SEQ ID NO: 851130 - RNA, 14 nt, Mycobacterium avium subsp. paratuberculosis
ggaggugccggccg

SEQ ID NO: 851131 - RNA, 21 nt, Mycobacterium avium subsp. paratuberculosis
ggaggucagcggcccgaucac

SEQ ID NO: 851132 - RNA, 18 nt, Mycobacterium avium subsp. paratuberculosis
ggaggucauggcgaccgc

SEQ ID NO: 851133 - RNA, 20 nt, Mycobacterium avium subsp. paratuberculosis
ggaggucauggcgaccgcga

SEQ ID NO: 851134 - RNA, 21 nt, Mycobacterium avium subsp. paratuberculosis
ggaggguuuucggggcgugug

SEQ ID NO: 851135 - RNA, 14 nt, Mycobacterium avium subsp. paratuberculosis
ggagucgucggcgc

SEQ ID NO: 851136 - RNA, 17 nt, Mycobacterium avium subsp. paratuberculosis
ggagucgucggcgcggu

SEQ ID NO: 851137 - RNA, 18 nt, Mycobacterium avium subsp. paratuberculosis
ggaguccggcucggugcc

SEQ ID NO: 851138 - RNA, 13 nt, Mycobacterium avium subsp. paratuberculosis
ggagucggggugc

SEQ ID NO: 851139 - RNA, 17 nt, Mycobacterium avium subsp. paratuberculosis
ggagucgguuucgaccu

SEQ ID NO: 851140 - RNA, 16 nt, Mycobacterium avium subsp. paratuberculosis
ggaguccaccggcgga

SEQ ID NO: 851141 - RNA, 15 nt, Mycobacterium avium subsp. paratuberculosis
ggaguagccgguucg

SEQ ID NO: 851142 - RNA, 15 nt, Mycobacterium avium subsp. paratuberculosis
ggaguaggcgccgcc

SEQ ID NO: 851143 - RNA, 17 nt, Mycobacterium avium subsp. paratuberculosis
ggauagcguccgcccac

SEQ ID NO: 851144 - RNA, 20 nt, Mycobacterium avium subsp. paratuberculosis
ggauaguucgccgccgccag

SEQ ID NO: 851145 - RNA, 22 nt, Mycobacterium avium subsp. paratuberculosis
ggauaguucgccgccgccagca

SEQ ID NO: 851146 - RNA, 20 nt, Mycobacterium avium subsp. paratuberculosis
ggauauccagccuugcagcc

SEQ ID NO: 851147 - RNA, 18 nt, Mycobacterium avium subsp. paratuberculosis
ggaucaaccacaccagca

SEQ ID NO: 851148 - RNA, 16 nt, Mycobacterium avium subsp. paratuberculosis
ggaucaacucgucggg

SEQ ID NO: 851149 - RNA, 21 nt, Mycobacterium avium subsp. paratuberculosis
ggaucaccucaucgcccagcc

SEQ ID NO: 851150 - RNA, 23 nt, Mycobacterium avium subsp. paratuberculosis
ggaucaccuggugcucgcgcucg

SEQ ID NO: 851151 - RNA, 13 nt, Mycobacterium avium subsp. paratuberculosis
ggaucaccucgcu

SEQ ID NO: 851152 - RNA, 21 nt, Mycobacterium avium subsp. paratuberculosis
ggaucaccucgcugacgucga

SEQ ID NO: 851153 - RNA, 14 nt, Mycobacterium avium subsp. paratuberculosis
ggaucacgcggcgg

SEQ ID NO: 851154 - RNA, 15 nt, Mycobacterium avium subsp. paratuberculosis
ggaucacacgcgcgc

SEQ ID NO: 851155 - RNA, 15 nt, Mycobacterium avium subsp. paratuberculosis
ggaucacccucggcg

SEQ ID NO: 851156 - RNA, 19 nt, Mycobacterium avium subsp. paratuberculosis
ggauacccaugaucgccag

SEQ ID NO: 851157 - RNA, 17 nt, Mycobacterium avium subsp. paratuberculosis
ggauagagcaccgcgcu

SEQ ID NO: 851158 - RNA, 19 nt, Mycobacterium avium subsp. paratuberculosis
ggauagccgagcggcgcca

SEQ ID NO: 851159 - RNA, 17 nt, Mycobacterium avium subsp. paratuberculosis
ggaucagcaccgacgcg

SEQ ID NO: 851160 - RNA, 22 nt, Mycobacterium avium subsp. paratuberculosis
ggaucagcaccgacgcggcgac

SEQ ID NO: 851161 - RNA, 13 nt, Mycobacterium avium subsp. paratuberculosis
ggaucacgucggc

SEQ ID NO: 851162 - RNA, 14 nt, Mycobacterium avium subsp. paratuberculosis
ggaucacgucggcg

SEQ ID NO: 851163 - RNA, 18 nt, Mycobacterium avium subsp. paratuberculosis
ggaucagcguuccggcgg

SEQ ID NO: 851164 - RNA, 20 nt, Mycobacterium avium subsp. paratuberculosis
ggaucagcguuccggcggcc

SEQ ID NO: 851165 - RNA, 23 nt, Mycobacterium avium subsp. paratuberculosis
ggaucagcguuccggcggccggc

SEQ ID NO: 851166 - RNA, 14 nt, Mycobacterium avium subsp. paratuberculosis
ggaucagcgggacg

SEQ ID NO: 851167 - RNA, 13 nt, Mycobacterium avium subsp. paratuberculosis
ggaucagcgucgc

SEQ ID NO: 851168 - RNA, 15 nt, Mycobacterium avium subsp. paratuberculosis
ggaucagcgucgcga

SEQ ID NO: 851169 - RNA, 20 nt, Mycobacterium avium subsp. paratuberculosis
ggauccaccaauucgcgcug

SEQ ID NO: 851170 - RNA, 14 nt, Mycobacterium avium subsp. paratuberculosis
ggaucaugucguug

SEQ ID NO: 851171 - RNA, 15 nt, Mycobacterium avium subsp. paratuberculosis
ggaucaugucguuga

SEQ ID NO: 851172 - RNA, 22 nt, Mycobacterium avium subsp. paratuberculosis
ggaucaggucggucaccgagcu

SEQ ID NO: 851173 - RNA, 22 nt, Mycobacterium avium subsp. paratuberculosis
ggaucagcugaccggcgaucgu

SEQ ID NO: 851174 - RNA, 16 nt, Mycobacterium avium subsp. paratuberculosis
ggauccgcucgacgag

SEQ ID NO: 851175 - RNA, 20 nt, Mycobacterium avium subsp. paratuberculosis
ggauccggacgaccugggcg

SEQ ID NO: 851176 - RNA, 18 nt, Mycobacterium avium subsp. paratuberculosis
ggauccgcaccgggcagc

SEQ ID NO: 851177 - RNA, 15 nt, Mycobacterium avium subsp. paratuberculosis
ggauccgcccgccgg

SEQ ID NO: 851178 - RNA, 17 nt, Mycobacterium avium subsp. paratuberculosis
ggauccgcccgccggug

SEQ ID NO: 851179 - RNA, 18 nt, Mycobacterium avium subsp. paratuberculosis
ggauccgcccgccggugg

SEQ ID NO: 851180 - RNA, 22 nt, Mycobacterium avium subsp. paratuberculosis
ggauccgcccgccgguggccgc

SEQ ID NO: 851181 - RNA, 21 nt, Mycobacterium avium subsp. paratuberculosis
ggaucccggugagcgugucgc

SEQ ID NO: 851182 - RNA, 18 nt, Mycobacterium avium subsp. paratuberculosis
ggauccgaggcgucaggg

SEQ ID NO: 851183 - RNA, 21 nt, Mycobacterium avium subsp. paratuberculosis
ggauccgaggguucgguggcc

SEQ ID NO: 851184 - RNA, 20 nt, Mycobacterium avium subsp. paratuberculosis
ggauccucgccgcgggccag

SEQ ID NO: 851185 - RNA, 18 nt, Mycobacterium avium subsp. paratuberculosis
ggauccggauugccgggc

SEQ ID NO: 851186 - RNA, 23 nt, Mycobacterium avium subsp. paratuberculosis
ggauccgggccggcgucgcggug

SEQ ID NO: 851187 - RNA, 17 nt, Mycobacterium avium subsp. paratuberculosis
ggauccggugaccgcga

SEQ ID NO: 851188 - RNA, 20 nt, Mycobacterium avium subsp. paratuberculosis
ggauccgucgccccgcaccg

SEQ ID NO: 851189 - RNA, 14 nt, Mycobacterium avium subsp. paratuberculosis
ggauccgucgcuac

SEQ ID NO: 851190 - RNA, 23 nt, Mycobacterium avium subsp. paratuberculosis
ggaucccagaauucgccggggca

SEQ ID NO: 851191 - RNA, 14 nt, Mycobacterium avium subsp. paratuberculosis
ggauccagcggcgg

SEQ ID NO: 851192 - RNA, 19 nt, Mycobacterium avium subsp. paratuberculosis
ggauccaggaacggcaccc

SEQ ID NO: 851193 - RNA, 15 nt, Mycobacterium avium subsp. paratuberculosis
ggauccccgcgcugg

SEQ ID NO: 851194 - RNA, 14 nt, Mycobacterium avium subsp. paratuberculosis
ggauccccguccag

SEQ ID NO: 851195 - RNA, 14 nt, Mycobacterium avium subsp. paratuberculosis
ggaucccgaaaccg

SEQ ID NO: 851196 - RNA, 17 nt, Mycobacterium avium subsp. paratuberculosis
ggaucccgaacugccgc

SEQ ID NO: 851197 - RNA, 14 nt, Mycobacterium avium subsp. paratuberculosis
ggcaaggugccguc

SEQ ID NO: 851198 - RNA, 18 nt, Mycobacterium avium subsp. paratuberculosis
ggcaaggugccguccggg

SEQ ID NO: 851199 - RNA, 14 nt, Mycobacterium avium subsp. paratuberculosis
ggcaagucgucggu

SEQ ID NO: 851200 - RNA, 16 nt, Mycobacterium avium subsp. paratuberculosis
ggcaagucgucggugg

SEQ ID NO: 851201 - RNA, 20 nt, Mycobacterium avium subsp. paratuberculosis
ggcaagucgucggugggccg

SEQ ID NO: 851202 - RNA, 22 nt, Mycobacterium avium subsp. paratuberculosis
ggcaagggcaaagacgacggcu

SEQ ID NO: 851203 - RNA, 14 nt, Mycobacterium avium subsp. paratuberculosis
ggcaaucaggcggu

SEQ ID NO: 851204 - RNA, 19 nt, Mycobacterium avium subsp. paratuberculosis
ggcaaucaggcggucgaac

SEQ ID NO: 851205 - RNA, 22 nt, Mycobacterium avium subsp. paratuberculosis
ggcacacgcggacagggcggcg

SEQ ID NO: 851206 - RNA, 24 nt, Mycobacterium avium subsp. paratuberculosis
ggcacaccgagcgagcgcaccaga

SEQ ID NO: 851207 - RNA, 19 nt, Mycobacterium avium subsp. paratuberculosis
ggcaauccggccccgcugc

SEQ ID NO: 851208 - RNA, 22 nt, Mycobacterium avium subsp. paratuberculosis
ggcaacucaguccucgccgaga

SEQ ID NO: 851209 - RNA, 18 nt, Mycobacterium avium subsp. paratuberculosis
ggcaacgucuggccaccg

SEQ ID NO: 851210 - RNA, 19 nt, Mycobacterium avium subsp. paratuberculosis
ggcaacgucuggccaccga

SEQ ID NO: 851211 - RNA, 23 nt, Mycobacterium avium subsp. paratuberculosis
ggcaacgugccacaggccgaaca

SEQ ID NO: 851212 - RNA, 20 nt, Mycobacterium avium subsp. paratuberculosis
ggcaacucgcgaggccgcca

SEQ ID NO: 851213 - RNA, 13 nt, Mycobacterium avium subsp. paratuberculosis
ggcaacgcgccgg

SEQ ID NO: 851214 - RNA, 17 nt, Mycobacterium avium subsp. paratuberculosis
ggcaacgcgccggcggu

SEQ ID NO: 851215 - RNA, 18 nt, Mycobacterium avium subsp. paratuberculosis
ggcaacgcgccggcgguc

SEQ ID NO: 851216 - RNA, 21 nt, Mycobacterium avium subsp. paratuberculosis
ggcaacgcgccggcggucgac

SEQ ID NO: 851217 - RNA, 15 nt, Mycobacterium avium subsp. paratuberculosis
ggcaacgcggcauga

SEQ ID NO: 851218 - RNA, 20 nt, Mycobacterium avium subsp. paratuberculosis
ggcaacgcggcaugaccggc

SEQ ID NO: 851219 - RNA, 17 nt, Mycobacterium avium subsp. paratuberculosis
ggcaaccacagcggcgc

SEQ ID NO: 851220 - RNA, 23 nt, Mycobacterium avium subsp. paratuberculosis
ggcaacggccaugaagccguugc

SEQ ID NO: 851221 - RNA, 16 nt, Mycobacterium avium subsp. paratuberculosis
ggcaacaccggcggcg

SEQ ID NO: 851222 - RNA, 13 nt, Mycobacterium avium subsp. paratuberculosis
ggcaacacgacca

SEQ ID NO: 851223 - RNA, 18 nt, Mycobacterium avium subsp. paratuberculosis
ggcaacacgucguccggc

SEQ ID NO: 851224 - RNA, 19 nt, Mycobacterium avium subsp. paratuberculosis
ggcaacacgucguccggcg

SEQ ID NO: 851225 - RNA, 20 nt, Mycobacterium avium subsp. paratuberculosis
ggcaacacgucguccggcgc

SEQ ID NO: 851226 - RNA, 22 nt, Mycobacterium avium subsp. paratuberculosis
ggcaacagcaccagcaccaccg

SEQ ID NO: 851227 - RNA, 14 nt, Mycobacterium avium subsp. paratuberculosis
ggcaacaacgccag

SEQ ID NO: 851228 - RNA, 16 nt, Mycobacterium avium subsp. paratuberculosis
ggcaacaacgccagcg

SEQ ID NO: 851229 - RNA, 17 nt, Mycobacterium avium subsp. paratuberculosis
ggcaacagcgcgccggc

SEQ ID NO: 851230 - RNA, 14 nt, Mycobacterium avium subsp. paratuberculosis
ggaucgagccggcc

SEQ ID NO: 851231 - RNA, 15 nt, Mycobacterium avium subsp. paratuberculosis
ggaucgagccggccg

SEQ ID NO: 851232 - RNA, 16 nt, Mycobacterium avium subsp. paratuberculosis
ggaucgaaggcgugcu

SEQ ID NO: 851233 - RNA, 16 nt, Mycobacterium avium subsp. paratuberculosis
ggaucgaauccggcgg

SEQ ID NO: 851234 - RNA, 20 nt, Mycobacterium avium subsp. paratuberculosis
ggaucgaauccggcggcgcu

SEQ ID NO: 851235 - RNA, 23 nt, Mycobacterium avium subsp. paratuberculosis
ggaucgacaacgcgugaugcagc

SEQ ID NO: 851236 - RNA, 16 nt, Mycobacterium avium subsp. paratuberculosis
ggcacguugacguaga

SEQ ID NO: 851237 - RNA, 13 nt, Mycobacterium avium subsp. paratuberculosis
ggcacggccggcc

SEQ ID NO: 851238 - RNA, 20 nt, Mycobacterium avium subsp. paratuberculosis
ggcacguguccgacgccguc

SEQ ID NO: 851239 - RNA, 13 nt, Mycobacterium avium subsp. paratuberculosis
ggcacgucgccgu

SEQ ID NO: 851240 - RNA, 12 nt, Mycobacterium avium subsp. paratuberculosis
ggcacgucgcgc

SEQ ID NO: 851241 - RNA, 12 nt, Mycobacterium avium subsp. paratuberculosis
ggcacgucggcc

SEQ ID NO: 851242 - RNA, 14 nt, Mycobacterium avium subsp. paratuberculosis
ggcacgucggccac

SEQ ID NO: 851243 - RNA, 13 nt, Mycobacterium avium subsp. paratuberculosis
ggcacguacgcgc

SEQ ID NO: 851244 - RNA, 22 nt, Mycobacterium avium subsp. paratuberculosis
ggcacggugcacacgccgaggc

SEQ ID NO: 851245 - RNA, 19 nt, Mycobacterium avium subsp. paratuberculosis
ggcacggugcgggugccga

SEQ ID NO: 851246 - RNA, 20 nt, Mycobacterium avium subsp. paratuberculosis
ggcacggugggacggcgggu

SEQ ID NO: 851247 - RNA, 18 nt, Mycobacterium avium subsp. paratuberculosis
ggcacgucgacgcccugc

SEQ ID NO: 851248 - RNA, 15 nt, Mycobacterium avium subsp. paratuberculosis
ggcacguccagcccg

SEQ ID NO: 851249 - RNA, 17 nt, Mycobacterium avium subsp. paratuberculosis
ggcacguccagcccgcg

SEQ ID NO: 851250 - RNA, 20 nt, Mycobacterium avium subsp. paratuberculosis
ggcacguccagcccgcgcca

SEQ ID NO: 851251 - RNA, 18 nt, Mycobacterium avium subsp. paratuberculosis
ggcacguccccgugcagc

SEQ ID NO: 851252 - RNA, 23 nt, Mycobacterium avium subsp. paratuberculosis
ggcacguccccgugcagccgggc

SEQ ID NO: 851253 - RNA, 15 nt, Mycobacterium avium subsp. paratuberculosis
ggcacggucaggugg

SEQ ID NO: 851254 - RNA, 19 nt, Mycobacterium avium subsp. paratuberculosis
ggcacggcgaggucgggau

SEQ ID NO: 851255 - RNA, 16 nt, Mycobacterium avium subsp. paratuberculosis
ggcacggccggccggc

SEQ ID NO: 851256 - RNA, 14 nt, Mycobacterium avium subsp. paratuberculosis
ggcacgggcccgcg

SEQ ID NO: 851257 - RNA, 22 nt, Mycobacterium avium subsp. paratuberculosis
ggcacgggcccgcgggaucagc

SEQ ID NO: 851258 - RNA, 14 nt, Mycobacterium avium subsp. paratuberculosis
ggcacgcccguucg

SEQ ID NO: 851259 - RNA, 17 nt, Mycobacterium avium subsp. paratuberculosis
ggcacgccgcucgucgg

SEQ ID NO: 851260 - RNA, 17 nt, Mycobacterium avium subsp. paratuberculosis
ggcacgccacucgucga

SEQ ID NO: 851261 - RNA, 24 nt, Mycobacterium avium subsp. paratuberculosis
ggcacgccacucgucgacguucga

SEQ ID NO: 851262 - RNA, 19 nt, Mycobacterium avium subsp. paratuberculosis
ggcacgaucggcagcgcca

SEQ ID NO: 851263 - RNA, 22 nt, Mycobacterium avium subsp. paratuberculosis
ggcacgaucggcagcgccaaca

SEQ ID NO: 851264 - RNA, 22 nt, Mycobacterium avium subsp. paratuberculosis
ggcacgaucucgaccaggccgu

SEQ ID NO: 851265 - RNA, 19 nt, Mycobacterium avium subsp. paratuberculosis
ggcacgaugaacuccucga

SEQ ID NO: 851266 - RNA, 22 nt, Mycobacterium avium subsp. paratuberculosis
ggcacgaugaacuccucgaucg

SEQ ID NO: 851267 - RNA, 18 nt, Mycobacterium avium subsp. paratuberculosis
ggcacgauggacgcccaa

SEQ ID NO: 851268 - RNA, 19 nt, Mycobacterium avium subsp. paratuberculosis
ggcacgauggcgcggcgca

SEQ ID NO: 851269 - RNA, 13 nt, Mycobacterium avium subsp. paratuberculosis
ggcaccgucgucg

SEQ ID NO: 851270 - RNA, 21 nt, Mycobacterium avium subsp. paratuberculosis
ggcaccgucgucgcaccggca

SEQ ID NO: 851271 - RNA, 21 nt, Mycobacterium avium subsp. paratuberculosis
ggcacgagcgaacacgugcag

SEQ ID NO: 851272 - RNA, 14 nt, Mycobacterium avium subsp. paratuberculosis
ggcaccgucaccga

SEQ ID NO: 851273 - RNA, 21 nt, Mycobacterium avium subsp. paratuberculosis
ggcaccgucaccgacggcugg

SEQ ID NO: 851274 - RNA, 16 nt, Mycobacterium avium subsp. paratuberculosis
ggcacgacggucagca

SEQ ID NO: 851275 - RNA, 19 nt, Mycobacterium avium subsp. paratuberculosis
ggcacgacggucagcacgc

SEQ ID NO: 851276 - RNA, 16 nt, Mycobacterium avium subsp. paratuberculosis
ggcaccgggaccuggg

SEQ ID NO: 851277 - RNA, 14 nt, Mycobacterium avium subsp. paratuberculosis
ggcaccgggugggc

SEQ ID NO: 851278 - RNA, 22 nt, Mycobacterium avium subsp. paratuberculosis
ggcaccgggugggccgaccugc

SEQ ID NO: 851279 - RNA, 13 nt, Mycobacterium avium subsp. paratuberculosis
ggcaccgucgacc

SEQ ID NO: 851280 - RNA, 15 nt, Mycobacterium avium subsp. paratuberculosis
ggcaccgucgaccuc

SEQ ID NO: 851281 - RNA, 21 nt, Mycobacterium avium subsp. paratuberculosis
ggcaccgucgaccucgaugcg

SEQ ID NO: 851282 - RNA, 13 nt, Mycobacterium avium subsp. paratuberculosis
ggcaccagcaccg

SEQ ID NO: 851283 - RNA, 16 nt, Mycobacterium avium subsp. paratuberculosis
ggcaccagcaccgaga

SEQ ID NO: 851284 - RNA, 21 nt, Mycobacterium avium subsp. paratuberculosis
ggcaccagcaccgagaucucg

SEQ ID NO: 851285 - RNA, 11 nt, Mycobacterium avium subsp. paratuberculosis
ggcaccagcag

SEQ ID NO: 851286 - RNA, 16 nt, Mycobacterium avium subsp. paratuberculosis
ggcaccagcagcgcga

SEQ ID NO: 851287 - RNA, 18 nt, Mycobacterium avium subsp. paratuberculosis
ggcaccagcagcgcgacg

SEQ ID NO: 851288 - RNA, 21 nt, Mycobacterium avium subsp. paratuberculosis
ggcaccagcagcgcgacgccg

SEQ ID NO: 851289 - RNA, 22 nt, Mycobacterium avium subsp. paratuberculosis
ggcaccagcagcgcgacgccga

SEQ ID NO: 851290 - RNA, 18 nt, Mycobacterium avium subsp. paratuberculosis
ggcaccacguccaccagc

SEQ ID NO: 851291 - RNA, 18 nt, Mycobacterium avium subsp. paratuberculosis
ggcacccgcugcaccagc

SEQ ID NO: 851292 - RNA, 19 nt, Mycobacterium avium subsp. paratuberculosis
ggcacccgcugcaccagcc

SEQ ID NO: 851293 - RNA, 18 nt, Mycobacterium avium subsp. paratuberculosis
ggcaccaguaggucaccc

SEQ ID NO: 851294 - RNA, 18 nt, Mycobacterium avium subsp. paratuberculosis
ggcaccagucgcgcagcg

SEQ ID NO: 851295 - RNA, 14 nt, Mycobacterium avium subsp. paratuberculosis
ggcacccggcgcgg

SEQ ID NO: 851296 - RNA, 19 nt, Mycobacterium avium subsp. paratuberculosis
ggcacccggcgcggccgcc

SEQ ID NO: 851297 - RNA, 20 nt, Mycobacterium avium subsp. paratuberculosis
ggcacccggcgcggccgccc

SEQ ID NO: 851298 - RNA, 13 nt, Mycobacterium avium subsp. paratuberculosis
ggcaccagcgcga

SEQ ID NO: 851299 - RNA, 15 nt, Mycobacterium avium subsp. paratuberculosis
ggcaccagcgcgacg

SEQ ID NO: 851300 - RNA, 18 nt, Mycobacterium avium subsp. paratuberculosis
ggcaccagcgcgacggug

SEQ ID NO: 851301 - RNA, 13 nt, Mycobacterium avium subsp. paratuberculosis
ggcaccagcggca

SEQ ID NO: 851302 - RNA, 20 nt, Mycobacterium avium subsp. paratuberculosis
ggcaccagcggcaucgccgc

SEQ ID NO: 851303 - RNA, 12 nt, Mycobacterium avium subsp. paratuberculosis
ggcaccggaccg

SEQ ID NO: 851304 - RNA, 15 nt, Mycobacterium avium subsp. paratuberculosis
ggcaccggaccgccg

SEQ ID NO: 851305 - RNA, 18 nt, Mycobacterium avium subsp. paratuberculosis
ggcaccggaccgccgaga

SEQ ID NO: 851306 - RNA, 14 nt, Mycobacterium avium subsp. paratuberculosis
ggcaccggugcggc

SEQ ID NO: 851307 - RNA, 16 nt, Mycobacterium avium subsp. paratuberculosis
ggcaccggugcggcgg

SEQ ID NO: 851308 - RNA, 24 nt, Mycobacterium avium subsp. paratuberculosis
ggcaccgaacgccagcagcugcgg

SEQ ID NO: 851309 - RNA, 21 nt, Mycobacterium avium subsp. paratuberculosis
ggcaccgacgaggagaccucc

SEQ ID NO: 851310 - RNA, 19 nt, Mycobacterium avium subsp. paratuberculosis
ggcaccgacggagccgagc

SEQ ID NO: 851311 - RNA, 14 nt, Mycobacterium avium subsp. paratuberculosis
ggcaccgacggccg

SEQ ID NO: 851312 - RNA, 16 nt, Mycobacterium avium subsp. paratuberculosis
ggcaccgacggccgca

SEQ ID NO: 851313 - RNA, 18 nt, Mycobacterium avium subsp. paratuberculosis
ggcaccgacggccgcacc

SEQ ID NO: 851314 - RNA, 18 nt, Mycobacterium avium subsp. paratuberculosis
ggcaccgacaucagaucg

SEQ ID NO: 851315 - RNA, 20 nt, Mycobacterium avium subsp. paratuberculosis
ggcaccgacaucagaucgcc

SEQ ID NO: 851316 - RNA, 23 nt, Mycobacterium avium subsp. paratuberculosis
ggcaccgacaucagaucgccgac

SEQ ID NO: 851317 - RNA, 15 nt, Mycobacterium avium subsp. paratuberculosis
ggcauaguccagcuc

SEQ ID NO: 851318 - RNA, 19 nt, Mycobacterium avium subsp. paratuberculosis
ggcauaguccagcucgcga

SEQ ID NO: 851319 - RNA, 16 nt, Mycobacterium avium subsp. paratuberculosis
ggcaguuccaugucga

SEQ ID NO: 851320 - RNA, 16 nt, Mycobacterium avium subsp. paratuberculosis
ggcaguuccucgccgg

SEQ ID NO: 851321 - RNA, 21 nt, Mycobacterium avium subsp. paratuberculosis
ggcagugugauucgggucaga

SEQ ID NO: 851322 - RNA, 18 nt, Mycobacterium avium subsp. paratuberculosis
ggcaucaucgcuacaccc

SEQ ID NO: 851323 - RNA, 15 nt, Mycobacterium avium subsp. paratuberculosis
ggcaucgcgcgcggc

SEQ ID NO: 851324 - RNA, 20 nt, Mycobacterium avium subsp. paratuberculosis
ggcaucgcgcgcggcgacgg

SEQ ID NO: 851325 - RNA, 16 nt, Mycobacterium avium subsp. paratuberculosis
ggcaucgccgucaugg

SEQ ID NO: 851326 - RNA, 20 nt, Mycobacterium avium subsp. paratuberculosis
ggcaucgccgucaugguguc

SEQ ID NO: 851327 - RNA, 15 nt, Mycobacterium avium subsp. paratuberculosis
ggcaucgauggcggg

SEQ ID NO: 851328 - RNA, 20 nt, Mycobacterium avium subsp. paratuberculosis
ggcaucgauggcgggcgcgc

SEQ ID NO: 851329 - RNA, 15 nt, Mycobacterium avium subsp. paratuberculosis
ggcaucgcagcgcgc

SEQ ID NO: 851330 - RNA, 22 nt, Mycobacterium avium subsp. paratuberculosis
ggcaucgcagcgcgcggcgcag

SEQ ID NO: 851331 - RNA, 11 nt, Mycobacterium avium subsp. paratuberculosis
ggcaucgccaa

SEQ ID NO: 851332 - RNA, 20 nt, Mycobacterium avium subsp. paratuberculosis
ggcaucgaggaccggcgccg

SEQ ID NO: 851333 - RNA, 19 nt, Mycobacterium avium subsp. paratuberculosis
ggcaucgacaugcccggcg

SEQ ID NO: 851334 - RNA, 20 nt, Mycobacterium avium subsp. paratuberculosis
ggcaucgacaugcccggcga

SEQ ID NO: 851335 - RNA, 12 nt, Mycobacterium avium subsp. paratuberculosis
ggcauccagcac

SEQ ID NO: 851336 - RNA, 16 nt, Mycobacterium avium subsp. paratuberculosis
ggcauccaggaucgcc

SEQ ID NO: 851337 - RNA, 18 nt, Mycobacterium avium subsp. paratuberculosis
ggcaucccgcuucuggcg

SEQ ID NO: 851338 - RNA, 20 nt, Mycobacterium avium subsp. paratuberculosis
ggcaucccgcuucuggcggg

SEQ ID NO: 851339 - RNA, 19 nt, Mycobacterium avium subsp. paratuberculosis
ggcaucccugacacgaccg

SEQ ID NO: 851340 - RNA, 16 nt, Mycobacterium avium subsp. paratuberculosis
ggcauccccagcuggg

SEQ ID NO: 851341 - RNA, 11 nt, Mycobacterium avium subsp. paratuberculosis
ggcauccggga

SEQ ID NO: 851342 - RNA, 17 nt, Mycobacterium avium subsp. paratuberculosis
ggcauccgggaggccag

SEQ ID NO: 851343 - RNA, 21 nt, Mycobacterium avium subsp. paratuberculosis
ggcauccgggaggccagcacc

SEQ ID NO: 851344 - RNA, 14 nt, Mycobacterium avium subsp. paratuberculosis
ggcauccgucggcc

SEQ ID NO: 851345 - RNA, 17 nt, Mycobacterium avium subsp. paratuberculosis
ggcauccugcuggccgg

SEQ ID NO: 851346 - RNA, 13 nt, Mycobacterium avium subsp. paratuberculosis
ggcauccacccgu

SEQ ID NO: 851347 - RNA, 16 nt, Mycobacterium avium subsp. paratuberculosis
ggcauccgcucgccgc

SEQ ID NO: 851348 - RNA, 17 nt, Mycobacterium avium subsp. paratuberculosis
ggcauccgcucgccgcg

SEQ ID NO: 851349 - RNA, 18 nt, Mycobacterium avium subsp. paratuberculosis
ggcauccgcucgccgcgg

SEQ ID NO: 851350 - RNA, 15 nt, Mycobacterium avium subsp. paratuberculosis
ggcagcgucccgucg

SEQ ID NO: 851351 - RNA, 17 nt, Mycobacterium avium subsp. paratuberculosis
ggcagcgucccgucggc

SEQ ID NO: 851352 - RNA, 13 nt, Mycobacterium avium subsp. paratuberculosis
ggcagcgucgcca

SEQ ID NO: 851353 - RNA, 16 nt, Mycobacterium avium subsp. paratuberculosis
ggcagcgucgccagcc

SEQ ID NO: 851354 - RNA, 17 nt, Mycobacterium avium subsp. paratuberculosis
ggcagcggugucaccga

SEQ ID NO: 851355 - RNA, 19 nt, Mycobacterium avium subsp. paratuberculosis
ggcagcggugucaccgacg

SEQ ID NO: 851356 - RNA, 18 nt, Mycobacterium avium subsp. paratuberculosis
ggcagcgccucggcgggc

SEQ ID NO: 851357 - RNA, 14 nt, Mycobacterium avium subsp. paratuberculosis
ggcagcggugccgc

SEQ ID NO: 851358 - RNA, 19 nt, Mycobacterium avium subsp. paratuberculosis
ggcagcggugccgcccgga

SEQ ID NO: 851359 - RNA, 23 nt, Mycobacterium avium subsp. paratuberculosis
ggcaguaucuuguucgccgacac

SEQ ID NO: 851360 - RNA, 21 nt, Mycobacterium avium subsp. paratuberculosis
ggcagguacugcuugccgccg

SEQ ID NO: 851361 - RNA, 22 nt, Mycobacterium avium subsp. paratuberculosis
ggcagguacugcuugccgccgg

SEQ ID NO: 851362 - RNA, 20 nt, Mycobacterium avium subsp. paratuberculosis
ggcaggguuuucacgucgag

SEQ ID NO: 851363 - RNA, 22 nt, Mycobacterium avium subsp. paratuberculosis
ggcaggucgaggccggccagcg

SEQ ID NO: 851364 - RNA, 21 nt, Mycobacterium avium subsp. paratuberculosis
ggcaggcgguuucaccgaggc

SEQ ID NO: 851365 - RNA, 20 nt, Mycobacterium avium subsp. paratuberculosis
ggcagggugaccgaggccgc

SEQ ID NO: 851366 - RNA, 22 nt, Mycobacterium avium subsp. paratuberculosis
ggcagggugaccgaggccgccc

SEQ ID NO: 851367 - RNA, 14 nt, Mycobacterium avium subsp. paratuberculosis
ggcagggcauccgg

SEQ ID NO: 851368 - RNA, 16 nt, Mycobacterium avium subsp. paratuberculosis
ggcagggccaccguca

SEQ ID NO: 851369 - RNA, 19 nt, Mycobacterium avium subsp. paratuberculosis
ggcagggccagcagcccgg

SEQ ID NO: 851370 - RNA, 23 nt, Mycobacterium avium subsp. paratuberculosis
ggcagugagggaacgccgaucac

SEQ ID NO: 851371 - RNA, 19 nt, Mycobacterium avium subsp. paratuberculosis
ggcaguccgcgccgguccc

SEQ ID NO: 851372 - RNA, 22 nt, Mycobacterium avium subsp. paratuberculosis
ggcaguccggacacggccagcg

SEQ ID NO: 851373 - RNA, 23 nt, Mycobacterium avium subsp. paratuberculosis
ggcaguccggacacggccagcgc

SEQ ID NO: 851374 - RNA, 13 nt, Mycobacterium avium subsp. paratuberculosis
ggcagucgcagca

SEQ ID NO: 851375 - RNA, 16 nt, Mycobacterium avium subsp. paratuberculosis
ggcagucgcagcagca

SEQ ID NO: 851376 - RNA, 15 nt, Mycobacterium avium subsp. paratuberculosis
ggcagucugccggug

SEQ ID NO: 851377 - RNA, 22 nt, Mycobacterium avium subsp. paratuberculosis
ggcagaagcuccacgccgccgg

SEQ ID NO: 851378 - RNA, 15 nt, Mycobacterium avium subsp. paratuberculosis
ggcagcaaccggcgg

SEQ ID NO: 851379 - RNA, 18 nt, Mycobacterium avium subsp. paratuberculosis
ggcagacccagcagcggc

SEQ ID NO: 851380 - RNA, 23 nt, Mycobacterium avium subsp. paratuberculosis
ggcagacccagcagcggccggcg

SEQ ID NO: 851381 - RNA, 15 nt, Mycobacterium avium subsp. paratuberculosis
ggcagacccccagca

SEQ ID NO: 851382 - RNA, 19 nt, Mycobacterium avium subsp. paratuberculosis
ggcagacccccagcagcgg

SEQ ID NO: 851383 - RNA, 15 nt, Mycobacterium avium subsp. paratuberculosis
ggcagacccgcgucg

SEQ ID NO: 851384 - RNA, 19 nt, Mycobacterium avium subsp. paratuberculosis
ggcagaccgguggcgaagu

SEQ ID NO: 851385 - RNA, 18 nt, Mycobacterium avium subsp. paratuberculosis
ggcagaccguccgguucg

SEQ ID NO: 851386 - RNA, 19 nt, Mycobacterium avium subsp. paratuberculosis
ggcagcaccucgcgcagca

SEQ ID NO: 851387 - RNA, 23 nt, Mycobacterium avium subsp. paratuberculosis
ggcagcacgggggaguagcgcgc

SEQ ID NO: 851388 - RNA, 15 nt, Mycobacterium avium subsp. paratuberculosis
ggcagcaccgccgac

SEQ ID NO: 851389 - RNA, 16 nt, Mycobacterium avium subsp. paratuberculosis
ggcagcaccgccgaca

SEQ ID NO: 851390 - RNA, 19 nt, Mycobacterium avium subsp. paratuberculosis
ggcagcaccgccgacaucg

SEQ ID NO: 851391 - RNA, 18 nt, Mycobacterium avium subsp. paratuberculosis
ggcagcaccgccgagccg

SEQ ID NO: 851392 - RNA, 12 nt, Mycobacterium avium subsp. paratuberculosis
ggcagcaccggc

SEQ ID NO: 851393 - RNA, 16 nt, Mycobacterium avium subsp. paratuberculosis
ggcagcaccggcagca

SEQ ID NO: 851394 - RNA, 15 nt, Mycobacterium avium subsp. paratuberculosis
ggcagcaccagcggc

SEQ ID NO: 851395 - RNA, 22 nt, Mycobacterium avium subsp. paratuberculosis
ggcagcaccagcggcaccaggu

SEQ ID NO: 851396 - RNA, 15 nt, Mycobacterium avium subsp. paratuberculosis
ggcagcagcgcgucg

SEQ ID NO: 851397 - RNA, 16 nt, Mycobacterium avium subsp. paratuberculosis
ggcagcagcgcgucgu

SEQ ID NO: 851398 - RNA, 18 nt, Mycobacterium avium subsp. paratuberculosis
ggcagcagggugccgccg

SEQ ID NO: 851399 - RNA, 18 nt, Mycobacterium avium subsp. paratuberculosis
ggcagcaggugcaccacc

SEQ ID NO: 851400 - RNA, 18 nt, Mycobacterium avium subsp. paratuberculosis
ggcagcauccgccgacga

SEQ ID NO: 851401 - RNA, 17 nt, Mycobacterium avium subsp. paratuberculosis
ggcagcagcgcccaccg

SEQ ID NO: 851402 - RNA, 12 nt, Mycobacterium avium subsp. paratuberculosis
ggcagcagcgcg

SEQ ID NO: 851403 - RNA, 12 nt, Mycobacterium avium subsp. paratuberculosis
ggcagcagcacc

SEQ ID NO: 851404 - RNA, 19 nt, Mycobacterium avium subsp. paratuberculosis
ggcagcagcaccagcgccg

SEQ ID NO: 851405 - RNA, 13 nt, Mycobacterium avium subsp. paratuberculosis
ggcagcagcaccc

SEQ ID NO: 851406 - RNA, 12 nt, Mycobacterium avium subsp. paratuberculosis
ggcagcagccgg

SEQ ID NO: 851407 - RNA, 17 nt, Mycobacterium avium subsp. paratuberculosis
ggcagcagccggaaggc

SEQ ID NO: 851408 - RNA, 15 nt, Mycobacterium avium subsp. paratuberculosis
ggcagcagcaucggu

SEQ ID NO: 851409 - RNA, 18 nt, Mycobacterium avium subsp. paratuberculosis
ggcagcagcaucgguccc

SEQ ID NO: 851410 - RNA, 18 nt, Mycobacterium avium subsp. paratuberculosis
ggcagcccagguaaucga

SEQ ID NO: 851411 - RNA, 22 nt, Mycobacterium avium subsp. paratuberculosis
ggcagcccagguaaucgaaggc

SEQ ID NO: 851412 - RNA, 19 nt, Mycobacterium avium subsp. paratuberculosis
ggcagccagaugucgcguu

SEQ ID NO: 851413 - RNA, 16 nt, Mycobacterium avium subsp. paratuberculosis
ggcagccagcccgcgc

SEQ ID NO: 851414 - RNA, 21 nt, Mycobacterium avium subsp. paratuberculosis
ggcagcaucgggacgccugcc

SEQ ID NO: 851415 - RNA, 16 nt, Mycobacterium avium subsp. paratuberculosis
ggcagccaaccgccgg

SEQ ID NO: 851416 - RNA, 13 nt, Mycobacterium avium subsp. paratuberculosis
ggcagccacaucu

SEQ ID NO: 851417 - RNA, 15 nt, Mycobacterium avium subsp. paratuberculosis
ggcagccacgcgcaa

SEQ ID NO: 851418 - RNA, 15 nt, Mycobacterium avium subsp. paratuberculosis
ggcagcccgaacagc

SEQ ID NO: 851419 - RNA, 22 nt, Mycobacterium avium subsp. paratuberculosis
ggcagcccgaacagccgggcca

SEQ ID NO: 851420 - RNA, 16 nt, Mycobacterium avium subsp. paratuberculosis
ggcagcccgacguccu

SEQ ID NO: 851421 - RNA, 14 nt, Mycobacterium avium subsp. paratuberculosis
ggcagcccgccgac

SEQ ID NO: 851422 - RNA, 13 nt, Mycobacterium avium subsp. paratuberculosis
ggcagcccgccgc

SEQ ID NO: 851423 - RNA, 16 nt, Mycobacterium avium subsp. paratuberculosis
ggcagcccgccgcgga

SEQ ID NO: 851424 - RNA, 20 nt, Mycobacterium avium subsp. paratuberculosis
ggcagcccgccgcggaucgg

SEQ ID NO: 851425 - RNA, 18 nt, Mycobacterium avium subsp. paratuberculosis
ggcagccccgucgguccc

SEQ ID NO: 851426 - RNA, 24 nt, Mycobacterium avium subsp. paratuberculosis
ggcagccccgucggucccgacgcg

SEQ ID NO: 851427 - RNA, 16 nt, Mycobacterium avium subsp. paratuberculosis
ggcagccgcacaccgc

SEQ ID NO: 851428 - RNA, 23 nt, Mycobacterium avium subsp. paratuberculosis
ggcagccgcacaccgcggcggcg

SEQ ID NO: 851429 - RNA, 17 nt, Mycobacterium avium subsp. paratuberculosis
ggcagcgcgacaccgga

SEQ ID NO: 851430 - RNA, 20 nt, Mycobacterium avium subsp. paratuberculosis
ggcagcggcgucgucgucga

SEQ ID NO: 851431 - RNA, 21 nt, Mycobacterium avium subsp. paratuberculosis
ggcagcgccucccggaccacc

SEQ ID NO: 851432 - RNA, 13 nt, Mycobacterium avium subsp. paratuberculosis
ggcagcgccccgg

SEQ ID NO: 851433 - RNA, 20 nt, Mycobacterium avium subsp. paratuberculosis
ggcagcgcacgaugugaugg

SEQ ID NO: 851434 - RNA, 12 nt, Mycobacterium avium subsp. paratuberculosis
ggcagcgccacc

SEQ ID NO: 851435 - RNA, 16 nt, Mycobacterium avium subsp. paratuberculosis
ggcagcgccaccagcu

SEQ ID NO: 851436 - RNA, 16 nt, Mycobacterium avium subsp. paratuberculosis
ggcagcgaggcgcgca

SEQ ID NO: 851437 - RNA, 22 nt, Mycobacterium avium subsp. paratuberculosis
ggcagcgacgcggugagcgcgc

SEQ ID NO: 851438 - RNA, 22 nt, Mycobacterium avium subsp. paratuberculosis
ggcagcgacucgggcaggaugg

SEQ ID NO: 851439 - RNA, 15 nt, Mycobacterium avium subsp. paratuberculosis
ggcagccggccggca

SEQ ID NO: 851440 - RNA, 16 nt, Mycobacterium avium subsp. paratuberculosis
ggcagccggccggcag

SEQ ID NO: 851441 - RNA, 17 nt, Mycobacterium avium subsp. paratuberculosis
ggcagccggccggcagg

SEQ ID NO: 851442 - RNA, 20 nt, Mycobacterium avium subsp. paratuberculosis
ggcagccggccggcaggucg

SEQ ID NO: 851443 - RNA, 12 nt, Mycobacterium avium subsp. paratuberculosis
ggcagccggcgc

SEQ ID NO: 851444 - RNA, 20 nt, Mycobacterium avium subsp. paratuberculosis
ggcagccggcgcccgcaggc

SEQ ID NO: 851445 - RNA, 12 nt, Mycobacterium avium subsp. paratuberculosis
ggcagccggcgu

SEQ ID NO: 851446 - RNA, 24 nt, Mycobacterium avium subsp. paratuberculosis
ggcagccggcguacucgcacagcc

SEQ ID NO: 851447 - RNA, 15 nt, Mycobacterium avium subsp. paratuberculosis
ggcagccgcuccggc

SEQ ID NO: 851448 - RNA, 23 nt, Mycobacterium avium subsp. paratuberculosis
ggcagccgcuccggcccgagcac

SEQ ID NO: 851449 - RNA, 15 nt, Mycobacterium avium subsp. paratuberculosis
ggcagccgcucggau

SEQ ID NO: 851450 - RNA, 20 nt, Mycobacterium avium subsp. paratuberculosis
ggcagccgcuuggccgggcg

SEQ ID NO: 851451 - RNA, 14 nt, Mycobacterium avium subsp. paratuberculosis
ggcagccgucgaug

SEQ ID NO: 851452 - RNA, 15 nt, Mycobacterium avium subsp. paratuberculosis
ggcagccgucgaugc

SEQ ID NO: 851453 - RNA, 23 nt, Mycobacterium avium subsp. paratuberculosis
ggcagccgucgaugccggcgacg

SEQ ID NO: 851454 - RNA, 17 nt, Mycobacterium avium subsp. paratuberculosis
ggcagcgaacugccggc

SEQ ID NO: 851455 - RNA, 14 nt, Mycobacterium avium subsp. paratuberculosis
ggcagcgaaucggg

SEQ ID NO: 851456 - RNA, 18 nt, Mycobacterium avium subsp. paratuberculosis
ggcagcgaaucggggucg

SEQ ID NO: 851457 - RNA, 19 nt, Mycobacterium avium subsp. paratuberculosis
ggcagcgaaucggggucga

SEQ ID NO: 851458 - RNA, 23 nt, Mycobacterium avium subsp. paratuberculosis
ggcagcgaaucggggucgaucac

SEQ ID NO: 851459 - RNA, 16 nt, Mycobacterium avium subsp. paratuberculosis
ggcagcgacagcgcgu

SEQ ID NO: 851460 - RNA, 13 nt, Mycobacterium avium subsp. paratuberculosis
ggcagccggggug

SEQ ID NO: 851461 - RNA, 19 nt, Mycobacterium avium subsp. paratuberculosis
ggccaugcagaccagcccg

SEQ ID NO: 851462 - RNA, 13 nt, Mycobacterium avium subsp. paratuberculosis
ggccaugccggcc

SEQ ID NO: 851463 - RNA, 18 nt, Mycobacterium avium subsp. paratuberculosis
ggccaugccucuucggcg

SEQ ID NO: 851464 - RNA, 15 nt, Mycobacterium avium subsp. paratuberculosis
ggccaucucggcggc

SEQ ID NO: 851465 - RNA, 15 nt, Mycobacterium avium subsp. paratuberculosis
ggccaugaagccguu

SEQ ID NO: 851466 - RNA, 16 nt, Mycobacterium avium subsp. paratuberculosis
ggccaugaccaugucg

SEQ ID NO: 851467 - RNA, 22 nt, Mycobacterium avium subsp. paratuberculosis
ggccaugaccaugucgacgcug

SEQ ID NO: 851468 - RNA, 19 nt, Mycobacterium avium subsp. paratuberculosis
ggccauggugccgccguug

SEQ ID NO: 851469 - RNA, 20 nt, Mycobacterium avium subsp. paratuberculosis
ggccaugcuuucgaucaucg

SEQ ID NO: 851470 - RNA, 17 nt, Mycobacterium avium subsp. paratuberculosis
ggccauggcgcaccgcg

SEQ ID NO: 851471 - RNA, 23 nt, Mycobacterium avium subsp. paratuberculosis
ggccauggcgcaccgcggccucg

SEQ ID NO: 851472 - RNA, 20 nt, Mycobacterium avium subsp. paratuberculosis
ggcccaaaaacgagaugccc

SEQ ID NO: 851473 - RNA, 17 nt, Mycobacterium avium subsp. paratuberculosis
ggccauucaucgcgcac

SEQ ID NO: 851474 - RNA, 18 nt, Mycobacterium avium subsp. paratuberculosis
ggccauguccccgccggu

SEQ ID NO: 851475 - RNA, 24 nt, Mycobacterium avium subsp. paratuberculosis
ggccauguacggauugcggacgcc

SEQ ID NO: 851476 - RNA, 16 nt, Mycobacterium avium subsp. paratuberculosis
ggcccacgacgucugg

SEQ ID NO: 851477 - RNA, 23 nt, Mycobacterium avium subsp. paratuberculosis
ggcccacgacgucugggccgccg

SEQ ID NO: 851478 - RNA, 14 nt, Mycobacterium avium subsp. paratuberculosis
ggcccaccgcgacc

SEQ ID NO: 851479 - RNA, 20 nt, Mycobacterium avium subsp. paratuberculosis
ggcccaccgcgacccggccg

SEQ ID NO: 851480 - RNA, 21 nt, Mycobacterium avium subsp. paratuberculosis
ggcccaccgcgacccggccga

SEQ ID NO: 851481 - RNA, 12 nt, Mycobacterium avium subsp. paratuberculosis
ggcccaccggcc

SEQ ID NO: 851482 - RNA, 17 nt, Mycobacterium avium subsp. paratuberculosis
ggcccaccggcccggcg

SEQ ID NO: 851483 - RNA, 19 nt, Mycobacterium avium subsp. paratuberculosis
ggcccaccggcccggcggg

SEQ ID NO: 851484 - RNA, 15 nt, Mycobacterium avium subsp. paratuberculosis
ggcccaccaggucga

SEQ ID NO: 851485 - RNA, 22 nt, Mycobacterium avium subsp. paratuberculosis
ggcccacccgcagggcgccggu

SEQ ID NO: 851486 - RNA, 16 nt, Mycobacterium avium subsp. paratuberculosis
ggcccaccgaaucacc

SEQ ID NO: 851487 - RNA, 18 nt, Mycobacterium avium subsp. paratuberculosis
ggcccaccgaaucaccca

SEQ ID NO: 851488 - RNA, 15 nt, Mycobacterium avium subsp. paratuberculosis
ggcccaccaccgccu

SEQ ID NO: 851489 - RNA, 22 nt, Mycobacterium avium subsp. paratuberculosis
ggcccaccaccgccucgacggu

SEQ ID NO: 851490 - RNA, 17 nt, Mycobacterium avium subsp. paratuberculosis
ggcccaauucguaggcg

SEQ ID NO: 851491 - RNA, 22 nt, Mycobacterium avium subsp. paratuberculosis
ggcccaaccgcauucggccgcc

SEQ ID NO: 851492 - RNA, 15 nt, Mycobacterium avium subsp. paratuberculosis
ggcccaauaccguuc

SEQ ID NO: 851493 - RNA, 22 nt, Mycobacterium avium subsp. paratuberculosis
ggcccagcuccaaugcggccga

SEQ ID NO: 851494 - RNA, 19 nt, Mycobacterium avium subsp. paratuberculosis
ggcccaggccgacgccggc

SEQ ID NO: 851495 - RNA, 13 nt, Mycobacterium avium subsp. paratuberculosis
ggcccaggccgcg

SEQ ID NO: 851496 - RNA, 15 nt, Mycobacterium avium subsp. paratuberculosis
ggcccaggccgcggu

SEQ ID NO: 851497 - RNA, 14 nt, Mycobacterium avium subsp. paratuberculosis
ggcccaggccggcg

SEQ ID NO: 851498 - RNA, 16 nt, Mycobacterium avium subsp. paratuberculosis
ggcccaggccggcggu

SEQ ID NO: 851499 - RNA, 18 nt, Mycobacterium avium subsp. paratuberculosis
ggcccaggcaguagccga

SEQ ID NO: 851500 - RNA, 14 nt, Mycobacterium avium subsp. paratuberculosis
ggcccaggccaaca

SEQ ID NO: 851501 - RNA, 15 nt, Mycobacterium avium subsp. paratuberculosis
ggcccagcugcugga

SEQ ID NO: 851502 - RNA, 23 nt, Mycobacterium avium subsp. paratuberculosis
ggcccagcugcuggaaucgcgga

SEQ ID NO: 851503 - RNA, 15 nt, Mycobacterium avium subsp. paratuberculosis
ggcccagcucgguga

SEQ ID NO: 851504 - RNA, 23 nt, Mycobacterium avium subsp. paratuberculosis
ggcccagcucggugaugaucgcc

SEQ ID NO: 851505 - RNA, 15 nt, Mycobacterium avium subsp. paratuberculosis
ggcccagcucggugc

SEQ ID NO: 851506 - RNA, 18 nt, Mycobacterium avium subsp. paratuberculosis
ggcccagcucggugcgca

SEQ ID NO: 851507 - RNA, 22 nt, Mycobacterium avium subsp. paratuberculosis
ggcccagcucguugccggcggc

SEQ ID NO: 851508 - RNA, 21 nt, Mycobacterium avium subsp. paratuberculosis
ggcccagcgaggcggccagcg

SEQ ID NO: 851509 - RNA, 14 nt, Mycobacterium avium subsp. paratuberculosis
ggcccagcccgccg

SEQ ID NO: 851510 - RNA, 12 nt, Mycobacterium avium subsp. paratuberculosis
ggcccagcgcga

SEQ ID NO: 851511 - RNA, 23 nt, Mycobacterium avium subsp. paratuberculosis
ggcccagcgcgacgucgaccgcg

SEQ ID NO: 851512 - RNA, 16 nt, Mycobacterium avium subsp. paratuberculosis
ggcccagcggaucgag

SEQ ID NO: 851513 - RNA, 14 nt, Mycobacterium avium subsp. paratuberculosis
ggcccagccggccg

SEQ ID NO: 851514 - RNA, 15 nt, Mycobacterium avium subsp. paratuberculosis
ggcccagccggccga

SEQ ID NO: 851515 - RNA, 19 nt, Mycobacterium avium subsp. paratuberculosis
ggcccagccggccgacgcg

SEQ ID NO: 851516 - RNA, 13 nt, Mycobacterium avium subsp. paratuberculosis
ggcccagccggug

SEQ ID NO: 851517 - RNA, 22 nt, Mycobacterium avium subsp. paratuberculosis
ggcccagccggugcgagccgcu

SEQ ID NO: 851518 - RNA, 15 nt, Mycobacterium avium subsp. paratuberculosis
ggcccagcccgccgc

SEQ ID NO: 851519 - RNA, 16 nt, Mycobacterium avium subsp. paratuberculosis
ggcccagcccgccgcg

SEQ ID NO: 851520 - RNA, 14 nt, Mycobacterium avium subsp. paratuberculosis
ggcccagcccggcc

SEQ ID NO: 851521 - RNA, 18 nt, Mycobacterium avium subsp. paratuberculosis
ggcccagcccggccagca

SEQ ID NO: 851522 - RNA, 22 nt, Mycobacterium avium subsp. paratuberculosis
ggcccagcccggccagcacccg

SEQ ID NO: 851523 - RNA, 15 nt, Mycobacterium avium subsp. paratuberculosis
ggcccagcaccacca

SEQ ID NO: 851524 - RNA, 15 nt, Mycobacterium avium subsp. paratuberculosis
ggcccagcaccaccu

SEQ ID NO: 851525 - RNA, 17 nt, Mycobacterium avium subsp. paratuberculosis
ggcccagcagcgcaccg

SEQ ID NO: 851526 - RNA, 22 nt, Mycobacterium avium subsp. paratuberculosis
ggcccagcagcgcaccggcgau

SEQ ID NO: 851527 - RNA, 23 nt, Mycobacterium avium subsp. paratuberculosis
ggcccagcagcgucacgucgacg

SEQ ID NO: 851528 - RNA, 23 nt, Mycobacterium avium subsp. paratuberculosis
ggcccagcagauagcccagccag

SEQ ID NO: 851529 - RNA, 17 nt, Mycobacterium avium subsp. paratuberculosis
ggcccagcagcaccgcg

SEQ ID NO: 851530 - RNA, 21 nt, Mycobacterium avium subsp. paratuberculosis
ggcccagcagcaccgcgaccg

SEQ ID NO: 851531 - RNA, 13 nt, Mycobacterium avium subsp. paratuberculosis
ggcccagcagccu

SEQ ID NO: 851532 - RNA, 17 nt, Mycobacterium avium subsp. paratuberculosis
ggcccagcagccugccc

SEQ ID NO: 851533 - RNA, 12 nt, Mycobacterium avium subsp. paratuberculosis
ggcccagcagcg

SEQ ID NO: 851534 - RNA, 15 nt, Mycobacterium avium subsp. paratuberculosis
ggcccagaucgcggu

SEQ ID NO: 851535 - RNA, 22 nt, Mycobacterium avium subsp. paratuberculosis
ggcccagaucgcgguccaccag

SEQ ID NO: 851536 - RNA, 14 nt, Mycobacterium avium subsp. paratuberculosis
ggcccagacgaugu

SEQ ID NO: 851537 - RNA, 19 nt, Mycobacterium avium subsp. paratuberculosis
ggcccagacaggccggccg

SEQ ID NO: 851538 - RNA, 20 nt, Mycobacterium avium subsp. paratuberculosis
ggcccacgucgcgccgaugu

SEQ ID NO: 851539 - RNA, 20 nt, Mycobacterium avium subsp. paratuberculosis
ggcccacguugagcacgccc

SEQ ID NO: 851540 - RNA, 23 nt, Mycobacterium avium subsp. paratuberculosis
ggcccacguugagcacgcccgcg

SEQ ID NO: 851541 - RNA, 13 nt, Mycobacterium avium subsp. paratuberculosis
ggcccacgcagcc

SEQ ID NO: 851542 - RNA, 16 nt, Mycobacterium avium subsp. paratuberculosis
ggcccacgcucgacgc

SEQ ID NO: 851543 - RNA, 20 nt, Mycobacterium avium subsp. paratuberculosis
ggccauauaggggugggcga

SEQ ID NO: 851544 - RNA, 15 nt, Mycobacterium avium subsp. paratuberculosis
ggccaucacggugcc

SEQ ID NO: 851545 - RNA, 17 nt, Mycobacterium avium subsp. paratuberculosis
ggccaucacggugccga

SEQ ID NO: 851546 - RNA, 23 nt, Mycobacterium avium subsp. paratuberculosis
ggccaucagcaccgaaucgccga

SEQ ID NO: 851547 - RNA, 22 nt, Mycobacterium avium subsp. paratuberculosis
ggccaucagcccggcguccugc

SEQ ID NO: 851548 - RNA, 15 nt, Mycobacterium avium subsp. paratuberculosis
ggccaucagccgccg

SEQ ID NO: 851549 - RNA, 23 nt, Mycobacterium avium subsp. paratuberculosis
ggccaucagccgccgucgcgcca

SEQ ID NO: 851550 - RNA, 16 nt, Mycobacterium avium subsp. paratuberculosis
ggccaguucaccgcgc

SEQ ID NO: 851551 - RNA, 18 nt, Mycobacterium avium subsp. paratuberculosis
ggccaguucaccgcgcuc

SEQ ID NO: 851552 - RNA, 15 nt, Mycobacterium avium subsp. paratuberculosis
ggccaguucgagcgc

SEQ ID NO: 851553 - RNA, 15 nt, Mycobacterium avium subsp. paratuberculosis
ggccaguucgccggu

SEQ ID NO: 851554 - RNA, 23 nt, Mycobacterium avium subsp. paratuberculosis
ggccaguucggguccgcgguccu

SEQ ID NO: 851555 - RNA, 13 nt, Mycobacterium avium subsp. paratuberculosis
ggccaguucgucg

SEQ ID NO: 851556 - RNA, 17 nt, Mycobacterium avium subsp. paratuberculosis
ggccaguucgucgcgcg

SEQ ID NO: 851557 - RNA, 20 nt, Mycobacterium avium subsp. paratuberculosis
ggccaguucgucgcgcgacu

SEQ ID NO: 851558 - RNA, 23 nt, Mycobacterium avium subsp. paratuberculosis
ggccaguugaaguccggcggucg

SEQ ID NO: 851559 - RNA, 19 nt, Mycobacterium avium subsp. paratuberculosis
ggccaucggcagacccagc

SEQ ID NO: 851560 - RNA, 23 nt, Mycobacterium avium subsp. paratuberculosis
ggccaucgucaucuugucggccu

SEQ ID NO: 851561 - RNA, 15 nt, Mycobacterium avium subsp. paratuberculosis
ggccaucgccugagc

SEQ ID NO: 851562 - RNA, 13 nt, Mycobacterium avium subsp. paratuberculosis
ggccaucgcgggu

SEQ ID NO: 851563 - RNA, 14 nt, Mycobacterium avium subsp. paratuberculosis
ggccaucgcgggug

SEQ ID NO: 851564 - RNA, 13 nt, Mycobacterium avium subsp. paratuberculosis
ggccaucgccgcg

SEQ ID NO: 851565 - RNA, 14 nt, Mycobacterium avium subsp. paratuberculosis
ggccaucgccgcgg

SEQ ID NO: 851566 - RNA, 17 nt, Mycobacterium avium subsp. paratuberculosis
ggccaucgccgccaucg

SEQ ID NO: 851567 - RNA, 14 nt, Mycobacterium avium subsp. paratuberculosis
ggccaucgccgagc

SEQ ID NO: 851568 - RNA, 16 nt, Mycobacterium avium subsp. paratuberculosis
ggccaucgccgagccg

SEQ ID NO: 851569 - RNA, 12 nt, Mycobacterium avium subsp. paratuberculosis
ggccaucgccag

SEQ ID NO: 851570 - RNA, 18 nt, Mycobacterium avium subsp. paratuberculosis
ggccaucgacuccagcac

SEQ ID NO: 851571 - RNA, 23 nt, Mycobacterium avium subsp. paratuberculosis
ggccaucgacuccagcaccggcg

SEQ ID NO: 851572 - RNA, 15 nt, Mycobacterium avium subsp. paratuberculosis
ggccauccggccggc

SEQ ID NO: 851573 - RNA, 16 nt, Mycobacterium avium subsp. paratuberculosis
ggccauccggccggcg

SEQ ID NO: 851574 - RNA, 17 nt, Mycobacterium avium subsp. paratuberculosis
ggccauccggccggcga

SEQ ID NO: 851575 - RNA, 18 nt, Mycobacterium avium subsp. paratuberculosis
ggccauccggccggcgag

SEQ ID NO: 851576 - RNA, 20 nt, Mycobacterium avium subsp. paratuberculosis
ggccauccggccggcgagga

SEQ ID NO: 851577 - RNA, 22 nt, Mycobacterium avium subsp. paratuberculosis
ggccauccugaagaagcggccg

SEQ ID NO: 851578 - RNA, 17 nt, Mycobacterium avium subsp. paratuberculosis
ggccaucaugcccacca

SEQ ID NO: 851579 - RNA, 21 nt, Mycobacterium avium subsp. paratuberculosis
ggccaucccggggacaccggg

SEQ ID NO: 851580 - RNA, 12 nt, Mycobacterium avium subsp. paratuberculosis
ggccaucccggu

SEQ ID NO: 851581 - RNA, 17 nt, Mycobacterium avium subsp. paratuberculosis
ggccaucccggugccgc

SEQ ID NO: 851582 - RNA, 18 nt, Mycobacterium avium subsp. paratuberculosis
ggccagcuuuccggccgc

SEQ ID NO: 851583 - RNA, 19 nt, Mycobacterium avium subsp. paratuberculosis
ggccagcuuuccggccgcc

SEQ ID NO: 851584 - RNA, 20 nt, Mycobacterium avium subsp. paratuberculosis
ggccagcuuuccggccgccu

SEQ ID NO: 851585 - RNA, 14 nt, Mycobacterium avium subsp. paratuberculosis
ggccaggaacggcg

SEQ ID NO: 851586 - RNA, 21 nt, Mycobacterium avium subsp. paratuberculosis
ggccaggaagaacuccgcgau

SEQ ID NO: 851587 - RNA, 13 nt, Mycobacterium avium subsp. paratuberculosis
ggccagggcggcg

SEQ ID NO: 851588 - RNA, 13 nt, Mycobacterium avium subsp. paratuberculosis
ggccagggcgagg

SEQ ID NO: 851589 - RNA, 14 nt, Mycobacterium avium subsp. paratuberculosis
ggccagggcccgca

SEQ ID NO: 851590 - RNA, 15 nt, Mycobacterium avium subsp. paratuberculosis
ggccagggcccgcag

SEQ ID NO: 851591 - RNA, 14 nt, Mycobacterium avium subsp. paratuberculosis
ggccagggccgccg

SEQ ID NO: 851592 - RNA, 16 nt, Mycobacterium avium subsp. paratuberculosis
ggccagggccgccgca

SEQ ID NO: 851593 - RNA, 20 nt, Mycobacterium avium subsp. paratuberculosis
ggccaggucccaggcguggu

SEQ ID NO: 851594 - RNA, 21 nt, Mycobacterium avium subsp. paratuberculosis
ggccagguccucgcuggcgau

SEQ ID NO: 851595 - RNA, 21 nt, Mycobacterium avium subsp. paratuberculosis
ggccagguacugaucaccgcg

SEQ ID NO: 851596 - RNA, 22 nt, Mycobacterium avium subsp. paratuberculosis
ggccaggguggggaucacgucg

SEQ ID NO: 851597 - RNA, 15 nt, Mycobacterium avium subsp. paratuberculosis
ggccaggguguccca

SEQ ID NO: 851598 - RNA, 21 nt, Mycobacterium avium subsp. paratuberculosis
ggccagggugucccagcgcca

SEQ ID NO: 851599 - RNA, 18 nt, Mycobacterium avium subsp. paratuberculosis
ggccagggcggcgccggc

SEQ ID NO: 851600 - RNA, 17 nt, Mycobacterium avium subsp. paratuberculosis
ggccaguccgcgugaca

SEQ ID NO: 851601 - RNA, 18 nt, Mycobacterium avium subsp. paratuberculosis
ggccagucgaaguucggc

SEQ ID NO: 851602 - RNA, 20 nt, Mycobacterium avium subsp. paratuberculosis
ggccagucgaaguucggcau

SEQ ID NO: 851603 - RNA, 15 nt, Mycobacterium avium subsp. paratuberculosis
ggccagucgccgcgc

SEQ ID NO: 851604 - RNA, 17 nt, Mycobacterium avium subsp. paratuberculosis
ggccagguuggucagca

SEQ ID NO: 851605 - RNA, 15 nt, Mycobacterium avium subsp. paratuberculosis
ggccagguugucguc

SEQ ID NO: 851606 - RNA, 16 nt, Mycobacterium avium subsp. paratuberculosis
ggccagguugucgucg

SEQ ID NO: 851607 - RNA, 18 nt, Mycobacterium avium subsp. paratuberculosis
ggccagguugucgucggg

SEQ ID NO: 851608 - RNA, 13 nt, Mycobacterium avium subsp. paratuberculosis
ggccagguggccg

SEQ ID NO: 851609 - RNA, 12 nt, Mycobacterium avium subsp. paratuberculosis
ggccaggucggu

SEQ ID NO: 851610 - RNA, 19 nt, Mycobacterium avium subsp. paratuberculosis
ggccagguugcgccguccg

SEQ ID NO: 851611 - RNA, 16 nt, Mycobacterium avium subsp. paratuberculosis
ggccaggugugcccgc

SEQ ID NO: 851612 - RNA, 19 nt, Mycobacterium avium subsp. paratuberculosis
ggccagguucaggcccgcg

SEQ ID NO: 851613 - RNA, 24 nt, Mycobacterium avium subsp. paratuberculosis
ggccagguucaggcccgcgccgac

SEQ ID NO: 851614 - RNA, 22 nt, Mycobacterium avium subsp. paratuberculosis
ggccagguuccaccgggcgucg

SEQ ID NO: 851615 - RNA, 16 nt, Mycobacterium avium subsp. paratuberculosis
ggccagguucgcgccg

SEQ ID NO: 851616 - RNA, 16 nt, Mycobacterium avium subsp. paratuberculosis
ggccagguugaccacc

SEQ ID NO: 851617 - RNA, 20 nt, Mycobacterium avium subsp. paratuberculosis
ggccagguugaccaccagcg

SEQ ID NO: 851618 - RNA, 14 nt, Mycobacterium avium subsp. paratuberculosis
ggccaggugcacgc

SEQ ID NO: 851619 - RNA, 19 nt, Mycobacterium avium subsp. paratuberculosis
ggccaggugcacgccgagc

SEQ ID NO: 851620 - RNA, 20 nt, Mycobacterium avium subsp. paratuberculosis
ggccaggugcacgccgagca

SEQ ID NO: 851621 - RNA, 17 nt, Mycobacterium avium subsp. paratuberculosis
ggccagggugacgguca

SEQ ID NO: 851622 - RNA, 17 nt, Mycobacterium avium subsp. paratuberculosis
ggccaggucgccgcgca

SEQ ID NO: 851623 - RNA, 19 nt, Mycobacterium avium subsp. paratuberculosis
ggccaggucgacggggucg

SEQ ID NO: 851624 - RNA, 20 nt, Mycobacterium avium subsp. paratuberculosis
ggccagccagccgcccagca

SEQ ID NO: 851625 - RNA, 20 nt, Mycobacterium avium subsp. paratuberculosis
ggccagccaguugggggcca

SEQ ID NO: 851626 - RNA, 19 nt, Mycobacterium avium subsp. paratuberculosis
ggccagccaggccgucggc

SEQ ID NO: 851627 - RNA, 22 nt, Mycobacterium avium subsp. paratuberculosis
ggccagccaggccgucggcgcg

SEQ ID NO: 851628 - RNA, 16 nt, Mycobacterium avium subsp. paratuberculosis
ggccagcaucucggcg

SEQ ID NO: 851629 - RNA, 18 nt, Mycobacterium avium subsp. paratuberculosis
ggccagcaucucggcgaa

SEQ ID NO: 851630 - RNA, 17 nt, Mycobacterium avium subsp. paratuberculosis
ggccagcaggucgucga

SEQ ID NO: 851631 - RNA, 17 nt, Mycobacterium avium subsp. paratuberculosis
ggccagcaguucgucca

SEQ ID NO: 851632 - RNA, 22 nt, Mycobacterium avium subsp. paratuberculosis
ggccagcaguucguccacgcug

SEQ ID NO: 851633 - RNA, 15 nt, Mycobacterium avium subsp. paratuberculosis
ggccagcagucguga

SEQ ID NO: 851634 - RNA, 22 nt, Mycobacterium avium subsp. paratuberculosis
ggccagcagucgugacgcggcg

SEQ ID NO: 851635 - RNA, 20 nt, Mycobacterium avium subsp. paratuberculosis
ggccagcagugccaccacca

SEQ ID NO: 851636 - RNA, 14 nt, Mycobacterium avium subsp. paratuberculosis
ggccagcaggucga

SEQ ID NO: 851637 - RNA, 18 nt, Mycobacterium avium subsp. paratuberculosis
ggccagcaggucgaaggc

SEQ ID NO: 851638 - RNA, 16 nt, Mycobacterium avium subsp. paratuberculosis
ggccagcagccgcgac

SEQ ID NO: 851639 - RNA, 14 nt, Mycobacterium avium subsp. paratuberculosis
ggccagcagccggg

SEQ ID NO: 851640 - RNA, 22 nt, Mycobacterium avium subsp. paratuberculosis
ggccagcagguagaucgccagc

SEQ ID NO: 851641 - RNA, 23 nt, Mycobacterium avium subsp. paratuberculosis
ggccagcagguagaucgccagcg

SEQ ID NO: 851642 - RNA, 19 nt, Mycobacterium avium subsp. paratuberculosis
ggccagcacggccagccag

SEQ ID NO: 851643 - RNA, 15 nt, Mycobacterium avium subsp. paratuberculosis
ggccagcagcaccag

SEQ ID NO: 851644 - RNA, 20 nt, Mycobacterium avium subsp. paratuberculosis
ggccagcagcaccagggcgu

SEQ ID NO: 851645 - RNA, 15 nt, Mycobacterium avium subsp. paratuberculosis
ggccagcagcagccc

SEQ ID NO: 851646 - RNA, 19 nt, Mycobacterium avium subsp. paratuberculosis
ggccagcagcagcccgccg

SEQ ID NO: 851647 - RNA, 18 nt, Mycobacterium avium subsp. paratuberculosis
ggccagcagcagguagcg

SEQ ID NO: 851648 - RNA, 14 nt, Mycobacterium avium subsp. paratuberculosis
ggccagcagccagc

SEQ ID NO: 851649 - RNA, 16 nt, Mycobacterium avium subsp. paratuberculosis
ggccagcagccagcug

SEQ ID NO: 851650 - RNA, 19 nt, Mycobacterium avium subsp. paratuberculosis
ggccagcagccagcuggug

SEQ ID NO: 851651 - RNA, 13 nt, Mycobacterium avium subsp. paratuberculosis
ggccagcagcccg

SEQ ID NO: 851652 - RNA, 12 nt, Mycobacterium avium subsp. paratuberculosis
ggccagcagccg

SEQ ID NO: 851653 - RNA, 16 nt, Mycobacterium avium subsp. paratuberculosis
ggccagcacggucagc

SEQ ID NO: 851654 - RNA, 23 nt, Mycobacterium avium subsp. paratuberculosis
ggccagcacgccggucagcacca

SEQ ID NO: 851655 - RNA, 14 nt, Mycobacterium avium subsp. paratuberculosis
ggccagcacgccuu

SEQ ID NO: 851656 - RNA, 21 nt, Mycobacterium avium subsp. paratuberculosis
ggccagcacgccuuccacgac

SEQ ID NO: 851657 - RNA, 13 nt, Mycobacterium avium subsp. paratuberculosis
ggccagcacgcug

SEQ ID NO: 851658 - RNA, 13 nt, Mycobacterium avium subsp. paratuberculosis
ggccagcacgccg

SEQ ID NO: 851659 - RNA, 23 nt, Mycobacterium avium subsp. paratuberculosis
ggccagcaccuggcgcaccgccg

SEQ ID NO: 851660 - RNA, 23 nt, Mycobacterium avium subsp. paratuberculosis
ggccagcaccuucagcgggcgca

SEQ ID NO: 851661 - RNA, 20 nt, Mycobacterium avium subsp. paratuberculosis
ggccagcacgaacaccacgu

SEQ ID NO: 851662 - RNA, 11 nt, Mycobacterium avium subsp. paratuberculosis
ggccagcacgc

SEQ ID NO: 851663 - RNA, 14 nt, Mycobacterium avium subsp. paratuberculosis
ggccagcaccguca

SEQ ID NO: 851664 - RNA, 16 nt, Mycobacterium avium subsp. paratuberculosis
ggccagcaccgucagc

SEQ ID NO: 851665 - RNA, 17 nt, Mycobacterium avium subsp. paratuberculosis
ggccagcaccgucagcc

SEQ ID NO: 851666 - RNA, 19 nt, Mycobacterium avium subsp. paratuberculosis
ggccagcaccgucagccag

SEQ ID NO: 851667 - RNA, 21 nt, Mycobacterium avium subsp. paratuberculosis
ggccagcaccgucagccaggu

SEQ ID NO: 851668 - RNA, 22 nt, Mycobacterium avium subsp. paratuberculosis
ggccagcacccgcucgcgggcc

SEQ ID NO: 851669 - RNA, 20 nt, Mycobacterium avium subsp. paratuberculosis
ggccagcacccggucgguga

SEQ ID NO: 851670 - RNA, 16 nt, Mycobacterium avium subsp. paratuberculosis
ggccagcaccgccagc

SEQ ID NO: 851671 - RNA, 17 nt, Mycobacterium avium subsp. paratuberculosis
ggccagcaccgccagcg

SEQ ID NO: 851672 - RNA, 19 nt, Mycobacterium avium subsp. paratuberculosis
ggccagcaccgccagcgcc

SEQ ID NO: 851673 - RNA, 23 nt, Mycobacterium avium subsp. paratuberculosis
ggccagcaccgccagcgccggca

SEQ ID NO: 851674 - RNA, 17 nt, Mycobacterium avium subsp. paratuberculosis
ggccagcaccgcggccg

SEQ ID NO: 851675 - RNA, 18 nt, Mycobacterium avium subsp. paratuberculosis
ggccagcaccgcggcgau

SEQ ID NO: 851676 - RNA, 20 nt, Mycobacterium avium subsp. paratuberculosis
ggccagcaccgcggcgaucg

SEQ ID NO: 851677 - RNA, 22 nt, Mycobacterium avium subsp. paratuberculosis
ggccagcaccgcggcgaucgcc

SEQ ID NO: 851678 - RNA, 16 nt, Mycobacterium avium subsp. paratuberculosis
ggccagcaccgcgucg

SEQ ID NO: 851679 - RNA, 20 nt, Mycobacterium avium subsp. paratuberculosis
ggccagcaccgcgucgaugu

SEQ ID NO: 851680 - RNA, 22 nt, Mycobacterium avium subsp. paratuberculosis
ggccagcaccgcgucgaugucg

SEQ ID NO: 851681 - RNA, 16 nt, Mycobacterium avium subsp. paratuberculosis
ggccagcaccaccgcg

SEQ ID NO: 851682 - RNA, 20 nt, Mycobacterium avium subsp. paratuberculosis
ggccagcaccaccgcgagcg

SEQ ID NO: 851683 - RNA, 13 nt, Mycobacterium avium subsp. paratuberculosis
ggccagcaccacg

SEQ ID NO: 851684 - RNA, 17 nt, Mycobacterium avium subsp. paratuberculosis
ggccagcacacccucga

SEQ ID NO: 851685 - RNA, 22 nt, Mycobacterium avium subsp. paratuberculosis
ggccagcacacccucgacccgu

SEQ ID NO: 851686 - RNA, 14 nt, Mycobacterium avium subsp. paratuberculosis
ggccagcaccacgu

SEQ ID NO: 851687 - RNA, 20 nt, Mycobacterium avium subsp. paratuberculosis
ggccagcaccacguccgcgg

SEQ ID NO: 851688 - RNA, 22 nt, Mycobacterium avium subsp. paratuberculosis
ggccagcaccacguccgcggug

SEQ ID NO: 851689 - RNA, 13 nt, Mycobacterium avium subsp. paratuberculosis
ggccagcaccagc

SEQ ID NO: 851690 - RNA, 14 nt, Mycobacterium avium subsp. paratuberculosis
ggccagcaccagca

SEQ ID NO: 851691 - RNA, 15 nt, Mycobacterium avium subsp. paratuberculosis
ggccagcaccagcag

SEQ ID NO: 851692 - RNA, 17 nt, Mycobacterium avium subsp. paratuberculosis
ggccagcaccagcccga

SEQ ID NO: 851693 - RNA, 14 nt, Mycobacterium avium subsp. paratuberculosis
ggccagcaccagcg

SEQ ID NO: 851694 - RNA, 15 nt, Mycobacterium avium subsp. paratuberculosis
ggccagcaccagcgc

SEQ ID NO: 851695 - RNA, 16 nt, Mycobacterium avium subsp. paratuberculosis
ggccagcaccagcgcg

SEQ ID NO: 851696 - RNA, 22 nt, Mycobacterium avium subsp. paratuberculosis
ggccagcaccagcgcgcgggug

SEQ ID NO: 851697 - RNA, 23 nt, Mycobacterium avium subsp. paratuberculosis
ggccagcaccaggaaggcgaccg

SEQ ID NO: 851698 - RNA, 19 nt, Mycobacterium avium subsp. paratuberculosis
ggccagcaccaguucgcgu

SEQ ID NO: 851699 - RNA, 16 nt, Mycobacterium avium subsp. paratuberculosis
ggccagcaccauccag

SEQ ID NO: 851700 - RNA, 19 nt, Mycobacterium avium subsp. paratuberculosis
ggccagcaccaugaucagg

SEQ ID NO: 851701 - RNA, 11 nt, Mycobacterium avium subsp. paratuberculosis
ggccagcaccc

SEQ ID NO: 851702 - RNA, 16 nt, Mycobacterium avium subsp. paratuberculosis
ggccagcugcccgccg

SEQ ID NO: 851703 - RNA, 21 nt, Mycobacterium avium subsp. paratuberculosis
ggccagcugcgacagcacggg

SEQ ID NO: 851704 - RNA, 17 nt, Mycobacterium avium subsp. paratuberculosis
ggccagcucgucgcgga

SEQ ID NO: 851705 - RNA, 17 nt, Mycobacterium avium subsp. paratuberculosis
ggccagcggcgccgggu

SEQ ID NO: 851706 - RNA, 15 nt, Mycobacterium avium subsp. paratuberculosis
ggccagcugauagcc

SEQ ID NO: 851707 - RNA, 12 nt, Mycobacterium avium subsp. paratuberculosis
ggccagcucggu

SEQ ID NO: 851708 - RNA, 16 nt, Mycobacterium avium subsp. paratuberculosis
ggccagcucggucagc

SEQ ID NO: 851709 - RNA, 17 nt, Mycobacterium avium subsp. paratuberculosis
ggccagcucggucagcc

SEQ ID NO: 851710 - RNA, 22 nt, Mycobacterium avium subsp. paratuberculosis
ggccagcucggucagccgggcg

SEQ ID NO: 851711 - RNA, 17 nt, Mycobacterium avium subsp. paratuberculosis
ggccagcucgccgccga

SEQ ID NO: 851712 - RNA, 20 nt, Mycobacterium avium subsp. paratuberculosis
ggccagcucgucgagccggc

SEQ ID NO: 851713 - RNA, 15 nt, Mycobacterium avium subsp. paratuberculosis
ggccagcggccagcc

SEQ ID NO: 851714 - RNA, 20 nt, Mycobacterium avium subsp. paratuberculosis
ggccagcggcagcgacagcg

SEQ ID NO: 851715 - RNA, 18 nt, Mycobacterium avium subsp. paratuberculosis
ggccagcggcagcggcgu

SEQ ID NO: 851716 - RNA, 20 nt, Mycobacterium avium subsp. paratuberculosis
ggccagcggcagcggcgucg

SEQ ID NO: 851717 - RNA, 13 nt, Mycobacterium avium subsp. paratuberculosis
ggccagcgggccg

SEQ ID NO: 851718 - RNA, 16 nt, Mycobacterium avium subsp. paratuberculosis
ggccagcgggcggccc

SEQ ID NO: 851719 - RNA, 16 nt, Mycobacterium avium subsp. paratuberculosis
ggccagcucgaccgcg

SEQ ID NO: 851720 - RNA, 19 nt, Mycobacterium avium subsp. paratuberculosis
ggccagcucgaccgcggcg

SEQ ID NO: 851721 - RNA, 11 nt, Mycobacterium avium subsp. paratuberculosis
ggccagcucgg

SEQ ID NO: 851722 - RNA, 16 nt, Mycobacterium avium subsp. paratuberculosis
ggccagcucggcccgc

SEQ ID NO: 851723 - RNA, 13 nt, Mycobacterium avium subsp. paratuberculosis
ggccagcucggcg

SEQ ID NO: 851724 - RNA, 15 nt, Mycobacterium avium subsp. paratuberculosis
ggccagcucggcggc

SEQ ID NO: 851725 - RNA, 16 nt, Mycobacterium avium subsp. paratuberculosis
ggccagcucggcggcc

SEQ ID NO: 851726 - RNA, 22 nt, Mycobacterium avium subsp. paratuberculosis
ggccagcucggcggccaugucg

SEQ ID NO: 851727 - RNA, 11 nt, Mycobacterium avium subsp. paratuberculosis
ggccagcgcgu

SEQ ID NO: 851728 - RNA, 13 nt, Mycobacterium avium subsp. paratuberculosis
ggccagcgcgucg

SEQ ID NO: 851729 - RNA, 18 nt, Mycobacterium avium subsp. paratuberculosis
ggccagcgcggccgggcg

SEQ ID NO: 851730 - RNA, 20 nt, Mycobacterium avium subsp. paratuberculosis
ggccagcgcggccgggcgcc

SEQ ID NO: 851731 - RNA, 17 nt, Mycobacterium avium subsp. paratuberculosis
ggccagcgcgucggcca

SEQ ID NO: 851732 - RNA, 20 nt, Mycobacterium avium subsp. paratuberculosis
ggccagcgcgucggccagca

SEQ ID NO: 851733 - RNA, 21 nt, Mycobacterium avium subsp. paratuberculosis
ggccagcgcgucggccagcac

SEQ ID NO: 851734 - RNA, 16 nt, Mycobacterium avium subsp. paratuberculosis
ggccagcgccgccagc

SEQ ID NO: 851735 - RNA, 20 nt, Mycobacterium avium subsp. paratuberculosis
ggccagcgcggcggucgcgc

SEQ ID NO: 851736 - RNA, 14 nt, Mycobacterium avium subsp. paratuberculosis
ggccagcgcggcgu

SEQ ID NO: 851737 - RNA, 12 nt, Mycobacterium avium subsp. paratuberculosis
ggccagcgcggu

SEQ ID NO: 851738 - RNA, 14 nt, Mycobacterium avium subsp. paratuberculosis
ggccagcgcgguga

SEQ ID NO: 851739 - RNA, 23 nt, Mycobacterium avium subsp. paratuberculosis
ggccagcgcggugaagucggugc

SEQ ID NO: 851740 - RNA, 16 nt, Mycobacterium avium subsp. paratuberculosis
ggccagcgcgguggcc

SEQ ID NO: 851741 - RNA, 21 nt, Mycobacterium avium subsp. paratuberculosis
ggccagcgcgguggccagcag

SEQ ID NO: 851742 - RNA, 19 nt, Mycobacterium avium subsp. paratuberculosis
ggccagcgcggugugcggc

SEQ ID NO: 851743 - RNA, 20 nt, Mycobacterium avium subsp. paratuberculosis
ggccagcgcggugugcggcg

SEQ ID NO: 851744 - RNA, 22 nt, Mycobacterium avium subsp. paratuberculosis
ggccagcgcggugugcggcggc

SEQ ID NO: 851745 - RNA, 17 nt, Mycobacterium avium subsp. paratuberculosis
ggccagcgccagcgcca

SEQ ID NO: 851746 - RNA, 13 nt, Mycobacterium avium subsp. paratuberculosis
ggccagcgccagc

SEQ ID NO: 851747 - RNA, 13 nt, Mycobacterium avium subsp. paratuberculosis
ggccagcgccaug

SEQ ID NO: 851748 - RNA, 18 nt, Mycobacterium avium subsp. paratuberculosis
ggccagcgcccgcgcgau

SEQ ID NO: 851749 - RNA, 17 nt, Mycobacterium avium subsp. paratuberculosis
ggccagcgcccgcgggu

SEQ ID NO: 851750 - RNA, 14 nt, Mycobacterium avium subsp. paratuberculosis
ggccagcgccgaga

SEQ ID NO: 851751 - RNA, 20 nt, Mycobacterium avium subsp. paratuberculosis
ggccagcgccgagccgaggc

SEQ ID NO: 851752 - RNA, 13 nt, Mycobacterium avium subsp. paratuberculosis
ggccagcgcagcg

SEQ ID NO: 851753 - RNA, 17 nt, Mycobacterium avium subsp. paratuberculosis
ggccagccgggcgaccg

SEQ ID NO: 851754 - RNA, 20 nt, Mycobacterium avium subsp. paratuberculosis
ggccagcgaauggcaauacg

SEQ ID NO: 851755 - RNA, 21 nt, Mycobacterium avium subsp. paratuberculosis
ggccagcgaguccagccagcc

SEQ ID NO: 851756 - RNA, 22 nt, Mycobacterium avium subsp. paratuberculosis
ggccagcgaguccagccagccg

SEQ ID NO: 851757 - RNA, 12 nt, Mycobacterium avium subsp. paratuberculosis
ggccagccgggg

SEQ ID NO: 851758 - RNA, 23 nt, Mycobacterium avium subsp. paratuberculosis
ggccagccgguugcgguggccga

SEQ ID NO: 851759 - RNA, 18 nt, Mycobacterium avium subsp. paratuberculosis
ggccaccaggcgccgucg

SEQ ID NO: 851760 - RNA, 17 nt, Mycobacterium avium subsp. paratuberculosis
ggccaccgcaucgccga

SEQ ID NO: 851761 - RNA, 17 nt, Mycobacterium avium subsp. paratuberculosis
ggccaccagcggccgga

SEQ ID NO: 851762 - RNA, 14 nt, Mycobacterium avium subsp. paratuberculosis
ggccaccaggccga

SEQ ID NO: 851763 - RNA, 23 nt, Mycobacterium avium subsp. paratuberculosis
ggccaccaggccgaagacgauga

SEQ ID NO: 851764 - RNA, 16 nt, Mycobacterium avium subsp. paratuberculosis
ggccaccacggcaccg

SEQ ID NO: 851765 - RNA, 13 nt, Mycobacterium avium subsp. paratuberculosis
ggccaccacgggu

SEQ ID NO: 851766 - RNA, 15 nt, Mycobacterium avium subsp. paratuberculosis
ggccaccacgggucg

SEQ ID NO: 851767 - RNA, 20 nt, Mycobacterium avium subsp. paratuberculosis
ggccaccagcagcgagaccg

SEQ ID NO: 851768 - RNA, 22 nt, Mycobacterium avium subsp. paratuberculosis
ggccaccagcagcgagaccggc

SEQ ID NO: 851769 - RNA, 16 nt, Mycobacterium avium subsp. paratuberculosis
ggccacaugggccacg

SEQ ID NO: 851770 - RNA, 11 nt, Mycobacterium avium subsp. paratuberculosis
ggccaccaccg

SEQ ID NO: 851771 - RNA, 19 nt, Mycobacterium avium subsp. paratuberculosis
ggccaccacaguggccgcc

SEQ ID NO: 851772 - RNA, 20 nt, Mycobacterium avium subsp. paratuberculosis
ggccaccacaguggccgcca

SEQ ID NO: 851773 - RNA, 22 nt, Mycobacterium avium subsp. paratuberculosis
ggccaccacaguggccgccagu

SEQ ID NO: 851774 - RNA, 21 nt, Mycobacterium avium subsp. paratuberculosis
ggccaccaccacggccgccga

SEQ ID NO: 851775 - RNA, 23 nt, Mycobacterium avium subsp. paratuberculosis
ggccaccaccacggccgccgagg

SEQ ID NO: 851776 - RNA, 19 nt, Mycobacterium avium subsp. paratuberculosis
ggccaccaccgagguggcc

SEQ ID NO: 851777 - RNA, 21 nt, Mycobacterium avium subsp. paratuberculosis
ggccaccaccgagguggccca

SEQ ID NO: 851778 - RNA, 19 nt, Mycobacterium avium subsp. paratuberculosis
ggccaccaccgccacggcg

SEQ ID NO: 851779 - RNA, 20 nt, Mycobacterium avium subsp. paratuberculosis
ggccaccacgacgccgggcg

SEQ ID NO: 851780 - RNA, 22 nt, Mycobacterium avium subsp. paratuberculosis
ggccaccacgacgccgggcgcc

SEQ ID NO: 851781 - RNA, 14 nt, Mycobacterium avium subsp. paratuberculosis
ggccaccacgccag

SEQ ID NO: 851782 - RNA, 18 nt, Mycobacterium avium subsp. paratuberculosis
ggccaccacgccagccuc

SEQ ID NO: 851783 - RNA, 20 nt, Mycobacterium avium subsp. paratuberculosis
ggcaucgcugguggccgacg

SEQ ID NO: 851784 - RNA, 21 nt, Mycobacterium avium subsp. paratuberculosis
ggcaucgcugguggccgacgu

SEQ ID NO: 851785 - RNA, 15 nt, Mycobacterium avium subsp. paratuberculosis
ggcaucgcgugccga

SEQ ID NO: 851786 - RNA, 17 nt, Mycobacterium avium subsp. paratuberculosis
ggcaucggcucguagcg

SEQ ID NO: 851787 - RNA, 18 nt, Mycobacterium avium subsp. paratuberculosis
ggcaucggcuggucggcg

SEQ ID NO: 851788 - RNA, 19 nt, Mycobacterium avium subsp. paratuberculosis
ggcaucggcuggucggcgg

SEQ ID NO: 851789 - RNA, 21 nt, Mycobacterium avium subsp. paratuberculosis
ggcaucgggucguagagcgcg

SEQ ID NO: 851790 - RNA, 18 nt, Mycobacterium avium subsp. paratuberculosis
ggcaugccgggccagccg

SEQ ID NO: 851791 - RNA, 13 nt, Mycobacterium avium subsp. paratuberculosis
ggcaugccgucgg

SEQ ID NO: 851792 - RNA, 17 nt, Mycobacterium avium subsp. paratuberculosis
ggcaugccgucggcgcc

SEQ ID NO: 851793 - RNA, 22 nt, Mycobacterium avium subsp. paratuberculosis
ggcaugccguucagcgcggcca

SEQ ID NO: 851794 - RNA, 23 nt, Mycobacterium avium subsp. paratuberculosis
ggcaugccguucagcgcggccac

SEQ ID NO: 851795 - RNA, 21 nt, Mycobacterium avium subsp. paratuberculosis
ggcaugcccguagaugccggu

SEQ ID NO: 851796 - RNA, 20 nt, Mycobacterium avium subsp. paratuberculosis
ggcaugccggaacaccucga

SEQ ID NO: 851797 - RNA, 16 nt, Mycobacterium avium subsp. paratuberculosis
ggcaugccggccggca

SEQ ID NO: 851798 - RNA, 16 nt, Mycobacterium avium subsp. paratuberculosis
ggccacugccccggcg

SEQ ID NO: 851799 - RNA, 17 nt, Mycobacterium avium subsp. paratuberculosis
ggccacugccccggcga

SEQ ID NO: 851800 - RNA, 13 nt, Mycobacterium avium subsp. paratuberculosis
ggccacucgccgc

SEQ ID NO: 851801 - RNA, 18 nt, Mycobacterium avium subsp. paratuberculosis
ggccacucgccgcgaacg

SEQ ID NO: 851802 - RNA, 13 nt, Mycobacterium avium subsp. paratuberculosis
ggccacucgcguc

SEQ ID NO: 851803 - RNA, 19 nt, Mycobacterium avium subsp. paratuberculosis
ggccacgucgaagcccggg

SEQ ID NO: 851804 - RNA, 19 nt, Mycobacterium avium subsp. paratuberculosis
ggccacgccccauugccgc

SEQ ID NO: 851805 - RNA, 22 nt, Mycobacterium avium subsp. paratuberculosis
ggccacgccccauugccgcgcc

SEQ ID NO: 851806 - RNA, 19 nt, Mycobacterium avium subsp. paratuberculosis
ggccacgcccuggccgccg

SEQ ID NO: 851807 - RNA, 21 nt, Mycobacterium avium subsp. paratuberculosis
ggccacgcccuggccgccggc

SEQ ID NO: 851808 - RNA, 22 nt, Mycobacterium avium subsp. paratuberculosis
ggccacgcccuggccgccggcc

SEQ ID NO: 851809 - RNA, 12 nt, Mycobacterium avium subsp. paratuberculosis
ggccacgcccac

SEQ ID NO: 851810 - RNA, 15 nt, Mycobacterium avium subsp. paratuberculosis
ggccacgcagucguc

SEQ ID NO: 851811 - RNA, 17 nt, Mycobacterium avium subsp. paratuberculosis
ggccacgcagucgucga

SEQ ID NO: 851812 - RNA, 18 nt, Mycobacterium avium subsp. paratuberculosis
ggccacgcagucgucgau

SEQ ID NO: 851813 - RNA, 13 nt, Mycobacterium avium subsp. paratuberculosis
ggccacgaucgcg

SEQ ID NO: 851814 - RNA, 20 nt, Mycobacterium avium subsp. paratuberculosis
ggccacgaucgcgaucgccg

SEQ ID NO: 851815 - RNA, 23 nt, Mycobacterium avium subsp. paratuberculosis
ggccacgaucgcgaucgccgauc

SEQ ID NO: 851816 - RNA, 19 nt, Mycobacterium avium subsp. paratuberculosis
ggccacgaugaucgucggc

SEQ ID NO: 851817 - RNA, 14 nt, Mycobacterium avium subsp. paratuberculosis
ggccacgauccgcg

SEQ ID NO: 851818 - RNA, 15 nt, Mycobacterium avium subsp. paratuberculosis
ggccacgauccgcgc

SEQ ID NO: 851819 - RNA, 16 nt, Mycobacterium avium subsp. paratuberculosis
ggccacgauccgcgcg

SEQ ID NO: 851820 - RNA, 23 nt, Mycobacterium avium subsp. paratuberculosis
ggccacgauccgcgcggccacca

SEQ ID NO: 851821 - RNA, 14 nt, Mycobacterium avium subsp. paratuberculosis
ggccaccggcgcca

SEQ ID NO: 851822 - RNA, 17 nt, Mycobacterium avium subsp. paratuberculosis
ggccaccggcgccaggu

SEQ ID NO: 851823 - RNA, 13 nt, Mycobacterium avium subsp. paratuberculosis
ggccacgaccucg

SEQ ID NO: 851824 - RNA, 14 nt, Mycobacterium avium subsp. paratuberculosis
ggccacgaccucgg

SEQ ID NO: 851825 - RNA, 19 nt, Mycobacterium avium subsp. paratuberculosis
ggccacgaccucggggucg

SEQ ID NO: 851826 - RNA, 12 nt, Mycobacterium avium subsp. paratuberculosis
ggccacgacgcg

SEQ ID NO: 851827 - RNA, 17 nt, Mycobacterium avium subsp. paratuberculosis
ggccacgacgcgccacg

SEQ ID NO: 851828 - RNA, 13 nt, Mycobacterium avium subsp. paratuberculosis
ggccacgacgcgg

SEQ ID NO: 851829 - RNA, 15 nt, Mycobacterium avium subsp. paratuberculosis
ggccacgacgcggcg

SEQ ID NO: 851830 - RNA, 16 nt, Mycobacterium avium subsp. paratuberculosis
ggccacgacgcggcgc

SEQ ID NO: 851831 - RNA, 21 nt, Mycobacterium avium subsp. paratuberculosis
ggccacgacgcggcgcgcgau

SEQ ID NO: 851832 - RNA, 15 nt, Mycobacterium avium subsp. paratuberculosis
ggccacgacggcgcu

SEQ ID NO: 851833 - RNA, 16 nt, Mycobacterium avium subsp. paratuberculosis
ggccacgacggcgcug

SEQ ID NO: 851834 - RNA, 15 nt, Mycobacterium avium subsp. paratuberculosis
ggccaccgcggcguu

SEQ ID NO: 851835 - RNA, 12 nt, Mycobacterium avium subsp. paratuberculosis
ggccaccgcguc

SEQ ID NO: 851836 - RNA, 22 nt, Mycobacterium avium subsp. paratuberculosis
ggccaccgcgucgcugcccaga

SEQ ID NO: 851837 - RNA, 14 nt, Mycobacterium avium subsp. paratuberculosis
ggccaccgcggcca

SEQ ID NO: 851838 - RNA, 13 nt, Mycobacterium avium subsp. paratuberculosis
ggccaccgcgccu

SEQ ID NO: 851839 - RNA, 17 nt, Mycobacterium avium subsp. paratuberculosis
ggccaccgcgcgcugcc

SEQ ID NO: 851840 - RNA, 15 nt, Mycobacterium avium subsp. paratuberculosis
ggccaccgcgcggcg

SEQ ID NO: 851841 - RNA, 18 nt, Mycobacterium avium subsp. paratuberculosis
ggccaccgcgcggcgguc

SEQ ID NO: 851842 - RNA, 23 nt, Mycobacterium avium subsp. paratuberculosis
ggccaccgcgcggcgguccagcg

SEQ ID NO: 851843 - RNA, 15 nt, Mycobacterium avium subsp. paratuberculosis
ggccaccgcgcggug

SEQ ID NO: 851844 - RNA, 16 nt, Mycobacterium avium subsp. paratuberculosis
ggccaccgcgcggugc

SEQ ID NO: 851845 - RNA, 21 nt, Mycobacterium avium subsp. paratuberculosis
ggccaccgcgcggugcaccag

SEQ ID NO: 851846 - RNA, 16 nt, Mycobacterium avium subsp. paratuberculosis
ggccaccgccugcgcg

SEQ ID NO: 851847 - RNA, 22 nt, Mycobacterium avium subsp. paratuberculosis
ggccaccgccugcgcgaucgcc

SEQ ID NO: 851848 - RNA, 19 nt, Mycobacterium avium subsp. paratuberculosis
ggccaccgcgacgcccagg

SEQ ID NO: 851849 - RNA, 17 nt, Mycobacterium avium subsp. paratuberculosis
ggccaccgcgacgcugc

SEQ ID NO: 851850 - RNA, 14 nt, Mycobacterium avium subsp. paratuberculosis
ggccaccgccgcca

SEQ ID NO: 851851 - RNA, 17 nt, Mycobacterium avium subsp. paratuberculosis
ggccaccgccgccagca

SEQ ID NO: 851852 - RNA, 17 nt, Mycobacterium avium subsp. paratuberculosis
ggccaccgccccagccg

SEQ ID NO: 851853 - RNA, 19 nt, Mycobacterium avium subsp. paratuberculosis
ggccaccgcgccccggcgc

SEQ ID NO: 851854 - RNA, 18 nt, Mycobacterium avium subsp. paratuberculosis
ggcgaaucgguccggcga

SEQ ID NO: 851855 - RNA, 15 nt, Mycobacterium avium subsp. paratuberculosis
ggcgaauccgaccgg

SEQ ID NO: 851856 - RNA, 22 nt, Mycobacterium avium subsp. paratuberculosis
ggcgaauccgaccggcucagcc

SEQ ID NO: 851857 - RNA, 15 nt, Mycobacterium avium subsp. paratuberculosis
ggcgaauccgagcau

SEQ ID NO: 851858 - RNA, 22 nt, Mycobacterium avium subsp. paratuberculosis
ggcgaauccgaguuggccggca

SEQ ID NO: 851859 - RNA, 16 nt, Mycobacterium avium subsp. paratuberculosis
ggcgaaguugcgguug

SEQ ID NO: 851860 - RNA, 19 nt, Mycobacterium avium subsp. paratuberculosis
ggcgaauauuucgccgauc

SEQ ID NO: 851861 - RNA, 23 nt, Mycobacterium avium subsp. paratuberculosis
ggcgaaucagcagcuugaucgcc

SEQ ID NO: 851862 - RNA, 13 nt, Mycobacterium avium subsp. paratuberculosis
ggcgacacccagc

SEQ ID NO: 851863 - RNA, 17 nt, Mycobacterium avium subsp. paratuberculosis
ggcgacacccagcggcg

SEQ ID NO: 851864 - RNA, 16 nt, Mycobacterium avium subsp. paratuberculosis
ggcgacaccccgcgag

SEQ ID NO: 851865 - RNA, 21 nt, Mycobacterium avium subsp. paratuberculosis
ggcgacaccgcauggccggcg

SEQ ID NO: 851866 - RNA, 22 nt, Mycobacterium avium subsp. paratuberculosis
ggcgacaccgcauggccggcga

SEQ ID NO: 851867 - RNA, 18 nt, Mycobacterium avium subsp. paratuberculosis
ggcgacaacaggcgaccu

SEQ ID NO: 851868 - RNA, 16 nt, Mycobacterium avium subsp. paratuberculosis
ggcgacaucgccgaga

SEQ ID NO: 851869 - RNA, 21 nt, Mycobacterium avium subsp. paratuberculosis
ggcgacaucgccgcggccgga

SEQ ID NO: 851870 - RNA, 22 nt, Mycobacterium avium subsp. paratuberculosis
ggcgacaucgccgcggccggag

SEQ ID NO: 851871 - RNA, 15 nt, Mycobacterium avium subsp. paratuberculosis
ggcgacaugcgcagc

SEQ ID NO: 851872 - RNA, 20 nt, Mycobacterium avium subsp. paratuberculosis
ggcgacaugcgcagcgccca

SEQ ID NO: 851873 - RNA, 24 nt, Mycobacterium avium subsp. paratuberculosis
ggcgacaugcgcagcgcccaggcg

SEQ ID NO: 851874 - RNA, 13 nt, Mycobacterium avium subsp. paratuberculosis
ggcgaccacaccg

SEQ ID NO: 851875 - RNA, 16 nt, Mycobacterium avium subsp. paratuberculosis
ggcgaccacaccgccg

SEQ ID NO: 851876 - RNA, 17 nt, Mycobacterium avium subsp. paratuberculosis
ggcgaccacaccgccgg

SEQ ID NO: 851877 - RNA, 22 nt, Mycobacterium avium subsp. paratuberculosis
ggcgaccacaccgccggccacg

SEQ ID NO: 851878 - RNA, 23 nt, Mycobacterium avium subsp. paratuberculosis
ggcgaccacaccgccggccacgu

SEQ ID NO: 851879 - RNA, 15 nt, Mycobacterium avium subsp. paratuberculosis
ggcgaccacaccguc

SEQ ID NO: 851880 - RNA, 19 nt, Mycobacterium avium subsp. paratuberculosis
ggcgaccaccacggccgca

SEQ ID NO: 851881 - RNA, 12 nt, Mycobacterium avium subsp. paratuberculosis
ggcgaccagcga

SEQ ID NO: 851882 - RNA, 18 nt, Mycobacterium avium subsp. paratuberculosis
ggcgaccagcgacggcag

SEQ ID NO: 851883 - RNA, 15 nt, Mycobacterium avium subsp. paratuberculosis
ggcgaccagcgagcc

SEQ ID NO: 851884 - RNA, 19 nt, Mycobacterium avium subsp. paratuberculosis
ggcgaccagcgagcccagc

SEQ ID NO: 851885 - RNA, 13 nt, Mycobacterium avium subsp. paratuberculosis
ggcgaccaccagc

SEQ ID NO: 851886 - RNA, 16 nt, Mycobacterium avium subsp. paratuberculosis
ggcgaccaccagccgc

SEQ ID NO: 851887 - RNA, 12 nt, Mycobacterium avium subsp. paratuberculosis
ggcgaccaccga

SEQ ID NO: 851888 - RNA, 20 nt, Mycobacterium avium subsp. paratuberculosis
ggcgaccaccucggcgacga

SEQ ID NO: 851889 - RNA, 20 nt, Mycobacterium avium subsp. paratuberculosis
ggcgaccagauaggccagcg

SEQ ID NO: 851890 - RNA, 19 nt, Mycobacterium avium subsp. paratuberculosis
ggcgaccuugcgcagccgg

SEQ ID NO: 851891 - RNA, 22 nt, Mycobacterium avium subsp. paratuberculosis
ggcgaccuugcgcagccggcag

SEQ ID NO: 851892 - RNA, 14 nt, Mycobacterium avium subsp. paratuberculosis
ggcgaccugcggcu

SEQ ID NO: 851893 - RNA, 15 nt, Mycobacterium avium subsp. paratuberculosis
ggcgaccugcgggcc

SEQ ID NO: 851894 - RNA, 17 nt, Mycobacterium avium subsp. paratuberculosis
ggcgaccugcgggccca

SEQ ID NO: 851895 - RNA, 20 nt, Mycobacterium avium subsp. paratuberculosis
ggcgaccugcgggcccaccg

SEQ ID NO: 851896 - RNA, 14 nt, Mycobacterium avium subsp. paratuberculosis
ggcgaccgugccca

SEQ ID NO: 851897 - RNA, 18 nt, Mycobacterium avium subsp. paratuberculosis
ggcgaccgugcccaccag

SEQ ID NO: 851898 - RNA, 19 nt, Mycobacterium avium subsp. paratuberculosis
ggcgaccgugcccaccagc

SEQ ID NO: 851899 - RNA, 17 nt, Mycobacterium avium subsp. paratuberculosis
ggcgaccuggacgccgc

SEQ ID NO: 851900 - RNA, 19 nt, Mycobacterium avium subsp. paratuberculosis
ggcgaccuggacgccgcac

SEQ ID NO: 851901 - RNA, 23 nt, Mycobacterium avium subsp. paratuberculosis
ggcgaccuggacgccgcacgcga

SEQ ID NO: 851902 - RNA, 19 nt, Mycobacterium avium subsp. paratuberculosis
ggcgacgaagucgacggcg

SEQ ID NO: 851903 - RNA, 20 nt, Mycobacterium avium subsp. paratuberculosis
ggcgacgaagucgacggcgg

SEQ ID NO: 851904 - RNA, 19 nt, Mycobacterium avium subsp. paratuberculosis
ggcgacgaagcagcucgcg

SEQ ID NO: 851905 - RNA, 13 nt, Mycobacterium avium subsp. paratuberculosis
ggcgacgaccgca

SEQ ID NO: 851906 - RNA, 22 nt, Mycobacterium avium subsp. paratuberculosis
ggcgacgaccgcaccgaccagc

SEQ ID NO: 851907 - RNA, 12 nt, Mycobacterium avium subsp. paratuberculosis
ggcgacgacgcc

SEQ ID NO: 851908 - RNA, 13 nt, Mycobacterium avium subsp. paratuberculosis
ggcgacgacgccg

SEQ ID NO: 851909 - RNA, 14 nt, Mycobacterium avium subsp. paratuberculosis
ggcgacgacgccga

SEQ ID NO: 851910 - RNA, 16 nt, Mycobacterium avium subsp. paratuberculosis
ggcgacgacgccgauc

SEQ ID NO: 851911 - RNA, 13 nt, Mycobacterium avium subsp. paratuberculosis
ggcgacgacgcgg

SEQ ID NO: 851912 - RNA, 18 nt, Mycobacterium avium subsp. paratuberculosis
ggcgacgacgcggucguc

SEQ ID NO: 851913 - RNA, 21 nt, Mycobacterium avium subsp. paratuberculosis
ggcgacgacgcggucgucguc

SEQ ID NO: 851914 - RNA, 19 nt, Mycobacterium avium subsp. paratuberculosis
ggcgaccgccuugucggcg

SEQ ID NO: 851915 - RNA, 20 nt, Mycobacterium avium subsp. paratuberculosis
ggcgaccgcgcgcggcgccg

SEQ ID NO: 851916 - RNA, 17 nt, Mycobacterium avium subsp. paratuberculosis
ggcgaccgcggccgcga

SEQ ID NO: 851917 - RNA, 14 nt, Mycobacterium avium subsp. paratuberculosis
ggcgaccggcccca

SEQ ID NO: 851918 - RNA, 13 nt, Mycobacterium avium subsp. paratuberculosis
ggcgaccgcgacg

SEQ ID NO: 851919 - RNA, 14 nt, Mycobacterium avium subsp. paratuberculosis
ggcgaccgcgacgg

SEQ ID NO: 851920 - RNA, 16 nt, Mycobacterium avium subsp. paratuberculosis
ggcgaccgcgacggug

SEQ ID NO: 851921 - RNA, 14 nt, Mycobacterium avium subsp. paratuberculosis
ggcgaccgcgcagg

SEQ ID NO: 851922 - RNA, 15 nt, Mycobacterium avium subsp. paratuberculosis
ggcgaccgcgcaggc

SEQ ID NO: 851923 - RNA, 19 nt, Mycobacterium avium subsp. paratuberculosis
ggcgaccgcgcaggcggcg

SEQ ID NO: 851924 - RNA, 22 nt, Mycobacterium avium subsp. paratuberculosis
ggcgaccgcgcaggcggcgacg

SEQ ID NO: 851925 - RNA, 21 nt, Mycobacterium avium subsp. paratuberculosis
ggcgaccgccgcguacagcca

SEQ ID NO: 851926 - RNA, 19 nt, Mycobacterium avium subsp. paratuberculosis
ggcgaccaucagccugcgg

SEQ ID NO: 851927 - RNA, 21 nt, Mycobacterium avium subsp. paratuberculosis
ggcgaccaucagccugcggug

SEQ ID NO: 851928 - RNA, 19 nt, Mycobacterium avium subsp. paratuberculosis
ggcgaccaugcccagcagu

SEQ ID NO: 851929 - RNA, 10 nt, Mycobacterium avium subsp. paratuberculosis
ggcgaccccg

SEQ ID NO: 851930 - RNA, 12 nt, Mycobacterium avium subsp. paratuberculosis
ggcgaccccggc

SEQ ID NO: 851931 - RNA, 16 nt, Mycobacterium avium subsp. paratuberculosis
ggcgaccccguucgcc

SEQ ID NO: 851932 - RNA, 14 nt, Mycobacterium avium subsp. paratuberculosis
ggcgacccgcacga

SEQ ID NO: 851933 - RNA, 12 nt, Mycobacterium avium subsp. paratuberculosis
ggcgacccgcuu

SEQ ID NO: 851934 - RNA, 20 nt, Mycobacterium avium subsp. paratuberculosis
ggcgacccgcuucgcccggc

SEQ ID NO: 851935 - RNA, 21 nt, Mycobacterium avium subsp. paratuberculosis
ggcgacccgcuucgcccggcu

SEQ ID NO: 851936 - RNA, 16 nt, Mycobacterium avium subsp. paratuberculosis
ggcgacccggaugaug

SEQ ID NO: 851937 - RNA, 18 nt, Mycobacterium avium subsp. paratuberculosis
ggcgaccgccaccucgag

SEQ ID NO: 851938 - RNA, 18 nt, Mycobacterium avium subsp. paratuberculosis
ggcgacgguggcgggccg

SEQ ID NO: 851939 - RNA, 21 nt, Mycobacterium avium subsp. paratuberculosis
ggcgacgguggcgggccgccg

SEQ ID NO: 851940 - RNA, 14 nt, Mycobacterium avium subsp. paratuberculosis
ggcgacgucgucga

SEQ ID NO: 851941 - RNA, 16 nt, Mycobacterium avium subsp. paratuberculosis
ggcgacgucgucgaug

SEQ ID NO: 851942 - RNA, 17 nt, Mycobacterium avium subsp. paratuberculosis
ggcgacgucgucgaugc

SEQ ID NO: 851943 - RNA, 21 nt, Mycobacterium avium subsp. paratuberculosis
ggcgacgucgucgaugccgau

SEQ ID NO: 851944 - RNA, 18 nt, Mycobacterium avium subsp. paratuberculosis
ggcgacgucgucgcccac

SEQ ID NO: 851945 - RNA, 20 nt, Mycobacterium avium subsp. paratuberculosis
ggcgacgucgucgcccaccc

SEQ ID NO: 851946 - RNA, 22 nt, Mycobacterium avium subsp. paratuberculosis
ggcgacgucgucgcccacccgc

SEQ ID NO: 851947 - RNA, 20 nt, Mycobacterium avium subsp. paratuberculosis
ggcgacgucgugcacgccgu

SEQ ID NO: 851948 - RNA, 15 nt, Mycobacterium avium subsp. paratuberculosis
ggcgacgucguggcc

SEQ ID NO: 851949 - RNA, 19 nt, Mycobacterium avium subsp. paratuberculosis
ggcgacgucguggcccgga

SEQ ID NO: 851950 - RNA, 18 nt, Mycobacterium avium subsp. paratuberculosis
ggcgacguacagcgagcc

SEQ ID NO: 851951 - RNA, 15 nt, Mycobacterium avium subsp. paratuberculosis
ggcgacgucgaacgc

SEQ ID NO: 851952 - RNA, 16 nt, Mycobacterium avium subsp. paratuberculosis
ggcgacgucgaacgcg

SEQ ID NO: 851953 - RNA, 14 nt, Mycobacterium avium subsp. paratuberculosis
ggcgacgucgccgg

SEQ ID NO: 851954 - RNA, 17 nt, Mycobacterium avium subsp. paratuberculosis
ggcgacgucgccggccu

SEQ ID NO: 851955 - RNA, 20 nt, Mycobacterium avium subsp. paratuberculosis
ggcgacuccagcagcgccag

SEQ ID NO: 851956 - RNA, 17 nt, Mycobacterium avium subsp. paratuberculosis
ggcgacuccggcgccgg

SEQ ID NO: 851957 - RNA, 23 nt, Mycobacterium avium subsp. paratuberculosis
ggcgacuccggcgccggucagcg

SEQ ID NO: 851958 - RNA, 17 nt, Mycobacterium avium subsp. paratuberculosis
ggcgagaccgucggugc

SEQ ID NO: 851959 - RNA, 19 nt, Mycobacterium avium subsp. paratuberculosis
ggcgacuucguuggugguc

SEQ ID NO: 851960 - RNA, 21 nt, Mycobacterium avium subsp. paratuberculosis
ggcgacuucguugguggucga

SEQ ID NO: 851961 - RNA, 18 nt, Mycobacterium avium subsp. paratuberculosis
ggcgacuucuucgccggc

SEQ ID NO: 851962 - RNA, 19 nt, Mycobacterium avium subsp. paratuberculosis
ggcgacugcgugcugggca

SEQ ID NO: 851963 - RNA, 22 nt, Mycobacterium avium subsp. paratuberculosis
ggcgacugcgugcugggcaccg

SEQ ID NO: 851964 - RNA, 19 nt, Mycobacterium avium subsp. paratuberculosis
ggcgagauuggccucggcg

SEQ ID NO: 851965 - RNA, 21 nt, Mycobacterium avium subsp. paratuberculosis
ggcgagauuggccucggcgcg

SEQ ID NO: 851966 - RNA, 19 nt, Mycobacterium avium subsp. paratuberculosis
ggcgagaucaacaccgcgc

SEQ ID NO: 851967 - RNA, 20 nt, Mycobacterium avium subsp. paratuberculosis
ggcgagaucaacaccgcgca

SEQ ID NO: 851968 - RNA, 18 nt, Mycobacterium avium subsp. paratuberculosis
ggcgagaucccugcgcuc

SEQ ID NO: 851969 - RNA, 17 nt, Mycobacterium avium subsp. paratuberculosis
ggcgagcagcccggcga

SEQ ID NO: 851970 - RNA, 21 nt, Mycobacterium avium subsp. paratuberculosis
ggcgagcagccgcgccgggcg

SEQ ID NO: 851971 - RNA, 23 nt, Mycobacterium avium subsp. paratuberculosis
ggcgagcagccgcgccgggcgga

SEQ ID NO: 851972 - RNA, 12 nt, Mycobacterium avium subsp. paratuberculosis
ggcgagcagcgc

SEQ ID NO: 851973 - RNA, 14 nt, Mycobacterium avium subsp. paratuberculosis
ggcgagcagcgcga

SEQ ID NO: 851974 - RNA, 23 nt, Mycobacterium avium subsp. paratuberculosis
ggcgagcacccggauggucugca

SEQ ID NO: 851975 - RNA, 13 nt, Mycobacterium avium subsp. paratuberculosis
ggcgagcaccgug

SEQ ID NO: 851976 - RNA, 15 nt, Mycobacterium avium subsp. paratuberculosis
ggcgagcacgccgcc

SEQ ID NO: 851977 - RNA, 16 nt, Mycobacterium avium subsp. paratuberculosis
ggcgagcacgccgccg

SEQ ID NO: 851978 - RNA, 19 nt, Mycobacterium avium subsp. paratuberculosis
aaggcguuggagccgacca

SEQ ID NO: 851979 - RNA, 22 nt, Mycobacterium avium subsp. paratuberculosis
aaggcguuggagccgaccagcg

SEQ ID NO: 851980 - RNA, 13 nt, Mycobacterium avium subsp. paratuberculosis
ggcgacggggugg

SEQ ID NO: 851981 - RNA, 20 nt, Mycobacterium avium subsp. paratuberculosis
ggcgacggcgucggcggccu

SEQ ID NO: 851982 - RNA, 14 nt, Mycobacterium avium subsp. paratuberculosis
ggcgacggcguugc

SEQ ID NO: 851983 - RNA, 18 nt, Mycobacterium avium subsp. paratuberculosis
ggcgacggcggcgacgug

SEQ ID NO: 851984 - RNA, 13 nt, Mycobacterium avium subsp. paratuberculosis
ggcgacggcgccu

SEQ ID NO: 851985 - RNA, 13 nt, Mycobacterium avium subsp. paratuberculosis
ggcgacggcggcg

SEQ ID NO: 851986 - RNA, 16 nt, Mycobacterium avium subsp. paratuberculosis
ggcgacggcgcucacc

SEQ ID NO: 851987 - RNA, 19 nt, Mycobacterium avium subsp. paratuberculosis
ggcgacggcgcucaccggc

SEQ ID NO: 851988 - RNA, 23 nt, Mycobacterium avium subsp. paratuberculosis
ggcgacggcgcuguggccguuga

SEQ ID NO: 851989 - RNA, 12 nt, Mycobacterium avium subsp. paratuberculosis
ggcgacggcggg

SEQ ID NO: 851990 - RNA, 16 nt, Mycobacterium avium subsp. paratuberculosis
ggcgacggcggggugc

SEQ ID NO: 851991 - RNA, 15 nt, Mycobacterium avium subsp. paratuberculosis
ggcgacggcgguucg

SEQ ID NO: 851992 - RNA, 11 nt, Mycobacterium avium subsp. paratuberculosis
ggcgacggcgu

SEQ ID NO: 851993 - RNA, 13 nt, Mycobacterium avium subsp. paratuberculosis
ggcgacggcgucc

SEQ ID NO: 851994 - RNA, 22 nt, Mycobacterium avium subsp. paratuberculosis
ggcgacggcguccagcugcgcg

SEQ ID NO: 851995 - RNA, 19 nt, Mycobacterium avium subsp. paratuberculosis
ggcgacggcgaguucgaug

SEQ ID NO: 851996 - RNA, 16 nt, Mycobacterium avium subsp. paratuberculosis
ggcgacggccagcgcg

SEQ ID NO: 851997 - RNA, 20 nt, Mycobacterium avium subsp. paratuberculosis
ggcgacggccguccggucgc

SEQ ID NO: 851998 - RNA, 20 nt, Mycobacterium avium subsp. paratuberculosis
ggcgacgcugaacagcagca

SEQ ID NO: 851999 - RNA, 13 nt, Mycobacterium avium subsp. paratuberculosis
ggcgacggcaccg

SEQ ID NO: 852000 - RNA, 13 nt, Mycobacterium avium subsp. paratuberculosis
ggcgacggccagc

SEQ ID NO: 852001 - RNA, 14 nt, Mycobacterium avium subsp. paratuberculosis
ggcgacggccagcg

SEQ ID NO: 852002 - RNA, 16 nt, Mycobacterium avium subsp. paratuberculosis
ggcgacgccggcgagg

SEQ ID NO: 852003 - RNA, 12 nt, Mycobacterium avium subsp. paratuberculosis
ggcgacgccgcg

SEQ ID NO: 852004 - RNA, 15 nt, Mycobacterium avium subsp. paratuberculosis
ggcgacgccgcgcug

SEQ ID NO: 852005 - RNA, 16 nt, Mycobacterium avium subsp. paratuberculosis
ggcgacgccgcgcugg

SEQ ID NO: 852006 - RNA, 20 nt, Mycobacterium avium subsp. paratuberculosis
ggcgacgccgcggaagcccc

SEQ ID NO: 852007 - RNA, 22 nt, Mycobacterium avium subsp. paratuberculosis
ggcgacgccgcggaagccccag

SEQ ID NO: 852008 - RNA, 14 nt, Mycobacterium avium subsp. paratuberculosis
ggcgacgauggcca

SEQ ID NO: 852009 - RNA, 22 nt, Mycobacterium avium subsp. paratuberculosis
ggcgacgauggccaggcccagc

SEQ ID NO: 852010 - RNA, 15 nt, Mycobacterium avium subsp. paratuberculosis
ggcgacgacggcgga

SEQ ID NO: 852011 - RNA, 16 nt, Mycobacterium avium subsp. paratuberculosis
ggcgacgacggcggag

SEQ ID NO: 852012 - RNA, 17 nt, Mycobacterium avium subsp. paratuberculosis
ggcgacgaugccggccg

SEQ ID NO: 852013 - RNA, 21 nt, Mycobacterium avium subsp. paratuberculosis
ggcgacgaugccggccgggac

SEQ ID NO: 852014 - RNA, 15 nt, Mycobacterium avium subsp. paratuberculosis
ggcgacgaucggcuc

SEQ ID NO: 852015 - RNA, 17 nt, Mycobacterium avium subsp. paratuberculosis
ggcgacgaucggcucga

SEQ ID NO: 852016 - RNA, 18 nt, Mycobacterium avium subsp. paratuberculosis
ggccuuccgcaacaucgu

SEQ ID NO: 852017 - RNA, 12 nt, Mycobacterium avium subsp. paratuberculosis
ggccuucagcgu

SEQ ID NO: 852018 - RNA, 17 nt, Mycobacterium avium subsp. paratuberculosis
ggccuucaucaccgccc

SEQ ID NO: 852019 - RNA, 14 nt, Mycobacterium avium subsp. paratuberculosis
ggccuggucggccg

SEQ ID NO: 852020 - RNA, 16 nt, Mycobacterium avium subsp. paratuberculosis
ggccuggucggccggc

SEQ ID NO: 852021 - RNA, 18 nt, Mycobacterium avium subsp. paratuberculosis
ggccuggucggccggcag

SEQ ID NO: 852022 - RNA, 14 nt, Mycobacterium avium subsp. paratuberculosis
ggccuggucggcga

SEQ ID NO: 852023 - RNA, 15 nt, Mycobacterium avium subsp. paratuberculosis
ggccuggucggcgac

SEQ ID NO: 852024 - RNA, 23 nt, Mycobacterium avium subsp. paratuberculosis
ggccugguacagcaccgccgcgg

SEQ ID NO: 852025 - RNA, 21 nt, Mycobacterium avium subsp. paratuberculosis
ggccugguagcugagcagcag

SEQ ID NO: 852026 - RNA, 17 nt, Mycobacterium avium subsp. paratuberculosis
ggccugguaggccgccu

SEQ ID NO: 852027 - RNA, 23 nt, Mycobacterium avium subsp. paratuberculosis
ggccuucuggaagccuggcacga

SEQ ID NO: 852028 - RNA, 21 nt, Mycobacterium avium subsp. paratuberculosis
ggccuucuuggcggcggccuu

SEQ ID NO: 852029 - RNA, 20 nt, Mycobacterium avium subsp. paratuberculosis
ggccuucuuucguucgaugu

SEQ ID NO: 852030 - RNA, 19 nt, Mycobacterium avium subsp. paratuberculosis
ggccuugaacucggccagg

SEQ ID NO: 852031 - RNA, 12 nt, Mycobacterium avium subsp. paratuberculosis
ggccuucggggu

SEQ ID NO: 852032 - RNA, 17 nt, Mycobacterium avium subsp. paratuberculosis
ggccuucggggugguca

SEQ ID NO: 852033 - RNA, 23 nt, Mycobacterium avium subsp. paratuberculosis
ggccuucgggguggucaccggca

SEQ ID NO: 852034 - RNA, 14 nt, Mycobacterium avium subsp. paratuberculosis
ggccuugaccacgg

SEQ ID NO: 852035 - RNA, 14 nt, Mycobacterium avium subsp. paratuberculosis
ggccuugaccagga

SEQ ID NO: 852036 - RNA, 22 nt, Mycobacterium avium subsp. paratuberculosis
ggccuugacgacggccaccgcg

SEQ ID NO: 852037 - RNA, 16 nt, Mycobacterium avium subsp. paratuberculosis
ggccuugagcaccgcg

SEQ ID NO: 852038 - RNA, 21 nt, Mycobacterium avium subsp. paratuberculosis
ggccuugcgagccggagccuu

SEQ ID NO: 852039 - RNA, 19 nt, Mycobacterium avium subsp. paratuberculosis
ggccuugcugagccggccc

SEQ ID NO: 852040 - RNA, 22 nt, Mycobacterium avium subsp. paratuberculosis
ggccuugcugauccccagcggc

SEQ ID NO: 852041 - RNA, 15 nt, Mycobacterium avium subsp. paratuberculosis
ggccuugcucgccgc

SEQ ID NO: 852042 - RNA, 16 nt, Mycobacterium avium subsp. paratuberculosis
ggccuugcucgccgcg

SEQ ID NO: 852043 - RNA, 15 nt, Mycobacterium avium subsp. paratuberculosis
ggccuugcagcccgc

SEQ ID NO: 852044 - RNA, 19 nt, Mycobacterium avium subsp. paratuberculosis
ggccuugacggccugggcg

SEQ ID NO: 852045 - RNA, 14 nt, Mycobacterium avium subsp. paratuberculosis
ggccucgucgaugu

SEQ ID NO: 852046 - RNA, 23 nt, Mycobacterium avium subsp. paratuberculosis
ggccucucgucgacgauggcccg

SEQ ID NO: 852047 - RNA, 14 nt, Mycobacterium avium subsp. paratuberculosis
ggccucgucgacgu

SEQ ID NO: 852048 - RNA, 16 nt, Mycobacterium avium subsp. paratuberculosis
ggccucgucgacgucg

SEQ ID NO: 852049 - RNA, 20 nt, Mycobacterium avium subsp. paratuberculosis
ggccucgucgacgucgggga

SEQ ID NO: 852050 - RNA, 16 nt, Mycobacterium avium subsp. paratuberculosis
ggccucgucgaugucg

SEQ ID NO: 852051 - RNA, 19 nt, Mycobacterium avium subsp. paratuberculosis
ggccucgucgaugucggcg

SEQ ID NO: 852052 - RNA, 20 nt, Mycobacterium avium subsp. paratuberculosis
ggccucgucgaugucggcgg

SEQ ID NO: 852053 - RNA, 21 nt, Mycobacterium avium subsp. paratuberculosis
ggccucgucgaugucggcggc

SEQ ID NO: 852054 - RNA, 15 nt, Mycobacterium avium subsp. paratuberculosis
ggccucgucgccgcg

SEQ ID NO: 852055 - RNA, 16 nt, Mycobacterium avium subsp. paratuberculosis
ggccucgucgccgcgg

SEQ ID NO: 852056 - RNA, 13 nt, Mycobacterium avium subsp. paratuberculosis
ggccucgucggcg

SEQ ID NO: 852057 - RNA, 16 nt, Mycobacterium avium subsp. paratuberculosis
ggccucgucggcgccg

SEQ ID NO: 852058 - RNA, 19 nt, Mycobacterium avium subsp. paratuberculosis
ggccucgucggcgccgucg

SEQ ID NO: 852059 - RNA, 14 nt, Mycobacterium avium subsp. paratuberculosis
ggccucgucgucgu

SEQ ID NO: 852060 - RNA, 17 nt, Mycobacterium avium subsp. paratuberculosis
ggccucgucgucgucga

SEQ ID NO: 852061 - RNA, 14 nt, Mycobacterium avium subsp. paratuberculosis
ggccucgggcgacg

SEQ ID NO: 852062 - RNA, 17 nt, Mycobacterium avium subsp. paratuberculosis
ggccucgggggugaagg

SEQ ID NO: 852063 - RNA, 19 nt, Mycobacterium avium subsp. paratuberculosis
ggccucggugcucaucagc

SEQ ID NO: 852064 - RNA, 15 nt, Mycobacterium avium subsp. paratuberculosis
ggccucgguggcggu

SEQ ID NO: 852065 - RNA, 16 nt, Mycobacterium avium subsp. paratuberculosis
ggccucgguggcggug

SEQ ID NO: 852066 - RNA, 17 nt, Mycobacterium avium subsp. paratuberculosis
ggccucgguggcggugg

SEQ ID NO: 852067 - RNA, 24 nt, Mycobacterium avium subsp. paratuberculosis
ggccucgguuucgaacugggucug

SEQ ID NO: 852068 - RNA, 13 nt, Mycobacterium avium subsp. paratuberculosis
aaggcggccaccg

SEQ ID NO: 852069 - RNA, 16 nt, Mycobacterium avium subsp. paratuberculosis
aaggcggccaccgcgg

SEQ ID NO: 852070 - RNA, 12 nt, Mycobacterium avium subsp. paratuberculosis
aaggcggcgucg

SEQ ID NO: 852071 - RNA, 15 nt, Mycobacterium avium subsp. paratuberculosis
aaggcggccgcgagc

SEQ ID NO: 852072 - RNA, 17 nt, Mycobacterium avium subsp. paratuberculosis
aaggcgcgggcguccac

SEQ ID NO: 852073 - RNA, 21 nt, Mycobacterium avium subsp. paratuberculosis
aaggcgcagaagcuaacgcca

SEQ ID NO: 852074 - RNA, 14 nt, Mycobacterium avium subsp. paratuberculosis
ggcgaacugcacca

SEQ ID NO: 852075 - RNA, 16 nt, Mycobacterium avium subsp. paratuberculosis
ggcgaacugcaccagc

SEQ ID NO: 852076 - RNA, 17 nt, Mycobacterium avium subsp. paratuberculosis
ggcgaacugcaccagca

SEQ ID NO: 852077 - RNA, 19 nt, Mycobacterium avium subsp. paratuberculosis
ggcgaacugcaccagcacg

SEQ ID NO: 852078 - RNA, 16 nt, Mycobacterium avium subsp. paratuberculosis
ggcgaacuccacccug

SEQ ID NO: 852079 - RNA, 23 nt, Mycobacterium avium subsp. paratuberculosis
ggcgaacuccacccugccgaccu

SEQ ID NO: 852080 - RNA, 20 nt, Mycobacterium avium subsp. paratuberculosis
ggcgaacuccagaucgccgc

SEQ ID NO: 852081 - RNA, 15 nt, Mycobacterium avium subsp. paratuberculosis
ggcgaacucgcggcg

SEQ ID NO: 852082 - RNA, 17 nt, Mycobacterium avium subsp. paratuberculosis
ggcgaacucgcggcggg

SEQ ID NO: 852083 - RNA, 17 nt, Mycobacterium avium subsp. paratuberculosis
ggcgaacuuggccgaca

SEQ ID NO: 852084 - RNA, 18 nt, Mycobacterium avium subsp. paratuberculosis
ggcgaacuuggccgacac

SEQ ID NO: 852085 - RNA, 13 nt, Mycobacterium avium subsp. paratuberculosis
ggcgaacgaccgg

SEQ ID NO: 852086 - RNA, 16 nt, Mycobacterium avium subsp. paratuberculosis
ggcgaaccgcggcggc

SEQ ID NO: 852087 - RNA, 17 nt, Mycobacterium avium subsp. paratuberculosis
ggcgaaccgcggcggca

SEQ ID NO: 852088 - RNA, 20 nt, Mycobacterium avium subsp. paratuberculosis
ggcgaaccgcggcggcagca

SEQ ID NO: 852089 - RNA, 14 nt, Mycobacterium avium subsp. paratuberculosis
ggcgaaccgccgca

SEQ ID NO: 852090 - RNA, 18 nt, Mycobacterium avium subsp. paratuberculosis
ggcgaaccgccgcaccca

SEQ ID NO: 852091 - RNA, 18 nt, Mycobacterium avium subsp. paratuberculosis
ggcgaacgaggccgacgu

SEQ ID NO: 852092 - RNA, 14 nt, Mycobacterium avium subsp. paratuberculosis
ggcgaacgcccggu

SEQ ID NO: 852093 - RNA, 23 nt, Mycobacterium avium subsp. paratuberculosis
ggcgaacgccucgguggucgacg

SEQ ID NO: 852094 - RNA, 23 nt, Mycobacterium avium subsp. paratuberculosis
ggcgaacgccuugagguacaucg

SEQ ID NO: 852095 - RNA, 15 nt, Mycobacterium avium subsp. paratuberculosis
ggcgaacgcgaccug

SEQ ID NO: 852096 - RNA, 20 nt, Mycobacterium avium subsp. paratuberculosis
ggcgaacgcgucccgggccu

SEQ ID NO: 852097 - RNA, 14 nt, Mycobacterium avium subsp. paratuberculosis
ggcgaacggccgcg

SEQ ID NO: 852098 - RNA, 18 nt, Mycobacterium avium subsp. paratuberculosis
ggcgaacggccgcgaugu

SEQ ID NO: 852099 - RNA, 13 nt, Mycobacterium avium subsp. paratuberculosis
ggcgaacggcgga

SEQ ID NO: 852100 - RNA, 15 nt, Mycobacterium avium subsp. paratuberculosis
ggcgaacgucgaugu

SEQ ID NO: 852101 - RNA, 16 nt, Mycobacterium avium subsp. paratuberculosis
ggcgaacgucgauguc

SEQ ID NO: 852102 - RNA, 17 nt, Mycobacterium avium subsp. paratuberculosis
ggcgaacgucgauguca

SEQ ID NO: 852103 - RNA, 14 nt, Mycobacterium avium subsp. paratuberculosis
ggcgaaguugaucg

SEQ ID NO: 852104 - RNA, 21 nt, Mycobacterium avium subsp. paratuberculosis
ggcgaaguucggcaucccgga

SEQ ID NO: 852105 - RNA, 14 nt, Mycobacterium avium subsp. paratuberculosis
ggcgaagucgccgg

SEQ ID NO: 852106 - RNA, 15 nt, Mycobacterium avium subsp. paratuberculosis
ggcgaagucgccggc

SEQ ID NO: 852107 - RNA, 21 nt, Mycobacterium avium subsp. paratuberculosis
ggcgaaggugggcagcgccac

SEQ ID NO: 852108 - RNA, 17 nt, Mycobacterium avium subsp. paratuberculosis
ggcgaagguguccucga

SEQ ID NO: 852109 - RNA, 16 nt, Mycobacterium avium subsp. paratuberculosis
ggcgaaguagccggcg

SEQ ID NO: 852110 - RNA, 17 nt, Mycobacterium avium subsp. paratuberculosis
ggcgaaguagccggcga

SEQ ID NO: 852111 - RNA, 18 nt, Mycobacterium avium subsp. paratuberculosis
ggcgaaguagccggcgau

SEQ ID NO: 852112 - RNA, 20 nt, Mycobacterium avium subsp. paratuberculosis
ggcgaaguagccggcgaucg

SEQ ID NO: 852113 - RNA, 21 nt, Mycobacterium avium subsp. paratuberculosis
ggcgaaguagcgggcguuggc

SEQ ID NO: 852114 - RNA, 17 nt, Mycobacterium avium subsp. paratuberculosis
ggcgaaguagucggcgu

SEQ ID NO: 852115 - RNA, 16 nt, Mycobacterium avium subsp. paratuberculosis
ggcgaagucaucaccg

SEQ ID NO: 852116 - RNA, 13 nt, Mycobacterium avium subsp. paratuberculosis
ggcgaagucaucg

SEQ ID NO: 852117 - RNA, 20 nt, Mycobacterium avium subsp. paratuberculosis
ggcgaagcaggggucguugu

SEQ ID NO: 852118 - RNA, 21 nt, Mycobacterium avium subsp. paratuberculosis
ggcgaaaacgccugcgccgcc

SEQ ID NO: 852119 - RNA, 19 nt, Mycobacterium avium subsp. paratuberculosis
ggcgaaauaacccaccccg

SEQ ID NO: 852120 - RNA, 17 nt, Mycobacterium avium subsp. paratuberculosis
ggcgaaaucgcgggccu

SEQ ID NO: 852121 - RNA, 14 nt, Mycobacterium avium subsp. paratuberculosis
ggcgaaaucucgaa

SEQ ID NO: 852122 - RNA, 17 nt, Mycobacterium avium subsp. paratuberculosis
ggccuuuuccggcgaca

SEQ ID NO: 852123 - RNA, 16 nt, Mycobacterium avium subsp. paratuberculosis
ggccuuuugcaccaag

SEQ ID NO: 852124 - RNA, 23 nt, Mycobacterium avium subsp. paratuberculosis
ggccuuggugaugggcagcgccc

SEQ ID NO: 852125 - RNA, 16 nt, Mycobacterium avium subsp. paratuberculosis
ggccuuggccaacgcg

SEQ ID NO: 852126 - RNA, 14 nt, Mycobacterium avium subsp. paratuberculosis
ggccuuggccacca

SEQ ID NO: 852127 - RNA, 17 nt, Mycobacterium avium subsp. paratuberculosis
ggccuuggccaccgccu

SEQ ID NO: 852128 - RNA, 20 nt, Mycobacterium avium subsp. paratuberculosis
ggcgaacagugcacugccga

SEQ ID NO: 852129 - RNA, 23 nt, Mycobacterium avium subsp. paratuberculosis
ggcgaacagugcacugccgaccc

SEQ ID NO: 852130 - RNA, 22 nt, Mycobacterium avium subsp. paratuberculosis
ggcgaacaucuuggucagccgc

SEQ ID NO: 852131 - RNA, 16 nt, Mycobacterium avium subsp. paratuberculosis
ggcgaacauggcggcc

SEQ ID NO: 852132 - RNA, 17 nt, Mycobacterium avium subsp. paratuberculosis
ggcgaacauggcggcca

SEQ ID NO: 852133 - RNA, 19 nt, Mycobacterium avium subsp. paratuberculosis
ggcgaacauggcggccagc

SEQ ID NO: 852134 - RNA, 21 nt, Mycobacterium avium subsp. paratuberculosis
ggcgaacauggcggccagccg

SEQ ID NO: 852135 - RNA, 18 nt, Mycobacterium avium subsp. paratuberculosis
ggcgaacauggucgccca

SEQ ID NO: 852136 - RNA, 20 nt, Mycobacterium avium subsp. paratuberculosis
ggcgaacauggucgcccaca

SEQ ID NO: 852137 - RNA, 20 nt, Mycobacterium avium subsp. paratuberculosis
ggcgaacaugguggucgaac

SEQ ID NO: 852138 - RNA, 20 nt, Mycobacterium avium subsp. paratuberculosis
ggcgaaccacgggucgcugu

SEQ ID NO: 852139 - RNA, 21 nt, Mycobacterium avium subsp. paratuberculosis
ggcgaaccagcaugcgccaga

SEQ ID NO: 852140 - RNA, 23 nt, Mycobacterium avium subsp. paratuberculosis
ggcgaaccagcaugcgccagagc

SEQ ID NO: 852141 - RNA, 20 nt, Mycobacterium avium subsp. paratuberculosis
ggcgaaccagggcagccagc

SEQ ID NO: 852142 - RNA, 23 nt, Mycobacterium avium subsp. paratuberculosis
ggcgaaccagggcagccagcccg

SEQ ID NO: 852143 - RNA, 13 nt, Mycobacterium avium subsp. paratuberculosis
ggcgaacccggcg

SEQ ID NO: 852144 - RNA, 18 nt, Mycobacterium avium subsp. paratuberculosis
ggcgaacccggcgcccgg

SEQ ID NO: 852145 - RNA, 16 nt, Mycobacterium avium subsp. paratuberculosis
ggcgaacaacgccaca

SEQ ID NO: 852146 - RNA, 12 nt, Mycobacterium avium subsp. paratuberculosis
ggcgaacaccac

SEQ ID NO: 852147 - RNA, 14 nt, Mycobacterium avium subsp. paratuberculosis
ggcgaacaccagcc

SEQ ID NO: 852148 - RNA, 22 nt, Mycobacterium avium subsp. paratuberculosis
ggcgaacacgucggccagcgcg

SEQ ID NO: 852149 - RNA, 18 nt, Mycobacterium avium subsp. paratuberculosis
ggcgaacaccucggcgau

SEQ ID NO: 852150 - RNA, 18 nt, Mycobacterium avium subsp. paratuberculosis
ggcgaacaccucggugau

SEQ ID NO: 852151 - RNA, 14 nt, Mycobacterium avium subsp. paratuberculosis
ggcgaacagcgggu

SEQ ID NO: 852152 - RNA, 24 nt, Mycobacterium avium subsp. paratuberculosis
ggcgaacaggaugcgggugaugcc

SEQ ID NO: 852153 - RNA, 19 nt, Mycobacterium avium subsp. paratuberculosis
ggccuaggaccccggcugc

SEQ ID NO: 852154 - RNA, 17 nt, Mycobacterium avium subsp. paratuberculosis
ggccucgaggaucgcgg

SEQ ID NO: 852155 - RNA, 14 nt, Mycobacterium avium subsp. paratuberculosis
ggccuaugccgcgu

SEQ ID NO: 852156 - RNA, 20 nt, Mycobacterium avium subsp. paratuberculosis
ggccucggcaccgugccgcg

SEQ ID NO: 852157 - RNA, 14 nt, Mycobacterium avium subsp. paratuberculosis
ggccucggcgaccg

SEQ ID NO: 852158 - RNA, 18 nt, Mycobacterium avium subsp. paratuberculosis
ggccucggcgcugcccgc

SEQ ID NO: 852159 - RNA, 16 nt, Mycobacterium avium subsp. paratuberculosis
ggccucggcggccggg

SEQ ID NO: 852160 - RNA, 18 nt, Mycobacterium avium subsp. paratuberculosis
ggccucgccgucgaaggc

SEQ ID NO: 852161 - RNA, 12 nt, Mycobacterium avium subsp. paratuberculosis
ggccucgccguu

SEQ ID NO: 852162 - RNA, 23 nt, Mycobacterium avium subsp. paratuberculosis
ggccucgccguugccggcccgca

SEQ ID NO: 852163 - RNA, 17 nt, Mycobacterium avium subsp. paratuberculosis
ggccucgaucaucacca

SEQ ID NO: 852164 - RNA, 22 nt, Mycobacterium avium subsp. paratuberculosis
ggccucgaugcggccgucggga

SEQ ID NO: 852165 - RNA, 16 nt, Mycobacterium avium subsp. paratuberculosis
ggccucgaugucgucg

SEQ ID NO: 852166 - RNA, 20 nt, Mycobacterium avium subsp. paratuberculosis
ggccucgaugucgucgauga

SEQ ID NO: 852167 - RNA, 17 nt, Mycobacterium avium subsp. paratuberculosis
ggccucgcccagcgccg

SEQ ID NO: 852168 - RNA, 15 nt, Mycobacterium avium subsp. paratuberculosis
ggccucgccggcgcc

SEQ ID NO: 852169 - RNA, 16 nt, Mycobacterium avium subsp. paratuberculosis
ggccucgccggcgccg

SEQ ID NO: 852170 - RNA, 17 nt, Mycobacterium avium subsp. paratuberculosis
ggccgugaucggccagc

SEQ ID NO: 852171 - RNA, 18 nt, Mycobacterium avium subsp. paratuberculosis
ggccgugaucucgugccg

SEQ ID NO: 852172 - RNA, 20 nt, Mycobacterium avium subsp. paratuberculosis
ggccgugaucucgugccgca

SEQ ID NO: 852173 - RNA, 23 nt, Mycobacterium avium subsp. paratuberculosis
ggccgugaucucgugccgcaccc

SEQ ID NO: 852174 - RNA, 18 nt, Mycobacterium avium subsp. paratuberculosis
ggccgugaugcgccggcg

SEQ ID NO: 852175 - RNA, 20 nt, Mycobacterium avium subsp. paratuberculosis
ggccgugaugcgccggcggu

SEQ ID NO: 852176 - RNA, 17 nt, Mycobacterium avium subsp. paratuberculosis
ggccgucuugcccggcg

SEQ ID NO: 852177 - RNA, 18 nt, Mycobacterium avium subsp. paratuberculosis
ggccgucuugcccggcga

SEQ ID NO: 852178 - RNA, 19 nt, Mycobacterium avium subsp. paratuberculosis
ggccgucuugcccggcgag

SEQ ID NO: 852179 - RNA, 20 nt, Mycobacterium avium subsp. paratuberculosis
ggccgucuugcccggcgagc

SEQ ID NO: 852180 - RNA, 19 nt, Mycobacterium avium subsp. paratuberculosis
ggccgugaaauaucccgau

SEQ ID NO: 852181 - RNA, 18 nt, Mycobacterium avium subsp. paratuberculosis
ggccgugaaccggcguug

SEQ ID NO: 852182 - RNA, 17 nt, Mycobacterium avium subsp. paratuberculosis
ggccgugaagggguccg

SEQ ID NO: 852183 - RNA, 17 nt, Mycobacterium avium subsp. paratuberculosis
ggccgucucgucggccg

SEQ ID NO: 852184 - RNA, 14 nt, Mycobacterium avium subsp. paratuberculosis
ggccgucucgagcc

SEQ ID NO: 852185 - RNA, 18 nt, Mycobacterium avium subsp. paratuberculosis
ggccgucucgagccggcg

SEQ ID NO: 852186 - RNA, 20 nt, Mycobacterium avium subsp. paratuberculosis
ggccgucucgagccggcgca

SEQ ID NO: 852187 - RNA, 15 nt, Mycobacterium avium subsp. paratuberculosis
ggccgucaucgccga

SEQ ID NO: 852188 - RNA, 16 nt, Mycobacterium avium subsp. paratuberculosis
ggccgucaucgccgac

SEQ ID NO: 852189 - RNA, 19 nt, Mycobacterium avium subsp. paratuberculosis
ggccgucacgcuggcguga

SEQ ID NO: 852190 - RNA, 19 nt, Mycobacterium avium subsp. paratuberculosis
ggccgucaggagugcucgg

SEQ ID NO: 852191 - RNA, 21 nt, Mycobacterium avium subsp. paratuberculosis
ggccgucaggagugcucggcg

SEQ ID NO: 852192 - RNA, 22 nt, Mycobacterium avium subsp. paratuberculosis
ggccgucaggagugcucggcgu

SEQ ID NO: 852193 - RNA, 15 nt, Mycobacterium avium subsp. paratuberculosis
ggccguaucggcccc

SEQ ID NO: 852194 - RNA, 20 nt, Mycobacterium avium subsp. paratuberculosis
ggccguaucggccccggccg

SEQ ID NO: 852195 - RNA, 22 nt, Mycobacterium avium subsp. paratuberculosis
ggccguaucggccccggccgag

SEQ ID NO: 852196 - RNA, 12 nt, Mycobacterium avium subsp. paratuberculosis
ggccguauacgc

SEQ ID NO: 852197 - RNA, 17 nt, Mycobacterium avium subsp. paratuberculosis
ggccguauacgccagau

SEQ ID NO: 852198 - RNA, 20 nt, Mycobacterium avium subsp. paratuberculosis
ggccguauacgccagaugcg

SEQ ID NO: 852199 - RNA, 17 nt, Mycobacterium avium subsp. paratuberculosis
ggccguaggucgggucg

SEQ ID NO: 852200 - RNA, 18 nt, Mycobacterium avium subsp. paratuberculosis
ggccguaggucgggucga

SEQ ID NO: 852201 - RNA, 14 nt, Mycobacterium avium subsp. paratuberculosis
ggccggugcguccg

SEQ ID NO: 852202 - RNA, 21 nt, Mycobacterium avium subsp. paratuberculosis
ggccguagcgagcgcuggccu

SEQ ID NO: 852203 - RNA, 15 nt, Mycobacterium avium subsp. paratuberculosis
ggccguagcggcucg

SEQ ID NO: 852204 - RNA, 19 nt, Mycobacterium avium subsp. paratuberculosis
ggccguagcggcucgccac

SEQ ID NO: 852205 - RNA, 19 nt, Mycobacterium avium subsp. paratuberculosis
ggccguagcguugccggcc

SEQ ID NO: 852206 - RNA, 17 nt, Mycobacterium avium subsp. paratuberculosis
ggccggugccacgguca

SEQ ID NO: 852207 - RNA, 16 nt, Mycobacterium avium subsp. paratuberculosis
ggccggugcgccgacc

SEQ ID NO: 852208 - RNA, 17 nt, Mycobacterium avium subsp. paratuberculosis
ggccggugcgccgaccg

SEQ ID NO: 852209 - RNA, 19 nt, Mycobacterium avium subsp. paratuberculosis
ggccggugcgccgaccgcg

SEQ ID NO: 852210 - RNA, 12 nt, Mycobacterium avium subsp. paratuberculosis
ggccggugcgga

SEQ ID NO: 852211 - RNA, 17 nt, Mycobacterium avium subsp. paratuberculosis
ggccgguaucgggucac

SEQ ID NO: 852212 - RNA, 19 nt, Mycobacterium avium subsp. paratuberculosis
ggccgguaucgggucaccg

SEQ ID NO: 852213 - RNA, 22 nt, Mycobacterium avium subsp. paratuberculosis
ggccgguaucgggucaccgugc

SEQ ID NO: 852214 - RNA, 22 nt, Mycobacterium avium subsp. paratuberculosis
ggccggucaccggucgcguuga

SEQ ID NO: 852215 - RNA, 11 nt, Mycobacterium avium subsp. paratuberculosis
ggccggucagc

SEQ ID NO: 852216 - RNA, 14 nt, Mycobacterium avium subsp. paratuberculosis
ggccggucagcgcg

SEQ ID NO: 852217 - RNA, 16 nt, Mycobacterium avium subsp. paratuberculosis
ggccggucagcgcgac

SEQ ID NO: 852218 - RNA, 17 nt, Mycobacterium avium subsp. paratuberculosis
ggccggucagcgcgaca

SEQ ID NO: 852219 - RNA, 13 nt, Mycobacterium avium subsp. paratuberculosis
ggccgguccccgg

SEQ ID NO: 852220 - RNA, 16 nt, Mycobacterium avium subsp. paratuberculosis
ggccgguccccggcga

SEQ ID NO: 852221 - RNA, 13 nt, Mycobacterium avium subsp. paratuberculosis
ggccgguccgccc

SEQ ID NO: 852222 - RNA, 20 nt, Mycobacterium avium subsp. paratuberculosis
ggccgguccgugcacggcca

SEQ ID NO: 852223 - RNA, 13 nt, Mycobacterium avium subsp. paratuberculosis
ggccggucgccga

SEQ ID NO: 852224 - RNA, 16 nt, Mycobacterium avium subsp. paratuberculosis
ggccggucgccgaugg

SEQ ID NO: 852225 - RNA, 14 nt, Mycobacterium avium subsp. paratuberculosis
ggccggucgccugc

SEQ ID NO: 852226 - RNA, 22 nt, Mycobacterium avium subsp. paratuberculosis
ggccggguuuucgggccgguca

SEQ ID NO: 852227 - RNA, 14 nt, Mycobacterium avium subsp. paratuberculosis
ggccgggcgguuuc

SEQ ID NO: 852228 - RNA, 12 nt, Mycobacterium avium subsp. paratuberculosis
ggccgggcgugc

SEQ ID NO: 852229 - RNA, 19 nt, Mycobacterium avium subsp. paratuberculosis
ggccgggcgugcccggcgc

SEQ ID NO: 852230 - RNA, 14 nt, Mycobacterium avium subsp. paratuberculosis
ggccgggcucccgc

SEQ ID NO: 852231 - RNA, 20 nt, Mycobacterium avium subsp. paratuberculosis
ggccgggcugcccaccacca

SEQ ID NO: 852232 - RNA, 15 nt, Mycobacterium avium subsp. paratuberculosis
ggccgggcugguccg

SEQ ID NO: 852233 - RNA, 23 nt, Mycobacterium avium subsp. paratuberculosis
ggccgggcugguccggaaccgcg

SEQ ID NO: 852234 - RNA, 18 nt, Mycobacterium avium subsp. paratuberculosis
ggccggggaguucgcggu

SEQ ID NO: 852235 - RNA, 21 nt, Mycobacterium avium subsp. paratuberculosis
ggccggggaguucgcgguuga

SEQ ID NO: 852236 - RNA, 22 nt, Mycobacterium avium subsp. paratuberculosis
ggccggggcagacccgcgucga

SEQ ID NO: 852237 - RNA, 20 nt, Mycobacterium avium subsp. paratuberculosis
ggccgggcggaagucggugc

SEQ ID NO: 852238 - RNA, 13 nt, Mycobacterium avium subsp. paratuberculosis
ggccgggcggacg

SEQ ID NO: 852239 - RNA, 16 nt, Mycobacterium avium subsp. paratuberculosis
ggccgggcggacggca

SEQ ID NO: 852240 - RNA, 12 nt, Mycobacterium avium subsp. paratuberculosis
ggccgggcgggc

SEQ ID NO: 852241 - RNA, 15 nt, Mycobacterium avium subsp. paratuberculosis
ggccgggcgggcacc

SEQ ID NO: 852242 - RNA, 17 nt, Mycobacterium avium subsp. paratuberculosis
ggccgggcgccccgaca

SEQ ID NO: 852243 - RNA, 11 nt, Mycobacterium avium subsp. paratuberculosis
ggccgggccgg

SEQ ID NO: 852244 - RNA, 15 nt, Mycobacterium avium subsp. paratuberculosis
ggccgggcgacugcg

SEQ ID NO: 852245 - RNA, 17 nt, Mycobacterium avium subsp. paratuberculosis
ggccgggcccucggacg

SEQ ID NO: 852246 - RNA, 13 nt, Mycobacterium avium subsp. paratuberculosis
ggccgggcagugc

SEQ ID NO: 852247 - RNA, 20 nt, Mycobacterium avium subsp. paratuberculosis
ggccgggcagugcgcggcgu

SEQ ID NO: 852248 - RNA, 14 nt, Mycobacterium avium subsp. paratuberculosis
ggccgggcaccgcg

SEQ ID NO: 852249 - RNA, 15 nt, Mycobacterium avium subsp. paratuberculosis
ggccgggcaccgcgc

SEQ ID NO: 852250 - RNA, 14 nt, Mycobacterium avium subsp. paratuberculosis
ggccgggcacgucg

SEQ ID NO: 852251 - RNA, 16 nt, Mycobacterium avium subsp. paratuberculosis
ggccgggcacgucgac

SEQ ID NO: 852252 - RNA, 13 nt, Mycobacterium avium subsp. paratuberculosis
ggccgggacgcgg

SEQ ID NO: 852253 - RNA, 16 nt, Mycobacterium avium subsp. paratuberculosis
ggccgggaucuggccg

SEQ ID NO: 852254 - RNA, 16 nt, Mycobacterium avium subsp. paratuberculosis
ggccgggaugccaguc

SEQ ID NO: 852255 - RNA, 20 nt, Mycobacterium avium subsp. paratuberculosis
ggccgggaugccgccgguca

SEQ ID NO: 852256 - RNA, 22 nt, Mycobacterium avium subsp. paratuberculosis
ggccgggauagagcaccgcgcu

SEQ ID NO: 852257 - RNA, 20 nt, Mycobacterium avium subsp. paratuberculosis
ggccgggagauacggucgca

SEQ ID NO: 852258 - RNA, 18 nt, Mycobacterium avium subsp. paratuberculosis
ggccgggauuucccgggc

SEQ ID NO: 852259 - RNA, 17 nt, Mycobacterium avium subsp. paratuberculosis
ggccgggaaugucgcgc

SEQ ID NO: 852260 - RNA, 20 nt, Mycobacterium avium subsp. paratuberculosis
ggccgggaaacccucgacgc

SEQ ID NO: 852261 - RNA, 16 nt, Mycobacterium avium subsp. paratuberculosis
ggccggcuucucggcg

SEQ ID NO: 852262 - RNA, 18 nt, Mycobacterium avium subsp. paratuberculosis
ggccggcuucucggcgug

SEQ ID NO: 852263 - RNA, 19 nt, Mycobacterium avium subsp. paratuberculosis
ggccggcuucucggcgugc

SEQ ID NO: 852264 - RNA, 19 nt, Mycobacterium avium subsp. paratuberculosis
ggccggcugcagccgggcg

SEQ ID NO: 852265 - RNA, 21 nt, Mycobacterium avium subsp. paratuberculosis
ggccggcugcagccgggcggc

SEQ ID NO: 852266 - RNA, 18 nt, Mycobacterium avium subsp. paratuberculosis
ggccggcgugcugggcca

SEQ ID NO: 852267 - RNA, 15 nt, Mycobacterium avium subsp. paratuberculosis
ggccggcuaccgcgc

SEQ ID NO: 852268 - RNA, 17 nt, Mycobacterium avium subsp. paratuberculosis
ggccggcgucgucgagc

SEQ ID NO: 852269 - RNA, 19 nt, Mycobacterium avium subsp. paratuberculosis
ggccggcgucgucgagcac

SEQ ID NO: 852270 - RNA, 14 nt, Mycobacterium avium subsp. paratuberculosis
ggccggcgucgcgg

SEQ ID NO: 852271 - RNA, 17 nt, Mycobacterium avium subsp. paratuberculosis
ggccggcggugauccgc

SEQ ID NO: 852272 - RNA, 18 nt, Mycobacterium avium subsp. paratuberculosis
ggccggcggugauccgcc

SEQ ID NO: 852273 - RNA, 12 nt, Mycobacterium avium subsp. paratuberculosis
ggccggcggggc

SEQ ID NO: 852274 - RNA, 22 nt, Mycobacterium avium subsp. paratuberculosis
ggccggcgggggcgcguccgcg

SEQ ID NO: 852275 - RNA, 14 nt, Mycobacterium avium subsp. paratuberculosis
ggccggcggucagg

SEQ ID NO: 852276 - RNA, 18 nt, Mycobacterium avium subsp. paratuberculosis
ggccggcggucaggccgu

SEQ ID NO: 852277 - RNA, 18 nt, Mycobacterium avium subsp. paratuberculosis
ggccggcgggcagcacgg

SEQ ID NO: 852278 - RNA, 15 nt, Mycobacterium avium subsp. paratuberculosis
ggccggcggacgcgg

SEQ ID NO: 852279 - RNA, 22 nt, Mycobacterium avium subsp. paratuberculosis
ggccggcgccgcgggugcggca

SEQ ID NO: 852280 - RNA, 22 nt, Mycobacterium avium subsp. paratuberculosis
ggccggcgcggugcucggcgcg

SEQ ID NO: 852281 - RNA, 21 nt, Mycobacterium avium subsp. paratuberculosis
ggccggcgcuggcgugcuuga

SEQ ID NO: 852282 - RNA, 17 nt, Mycobacterium avium subsp. paratuberculosis
ggccggcgcgaccagcg

SEQ ID NO: 852283 - RNA, 14 nt, Mycobacterium avium subsp. paratuberculosis
ggccggcgcggcgg

SEQ ID NO: 852284 - RNA, 15 nt, Mycobacterium avium subsp. paratuberculosis
ggccggcgcggcggc

SEQ ID NO: 852285 - RNA, 16 nt, Mycobacterium avium subsp. paratuberculosis
ggccggcgcggcggcg

SEQ ID NO: 852286 - RNA, 16 nt, Mycobacterium avium subsp. paratuberculosis
ggccggcgccggcggu

SEQ ID NO: 852287 - RNA, 17 nt, Mycobacterium avium subsp. paratuberculosis
ggccggcgccggcgguc

SEQ ID NO: 852288 - RNA, 18 nt, Mycobacterium avium subsp. paratuberculosis
ggccggcgccggcgguca

SEQ ID NO: 852289 - RNA, 21 nt, Mycobacterium avium subsp. paratuberculosis
ggccggcgccggcggucagcu

SEQ ID NO: 852290 - RNA, 17 nt, Mycobacterium avium subsp. paratuberculosis
ggccggcgccgccgggg

SEQ ID NO: 852291 - RNA, 13 nt, Mycobacterium avium subsp. paratuberculosis
ggccggcgccgcg

SEQ ID NO: 852292 - RNA, 14 nt, Mycobacterium avium subsp. paratuberculosis
ggccggcgccgcgg

SEQ ID NO: 852293 - RNA, 15 nt, Mycobacterium avium subsp. paratuberculosis
ggccggcgccgaccg

SEQ ID NO: 852294 - RNA, 20 nt, Mycobacterium avium subsp. paratuberculosis
ggccggcgccgaccgagggc

SEQ ID NO: 852295 - RNA, 16 nt, Mycobacterium avium subsp. paratuberculosis
ggccggcgccgacgac

SEQ ID NO: 852296 - RNA, 14 nt, Mycobacterium avium subsp. paratuberculosis
ggccggccgccggc

SEQ ID NO: 852297 - RNA, 21 nt, Mycobacterium avium subsp. paratuberculosis
ggccggcgcccgucacgcugg

SEQ ID NO: 852298 - RNA, 13 nt, Mycobacterium avium subsp. paratuberculosis
ggccggccgccug

SEQ ID NO: 852299 - RNA, 14 nt, Mycobacterium avium subsp. paratuberculosis
ggccggccgaacac

SEQ ID NO: 852300 - RNA, 23 nt, Mycobacterium avium subsp. paratuberculosis
ggccggccgcagcugcugcggcc

SEQ ID NO: 852301 - RNA, 15 nt, Mycobacterium avium subsp. paratuberculosis
ggccggccgcccgca

SEQ ID NO: 852302 - RNA, 19 nt, Mycobacterium avium subsp. paratuberculosis
ggccggccccgcccggcgc

SEQ ID NO: 852303 - RNA, 21 nt, Mycobacterium avium subsp. paratuberculosis
ggccggccccgcccggcgcgc

SEQ ID NO: 852304 - RNA, 22 nt, Mycobacterium avium subsp. paratuberculosis
ggccggccccgcccggcgcgca

SEQ ID NO: 852305 - RNA, 19 nt, Mycobacterium avium subsp. paratuberculosis
ggccggccccggccgggcg

SEQ ID NO: 852306 - RNA, 20 nt, Mycobacterium avium subsp. paratuberculosis
ggccggcccgcccggcggcg

SEQ ID NO: 852307 - RNA, 15 nt, Mycobacterium avium subsp. paratuberculosis
ggccggcccgcccgu

SEQ ID NO: 852308 - RNA, 15 nt, Mycobacterium avium subsp. paratuberculosis
ggccggccaguccug

SEQ ID NO: 852309 - RNA, 17 nt, Mycobacterium avium subsp. paratuberculosis
ggccggccaugaugaug

SEQ ID NO: 852310 - RNA, 10 nt, Mycobacterium avium subsp. paratuberculosis
ggccggccca

SEQ ID NO: 852311 - RNA, 15 nt, Mycobacterium avium subsp. paratuberculosis
ggccggcccagccuu

SEQ ID NO: 852312 - RNA, 22 nt, Mycobacterium avium subsp. paratuberculosis
ggccggcccagccuucgccgca

SEQ ID NO: 852313 - RNA, 20 nt, Mycobacterium avium subsp. paratuberculosis
ggccggcccagcgcgcggcg

SEQ ID NO: 852314 - RNA, 19 nt, Mycobacterium avium subsp. paratuberculosis
ggccggccagcgcgcggcc

SEQ ID NO: 852315 - RNA, 13 nt, Mycobacterium avium subsp. paratuberculosis
ggccggccagcgg

SEQ ID NO: 852316 - RNA, 15 nt, Mycobacterium avium subsp. paratuberculosis
ggccggccagcgggu

SEQ ID NO: 852317 - RNA, 17 nt, Mycobacterium avium subsp. paratuberculosis
ggccggccagcagccgg

SEQ ID NO: 852318 - RNA, 12 nt, Mycobacterium avium subsp. paratuberculosis
ggccggccacca

SEQ ID NO: 852319 - RNA, 21 nt, Mycobacterium avium subsp. paratuberculosis
ggccggccaccagcggccgga

SEQ ID NO: 852320 - RNA, 20 nt, Mycobacterium avium subsp. paratuberculosis
ggccgcugaggaugguggug

SEQ ID NO: 852321 - RNA, 13 nt, Mycobacterium avium subsp. paratuberculosis
ggccgcuggccgc

SEQ ID NO: 852322 - RNA, 14 nt, Mycobacterium avium subsp. paratuberculosis
ggccgcuggccgcc

SEQ ID NO: 852323 - RNA, 16 nt, Mycobacterium avium subsp. paratuberculosis
ggccgcugcgcccagc

SEQ ID NO: 852324 - RNA, 19 nt, Mycobacterium avium subsp. paratuberculosis
ggccgcugcgggcgggccg

SEQ ID NO: 852325 - RNA, 20 nt, Mycobacterium avium subsp. paratuberculosis
ggccgcugcgggcgggccgc

SEQ ID NO: 852326 - RNA, 15 nt, Mycobacterium avium subsp. paratuberculosis
ggccgcuggcguuga

SEQ ID NO: 852327 - RNA, 12 nt, Mycobacterium avium subsp. paratuberculosis
ggccgcgcagcg

SEQ ID NO: 852328 - RNA, 15 nt, Mycobacterium avium subsp. paratuberculosis
ggccgcgcagcgugu

SEQ ID NO: 852329 - RNA, 17 nt, Mycobacterium avium subsp. paratuberculosis
ggccgcgcagcucgggg

SEQ ID NO: 852330 - RNA, 15 nt, Mycobacterium avium subsp. paratuberculosis
ggccgcgcaccgccc

SEQ ID NO: 852331 - RNA, 16 nt, Mycobacterium avium subsp. paratuberculosis
ggccgcgcagaucgag

SEQ ID NO: 852332 - RNA, 19 nt, Mycobacterium avium subsp. paratuberculosis
ggccgcgcagaucgccagc

SEQ ID NO: 852333 - RNA, 13 nt, Mycobacterium avium subsp. paratuberculosis
ggccgcgaucgcc

SEQ ID NO: 852334 - RNA, 22 nt, Mycobacterium avium subsp. paratuberculosis
ggccgcgaucgccaacgcgcuc

SEQ ID NO: 852335 - RNA, 23 nt, Mycobacterium avium subsp. paratuberculosis
ggccgcgaugaggcucaggccgg

SEQ ID NO: 852336 - RNA, 16 nt, Mycobacterium avium subsp. paratuberculosis
ggccgcgauccagcgc

SEQ ID NO: 852337 - RNA, 18 nt, Mycobacterium avium subsp. paratuberculosis
ggccgcgauccagcgcug

SEQ ID NO: 852338 - RNA, 22 nt, Mycobacterium avium subsp. paratuberculosis
ggccgcgauccagcgcuggccg

SEQ ID NO: 852339 - RNA, 19 nt, Mycobacterium avium subsp. paratuberculosis
ggccgcgcgggcggcgucg

SEQ ID NO: 852340 - RNA, 13 nt, Mycobacterium avium subsp. paratuberculosis
ggccgcgcggugc

SEQ ID NO: 852341 - RNA, 19 nt, Mycobacterium avium subsp. paratuberculosis
ggccgcgcguagaucaucu

SEQ ID NO: 852342 - RNA, 17 nt, Mycobacterium avium subsp. paratuberculosis
ggccgcgcgugcccgcg

SEQ ID NO: 852343 - RNA, 19 nt, Mycobacterium avium subsp. paratuberculosis
ggccgcgcgggcgaccugc

SEQ ID NO: 852344 - RNA, 20 nt, Mycobacterium avium subsp. paratuberculosis
ggccgcgcgggcgaccugcg

SEQ ID NO: 852345 - RNA, 12 nt, Mycobacterium avium subsp. paratuberculosis
ggccgcgcgcgg

SEQ ID NO: 852346 - RNA, 13 nt, Mycobacterium avium subsp. paratuberculosis
ggccgcgcgcggc

SEQ ID NO: 852347 - RNA, 16 nt, Mycobacterium avium subsp. paratuberculosis
ggccgcgcgcggcgcg

SEQ ID NO: 852348 - RNA, 18 nt, Mycobacterium avium subsp. paratuberculosis
ggccgcgcgcaggcgcug

SEQ ID NO: 852349 - RNA, 21 nt, Mycobacterium avium subsp. paratuberculosis
ggccgcgcgcaggcgcugagc

SEQ ID NO: 852350 - RNA, 13 nt, Mycobacterium avium subsp. paratuberculosis
ggccgcgcgcauc

SEQ ID NO: 852351 - RNA, 17 nt, Mycobacterium avium subsp. paratuberculosis
ggccgcgcgcaucucga

SEQ ID NO: 852352 - RNA, 21 nt, Mycobacterium avium subsp. paratuberculosis
ggccgcgcgcccgucgucggu

SEQ ID NO: 852353 - RNA, 15 nt, Mycobacterium avium subsp. paratuberculosis
ggccgccggcggcca

SEQ ID NO: 852354 - RNA, 17 nt, Mycobacterium avium subsp. paratuberculosis
ggccgccggcggccaau

SEQ ID NO: 852355 - RNA, 22 nt, Mycobacterium avium subsp. paratuberculosis
ggccgcgagcgcuaccgcgcuc

SEQ ID NO: 852356 - RNA, 23 nt, Mycobacterium avium subsp. paratuberculosis
ggccgcgaggauuucgcucagcc

SEQ ID NO: 852357 - RNA, 19 nt, Mycobacterium avium subsp. paratuberculosis
ggccgcgagcacgacgucg

SEQ ID NO: 852358 - RNA, 20 nt, Mycobacterium avium subsp. paratuberculosis
ggccgcgagcacgacgucga

SEQ ID NO: 852359 - RNA, 23 nt, Mycobacterium avium subsp. paratuberculosis
ggccgcgagcacgacgucgacgu

SEQ ID NO: 852360 - RNA, 16 nt, Mycobacterium avium subsp. paratuberculosis
ggccgcgagcccggcg

SEQ ID NO: 852361 - RNA, 22 nt, Mycobacterium avium subsp. paratuberculosis
ggccgcgagcccggcgacgucg

SEQ ID NO: 852362 - RNA, 12 nt, Mycobacterium avium subsp. paratuberculosis
ggccgccggcgg

SEQ ID NO: 852363 - RNA, 12 nt, Mycobacterium avium subsp. paratuberculosis
ggccgccggccg

SEQ ID NO: 852364 - RNA, 13 nt, Mycobacterium avium subsp. paratuberculosis
ggccgccggccgc

SEQ ID NO: 852365 - RNA, 14 nt, Mycobacterium avium subsp. paratuberculosis
ggccgccggccgcg

SEQ ID NO: 852366 - RNA, 16 nt, Mycobacterium avium subsp. paratuberculosis
ggccgccggccgcgca

SEQ ID NO: 852367 - RNA, 15 nt, Mycobacterium avium subsp. paratuberculosis
ggccgccggccgcgg

SEQ ID NO: 852368 - RNA, 16 nt, Mycobacterium avium subsp. paratuberculosis
ggccgccggccgcggc

SEQ ID NO: 852369 - RNA, 23 nt, Mycobacterium avium subsp. paratuberculosis
ggccgccggccgcucgcgggcca

SEQ ID NO: 852370 - RNA, 14 nt, Mycobacterium avium subsp. paratuberculosis
ggccgccggccagc

SEQ ID NO: 852371 - RNA, 13 nt, Mycobacterium avium subsp. paratuberculosis
ggccgccggaucg

SEQ ID NO: 852372 - RNA, 15 nt, Mycobacterium avium subsp. paratuberculosis
ggccgccggaucgug

SEQ ID NO: 852373 - RNA, 22 nt, Mycobacterium avium subsp. paratuberculosis
ggccgccggauuacucgccggc

SEQ ID NO: 852374 - RNA, 13 nt, Mycobacterium avium subsp. paratuberculosis
ggccgccgcgcgg

SEQ ID NO: 852375 - RNA, 15 nt, Mycobacterium avium subsp. paratuberculosis
ggccgccgcgcgggu

SEQ ID NO: 852376 - RNA, 14 nt, Mycobacterium avium subsp. paratuberculosis
ggccgccgcggcca

SEQ ID NO: 852377 - RNA, 15 nt, Mycobacterium avium subsp. paratuberculosis
ggccgccgcggccac

SEQ ID NO: 852378 - RNA, 12 nt, Mycobacterium avium subsp. paratuberculosis
ggccgccgaagc

SEQ ID NO: 852379 - RNA, 19 nt, Mycobacterium avium subsp. paratuberculosis
ggccgccgaagccggcucg

SEQ ID NO: 852380 - RNA, 21 nt, Mycobacterium avium subsp. paratuberculosis
ggccgccgacgacggcgaacg

SEQ ID NO: 852381 - RNA, 17 nt, Mycobacterium avium subsp. paratuberculosis
ggccgccgacgucgugg

SEQ ID NO: 852382 - RNA, 18 nt, Mycobacterium avium subsp. paratuberculosis
ggccgcucagcgggcggc

SEQ ID NO: 852383 - RNA, 22 nt, Mycobacterium avium subsp. paratuberculosis
ggccgcucagcgggcggccagc

SEQ ID NO: 852384 - RNA, 23 nt, Mycobacterium avium subsp. paratuberculosis
ggccgcucagcgggcggccagcc

SEQ ID NO: 852385 - RNA, 12 nt, Mycobacterium avium subsp. paratuberculosis
ggccgcucgcgg

SEQ ID NO: 852386 - RNA, 13 nt, Mycobacterium avium subsp. paratuberculosis
ggccgcucgcggg

SEQ ID NO: 852387 - RNA, 18 nt, Mycobacterium avium subsp. paratuberculosis
ggccgcucgggugucgcc

SEQ ID NO: 852388 - RNA, 22 nt, Mycobacterium avium subsp. paratuberculosis
ggccgcucgggugucgccgagc

SEQ ID NO: 852389 - RNA, 15 nt, Mycobacterium avium subsp. paratuberculosis
ggccgcugcccggcg

SEQ ID NO: 852390 - RNA, 16 nt, Mycobacterium avium subsp. paratuberculosis
ggccgcugcccggcgc

SEQ ID NO: 852391 - RNA, 18 nt, Mycobacterium avium subsp. paratuberculosis
ggccgcugcccggcgcua

SEQ ID NO: 852392 - RNA, 14 nt, Mycobacterium avium subsp. paratuberculosis
ggccgcugcccggg

SEQ ID NO: 852393 - RNA, 15 nt, Mycobacterium avium subsp. paratuberculosis
ggccgcugcccgggc

SEQ ID NO: 852394 - RNA, 22 nt, Mycobacterium avium subsp. paratuberculosis
ggccgcuaguuggugcugggca

SEQ ID NO: 852395 - RNA, 14 nt, Mycobacterium avium subsp. paratuberculosis
ggccgcuacccggc

SEQ ID NO: 852396 - RNA, 15 nt, Mycobacterium avium subsp. paratuberculosis
ggccgcuacccggcg

SEQ ID NO: 852397 - RNA, 17 nt, Mycobacterium avium subsp. paratuberculosis
ggccgcuacgccgaggc

SEQ ID NO: 852398 - RNA, 19 nt, Mycobacterium avium subsp. paratuberculosis
ggccgcgugcaacacaugg

SEQ ID NO: 852399 - RNA, 21 nt, Mycobacterium avium subsp. paratuberculosis
ggccgcgugcaacacaugguc

SEQ ID NO: 852400 - RNA, 18 nt, Mycobacterium avium subsp. paratuberculosis
ggccgcgggugcggccca

SEQ ID NO: 852401 - RNA, 23 nt, Mycobacterium avium subsp. paratuberculosis
ggccgcguccucgccguacgcgc

SEQ ID NO: 852402 - RNA, 13 nt, Mycobacterium avium subsp. paratuberculosis
ggccgcgucgacc

SEQ ID NO: 852403 - RNA, 14 nt, Mycobacterium avium subsp. paratuberculosis
ggccgcgucgacca

SEQ ID NO: 852404 - RNA, 16 nt, Mycobacterium avium subsp. paratuberculosis
ggccgcgucgaccagc

SEQ ID NO: 852405 - RNA, 17 nt, Mycobacterium avium subsp. paratuberculosis
ggccgcgucgaccagcc

SEQ ID NO: 852406 - RNA, 14 nt, Mycobacterium avium subsp. paratuberculosis
ggccgcgucgccga

SEQ ID NO: 852407 - RNA, 16 nt, Mycobacterium avium subsp. paratuberculosis
ggccgcgucgccgacc

SEQ ID NO: 852408 - RNA, 20 nt, Mycobacterium avium subsp. paratuberculosis
ggccgcgucgccgaccagca

SEQ ID NO: 852409 - RNA, 21 nt, Mycobacterium avium subsp. paratuberculosis
ggccgcgucgccgaccagcag

SEQ ID NO: 852410 - RNA, 23 nt, Mycobacterium avium subsp. paratuberculosis
ggccgcgucgccgaccagcagga

SEQ ID NO: 852411 - RNA, 18 nt, Mycobacterium avium subsp. paratuberculosis
ggccgcgucggcggcggc

SEQ ID NO: 852412 - RNA, 16 nt, Mycobacterium avium subsp. paratuberculosis
ggccgcgucggcgguc

SEQ ID NO: 852413 - RNA, 17 nt, Mycobacterium avium subsp. paratuberculosis
ggccgcgucggcggucg

SEQ ID NO: 852414 - RNA, 20 nt, Mycobacterium avium subsp. paratuberculosis
ggccgcgucggcggucgcca

SEQ ID NO: 852415 - RNA, 12 nt, Mycobacterium avium subsp. paratuberculosis
ggccgcgucggg

SEQ ID NO: 852416 - RNA, 13 nt, Mycobacterium avium subsp. paratuberculosis
ggccgcgucgggc

SEQ ID NO: 852417 - RNA, 19 nt, Mycobacterium avium subsp. paratuberculosis
ggccgcguagcucgccgcg

SEQ ID NO: 852418 - RNA, 24 nt, Mycobacterium avium subsp. paratuberculosis
ggccgcguagcucgccgcggccac

SEQ ID NO: 852419 - RNA, 24 nt, Mycobacterium avium subsp. paratuberculosis
ggccgcguaggccuugcugagccg

SEQ ID NO: 852420 - RNA, 13 nt, Mycobacterium avium subsp. paratuberculosis
ggccgcggugcgu

SEQ ID NO: 852421 - RNA, 20 nt, Mycobacterium avium subsp. paratuberculosis
ggccgcggucucgaccgacu

SEQ ID NO: 852422 - RNA, 12 nt, Mycobacterium avium subsp. paratuberculosis
ggccgcggugac

SEQ ID NO: 852423 - RNA, 15 nt, Mycobacterium avium subsp. paratuberculosis
ggccgcggugaccgc

SEQ ID NO: 852424 - RNA, 16 nt, Mycobacterium avium subsp. paratuberculosis
ggccgcggugaccgcg

SEQ ID NO: 852425 - RNA, 20 nt, Mycobacterium avium subsp. paratuberculosis
ggccgcggugaccgcgccgc

SEQ ID NO: 852426 - RNA, 13 nt, Mycobacterium avium subsp. paratuberculosis
ggccgcggucgcc

SEQ ID NO: 852427 - RNA, 22 nt, Mycobacterium avium subsp. paratuberculosis
ggccgcggucgccccggccgcg

SEQ ID NO: 852428 - RNA, 14 nt, Mycobacterium avium subsp. paratuberculosis
ggccgcgggcgggc

SEQ ID NO: 852429 - RNA, 20 nt, Mycobacterium avium subsp. paratuberculosis
ggccgcgggcgggccgaacc

SEQ ID NO: 852430 - RNA, 14 nt, Mycobacterium avium subsp. paratuberculosis
ggccgcgcugucca

SEQ ID NO: 852431 - RNA, 19 nt, Mycobacterium avium subsp. paratuberculosis
ggccgcggcucgcgacgcg

SEQ ID NO: 852432 - RNA, 16 nt, Mycobacterium avium subsp. paratuberculosis
ggccgcgggcccaccg

SEQ ID NO: 852433 - RNA, 19 nt, Mycobacterium avium subsp. paratuberculosis
ggccgcgggcccaccgcca

SEQ ID NO: 852434 - RNA, 20 nt, Mycobacterium avium subsp. paratuberculosis
ggccgcgggcccaccgccac

SEQ ID NO: 852435 - RNA, 23 nt, Mycobacterium avium subsp. paratuberculosis
ggccgcgggcccaccgccaccag

SEQ ID NO: 852436 - RNA, 14 nt, Mycobacterium avium subsp. paratuberculosis
ggccgcgcuggcgc

SEQ ID NO: 852437 - RNA, 12 nt, Mycobacterium avium subsp. paratuberculosis
ggccgcgcuggc

SEQ ID NO: 852438 - RNA, 17 nt, Mycobacterium avium subsp. paratuberculosis
ggccgcgcuggccagcg

SEQ ID NO: 852439 - RNA, 17 nt, Mycobacterium avium subsp. paratuberculosis
ggccgcgcugaacgcgg

SEQ ID NO: 852440 - RNA, 16 nt, Mycobacterium avium subsp. paratuberculosis
ggccgcauuuggcgua

SEQ ID NO: 852441 - RNA, 23 nt, Mycobacterium avium subsp. paratuberculosis
ggccgccaacggauucagcgucg

SEQ ID NO: 852442 - RNA, 17 nt, Mycobacterium avium subsp. paratuberculosis
ggccccuaccgccgagc

SEQ ID NO: 852443 - RNA, 18 nt, Mycobacterium avium subsp. paratuberculosis
ggccgcauccagcgccgc

SEQ ID NO: 852444 - RNA, 19 nt, Mycobacterium avium subsp. paratuberculosis
ggccgcauccagcgccgcc

SEQ ID NO: 852445 - RNA, 23 nt, Mycobacterium avium subsp. paratuberculosis
ggccgcauccagcgccgccaacc

SEQ ID NO: 852446 - RNA, 16 nt, Mycobacterium avium subsp. paratuberculosis
ggccgcauccgcgagc

SEQ ID NO: 852447 - RNA, 17 nt, Mycobacterium avium subsp. paratuberculosis
ggccgcauccgcgagcc

SEQ ID NO: 852448 - RNA, 18 nt, Mycobacterium avium subsp. paratuberculosis
ggccgcauccgcgagccg

SEQ ID NO: 852449 - RNA, 23 nt, Mycobacterium avium subsp. paratuberculosis
ggccgcauccgcgagccgagccg

SEQ ID NO: 852450 - RNA, 11 nt, Mycobacterium avium subsp. paratuberculosis
ggccgccagca

SEQ ID NO: 852451 - RNA, 15 nt, Mycobacterium avium subsp. paratuberculosis
ggccgccacggcgcc

SEQ ID NO: 852452 - RNA, 16 nt, Mycobacterium avium subsp. paratuberculosis
ggccgccacggcgcca

SEQ ID NO: 852453 - RNA, 13 nt, Mycobacterium avium subsp. paratuberculosis
ggccgccacggcg

SEQ ID NO: 852454 - RNA, 14 nt, Mycobacterium avium subsp. paratuberculosis
ggccgccaccgagg

SEQ ID NO: 852455 - RNA, 13 nt, Mycobacterium avium subsp. paratuberculosis
ggcccaucaccag

SEQ ID NO: 852456 - RNA, 18 nt, Mycobacterium avium subsp. paratuberculosis
ggcccaucaccagcggcu

SEQ ID NO: 852457 - RNA, 14 nt, Mycobacterium avium subsp. paratuberculosis
ggccccggccgagc

SEQ ID NO: 852458 - RNA, 14 nt, Mycobacterium avium subsp. paratuberculosis
ggccccgcgugacg

SEQ ID NO: 852459 - RNA, 21 nt, Mycobacterium avium subsp. paratuberculosis
ggccccgcgugacggccgcgg

SEQ ID NO: 852460 - RNA, 15 nt, Mycobacterium avium subsp. paratuberculosis
ggccccgcugccguc

SEQ ID NO: 852461 - RNA, 14 nt, Mycobacterium avium subsp. paratuberculosis
ggccccggauccgu

SEQ ID NO: 852462 - RNA, 20 nt, Mycobacterium avium subsp. paratuberculosis
ggccccggauccgucgcccc

SEQ ID NO: 852463 - RNA, 22 nt, Mycobacterium avium subsp. paratuberculosis
ggcccaguccugcagcucgccg

SEQ ID NO: 852464 - RNA, 20 nt, Mycobacterium avium subsp. paratuberculosis
ggcccaguggaucggcccga

SEQ ID NO: 852465 - RNA, 21 nt, Mycobacterium avium subsp. paratuberculosis
ggcccaguccagucgcgccga

SEQ ID NO: 852466 - RNA, 23 nt, Mycobacterium avium subsp. paratuberculosis
ggcccaguccagucgcgccgagg

SEQ ID NO: 852467 - RNA, 24 nt, Mycobacterium avium subsp. paratuberculosis
ggcccagguucuccggcccgcucg

SEQ ID NO: 852468 - RNA, 19 nt, Mycobacterium avium subsp. paratuberculosis
ggcccagguaguagcgcca

SEQ ID NO: 852469 - RNA, 21 nt, Mycobacterium avium subsp. paratuberculosis
ggcccagguaguagcgccaca

SEQ ID NO: 852470 - RNA, 18 nt, Mycobacterium avium subsp. paratuberculosis
ggccccuucgaugucgcc

SEQ ID NO: 852471 - RNA, 22 nt, Mycobacterium avium subsp. paratuberculosis
ggccccuuggcguauucggcgc

SEQ ID NO: 852472 - RNA, 13 nt, Mycobacterium avium subsp. paratuberculosis
ggcccgaacaccg

SEQ ID NO: 852473 - RNA, 15 nt, Mycobacterium avium subsp. paratuberculosis
ggcccgaacaccucc

SEQ ID NO: 852474 - RNA, 17 nt, Mycobacterium avium subsp. paratuberculosis
ggccccuccagccgccg

SEQ ID NO: 852475 - RNA, 19 nt, Mycobacterium avium subsp. paratuberculosis
ggccccuccagccgccggu

SEQ ID NO: 852476 - RNA, 23 nt, Mycobacterium avium subsp. paratuberculosis
ggccccugcggggugucgaccca

SEQ ID NO: 852477 - RNA, 14 nt, Mycobacterium avium subsp. paratuberculosis
ggccccggcgacgg

SEQ ID NO: 852478 - RNA, 17 nt, Mycobacterium avium subsp. paratuberculosis
ggccccgggggaccagc

SEQ ID NO: 852479 - RNA, 14 nt, Mycobacterium avium subsp. paratuberculosis
ggccccggcucggg

SEQ ID NO: 852480 - RNA, 16 nt, Mycobacterium avium subsp. paratuberculosis
ggccccggccggcggg

SEQ ID NO: 852481 - RNA, 21 nt, Mycobacterium avium subsp. paratuberculosis
ggccccguucgguggccaccg

SEQ ID NO: 852482 - RNA, 15 nt, Mycobacterium avium subsp. paratuberculosis
ggccgcccggcgagc

SEQ ID NO: 852483 - RNA, 16 nt, Mycobacterium avium subsp. paratuberculosis
ggccgcccggcgagca

SEQ ID NO: 852484 - RNA, 17 nt, Mycobacterium avium subsp. paratuberculosis
ggccgcccgcuggggcg

SEQ ID NO: 852485 - RNA, 19 nt, Mycobacterium avium subsp. paratuberculosis
ggccgcccgcuggggcgca

SEQ ID NO: 852486 - RNA, 21 nt, Mycobacterium avium subsp. paratuberculosis
ggccgcccgcuggggcgcacc

SEQ ID NO: 852487 - RNA, 22 nt, Mycobacterium avium subsp. paratuberculosis
ggccgcccgcuggggcgcaccg

SEQ ID NO: 852488 - RNA, 11 nt, Mycobacterium avium subsp. paratuberculosis
ggccgcccggc

SEQ ID NO: 852489 - RNA, 14 nt, Mycobacterium avium subsp. paratuberculosis
ggccgcccggccca

SEQ ID NO: 852490 - RNA, 22 nt, Mycobacterium avium subsp. paratuberculosis
ggccgcccggcccaagacccgc

SEQ ID NO: 852491 - RNA, 19 nt, Mycobacterium avium subsp. paratuberculosis
ggccgcccggcgagcagcc

SEQ ID NO: 852492 - RNA, 13 nt, Mycobacterium avium subsp. paratuberculosis
ggccgcccggcgc

SEQ ID NO: 852493 - RNA, 15 nt, Mycobacterium avium subsp. paratuberculosis
ggccgcccggcgcgc

SEQ ID NO: 852494 - RNA, 15 nt, Mycobacterium avium subsp. paratuberculosis
ggccgcccgggaaaa

SEQ ID NO: 852495 - RNA, 19 nt, Mycobacterium avium subsp. paratuberculosis
ggccgcccgggcggcccgc

SEQ ID NO: 852496 - RNA, 20 nt, Mycobacterium avium subsp. paratuberculosis
ggccgcccgggcggcccgca

SEQ ID NO: 852497 - RNA, 19 nt, Mycobacterium avium subsp. paratuberculosis
ggccgcccgguccgggucg

SEQ ID NO: 852498 - RNA, 20 nt, Mycobacterium avium subsp. paratuberculosis
ggccgcccucgcugccgccc

SEQ ID NO: 852499 - RNA, 12 nt, Mycobacterium avium subsp. paratuberculosis
ggccgcccgcgc

SEQ ID NO: 852500 - RNA, 23 nt, Mycobacterium avium subsp. paratuberculosis
ggccgcccgcuccugcaggccga

SEQ ID NO: 852501 - RNA, 17 nt, Mycobacterium avium subsp. paratuberculosis
ggccgccagggccaggu

SEQ ID NO: 852502 - RNA, 18 nt, Mycobacterium avium subsp. paratuberculosis
ggccgcccgcaccagcag

SEQ ID NO: 852503 - RNA, 17 nt, Mycobacterium avium subsp. paratuberculosis
ggccgcccagucgccgc

SEQ ID NO: 852504 - RNA, 21 nt, Mycobacterium avium subsp. paratuberculosis
ggccgcccagucgccgccgcg

SEQ ID NO: 852505 - RNA, 23 nt, Mycobacterium avium subsp. paratuberculosis
ggccgcccagucgccgccgcgca

SEQ ID NO: 852506 - RNA, 13 nt, Mycobacterium avium subsp. paratuberculosis
ggccgccccgaac

SEQ ID NO: 852507 - RNA, 23 nt, Mycobacterium avium subsp. paratuberculosis
ggccgccccgaacagcgccaggg

SEQ ID NO: 852508 - RNA, 15 nt, Mycobacterium avium subsp. paratuberculosis
ggccgccccggccgc

SEQ ID NO: 852509 - RNA, 18 nt, Mycobacterium avium subsp. paratuberculosis
ggccgccccggccgcgca

SEQ ID NO: 852510 - RNA, 16 nt, Mycobacterium avium subsp. paratuberculosis
ggccgcccagcccgcg

SEQ ID NO: 852511 - RNA, 18 nt, Mycobacterium avium subsp. paratuberculosis
ggccgcccaccacgaacc

SEQ ID NO: 852512 - RNA, 23 nt, Mycobacterium avium subsp. paratuberculosis
ggccgcccaccacgaaccaggcg

SEQ ID NO: 852513 - RNA, 18 nt, Mycobacterium avium subsp. paratuberculosis
ggccgccaucauccgcug

SEQ ID NO: 852514 - RNA, 22 nt, Mycobacterium avium subsp. paratuberculosis
ggccgccaucgaucgggcgucg

SEQ ID NO: 852515 - RNA, 18 nt, Mycobacterium avium subsp. paratuberculosis
ggccgccagcgucccguc

SEQ ID NO: 852516 - RNA, 22 nt, Mycobacterium avium subsp. paratuberculosis
ggccgccagcgucccguccugg

SEQ ID NO: 852517 - RNA, 12 nt, Mycobacterium avium subsp. paratuberculosis
ggccgccagcuc

SEQ ID NO: 852518 - RNA, 22 nt, Mycobacterium avium subsp. paratuberculosis
ggccgccaggaucugcucggcg

SEQ ID NO: 852519 - RNA, 23 nt, Mycobacterium avium subsp. paratuberculosis
ggccgccaggaugucguccucgg

SEQ ID NO: 852520 - RNA, 14 nt, Mycobacterium avium subsp. paratuberculosis
ggccgccagcgccc

SEQ ID NO: 852521 - RNA, 17 nt, Mycobacterium avium subsp. paratuberculosis
ggccgccagcgcccgcg

SEQ ID NO: 852522 - RNA, 13 nt, Mycobacterium avium subsp. paratuberculosis
ggccgccagcgca

SEQ ID NO: 852523 - RNA, 14 nt, Mycobacterium avium subsp. paratuberculosis
ggccgccagcgcac

SEQ ID NO: 852524 - RNA, 13 nt, Mycobacterium avium subsp. paratuberculosis
ggccgccagccgg

SEQ ID NO: 852525 - RNA, 22 nt, Mycobacterium avium subsp. paratuberculosis
ggccgccagccgguacggaucg

SEQ ID NO: 852526 - RNA, 20 nt, Mycobacterium avium subsp. paratuberculosis
ggccgccagcaccucgcggc

SEQ ID NO: 852527 - RNA, 12 nt, Mycobacterium avium subsp. paratuberculosis
ggccgccagcag

SEQ ID NO: 852528 - RNA, 19 nt, Mycobacterium avium subsp. paratuberculosis
ggccgccagcagcacggca

SEQ ID NO: 852529 - RNA, 20 nt, Mycobacterium avium subsp. paratuberculosis
ggccgccagcagcacggcaa

SEQ ID NO: 852530 - RNA, 19 nt, Mycobacterium avium subsp. paratuberculosis
ggcgcaacgggauggcuca

SEQ ID NO: 852531 - RNA, 15 nt, Mycobacterium avium subsp. paratuberculosis
aagggcccaugccgc

SEQ ID NO: 852532 - RNA, 20 nt, Mycobacterium avium subsp. paratuberculosis
aagggcuugggcgcgaucgg

SEQ ID NO: 852533 - RNA, 14 nt, Mycobacterium avium subsp. paratuberculosis
aaggggccgggcua

SEQ ID NO: 852534 - RNA, 19 nt, Mycobacterium avium subsp. paratuberculosis
ggcgcaaccaacucgcgau

SEQ ID NO: 852535 - RNA, 14 nt, Mycobacterium avium subsp. paratuberculosis
ggcgcaacagcacc

SEQ ID NO: 852536 - RNA, 22 nt, Mycobacterium avium subsp. paratuberculosis
ggcgcaacagcaccucgucgcc

SEQ ID NO: 852537 - RNA, 16 nt, Mycobacterium avium subsp. paratuberculosis
ggcgagcuggccgccc

SEQ ID NO: 852538 - RNA, 17 nt, Mycobacterium avium subsp. paratuberculosis
ggcgagcuggccgccca

SEQ ID NO: 852539 - RNA, 23 nt, Mycobacterium avium subsp. paratuberculosis
ggcgagcgguucgaucucgucgg

SEQ ID NO: 852540 - RNA, 13 nt, Mycobacterium avium subsp. paratuberculosis
ggcgagcgucgcc

SEQ ID NO: 852541 - RNA, 20 nt, Mycobacterium avium subsp. paratuberculosis
ggcgagcucguucucggcga

SEQ ID NO: 852542 - RNA, 21 nt, Mycobacterium avium subsp. paratuberculosis
ggcgagcucguucucggcgaa

SEQ ID NO: 852543 - RNA, 22 nt, Mycobacterium avium subsp. paratuberculosis
ggcgagcucguucucggcgaac

SEQ ID NO: 852544 - RNA, 19 nt, Mycobacterium avium subsp. paratuberculosis
ggcgagcugaucggcguug

SEQ ID NO: 852545 - RNA, 13 nt, Mycobacterium avium subsp. paratuberculosis
ggcgagcugcggg

SEQ ID NO: 852546 - RNA, 22 nt, Mycobacterium avium subsp. paratuberculosis
ggcgagcgcgugcacgaacgcg

SEQ ID NO: 852547 - RNA, 23 nt, Mycobacterium avium subsp. paratuberculosis
ggcgagcgcguucuccaccgcgc

SEQ ID NO: 852548 - RNA, 14 nt, Mycobacterium avium subsp. paratuberculosis
ggcgagcggcaccu

SEQ ID NO: 852549 - RNA, 18 nt, Mycobacterium avium subsp. paratuberculosis
ggcgagcggcccugcgcg

SEQ ID NO: 852550 - RNA, 20 nt, Mycobacterium avium subsp. paratuberculosis
ggcgagcacggcacgcccgu

SEQ ID NO: 852551 - RNA, 16 nt, Mycobacterium avium subsp. paratuberculosis
ggcgcaggcgcgcacc

SEQ ID NO: 852552 - RNA, 17 nt, Mycobacterium avium subsp. paratuberculosis
ggcgcaggcgcgcacca

SEQ ID NO: 852553 - RNA, 15 nt, Mycobacterium avium subsp. paratuberculosis
ggcgcagggccgcua

SEQ ID NO: 852554 - RNA, 15 nt, Mycobacterium avium subsp. paratuberculosis
ggcgcagguccaccc

SEQ ID NO: 852555 - RNA, 22 nt, Mycobacterium avium subsp. paratuberculosis
ggcgcagguccggcagcgcgcc

SEQ ID NO: 852556 - RNA, 18 nt, Mycobacterium avium subsp. paratuberculosis
ggcgcaggugggcggugc

SEQ ID NO: 852557 - RNA, 19 nt, Mycobacterium avium subsp. paratuberculosis
ggcgcagguguccagcccu

SEQ ID NO: 852558 - RNA, 22 nt, Mycobacterium avium subsp. paratuberculosis
ggcgcagguuguccagccggug

SEQ ID NO: 852559 - RNA, 23 nt, Mycobacterium avium subsp. paratuberculosis
ggcgcagguuguccagccggugc

SEQ ID NO: 852560 - RNA, 16 nt, Mycobacterium avium subsp. paratuberculosis
ggcgcagucggccgga

SEQ ID NO: 852561 - RNA, 20 nt, Mycobacterium avium subsp. paratuberculosis
ggcgcaguuaccggcguaga

SEQ ID NO: 852562 - RNA, 14 nt, Mycobacterium avium subsp. paratuberculosis
ggcgcaggccgguc

SEQ ID NO: 852563 - RNA, 16 nt, Mycobacterium avium subsp. paratuberculosis
ggcgccacaacugguc

SEQ ID NO: 852564 - RNA, 20 nt, Mycobacterium avium subsp. paratuberculosis
ggcgccacaacuggucgugc

SEQ ID NO: 852565 - RNA, 16 nt, Mycobacterium avium subsp. paratuberculosis
ggcgcauaaaccuggu

SEQ ID NO: 852566 - RNA, 13 nt, Mycobacterium avium subsp. paratuberculosis
ggcgcagcggccc

SEQ ID NO: 852567 - RNA, 15 nt, Mycobacterium avium subsp. paratuberculosis
ggcgcagcggcccga

SEQ ID NO: 852568 - RNA, 23 nt, Mycobacterium avium subsp. paratuberculosis
ggcgcagcgucucgaucgacgac

SEQ ID NO: 852569 - RNA, 18 nt, Mycobacterium avium subsp. paratuberculosis
ggcgccaccggcuggccg

SEQ ID NO: 852570 - RNA, 19 nt, Mycobacterium avium subsp. paratuberculosis
ggcgccaccggcuggccgg

SEQ ID NO: 852571 - RNA, 13 nt, Mycobacterium avium subsp. paratuberculosis
ggcgccaccagcc

SEQ ID NO: 852572 - RNA, 15 nt, Mycobacterium avium subsp. paratuberculosis
ggcgccacgaccagc

SEQ ID NO: 852573 - RNA, 19 nt, Mycobacterium avium subsp. paratuberculosis
ggcgccacgaccagcggca

SEQ ID NO: 852574 - RNA, 21 nt, Mycobacterium avium subsp. paratuberculosis
ggcgccacgacugcgcggccg

SEQ ID NO: 852575 - RNA, 19 nt, Mycobacterium avium subsp. paratuberculosis
ggcgccacgcuggcgugac

SEQ ID NO: 852576 - RNA, 20 nt, Mycobacterium avium subsp. paratuberculosis
ggcgccacgcuggcgugacg

SEQ ID NO: 852577 - RNA, 16 nt, Mycobacterium avium subsp. paratuberculosis
ggcgccacguggucga

SEQ ID NO: 852578 - RNA, 12 nt, Mycobacterium avium subsp. paratuberculosis
ggcgccagcccg

SEQ ID NO: 852579 - RNA, 13 nt, Mycobacterium avium subsp. paratuberculosis
ggcgccagccguu

SEQ ID NO: 852580 - RNA, 22 nt, Mycobacterium avium subsp. paratuberculosis
ggcgccagccguucccggcaga

SEQ ID NO: 852581 - RNA, 17 nt, Mycobacterium avium subsp. paratuberculosis
ggcgccagcccgccgaa

SEQ ID NO: 852582 - RNA, 15 nt, Mycobacterium avium subsp. paratuberculosis
ggcgccagcccggug

SEQ ID NO: 852583 - RNA, 12 nt, Mycobacterium avium subsp. paratuberculosis
ggcgccagccgc

SEQ ID NO: 852584 - RNA, 17 nt, Mycobacterium avium subsp. paratuberculosis
ggcgccagccgcaccgc

SEQ ID NO: 852585 - RNA, 20 nt, Mycobacterium avium subsp. paratuberculosis
ggcgccagccgcaccgcgac

SEQ ID NO: 852586 - RNA, 15 nt, Mycobacterium avium subsp. paratuberculosis
ggcgccagcagcacc

SEQ ID NO: 852587 - RNA, 16 nt, Mycobacterium avium subsp. paratuberculosis
ggcgccagcagcaccu

SEQ ID NO: 852588 - RNA, 16 nt, Mycobacterium avium subsp. paratuberculosis
ggcgcccgucacgcug

SEQ ID NO: 852589 - RNA, 20 nt, Mycobacterium avium subsp. paratuberculosis
ggcgcccgucacgcuggcgu

SEQ ID NO: 852590 - RNA, 22 nt, Mycobacterium avium subsp. paratuberculosis
ggcgcccgucacgcuggcguga

SEQ ID NO: 852591 - RNA, 14 nt, Mycobacterium avium subsp. paratuberculosis
ggcgcccucgccga

SEQ ID NO: 852592 - RNA, 15 nt, Mycobacterium avium subsp. paratuberculosis
ggcgcccucgccgac

SEQ ID NO: 852593 - RNA, 18 nt, Mycobacterium avium subsp. paratuberculosis
ggcgcccucgccgaccug

SEQ ID NO: 852594 - RNA, 21 nt, Mycobacterium avium subsp. paratuberculosis
ggcgcccucgccggcggcgcc

SEQ ID NO: 852595 - RNA, 16 nt, Mycobacterium avium subsp. paratuberculosis
ggcgcccucggcgauc

SEQ ID NO: 852596 - RNA, 23 nt, Mycobacterium avium subsp. paratuberculosis
ggcgcccucggcgaucucguccc

SEQ ID NO: 852597 - RNA, 14 nt, Mycobacterium avium subsp. paratuberculosis
ggcgcccggcgcgc

SEQ ID NO: 852598 - RNA, 15 nt, Mycobacterium avium subsp. paratuberculosis
ggcgcccggcgcgcc

SEQ ID NO: 852599 - RNA, 21 nt, Mycobacterium avium subsp. paratuberculosis
ggcgcccggcgcgccacgacg

SEQ ID NO: 852600 - RNA, 16 nt, Mycobacterium avium subsp. paratuberculosis
ggcgcccggcccagcc

SEQ ID NO: 852601 - RNA, 17 nt, Mycobacterium avium subsp. paratuberculosis
ggcgcccggcccagccg

SEQ ID NO: 852602 - RNA, 14 nt, Mycobacterium avium subsp. paratuberculosis
ggcgcccggccggc

SEQ ID NO: 852603 - RNA, 21 nt, Mycobacterium avium subsp. paratuberculosis
ggcgcccggagcugucgguga

SEQ ID NO: 852604 - RNA, 18 nt, Mycobacterium avium subsp. paratuberculosis
ggcgcccgcuccggcgga

SEQ ID NO: 852605 - RNA, 14 nt, Mycobacterium avium subsp. paratuberculosis
ggcgcccgcggccu

SEQ ID NO: 852606 - RNA, 15 nt, Mycobacterium avium subsp. paratuberculosis
ggcgcccgcggcgcg

SEQ ID NO: 852607 - RNA, 16 nt, Mycobacterium avium subsp. paratuberculosis
ggcgccaggccggcga

SEQ ID NO: 852608 - RNA, 13 nt, Mycobacterium avium subsp. paratuberculosis
ggcgcccgcggug

SEQ ID NO: 852609 - RNA, 14 nt, Mycobacterium avium subsp. paratuberculosis
ggcgcccgccccga

SEQ ID NO: 852610 - RNA, 15 nt, Mycobacterium avium subsp. paratuberculosis
ggcgcccgccccgac

SEQ ID NO: 852611 - RNA, 16 nt, Mycobacterium avium subsp. paratuberculosis
ggcgcccgccccgacg

SEQ ID NO: 852612 - RNA, 17 nt, Mycobacterium avium subsp. paratuberculosis
ggcgccgggcggcccgc

SEQ ID NO: 852613 - RNA, 19 nt, Mycobacterium avium subsp. paratuberculosis
ggcgccgggcggcccgccu

SEQ ID NO: 852614 - RNA, 16 nt, Mycobacterium avium subsp. paratuberculosis
ggcgccgggcgggcgc

SEQ ID NO: 852615 - RNA, 18 nt, Mycobacterium avium subsp. paratuberculosis
ggcgccgggcagcccggg

SEQ ID NO: 852616 - RNA, 15 nt, Mycobacterium avium subsp. paratuberculosis
ggcgccggcggccac

SEQ ID NO: 852617 - RNA, 17 nt, Mycobacterium avium subsp. paratuberculosis
ggcgccggcggccacgc

SEQ ID NO: 852618 - RNA, 17 nt, Mycobacterium avium subsp. paratuberculosis
ggcgccggcugcccgcg

SEQ ID NO: 852619 - RNA, 24 nt, Mycobacterium avium subsp. paratuberculosis
ggcgccggcugcccgcgacugucg

SEQ ID NO: 852620 - RNA, 16 nt, Mycobacterium avium subsp. paratuberculosis
ggcgccggcggucagc

SEQ ID NO: 852621 - RNA, 13 nt, Mycobacterium avium subsp. paratuberculosis
ggcgccggcguca

SEQ ID NO: 852622 - RNA, 23 nt, Mycobacterium avium subsp. paratuberculosis
ggcgccggcguccagcgccgcca

SEQ ID NO: 852623 - RNA, 13 nt, Mycobacterium avium subsp. paratuberculosis
ggcgccggcgcgg

SEQ ID NO: 852624 - RNA, 23 nt, Mycobacterium avium subsp. paratuberculosis
ggcgccggcgcgcaacagcgucu

SEQ ID NO: 852625 - RNA, 17 nt, Mycobacterium avium subsp. paratuberculosis
ggcgccggccggcgcgu

SEQ ID NO: 852626 - RNA, 12 nt, Mycobacterium avium subsp. paratuberculosis
ggcgccggccgu

SEQ ID NO: 852627 - RNA, 16 nt, Mycobacterium avium subsp. paratuberculosis
ggcgccggccgccgga

SEQ ID NO: 852628 - RNA, 14 nt, Mycobacterium avium subsp. paratuberculosis
ggcgccggccggcg

SEQ ID NO: 852629 - RNA, 12 nt, Mycobacterium avium subsp. paratuberculosis
ggcgccggccgc

SEQ ID NO: 852630 - RNA, 13 nt, Mycobacterium avium subsp. paratuberculosis
ggcgccgccggcg

SEQ ID NO: 852631 - RNA, 13 nt, Mycobacterium avium subsp. paratuberculosis
ggcgccgcccggc

SEQ ID NO: 852632 - RNA, 15 nt, Mycobacterium avium subsp. paratuberculosis
ggcgccgcccggcga

SEQ ID NO: 852633 - RNA, 12 nt, Mycobacterium avium subsp. paratuberculosis
ggcgccgccgaa

SEQ ID NO: 852634 - RNA, 12 nt, Mycobacterium avium subsp. paratuberculosis
ggcgccgcccac

SEQ ID NO: 852635 - RNA, 15 nt, Mycobacterium avium subsp. paratuberculosis
ggcgccgcccaccag

SEQ ID NO: 852636 - RNA, 16 nt, Mycobacterium avium subsp. paratuberculosis
ggcgccgcccaccagc

SEQ ID NO: 852637 - RNA, 18 nt, Mycobacterium avium subsp. paratuberculosis
ggcgccgccgaccgcccg

SEQ ID NO: 852638 - RNA, 18 nt, Mycobacterium avium subsp. paratuberculosis
ggcgccgccgagccgcgg

SEQ ID NO: 852639 - RNA, 15 nt, Mycobacterium avium subsp. paratuberculosis
ggcgccgccaccacg

SEQ ID NO: 852640 - RNA, 16 nt, Mycobacterium avium subsp. paratuberculosis
ggcgccgccaccacga

SEQ ID NO: 852641 - RNA, 21 nt, Mycobacterium avium subsp. paratuberculosis
ggcgccgccaccacgauguug

SEQ ID NO: 852642 - RNA, 22 nt, Mycobacterium avium subsp. paratuberculosis
ggcgccgacagucgcgggcagc

SEQ ID NO: 852643 - RNA, 17 nt, Mycobacterium avium subsp. paratuberculosis
ggcgccgcagcggcgcc

SEQ ID NO: 852644 - RNA, 15 nt, Mycobacterium avium subsp. paratuberculosis
ggcgccgcagcucgu

SEQ ID NO: 852645 - RNA, 17 nt, Mycobacterium avium subsp. paratuberculosis
ggcgccgcagcacgcug

SEQ ID NO: 852646 - RNA, 19 nt, Mycobacterium avium subsp. paratuberculosis
ggcgcccugcgagcccggg

SEQ ID NO: 852647 - RNA, 23 nt, Mycobacterium avium subsp. paratuberculosis
ggcgccgaacagaugccugccca

SEQ ID NO: 852648 - RNA, 19 nt, Mycobacterium avium subsp. paratuberculosis
ggcgccgaaccgggugacg

SEQ ID NO: 852649 - RNA, 21 nt, Mycobacterium avium subsp. paratuberculosis
ggcgccgaacgucgagcgcgg

SEQ ID NO: 852650 - RNA, 20 nt, Mycobacterium avium subsp. paratuberculosis
ggcgccgaacucggcgccgc

SEQ ID NO: 852651 - RNA, 21 nt, Mycobacterium avium subsp. paratuberculosis
ggcgccgaacucggcgccgcc

SEQ ID NO: 852652 - RNA, 20 nt, Mycobacterium avium subsp. paratuberculosis
ggcgccgaagcccgcagcga

SEQ ID NO: 852653 - RNA, 22 nt, Mycobacterium avium subsp. paratuberculosis
ggcgccgaagccgucgaccccg

SEQ ID NO: 852654 - RNA, 23 nt, Mycobacterium avium subsp. paratuberculosis
ggcgccgaagccgucgaccccgc

SEQ ID NO: 852655 - RNA, 12 nt, Mycobacterium avium subsp. paratuberculosis
ggcgccgaaggc

SEQ ID NO: 852656 - RNA, 19 nt, Mycobacterium avium subsp. paratuberculosis
ggcgcccugcacccagccg

SEQ ID NO: 852657 - RNA, 14 nt, Mycobacterium avium subsp. paratuberculosis
ggcgcccugcgcgc

SEQ ID NO: 852658 - RNA, 14 nt, Mycobacterium avium subsp. paratuberculosis
ggcgcccuucggcg

SEQ ID NO: 852659 - RNA, 16 nt, Mycobacterium avium subsp. paratuberculosis
ggcgcccuugaucguc

SEQ ID NO: 852660 - RNA, 18 nt, Mycobacterium avium subsp. paratuberculosis
ggcgcccuugccgaugcc

SEQ ID NO: 852661 - RNA, 22 nt, Mycobacterium avium subsp. paratuberculosis
ggcgcccuugccgaugccggcg

SEQ ID NO: 852662 - RNA, 23 nt, Mycobacterium avium subsp. paratuberculosis
ggcgcccuugccgaugccggcgu

SEQ ID NO: 852663 - RNA, 14 nt, Mycobacterium avium subsp. paratuberculosis
ggcgcgccgagcgc

SEQ ID NO: 852664 - RNA, 13 nt, Mycobacterium avium subsp. paratuberculosis
ggcgcgccgcacc

SEQ ID NO: 852665 - RNA, 20 nt, Mycobacterium avium subsp. paratuberculosis
ggcgcgccgcaccucgccga

SEQ ID NO: 852666 - RNA, 12 nt, Mycobacterium avium subsp. paratuberculosis
ggcgcgccgcag

SEQ ID NO: 852667 - RNA, 22 nt, Mycobacterium avium subsp. paratuberculosis
ggcgcgccgaagauggccagcg

SEQ ID NO: 852668 - RNA, 12 nt, Mycobacterium avium subsp. paratuberculosis
ggcgcgccggcg

SEQ ID NO: 852669 - RNA, 13 nt, Mycobacterium avium subsp. paratuberculosis
ggcgcgccggcga

SEQ ID NO: 852670 - RNA, 23 nt, Mycobacterium avium subsp. paratuberculosis
ggcgcgccggcgauaggcggcca

SEQ ID NO: 852671 - RNA, 16 nt, Mycobacterium avium subsp. paratuberculosis
ggcgcgccggcgcgca

SEQ ID NO: 852672 - RNA, 18 nt, Mycobacterium avium subsp. paratuberculosis
ggcgcgccggcgcgcagc

SEQ ID NO: 852673 - RNA, 15 nt, Mycobacterium avium subsp. paratuberculosis
ggcgcgccggccgga

SEQ ID NO: 852674 - RNA, 23 nt, Mycobacterium avium subsp. paratuberculosis
ggcgcgccggccggagcggaugg

SEQ ID NO: 852675 - RNA, 19 nt, Mycobacterium avium subsp. paratuberculosis
ggcgcgccgcguucggcgg

SEQ ID NO: 852676 - RNA, 14 nt, Mycobacterium avium subsp. paratuberculosis
ggcgcgccugcgcg

SEQ ID NO: 852677 - RNA, 17 nt, Mycobacterium avium subsp. paratuberculosis
ggcgcgccugcgcggcg

SEQ ID NO: 852678 - RNA, 18 nt, Mycobacterium avium subsp. paratuberculosis
ggcgcgccugcgcggcgg

SEQ ID NO: 852679 - RNA, 19 nt, Mycobacterium avium subsp. paratuberculosis
ggcgcgccugcgcggcggc

SEQ ID NO: 852680 - RNA, 24 nt, Mycobacterium avium subsp. paratuberculosis
ggcgcgccgguaaugggcgaucga

SEQ ID NO: 852681 - RNA, 16 nt, Mycobacterium avium subsp. paratuberculosis
ggcgcgccccggcccg

SEQ ID NO: 852682 - RNA, 19 nt, Mycobacterium avium subsp. paratuberculosis
ggcgcgcccgagucacccg

SEQ ID NO: 852683 - RNA, 16 nt, Mycobacterium avium subsp. paratuberculosis
ggcgcgcccacccgcg

SEQ ID NO: 852684 - RNA, 18 nt, Mycobacterium avium subsp. paratuberculosis
ggcgcgcccacccgcgcc

SEQ ID NO: 852685 - RNA, 17 nt, Mycobacterium avium subsp. paratuberculosis
ggcgcgcaucccgaucg

SEQ ID NO: 852686 - RNA, 18 nt, Mycobacterium avium subsp. paratuberculosis
ggcgcgcaucgccgucca

SEQ ID NO: 852687 - RNA, 13 nt, Mycobacterium avium subsp. paratuberculosis
ggcgcgcaucguc

SEQ ID NO: 852688 - RNA, 13 nt, Mycobacterium avium subsp. paratuberculosis
ggcgcgccacccg

SEQ ID NO: 852689 - RNA, 12 nt, Mycobacterium avium subsp. paratuberculosis
ggcgcgcaucug

SEQ ID NO: 852690 - RNA, 17 nt, Mycobacterium avium subsp. paratuberculosis
ggcgcgcaucugcucgg

SEQ ID NO: 852691 - RNA, 12 nt, Mycobacterium avium subsp. paratuberculosis
ggcgcgcaccag

SEQ ID NO: 852692 - RNA, 22 nt, Mycobacterium avium subsp. paratuberculosis
ggcgcgcagucgcaggccccgg

SEQ ID NO: 852693 - RNA, 11 nt, Mycobacterium avium subsp. paratuberculosis
ggcgcgcagcu

SEQ ID NO: 852694 - RNA, 17 nt, Mycobacterium avium subsp. paratuberculosis
ggcgcgcaggcgcgcgg

SEQ ID NO: 852695 - RNA, 20 nt, Mycobacterium avium subsp. paratuberculosis
ggcgcgcaggcgcgcggcca

SEQ ID NO: 852696 - RNA, 17 nt, Mycobacterium avium subsp. paratuberculosis
ggcgcgcaggcuggcau

SEQ ID NO: 852697 - RNA, 14 nt, Mycobacterium avium subsp. paratuberculosis
ggcgcgcagcaauu

SEQ ID NO: 852698 - RNA, 23 nt, Mycobacterium avium subsp. paratuberculosis
ggcgcgcagcaauugacgccgac

SEQ ID NO: 852699 - RNA, 18 nt, Mycobacterium avium subsp. paratuberculosis
ggcgcgcagaucgucgac

SEQ ID NO: 852700 - RNA, 20 nt, Mycobacterium avium subsp. paratuberculosis
ggcgcgcagaucgucgaccu

SEQ ID NO: 852701 - RNA, 15 nt, Mycobacterium avium subsp. paratuberculosis
ggcgcgcagccacga

SEQ ID NO: 852702 - RNA, 14 nt, Mycobacterium avium subsp. paratuberculosis
ggcgcgcagccagu

SEQ ID NO: 852703 - RNA, 23 nt, Mycobacterium avium subsp. paratuberculosis
ggcgcgcagccagucgccggcca

SEQ ID NO: 852704 - RNA, 17 nt, Mycobacterium avium subsp. paratuberculosis
ggcgcgcagccggccgu

SEQ ID NO: 852705 - RNA, 20 nt, Mycobacterium avium subsp. paratuberculosis
ggcgcgcagccggccgucca

SEQ ID NO: 852706 - RNA, 19 nt, Mycobacterium avium subsp. paratuberculosis
ggcgcgcacgucaccgcgc

SEQ ID NO: 852707 - RNA, 19 nt, Mycobacterium avium subsp. paratuberculosis
ggcgcgcacguuggcggcc

SEQ ID NO: 852708 - RNA, 22 nt, Mycobacterium avium subsp. paratuberculosis
ggcgcgcacguuggcggccagc

SEQ ID NO: 852709 - RNA, 23 nt, Mycobacterium avium subsp. paratuberculosis
ggcgcgcacguuggcggccagcg

SEQ ID NO: 852710 - RNA, 14 nt, Mycobacterium avium subsp. paratuberculosis
ggcgcgcaccaucg

SEQ ID NO: 852711 - RNA, 13 nt, Mycobacterium avium subsp. paratuberculosis
ggcgcgcacggca

SEQ ID NO: 852712 - RNA, 15 nt, Mycobacterium avium subsp. paratuberculosis
ggcgcgcacggcagc

SEQ ID NO: 852713 - RNA, 21 nt, Mycobacterium avium subsp. paratuberculosis
ggcgcgcacggcagcccgacg

SEQ ID NO: 852714 - RNA, 17 nt, Mycobacterium avium subsp. paratuberculosis
ggcgcgcaccaucgcga

SEQ ID NO: 852715 - RNA, 14 nt, Mycobacterium avium subsp. paratuberculosis
ggcgcgcaccgcga

SEQ ID NO: 852716 - RNA, 22 nt, Mycobacterium avium subsp. paratuberculosis
ggcgcgcaccgcgaaacgcaac

SEQ ID NO: 852717 - RNA, 17 nt, Mycobacterium avium subsp. paratuberculosis
ggcgcgcaccgcgggca

SEQ ID NO: 852718 - RNA, 17 nt, Mycobacterium avium subsp. paratuberculosis
ggcgcgcaccagcucgg

SEQ ID NO: 852719 - RNA, 21 nt, Mycobacterium avium subsp. paratuberculosis
ggcgcgcaccagcucggcgcu

SEQ ID NO: 852720 - RNA, 14 nt, Mycobacterium avium subsp. paratuberculosis
ggcgcgaugaucgc

SEQ ID NO: 852721 - RNA, 22 nt, Mycobacterium avium subsp. paratuberculosis
ggcgcgaugaucgccggcgccg

SEQ ID NO: 852722 - RNA, 17 nt, Mycobacterium avium subsp. paratuberculosis
ggcgcgcaacucgucca

SEQ ID NO: 852723 - RNA, 21 nt, Mycobacterium avium subsp. paratuberculosis
ggcgcgcaacucguccaccag

SEQ ID NO: 852724 - RNA, 19 nt, Mycobacterium avium subsp. paratuberculosis
ggcgcgaucaggcugccgc

SEQ ID NO: 852725 - RNA, 13 nt, Mycobacterium avium subsp. paratuberculosis
ggcgcgaucggca

SEQ ID NO: 852726 - RNA, 23 nt, Mycobacterium avium subsp. paratuberculosis
ggcgcgaucggccgcugcccggg

SEQ ID NO: 852727 - RNA, 15 nt, Mycobacterium avium subsp. paratuberculosis
ggcgcgaggcgggua

SEQ ID NO: 852728 - RNA, 17 nt, Mycobacterium avium subsp. paratuberculosis
ggcgcgaucgucgacca

SEQ ID NO: 852729 - RNA, 17 nt, Mycobacterium avium subsp. paratuberculosis
ggcgcgauagccgguga

SEQ ID NO: 852730 - RNA, 19 nt, Mycobacterium avium subsp. paratuberculosis
ggcgcgauagccggugauc

SEQ ID NO: 852731 - RNA, 23 nt, Mycobacterium avium subsp. paratuberculosis
ggcgcgacgcgggauugccgagc

SEQ ID NO: 852732 - RNA, 12 nt, Mycobacterium avium subsp. paratuberculosis
ggcgcgacggcg

SEQ ID NO: 852733 - RNA, 16 nt, Mycobacterium avium subsp. paratuberculosis
ggcgcgacggcggcga

SEQ ID NO: 852734 - RNA, 16 nt, Mycobacterium avium subsp. paratuberculosis
ggcgccuccgcccggg

SEQ ID NO: 852735 - RNA, 18 nt, Mycobacterium avium subsp. paratuberculosis
ggcgccuccgcccgggug

SEQ ID NO: 852736 - RNA, 14 nt, Mycobacterium avium subsp. paratuberculosis
ggcgccucgaugcg

SEQ ID NO: 852737 - RNA, 15 nt, Mycobacterium avium subsp. paratuberculosis
ggcgccucgccgacc

SEQ ID NO: 852738 - RNA, 18 nt, Mycobacterium avium subsp. paratuberculosis
ggcgccguugaccggccg

SEQ ID NO: 852739 - RNA, 14 nt, Mycobacterium avium subsp. paratuberculosis
ggcgccgugccgcg

SEQ ID NO: 852740 - RNA, 16 nt, Mycobacterium avium subsp. paratuberculosis
ggcgccgugccgcgcg

SEQ ID NO: 852741 - RNA, 17 nt, Mycobacterium avium subsp. paratuberculosis
ggcgccgugccgcgcgg

SEQ ID NO: 852742 - RNA, 13 nt, Mycobacterium avium subsp. paratuberculosis
ggcgccgugcgcc

SEQ ID NO: 852743 - RNA, 17 nt, Mycobacterium avium subsp. paratuberculosis
ggcgccgugcaggauga

SEQ ID NO: 852744 - RNA, 23 nt, Mycobacterium avium subsp. paratuberculosis
ggcgccgucgcgggagagcgcgg

SEQ ID NO: 852745 - RNA, 14 nt, Mycobacterium avium subsp. paratuberculosis
ggcgccgucggcgg

SEQ ID NO: 852746 - RNA, 14 nt, Mycobacterium avium subsp. paratuberculosis
ggcgccgucggugg

SEQ ID NO: 852747 - RNA, 19 nt, Mycobacterium avium subsp. paratuberculosis
ggcgccgucggugggggcc

SEQ ID NO: 852748 - RNA, 14 nt, Mycobacterium avium subsp. paratuberculosis
aagguguuggugcg

SEQ ID NO: 852749 - RNA, 15 nt, Mycobacterium avium subsp. paratuberculosis
ggcgcucagcggcag

SEQ ID NO: 852750 - RNA, 23 nt, Mycobacterium avium subsp. paratuberculosis
ggcgcucagcggcagcgucgcca

SEQ ID NO: 852751 - RNA, 20 nt, Mycobacterium avium subsp. paratuberculosis
ggcgcucaacgugauacgcc

SEQ ID NO: 852752 - RNA, 20 nt, Mycobacterium avium subsp. paratuberculosis
aaggugacgucgccgauggc

SEQ ID NO: 852753 - RNA, 19 nt, Mycobacterium avium subsp. paratuberculosis
aaggucugaaaugccgggc

SEQ ID NO: 852754 - RNA, 15 nt, Mycobacterium avium subsp. paratuberculosis
ggcgcgugcgccgcg

SEQ ID NO: 852755 - RNA, 19 nt, Mycobacterium avium subsp. paratuberculosis
ggcgcgugcacaccggccu

SEQ ID NO: 852756 - RNA, 18 nt, Mycobacterium avium subsp. paratuberculosis
ggcgcuagcugcgccggc

SEQ ID NO: 852757 - RNA, 21 nt, Mycobacterium avium subsp. paratuberculosis
ggcgcgugcuguugcaggugc

SEQ ID NO: 852758 - RNA, 22 nt, Mycobacterium avium subsp. paratuberculosis
ggcgcgugcuguugcaggugcg

SEQ ID NO: 852759 - RNA, 20 nt, Mycobacterium avium subsp. paratuberculosis
ggcgcgucgguaaucggcgg

SEQ ID NO: 852760 - RNA, 23 nt, Mycobacterium avium subsp. paratuberculosis
ggcgcgucguacaccucggucgg

SEQ ID NO: 852761 - RNA, 14 nt, Mycobacterium avium subsp. paratuberculosis
ggcgcgucguccga

SEQ ID NO: 852762 - RNA, 22 nt, Mycobacterium avium subsp. paratuberculosis
ggcgcggcggcaaccagcuccg

SEQ ID NO: 852763 - RNA, 15 nt, Mycobacterium avium subsp. paratuberculosis
ggcgcggcggccggc

SEQ ID NO: 852764 - RNA, 17 nt, Mycobacterium avium subsp. paratuberculosis
ggcgcggcggccggcca

SEQ ID NO: 852765 - RNA, 22 nt, Mycobacterium avium subsp. paratuberculosis
ggcgcggcggccggccagcgcg

SEQ ID NO: 852766 - RNA, 16 nt, Mycobacterium avium subsp. paratuberculosis
ggcgcggcggcgacgu

SEQ ID NO: 852767 - RNA, 15 nt, Mycobacterium avium subsp. paratuberculosis
ggcgcggcggcgccg

SEQ ID NO: 852768 - RNA, 16 nt, Mycobacterium avium subsp. paratuberculosis
ggcgcggcggcgccgc

SEQ ID NO: 852769 - RNA, 19 nt, Mycobacterium avium subsp. paratuberculosis
ggcgcggcucacgacuccu

SEQ ID NO: 852770 - RNA, 20 nt, Mycobacterium avium subsp. paratuberculosis
ggcgcggcguagccgccggu

SEQ ID NO: 852771 - RNA, 14 nt, Mycobacterium avium subsp. paratuberculosis
ggcgcggcgcaccg

SEQ ID NO: 852772 - RNA, 17 nt, Mycobacterium avium subsp. paratuberculosis
ggcgcggcgcaccgagu

SEQ ID NO: 852773 - RNA, 17 nt, Mycobacterium avium subsp. paratuberculosis
ggcgcggcgcagcgcga

SEQ ID NO: 852774 - RNA, 14 nt, Mycobacterium avium subsp. paratuberculosis
ggcgcggcgaaucg

SEQ ID NO: 852775 - RNA, 13 nt, Mycobacterium avium subsp. paratuberculosis
ggcgcggcgacgu

SEQ ID NO: 852776 - RNA, 15 nt, Mycobacterium avium subsp. paratuberculosis
ggcgcggcgacguga

SEQ ID NO: 852777 - RNA, 20 nt, Mycobacterium avium subsp. paratuberculosis
ggcgcggccggugcgcguca

SEQ ID NO: 852778 - RNA, 17 nt, Mycobacterium avium subsp. paratuberculosis
ggcgcggccggccgaca

SEQ ID NO: 852779 - RNA, 16 nt, Mycobacterium avium subsp. paratuberculosis
ggcgcggccgcccagc

SEQ ID NO: 852780 - RNA, 22 nt, Mycobacterium avium subsp. paratuberculosis
ggcgcggccgcccagcccgcgc

SEQ ID NO: 852781 - RNA, 13 nt, Mycobacterium avium subsp. paratuberculosis
ggcgcggccaccc

SEQ ID NO: 852782 - RNA, 13 nt, Mycobacterium avium subsp. paratuberculosis
ggcgcggcccggc

SEQ ID NO: 852783 - RNA, 16 nt, Mycobacterium avium subsp. paratuberculosis
ggcgcggcccggcccg

SEQ ID NO: 852784 - RNA, 18 nt, Mycobacterium avium subsp. paratuberculosis
ggcgcggcccggcccgcu

SEQ ID NO: 852785 - RNA, 22 nt, Mycobacterium avium subsp. paratuberculosis
ggcgcggcccggcccgcuggcc

SEQ ID NO: 852786 - RNA, 13 nt, Mycobacterium avium subsp. paratuberculosis
ggcgcggccagcg

SEQ ID NO: 852787 - RNA, 15 nt, Mycobacterium avium subsp. paratuberculosis
ggcgcggccagcgcg

SEQ ID NO: 852788 - RNA, 14 nt, Mycobacterium avium subsp. paratuberculosis
ggcgcggccagcug

SEQ ID NO: 852789 - RNA, 15 nt, Mycobacterium avium subsp. paratuberculosis
ggcgcggcagggcca

SEQ ID NO: 852790 - RNA, 13 nt, Mycobacterium avium subsp. paratuberculosis
ggcgcgcgccgca

SEQ ID NO: 852791 - RNA, 15 nt, Mycobacterium avium subsp. paratuberculosis
ggcgcgcgccgcagc

SEQ ID NO: 852792 - RNA, 15 nt, Mycobacterium avium subsp. paratuberculosis
ggcgcgcgccagcgu

SEQ ID NO: 852793 - RNA, 20 nt, Mycobacterium avium subsp. paratuberculosis
ggcgcgcgccagcgucugcu

SEQ ID NO: 852794 - RNA, 18 nt, Mycobacterium avium subsp. paratuberculosis
ggcgcgcgauggacagca

SEQ ID NO: 852795 - RNA, 19 nt, Mycobacterium avium subsp. paratuberculosis
ggcgguuuuguugaccguu

SEQ ID NO: 852796 - RNA, 21 nt, Mycobacterium avium subsp. paratuberculosis
ggcguacaccagggugccgcc

SEQ ID NO: 852797 - RNA, 17 nt, Mycobacterium avium subsp. paratuberculosis
ggcguacagcccgcgga

SEQ ID NO: 852798 - RNA, 14 nt, Mycobacterium avium subsp. paratuberculosis
ggcguacaggccgu

SEQ ID NO: 852799 - RNA, 15 nt, Mycobacterium avium subsp. paratuberculosis
ggcguacaggccguc

SEQ ID NO: 852800 - RNA, 17 nt, Mycobacterium avium subsp. paratuberculosis
ggcguaccgcggcggcg

SEQ ID NO: 852801 - RNA, 21 nt, Mycobacterium avium subsp. paratuberculosis
ggcgguuucggugccggccca

SEQ ID NO: 852802 - RNA, 22 nt, Mycobacterium avium subsp. paratuberculosis
ggcgguuucggugccggcccag

SEQ ID NO: 852803 - RNA, 23 nt, Mycobacterium avium subsp. paratuberculosis
ggcgguuucggugccggcccagu

SEQ ID NO: 852804 - RNA, 17 nt, Mycobacterium avium subsp. paratuberculosis
ggcgguuccgguggcgc

SEQ ID NO: 852805 - RNA, 20 nt, Mycobacterium avium subsp. paratuberculosis
ggcgguucgaagcgcagcgu

SEQ ID NO: 852806 - RNA, 19 nt, Mycobacterium avium subsp. paratuberculosis
ggcgguugcucgucggccg

SEQ ID NO: 852807 - RNA, 15 nt, Mycobacterium avium subsp. paratuberculosis
ggcguagucgccggu

SEQ ID NO: 852808 - RNA, 16 nt, Mycobacterium avium subsp. paratuberculosis
ggcguagucggcgcag

SEQ ID NO: 852809 - RNA, 15 nt, Mycobacterium avium subsp. paratuberculosis
ggcguagucgucgau

SEQ ID NO: 852810 - RNA, 13 nt, Mycobacterium avium subsp. paratuberculosis
ggcguagugcgcc

SEQ ID NO: 852811 - RNA, 14 nt, Mycobacterium avium subsp. paratuberculosis
ggcguagugcgccc

SEQ ID NO: 852812 - RNA, 18 nt, Mycobacterium avium subsp. paratuberculosis
ggcguaguucgucgaaca

SEQ ID NO: 852813 - RNA, 15 nt, Mycobacterium avium subsp. paratuberculosis
ggcguaggcggccau

SEQ ID NO: 852814 - RNA, 17 nt, Mycobacterium avium subsp. paratuberculosis
ggcguagcgggucagcu

SEQ ID NO: 852815 - RNA, 23 nt, Mycobacterium avium subsp. paratuberculosis
ggcguagaucugcacgcuguugg

SEQ ID NO: 852816 - RNA, 19 nt, Mycobacterium avium subsp. paratuberculosis
ggcguagaccagcgacgcc

SEQ ID NO: 852817 - RNA, 17 nt, Mycobacterium avium subsp. paratuberculosis
ggcguagaggugcagcg

SEQ ID NO: 852818 - RNA, 22 nt, Mycobacterium avium subsp. paratuberculosis
ggcguagaggugcagcgggcug

SEQ ID NO: 852819 - RNA, 16 nt, Mycobacterium avium subsp. paratuberculosis
ggcguacugcgcgacc

SEQ ID NO: 852820 - RNA, 14 nt, Mycobacterium avium subsp. paratuberculosis
ggcguacugcucgg

SEQ ID NO: 852821 - RNA, 21 nt, Mycobacterium avium subsp. paratuberculosis
ggcguacugcucggcgcggcu

SEQ ID NO: 852822 - RNA, 20 nt, Mycobacterium avium subsp. paratuberculosis
ggcguacgcgcugccgacga

SEQ ID NO: 852823 - RNA, 20 nt, Mycobacterium avium subsp. paratuberculosis
ggcguacgacaucucgacgg

SEQ ID NO: 852824 - RNA, 22 nt, Mycobacterium avium subsp. paratuberculosis
ggcguacgacaucucgacggug

SEQ ID NO: 852825 - RNA, 15 nt, Mycobacterium avium subsp. paratuberculosis
ggcgguggccucggg

SEQ ID NO: 852826 - RNA, 19 nt, Mycobacterium avium subsp. paratuberculosis
ggcggugguccgcgcgacc

SEQ ID NO: 852827 - RNA, 12 nt, Mycobacterium avium subsp. paratuberculosis
ggcgguggugcc

SEQ ID NO: 852828 - RNA, 18 nt, Mycobacterium avium subsp. paratuberculosis
ggcggugguugggguugg

SEQ ID NO: 852829 - RNA, 15 nt, Mycobacterium avium subsp. paratuberculosis
ggcggugucggugcc

SEQ ID NO: 852830 - RNA, 17 nt, Mycobacterium avium subsp. paratuberculosis
ggcggugucggugccca

SEQ ID NO: 852831 - RNA, 20 nt, Mycobacterium avium subsp. paratuberculosis
ggcggugucggugcccaggu

SEQ ID NO: 852832 - RNA, 21 nt, Mycobacterium avium subsp. paratuberculosis
ggcggugucggugccgagcac

SEQ ID NO: 852833 - RNA, 16 nt, Mycobacterium avium subsp. paratuberculosis
ggcggugucggcggca

SEQ ID NO: 852834 - RNA, 22 nt, Mycobacterium avium subsp. paratuberculosis
ggcgguguucgagggcgcggcg

SEQ ID NO: 852835 - RNA, 13 nt, Mycobacterium avium subsp. paratuberculosis
ggcggugggcgca

SEQ ID NO: 852836 - RNA, 22 nt, Mycobacterium avium subsp. paratuberculosis
ggcgguggggccgaagccgaca

SEQ ID NO: 852837 - RNA, 18 nt, Mycobacterium avium subsp. paratuberculosis
ggcgguggccugcccggc

SEQ ID NO: 852838 - RNA, 20 nt, Mycobacterium avium subsp. paratuberculosis
ggcgguggccugcccggcgg

SEQ ID NO: 852839 - RNA, 22 nt, Mycobacterium avium subsp. paratuberculosis
ggcgguggcgcacaacccggac

SEQ ID NO: 852840 - RNA, 13 nt, Mycobacterium avium subsp. paratuberculosis
ggcgguggcgccg

SEQ ID NO: 852841 - RNA, 14 nt, Mycobacterium avium subsp. paratuberculosis
ggcgguggcgccgg

SEQ ID NO: 852842 - RNA, 12 nt, Mycobacterium avium subsp. paratuberculosis
ggcgguggcgua

SEQ ID NO: 852843 - RNA, 15 nt, Mycobacterium avium subsp. paratuberculosis
ggcgguggccgaacc

SEQ ID NO: 852844 - RNA, 16 nt, Mycobacterium avium subsp. paratuberculosis
ggcgguggccacggcg

SEQ ID NO: 852845 - RNA, 18 nt, Mycobacterium avium subsp. paratuberculosis
ggcggugcgcagccgcug

SEQ ID NO: 852846 - RNA, 14 nt, Mycobacterium avium subsp. paratuberculosis
ggcggugcggcggg

SEQ ID NO: 852847 - RNA, 21 nt, Mycobacterium avium subsp. paratuberculosis
ggcggugcggucgcgcagccg

SEQ ID NO: 852848 - RNA, 14 nt, Mycobacterium avium subsp. paratuberculosis
ggcggugcucgcgc

SEQ ID NO: 852849 - RNA, 23 nt, Mycobacterium avium subsp. paratuberculosis
ggcggugcucucgucgucggcgg

SEQ ID NO: 852850 - RNA, 14 nt, Mycobacterium avium subsp. paratuberculosis
ggcggugcgucggg

SEQ ID NO: 852851 - RNA, 16 nt, Mycobacterium avium subsp. paratuberculosis
ggcggugccgagcccg

SEQ ID NO: 852852 - RNA, 19 nt, Mycobacterium avium subsp. paratuberculosis
ggcggugccgagcccgccg

SEQ ID NO: 852853 - RNA, 16 nt, Mycobacterium avium subsp. paratuberculosis
ggcggugccggccaga

SEQ ID NO: 852854 - RNA, 21 nt, Mycobacterium avium subsp. paratuberculosis
ggcggugccguccucggccgc

SEQ ID NO: 852855 - RNA, 22 nt, Mycobacterium avium subsp. paratuberculosis
ggcggugaccggaucggccagc

SEQ ID NO: 852856 - RNA, 23 nt, Mycobacterium avium subsp. paratuberculosis
ggcggugacguuccagccgugcu

SEQ ID NO: 852857 - RNA, 20 nt, Mycobacterium avium subsp. paratuberculosis
ggcggugagccgccacagcg

SEQ ID NO: 852858 - RNA, 22 nt, Mycobacterium avium subsp. paratuberculosis
ggcggugauccgcccggcccgc

SEQ ID NO: 852859 - RNA, 23 nt, Mycobacterium avium subsp. paratuberculosis
ggcggugauccgcccggcccgca

SEQ ID NO: 852860 - RNA, 20 nt, Mycobacterium avium subsp. paratuberculosis
ggcggugacgaacccgccgc

SEQ ID NO: 852861 - RNA, 14 nt, Mycobacterium avium subsp. paratuberculosis
ggcggugcagccgg

SEQ ID NO: 852862 - RNA, 15 nt, Mycobacterium avium subsp. paratuberculosis
ggcggugaccacgcc

SEQ ID NO: 852863 - RNA, 16 nt, Mycobacterium avium subsp. paratuberculosis
ggcggucuuggcggcc

SEQ ID NO: 852864 - RNA, 22 nt, Mycobacterium avium subsp. paratuberculosis
ggcggucuucuuggccgcgccg

SEQ ID NO: 852865 - RNA, 23 nt, Mycobacterium avium subsp. paratuberculosis
ggcggucuucuuggccgcgccgc

SEQ ID NO: 852866 - RNA, 21 nt, Mycobacterium avium subsp. paratuberculosis
ggcggucugcgcccgaucggc

SEQ ID NO: 852867 - RNA, 20 nt, Mycobacterium avium subsp. paratuberculosis
ggcggucgcgucgucggcgg

SEQ ID NO: 852868 - RNA, 20 nt, Mycobacterium avium subsp. paratuberculosis
ggcggucgugcggcugccca

SEQ ID NO: 852869 - RNA, 23 nt, Mycobacterium avium subsp. paratuberculosis
ggcggucggcauagcgccgcucg

SEQ ID NO: 852870 - RNA, 12 nt, Mycobacterium avium subsp. paratuberculosis
ggcggucggcgc

SEQ ID NO: 852871 - RNA, 13 nt, Mycobacterium avium subsp. paratuberculosis
ggcggucggcgcc

SEQ ID NO: 852872 - RNA, 14 nt, Mycobacterium avium subsp. paratuberculosis
ggcggucggcgccg

SEQ ID NO: 852873 - RNA, 20 nt, Mycobacterium avium subsp. paratuberculosis
ggcggguugcugagccgccg

SEQ ID NO: 852874 - RNA, 19 nt, Mycobacterium avium subsp. paratuberculosis
ggcggguuggccgucgaac

SEQ ID NO: 852875 - RNA, 20 nt, Mycobacterium avium subsp. paratuberculosis
ggcggguuggucccgaucac

SEQ ID NO: 852876 - RNA, 16 nt, Mycobacterium avium subsp. paratuberculosis
ggcggguuggugucga

SEQ ID NO: 852877 - RNA, 17 nt, Mycobacterium avium subsp. paratuberculosis
ggcgguaccgccgaucg

SEQ ID NO: 852878 - RNA, 22 nt, Mycobacterium avium subsp. paratuberculosis
ggcggucaccaaggcgauuucg

SEQ ID NO: 852879 - RNA, 16 nt, Mycobacterium avium subsp. paratuberculosis
ggcgguaugcccgggc

SEQ ID NO: 852880 - RNA, 20 nt, Mycobacterium avium subsp. paratuberculosis
ggcgguaugcccgggccguc

SEQ ID NO: 852881 - RNA, 18 nt, Mycobacterium avium subsp. paratuberculosis
ggcgguagcggcagaugg

SEQ ID NO: 852882 - RNA, 15 nt, Mycobacterium avium subsp. paratuberculosis
ggcgguacgcgccgc

SEQ ID NO: 852883 - RNA, 16 nt, Mycobacterium avium subsp. paratuberculosis
ggcgguacgcgccgcg

SEQ ID NO: 852884 - RNA, 22 nt, Mycobacterium avium subsp. paratuberculosis
ggcgguacgcgccgcgcgcccu

SEQ ID NO: 852885 - RNA, 20 nt, Mycobacterium avium subsp. paratuberculosis
ggcggucagcauggcgauga

SEQ ID NO: 852886 - RNA, 22 nt, Mycobacterium avium subsp. paratuberculosis
ggcggucagcauggcgaugacg

SEQ ID NO: 852887 - RNA, 14 nt, Mycobacterium avium subsp. paratuberculosis
ggcggucagcgggu

SEQ ID NO: 852888 - RNA, 14 nt, Mycobacterium avium subsp. paratuberculosis
ggcggucaggccgu

SEQ ID NO: 852889 - RNA, 15 nt, Mycobacterium avium subsp. paratuberculosis
ggcgguccaccacca

SEQ ID NO: 852890 - RNA, 17 nt, Mycobacterium avium subsp. paratuberculosis
ggcgguccaccaccaca

SEQ ID NO: 852891 - RNA, 22 nt, Mycobacterium avium subsp. paratuberculosis
ggcgguccaccaccacacccgc

SEQ ID NO: 852892 - RNA, 17 nt, Mycobacterium avium subsp. paratuberculosis
ggcgguccaccgacgcc

SEQ ID NO: 852893 - RNA, 18 nt, Mycobacterium avium subsp. paratuberculosis
ggcgguccaccgacgcca

SEQ ID NO: 852894 - RNA, 20 nt, Mycobacterium avium subsp. paratuberculosis
ggcgguccaguacaccgcga

SEQ ID NO: 852895 - RNA, 14 nt, Mycobacterium avium subsp. paratuberculosis
ggcggucccgugcg

SEQ ID NO: 852896 - RNA, 16 nt, Mycobacterium avium subsp. paratuberculosis
ggcggucccgugcgcc

SEQ ID NO: 852897 - RNA, 21 nt, Mycobacterium avium subsp. paratuberculosis
ggcggucccgugcgccgccca

SEQ ID NO: 852898 - RNA, 18 nt, Mycobacterium avium subsp. paratuberculosis
ggcgguccugcggcgaca

SEQ ID NO: 852899 - RNA, 20 nt, Mycobacterium avium subsp. paratuberculosis
ggcggucgccacucgggcgg

SEQ ID NO: 852900 - RNA, 14 nt, Mycobacterium avium subsp. paratuberculosis
ggcggucgccagcg

SEQ ID NO: 852901 - RNA, 19 nt, Mycobacterium avium subsp. paratuberculosis
ggcggucgcgcagccgccg

SEQ ID NO: 852902 - RNA, 13 nt, Mycobacterium avium subsp. paratuberculosis
ggcggucgcgcca

SEQ ID NO: 852903 - RNA, 14 nt, Mycobacterium avium subsp. paratuberculosis
ggcggucgcgccag

SEQ ID NO: 852904 - RNA, 15 nt, Mycobacterium avium subsp. paratuberculosis
ggcggucgcgccaga

SEQ ID NO: 852905 - RNA, 17 nt, Mycobacterium avium subsp. paratuberculosis
ggcggucgcugaccccg

SEQ ID NO: 852906 - RNA, 21 nt, Mycobacterium avium subsp. paratuberculosis
ggcggucgcugaccccgcucg

SEQ ID NO: 852907 - RNA, 23 nt, Mycobacterium avium subsp. paratuberculosis
ggcggucgcugcagcggcggcca

SEQ ID NO: 852908 - RNA, 15 nt, Mycobacterium avium subsp. paratuberculosis
ggcgguccgacaccg

SEQ ID NO: 852909 - RNA, 13 nt, Mycobacterium avium subsp. paratuberculosis
ggcgguccgccgc

SEQ ID NO: 852910 - RNA, 14 nt, Mycobacterium avium subsp. paratuberculosis
ggcgguccgccgca

SEQ ID NO: 852911 - RNA, 23 nt, Mycobacterium avium subsp. paratuberculosis
ggcgguccgccgcagcggcgccg

SEQ ID NO: 852912 - RNA, 22 nt, Mycobacterium avium subsp. paratuberculosis
ggcgguccgcuccaccagcgcg

SEQ ID NO: 852913 - RNA, 12 nt, Mycobacterium avium subsp. paratuberculosis
ggcggucgaacg

SEQ ID NO: 852914 - RNA, 21 nt, Mycobacterium avium subsp. paratuberculosis
ggcggucgaacgcggcgccga

SEQ ID NO: 852915 - RNA, 23 nt, Mycobacterium avium subsp. paratuberculosis
ggcggucgaacgcggcgccgacg

SEQ ID NO: 852916 - RNA, 23 nt, Mycobacterium avium subsp. paratuberculosis
ggcgggagcuaggcggccgggcg

SEQ ID NO: 852917 - RNA, 20 nt, Mycobacterium avium subsp. paratuberculosis
ggcgggacgaaugucucgau

SEQ ID NO: 852918 - RNA, 14 nt, Mycobacterium avium subsp. paratuberculosis
ggcgggacccgcga

SEQ ID NO: 852919 - RNA, 16 nt, Mycobacterium avium subsp. paratuberculosis
ggcgggacccgcgacc

SEQ ID NO: 852920 - RNA, 16 nt, Mycobacterium avium subsp. paratuberculosis
ggcgggcacccgggcg

SEQ ID NO: 852921 - RNA, 19 nt, Mycobacterium avium subsp. paratuberculosis
ggcgggcaccucgaugccg

SEQ ID NO: 852922 - RNA, 24 nt, Mycobacterium avium subsp. paratuberculosis
ggcgggcaccucgaugccgugccg

SEQ ID NO: 852923 - RNA, 14 nt, Mycobacterium avium subsp. paratuberculosis
ggcgggcacgucgc

SEQ ID NO: 852924 - RNA, 18 nt, Mycobacterium avium subsp. paratuberculosis
ggcgggaucgcggcgguc

SEQ ID NO: 852925 - RNA, 16 nt, Mycobacterium avium subsp. paratuberculosis
ggcgggaucggaccgc

SEQ ID NO: 852926 - RNA, 18 nt, Mycobacterium avium subsp. paratuberculosis
ggcgggauggguggucac

SEQ ID NO: 852927 - RNA, 17 nt, Mycobacterium avium subsp. paratuberculosis
ggcgggcgggcggggga

SEQ ID NO: 852928 - RNA, 16 nt, Mycobacterium avium subsp. paratuberculosis
ggcgggcggcggcugg

SEQ ID NO: 852929 - RNA, 14 nt, Mycobacterium avium subsp. paratuberculosis
ggcgggcgcguuga

SEQ ID NO: 852930 - RNA, 23 nt, Mycobacterium avium subsp. paratuberculosis
ggcgggcgcguugaugccgugcg

SEQ ID NO: 852931 - RNA, 15 nt, Mycobacterium avium subsp. paratuberculosis
ggcgggcggcccgca

SEQ ID NO: 852932 - RNA, 17 nt, Mycobacterium avium subsp. paratuberculosis
ggcgggcggcccgcacg

SEQ ID NO: 852933 - RNA, 20 nt, Mycobacterium avium subsp. paratuberculosis
ggcgggcgcgccggcgcgca

SEQ ID NO: 852934 - RNA, 23 nt, Mycobacterium avium subsp. paratuberculosis
ggcgggcgcgcgccucgcguacc

SEQ ID NO: 852935 - RNA, 15 nt, Mycobacterium avium subsp. paratuberculosis
ggcgggcgccggucg

SEQ ID NO: 852936 - RNA, 23 nt, Mycobacterium avium subsp. paratuberculosis
ggcgggcaggcccgagcccgacg

SEQ ID NO: 852937 - RNA, 21 nt, Mycobacterium avium subsp. paratuberculosis
ggcgggagccggcggcggugc

SEQ ID NO: 852938 - RNA, 14 nt, Mycobacterium avium subsp. paratuberculosis
ggcgggcagcacca

SEQ ID NO: 852939 - RNA, 16 nt, Mycobacterium avium subsp. paratuberculosis
ggcggggaugcccggg

SEQ ID NO: 852940 - RNA, 17 nt, Mycobacterium avium subsp. paratuberculosis
ggcggggcaugguguca

SEQ ID NO: 852941 - RNA, 15 nt, Mycobacterium avium subsp. paratuberculosis
ggcggggcgccgaca

SEQ ID NO: 852942 - RNA, 14 nt, Mycobacterium avium subsp. paratuberculosis
ggcggggccgguga

SEQ ID NO: 852943 - RNA, 20 nt, Mycobacterium avium subsp. paratuberculosis
ggcggggccuccaccagcgg

SEQ ID NO: 852944 - RNA, 23 nt, Mycobacterium avium subsp. paratuberculosis
ggcggggccuccaccagcggcgc

SEQ ID NO: 852945 - RNA, 22 nt, Mycobacterium avium subsp. paratuberculosis
ggcgggcucccucgucgcuacc

SEQ ID NO: 852946 - RNA, 15 nt, Mycobacterium avium subsp. paratuberculosis
ggcgggcugcgggca

SEQ ID NO: 852947 - RNA, 17 nt, Mycobacterium avium subsp. paratuberculosis
ggcgggcgucacgucca

SEQ ID NO: 852948 - RNA, 19 nt, Mycobacterium avium subsp. paratuberculosis
ggcgggcguccugcgggga

SEQ ID NO: 852949 - RNA, 20 nt, Mycobacterium avium subsp. paratuberculosis
ggcgggcucgccggcccgac

SEQ ID NO: 852950 - RNA, 21 nt, Mycobacterium avium subsp. paratuberculosis
ggcgggcucgccggcccgacc

SEQ ID NO: 852951 - RNA, 13 nt, Mycobacterium avium subsp. paratuberculosis
ggcgggcucgcgc

SEQ ID NO: 852952 - RNA, 13 nt, Mycobacterium avium subsp. paratuberculosis
ggcggguggcgau

SEQ ID NO: 852953 - RNA, 15 nt, Mycobacterium avium subsp. paratuberculosis
ggcggguggcgauga

SEQ ID NO: 852954 - RNA, 13 nt, Mycobacterium avium subsp. paratuberculosis
ggcgggucgucga

SEQ ID NO: 852955 - RNA, 22 nt, Mycobacterium avium subsp. paratuberculosis
ggcgggucugugaccacgguca

SEQ ID NO: 852956 - RNA, 20 nt, Mycobacterium avium subsp. paratuberculosis
ggcgggugaucccgaugccg

SEQ ID NO: 852957 - RNA, 16 nt, Mycobacterium avium subsp. paratuberculosis
ggcggguacagccgca

SEQ ID NO: 852958 - RNA, 22 nt, Mycobacterium avium subsp. paratuberculosis
ggcggguagaaccagcccggcc

SEQ ID NO: 852959 - RNA, 21 nt, Mycobacterium avium subsp. paratuberculosis
ggcggguaggcgccgaugccc

SEQ ID NO: 852960 - RNA, 21 nt, Mycobacterium avium subsp. paratuberculosis
ggcggguaggcgucgcgcagc

SEQ ID NO: 852961 - RNA, 21 nt, Mycobacterium avium subsp. paratuberculosis
ggcggguaugucggcgacccg

SEQ ID NO: 852962 - RNA, 17 nt, Mycobacterium avium subsp. paratuberculosis
ggcgggucagcacccgc

SEQ ID NO: 852963 - RNA, 19 nt, Mycobacterium avium subsp. paratuberculosis
ggcgggguuguagaacgac

SEQ ID NO: 852964 - RNA, 12 nt, Mycobacterium avium subsp. paratuberculosis
ggcggggucuca

SEQ ID NO: 852965 - RNA, 16 nt, Mycobacterium avium subsp. paratuberculosis
ggcggggugacgguca

SEQ ID NO: 852966 - RNA, 18 nt, Mycobacterium avium subsp. paratuberculosis
ggcgggguuccgucgaac

SEQ ID NO: 852967 - RNA, 14 nt, Mycobacterium avium subsp. paratuberculosis
ggcggggcgucgcc

SEQ ID NO: 852968 - RNA, 17 nt, Mycobacterium avium subsp. paratuberculosis
ggcgggggagccgugca

SEQ ID NO: 852969 - RNA, 16 nt, Mycobacterium avium subsp. paratuberculosis
ggcgggggauccgccu

SEQ ID NO: 852970 - RNA, 15 nt, Mycobacterium avium subsp. paratuberculosis
ggcgggggcgggccc

SEQ ID NO: 852971 - RNA, 15 nt, Mycobacterium avium subsp. paratuberculosis
ggcgggggcugucca

SEQ ID NO: 852972 - RNA, 18 nt, Mycobacterium avium subsp. paratuberculosis
ggcggggguucgacguca

SEQ ID NO: 852973 - RNA, 23 nt, Mycobacterium avium subsp. paratuberculosis
ggcggggguucguugcgccgcca

SEQ ID NO: 852974 - RNA, 22 nt, Mycobacterium avium subsp. paratuberculosis
ggcggauauagccgacgggauc

SEQ ID NO: 852975 - RNA, 23 nt, Mycobacterium avium subsp. paratuberculosis
ggcggcaagcccuuuggcggcca

SEQ ID NO: 852976 - RNA, 24 nt, Mycobacterium avium subsp. paratuberculosis
ggcggcaagcccuuuggcggccag

SEQ ID NO: 852977 - RNA, 22 nt, Mycobacterium avium subsp. paratuberculosis
ggcggcaaagcguugccgcgcg

SEQ ID NO: 852978 - RNA, 13 nt, Mycobacterium avium subsp. paratuberculosis
ggcggcaaccagc

SEQ ID NO: 852979 - RNA, 14 nt, Mycobacterium avium subsp. paratuberculosis
ggcggcaaccagcu

SEQ ID NO: 852980 - RNA, 22 nt, Mycobacterium avium subsp. paratuberculosis
ggcggcaccgcggcucggucgc

SEQ ID NO: 852981 - RNA, 13 nt, Mycobacterium avium subsp. paratuberculosis
ggcggcacccagg

SEQ ID NO: 852982 - RNA, 14 nt, Mycobacterium avium subsp. paratuberculosis
ggcggcaccgaucg

SEQ ID NO: 852983 - RNA, 16 nt, Mycobacterium avium subsp. paratuberculosis
ggcggcaccgcccggg

SEQ ID NO: 852984 - RNA, 17 nt, Mycobacterium avium subsp. paratuberculosis
ggcggcaccgcccgggu

SEQ ID NO: 852985 - RNA, 13 nt, Mycobacterium avium subsp. paratuberculosis
ggcggcaccgccg

SEQ ID NO: 852986 - RNA, 12 nt, Mycobacterium avium subsp. paratuberculosis
ggcggcacaccg

SEQ ID NO: 852987 - RNA, 15 nt, Mycobacterium avium subsp. paratuberculosis
ggcggcacaccgcgc

SEQ ID NO: 852988 - RNA, 13 nt, Mycobacterium avium subsp. paratuberculosis
ggcggcaccaccc

SEQ ID NO: 852989 - RNA, 14 nt, Mycobacterium avium subsp. paratuberculosis
ggcggcaccacccg

SEQ ID NO: 852990 - RNA, 15 nt, Mycobacterium avium subsp. paratuberculosis
ggcggcaccacccgc

SEQ ID NO: 852991 - RNA, 20 nt, Mycobacterium avium subsp. paratuberculosis
ggcggcaccacccgcggccg

SEQ ID NO: 852992 - RNA, 12 nt, Mycobacterium avium subsp. paratuberculosis
ggcggccagcgc

SEQ ID NO: 852993 - RNA, 20 nt, Mycobacterium avium subsp. paratuberculosis
ggcggccagcgcccgcgggu

SEQ ID NO: 852994 - RNA, 21 nt, Mycobacterium avium subsp. paratuberculosis
ggcggccagcgcccgcgggug

SEQ ID NO: 852995 - RNA, 16 nt, Mycobacterium avium subsp. paratuberculosis
ggcggccagcgcgacg

SEQ ID NO: 852996 - RNA, 23 nt, Mycobacterium avium subsp. paratuberculosis
ggcggccagcgagaagucgcuca

SEQ ID NO: 852997 - RNA, 16 nt, Mycobacterium avium subsp. paratuberculosis
ggcggccagccgcgcg

SEQ ID NO: 852998 - RNA, 21 nt, Mycobacterium avium subsp. paratuberculosis
ggcggccagccgcucccggcg

SEQ ID NO: 852999 - RNA, 17 nt, Mycobacterium avium subsp. paratuberculosis
ggcggccaccucgccgc

SEQ ID NO: 853000 - RNA, 16 nt, Mycobacterium avium subsp. paratuberculosis
ggcggccaccucggcg

SEQ ID NO: 853001 - RNA, 16 nt, Mycobacterium avium subsp. paratuberculosis
ggcggccacgacggcg

SEQ ID NO: 853002 - RNA, 23 nt, Mycobacterium avium subsp. paratuberculosis
ggcggccacgacggcgcuggccg

SEQ ID NO: 853003 - RNA, 14 nt, Mycobacterium avium subsp. paratuberculosis
ggcggccacgaucg

SEQ ID NO: 853004 - RNA, 17 nt, Mycobacterium avium subsp. paratuberculosis
ggcggccacgaucgcgg

SEQ ID NO: 853005 - RNA, 20 nt, Mycobacterium avium subsp. paratuberculosis
ggcggccacgaucgcggcca

SEQ ID NO: 853006 - RNA, 22 nt, Mycobacterium avium subsp. paratuberculosis
ggcggccacgaucgcggccagc

SEQ ID NO: 853007 - RNA, 14 nt, Mycobacterium avium subsp. paratuberculosis
ggcggccagcagca

SEQ ID NO: 853008 - RNA, 11 nt, Mycobacterium avium subsp. paratuberculosis
ggcggccacca

SEQ ID NO: 853009 - RNA, 18 nt, Mycobacterium avium subsp. paratuberculosis
ggcggccaccaacggcag

SEQ ID NO: 853010 - RNA, 21 nt, Mycobacterium avium subsp. paratuberculosis
ggcggcauguucgaugcgguc

SEQ ID NO: 853011 - RNA, 13 nt, Mycobacterium avium subsp. paratuberculosis
ggcggccaccagc

SEQ ID NO: 853012 - RNA, 12 nt, Mycobacterium avium subsp. paratuberculosis
ggcggccaccgc

SEQ ID NO: 853013 - RNA, 14 nt, Mycobacterium avium subsp. paratuberculosis
ggcggccaccgcgc

SEQ ID NO: 853014 - RNA, 15 nt, Mycobacterium avium subsp. paratuberculosis
ggcggccaccgcgcc

SEQ ID NO: 853015 - RNA, 19 nt, Mycobacterium avium subsp. paratuberculosis
ggcggccaccgcgccccgg

SEQ ID NO: 853016 - RNA, 17 nt, Mycobacterium avium subsp. paratuberculosis
ggcggccaccgcggcca

SEQ ID NO: 853017 - RNA, 19 nt, Mycobacterium avium subsp. paratuberculosis
ggcggccaacgccucgucg

SEQ ID NO: 853018 - RNA, 20 nt, Mycobacterium avium subsp. paratuberculosis
ggcggccaacgccucgucga

SEQ ID NO: 853019 - RNA, 21 nt, Mycobacterium avium subsp. paratuberculosis
ggcggccaacgccucgucgac

SEQ ID NO: 853020 - RNA, 22 nt, Mycobacterium avium subsp. paratuberculosis
ggcggccaacgccucgucgacc

SEQ ID NO: 853021 - RNA, 14 nt, Mycobacterium avium subsp. paratuberculosis
ggcggccaacgcga

SEQ ID NO: 853022 - RNA, 13 nt, Mycobacterium avium subsp. paratuberculosis
aaggugcccgcau

SEQ ID NO: 853023 - RNA, 14 nt, Mycobacterium avium subsp. paratuberculosis
ggcggaacccgggu

SEQ ID NO: 853024 - RNA, 21 nt, Mycobacterium avium subsp. paratuberculosis
ggcggaacccggguggcccgc

SEQ ID NO: 853025 - RNA, 22 nt, Mycobacterium avium subsp. paratuberculosis
ggcggaaccgggccgcuggccg

SEQ ID NO: 853026 - RNA, 23 nt, Mycobacterium avium subsp. paratuberculosis
ggcggaaccgggccgcuggccgc

SEQ ID NO: 853027 - RNA, 21 nt, Mycobacterium avium subsp. paratuberculosis
ggcgcucaucaggcggccggc

SEQ ID NO: 853028 - RNA, 15 nt, Mycobacterium avium subsp. paratuberculosis
ggcggaaggccgcgc

SEQ ID NO: 853029 - RNA, 17 nt, Mycobacterium avium subsp. paratuberculosis
ggcggaaguagcccgga

SEQ ID NO: 853030 - RNA, 21 nt, Mycobacterium avium subsp. paratuberculosis
ggcggacagccccgagccgcg

SEQ ID NO: 853031 - RNA, 13 nt, Mycobacterium avium subsp. paratuberculosis
ggcggacccagcu

SEQ ID NO: 853032 - RNA, 22 nt, Mycobacterium avium subsp. paratuberculosis
ggcggacccagcuccucggcca

SEQ ID NO: 853033 - RNA, 19 nt, Mycobacterium avium subsp. paratuberculosis
ggcggaauuuucgccguca

SEQ ID NO: 853034 - RNA, 15 nt, Mycobacterium avium subsp. paratuberculosis
ggcggaaucgcaacc

SEQ ID NO: 853035 - RNA, 17 nt, Mycobacterium avium subsp. paratuberculosis
ggcggacggcaccgacg

SEQ ID NO: 853036 - RNA, 17 nt, Mycobacterium avium subsp. paratuberculosis
ggcggacggcgaccucu

SEQ ID NO: 853037 - RNA, 12 nt, Mycobacterium avium subsp. paratuberculosis
ggcggacgggac

SEQ ID NO: 853038 - RNA, 18 nt, Mycobacterium avium subsp. paratuberculosis
ggcggacgggaccacccg

SEQ ID NO: 853039 - RNA, 13 nt, Mycobacterium avium subsp. paratuberculosis
ggcggacgguccc

SEQ ID NO: 853040 - RNA, 20 nt, Mycobacterium avium subsp. paratuberculosis
ggcggacggucccgacgcug

SEQ ID NO: 853041 - RNA, 13 nt, Mycobacterium avium subsp. paratuberculosis
ggcggacucggcg

SEQ ID NO: 853042 - RNA, 22 nt, Mycobacterium avium subsp. paratuberculosis
ggcggacucguuggggccacca

SEQ ID NO: 853043 - RNA, 19 nt, Mycobacterium avium subsp. paratuberculosis
ggcggacugcccgaccgcg

SEQ ID NO: 853044 - RNA, 22 nt, Mycobacterium avium subsp. paratuberculosis
ggcggacugcccgaccgcgccg

SEQ ID NO: 853045 - RNA, 15 nt, Mycobacterium avium subsp. paratuberculosis
ggcggacccgcuccc

SEQ ID NO: 853046 - RNA, 19 nt, Mycobacterium avium subsp. paratuberculosis
ggcggacccggaggcggcg

SEQ ID NO: 853047 - RNA, 16 nt, Mycobacterium avium subsp. paratuberculosis
ggcggaccggcggccg

SEQ ID NO: 853048 - RNA, 18 nt, Mycobacterium avium subsp. paratuberculosis
ggcggaccggcggccgcc

SEQ ID NO: 853049 - RNA, 19 nt, Mycobacterium avium subsp. paratuberculosis
ggcggaccggcggccgcca

SEQ ID NO: 853050 - RNA, 20 nt, Mycobacterium avium subsp. paratuberculosis
ggcggacgauguccgccggc

SEQ ID NO: 853051 - RNA, 14 nt, Mycobacterium avium subsp. paratuberculosis
ggcggacgcggcca

SEQ ID NO: 853052 - RNA, 20 nt, Mycobacterium avium subsp. paratuberculosis
ggcggaggggcccaauaccg

SEQ ID NO: 853053 - RNA, 14 nt, Mycobacterium avium subsp. paratuberculosis
ggcggaggucagcg

SEQ ID NO: 853054 - RNA, 23 nt, Mycobacterium avium subsp. paratuberculosis
ggcggaggucagcggcccgauca

SEQ ID NO: 853055 - RNA, 16 nt, Mycobacterium avium subsp. paratuberculosis
ggcggaggccugcgcg

SEQ ID NO: 853056 - RNA, 13 nt, Mycobacterium avium subsp. paratuberculosis
ggcggcgcugaug

SEQ ID NO: 853057 - RNA, 20 nt, Mycobacterium avium subsp. paratuberculosis
ggcggcgcggcgcagcgcga

SEQ ID NO: 853058 - RNA, 20 nt, Mycobacterium avium subsp. paratuberculosis
ggcggcgcucagcgcggcgg

SEQ ID NO: 853059 - RNA, 21 nt, Mycobacterium avium subsp. paratuberculosis
ggcggcgcucagcgcggcggg

SEQ ID NO: 853060 - RNA, 20 nt, Mycobacterium avium subsp. paratuberculosis
ggcggcgcgugcgccgcggc

SEQ ID NO: 853061 - RNA, 23 nt, Mycobacterium avium subsp. paratuberculosis
ggcggcgcgugcgccgcggcggc

SEQ ID NO: 853062 - RNA, 13 nt, Mycobacterium avium subsp. paratuberculosis
ggcggcgcgcugc

SEQ ID NO: 853063 - RNA, 14 nt, Mycobacterium avium subsp. paratuberculosis
ggcggcgcggccca

SEQ ID NO: 853064 - RNA, 19 nt, Mycobacterium avium subsp. paratuberculosis
ggcggcgcggcccagggcg

SEQ ID NO: 853065 - RNA, 13 nt, Mycobacterium avium subsp. paratuberculosis
ggcggcgcggauc

SEQ ID NO: 853066 - RNA, 13 nt, Mycobacterium avium subsp. paratuberculosis
ggcggcgcggcag

SEQ ID NO: 853067 - RNA, 16 nt, Mycobacterium avium subsp. paratuberculosis
ggcggcgcgccggccg

SEQ ID NO: 853068 - RNA, 12 nt, Mycobacterium avium subsp. paratuberculosis
ggcggcgcgcgc

SEQ ID NO: 853069 - RNA, 13 nt, Mycobacterium avium subsp. paratuberculosis
ggcggcggcccgc

SEQ ID NO: 853070 - RNA, 20 nt, Mycobacterium avium subsp. paratuberculosis
ggcggcggccaccucgccgc

SEQ ID NO: 853071 - RNA, 13 nt, Mycobacterium avium subsp. paratuberculosis
ggcggcggcaccg

SEQ ID NO: 853072 - RNA, 14 nt, Mycobacterium avium subsp. paratuberculosis
ggcggcggcaccga

SEQ ID NO: 853073 - RNA, 15 nt, Mycobacterium avium subsp. paratuberculosis
ggcggcggcccgccg

SEQ ID NO: 853074 - RNA, 16 nt, Mycobacterium avium subsp. paratuberculosis
ggcggcggcccgccgc

SEQ ID NO: 853075 - RNA, 23 nt, Mycobacterium avium subsp. paratuberculosis
ggcggcggcccgccgcgcccggc

SEQ ID NO: 853076 - RNA, 14 nt, Mycobacterium avium subsp. paratuberculosis
ggcggcggcccgcg

SEQ ID NO: 853077 - RNA, 16 nt, Mycobacterium avium subsp. paratuberculosis
ggcggcggcccgcgcg

SEQ ID NO: 853078 - RNA, 22 nt, Mycobacterium avium subsp. paratuberculosis
ggcggcggcccguccgccccgc

SEQ ID NO: 853079 - RNA, 18 nt, Mycobacterium avium subsp. paratuberculosis
ggcggcgcugccccagcc

SEQ ID NO: 853080 - RNA, 18 nt, Mycobacterium avium subsp. paratuberculosis
ggcggcgcuggucggcgg

SEQ ID NO: 853081 - RNA, 22 nt, Mycobacterium avium subsp. paratuberculosis
ggcggcggaccgucggugucga

SEQ ID NO: 853082 - RNA, 15 nt, Mycobacterium avium subsp. paratuberculosis
ggcggcggaucagca

SEQ ID NO: 853083 - RNA, 21 nt, Mycobacterium avium subsp. paratuberculosis
ggcggcggaucagcaccgacg

SEQ ID NO: 853084 - RNA, 17 nt, Mycobacterium avium subsp. paratuberculosis
ggcggcguuggccgccg

SEQ ID NO: 853085 - RNA, 12 nt, Mycobacterium avium subsp. paratuberculosis
ggcggcucgggg

SEQ ID NO: 853086 - RNA, 13 nt, Mycobacterium avium subsp. paratuberculosis
ggcggcucgucca

SEQ ID NO: 853087 - RNA, 18 nt, Mycobacterium avium subsp. paratuberculosis
ggcggcugaaccaccgcg

SEQ ID NO: 853088 - RNA, 21 nt, Mycobacterium avium subsp. paratuberculosis
ggcgggaaaccaccugccgca

SEQ ID NO: 853089 - RNA, 22 nt, Mycobacterium avium subsp. paratuberculosis
ggcggcgugggguucccggccg

SEQ ID NO: 853090 - RNA, 15 nt, Mycobacterium avium subsp. paratuberculosis
ggcggcgugcccgcu

SEQ ID NO: 853091 - RNA, 17 nt, Mycobacterium avium subsp. paratuberculosis
ggcggcgugcccgcucg

SEQ ID NO: 853092 - RNA, 13 nt, Mycobacterium avium subsp. paratuberculosis
ggcggcggcgcgc

SEQ ID NO: 853093 - RNA, 20 nt, Mycobacterium avium subsp. paratuberculosis
ggcggcgugcaccgcccgcg

SEQ ID NO: 853094 - RNA, 22 nt, Mycobacterium avium subsp. paratuberculosis
ggcggcgugcaccgcccgcgcg

SEQ ID NO: 853095 - RNA, 15 nt, Mycobacterium avium subsp. paratuberculosis
ggcggcggcgcgugc

SEQ ID NO: 853096 - RNA, 13 nt, Mycobacterium avium subsp. paratuberculosis
ggcggcggcggca

SEQ ID NO: 853097 - RNA, 14 nt, Mycobacterium avium subsp. paratuberculosis
ggcggcggccuccg

SEQ ID NO: 853098 - RNA, 23 nt, Mycobacterium avium subsp. paratuberculosis
ggcggcgccggccgggcugcgca

SEQ ID NO: 853099 - RNA, 13 nt, Mycobacterium avium subsp. paratuberculosis
ggcggcgcgaucg

SEQ ID NO: 853100 - RNA, 20 nt, Mycobacterium avium subsp. paratuberculosis
ggcggcgcgcacgucaccgc

SEQ ID NO: 853101 - RNA, 12 nt, Mycobacterium avium subsp. paratuberculosis
ggcggcgcgcag

SEQ ID NO: 853102 - RNA, 19 nt, Mycobacterium avium subsp. paratuberculosis
ggcggcgcgcagccggccg

SEQ ID NO: 853103 - RNA, 12 nt, Mycobacterium avium subsp. paratuberculosis
ggcggcgcgcca

SEQ ID NO: 853104 - RNA, 13 nt, Mycobacterium avium subsp. paratuberculosis
ggcggcgcgccag

SEQ ID NO: 853105 - RNA, 15 nt, Mycobacterium avium subsp. paratuberculosis
ggcggcgcgccagcg

SEQ ID NO: 853106 - RNA, 17 nt, Mycobacterium avium subsp. paratuberculosis
ggcggcgccuugccggu

SEQ ID NO: 853107 - RNA, 20 nt, Mycobacterium avium subsp. paratuberculosis
ggcggcgacggcgucggcgg

SEQ ID NO: 853108 - RNA, 13 nt, Mycobacterium avium subsp. paratuberculosis
ggcggcgacgucg

SEQ ID NO: 853109 - RNA, 19 nt, Mycobacterium avium subsp. paratuberculosis
ggcggcgacgucgacggca

SEQ ID NO: 853110 - RNA, 20 nt, Mycobacterium avium subsp. paratuberculosis
ggcggcgacgucgacggcag

SEQ ID NO: 853111 - RNA, 18 nt, Mycobacterium avium subsp. paratuberculosis
ggcggcgacgugaucggc

SEQ ID NO: 853112 - RNA, 23 nt, Mycobacterium avium subsp. paratuberculosis
ggcggcgacgugaucggcggccu

SEQ ID NO: 853113 - RNA, 14 nt, Mycobacterium avium subsp. paratuberculosis
ggcggcgacgugcc

SEQ ID NO: 853114 - RNA, 18 nt, Mycobacterium avium subsp. paratuberculosis
ggcggcgacgugccggcg

SEQ ID NO: 853115 - RNA, 22 nt, Mycobacterium avium subsp. paratuberculosis
ggcggcgagauuggccucggcg

SEQ ID NO: 853116 - RNA, 16 nt, Mycobacterium avium subsp. paratuberculosis
ggcggcgacggcaccg

SEQ ID NO: 853117 - RNA, 14 nt, Mycobacterium avium subsp. paratuberculosis
ggcggcgacggcgu

SEQ ID NO: 853118 - RNA, 12 nt, Mycobacterium avium subsp. paratuberculosis
ggcggcgccgca

SEQ ID NO: 853119 - RNA, 14 nt, Mycobacterium avium subsp. paratuberculosis
ggcggcgccgcggc

SEQ ID NO: 853120 - RNA, 14 nt, Mycobacterium avium subsp. paratuberculosis
ggcggcgccgcggu

SEQ ID NO: 853121 - RNA, 17 nt, Mycobacterium avium subsp. paratuberculosis
ggcggcgccggaggcca

SEQ ID NO: 853122 - RNA, 13 nt, Mycobacterium avium subsp. paratuberculosis
ggcggcgccggca

SEQ ID NO: 853123 - RNA, 17 nt, Mycobacterium avium subsp. paratuberculosis
ggcggcgaagccggccc

SEQ ID NO: 853124 - RNA, 22 nt, Mycobacterium avium subsp. paratuberculosis
ggcggcgaagccggccccgccc

SEQ ID NO: 853125 - RNA, 23 nt, Mycobacterium avium subsp. paratuberculosis
ggcggcgaagccggccccgcccg

SEQ ID NO: 853126 - RNA, 13 nt, Mycobacterium avium subsp. paratuberculosis
ggcggcgaccgcg

SEQ ID NO: 853127 - RNA, 15 nt, Mycobacterium avium subsp. paratuberculosis
ggcggcgaccgcgac

SEQ ID NO: 853128 - RNA, 14 nt, Mycobacterium avium subsp. paratuberculosis
ggcggcgacgaugc

SEQ ID NO: 853129 - RNA, 19 nt, Mycobacterium avium subsp. paratuberculosis
ggcggcgacgaugcggccg

SEQ ID NO: 853130 - RNA, 14 nt, Mycobacterium avium subsp. paratuberculosis
ggcggcgacggcga

SEQ ID NO: 853131 - RNA, 20 nt, Mycobacterium avium subsp. paratuberculosis
ggcggcgacggcgaccacac

SEQ ID NO: 853132 - RNA, 13 nt, Mycobacterium avium subsp. paratuberculosis
ggcggccucggcg

SEQ ID NO: 853133 - RNA, 22 nt, Mycobacterium avium subsp. paratuberculosis
ggcggcgaacaccagcacccag

SEQ ID NO: 853134 - RNA, 23 nt, Mycobacterium avium subsp. paratuberculosis
ggcggcgaacaccagcacccagc

SEQ ID NO: 853135 - RNA, 12 nt, Mycobacterium avium subsp. paratuberculosis
ggcggcgaauac

SEQ ID NO: 853136 - RNA, 18 nt, Mycobacterium avium subsp. paratuberculosis
ggcggcgaaugccugacg

SEQ ID NO: 853137 - RNA, 13 nt, Mycobacterium avium subsp. paratuberculosis
ggcggcgacacgc

SEQ ID NO: 853138 - RNA, 16 nt, Mycobacterium avium subsp. paratuberculosis
ggcggcgacacgccga

SEQ ID NO: 853139 - RNA, 18 nt, Mycobacterium avium subsp. paratuberculosis
ggcggcgacacgccgacg

SEQ ID NO: 853140 - RNA, 14 nt, Mycobacterium avium subsp. paratuberculosis
ggcggccucgccgu

SEQ ID NO: 853141 - RNA, 17 nt, Mycobacterium avium subsp. paratuberculosis
ggcggccucgccgucga

SEQ ID NO: 853142 - RNA, 18 nt, Mycobacterium avium subsp. paratuberculosis
ggcggccgucgcgcacca

SEQ ID NO: 853143 - RNA, 20 nt, Mycobacterium avium subsp. paratuberculosis
ggcggccgucuugcccggcg

SEQ ID NO: 853144 - RNA, 14 nt, Mycobacterium avium subsp. paratuberculosis
ggcggccguggucg

SEQ ID NO: 853145 - RNA, 17 nt, Mycobacterium avium subsp. paratuberculosis
ggcggccguggucgaug

SEQ ID NO: 853146 - RNA, 23 nt, Mycobacterium avium subsp. paratuberculosis
ggcggccgggucgagcgcgccga

SEQ ID NO: 853147 - RNA, 14 nt, Mycobacterium avium subsp. paratuberculosis
ggcggccggccccg

SEQ ID NO: 853148 - RNA, 22 nt, Mycobacterium avium subsp. paratuberculosis
ggcggccggccccggccgggcg

SEQ ID NO: 853149 - RNA, 20 nt, Mycobacterium avium subsp. paratuberculosis
ggcggccggcccggcccgac

SEQ ID NO: 853150 - RNA, 12 nt, Mycobacterium avium subsp. paratuberculosis
ggcggccggcgc

SEQ ID NO: 853151 - RNA, 15 nt, Mycobacterium avium subsp. paratuberculosis
ggcggccggccagca

SEQ ID NO: 853152 - RNA, 16 nt, Mycobacterium avium subsp. paratuberculosis
ggcggccggagccgac

SEQ ID NO: 853153 - RNA, 23 nt, Mycobacterium avium subsp. paratuberculosis
ggcggccgcgucggcggucgcca

SEQ ID NO: 853154 - RNA, 14 nt, Mycobacterium avium subsp. paratuberculosis
ggcggccggcggca

SEQ ID NO: 853155 - RNA, 20 nt, Mycobacterium avium subsp. paratuberculosis
ggcggccgggaucuggccgg

SEQ ID NO: 853156 - RNA, 21 nt, Mycobacterium avium subsp. paratuberculosis
ggcggccgggaucuggccggu

SEQ ID NO: 853157 - RNA, 23 nt, Mycobacterium avium subsp. paratuberculosis
ggcggccgggaucuggccgguga

SEQ ID NO: 853158 - RNA, 13 nt, Mycobacterium avium subsp. paratuberculosis
ggcggccgggccg

SEQ ID NO: 853159 - RNA, 18 nt, Mycobacterium avium subsp. paratuberculosis
ggcggccgggccgcggcg

SEQ ID NO: 853160 - RNA, 14 nt, Mycobacterium avium subsp. paratuberculosis
ggcggccgggccgg

SEQ ID NO: 853161 - RNA, 17 nt, Mycobacterium avium subsp. paratuberculosis
ggcggccaggccggcga

SEQ ID NO: 853162 - RNA, 19 nt, Mycobacterium avium subsp. paratuberculosis
ggcggccaggccggcgacg

SEQ ID NO: 853163 - RNA, 16 nt, Mycobacterium avium subsp. paratuberculosis
ggcggccaggccggcg

SEQ ID NO: 853164 - RNA, 12 nt, Mycobacterium avium subsp. paratuberculosis
ggcggccagcgu

SEQ ID NO: 853165 - RNA, 14 nt, Mycobacterium avium subsp. paratuberculosis
cgggauggcggcgu

SEQ ID NO: 853166 - RNA, 16 nt, Mycobacterium avium subsp. paratuberculosis
cgggauugccgagcac

SEQ ID NO: 853167 - RNA, 15 nt, Mycobacterium avium subsp. paratuberculosis
cgggauucgcgcacc

SEQ ID NO: 853168 - RNA, 14 nt, Mycobacterium avium subsp. paratuberculosis
cgggauggagccgc

SEQ ID NO: 853169 - RNA, 21 nt, Mycobacterium avium subsp. paratuberculosis
cgggauggagccgcccaugcc

SEQ ID NO: 853170 - RNA, 21 nt, Mycobacterium avium subsp. paratuberculosis
cgggaugucgugggcgugccg

SEQ ID NO: 853171 - RNA, 12 nt, Mycobacterium avium subsp. paratuberculosis
cgggauggugac

SEQ ID NO: 853172 - RNA, 14 nt, Mycobacterium avium subsp. paratuberculosis
cgggauggugacca

SEQ ID NO: 853173 - RNA, 18 nt, Mycobacterium avium subsp. paratuberculosis
cgggauagggcgcgucga

SEQ ID NO: 853174 - RNA, 15 nt, Mycobacterium avium subsp. paratuberculosis
cgggauaguccggca

SEQ ID NO: 853175 - RNA, 18 nt, Mycobacterium avium subsp. paratuberculosis
cgggauaguucgccgccg

SEQ ID NO: 853176 - RNA, 21 nt, Mycobacterium avium subsp. paratuberculosis
cgggauacucguccucccggu

SEQ ID NO: 853177 - RNA, 19 nt, Mycobacterium avium subsp. paratuberculosis
cgggauagagcaccgcgcu

SEQ ID NO: 853178 - RNA, 16 nt, Mycobacterium avium subsp. paratuberculosis
cgggauagccgagcgg

SEQ ID NO: 853179 - RNA, 17 nt, Mycobacterium avium subsp. paratuberculosis
cgggauagccgagcggc

SEQ ID NO: 853180 - RNA, 21 nt, Mycobacterium avium subsp. paratuberculosis
cgggauagccgagcggcgcca

SEQ ID NO: 853181 - RNA, 15 nt, Mycobacterium avium subsp. paratuberculosis
cgggaucacccucgg

SEQ ID NO: 853182 - RNA, 20 nt, Mycobacterium avium subsp. paratuberculosis
cgggaucacccucggcgucc

SEQ ID NO: 853183 - RNA, 23 nt, Mycobacterium avium subsp. paratuberculosis
cgggauaugcgccugcacggugc

SEQ ID NO: 853184 - RNA, 17 nt, Mycobacterium avium subsp. paratuberculosis
cgggauauucgcccagc

SEQ ID NO: 853185 - RNA, 21 nt, Mycobacterium avium subsp. paratuberculosis
cgggauauucgcccagcggca

SEQ ID NO: 853186 - RNA, 17 nt, Mycobacterium avium subsp. paratuberculosis
cgggaucaacacgaacu

SEQ ID NO: 853187 - RNA, 18 nt, Mycobacterium avium subsp. paratuberculosis
cgggaucagccguaccga

SEQ ID NO: 853188 - RNA, 23 nt, Mycobacterium avium subsp. paratuberculosis
cgggaucagguagaggcugucca

SEQ ID NO: 853189 - RNA, 18 nt, Mycobacterium avium subsp. paratuberculosis
aacaugcugcacggggug

SEQ ID NO: 853190 - RNA, 13 nt, Mycobacterium avium subsp. paratuberculosis
aacauggcggcca

SEQ ID NO: 853191 - RNA, 20 nt, Mycobacterium avium subsp. paratuberculosis
cgggauccaggaacggcacc

SEQ ID NO: 853192 - RNA, 13 nt, Mycobacterium avium subsp. paratuberculosis
cgggaucggcggg

SEQ ID NO: 853193 - RNA, 18 nt, Mycobacterium avium subsp. paratuberculosis
cgggaucggcggggcgcg

SEQ ID NO: 853194 - RNA, 20 nt, Mycobacterium avium subsp. paratuberculosis
cgggaucggcggggcgcguu

SEQ ID NO: 853195 - RNA, 14 nt, Mycobacterium avium subsp. paratuberculosis
cgggagccggccag

SEQ ID NO: 853196 - RNA, 15 nt, Mycobacterium avium subsp. paratuberculosis
cgggagccggccagg

SEQ ID NO: 853197 - RNA, 14 nt, Mycobacterium avium subsp. paratuberculosis
cgggagccggcggc

SEQ ID NO: 853198 - RNA, 16 nt, Mycobacterium avium subsp. paratuberculosis
cgggagccggcggcgg

SEQ ID NO: 853199 - RNA, 15 nt, Mycobacterium avium subsp. paratuberculosis
cgggauaccgcgacc

SEQ ID NO: 853200 - RNA, 16 nt, Mycobacterium avium subsp. paratuberculosis
cgggauaccgcgaccg

SEQ ID NO: 853201 - RNA, 15 nt, Mycobacterium avium subsp. paratuberculosis
cgggagacgcugugc

SEQ ID NO: 853202 - RNA, 21 nt, Mycobacterium avium subsp. paratuberculosis
cgggagagcgcgggcaccguc

SEQ ID NO: 853203 - RNA, 19 nt, Mycobacterium avium subsp. paratuberculosis
cgggagcaaggucgucgcg

SEQ ID NO: 853204 - RNA, 20 nt, Mycobacterium avium subsp. paratuberculosis
cgggagcaaggucgucgcgg

SEQ ID NO: 853205 - RNA, 12 nt, Mycobacterium avium subsp. paratuberculosis
cgggagcaucgg

SEQ ID NO: 853206 - RNA, 16 nt, Mycobacterium avium subsp. paratuberculosis
cgggacugggcgauug

SEQ ID NO: 853207 - RNA, 16 nt, Mycobacterium avium subsp. paratuberculosis
cgggacugcagcgcgg

SEQ ID NO: 853208 - RNA, 13 nt, Mycobacterium avium subsp. paratuberculosis
cgggacgucggcg

SEQ ID NO: 853209 - RNA, 19 nt, Mycobacterium avium subsp. paratuberculosis
cgggacgucggcgcgcucg

SEQ ID NO: 853210 - RNA, 20 nt, Mycobacterium avium subsp. paratuberculosis
cgggacgucagcccgcgucg

SEQ ID NO: 853211 - RNA, 16 nt, Mycobacterium avium subsp. paratuberculosis
cgggacguccgcgcga

SEQ ID NO: 853212 - RNA, 16 nt, Mycobacterium avium subsp. paratuberculosis
cgggacguggcucagc

SEQ ID NO: 853213 - RNA, 19 nt, Mycobacterium avium subsp. paratuberculosis
cgggacguggcucagcggc

SEQ ID NO: 853214 - RNA, 22 nt, Mycobacterium avium subsp. paratuberculosis
cgggacguggcucagcggcagg

SEQ ID NO: 853215 - RNA, 12 nt, Mycobacterium avium subsp. paratuberculosis
cgggacggccag

SEQ ID NO: 853216 - RNA, 14 nt, Mycobacterium avium subsp. paratuberculosis
cgggacggccagca

SEQ ID NO: 853217 - RNA, 18 nt, Mycobacterium avium subsp. paratuberculosis
cgggacggccagcagggc

SEQ ID NO: 853218 - RNA, 15 nt, Mycobacterium avium subsp. paratuberculosis
cgggacgggggugcc

SEQ ID NO: 853219 - RNA, 17 nt, Mycobacterium avium subsp. paratuberculosis
cgggacgggggugccga

SEQ ID NO: 853220 - RNA, 18 nt, Mycobacterium avium subsp. paratuberculosis
cgggacgggggugccgac

SEQ ID NO: 853221 - RNA, 20 nt, Mycobacterium avium subsp. paratuberculosis
cgggacgggggugccgaccg

SEQ ID NO: 853222 - RNA, 21 nt, Mycobacterium avium subsp. paratuberculosis
cgggacggguugcaggccacg

SEQ ID NO: 853223 - RNA, 14 nt, Mycobacterium avium subsp. paratuberculosis
cgggaaucacgccc

SEQ ID NO: 853224 - RNA, 24 nt, Mycobacterium avium subsp. paratuberculosis
cgggaaucccacccgcaacgcuga

SEQ ID NO: 853225 - RNA, 14 nt, Mycobacterium avium subsp. paratuberculosis
cgggaaguucacgu

SEQ ID NO: 853226 - RNA, 23 nt, Mycobacterium avium subsp. paratuberculosis
cgggaauggggcccgguccgcug

SEQ ID NO: 853227 - RNA, 15 nt, Mycobacterium avium subsp. paratuberculosis
cgggaauggccgcgc

SEQ ID NO: 853228 - RNA, 17 nt, Mycobacterium avium subsp. paratuberculosis
cgggaauggccgcgccg

SEQ ID NO: 853229 - RNA, 17 nt, Mycobacterium avium subsp. paratuberculosis
cgggaauuggcaccgga

SEQ ID NO: 853230 - RNA, 18 nt, Mycobacterium avium subsp. paratuberculosis
cgggaauuggcaccggac

SEQ ID NO: 853231 - RNA, 21 nt, Mycobacterium avium subsp. paratuberculosis
cgggaauuggcaccggaccgc

SEQ ID NO: 853232 - RNA, 20 nt, Mycobacterium avium subsp. paratuberculosis
cgggacgaaggugcgcacga

SEQ ID NO: 853233 - RNA, 14 nt, Mycobacterium avium subsp. paratuberculosis
cgggacgacggcgc

SEQ ID NO: 853234 - RNA, 18 nt, Mycobacterium avium subsp. paratuberculosis
cgggacgacggcgccgcc

SEQ ID NO: 853235 - RNA, 20 nt, Mycobacterium avium subsp. paratuberculosis
cgggacgaucugcgucaugg

SEQ ID NO: 853236 - RNA, 20 nt, Mycobacterium avium subsp. paratuberculosis
cgggaccugggucugcggcc

SEQ ID NO: 853237 - RNA, 21 nt, Mycobacterium avium subsp. paratuberculosis
cgggaccugggucugcggccg

SEQ ID NO: 853238 - RNA, 16 nt, Mycobacterium avium subsp. paratuberculosis
cgggacgccacggcga

SEQ ID NO: 853239 - RNA, 13 nt, Mycobacterium avium subsp. paratuberculosis
cgggacgcgcaga

SEQ ID NO: 853240 - RNA, 12 nt, Mycobacterium avium subsp. paratuberculosis
cgggacgcgguc

SEQ ID NO: 853241 - RNA, 16 nt, Mycobacterium avium subsp. paratuberculosis
cgggacgcgguccagc

SEQ ID NO: 853242 - RNA, 20 nt, Mycobacterium avium subsp. paratuberculosis
cgggacgccguugacaccgg

SEQ ID NO: 853243 - RNA, 14 nt, Mycobacterium avium subsp. paratuberculosis
cgggacgccugccg

SEQ ID NO: 853244 - RNA, 15 nt, Mycobacterium avium subsp. paratuberculosis
cgggcaucccgccga

SEQ ID NO: 853245 - RNA, 17 nt, Mycobacterium avium subsp. paratuberculosis
cgggcaucccgccgaac

SEQ ID NO: 853246 - RNA, 14 nt, Mycobacterium avium subsp. paratuberculosis
cgggcauccgcccg

SEQ ID NO: 853247 - RNA, 21 nt, Mycobacterium avium subsp. paratuberculosis
cgggcauccggcucagaaggc

SEQ ID NO: 853248 - RNA, 15 nt, Mycobacterium avium subsp. paratuberculosis
cgggcauccgggccg

SEQ ID NO: 853249 - RNA, 18 nt, Mycobacterium avium subsp. paratuberculosis
cgggcauccgggccgccg

SEQ ID NO: 853250 - RNA, 23 nt, Mycobacterium avium subsp. paratuberculosis
cgggcauacugcuugccgucgac

SEQ ID NO: 853251 - RNA, 16 nt, Mycobacterium avium subsp. paratuberculosis
cgggcaucgccgucau

SEQ ID NO: 853252 - RNA, 22 nt, Mycobacterium avium subsp. paratuberculosis
cgggcaucgcugguggccgacg

SEQ ID NO: 853253 - RNA, 23 nt, Mycobacterium avium subsp. paratuberculosis
cgggcaucgcugguggccgacgu

SEQ ID NO: 853254 - RNA, 22 nt, Mycobacterium avium subsp. paratuberculosis
cgggcaucucguugucgucggg

SEQ ID NO: 853255 - RNA, 20 nt, Mycobacterium avium subsp. paratuberculosis
cgggcaucggcuggucggcg

SEQ ID NO: 853256 - RNA, 12 nt, Mycobacterium avium subsp. paratuberculosis
cgggccagcagu

SEQ ID NO: 853257 - RNA, 16 nt, Mycobacterium avium subsp. paratuberculosis
cgggccagcaguucgu

SEQ ID NO: 853258 - RNA, 19 nt, Mycobacterium avium subsp. paratuberculosis
cgggccagcaguucgucca

SEQ ID NO: 853259 - RNA, 21 nt, Mycobacterium avium subsp. paratuberculosis
cgggccagcaguucguccacg

SEQ ID NO: 853260 - RNA, 16 nt, Mycobacterium avium subsp. paratuberculosis
cgggcaguugccggcc

SEQ ID NO: 853261 - RNA, 17 nt, Mycobacterium avium subsp. paratuberculosis
cgggcaguugccggcca

SEQ ID NO: 853262 - RNA, 18 nt, Mycobacterium avium subsp. paratuberculosis
cgggcagugcgcggcguc

SEQ ID NO: 853263 - RNA, 23 nt, Mycobacterium avium subsp. paratuberculosis
cgggcagugcgcggcguccucga

SEQ ID NO: 853264 - RNA, 13 nt, Mycobacterium avium subsp. paratuberculosis
cgggcagcguguc

SEQ ID NO: 853265 - RNA, 17 nt, Mycobacterium avium subsp. paratuberculosis
cgggcagucugccggug

SEQ ID NO: 853266 - RNA, 21 nt, Mycobacterium avium subsp. paratuberculosis
cgggcagugcacgacgaccgc

SEQ ID NO: 853267 - RNA, 22 nt, Mycobacterium avium subsp. paratuberculosis
cgggcagugcacgacgaccgcg

SEQ ID NO: 853268 - RNA, 14 nt, Mycobacterium avium subsp. paratuberculosis
cgggcagugcgcgg

SEQ ID NO: 853269 - RNA, 23 nt, Mycobacterium avium subsp. paratuberculosis
cgggccauguccccgaccaucau

SEQ ID NO: 853270 - RNA, 15 nt, Mycobacterium avium subsp. paratuberculosis
cgggcccagcaccac

SEQ ID NO: 853271 - RNA, 16 nt, Mycobacterium avium subsp. paratuberculosis
cgggcccagcaccacc

SEQ ID NO: 853272 - RNA, 17 nt, Mycobacterium avium subsp. paratuberculosis
cgggcccagcaccacca

SEQ ID NO: 853273 - RNA, 18 nt, Mycobacterium avium subsp. paratuberculosis
cgggcccagcaccaccac

SEQ ID NO: 853274 - RNA, 22 nt, Mycobacterium avium subsp. paratuberculosis
cgggcccagcagauagcccagc

SEQ ID NO: 853275 - RNA, 13 nt, Mycobacterium avium subsp. paratuberculosis
cgggcccagcagc

SEQ ID NO: 853276 - RNA, 14 nt, Mycobacterium avium subsp. paratuberculosis
cgggcccagcagcc

SEQ ID NO: 853277 - RNA, 14 nt, Mycobacterium avium subsp. paratuberculosis
cgggcccaccgcca

SEQ ID NO: 853278 - RNA, 19 nt, Mycobacterium avium subsp. paratuberculosis
cgggcccaccgcgcgcugc

SEQ ID NO: 853279 - RNA, 16 nt, Mycobacterium avium subsp. paratuberculosis
cgggcccagcgcgacg

SEQ ID NO: 853280 - RNA, 17 nt, Mycobacterium avium subsp. paratuberculosis
cgggcccagcucggugc

SEQ ID NO: 853281 - RNA, 17 nt, Mycobacterium avium subsp. paratuberculosis
cgggccaggcgcgcgua

SEQ ID NO: 853282 - RNA, 21 nt, Mycobacterium avium subsp. paratuberculosis
cgggccaggucccaggcgugg

SEQ ID NO: 853283 - RNA, 13 nt, Mycobacterium avium subsp. paratuberculosis
cgggccaggucga

SEQ ID NO: 853284 - RNA, 16 nt, Mycobacterium avium subsp. paratuberculosis
cgggccaggucgaagc

SEQ ID NO: 853285 - RNA, 14 nt, Mycobacterium avium subsp. paratuberculosis
cgggccaggugugc

SEQ ID NO: 853286 - RNA, 22 nt, Mycobacterium avium subsp. paratuberculosis
cgggccagguucgcgccgaugc

SEQ ID NO: 853287 - RNA, 19 nt, Mycobacterium avium subsp. paratuberculosis
cgggccaggaugaccgccc

SEQ ID NO: 853288 - RNA, 14 nt, Mycobacterium avium subsp. paratuberculosis
cgggccaggcacgg

SEQ ID NO: 853289 - RNA, 16 nt, Mycobacterium avium subsp. paratuberculosis
cgggccaggcccaccg

SEQ ID NO: 853290 - RNA, 21 nt, Mycobacterium avium subsp. paratuberculosis
cgggccagcguuuccagcgcc

SEQ ID NO: 853291 - RNA, 23 nt, Mycobacterium avium subsp. paratuberculosis
cgggccagcguuuccagcgccgg

SEQ ID NO: 853292 - RNA, 13 nt, Mycobacterium avium subsp. paratuberculosis
cgggccagcucga

SEQ ID NO: 853293 - RNA, 20 nt, Mycobacterium avium subsp. paratuberculosis
cgggccagcucgaaccugga

SEQ ID NO: 853294 - RNA, 13 nt, Mycobacterium avium subsp. paratuberculosis
cgggccagcucgu

SEQ ID NO: 853295 - RNA, 13 nt, Mycobacterium avium subsp. paratuberculosis
cgggccagcugcu

SEQ ID NO: 853296 - RNA, 14 nt, Mycobacterium avium subsp. paratuberculosis
cgggccagcugcuc

SEQ ID NO: 853297 - RNA, 15 nt, Mycobacterium avium subsp. paratuberculosis
cgggccagcgcaucg

SEQ ID NO: 853298 - RNA, 16 nt, Mycobacterium avium subsp. paratuberculosis
cgggccagcgccuucg

SEQ ID NO: 853299 - RNA, 17 nt, Mycobacterium avium subsp. paratuberculosis
cgggccagcgccuucgg

SEQ ID NO: 853300 - RNA, 14 nt, Mycobacterium avium subsp. paratuberculosis
cgggccagccggcc

SEQ ID NO: 853301 - RNA, 12 nt, Mycobacterium avium subsp. paratuberculosis
cgggccagccgu

SEQ ID NO: 853302 - RNA, 15 nt, Mycobacterium avium subsp. paratuberculosis
cgggccagccguugu

SEQ ID NO: 853303 - RNA, 18 nt, Mycobacterium avium subsp. paratuberculosis
cgggauuggacagcggcg

SEQ ID NO: 853304 - RNA, 21 nt, Mycobacterium avium subsp. paratuberculosis
cgggauuggacagcggcgcgg

SEQ ID NO: 853305 - RNA, 22 nt, Mycobacterium avium subsp. paratuberculosis
cgggauuggcgccacugccgcc

SEQ ID NO: 853306 - RNA, 15 nt, Mycobacterium avium subsp. paratuberculosis
cgggauuggcggcca

SEQ ID NO: 853307 - RNA, 14 nt, Mycobacterium avium subsp. paratuberculosis
cgggcaaucgcugc

SEQ ID NO: 853308 - RNA, 21 nt, Mycobacterium avium subsp. paratuberculosis
cgggcaaucggacccagcccg

SEQ ID NO: 853309 - RNA, 22 nt, Mycobacterium avium subsp. paratuberculosis
cgggcaaucggacccagcccga

SEQ ID NO: 853310 - RNA, 20 nt, Mycobacterium avium subsp. paratuberculosis
cgggcaaugaugucggcggg

SEQ ID NO: 853311 - RNA, 18 nt, Mycobacterium avium subsp. paratuberculosis
cgggcacaccgucgucca

SEQ ID NO: 853312 - RNA, 20 nt, Mycobacterium avium subsp. paratuberculosis
cgggcacaccgucguccacg

SEQ ID NO: 853313 - RNA, 16 nt, Mycobacterium avium subsp. paratuberculosis
cgggcacguccagccc

SEQ ID NO: 853314 - RNA, 17 nt, Mycobacterium avium subsp. paratuberculosis
cgggcacguccagcccg

SEQ ID NO: 853315 - RNA, 14 nt, Mycobacterium avium subsp. paratuberculosis
cgggcacgucgacg

SEQ ID NO: 853316 - RNA, 16 nt, Mycobacterium avium subsp. paratuberculosis
cgggcacgucgcgcgg

SEQ ID NO: 853317 - RNA, 21 nt, Mycobacterium avium subsp. paratuberculosis
cgggcacgucgcgcggggucg

SEQ ID NO: 853318 - RNA, 22 nt, Mycobacterium avium subsp. paratuberculosis
cgggcacgucgcgcggggucgg

SEQ ID NO: 853319 - RNA, 23 nt, Mycobacterium avium subsp. paratuberculosis
cgggcacuuaacaccucgccucc

SEQ ID NO: 853320 - RNA, 14 nt, Mycobacterium avium subsp. paratuberculosis
cgggcagcgcgaca

SEQ ID NO: 853321 - RNA, 15 nt, Mycobacterium avium subsp. paratuberculosis
cgggcagcgcgacac

SEQ ID NO: 853322 - RNA, 14 nt, Mycobacterium avium subsp. paratuberculosis
cgggcagcgagcac

SEQ ID NO: 853323 - RNA, 20 nt, Mycobacterium avium subsp. paratuberculosis
cgggcagcgagcacagcggc

SEQ ID NO: 853324 - RNA, 21 nt, Mycobacterium avium subsp. paratuberculosis
cgggcagcgagcacagcggcg

SEQ ID NO: 853325 - RNA, 14 nt, Mycobacterium avium subsp. paratuberculosis
cgggcagcgagucg

SEQ ID NO: 853326 - RNA, 18 nt, Mycobacterium avium subsp. paratuberculosis
cgggcagccgcuuggccg

SEQ ID NO: 853327 - RNA, 19 nt, Mycobacterium avium subsp. paratuberculosis
cgggcagccgcuuggccgg

SEQ ID NO: 853328 - RNA, 14 nt, Mycobacterium avium subsp. paratuberculosis
cgggcagccggcgc

SEQ ID NO: 853329 - RNA, 14 nt, Mycobacterium avium subsp. paratuberculosis
cgggcagcccgccg

SEQ ID NO: 853330 - RNA, 15 nt, Mycobacterium avium subsp. paratuberculosis
cgggcagcccgccga

SEQ ID NO: 853331 - RNA, 16 nt, Mycobacterium avium subsp. paratuberculosis
cgggcagcccgccgac

SEQ ID NO: 853332 - RNA, 20 nt, Mycobacterium avium subsp. paratuberculosis
cgggcagcccgccgaccacc

SEQ ID NO: 853333 - RNA, 17 nt, Mycobacterium avium subsp. paratuberculosis
cgggcagcccgccgcgg

SEQ ID NO: 853334 - RNA, 21 nt, Mycobacterium avium subsp. paratuberculosis
cgggcagcccgccgcggaucg

SEQ ID NO: 853335 - RNA, 16 nt, Mycobacterium avium subsp. paratuberculosis
cgggcagcagcaccag

SEQ ID NO: 853336 - RNA, 21 nt, Mycobacterium avium subsp. paratuberculosis
cgggcagcagcaccagcgccg

SEQ ID NO: 853337 - RNA, 22 nt, Mycobacterium avium subsp. paratuberculosis
cgggcagcagcaccagcgccgc

SEQ ID NO: 853338 - RNA, 21 nt, Mycobacterium avium subsp. paratuberculosis
cgggcagcagcuccaucgacg

SEQ ID NO: 853339 - RNA, 15 nt, Mycobacterium avium subsp. paratuberculosis
cgggcagcaccagcg

SEQ ID NO: 853340 - RNA, 20 nt, Mycobacterium avium subsp. paratuberculosis
cgggcagcaccagcggcacc

SEQ ID NO: 853341 - RNA, 13 nt, Mycobacterium avium subsp. paratuberculosis
cgggcacggucag

SEQ ID NO: 853342 - RNA, 14 nt, Mycobacterium avium subsp. paratuberculosis
cgggcacggucagg

SEQ ID NO: 853343 - RNA, 21 nt, Mycobacterium avium subsp. paratuberculosis
cgggcacucgagcguccggag

SEQ ID NO: 853344 - RNA, 18 nt, Mycobacterium avium subsp. paratuberculosis
cgggcagauggucgccga

SEQ ID NO: 853345 - RNA, 17 nt, Mycobacterium avium subsp. paratuberculosis
cggcgugccaccgcugg

SEQ ID NO: 853346 - RNA, 18 nt, Mycobacterium avium subsp. paratuberculosis
cggcgugccaccgcuggg

SEQ ID NO: 853347 - RNA, 19 nt, Mycobacterium avium subsp. paratuberculosis
cggcgugccaccgcugggc

SEQ ID NO: 853348 - RNA, 15 nt, Mycobacterium avium subsp. paratuberculosis
cggcgugcagcacgc

SEQ ID NO: 853349 - RNA, 16 nt, Mycobacterium avium subsp. paratuberculosis
cggcgugcagcacgcc

SEQ ID NO: 853350 - RNA, 21 nt, Mycobacterium avium subsp. paratuberculosis
cggcgugcagcacgcccucgg

SEQ ID NO: 853351 - RNA, 22 nt, Mycobacterium avium subsp. paratuberculosis
cggcgugcaacugcguggccgu

SEQ ID NO: 853352 - RNA, 16 nt, Mycobacterium avium subsp. paratuberculosis
cggcgugcacaggccg

SEQ ID NO: 853353 - RNA, 19 nt, Mycobacterium avium subsp. paratuberculosis
cggcgugcacaggccgccg

SEQ ID NO: 853354 - RNA, 17 nt, Mycobacterium avium subsp. paratuberculosis
cggcgugcaccgcccgc

SEQ ID NO: 853355 - RNA, 14 nt, Mycobacterium avium subsp. paratuberculosis
cggcgugcagccga

SEQ ID NO: 853356 - RNA, 22 nt, Mycobacterium avium subsp. paratuberculosis
cggcgugcaggauccgcucgac

SEQ ID NO: 853357 - RNA, 17 nt, Mycobacterium avium subsp. paratuberculosis
cggcgugaugacggcgg

SEQ ID NO: 853358 - RNA, 22 nt, Mycobacterium avium subsp. paratuberculosis
cggcgugaugacggcggcggug

SEQ ID NO: 853359 - RNA, 14 nt, Mycobacterium avium subsp. paratuberculosis
cggcguggucgagg

SEQ ID NO: 853360 - RNA, 13 nt, Mycobacterium avium subsp. paratuberculosis
cggcguggccguc

SEQ ID NO: 853361 - RNA, 16 nt, Mycobacterium avium subsp. paratuberculosis
cggcguggccguccga

SEQ ID NO: 853362 - RNA, 16 nt, Mycobacterium avium subsp. paratuberculosis
cggcgugguagccgcc

SEQ ID NO: 853363 - RNA, 18 nt, Mycobacterium avium subsp. paratuberculosis
cggcgugguagccgccgu

SEQ ID NO: 853364 - RNA, 14 nt, Mycobacterium avium subsp. paratuberculosis
cggcgugggccgca

SEQ ID NO: 853365 - RNA, 18 nt, Mycobacterium avium subsp. paratuberculosis
cggcgugggccgcagcgc

SEQ ID NO: 853366 - RNA, 22 nt, Mycobacterium avium subsp. paratuberculosis
cggcgugggccgcagcgcggcg

SEQ ID NO: 853367 - RNA, 19 nt, Mycobacterium avium subsp. paratuberculosis
cggcguggcgcucagcggc

SEQ ID NO: 853368 - RNA, 20 nt, Mycobacterium avium subsp. paratuberculosis
cggcguggcugaggccgccc

SEQ ID NO: 853369 - RNA, 23 nt, Mycobacterium avium subsp. paratuberculosis
cggcguggcugaggccgccccgg

SEQ ID NO: 853370 - RNA, 17 nt, Mycobacterium avium subsp. paratuberculosis
cggcguggcgguggcgg

SEQ ID NO: 853371 - RNA, 17 nt, Mycobacterium avium subsp. paratuberculosis
cggcugaagcgcuggga

SEQ ID NO: 853372 - RNA, 16 nt, Mycobacterium avium subsp. paratuberculosis
cggcugaccgagcggc

SEQ ID NO: 853373 - RNA, 19 nt, Mycobacterium avium subsp. paratuberculosis
cggcugaccgagcggcgcu

SEQ ID NO: 853374 - RNA, 21 nt, Mycobacterium avium subsp. paratuberculosis
cggcugaccgagcggcgcugc

SEQ ID NO: 853375 - RNA, 13 nt, Mycobacterium avium subsp. paratuberculosis
cggcugaccggcg

SEQ ID NO: 853376 - RNA, 16 nt, Mycobacterium avium subsp. paratuberculosis
cggcugaccggcggug

SEQ ID NO: 853377 - RNA, 19 nt, Mycobacterium avium subsp. paratuberculosis
cggcugaccggcggugccg

SEQ ID NO: 853378 - RNA, 16 nt, Mycobacterium avium subsp. paratuberculosis
cggcugacccgcccgg

SEQ ID NO: 853379 - RNA, 14 nt, Mycobacterium avium subsp. paratuberculosis
cggcugaucagccg

SEQ ID NO: 853380 - RNA, 18 nt, Mycobacterium avium subsp. paratuberculosis
cggcugaucagccggcga

SEQ ID NO: 853381 - RNA, 20 nt, Mycobacterium avium subsp. paratuberculosis
cggcugaucagccggcgagc

SEQ ID NO: 853382 - RNA, 21 nt, Mycobacterium avium subsp. paratuberculosis
cggcugaucagccggcgagcg

SEQ ID NO: 853383 - RNA, 22 nt, Mycobacterium avium subsp. paratuberculosis
cggcugaucagccggcgagcgc

SEQ ID NO: 853384 - RNA, 17 nt, Mycobacterium avium subsp. paratuberculosis
cggcugacugccggcga

SEQ ID NO: 853385 - RNA, 20 nt, Mycobacterium avium subsp. paratuberculosis
cggcugacugccggcgacgg

SEQ ID NO: 853386 - RNA, 15 nt, Mycobacterium avium subsp. paratuberculosis
cggcugagcagcucg

SEQ ID NO: 853387 - RNA, 16 nt, Mycobacterium avium subsp. paratuberculosis
cggcuggccgucgucg

SEQ ID NO: 853388 - RNA, 22 nt, Mycobacterium avium subsp. paratuberculosis
cggcuggccgucgucgaggccg

SEQ ID NO: 853389 - RNA, 14 nt, Mycobacterium avium subsp. paratuberculosis
cggcugcuggucga

SEQ ID NO: 853390 - RNA, 15 nt, Mycobacterium avium subsp. paratuberculosis
cggcuggccggaaag

SEQ ID NO: 853391 - RNA, 21 nt, Mycobacterium avium subsp. paratuberculosis
cggcuggccggaaaggcguga

SEQ ID NO: 853392 - RNA, 16 nt, Mycobacterium avium subsp. paratuberculosis
cggcugcugcgcggca

SEQ ID NO: 853393 - RNA, 17 nt, Mycobacterium avium subsp. paratuberculosis
cggcugcucgcgcugcc

SEQ ID NO: 853394 - RNA, 18 nt, Mycobacterium avium subsp. paratuberculosis
cggcugcucgcgcugccg

SEQ ID NO: 853395 - RNA, 23 nt, Mycobacterium avium subsp. paratuberculosis
cggcugcucgcgcugccgcgcgc

SEQ ID NO: 853396 - RNA, 17 nt, Mycobacterium avium subsp. paratuberculosis
cggcugcugcacgacga

SEQ ID NO: 853397 - RNA, 20 nt, Mycobacterium avium subsp. paratuberculosis
cggcugcugcacgacgaccg

SEQ ID NO: 853398 - RNA, 16 nt, Mycobacterium avium subsp. paratuberculosis
cggcugcugcagcgcc

SEQ ID NO: 853399 - RNA, 19 nt, Mycobacterium avium subsp. paratuberculosis
cggcugcugcagcgcccgg

SEQ ID NO: 853400 - RNA, 14 nt, Mycobacterium avium subsp. paratuberculosis
cggcugggcagccg

SEQ ID NO: 853401 - RNA, 15 nt, Mycobacterium avium subsp. paratuberculosis
cggcugucgacagga

SEQ ID NO: 853402 - RNA, 18 nt, Mycobacterium avium subsp. paratuberculosis
cggcugucgacaggaucg

SEQ ID NO: 853403 - RNA, 14 nt, Mycobacterium avium subsp. paratuberculosis
cggcugggcgcgca

SEQ ID NO: 853404 - RNA, 17 nt, Mycobacterium avium subsp. paratuberculosis
cggcugggcgcgcaacu

SEQ ID NO: 853405 - RNA, 17 nt, Mycobacterium avium subsp. paratuberculosis
cggcuggcgggcgaucg

SEQ ID NO: 853406 - RNA, 18 nt, Mycobacterium avium subsp. paratuberculosis
cggcuggcgggugguugg

SEQ ID NO: 853407 - RNA, 19 nt, Mycobacterium avium subsp. paratuberculosis
cggcugggcagccgcgcgu

SEQ ID NO: 853408 - RNA, 20 nt, Mycobacterium avium subsp. paratuberculosis
cggcugggcagccgcgcgug

SEQ ID NO: 853409 - RNA, 21 nt, Mycobacterium avium subsp. paratuberculosis
cggcugggcagccgcgcgugc

SEQ ID NO: 853410 - RNA, 13 nt, Mycobacterium avium subsp. paratuberculosis
cggcugggccgcg

SEQ ID NO: 853411 - RNA, 14 nt, Mycobacterium avium subsp. paratuberculosis
cggcugggccgcgg

SEQ ID NO: 853412 - RNA, 15 nt, Mycobacterium avium subsp. paratuberculosis
cggcugggccgcggc

SEQ ID NO: 853413 - RNA, 17 nt, Mycobacterium avium subsp. paratuberculosis
cggcugggccgcggcgc

SEQ ID NO: 853414 - RNA, 19 nt, Mycobacterium avium subsp. paratuberculosis
cggcugggccgcggcgccg

SEQ ID NO: 853415 - RNA, 20 nt, Mycobacterium avium subsp. paratuberculosis
cggcugggccgcggcgccgu

SEQ ID NO: 853416 - RNA, 15 nt, Mycobacterium avium subsp. paratuberculosis
cggcugcucgaaccg

SEQ ID NO: 853417 - RNA, 18 nt, Mycobacterium avium subsp. paratuberculosis
cggcugcucgaaccgcga

SEQ ID NO: 853418 - RNA, 14 nt, Mycobacterium avium subsp. paratuberculosis
cggcugcgggccag

SEQ ID NO: 853419 - RNA, 21 nt, Mycobacterium avium subsp. paratuberculosis
cggcugcgggccagcgcaucg

SEQ ID NO: 853420 - RNA, 19 nt, Mycobacterium avium subsp. paratuberculosis
cggcugcgguuggccggcc

SEQ ID NO: 853421 - RNA, 20 nt, Mycobacterium avium subsp. paratuberculosis
cggcugcgguuggccggccg

SEQ ID NO: 853422 - RNA, 22 nt, Mycobacterium avium subsp. paratuberculosis
cggcugcgcguucggcgccacc

SEQ ID NO: 853423 - RNA, 13 nt, Mycobacterium avium subsp. paratuberculosis
cggcugcagccgg

SEQ ID NO: 853424 - RNA, 20 nt, Mycobacterium avium subsp. paratuberculosis
cggcugcagccgggcggcgg

SEQ ID NO: 853425 - RNA, 14 nt, Mycobacterium avium subsp. paratuberculosis
cggcugcaggcagc

SEQ ID NO: 853426 - RNA, 16 nt, Mycobacterium avium subsp. paratuberculosis
cggcugcaggcagcga

SEQ ID NO: 853427 - RNA, 19 nt, Mycobacterium avium subsp. paratuberculosis
cggcugcacccucugccac

SEQ ID NO: 853428 - RNA, 23 nt, Mycobacterium avium subsp. paratuberculosis
cggcugcacccucugccacggcg

SEQ ID NO: 853429 - RNA, 18 nt, Mycobacterium avium subsp. paratuberculosis
cggcugucguagcggccc

SEQ ID NO: 853430 - RNA, 22 nt, Mycobacterium avium subsp. paratuberculosis
cggcuucaaaaaccuguccggg

SEQ ID NO: 853431 - RNA, 14 nt, Mycobacterium avium subsp. paratuberculosis
cggcuuaaucgccc

SEQ ID NO: 853432 - RNA, 21 nt, Mycobacterium avium subsp. paratuberculosis
cggcuuaccggcgggcggcgg

SEQ ID NO: 853433 - RNA, 13 nt, Mycobacterium avium subsp. paratuberculosis
cggcuugccgccg

SEQ ID NO: 853434 - RNA, 14 nt, Mycobacterium avium subsp. paratuberculosis
cggcuugccgccgc

SEQ ID NO: 853435 - RNA, 15 nt, Mycobacterium avium subsp. paratuberculosis
cggcuugccgccgca

SEQ ID NO: 853436 - RNA, 21 nt, Mycobacterium avium subsp. paratuberculosis
cggcuuucgaagagccggcgu

SEQ ID NO: 853437 - RNA, 20 nt, Mycobacterium avium subsp. paratuberculosis
cggcuuggggaagccggcca

SEQ ID NO: 853438 - RNA, 19 nt, Mycobacterium avium subsp. paratuberculosis
cggcuuggucaccagcucg

SEQ ID NO: 853439 - RNA, 20 nt, Mycobacterium avium subsp. paratuberculosis
cggcuuggucaccagcucgc

SEQ ID NO: 853440 - RNA, 21 nt, Mycobacterium avium subsp. paratuberculosis
cggcuugggcgaaucugucga

SEQ ID NO: 853441 - RNA, 16 nt, Mycobacterium avium subsp. paratuberculosis
cggcuuggccgugcag

SEQ ID NO: 853442 - RNA, 16 nt, Mycobacterium avium subsp. paratuberculosis
cggcuuggcggugaug

SEQ ID NO: 853443 - RNA, 16 nt, Mycobacterium avium subsp. paratuberculosis
cggcuugcgucgcugu

SEQ ID NO: 853444 - RNA, 13 nt, Mycobacterium avium subsp. paratuberculosis
cggcuuggccacc

SEQ ID NO: 853445 - RNA, 14 nt, Mycobacterium avium subsp. paratuberculosis
cggcuuggccacga

SEQ ID NO: 853446 - RNA, 23 nt, Mycobacterium avium subsp. paratuberculosis
cggcuuggccacgaugaucgucg

SEQ ID NO: 853447 - RNA, 20 nt, Mycobacterium avium subsp. paratuberculosis
cgggaaaauuuccuggccga

SEQ ID NO: 853448 - RNA, 20 nt, Mycobacterium avium subsp. paratuberculosis
cggcuuuggugacgccgacg

SEQ ID NO: 853449 - RNA, 18 nt, Mycobacterium avium subsp. paratuberculosis
cgggaaaucggacccagc

SEQ ID NO: 853450 - RNA, 19 nt, Mycobacterium avium subsp. paratuberculosis
cgggaaaucggacccagcc

SEQ ID NO: 853451 - RNA, 15 nt, Mycobacterium avium subsp. paratuberculosis
cgggaaaugcgucgg

SEQ ID NO: 853452 - RNA, 16 nt, Mycobacterium avium subsp. paratuberculosis
cgggaacacguagcga

SEQ ID NO: 853453 - RNA, 20 nt, Mycobacterium avium subsp. paratuberculosis
cgggaacacguagcgaucgg

SEQ ID NO: 853454 - RNA, 20 nt, Mycobacterium avium subsp. paratuberculosis
cgggaacagcccgcccuggc

SEQ ID NO: 853455 - RNA, 17 nt, Mycobacterium avium subsp. paratuberculosis
cgggaacagcgacgccc

SEQ ID NO: 853456 - RNA, 18 nt, Mycobacterium avium subsp. paratuberculosis
cgggaacagcgacgccca

SEQ ID NO: 853457 - RNA, 14 nt, Mycobacterium avium subsp. paratuberculosis
cgggaaccagccca

SEQ ID NO: 853458 - RNA, 21 nt, Mycobacterium avium subsp. paratuberculosis
cgggaacccauucggucaucg

SEQ ID NO: 853459 - RNA, 22 nt, Mycobacterium avium subsp. paratuberculosis
cgggaacccauucggucaucgg

SEQ ID NO: 853460 - RNA, 23 nt, Mycobacterium avium subsp. paratuberculosis
cgggaaagcgggugaccgacagc

SEQ ID NO: 853461 - RNA, 15 nt, Mycobacterium avium subsp. paratuberculosis
cgggaaacgcgucgc

SEQ ID NO: 853462 - RNA, 20 nt, Mycobacterium avium subsp. paratuberculosis
cgggaagcugguggugaucg

SEQ ID NO: 853463 - RNA, 20 nt, Mycobacterium avium subsp. paratuberculosis
cgggaaguagggcagcccga

SEQ ID NO: 853464 - RNA, 22 nt, Mycobacterium avium subsp. paratuberculosis
cgggaaguagggcagcccgaac

SEQ ID NO: 853465 - RNA, 20 nt, Mycobacterium avium subsp. paratuberculosis
cgggaaguagugcaucggca

SEQ ID NO: 853466 - RNA, 23 nt, Mycobacterium avium subsp. paratuberculosis
cgggaaguugcccaacuggcgac

SEQ ID NO: 853467 - RNA, 22 nt, Mycobacterium avium subsp. paratuberculosis
cgggaauauccaucgauggcgg

SEQ ID NO: 853468 - RNA, 15 nt, Mycobacterium avium subsp. paratuberculosis
cgggaaccuggccgu

SEQ ID NO: 853469 - RNA, 15 nt, Mycobacterium avium subsp. paratuberculosis
cgggaacgacggugc

SEQ ID NO: 853470 - RNA, 20 nt, Mycobacterium avium subsp. paratuberculosis
cgggaacgacggugcgcccg

SEQ ID NO: 853471 - RNA, 23 nt, Mycobacterium avium subsp. paratuberculosis
cgggaacgacggugcgcccgucg

SEQ ID NO: 853472 - RNA, 13 nt, Mycobacterium avium subsp. paratuberculosis
cgggaacgcggcg

SEQ ID NO: 853473 - RNA, 17 nt, Mycobacterium avium subsp. paratuberculosis
cgggaacgcggcgaagg

SEQ ID NO: 853474 - RNA, 20 nt, Mycobacterium avium subsp. paratuberculosis
cgggaacgcgucgaacaccc

SEQ ID NO: 853475 - RNA, 16 nt, Mycobacterium avium subsp. paratuberculosis
cgggaacucggccagc

SEQ ID NO: 853476 - RNA, 20 nt, Mycobacterium avium subsp. paratuberculosis
cgggaacucggccagcuggu

SEQ ID NO: 853477 - RNA, 14 nt, Mycobacterium avium subsp. paratuberculosis
cgggaagcccaccg

SEQ ID NO: 853478 - RNA, 17 nt, Mycobacterium avium subsp. paratuberculosis
cgggaagcccaccgcgg

SEQ ID NO: 853479 - RNA, 19 nt, Mycobacterium avium subsp. paratuberculosis
cgggaagcccaccgcggug

SEQ ID NO: 853480 - RNA, 19 nt, Mycobacterium avium subsp. paratuberculosis
cgggaagccgaggucgccg

SEQ ID NO: 853481 - RNA, 21 nt, Mycobacterium avium subsp. paratuberculosis
cgggaagccgaggucgccgac

SEQ ID NO: 853482 - RNA, 22 nt, Mycobacterium avium subsp. paratuberculosis
cgggaagccgaggucgccgacg

SEQ ID NO: 853483 - RNA, 19 nt, Mycobacterium avium subsp. paratuberculosis
cggggcaagcagcggcagc

SEQ ID NO: 853484 - RNA, 19 nt, Mycobacterium avium subsp. paratuberculosis
cggggcaccacguccacca

SEQ ID NO: 853485 - RNA, 23 nt, Mycobacterium avium subsp. paratuberculosis
cggggcaccacguccaccagcac

SEQ ID NO: 853486 - RNA, 14 nt, Mycobacterium avium subsp. paratuberculosis
cggggaugucgucg

SEQ ID NO: 853487 - RNA, 18 nt, Mycobacterium avium subsp. paratuberculosis
cggggaugucgucgggcg

SEQ ID NO: 853488 - RNA, 19 nt, Mycobacterium avium subsp. paratuberculosis
cggggaugguuuccacugc

SEQ ID NO: 853489 - RNA, 21 nt, Mycobacterium avium subsp. paratuberculosis
cggggccaccaggcgccgucg

SEQ ID NO: 853490 - RNA, 12 nt, Mycobacterium avium subsp. paratuberculosis
cggggccagcac

SEQ ID NO: 853491 - RNA, 15 nt, Mycobacterium avium subsp. paratuberculosis
cggggccagcaccca

SEQ ID NO: 853492 - RNA, 22 nt, Mycobacterium avium subsp. paratuberculosis
cggggccagcacgcccccgcug

SEQ ID NO: 853493 - RNA, 22 nt, Mycobacterium avium subsp. paratuberculosis
cggggcaguagugguccaccgc

SEQ ID NO: 853494 - RNA, 22 nt, Mycobacterium avium subsp. paratuberculosis
cggggcaucccugacacgaccg

SEQ ID NO: 853495 - RNA, 24 nt, Mycobacterium avium subsp. paratuberculosis
cggggcaucgcagcgcgcggcgca

SEQ ID NO: 853496 - RNA, 17 nt, Mycobacterium avium subsp. paratuberculosis
cggggccaacuccggcg

SEQ ID NO: 853497 - RNA, 20 nt, Mycobacterium avium subsp. paratuberculosis
cggggccaacuccggcggca

SEQ ID NO: 853498 - RNA, 22 nt, Mycobacterium avium subsp. paratuberculosis
cggggccaacuccggcggcagc

SEQ ID NO: 853499 - RNA, 15 nt, Mycobacterium avium subsp. paratuberculosis
cggggcagccgucga

SEQ ID NO: 853500 - RNA, 21 nt, Mycobacterium avium subsp. paratuberculosis
cggggcacgcgcgcccggcac

SEQ ID NO: 853501 - RNA, 15 nt, Mycobacterium avium subsp. paratuberculosis
cggggcagcacccgc

SEQ ID NO: 853502 - RNA, 18 nt, Mycobacterium avium subsp. paratuberculosis
cggggcagcacccgcacc

SEQ ID NO: 853503 - RNA, 13 nt, Mycobacterium avium subsp. paratuberculosis
cggggcagcagca

SEQ ID NO: 853504 - RNA, 16 nt, Mycobacterium avium subsp. paratuberculosis
cggggcagcagcaucg

SEQ ID NO: 853505 - RNA, 12 nt, Mycobacterium avium subsp. paratuberculosis
cggggacaccgg

SEQ ID NO: 853506 - RNA, 17 nt, Mycobacterium avium subsp. paratuberculosis
cggggacaccgggcacc

SEQ ID NO: 853507 - RNA, 16 nt, Mycobacterium avium subsp. paratuberculosis
cggggaauccuggccg

SEQ ID NO: 853508 - RNA, 18 nt, Mycobacterium avium subsp. paratuberculosis
cggggaauccuggccgau

SEQ ID NO: 853509 - RNA, 17 nt, Mycobacterium avium subsp. paratuberculosis
cggggaauuccggcgcg

SEQ ID NO: 853510 - RNA, 18 nt, Mycobacterium avium subsp. paratuberculosis
cggggaauuccggcgcga

SEQ ID NO: 853511 - RNA, 21 nt, Mycobacterium avium subsp. paratuberculosis
cggggaauuccggcgcgaucg

SEQ ID NO: 853512 - RNA, 22 nt, Mycobacterium avium subsp. paratuberculosis
cggggaauuccggcgcgaucgg

SEQ ID NO: 853513 - RNA, 23 nt, Mycobacterium avium subsp. paratuberculosis
cggggaaggugcgggcggggccc

SEQ ID NO: 853514 - RNA, 22 nt, Mycobacterium avium subsp. paratuberculosis
cggggacuugacgauccccugg

SEQ ID NO: 853515 - RNA, 18 nt, Mycobacterium avium subsp. paratuberculosis
cggggacgucgucguccc

SEQ ID NO: 853516 - RNA, 15 nt, Mycobacterium avium subsp. paratuberculosis
cggggaccguccccg

SEQ ID NO: 853517 - RNA, 13 nt, Mycobacterium avium subsp. paratuberculosis
cggggacgacggc

SEQ ID NO: 853518 - RNA, 16 nt, Mycobacterium avium subsp. paratuberculosis
cggggacgacggcggg

SEQ ID NO: 853519 - RNA, 21 nt, Mycobacterium avium subsp. paratuberculosis
cggggacgcugaacagcccga

SEQ ID NO: 853520 - RNA, 16 nt, Mycobacterium avium subsp. paratuberculosis
cggggaguucgcgguu

SEQ ID NO: 853521 - RNA, 19 nt, Mycobacterium avium subsp. paratuberculosis
cggggaucaccucgcugac

SEQ ID NO: 853522 - RNA, 19 nt, Mycobacterium avium subsp. paratuberculosis
cggggaucagcgucgcgau

SEQ ID NO: 853523 - RNA, 12 nt, Mycobacterium avium subsp. paratuberculosis
cggggaucccga

SEQ ID NO: 853524 - RNA, 19 nt, Mycobacterium avium subsp. paratuberculosis
cggggauccgaucugcucg

SEQ ID NO: 853525 - RNA, 17 nt, Mycobacterium avium subsp. paratuberculosis
cggggaucgcgcagccg

SEQ ID NO: 853526 - RNA, 15 nt, Mycobacterium avium subsp. paratuberculosis
cggggccaggaugcc

SEQ ID NO: 853527 - RNA, 22 nt, Mycobacterium avium subsp. paratuberculosis
cggggccaggaugccgaacgcg

SEQ ID NO: 853528 - RNA, 19 nt, Mycobacterium avium subsp. paratuberculosis
cggggccagguacuccucg

SEQ ID NO: 853529 - RNA, 15 nt, Mycobacterium avium subsp. paratuberculosis
cggggcccaccccgg

SEQ ID NO: 853530 - RNA, 19 nt, Mycobacterium avium subsp. paratuberculosis
cggggcccaccccggacaa

SEQ ID NO: 853531 - RNA, 14 nt, Mycobacterium avium subsp. paratuberculosis
cggggccgacccgc

SEQ ID NO: 853532 - RNA, 15 nt, Mycobacterium avium subsp. paratuberculosis
cggggccgcaccuga

SEQ ID NO: 853533 - RNA, 15 nt, Mycobacterium avium subsp. paratuberculosis
cggggcccggcccgg

SEQ ID NO: 853534 - RNA, 19 nt, Mycobacterium avium subsp. paratuberculosis
cggggcccggcccggcgau

SEQ ID NO: 853535 - RNA, 15 nt, Mycobacterium avium subsp. paratuberculosis
cggggcccgggccgg

SEQ ID NO: 853536 - RNA, 16 nt, Mycobacterium avium subsp. paratuberculosis
cggggcccguccccac

SEQ ID NO: 853537 - RNA, 18 nt, Mycobacterium avium subsp. paratuberculosis
cggggcccguccccacca

SEQ ID NO: 853538 - RNA, 21 nt, Mycobacterium avium subsp. paratuberculosis
cggggcccguccccaccaccg

SEQ ID NO: 853539 - RNA, 12 nt, Mycobacterium avium subsp. paratuberculosis
cggggccggugc

SEQ ID NO: 853540 - RNA, 22 nt, Mycobacterium avium subsp. paratuberculosis
cggggccgguuggugcgccguc

SEQ ID NO: 853541 - RNA, 12 nt, Mycobacterium avium subsp. paratuberculosis
cggggccggcgc

SEQ ID NO: 853542 - RNA, 15 nt, Mycobacterium avium subsp. paratuberculosis
cggggccggcgcggu

SEQ ID NO: 853543 - RNA, 17 nt, Mycobacterium avium subsp. paratuberculosis
cggggccggcgcggugg

SEQ ID NO: 853544 - RNA, 14 nt, Mycobacterium avium subsp. paratuberculosis
cggggccggcgcug

SEQ ID NO: 853545 - RNA, 15 nt, Mycobacterium avium subsp. paratuberculosis
cggggccggcggcgg

SEQ ID NO: 853546 - RNA, 19 nt, Mycobacterium avium subsp. paratuberculosis
cggggccggcggcggccag

SEQ ID NO: 853547 - RNA, 20 nt, Mycobacterium avium subsp. paratuberculosis
cggggccggcggcggccagc

SEQ ID NO: 853548 - RNA, 13 nt, Mycobacterium avium subsp. paratuberculosis
cggggccggcggg

SEQ ID NO: 853549 - RNA, 22 nt, Mycobacterium avium subsp. paratuberculosis
cggggccggcgggggcgcgucc

SEQ ID NO: 853550 - RNA, 14 nt, Mycobacterium avium subsp. paratuberculosis
cggggccgcggccg

SEQ ID NO: 853551 - RNA, 15 nt, Mycobacterium avium subsp. paratuberculosis
cggggccgcggccgg

SEQ ID NO: 853552 - RNA, 14 nt, Mycobacterium avium subsp. paratuberculosis
cggggccgcggcuc

SEQ ID NO: 853553 - RNA, 17 nt, Mycobacterium avium subsp. paratuberculosis
cggggccgcggcucgcg

SEQ ID NO: 853554 - RNA, 14 nt, Mycobacterium avium subsp. paratuberculosis
cggggccgccgucg

SEQ ID NO: 853555 - RNA, 14 nt, Mycobacterium avium subsp. paratuberculosis
cggggcggaugcgc

SEQ ID NO: 853556 - RNA, 18 nt, Mycobacterium avium subsp. paratuberculosis
cggggcggaugcgcuggu

SEQ ID NO: 853557 - RNA, 20 nt, Mycobacterium avium subsp. paratuberculosis
cggggcggaugcgcuggugc

SEQ ID NO: 853558 - RNA, 18 nt, Mycobacterium avium subsp. paratuberculosis
cggggcgccgacagucgc

SEQ ID NO: 853559 - RNA, 21 nt, Mycobacterium avium subsp. paratuberculosis
cggggcgccgacagucgcggg

SEQ ID NO: 853560 - RNA, 22 nt, Mycobacterium avium subsp. paratuberculosis
cggggcgccgacagucgcgggc

SEQ ID NO: 853561 - RNA, 14 nt, Mycobacterium avium subsp. paratuberculosis
cggggcgccgccga

SEQ ID NO: 853562 - RNA, 13 nt, Mycobacterium avium subsp. paratuberculosis
cggggcgcagccc

SEQ ID NO: 853563 - RNA, 17 nt, Mycobacterium avium subsp. paratuberculosis
cggggcgcagcccggcg

SEQ ID NO: 853564 - RNA, 19 nt, Mycobacterium avium subsp. paratuberculosis
cggggcgcagcccggcggu

SEQ ID NO: 853565 - RNA, 15 nt, Mycobacterium avium subsp. paratuberculosis
cggggcgcgaggcgc

SEQ ID NO: 853566 - RNA, 12 nt, Mycobacterium avium subsp. paratuberculosis
cggggcgcgcag

SEQ ID NO: 853567 - RNA, 13 nt, Mycobacterium avium subsp. paratuberculosis
cggggcgcgcagg

SEQ ID NO: 853568 - RNA, 15 nt, Mycobacterium avium subsp. paratuberculosis
cggggcgcgcaggcg

SEQ ID NO: 853569 - RNA, 20 nt, Mycobacterium avium subsp. paratuberculosis
cggggcgccgcugcgggcca

SEQ ID NO: 853570 - RNA, 13 nt, Mycobacterium avium subsp. paratuberculosis
cggggcgccuacc

SEQ ID NO: 853571 - RNA, 13 nt, Mycobacterium avium subsp. paratuberculosis
cggggcgcgcugg

SEQ ID NO: 853572 - RNA, 13 nt, Mycobacterium avium subsp. paratuberculosis
cggggcgcggacc

SEQ ID NO: 853573 - RNA, 17 nt, Mycobacterium avium subsp. paratuberculosis
cggggcgcggaccgcac

SEQ ID NO: 853574 - RNA, 18 nt, Mycobacterium avium subsp. paratuberculosis
cggggccuccaccagcgg

SEQ ID NO: 853575 - RNA, 19 nt, Mycobacterium avium subsp. paratuberculosis
cggggccuccaccagcggc

SEQ ID NO: 853576 - RNA, 20 nt, Mycobacterium avium subsp. paratuberculosis
cggggccuccaccagcggcg

SEQ ID NO: 853577 - RNA, 15 nt, Mycobacterium avium subsp. paratuberculosis
cggggccuccagcca

SEQ ID NO: 853578 - RNA, 16 nt, Mycobacterium avium subsp. paratuberculosis
cggggccuccagccag

SEQ ID NO: 853579 - RNA, 20 nt, Mycobacterium avium subsp. paratuberculosis
cggggccuccagccagcgcg

SEQ ID NO: 853580 - RNA, 18 nt, Mycobacterium avium subsp. paratuberculosis
cggggccucgaugcggcc

SEQ ID NO: 853581 - RNA, 18 nt, Mycobacterium avium subsp. paratuberculosis
cggggccucgucgccgcg

SEQ ID NO: 853582 - RNA, 20 nt, Mycobacterium avium subsp. paratuberculosis
cggggccugcgggacgccgu

SEQ ID NO: 853583 - RNA, 22 nt, Mycobacterium avium subsp. paratuberculosis
cggggccugcgggacgccguug

SEQ ID NO: 853584 - RNA, 20 nt, Mycobacterium avium subsp. paratuberculosis
cggggccuucuuggcggcgg

SEQ ID NO: 853585 - RNA, 23 nt, Mycobacterium avium subsp. paratuberculosis
cggggccuucuuggcggcggccu

SEQ ID NO: 853586 - RNA, 22 nt, Mycobacterium avium subsp. paratuberculosis
cggggcgaacccggcgcccggc

SEQ ID NO: 853587 - RNA, 20 nt, Mycobacterium avium subsp. paratuberculosis
cggggcgaccuggacgccgc

SEQ ID NO: 853588 - RNA, 21 nt, Mycobacterium avium subsp. paratuberculosis
cggggcgaccuggacgccgca

SEQ ID NO: 853589 - RNA, 15 nt, Mycobacterium avium subsp. paratuberculosis
cggggcgaccuugcg

SEQ ID NO: 853590 - RNA, 23 nt, Mycobacterium avium subsp. paratuberculosis
cggggcgaccuugcgcagccggc

SEQ ID NO: 853591 - RNA, 17 nt, Mycobacterium avium subsp. paratuberculosis
cggggcgagcuggccgc

SEQ ID NO: 853592 - RNA, 16 nt, Mycobacterium avium subsp. paratuberculosis
cggggcgaugccgaca

SEQ ID NO: 853593 - RNA, 17 nt, Mycobacterium avium subsp. paratuberculosis
cggggcgaugccgacac

SEQ ID NO: 853594 - RNA, 22 nt, Mycobacterium avium subsp. paratuberculosis
cggggcgaugccgacaccccac

SEQ ID NO: 853595 - RNA, 20 nt, Mycobacterium avium subsp. paratuberculosis
cggggguaaaccgccagcag

SEQ ID NO: 853596 - RNA, 13 nt, Mycobacterium avium subsp. paratuberculosis
cggggguagcggu

SEQ ID NO: 853597 - RNA, 22 nt, Mycobacterium avium subsp. paratuberculosis
cggggggcacguccccgugcag

SEQ ID NO: 853598 - RNA, 23 nt, Mycobacterium avium subsp. paratuberculosis
cggggggcacguccccgugcagc

SEQ ID NO: 853599 - RNA, 17 nt, Mycobacterium avium subsp. paratuberculosis
cggggggcgagccggcc

SEQ ID NO: 853600 - RNA, 18 nt, Mycobacterium avium subsp. paratuberculosis
cgggggugaaggcggcca

SEQ ID NO: 853601 - RNA, 12 nt, Mycobacterium avium subsp. paratuberculosis
cgggggugccgc

SEQ ID NO: 853602 - RNA, 17 nt, Mycobacterium avium subsp. paratuberculosis
cgggggugccgcuccgg

SEQ ID NO: 853603 - RNA, 22 nt, Mycobacterium avium subsp. paratuberculosis
cggggguggcggucccggcgga

SEQ ID NO: 853604 - RNA, 21 nt, Mycobacterium avium subsp. paratuberculosis
cgggggcggccgggccgcggc

SEQ ID NO: 853605 - RNA, 15 nt, Mycobacterium avium subsp. paratuberculosis
cgggggcggcggcgc

SEQ ID NO: 853606 - RNA, 19 nt, Mycobacterium avium subsp. paratuberculosis
cgggggcggcggcgcgugc

SEQ ID NO: 853607 - RNA, 16 nt, Mycobacterium avium subsp. paratuberculosis
cgggggcgggccccac

SEQ ID NO: 853608 - RNA, 18 nt, Mycobacterium avium subsp. paratuberculosis
cgggggcuguccaccugc

SEQ ID NO: 853609 - RNA, 20 nt, Mycobacterium avium subsp. paratuberculosis
cgggggcuguccaccugcac

SEQ ID NO: 853610 - RNA, 13 nt, Mycobacterium avium subsp. paratuberculosis
cgggggcggccgg

SEQ ID NO: 853611 - RNA, 18 nt, Mycobacterium avium subsp. paratuberculosis
cgggggcgagaccgucgg

SEQ ID NO: 853612 - RNA, 21 nt, Mycobacterium avium subsp. paratuberculosis
cgggggcgagaccgucggugc

SEQ ID NO: 853613 - RNA, 16 nt, Mycobacterium avium subsp. paratuberculosis
cgggggccgucacagg

SEQ ID NO: 853614 - RNA, 22 nt, Mycobacterium avium subsp. paratuberculosis
cgggggccgucacaggccgccu

SEQ ID NO: 853615 - RNA, 14 nt, Mycobacterium avium subsp. paratuberculosis
cgggggccgagcag

SEQ ID NO: 853616 - RNA, 13 nt, Mycobacterium avium subsp. paratuberculosis
cgggggccgccgc

SEQ ID NO: 853617 - RNA, 12 nt, Mycobacterium avium subsp. paratuberculosis
cgggggccgcga

SEQ ID NO: 853618 - RNA, 15 nt, Mycobacterium avium subsp. paratuberculosis
cgggggauccgccug

SEQ ID NO: 853619 - RNA, 15 nt, Mycobacterium avium subsp. paratuberculosis
cgggggaccagcgca

SEQ ID NO: 853620 - RNA, 16 nt, Mycobacterium avium subsp. paratuberculosis
cgggggaucggcggga

SEQ ID NO: 853621 - RNA, 16 nt, Mycobacterium avium subsp. paratuberculosis
cggggcuucgaacgcc

SEQ ID NO: 853622 - RNA, 15 nt, Mycobacterium avium subsp. paratuberculosis
cggggcuggcggcga

SEQ ID NO: 853623 - RNA, 15 nt, Mycobacterium avium subsp. paratuberculosis
cgggggaagcccagc

SEQ ID NO: 853624 - RNA, 18 nt, Mycobacterium avium subsp. paratuberculosis
cgggggaagcccagcacc

SEQ ID NO: 853625 - RNA, 17 nt, Mycobacterium avium subsp. paratuberculosis
cgggggagccgugcagc

SEQ ID NO: 853626 - RNA, 18 nt, Mycobacterium avium subsp. paratuberculosis
cggggcugaguucgguga

SEQ ID NO: 853627 - RNA, 17 nt, Mycobacterium avium subsp. paratuberculosis
cggggcugcccaggucc

SEQ ID NO: 853628 - RNA, 13 nt, Mycobacterium avium subsp. paratuberculosis
cggggcugcgcgg

SEQ ID NO: 853629 - RNA, 15 nt, Mycobacterium avium subsp. paratuberculosis
cggggcugcgcggcu

SEQ ID NO: 853630 - RNA, 17 nt, Mycobacterium avium subsp. paratuberculosis
cggggcugcgcggcuug

SEQ ID NO: 853631 - RNA, 15 nt, Mycobacterium avium subsp. paratuberculosis
cggggcgucggcggc

SEQ ID NO: 853632 - RNA, 18 nt, Mycobacterium avium subsp. paratuberculosis
cggggcgucucgaaccgu

SEQ ID NO: 853633 - RNA, 16 nt, Mycobacterium avium subsp. paratuberculosis
cggggcgugcccggcg

SEQ ID NO: 853634 - RNA, 17 nt, Mycobacterium avium subsp. paratuberculosis
cggggcgugcccggcgc

SEQ ID NO: 853635 - RNA, 18 nt, Mycobacterium avium subsp. paratuberculosis
cggggcguggcggaagcg

SEQ ID NO: 853636 - RNA, 22 nt, Mycobacterium avium subsp. paratuberculosis
cggggcguugguugcggccccg

SEQ ID NO: 853637 - RNA, 14 nt, Mycobacterium avium subsp. paratuberculosis
cggggcggccgccg

SEQ ID NO: 853638 - RNA, 23 nt, Mycobacterium avium subsp. paratuberculosis
cggggcuacaaaaccaagaccgc

SEQ ID NO: 853639 - RNA, 12 nt, Mycobacterium avium subsp. paratuberculosis
cggggcucacca

SEQ ID NO: 853640 - RNA, 18 nt, Mycobacterium avium subsp. paratuberculosis
cggggcucauacggcggc

SEQ ID NO: 853641 - RNA, 20 nt, Mycobacterium avium subsp. paratuberculosis
cggggcucauacggcggcuc

SEQ ID NO: 853642 - RNA, 13 nt, Mycobacterium avium subsp. paratuberculosis
cggggcucgcggu

SEQ ID NO: 853643 - RNA, 15 nt, Mycobacterium avium subsp. paratuberculosis
cggggcucgcggugu

SEQ ID NO: 853644 - RNA, 14 nt, Mycobacterium avium subsp. paratuberculosis
cggggcguccagcg

SEQ ID NO: 853645 - RNA, 17 nt, Mycobacterium avium subsp. paratuberculosis
cggggcgucgcccgccg

SEQ ID NO: 853646 - RNA, 18 nt, Mycobacterium avium subsp. paratuberculosis
cggggcgucgcccgccga

SEQ ID NO: 853647 - RNA, 14 nt, Mycobacterium avium subsp. paratuberculosis
cggggcggcgaugc

SEQ ID NO: 853648 - RNA, 14 nt, Mycobacterium avium subsp. paratuberculosis
cggggcggcggcgc

SEQ ID NO: 853649 - RNA, 16 nt, Mycobacterium avium subsp. paratuberculosis
cggggcggcggcgccg

SEQ ID NO: 853650 - RNA, 13 nt, Mycobacterium avium subsp. paratuberculosis
cggggcggcggga

SEQ ID NO: 853651 - RNA, 15 nt, Mycobacterium avium subsp. paratuberculosis
cggggcggcgggcga

SEQ ID NO: 853652 - RNA, 17 nt, Mycobacterium avium subsp. paratuberculosis
cggggcgggcacgucgc

SEQ ID NO: 853653 - RNA, 21 nt, Mycobacterium avium subsp. paratuberculosis
cggggcgggcacgucgcgcgg

SEQ ID NO: 853654 - RNA, 14 nt, Mycobacterium avium subsp. paratuberculosis
cggggcgggcggcg

SEQ ID NO: 853655 - RNA, 17 nt, Mycobacterium avium subsp. paratuberculosis
cggggcgggcggcggcu

SEQ ID NO: 853656 - RNA, 21 nt, Mycobacterium avium subsp. paratuberculosis
cggggcggugaccuugcgggc

SEQ ID NO: 853657 - RNA, 12 nt, Mycobacterium avium subsp. paratuberculosis
cggggcguacgc

SEQ ID NO: 853658 - RNA, 16 nt, Mycobacterium avium subsp. paratuberculosis
cggggcguacgcgcug

SEQ ID NO: 853659 - RNA, 19 nt, Mycobacterium avium subsp. paratuberculosis
cggggcguacgcgcugccg

SEQ ID NO: 853660 - RNA, 13 nt, Mycobacterium avium subsp. paratuberculosis
cggggugaugccg

SEQ ID NO: 853661 - RNA, 13 nt, Mycobacterium avium subsp. paratuberculosis
cggggugacgccc

SEQ ID NO: 853662 - RNA, 15 nt, Mycobacterium avium subsp. paratuberculosis
cggggugacgcccgu

SEQ ID NO: 853663 - RNA, 18 nt, Mycobacterium avium subsp. paratuberculosis
cggggugacgcccguccc

SEQ ID NO: 853664 - RNA, 19 nt, Mycobacterium avium subsp. paratuberculosis
cggggugacgcccgucccg

SEQ ID NO: 853665 - RNA, 22 nt, Mycobacterium avium subsp. paratuberculosis
cggggugacgcccgucccgccg

SEQ ID NO: 853666 - RNA, 20 nt, Mycobacterium avium subsp. paratuberculosis
cggggugagcagggccagcg

SEQ ID NO: 853667 - RNA, 22 nt, Mycobacterium avium subsp. paratuberculosis
cggggugagcagggccagcggc

SEQ ID NO: 853668 - RNA, 23 nt, Mycobacterium avium subsp. paratuberculosis
cggggucguugcacaccaccagc

SEQ ID NO: 853669 - RNA, 23 nt, Mycobacterium avium subsp. paratuberculosis
cggggucucaaucuucuccgcgg

SEQ ID NO: 853670 - RNA, 18 nt, Mycobacterium avium subsp. paratuberculosis
cggggucugacccaugcc

SEQ ID NO: 853671 - RNA, 18 nt, Mycobacterium avium subsp. paratuberculosis
cggggucugcacgaugcc

SEQ ID NO: 853672 - RNA, 23 nt, Mycobacterium avium subsp. paratuberculosis
cggggucugcacgaugccgacca

SEQ ID NO: 853673 - RNA, 15 nt, Mycobacterium avium subsp. paratuberculosis
cgggggugggcuccc

SEQ ID NO: 853674 - RNA, 20 nt, Mycobacterium avium subsp. paratuberculosis
cgggggugucguagcggcug

SEQ ID NO: 853675 - RNA, 20 nt, Mycobacterium avium subsp. paratuberculosis
cggggguucguugcgccgcc

SEQ ID NO: 853676 - RNA, 23 nt, Mycobacterium avium subsp. paratuberculosis
cggggguucguugcgccgccagg

SEQ ID NO: 853677 - RNA, 21 nt, Mycobacterium avium subsp. paratuberculosis
cgggguacucggcggcgggca

SEQ ID NO: 853678 - RNA, 17 nt, Mycobacterium avium subsp. paratuberculosis
cgggguagaggccgcgg

SEQ ID NO: 853679 - RNA, 21 nt, Mycobacterium avium subsp. paratuberculosis
cgggguagaggccgcggaucg

SEQ ID NO: 853680 - RNA, 22 nt, Mycobacterium avium subsp. paratuberculosis
cgggguagccggcccgcagcca

SEQ ID NO: 853681 - RNA, 18 nt, Mycobacterium avium subsp. paratuberculosis
cgggguaguucagcgcgc

SEQ ID NO: 853682 - RNA, 20 nt, Mycobacterium avium subsp. paratuberculosis
cgggguaguucagcgcgcgg

SEQ ID NO: 853683 - RNA, 17 nt, Mycobacterium avium subsp. paratuberculosis
cggggucggccgagguc

SEQ ID NO: 853684 - RNA, 13 nt, Mycobacterium avium subsp. paratuberculosis
cggggucggccgg

SEQ ID NO: 853685 - RNA, 17 nt, Mycobacterium avium subsp. paratuberculosis
cggggucggccggaucg

SEQ ID NO: 853686 - RNA, 24 nt, Mycobacterium avium subsp. paratuberculosis
cgggguaguccgacuucgcgugcc

SEQ ID NO: 853687 - RNA, 14 nt, Mycobacterium avium subsp. paratuberculosis
cggggucggcgccc

SEQ ID NO: 853688 - RNA, 15 nt, Mycobacterium avium subsp. paratuberculosis
cggggucggcgccgc

SEQ ID NO: 853689 - RNA, 14 nt, Mycobacterium avium subsp. paratuberculosis
cggggucggcgucg

SEQ ID NO: 853690 - RNA, 15 nt, Mycobacterium avium subsp. paratuberculosis
cggggucggcgucgg

SEQ ID NO: 853691 - RNA, 20 nt, Mycobacterium avium subsp. paratuberculosis
cggggucgggaucaacacga

SEQ ID NO: 853692 - RNA, 13 nt, Mycobacterium avium subsp. paratuberculosis
cggggucgggccg

SEQ ID NO: 853693 - RNA, 15 nt, Mycobacterium avium subsp. paratuberculosis
cggggucgggccgga

SEQ ID NO: 853694 - RNA, 18 nt, Mycobacterium avium subsp. paratuberculosis
cggggucgggccggacag

SEQ ID NO: 853695 - RNA, 22 nt, Mycobacterium avium subsp. paratuberculosis
cggggucgggccggacagcggc

SEQ ID NO: 853696 - RNA, 16 nt, Mycobacterium avium subsp. paratuberculosis
cggggucgucgacggc

SEQ ID NO: 853697 - RNA, 19 nt, Mycobacterium avium subsp. paratuberculosis
cggggucgucgacggccgc

SEQ ID NO: 853698 - RNA, 14 nt, Mycobacterium avium subsp. paratuberculosis
cggggucgucgcgg

SEQ ID NO: 853699 - RNA, 23 nt, Mycobacterium avium subsp. paratuberculosis
cggggucgucgcgguccacgccg

SEQ ID NO: 853700 - RNA, 18 nt, Mycobacterium avium subsp. paratuberculosis
cggguaacccuccggcgc

SEQ ID NO: 853701 - RNA, 16 nt, Mycobacterium avium subsp. paratuberculosis
cggguaaccgcagccg

SEQ ID NO: 853702 - RNA, 17 nt, Mycobacterium avium subsp. paratuberculosis
cggguaaccgcagccgg

SEQ ID NO: 853703 - RNA, 21 nt, Mycobacterium avium subsp. paratuberculosis
cggguaaccgcagccgggugc

SEQ ID NO: 853704 - RNA, 19 nt, Mycobacterium avium subsp. paratuberculosis
cgggguuuuugauugcgcg

SEQ ID NO: 853705 - RNA, 19 nt, Mycobacterium avium subsp. paratuberculosis
cgggguuuuugauugcgcu

SEQ ID NO: 853706 - RNA, 18 nt, Mycobacterium avium subsp. paratuberculosis
cgggguuuugaucagccc

SEQ ID NO: 853707 - RNA, 20 nt, Mycobacterium avium subsp. paratuberculosis
cgggguuguagaacgacgac

SEQ ID NO: 853708 - RNA, 20 nt, Mycobacterium avium subsp. paratuberculosis
cgggguucaguagcagcguc

SEQ ID NO: 853709 - RNA, 23 nt, Mycobacterium avium subsp. paratuberculosis
cgggguucaguagcagcgucugc

SEQ ID NO: 853710 - RNA, 21 nt, Mycobacterium avium subsp. paratuberculosis
cgggguugaagucuucggcca

SEQ ID NO: 853711 - RNA, 18 nt, Mycobacterium avium subsp. paratuberculosis
cgggguugacccggccgg

SEQ ID NO: 853712 - RNA, 17 nt, Mycobacterium avium subsp. paratuberculosis
cgggcgcgugcacaccg

SEQ ID NO: 853713 - RNA, 19 nt, Mycobacterium avium subsp. paratuberculosis
cgggcgcgugcacaccggc

SEQ ID NO: 853714 - RNA, 14 nt, Mycobacterium avium subsp. paratuberculosis
cgggcgcucgaugg

SEQ ID NO: 853715 - RNA, 13 nt, Mycobacterium avium subsp. paratuberculosis
cgggcgcucggcc

SEQ ID NO: 853716 - RNA, 20 nt, Mycobacterium avium subsp. paratuberculosis
cgggcgcguugaugccgugc

SEQ ID NO: 853717 - RNA, 13 nt, Mycobacterium avium subsp. paratuberculosis
cgggcgcggugug

SEQ ID NO: 853718 - RNA, 15 nt, Mycobacterium avium subsp. paratuberculosis
cgggcgcgucgaggu

SEQ ID NO: 853719 - RNA, 23 nt, Mycobacterium avium subsp. paratuberculosis
cgggcgcggacagcugcgcgggc

SEQ ID NO: 853720 - RNA, 18 nt, Mycobacterium avium subsp. paratuberculosis
cgggcgcggauggguggc

SEQ ID NO: 853721 - RNA, 12 nt, Mycobacterium avium subsp. paratuberculosis
cgggcggccagc

SEQ ID NO: 853722 - RNA, 16 nt, Mycobacterium avium subsp. paratuberculosis
cgggcggccagccgcg

SEQ ID NO: 853723 - RNA, 17 nt, Mycobacterium avium subsp. paratuberculosis
cgggcggccagccgcgc

SEQ ID NO: 853724 - RNA, 19 nt, Mycobacterium avium subsp. paratuberculosis
cgggcggccagccgcgcgg

SEQ ID NO: 853725 - RNA, 19 nt, Mycobacterium avium subsp. paratuberculosis
cgggcggccagcguggcgc

SEQ ID NO: 853726 - RNA, 21 nt, Mycobacterium avium subsp. paratuberculosis
cgggcggccagcguggcgcgc

SEQ ID NO: 853727 - RNA, 12 nt, Mycobacterium avium subsp. paratuberculosis
cgggcgcuggcc

SEQ ID NO: 853728 - RNA, 14 nt, Mycobacterium avium subsp. paratuberculosis
cgggcgcuggccgu

SEQ ID NO: 853729 - RNA, 16 nt, Mycobacterium avium subsp. paratuberculosis
cgggcgcuggccgugg

SEQ ID NO: 853730 - RNA, 17 nt, Mycobacterium avium subsp. paratuberculosis
cgggcgcuggccguggc

SEQ ID NO: 853731 - RNA, 22 nt, Mycobacterium avium subsp. paratuberculosis
cgggcgcuggccguggccguga

SEQ ID NO: 853732 - RNA, 16 nt, Mycobacterium avium subsp. paratuberculosis
cgggcgcuggcgaugg

SEQ ID NO: 853733 - RNA, 23 nt, Mycobacterium avium subsp. paratuberculosis
cgggcgcugcgcgguggcgcggg

SEQ ID NO: 853734 - RNA, 14 nt, Mycobacterium avium subsp. paratuberculosis
cgggcgcugccguc

SEQ ID NO: 853735 - RNA, 19 nt, Mycobacterium avium subsp. paratuberculosis
cgggcgcucuucgggcugc

SEQ ID NO: 853736 - RNA, 20 nt, Mycobacterium avium subsp. paratuberculosis
cgggcgcucuucgggcugcg

SEQ ID NO: 853737 - RNA, 19 nt, Mycobacterium avium subsp. paratuberculosis
cgggcgcugagcacggugg

SEQ ID NO: 853738 - RNA, 20 nt, Mycobacterium avium subsp. paratuberculosis
cgggcgcugagcacgguggg

SEQ ID NO: 853739 - RNA, 23 nt, Mycobacterium avium subsp. paratuberculosis
cgggcgcugagcacggugggcgc

SEQ ID NO: 853740 - RNA, 12 nt, Mycobacterium avium subsp. paratuberculosis
cgggcgcggcca

SEQ ID NO: 853741 - RNA, 13 nt, Mycobacterium avium subsp. paratuberculosis
cgggcgcggccag

SEQ ID NO: 853742 - RNA, 18 nt, Mycobacterium avium subsp. paratuberculosis
cgggcgcggccagcgcga

SEQ ID NO: 853743 - RNA, 14 nt, Mycobacterium avium subsp. paratuberculosis
cgggcgcgcagcca

SEQ ID NO: 853744 - RNA, 15 nt, Mycobacterium avium subsp. paratuberculosis
cgggcgcgcgcgcca

SEQ ID NO: 853745 - RNA, 13 nt, Mycobacterium avium subsp. paratuberculosis
cgggcgcgccguc

SEQ ID NO: 853746 - RNA, 14 nt, Mycobacterium avium subsp. paratuberculosis
cgggcgcgccggcg

SEQ ID NO: 853747 - RNA, 15 nt, Mycobacterium avium subsp. paratuberculosis
cgggcgcgccggcgc

SEQ ID NO: 853748 - RNA, 11 nt, Mycobacterium avium subsp. paratuberculosis
cgggcgcgccc

SEQ ID NO: 853749 - RNA, 14 nt, Mycobacterium avium subsp. paratuberculosis
cgggcgcgcccacc

SEQ ID NO: 853750 - RNA, 15 nt, Mycobacterium avium subsp. paratuberculosis
cgggcgcgcccaccc

SEQ ID NO: 853751 - RNA, 23 nt, Mycobacterium avium subsp. paratuberculosis
cgggcgcgcccacccgcgccggc

SEQ ID NO: 853752 - RNA, 17 nt, Mycobacterium avium subsp. paratuberculosis
cgggcgaucuccagcgg

SEQ ID NO: 853753 - RNA, 20 nt, Mycobacterium avium subsp. paratuberculosis
cgggcgaucuccagcggccg

SEQ ID NO: 853754 - RNA, 17 nt, Mycobacterium avium subsp. paratuberculosis
cgggcgaucucgaugua

SEQ ID NO: 853755 - RNA, 16 nt, Mycobacterium avium subsp. paratuberculosis
cgggcgcgaacagcgc

SEQ ID NO: 853756 - RNA, 17 nt, Mycobacterium avium subsp. paratuberculosis
cgggcgcgaacagcgcc

SEQ ID NO: 853757 - RNA, 18 nt, Mycobacterium avium subsp. paratuberculosis
cgggcgcgaacagcgccg

SEQ ID NO: 853758 - RNA, 22 nt, Mycobacterium avium subsp. paratuberculosis
cgggcgcgaauuccucagcgcc

SEQ ID NO: 853759 - RNA, 12 nt, Mycobacterium avium subsp. paratuberculosis
cgggcgcgacgg

SEQ ID NO: 853760 - RNA, 14 nt, Mycobacterium avium subsp. paratuberculosis
cgggcgaucagccc

SEQ ID NO: 853761 - RNA, 16 nt, Mycobacterium avium subsp. paratuberculosis
cgggcgaucgccucgg

SEQ ID NO: 853762 - RNA, 17 nt, Mycobacterium avium subsp. paratuberculosis
cgggcgaucgccucggc

SEQ ID NO: 853763 - RNA, 16 nt, Mycobacterium avium subsp. paratuberculosis
cgggcgagcgucgccg

SEQ ID NO: 853764 - RNA, 18 nt, Mycobacterium avium subsp. paratuberculosis
cgggcgaacgaccgggug

SEQ ID NO: 853765 - RNA, 20 nt, Mycobacterium avium subsp. paratuberculosis
cgggccuuguugcggcgcac

SEQ ID NO: 853766 - RNA, 16 nt, Mycobacterium avium subsp. paratuberculosis
cgggcgagcagcgccc

SEQ ID NO: 853767 - RNA, 22 nt, Mycobacterium avium subsp. paratuberculosis
cgggcgagcagcgcccgggugc

SEQ ID NO: 853768 - RNA, 18 nt, Mycobacterium avium subsp. paratuberculosis
cgggccgacagcacgccg

SEQ ID NO: 853769 - RNA, 15 nt, Mycobacterium avium subsp. paratuberculosis
cgggcgagccgaagc

SEQ ID NO: 853770 - RNA, 19 nt, Mycobacterium avium subsp. paratuberculosis
cgggcgagccgacagucgc

SEQ ID NO: 853771 - RNA, 21 nt, Mycobacterium avium subsp. paratuberculosis
cgggcgagccgacagucgcgg

SEQ ID NO: 853772 - RNA, 22 nt, Mycobacterium avium subsp. paratuberculosis
cgggcgagccgacagucgcggg

SEQ ID NO: 853773 - RNA, 19 nt, Mycobacterium avium subsp. paratuberculosis
cgggcgaaaucgcgggccu

SEQ ID NO: 853774 - RNA, 14 nt, Mycobacterium avium subsp. paratuberculosis
cgggcgaaccacgg

SEQ ID NO: 853775 - RNA, 17 nt, Mycobacterium avium subsp. paratuberculosis
cgggcgaaccacggguc

SEQ ID NO: 853776 - RNA, 22 nt, Mycobacterium avium subsp. paratuberculosis
cgggcgaaccacgggucgcugu

SEQ ID NO: 853777 - RNA, 20 nt, Mycobacterium avium subsp. paratuberculosis
cgggccuucuucucgacgua

SEQ ID NO: 853778 - RNA, 18 nt, Mycobacterium avium subsp. paratuberculosis
cgggccuugacggccugg

SEQ ID NO: 853779 - RNA, 16 nt, Mycobacterium avium subsp. paratuberculosis
cgggccuugagcaccg

SEQ ID NO: 853780 - RNA, 21 nt, Mycobacterium avium subsp. paratuberculosis
cgggccuugagcaccgcgucg

SEQ ID NO: 853781 - RNA, 19 nt, Mycobacterium avium subsp. paratuberculosis
cgggccuguccagccgguc

SEQ ID NO: 853782 - RNA, 19 nt, Mycobacterium avium subsp. paratuberculosis
cgggccuguuucugcgccu

SEQ ID NO: 853783 - RNA, 16 nt, Mycobacterium avium subsp. paratuberculosis
cgggccuucacgcugg

SEQ ID NO: 853784 - RNA, 14 nt, Mycobacterium avium subsp. paratuberculosis
cgggccugcggcgc

SEQ ID NO: 853785 - RNA, 19 nt, Mycobacterium avium subsp. paratuberculosis
cgggccugcggcgcggcca

SEQ ID NO: 853786 - RNA, 16 nt, Mycobacterium avium subsp. paratuberculosis
cgggccugcggcggcc

SEQ ID NO: 853787 - RNA, 16 nt, Mycobacterium avium subsp. paratuberculosis
cgggccugcucgucgg

SEQ ID NO: 853788 - RNA, 17 nt, Mycobacterium avium subsp. paratuberculosis
cgggccgaucacgcgga

SEQ ID NO: 853789 - RNA, 15 nt, Mycobacterium avium subsp. paratuberculosis
cgggccugcgcgccg

SEQ ID NO: 853790 - RNA, 16 nt, Mycobacterium avium subsp. paratuberculosis
cgggccugcgcgccga

SEQ ID NO: 853791 - RNA, 17 nt, Mycobacterium avium subsp. paratuberculosis
cgggccugcgcgccgau

SEQ ID NO: 853792 - RNA, 17 nt, Mycobacterium avium subsp. paratuberculosis
cgggccgagcgcgccgc

SEQ ID NO: 853793 - RNA, 18 nt, Mycobacterium avium subsp. paratuberculosis
cgggccgagcgcgccgcc

SEQ ID NO: 853794 - RNA, 16 nt, Mycobacterium avium subsp. paratuberculosis
cgggccgagcguucgg

SEQ ID NO: 853795 - RNA, 18 nt, Mycobacterium avium subsp. paratuberculosis
cgggccgagcguucggcg

SEQ ID NO: 853796 - RNA, 17 nt, Mycobacterium avium subsp. paratuberculosis
cgggccgacccggccga

SEQ ID NO: 853797 - RNA, 13 nt, Mycobacterium avium subsp. paratuberculosis
cgggccgaccguc

SEQ ID NO: 853798 - RNA, 24 nt, Mycobacterium avium subsp. paratuberculosis
cgggccgaccuggcggccggauuc

SEQ ID NO: 853799 - RNA, 16 nt, Mycobacterium avium subsp. paratuberculosis
cgggccgaaccggaag

SEQ ID NO: 853800 - RNA, 21 nt, Mycobacterium avium subsp. paratuberculosis
cgggccgaacugccgaugcug

SEQ ID NO: 853801 - RNA, 17 nt, Mycobacterium avium subsp. paratuberculosis
cgggccgaaggcggcgc

SEQ ID NO: 853802 - RNA, 20 nt, Mycobacterium avium subsp. paratuberculosis
cgggccgaaggcggcgccgg

SEQ ID NO: 853803 - RNA, 21 nt, Mycobacterium avium subsp. paratuberculosis
cgggccgaaggcggcgccggc

SEQ ID NO: 853804 - RNA, 19 nt, Mycobacterium avium subsp. paratuberculosis
cgggcccgagguccucgcg

SEQ ID NO: 853805 - RNA, 22 nt, Mycobacterium avium subsp. paratuberculosis
cgggcccucguccgacagcgcc

SEQ ID NO: 853806 - RNA, 14 nt, Mycobacterium avium subsp. paratuberculosis
cgggcccgacgacg

SEQ ID NO: 853807 - RNA, 22 nt, Mycobacterium avium subsp. paratuberculosis
cgggcccagguaguagcgccac

SEQ ID NO: 853808 - RNA, 20 nt, Mycobacterium avium subsp. paratuberculosis
cgggcugcugcacgucgccg

SEQ ID NO: 853809 - RNA, 14 nt, Mycobacterium avium subsp. paratuberculosis
cgggcugcggcgag

SEQ ID NO: 853810 - RNA, 15 nt, Mycobacterium avium subsp. paratuberculosis
cgggcugcggcgagu

SEQ ID NO: 853811 - RNA, 16 nt, Mycobacterium avium subsp. paratuberculosis
cgggcugcgggcaucg

SEQ ID NO: 853812 - RNA, 13 nt, Mycobacterium avium subsp. paratuberculosis
cgggcugcgguuc

SEQ ID NO: 853813 - RNA, 22 nt, Mycobacterium avium subsp. paratuberculosis
cgggcuggugcgcagccgucgc

SEQ ID NO: 853814 - RNA, 12 nt, Mycobacterium avium subsp. paratuberculosis
cgggcuggccag

SEQ ID NO: 853815 - RNA, 14 nt, Mycobacterium avium subsp. paratuberculosis
cgggcugcgcagca

SEQ ID NO: 853816 - RNA, 16 nt, Mycobacterium avium subsp. paratuberculosis
cgggcugcgcagcacc

SEQ ID NO: 853817 - RNA, 17 nt, Mycobacterium avium subsp. paratuberculosis
cgggcugcccaccacca

SEQ ID NO: 853818 - RNA, 17 nt, Mycobacterium avium subsp. paratuberculosis
cgggcugcccggcgccg

SEQ ID NO: 853819 - RNA, 20 nt, Mycobacterium avium subsp. paratuberculosis
cgggcugcccggcgccgguc

SEQ ID NO: 853820 - RNA, 22 nt, Mycobacterium avium subsp. paratuberculosis
cgggcugcccggcgccggucgu

SEQ ID NO: 853821 - RNA, 13 nt, Mycobacterium avium subsp. paratuberculosis
cgggcugcagcag

SEQ ID NO: 853822 - RNA, 14 nt, Mycobacterium avium subsp. paratuberculosis
cgggcugcagcagc

SEQ ID NO: 853823 - RNA, 18 nt, Mycobacterium avium subsp. paratuberculosis
cgggcugcagcagcgacu

SEQ ID NO: 853824 - RNA, 14 nt, Mycobacterium avium subsp. paratuberculosis
cgggcugcagcgac

SEQ ID NO: 853825 - RNA, 15 nt, Mycobacterium avium subsp. paratuberculosis
cgggcugcagcgacu

SEQ ID NO: 853826 - RNA, 16 nt, Mycobacterium avium subsp. paratuberculosis
cgggcugauccgcgac

SEQ ID NO: 853827 - RNA, 13 nt, Mycobacterium avium subsp. paratuberculosis
cgggcugcacgcu

SEQ ID NO: 853828 - RNA, 15 nt, Mycobacterium avium subsp. paratuberculosis
cgggcugcacgcugc

SEQ ID NO: 853829 - RNA, 20 nt, Mycobacterium avium subsp. paratuberculosis
cgggcugcacgcugcgcacc

SEQ ID NO: 853830 - RNA, 22 nt, Mycobacterium avium subsp. paratuberculosis
cgggcugaacucgacgucgacg

SEQ ID NO: 853831 - RNA, 21 nt, Mycobacterium avium subsp. paratuberculosis
cgggcugaagaucaacagccg

SEQ ID NO: 853832 - RNA, 16 nt, Mycobacterium avium subsp. paratuberculosis
cgggcugacgucgaag

SEQ ID NO: 853833 - RNA, 21 nt, Mycobacterium avium subsp. paratuberculosis
cgggcugagcugugccgcggu

SEQ ID NO: 853834 - RNA, 17 nt, Mycobacterium avium subsp. paratuberculosis
cgggcuggugucccgcg

SEQ ID NO: 853835 - RNA, 19 nt, Mycobacterium avium subsp. paratuberculosis
cgggcuggguccgauugcc

SEQ ID NO: 853836 - RNA, 17 nt, Mycobacterium avium subsp. paratuberculosis
cgggcugucccggccgc

SEQ ID NO: 853837 - RNA, 21 nt, Mycobacterium avium subsp. paratuberculosis
cgggcugucccggccgcgaca

SEQ ID NO: 853838 - RNA, 12 nt, Mycobacterium avium subsp. paratuberculosis
cgggcuguccgc

SEQ ID NO: 853839 - RNA, 13 nt, Mycobacterium avium subsp. paratuberculosis
cgggcugucggcg

SEQ ID NO: 853840 - RNA, 17 nt, Mycobacterium avium subsp. paratuberculosis
cgggcuguugaccacgg

SEQ ID NO: 853841 - RNA, 13 nt, Mycobacterium avium subsp. paratuberculosis
cggggaacaccgg

SEQ ID NO: 853842 - RNA, 17 nt, Mycobacterium avium subsp. paratuberculosis
cggggaacaccggcgag

SEQ ID NO: 853843 - RNA, 18 nt, Mycobacterium avium subsp. paratuberculosis
cggggaacaccggcgagg

SEQ ID NO: 853844 - RNA, 15 nt, Mycobacterium avium subsp. paratuberculosis
cgggcugugccggcg

SEQ ID NO: 853845 - RNA, 15 nt, Mycobacterium avium subsp. paratuberculosis
cgggcuucggcguca

SEQ ID NO: 853846 - RNA, 20 nt, Mycobacterium avium subsp. paratuberculosis
cgggcuugcgcaacagcgug

SEQ ID NO: 853847 - RNA, 17 nt, Mycobacterium avium subsp. paratuberculosis
cgggcuagacgcgcacc

SEQ ID NO: 853848 - RNA, 19 nt, Mycobacterium avium subsp. paratuberculosis
cgggcuagacgcgcaccag

SEQ ID NO: 853849 - RNA, 20 nt, Mycobacterium avium subsp. paratuberculosis
cgggcuagacgcgcaccagg

SEQ ID NO: 853850 - RNA, 16 nt, Mycobacterium avium subsp. paratuberculosis
cgggcuaggcucggca

SEQ ID NO: 853851 - RNA, 20 nt, Mycobacterium avium subsp. paratuberculosis
cgggcuaggcucggcagccg

SEQ ID NO: 853852 - RNA, 16 nt, Mycobacterium avium subsp. paratuberculosis
cgggcgugccggacac

SEQ ID NO: 853853 - RNA, 20 nt, Mycobacterium avium subsp. paratuberculosis
cgggcgugcgaaugacgcgc

SEQ ID NO: 853854 - RNA, 15 nt, Mycobacterium avium subsp. paratuberculosis
cgggcgugcgcgugg

SEQ ID NO: 853855 - RNA, 17 nt, Mycobacterium avium subsp. paratuberculosis
cgggcgugcgguuggcc

SEQ ID NO: 853856 - RNA, 16 nt, Mycobacterium avium subsp. paratuberculosis
cgggcuaucgcccggc

SEQ ID NO: 853857 - RNA, 13 nt, Mycobacterium avium subsp. paratuberculosis
cgggcucagcacc

SEQ ID NO: 853858 - RNA, 16 nt, Mycobacterium avium subsp. paratuberculosis
cgggcucgagccccag

SEQ ID NO: 853859 - RNA, 18 nt, Mycobacterium avium subsp. paratuberculosis
cgggcucgagggcggcga

SEQ ID NO: 853860 - RNA, 22 nt, Mycobacterium avium subsp. paratuberculosis
cgggcucgagggcggcgaccug

SEQ ID NO: 853861 - RNA, 17 nt, Mycobacterium avium subsp. paratuberculosis
cgggcugaccgccagga

SEQ ID NO: 853862 - RNA, 16 nt, Mycobacterium avium subsp. paratuberculosis
cgggcugaccgucgac

SEQ ID NO: 853863 - RNA, 18 nt, Mycobacterium avium subsp. paratuberculosis
cgggcugaccgucgacca

SEQ ID NO: 853864 - RNA, 19 nt, Mycobacterium avium subsp. paratuberculosis
cgggcugaccucgcgcacc

SEQ ID NO: 853865 - RNA, 20 nt, Mycobacterium avium subsp. paratuberculosis
cgggcugaccucgcgcaccg

SEQ ID NO: 853866 - RNA, 23 nt, Mycobacterium avium subsp. paratuberculosis
cgggcugaccucgcgcaccggcu

SEQ ID NO: 853867 - RNA, 22 nt, Mycobacterium avium subsp. paratuberculosis
cgggcucgaacaacccggccgc

SEQ ID NO: 853868 - RNA, 15 nt, Mycobacterium avium subsp. paratuberculosis
cgggcucccgcucgc

SEQ ID NO: 853869 - RNA, 16 nt, Mycobacterium avium subsp. paratuberculosis
cgggcucccgcucgcc

SEQ ID NO: 853870 - RNA, 14 nt, Mycobacterium avium subsp. paratuberculosis
cgggcuccgcacga

SEQ ID NO: 853871 - RNA, 15 nt, Mycobacterium avium subsp. paratuberculosis
cgggcuccgcacgac

SEQ ID NO: 853872 - RNA, 15 nt, Mycobacterium avium subsp. paratuberculosis
cgggcuccagcgggu

SEQ ID NO: 853873 - RNA, 22 nt, Mycobacterium avium subsp. paratuberculosis
cgggcuccagcggguccagccg

SEQ ID NO: 853874 - RNA, 17 nt, Mycobacterium avium subsp. paratuberculosis
cgggcggcccgccucgg

SEQ ID NO: 853875 - RNA, 19 nt, Mycobacterium avium subsp. paratuberculosis
cgggcggcccgccucggcg

SEQ ID NO: 853876 - RNA, 14 nt, Mycobacterium avium subsp. paratuberculosis
cgggcggccagggu

SEQ ID NO: 853877 - RNA, 21 nt, Mycobacterium avium subsp. paratuberculosis
cgggcggccccgggcgcuggc

SEQ ID NO: 853878 - RNA, 15 nt, Mycobacterium avium subsp. paratuberculosis
cgggcggccgggccg

SEQ ID NO: 853879 - RNA, 13 nt, Mycobacterium avium subsp. paratuberculosis
cgggcggccgugg

SEQ ID NO: 853880 - RNA, 14 nt, Mycobacterium avium subsp. paratuberculosis
cgggcggccguggu

SEQ ID NO: 853881 - RNA, 22 nt, Mycobacterium avium subsp. paratuberculosis
cgggcggcccggguggacgccc

SEQ ID NO: 853882 - RNA, 16 nt, Mycobacterium avium subsp. paratuberculosis
cgggcggccgaucccg

SEQ ID NO: 853883 - RNA, 13 nt, Mycobacterium avium subsp. paratuberculosis
cgggcggccgcgg

SEQ ID NO: 853884 - RNA, 13 nt, Mycobacterium avium subsp. paratuberculosis
cgggcggcgccga

SEQ ID NO: 853885 - RNA, 18 nt, Mycobacterium avium subsp. paratuberculosis
cgggcggcgccgaaccgg

SEQ ID NO: 853886 - RNA, 15 nt, Mycobacterium avium subsp. paratuberculosis
cgggcggccugcugc

SEQ ID NO: 853887 - RNA, 17 nt, Mycobacterium avium subsp. paratuberculosis
cgggcggcgcagucggc

SEQ ID NO: 853888 - RNA, 18 nt, Mycobacterium avium subsp. paratuberculosis
cgggcggcgaacaccagc

SEQ ID NO: 853889 - RNA, 21 nt, Mycobacterium avium subsp. paratuberculosis
cgggcggcgaacaccagcacc

SEQ ID NO: 853890 - RNA, 12 nt, Mycobacterium avium subsp. paratuberculosis
cgggcggcgacg

SEQ ID NO: 853891 - RNA, 16 nt, Mycobacterium avium subsp. paratuberculosis
cgggcggcgacgucgu

SEQ ID NO: 853892 - RNA, 15 nt, Mycobacterium avium subsp. paratuberculosis
cgggcggcgaguccg

SEQ ID NO: 853893 - RNA, 13 nt, Mycobacterium avium subsp. paratuberculosis
cgggcggccucgg

SEQ ID NO: 853894 - RNA, 15 nt, Mycobacterium avium subsp. paratuberculosis
cgggcggccucggcg

SEQ ID NO: 853895 - RNA, 13 nt, Mycobacterium avium subsp. paratuberculosis
cgggcggccucgu

SEQ ID NO: 853896 - RNA, 17 nt, Mycobacterium avium subsp. paratuberculosis
cgggcggcgcggcgcag

SEQ ID NO: 853897 - RNA, 16 nt, Mycobacterium avium subsp. paratuberculosis
cgggcgugacggaugu

SEQ ID NO: 853898 - RNA, 15 nt, Mycobacterium avium subsp. paratuberculosis
cgggcgugcccggcg

SEQ ID NO: 853899 - RNA, 16 nt, Mycobacterium avium subsp. paratuberculosis
cgggcgugcccggcgc

SEQ ID NO: 853900 - RNA, 13 nt, Mycobacterium avium subsp. paratuberculosis
cgggcguccacga

SEQ ID NO: 853901 - RNA, 21 nt, Mycobacterium avium subsp. paratuberculosis
cgggcggcggaucagcaccga

SEQ ID NO: 853902 - RNA, 14 nt, Mycobacterium avium subsp. paratuberculosis
cgggcggcggcguu

SEQ ID NO: 853903 - RNA, 23 nt, Mycobacterium avium subsp. paratuberculosis
cgggcggcguccucgaccacccg

SEQ ID NO: 853904 - RNA, 16 nt, Mycobacterium avium subsp. paratuberculosis
cgggcguccucgucgg

SEQ ID NO: 853905 - RNA, 15 nt, Mycobacterium avium subsp. paratuberculosis
cgggcguccuugacc

SEQ ID NO: 853906 - RNA, 18 nt, Mycobacterium avium subsp. paratuberculosis
cgggcguccuugaccagc

SEQ ID NO: 853907 - RNA, 19 nt, Mycobacterium avium subsp. paratuberculosis
cgggcguccuugaccagcu

SEQ ID NO: 853908 - RNA, 21 nt, Mycobacterium avium subsp. paratuberculosis
cgggcguccuugaccagcugc

SEQ ID NO: 853909 - RNA, 16 nt, Mycobacterium avium subsp. paratuberculosis
cgggcgucgacgaugg

SEQ ID NO: 853910 - RNA, 20 nt, Mycobacterium avium subsp. paratuberculosis
cgggcgucgcagaucccgcc

SEQ ID NO: 853911 - RNA, 22 nt, Mycobacterium avium subsp. paratuberculosis
cgggcgucgcagaucccgccgg

SEQ ID NO: 853912 - RNA, 15 nt, Mycobacterium avium subsp. paratuberculosis
cgggcgucggcgggc

SEQ ID NO: 853913 - RNA, 16 nt, Mycobacterium avium subsp. paratuberculosis
cgggcgucggcgggcg

SEQ ID NO: 853914 - RNA, 15 nt, Mycobacterium avium subsp. paratuberculosis
cgggcgucggcggug

SEQ ID NO: 853915 - RNA, 15 nt, Mycobacterium avium subsp. paratuberculosis
cgggcgucgggcagc

SEQ ID NO: 853916 - RNA, 18 nt, Mycobacterium avium subsp. paratuberculosis
cggcgucgggauggucga

SEQ ID NO: 853917 - RNA, 14 nt, Mycobacterium avium subsp. paratuberculosis
cggcgucgggccgg

SEQ ID NO: 853918 - RNA, 16 nt, Mycobacterium avium subsp. paratuberculosis
cggcgucgggccgggg

SEQ ID NO: 853919 - RNA, 18 nt, Mycobacterium avium subsp. paratuberculosis
cggcgucgggccgggggc

SEQ ID NO: 853920 - RNA, 19 nt, Mycobacterium avium subsp. paratuberculosis
cggcgucgggccgggggcg

SEQ ID NO: 853921 - RNA, 19 nt, Mycobacterium avium subsp. paratuberculosis
cggcgucguacagcagccc

SEQ ID NO: 853922 - RNA, 20 nt, Mycobacterium avium subsp. paratuberculosis
cggcgucguacagcagcccc

SEQ ID NO: 853923 - RNA, 17 nt, Mycobacterium avium subsp. paratuberculosis
cggcgucguagacgcug

SEQ ID NO: 853924 - RNA, 18 nt, Mycobacterium avium subsp. paratuberculosis
cggcgucguagacgcugc

SEQ ID NO: 853925 - RNA, 19 nt, Mycobacterium avium subsp. paratuberculosis
cggcgucguagacgcugcc

SEQ ID NO: 853926 - RNA, 13 nt, Mycobacterium avium subsp. paratuberculosis
cggcgucgggcgg

SEQ ID NO: 853927 - RNA, 19 nt, Mycobacterium avium subsp. paratuberculosis
cggcgucgggcggggugug

SEQ ID NO: 853928 - RNA, 20 nt, Mycobacterium avium subsp. paratuberculosis
cggcgucggguagggcgccg

SEQ ID NO: 853929 - RNA, 23 nt, Mycobacterium avium subsp. paratuberculosis
cggcgucggguagggcgccgucg

SEQ ID NO: 853930 - RNA, 21 nt, Mycobacterium avium subsp. paratuberculosis
cggcgucguaguugcggccgg

SEQ ID NO: 853931 - RNA, 22 nt, Mycobacterium avium subsp. paratuberculosis
cggcgucguaguugcggccggc

SEQ ID NO: 853932 - RNA, 14 nt, Mycobacterium avium subsp. paratuberculosis
cggcgucgucgagc

SEQ ID NO: 853933 - RNA, 15 nt, Mycobacterium avium subsp. paratuberculosis
cggcgucgucgagca

SEQ ID NO: 853934 - RNA, 14 nt, Mycobacterium avium subsp. paratuberculosis
cggcgucgucgccg

SEQ ID NO: 853935 - RNA, 15 nt, Mycobacterium avium subsp. paratuberculosis
cggcgucgucgccgu

SEQ ID NO: 853936 - RNA, 18 nt, Mycobacterium avium subsp. paratuberculosis
cggcgucgucgccguggc

SEQ ID NO: 853937 - RNA, 23 nt, Mycobacterium avium subsp. paratuberculosis
cggcgucgucgccguggcggccc

SEQ ID NO: 853938 - RNA, 16 nt, Mycobacterium avium subsp. paratuberculosis
cggcgucgucgucgag

SEQ ID NO: 853939 - RNA, 20 nt, Mycobacterium avium subsp. paratuberculosis
cggcgucgucgucgcagugc

SEQ ID NO: 853940 - RNA, 16 nt, Mycobacterium avium subsp. paratuberculosis
cggcgugagcgagccg

SEQ ID NO: 853941 - RNA, 14 nt, Mycobacterium avium subsp. paratuberculosis
cggcgugaccggcu

SEQ ID NO: 853942 - RNA, 15 nt, Mycobacterium avium subsp. paratuberculosis
cggcgugaccggcug

SEQ ID NO: 853943 - RNA, 16 nt, Mycobacterium avium subsp. paratuberculosis
cggcgugaccggcugc

SEQ ID NO: 853944 - RNA, 16 nt, Mycobacterium avium subsp. paratuberculosis
cggcgugaccgggaag

SEQ ID NO: 853945 - RNA, 19 nt, Mycobacterium avium subsp. paratuberculosis
cggcgugaauccucagcac

SEQ ID NO: 853946 - RNA, 21 nt, Mycobacterium avium subsp. paratuberculosis
cggcgugaauccucagcacgg

SEQ ID NO: 853947 - RNA, 22 nt, Mycobacterium avium subsp. paratuberculosis
cggcgugaauccucagcacggc

SEQ ID NO: 853948 - RNA, 17 nt, Mycobacterium avium subsp. paratuberculosis
cggcgucguugagcagg

SEQ ID NO: 853949 - RNA, 21 nt, Mycobacterium avium subsp. paratuberculosis
cggcgucguugagcaggcugg

SEQ ID NO: 853950 - RNA, 13 nt, Mycobacterium avium subsp. paratuberculosis
cggcgucgccgag

SEQ ID NO: 853951 - RNA, 14 nt, Mycobacterium avium subsp. paratuberculosis
cggcgucgccgagc

SEQ ID NO: 853952 - RNA, 16 nt, Mycobacterium avium subsp. paratuberculosis
cggcgucgccgagccg

SEQ ID NO: 853953 - RNA, 19 nt, Mycobacterium avium subsp. paratuberculosis
cggcgucgggaccgucgcg

SEQ ID NO: 853954 - RNA, 14 nt, Mycobacterium avium subsp. paratuberculosis
cggcgucgaugucg

SEQ ID NO: 853955 - RNA, 22 nt, Mycobacterium avium subsp. paratuberculosis
cggcgucgaugucgcccggcgc

SEQ ID NO: 853956 - RNA, 20 nt, Mycobacterium avium subsp. paratuberculosis
cggcgucgaugucgucgucg

SEQ ID NO: 853957 - RNA, 23 nt, Mycobacterium avium subsp. paratuberculosis
cggcgucgaugucgucgucgacg

SEQ ID NO: 853958 - RNA, 13 nt, Mycobacterium avium subsp. paratuberculosis
cggcgucgauguc

SEQ ID NO: 853959 - RNA, 23 nt, Mycobacterium avium subsp. paratuberculosis
cggcgucgaugaugccggcggac

SEQ ID NO: 853960 - RNA, 19 nt, Mycobacterium avium subsp. paratuberculosis
cggcgucgaugaccucgcg

SEQ ID NO: 853961 - RNA, 22 nt, Mycobacterium avium subsp. paratuberculosis
cggcgucgaugaccucgcgcag

SEQ ID NO: 853962 - RNA, 23 nt, Mycobacterium avium subsp. paratuberculosis
cggcgucgaugaccucgcgcagc

SEQ ID NO: 853963 - RNA, 18 nt, Mycobacterium avium subsp. paratuberculosis
cggcgucgaguucgccgu

SEQ ID NO: 853964 - RNA, 20 nt, Mycobacterium avium subsp. paratuberculosis
cggcgucgaguucgccgucg

SEQ ID NO: 853965 - RNA, 21 nt, Mycobacterium avium subsp. paratuberculosis
cggcgucgaguucgccgucga

SEQ ID NO: 853966 - RNA, 14 nt, Mycobacterium avium subsp. paratuberculosis
cggcgucgaucgcc

SEQ ID NO: 853967 - RNA, 15 nt, Mycobacterium avium subsp. paratuberculosis
cggcgucgaucgccg

SEQ ID NO: 853968 - RNA, 16 nt, Mycobacterium avium subsp. paratuberculosis
cggcgucgaucgccgu

SEQ ID NO: 853969 - RNA, 17 nt, Mycobacterium avium subsp. paratuberculosis
cggcgucgaucgccguc

SEQ ID NO: 853970 - RNA, 18 nt, Mycobacterium avium subsp. paratuberculosis
cggcgucgaucgccguca

SEQ ID NO: 853971 - RNA, 20 nt, Mycobacterium avium subsp. paratuberculosis
cggcgucgaucgccgucacg

SEQ ID NO: 853972 - RNA, 20 nt, Mycobacterium avium subsp. paratuberculosis
cggcgucgagcguggggccu

SEQ ID NO: 853973 - RNA, 16 nt, Mycobacterium avium subsp. paratuberculosis
cggcguccgggcgcug

SEQ ID NO: 853974 - RNA, 19 nt, Mycobacterium avium subsp. paratuberculosis
cggcguccgggcgcugcgc

SEQ ID NO: 853975 - RNA, 15 nt, Mycobacterium avium subsp. paratuberculosis
cggcguccgcggcgg

SEQ ID NO: 853976 - RNA, 16 nt, Mycobacterium avium subsp. paratuberculosis
cggcgucgacgucggg

SEQ ID NO: 853977 - RNA, 14 nt, Mycobacterium avium subsp. paratuberculosis
cggcguccccggcg

SEQ ID NO: 853978 - RNA, 14 nt, Mycobacterium avium subsp. paratuberculosis
cggcgucccgcgcc

SEQ ID NO: 853979 - RNA, 18 nt, Mycobacterium avium subsp. paratuberculosis
cggcgucccgcgccacgu

SEQ ID NO: 853980 - RNA, 16 nt, Mycobacterium avium subsp. paratuberculosis
cggcguccgcgaacgg

SEQ ID NO: 853981 - RNA, 17 nt, Mycobacterium avium subsp. paratuberculosis
cggcguccgcggccgcg

SEQ ID NO: 853982 - RNA, 18 nt, Mycobacterium avium subsp. paratuberculosis
cggcguccgcggccgcgg

SEQ ID NO: 853983 - RNA, 21 nt, Mycobacterium avium subsp. paratuberculosis
cggcguccgcggccgcggcgc

SEQ ID NO: 853984 - RNA, 19 nt, Mycobacterium avium subsp. paratuberculosis
cggcggugucgcccagcug

SEQ ID NO: 853985 - RNA, 20 nt, Mycobacterium avium subsp. paratuberculosis
cggcggugucgcccagcugg

SEQ ID NO: 853986 - RNA, 18 nt, Mycobacterium avium subsp. paratuberculosis
cggcggugucggcggcaa

SEQ ID NO: 853987 - RNA, 14 nt, Mycobacterium avium subsp. paratuberculosis
cggcggugucggug

SEQ ID NO: 853988 - RNA, 15 nt, Mycobacterium avium subsp. paratuberculosis
cggcggugucggugc

SEQ ID NO: 853989 - RNA, 16 nt, Mycobacterium avium subsp. paratuberculosis
cggcggugucggugcc

SEQ ID NO: 853990 - RNA, 17 nt, Mycobacterium avium subsp. paratuberculosis
cggcggugucggugccg

SEQ ID NO: 853991 - RNA, 20 nt, Mycobacterium avium subsp. paratuberculosis
cggcggugucggugccgagc

SEQ ID NO: 853992 - RNA, 20 nt, Mycobacterium avium subsp. paratuberculosis
cggcggugguccgcgcgacc

SEQ ID NO: 853993 - RNA, 21 nt, Mycobacterium avium subsp. paratuberculosis
cggcggugguccgcgcgacca

SEQ ID NO: 853994 - RNA, 21 nt, Mycobacterium avium subsp. paratuberculosis
cggcgguggugaacgcgucgg

SEQ ID NO: 853995 - RNA, 20 nt, Mycobacterium avium subsp. paratuberculosis
cggcgguggugccgccgucg

SEQ ID NO: 853996 - RNA, 19 nt, Mycobacterium avium subsp. paratuberculosis
cggcgguguccacgaugcg

SEQ ID NO: 853997 - RNA, 15 nt, Mycobacterium avium subsp. paratuberculosis
cggcggugucgaagg

SEQ ID NO: 853998 - RNA, 16 nt, Mycobacterium avium subsp. paratuberculosis
cggcgguucgauaccg

SEQ ID NO: 853999 - RNA, 23 nt, Mycobacterium avium subsp. paratuberculosis
cggcgguucgauaccguccgcgc

SEQ ID NO: 854000 - RNA, 21 nt, Mycobacterium avium subsp. paratuberculosis
cggcgguucggaguccaccgg

SEQ ID NO: 854001 - RNA, 18 nt, Mycobacterium avium subsp. paratuberculosis
cggcgguucggcgggccu

SEQ ID NO: 854002 - RNA, 17 nt, Mycobacterium avium subsp. paratuberculosis
cggcgguugcucgucgg

SEQ ID NO: 854003 - RNA, 21 nt, Mycobacterium avium subsp. paratuberculosis
cggcgguugcucgucggccga

SEQ ID NO: 854004 - RNA, 22 nt, Mycobacterium avium subsp. paratuberculosis
cggcgguugcucgucggccgac

SEQ ID NO: 854005 - RNA, 17 nt, Mycobacterium avium subsp. paratuberculosis
cggcgguuucggugccg

SEQ ID NO: 854006 - RNA, 20 nt, Mycobacterium avium subsp. paratuberculosis
cggcgguuucggugccggcc

SEQ ID NO: 854007 - RNA, 17 nt, Mycobacterium avium subsp. paratuberculosis
cggcgguuuuggucggc

SEQ ID NO: 854008 - RNA, 19 nt, Mycobacterium avium subsp. paratuberculosis
cggcgguuuuggucggcac

SEQ ID NO: 854009 - RNA, 21 nt, Mycobacterium avium subsp. paratuberculosis
cggcgucccagugcucgacca

SEQ ID NO: 854010 - RNA, 18 nt, Mycobacterium avium subsp. paratuberculosis
cggcguccaguagccgcc

SEQ ID NO: 854011 - RNA, 20 nt, Mycobacterium avium subsp. paratuberculosis
cggcguccaguagccgccgg

SEQ ID NO: 854012 - RNA, 22 nt, Mycobacterium avium subsp. paratuberculosis
cggcguccagugcaugccggcc

SEQ ID NO: 854013 - RNA, 18 nt, Mycobacterium avium subsp. paratuberculosis
cggcguccaguucggcca

SEQ ID NO: 854014 - RNA, 22 nt, Mycobacterium avium subsp. paratuberculosis
cggcguccaguucggccagcgc

SEQ ID NO: 854015 - RNA, 20 nt, Mycobacterium avium subsp. paratuberculosis
cggcguccaguugcggcacg

SEQ ID NO: 854016 - RNA, 21 nt, Mycobacterium avium subsp. paratuberculosis
cggcgucacauacgccucacc

SEQ ID NO: 854017 - RNA, 13 nt, Mycobacterium avium subsp. paratuberculosis
cggcgucaccagg

SEQ ID NO: 854018 - RNA, 19 nt, Mycobacterium avium subsp. paratuberculosis
cggcguccagcgcggugag

SEQ ID NO: 854019 - RNA, 13 nt, Mycobacterium avium subsp. paratuberculosis
cggcguccagcug

SEQ ID NO: 854020 - RNA, 21 nt, Mycobacterium avium subsp. paratuberculosis
cggcguccaggcgcaccgcca

SEQ ID NO: 854021 - RNA, 19 nt, Mycobacterium avium subsp. paratuberculosis
cggcguaucuccaccgucg

SEQ ID NO: 854022 - RNA, 22 nt, Mycobacterium avium subsp. paratuberculosis
cggcguaggugggcagcgcggc

SEQ ID NO: 854023 - RNA, 16 nt, Mycobacterium avium subsp. paratuberculosis
cggcguagucgccggu

SEQ ID NO: 854024 - RNA, 19 nt, Mycobacterium avium subsp. paratuberculosis
cggcguagucgccggugua

SEQ ID NO: 854025 - RNA, 16 nt, Mycobacterium avium subsp. paratuberculosis
cggcguagucggcgca

SEQ ID NO: 854026 - RNA, 17 nt, Mycobacterium avium subsp. paratuberculosis
cggcguagucggcgcag

SEQ ID NO: 854027 - RNA, 18 nt, Mycobacterium avium subsp. paratuberculosis
cggcguagucggcgcagc

SEQ ID NO: 854028 - RNA, 13 nt, Mycobacterium avium subsp. paratuberculosis
cggcguaguucgu

SEQ ID NO: 854029 - RNA, 20 nt, Mycobacterium avium subsp. paratuberculosis
cggcguaguucgucgaacag

SEQ ID NO: 854030 - RNA, 14 nt, Mycobacterium avium subsp. paratuberculosis
cggcguagccgccg

SEQ ID NO: 854031 - RNA, 21 nt, Mycobacterium avium subsp. paratuberculosis
cggcguagaggugcagcgggc

SEQ ID NO: 854032 - RNA, 14 nt, Mycobacterium avium subsp. paratuberculosis
cggcguagcagucg

SEQ ID NO: 854033 - RNA, 15 nt, Mycobacterium avium subsp. paratuberculosis
cggcguagcagucgg

SEQ ID NO: 854034 - RNA, 18 nt, Mycobacterium avium subsp. paratuberculosis
cggcguagcagucggccu

SEQ ID NO: 854035 - RNA, 23 nt, Mycobacterium avium subsp. paratuberculosis
cggcguagcagucggccugcagc

SEQ ID NO: 854036 - RNA, 23 nt, Mycobacterium avium subsp. paratuberculosis
cggcggguucugauacaccaccc

SEQ ID NO: 854037 - RNA, 22 nt, Mycobacterium avium subsp. paratuberculosis
cggcgggugggggucuggucgg

SEQ ID NO: 854038 - RNA, 23 nt, Mycobacterium avium subsp. paratuberculosis
cggcgggugggggucuggucggu

SEQ ID NO: 854039 - RNA, 16 nt, Mycobacterium avium subsp. paratuberculosis
cggcggguugcugagc

SEQ ID NO: 854040 - RNA, 22 nt, Mycobacterium avium subsp. paratuberculosis
cggcggguugcugagccgccga

SEQ ID NO: 854041 - RNA, 14 nt, Mycobacterium avium subsp. paratuberculosis
cggcggguuggccg

SEQ ID NO: 854042 - RNA, 20 nt, Mycobacterium avium subsp. paratuberculosis
cggcggguaugucggcgacc

SEQ ID NO: 854043 - RNA, 15 nt, Mycobacterium avium subsp. paratuberculosis
cggcgggucagcacc

SEQ ID NO: 854044 - RNA, 14 nt, Mycobacterium avium subsp. paratuberculosis
cggcgggucagcag

SEQ ID NO: 854045 - RNA, 19 nt, Mycobacterium avium subsp. paratuberculosis
cggcgggucguagccgucg

SEQ ID NO: 854046 - RNA, 20 nt, Mycobacterium avium subsp. paratuberculosis
cggcgggucguagccgucga

SEQ ID NO: 854047 - RNA, 17 nt, Mycobacterium avium subsp. paratuberculosis
cggcgggugagccgguc

SEQ ID NO: 854048 - RNA, 13 nt, Mycobacterium avium subsp. paratuberculosis
cggcgggugcggg

SEQ ID NO: 854049 - RNA, 19 nt, Mycobacterium avium subsp. paratuberculosis
cggcgggugcgggcgcugc

SEQ ID NO: 854050 - RNA, 13 nt, Mycobacterium avium subsp. paratuberculosis
cggcgggcucgga

SEQ ID NO: 854051 - RNA, 18 nt, Mycobacterium avium subsp. paratuberculosis
cggcggggcgcguucggg

SEQ ID NO: 854052 - RNA, 17 nt, Mycobacterium avium subsp. paratuberculosis
cggcggggcggaugcgc

SEQ ID NO: 854053 - RNA, 20 nt, Mycobacterium avium subsp. paratuberculosis
cggcggggcgucgcccgccg

SEQ ID NO: 854054 - RNA, 21 nt, Mycobacterium avium subsp. paratuberculosis
cggcggggcgucgcccgccga

SEQ ID NO: 854055 - RNA, 18 nt, Mycobacterium avium subsp. paratuberculosis
cggcggggcugcccaggu

SEQ ID NO: 854056 - RNA, 15 nt, Mycobacterium avium subsp. paratuberculosis
cggcgggggaucggg

SEQ ID NO: 854057 - RNA, 15 nt, Mycobacterium avium subsp. paratuberculosis
cggcgggggcaggga

SEQ ID NO: 854058 - RNA, 17 nt, Mycobacterium avium subsp. paratuberculosis
cggcgggggcgagaccg

SEQ ID NO: 854059 - RNA, 20 nt, Mycobacterium avium subsp. paratuberculosis
cggcgggggcgagaccgucg

SEQ ID NO: 854060 - RNA, 13 nt, Mycobacterium avium subsp. paratuberculosis
cggcgggggcgcg

SEQ ID NO: 854061 - RNA, 16 nt, Mycobacterium avium subsp. paratuberculosis
cggcgggggcgcgucc

SEQ ID NO: 854062 - RNA, 17 nt, Mycobacterium avium subsp. paratuberculosis
cggcgggggcgcguccg

SEQ ID NO: 854063 - RNA, 22 nt, Mycobacterium avium subsp. paratuberculosis
cggcgggggcggcggggugacg

SEQ ID NO: 854064 - RNA, 16 nt, Mycobacterium avium subsp. paratuberculosis
cggcgggggcgggccc

SEQ ID NO: 854065 - RNA, 22 nt, Mycobacterium avium subsp. paratuberculosis
cggcgggggcgggccccacgcc

SEQ ID NO: 854066 - RNA, 21 nt, Mycobacterium avium subsp. paratuberculosis
cggcggggggagaggcgcggc

SEQ ID NO: 854067 - RNA, 23 nt, Mycobacterium avium subsp. paratuberculosis
cggcggggggagaggcgcggcgc

SEQ ID NO: 854068 - RNA, 22 nt, Mycobacterium avium subsp. paratuberculosis
cggcggggguucgacgucacga

SEQ ID NO: 854069 - RNA, 19 nt, Mycobacterium avium subsp. paratuberculosis
cggcggggucaagcggcag

SEQ ID NO: 854070 - RNA, 22 nt, Mycobacterium avium subsp. paratuberculosis
cggcggggugggcaccuggccg

SEQ ID NO: 854071 - RNA, 20 nt, Mycobacterium avium subsp. paratuberculosis
cggcgggguuccgucgaaca

SEQ ID NO: 854072 - RNA, 21 nt, Mycobacterium avium subsp. paratuberculosis
cggcgggguuccgucgaacag

SEQ ID NO: 854073 - RNA, 22 nt, Mycobacterium avium subsp. paratuberculosis
cggcgggguuccgucgaacagc

SEQ ID NO: 854074 - RNA, 13 nt, Mycobacterium avium subsp. paratuberculosis
cggcgguccagcg

SEQ ID NO: 854075 - RNA, 15 nt, Mycobacterium avium subsp. paratuberculosis
cggcgguccagcgag

SEQ ID NO: 854076 - RNA, 17 nt, Mycobacterium avium subsp. paratuberculosis
cggcgguccagcgagcc

SEQ ID NO: 854077 - RNA, 16 nt, Mycobacterium avium subsp. paratuberculosis
cggcggucagguucgc

SEQ ID NO: 854078 - RNA, 15 nt, Mycobacterium avium subsp. paratuberculosis
cggcggucaggccgu

SEQ ID NO: 854079 - RNA, 17 nt, Mycobacterium avium subsp. paratuberculosis
cggcggucaggccgucu

SEQ ID NO: 854080 - RNA, 19 nt, Mycobacterium avium subsp. paratuberculosis
cggcggucaggccgucucg

SEQ ID NO: 854081 - RNA, 13 nt, Mycobacterium avium subsp. paratuberculosis
cggcggucagcac

SEQ ID NO: 854082 - RNA, 15 nt, Mycobacterium avium subsp. paratuberculosis
cggcggucagcaccg

SEQ ID NO: 854083 - RNA, 22 nt, Mycobacterium avium subsp. paratuberculosis
cggcggucagcaccgucaccgc

SEQ ID NO: 854084 - RNA, 23 nt, Mycobacterium avium subsp. paratuberculosis
cggcggucagcaccgucaccgcc

SEQ ID NO: 854085 - RNA, 12 nt, Mycobacterium avium subsp. paratuberculosis
cggcggucacga

SEQ ID NO: 854086 - RNA, 14 nt, Mycobacterium avium subsp. paratuberculosis
cggcggucacgccc

SEQ ID NO: 854087 - RNA, 15 nt, Mycobacterium avium subsp. paratuberculosis
cggcggucacgcccg

SEQ ID NO: 854088 - RNA, 18 nt, Mycobacterium avium subsp. paratuberculosis
cggcggucacgcccgggu

SEQ ID NO: 854089 - RNA, 17 nt, Mycobacterium avium subsp. paratuberculosis
cggcgguaugcccgggc

SEQ ID NO: 854090 - RNA, 19 nt, Mycobacterium avium subsp. paratuberculosis
cggcgguaugcccgggccg

SEQ ID NO: 854091 - RNA, 22 nt, Mycobacterium avium subsp. paratuberculosis
cggcgguaugcccgggccguca

SEQ ID NO: 854092 - RNA, 19 nt, Mycobacterium avium subsp. paratuberculosis
cggcgguauucgucacccc

SEQ ID NO: 854093 - RNA, 20 nt, Mycobacterium avium subsp. paratuberculosis
cggcggucaacacgaagccg

SEQ ID NO: 854094 - RNA, 20 nt, Mycobacterium avium subsp. paratuberculosis
cggcgguaccgaacgacgag

SEQ ID NO: 854095 - RNA, 13 nt, Mycobacterium avium subsp. paratuberculosis
cggcgguaccgcc

SEQ ID NO: 854096 - RNA, 14 nt, Mycobacterium avium subsp. paratuberculosis
cggcgguaccgccg

SEQ ID NO: 854097 - RNA, 18 nt, Mycobacterium avium subsp. paratuberculosis
cggcgguaccgccgaucg

SEQ ID NO: 854098 - RNA, 19 nt, Mycobacterium avium subsp. paratuberculosis
cggcgguaccgccgaucgu

SEQ ID NO: 854099 - RNA, 15 nt, Mycobacterium avium subsp. paratuberculosis
cggcgguagcgggcg

SEQ ID NO: 854100 - RNA, 18 nt, Mycobacterium avium subsp. paratuberculosis
cggcggugaugcgcgccg

SEQ ID NO: 854101 - RNA, 20 nt, Mycobacterium avium subsp. paratuberculosis
cggcggugaugcgcgccgac

SEQ ID NO: 854102 - RNA, 15 nt, Mycobacterium avium subsp. paratuberculosis
cggcggugauggaca

SEQ ID NO: 854103 - RNA, 13 nt, Mycobacterium avium subsp. paratuberculosis
cggcggugagccg

SEQ ID NO: 854104 - RNA, 19 nt, Mycobacterium avium subsp. paratuberculosis
cggcggugagccgccacag

SEQ ID NO: 854105 - RNA, 17 nt, Mycobacterium avium subsp. paratuberculosis
cggcggugagcgcgucg

SEQ ID NO: 854106 - RNA, 19 nt, Mycobacterium avium subsp. paratuberculosis
cggcggugauccgcccggc

SEQ ID NO: 854107 - RNA, 23 nt, Mycobacterium avium subsp. paratuberculosis
cggcggugauccgcccggcccgc

SEQ ID NO: 854108 - RNA, 14 nt, Mycobacterium avium subsp. paratuberculosis
cggcggugaucgcc

SEQ ID NO: 854109 - RNA, 17 nt, Mycobacterium avium subsp. paratuberculosis
cggcggugaucucgucg

SEQ ID NO: 854110 - RNA, 18 nt, Mycobacterium avium subsp. paratuberculosis
cggcggugaucucgucgg

SEQ ID NO: 854111 - RNA, 15 nt, Mycobacterium avium subsp. paratuberculosis
cggcggugccggcca

SEQ ID NO: 854112 - RNA, 16 nt, Mycobacterium avium subsp. paratuberculosis
cggcggugccggccag

SEQ ID NO: 854113 - RNA, 19 nt, Mycobacterium avium subsp. paratuberculosis
cggcggugccggccagauc

SEQ ID NO: 854114 - RNA, 13 nt, Mycobacterium avium subsp. paratuberculosis
cggcggugccggu

SEQ ID NO: 854115 - RNA, 12 nt, Mycobacterium avium subsp. paratuberculosis
cggcggugccga

SEQ ID NO: 854116 - RNA, 14 nt, Mycobacterium avium subsp. paratuberculosis
cggcggugccgagc

SEQ ID NO: 854117 - RNA, 22 nt, Mycobacterium avium subsp. paratuberculosis
cggcggugccgcaggcgaacac

SEQ ID NO: 854118 - RNA, 18 nt, Mycobacterium avium subsp. paratuberculosis
cggcggugccguccucgg

SEQ ID NO: 854119 - RNA, 12 nt, Mycobacterium avium subsp. paratuberculosis
cggcggugcggc

SEQ ID NO: 854120 - RNA, 16 nt, Mycobacterium avium subsp. paratuberculosis
cggcggugcgcagccg

SEQ ID NO: 854121 - RNA, 23 nt, Mycobacterium avium subsp. paratuberculosis
cggcggugcgcagccgcugcagc

SEQ ID NO: 854122 - RNA, 21 nt, Mycobacterium avium subsp. paratuberculosis
cggcggugcgggugguguggc

SEQ ID NO: 854123 - RNA, 19 nt, Mycobacterium avium subsp. paratuberculosis
cggcggugcgucgggcgcc

SEQ ID NO: 854124 - RNA, 22 nt, Mycobacterium avium subsp. paratuberculosis
cggcggugcgucgggcgccggc

SEQ ID NO: 854125 - RNA, 15 nt, Mycobacterium avium subsp. paratuberculosis
cggcggugcucgcgc

SEQ ID NO: 854126 - RNA, 16 nt, Mycobacterium avium subsp. paratuberculosis
cggcggugcucgcgcc

SEQ ID NO: 854127 - RNA, 19 nt, Mycobacterium avium subsp. paratuberculosis
cggcggugcucgcgccggg

SEQ ID NO: 854128 - RNA, 21 nt, Mycobacterium avium subsp. paratuberculosis
cggcggugcucgcgccgggcg

SEQ ID NO: 854129 - RNA, 22 nt, Mycobacterium avium subsp. paratuberculosis
cggcggugcucucgucgucggc

SEQ ID NO: 854130 - RNA, 14 nt, Mycobacterium avium subsp. paratuberculosis
cggcgguggccugc

SEQ ID NO: 854131 - RNA, 15 nt, Mycobacterium avium subsp. paratuberculosis
cggcgguggccugcc

SEQ ID NO: 854132 - RNA, 15 nt, Mycobacterium avium subsp. paratuberculosis
cggcgguggccuggu

SEQ ID NO: 854133 - RNA, 18 nt, Mycobacterium avium subsp. paratuberculosis
cggcgguggccuggucga

SEQ ID NO: 854134 - RNA, 23 nt, Mycobacterium avium subsp. paratuberculosis
cggcgguggccuggucgaacagc

SEQ ID NO: 854135 - RNA, 15 nt, Mycobacterium avium subsp. paratuberculosis
cggcgguggcgauga

SEQ ID NO: 854136 - RNA, 14 nt, Mycobacterium avium subsp. paratuberculosis
cggcggugcggacc

SEQ ID NO: 854137 - RNA, 16 nt, Mycobacterium avium subsp. paratuberculosis
cggcggugggcucggc

SEQ ID NO: 854138 - RNA, 18 nt, Mycobacterium avium subsp. paratuberculosis
cggcggugggcucggcca

SEQ ID NO: 854139 - RNA, 23 nt, Mycobacterium avium subsp. paratuberculosis
cggcggugaccggaucggccagc

SEQ ID NO: 854140 - RNA, 20 nt, Mycobacterium avium subsp. paratuberculosis
cggcggugacgaugucgaug

SEQ ID NO: 854141 - RNA, 21 nt, Mycobacterium avium subsp. paratuberculosis
cggcggugacgaugucgauga

SEQ ID NO: 854142 - RNA, 18 nt, Mycobacterium avium subsp. paratuberculosis
cggcggucuuggcggcca

SEQ ID NO: 854143 - RNA, 22 nt, Mycobacterium avium subsp. paratuberculosis
cggcggugacguuccagccgug

SEQ ID NO: 854144 - RNA, 20 nt, Mycobacterium avium subsp. paratuberculosis
cggcggucugucgcgcgaac

SEQ ID NO: 854145 - RNA, 22 nt, Mycobacterium avium subsp. paratuberculosis
cggcggucugucgcgcgaacag

SEQ ID NO: 854146 - RNA, 21 nt, Mycobacterium avium subsp. paratuberculosis
cggcggucuucuuggccgcgc

SEQ ID NO: 854147 - RNA, 22 nt, Mycobacterium avium subsp. paratuberculosis
cggcggucuucuuggcgggcga

SEQ ID NO: 854148 - RNA, 23 nt, Mycobacterium avium subsp. paratuberculosis
cggcggucuucuuggcgggcgac

SEQ ID NO: 854149 - RNA, 15 nt, Mycobacterium avium subsp. paratuberculosis
cggcgguccgcccgg

SEQ ID NO: 854150 - RNA, 20 nt, Mycobacterium avium subsp. paratuberculosis
cggcgguccgcccggaccag

SEQ ID NO: 854151 - RNA, 24 nt, Mycobacterium avium subsp. paratuberculosis
cggcgguccgccgcagcggcgccg

SEQ ID NO: 854152 - RNA, 20 nt, Mycobacterium avium subsp. paratuberculosis
cggcgguccguucggcgguu

SEQ ID NO: 854153 - RNA, 15 nt, Mycobacterium avium subsp. paratuberculosis
cggcgguccugcggc

SEQ ID NO: 854154 - RNA, 20 nt, Mycobacterium avium subsp. paratuberculosis
cggcggucgacacgaucggc

SEQ ID NO: 854155 - RNA, 21 nt, Mycobacterium avium subsp. paratuberculosis
cggcggucgacacgaucggca

SEQ ID NO: 854156 - RNA, 16 nt, Mycobacterium avium subsp. paratuberculosis
cggcgguccccgaagc

SEQ ID NO: 854157 - RNA, 18 nt, Mycobacterium avium subsp. paratuberculosis
cggcggucccgugcgccg

SEQ ID NO: 854158 - RNA, 18 nt, Mycobacterium avium subsp. paratuberculosis
cggcggucgccacucggg

SEQ ID NO: 854159 - RNA, 15 nt, Mycobacterium avium subsp. paratuberculosis
cggcggucgccagcg

SEQ ID NO: 854160 - RNA, 16 nt, Mycobacterium avium subsp. paratuberculosis
cggcggucgccagcgc

SEQ ID NO: 854161 - RNA, 20 nt, Mycobacterium avium subsp. paratuberculosis
cggcggucgccagcgccacg

SEQ ID NO: 854162 - RNA, 14 nt, Mycobacterium avium subsp. paratuberculosis
cggcggucgcgcgc

SEQ ID NO: 854163 - RNA, 15 nt, Mycobacterium avium subsp. paratuberculosis
cggcggucgcgcgcc

SEQ ID NO: 854164 - RNA, 18 nt, Mycobacterium avium subsp. paratuberculosis
cggcggucgcgcgccggc

SEQ ID NO: 854165 - RNA, 15 nt, Mycobacterium avium subsp. paratuberculosis
cggcggucgcggugc

SEQ ID NO: 854166 - RNA, 20 nt, Mycobacterium avium subsp. paratuberculosis
cggcggucgcggugcccagc

SEQ ID NO: 854167 - RNA, 11 nt, Mycobacterium avium subsp. paratuberculosis
cggcggucgcu

SEQ ID NO: 854168 - RNA, 14 nt, Mycobacterium avium subsp. paratuberculosis
cggcggucggaucg

SEQ ID NO: 854169 - RNA, 17 nt, Mycobacterium avium subsp. paratuberculosis
cggcggucggaucgagc

SEQ ID NO: 854170 - RNA, 12 nt, Mycobacterium avium subsp. paratuberculosis
cggcggucggca

SEQ ID NO: 854171 - RNA, 15 nt, Mycobacterium avium subsp. paratuberculosis
cggcggucggcgccg

SEQ ID NO: 854172 - RNA, 15 nt, Mycobacterium avium subsp. paratuberculosis
cggcggcgacgaugc

SEQ ID NO: 854173 - RNA, 16 nt, Mycobacterium avium subsp. paratuberculosis
cggcggcgacgaugcg

SEQ ID NO: 854174 - RNA, 14 nt, Mycobacterium avium subsp. paratuberculosis
cggcggcgacggcg

SEQ ID NO: 854175 - RNA, 15 nt, Mycobacterium avium subsp. paratuberculosis
cggcggcgacggcga

SEQ ID NO: 854176 - RNA, 16 nt, Mycobacterium avium subsp. paratuberculosis
cggcggcgacggcgac

SEQ ID NO: 854177 - RNA, 15 nt, Mycobacterium avium subsp. paratuberculosis
cggcggcgacggugu

SEQ ID NO: 854178 - RNA, 13 nt, Mycobacterium avium subsp. paratuberculosis
cggcggcgccaug

SEQ ID NO: 854179 - RNA, 13 nt, Mycobacterium avium subsp. paratuberculosis
cggcggcgcaggc

SEQ ID NO: 854180 - RNA, 19 nt, Mycobacterium avium subsp. paratuberculosis
cggcggcgauccggccggc

SEQ ID NO: 854181 - RNA, 22 nt, Mycobacterium avium subsp. paratuberculosis
cggcggcgauccggccggcggc

SEQ ID NO: 854182 - RNA, 22 nt, Mycobacterium avium subsp. paratuberculosis
cggcggcgaggacgucgucgac

SEQ ID NO: 854183 - RNA, 23 nt, Mycobacterium avium subsp. paratuberculosis
cggcggcgaggacgucgucgacg

SEQ ID NO: 854184 - RNA, 13 nt, Mycobacterium avium subsp. paratuberculosis
cggcggcgacgug

SEQ ID NO: 854185 - RNA, 14 nt, Mycobacterium avium subsp. paratuberculosis
cggcggcgacguga

SEQ ID NO: 854186 - RNA, 22 nt, Mycobacterium avium subsp. paratuberculosis
cggcggcgacgugaucggcggc

SEQ ID NO: 854187 - RNA, 17 nt, Mycobacterium avium subsp. paratuberculosis
cggcggcgacgugccgg

SEQ ID NO: 854188 - RNA, 20 nt, Mycobacterium avium subsp. paratuberculosis
cggcggccuuuuccggcgac

SEQ ID NO: 854189 - RNA, 17 nt, Mycobacterium avium subsp. paratuberculosis
cggcggccuugaacgcg

SEQ ID NO: 854190 - RNA, 22 nt, Mycobacterium avium subsp. paratuberculosis
cggcggccuugaacgcguccga

SEQ ID NO: 854191 - RNA, 22 nt, Mycobacterium avium subsp. paratuberculosis
cggcggccuuuuucugcgcccg

SEQ ID NO: 854192 - RNA, 23 nt, Mycobacterium avium subsp. paratuberculosis
cggcggccuuuuucugcgcccga

SEQ ID NO: 854193 - RNA, 14 nt, Mycobacterium avium subsp. paratuberculosis
cggcggcgaacgcc

SEQ ID NO: 854194 - RNA, 16 nt, Mycobacterium avium subsp. paratuberculosis
cggcggcgaacgccgc

SEQ ID NO: 854195 - RNA, 17 nt, Mycobacterium avium subsp. paratuberculosis
cggcggccuggccgucg

SEQ ID NO: 854196 - RNA, 18 nt, Mycobacterium avium subsp. paratuberculosis
cggcggccuggccgucgc

SEQ ID NO: 854197 - RNA, 21 nt, Mycobacterium avium subsp. paratuberculosis
cggcggccuggccgucgcggc

SEQ ID NO: 854198 - RNA, 17 nt, Mycobacterium avium subsp. paratuberculosis
cggcggccugcaccucg

SEQ ID NO: 854199 - RNA, 22 nt, Mycobacterium avium subsp. paratuberculosis
cggcggccugcuucucgccguc

SEQ ID NO: 854200 - RNA, 20 nt, Mycobacterium avium subsp. paratuberculosis
cggcggccugcuugaccgcc

SEQ ID NO: 854201 - RNA, 22 nt, Mycobacterium avium subsp. paratuberculosis
cggcggccugcuugaccgccag

SEQ ID NO: 854202 - RNA, 17 nt, Mycobacterium avium subsp. paratuberculosis
cggcggcgcucagcgcg

SEQ ID NO: 854203 - RNA, 15 nt, Mycobacterium avium subsp. paratuberculosis
cggcggcgcugaugc

SEQ ID NO: 854204 - RNA, 17 nt, Mycobacterium avium subsp. paratuberculosis
cggcggcgcugaugccg

SEQ ID NO: 854205 - RNA, 14 nt, Mycobacterium avium subsp. paratuberculosis
cggcggcggaccgu

SEQ ID NO: 854206 - RNA, 23 nt, Mycobacterium avium subsp. paratuberculosis
cggcggcggaccgucggugucga

SEQ ID NO: 854207 - RNA, 12 nt, Mycobacterium avium subsp. paratuberculosis
cggcggcgcggg

SEQ ID NO: 854208 - RNA, 15 nt, Mycobacterium avium subsp. paratuberculosis
cggcggcgcgggcgc

SEQ ID NO: 854209 - RNA, 16 nt, Mycobacterium avium subsp. paratuberculosis
cggcggcgcgggcggc

SEQ ID NO: 854210 - RNA, 13 nt, Mycobacterium avium subsp. paratuberculosis
cggcggcgcggca

SEQ ID NO: 854211 - RNA, 14 nt, Mycobacterium avium subsp. paratuberculosis
cggcggcgcggcag

SEQ ID NO: 854212 - RNA, 14 nt, Mycobacterium avium subsp. paratuberculosis
cggcggcgcggccc

SEQ ID NO: 854213 - RNA, 13 nt, Mycobacterium avium subsp. paratuberculosis
cggcggcgcgcug

SEQ ID NO: 854214 - RNA, 16 nt, Mycobacterium avium subsp. paratuberculosis
cggcggcgcgcugcag

SEQ ID NO: 854215 - RNA, 14 nt, Mycobacterium avium subsp. paratuberculosis
cggcggcgcgccgg

SEQ ID NO: 854216 - RNA, 17 nt, Mycobacterium avium subsp. paratuberculosis
cggcggcgcgccggccg

SEQ ID NO: 854217 - RNA, 21 nt, Mycobacterium avium subsp. paratuberculosis
cggcggcgcgccggccggagc

SEQ ID NO: 854218 - RNA, 13 nt, Mycobacterium avium subsp. paratuberculosis
cggcggcgcgccg

SEQ ID NO: 854219 - RNA, 14 nt, Mycobacterium avium subsp. paratuberculosis
cggcggcgcgcagg

SEQ ID NO: 854220 - RNA, 15 nt, Mycobacterium avium subsp. paratuberculosis
cggcggcgcgcaggc

SEQ ID NO: 854221 - RNA, 22 nt, Mycobacterium avium subsp. paratuberculosis
cggcggcgcgcaggcgcgcggc

SEQ ID NO: 854222 - RNA, 15 nt, Mycobacterium avium subsp. paratuberculosis
cggcggcgcgcacgu

SEQ ID NO: 854223 - RNA, 21 nt, Mycobacterium avium subsp. paratuberculosis
cggcggcgcgcacgucaccgc

SEQ ID NO: 854224 - RNA, 14 nt, Mycobacterium avium subsp. paratuberculosis
cggcggcgccgucg

SEQ ID NO: 854225 - RNA, 15 nt, Mycobacterium avium subsp. paratuberculosis
cggcggcgccgucgc

SEQ ID NO: 854226 - RNA, 17 nt, Mycobacterium avium subsp. paratuberculosis
cggcggcgccgucgccg

SEQ ID NO: 854227 - RNA, 20 nt, Mycobacterium avium subsp. paratuberculosis
cggcggcgccggucagaccc

SEQ ID NO: 854228 - RNA, 19 nt, Mycobacterium avium subsp. paratuberculosis
cggcggcgccuugccgguc

SEQ ID NO: 854229 - RNA, 14 nt, Mycobacterium avium subsp. paratuberculosis
cggcggcgccgcgg

SEQ ID NO: 854230 - RNA, 13 nt, Mycobacterium avium subsp. paratuberculosis
cggcggcgccggg

SEQ ID NO: 854231 - RNA, 13 nt, Mycobacterium avium subsp. paratuberculosis
cggcggcgccgac

SEQ ID NO: 854232 - RNA, 14 nt, Mycobacterium avium subsp. paratuberculosis
cggcggcgccgacg

SEQ ID NO: 854233 - RNA, 12 nt, Mycobacterium avium subsp. paratuberculosis
cggcggcgccgc

SEQ ID NO: 854234 - RNA, 14 nt, Mycobacterium avium subsp. paratuberculosis
cggcggcgccgcag

SEQ ID NO: 854235 - RNA, 18 nt, Mycobacterium avium subsp. paratuberculosis
cggcggcgccgcagcacg

SEQ ID NO: 854236 - RNA, 19 nt, Mycobacterium avium subsp. paratuberculosis
cggcggcgccgcagcacgc

SEQ ID NO: 854237 - RNA, 16 nt, Mycobacterium avium subsp. paratuberculosis
cggcggccucgccguc

SEQ ID NO: 854238 - RNA, 21 nt, Mycobacterium avium subsp. paratuberculosis
cggcggccucgccgucgaagg

SEQ ID NO: 854239 - RNA, 17 nt, Mycobacterium avium subsp. paratuberculosis
cggcggccugcgcgucg

SEQ ID NO: 854240 - RNA, 20 nt, Mycobacterium avium subsp. paratuberculosis
cggcggccugcgcgucgucg

SEQ ID NO: 854241 - RNA, 16 nt, Mycobacterium avium subsp. paratuberculosis
cggcggccugcggcgg

SEQ ID NO: 854242 - RNA, 13 nt, Mycobacterium avium subsp. paratuberculosis
cggcggccugcuc

SEQ ID NO: 854243 - RNA, 20 nt, Mycobacterium avium subsp. paratuberculosis
cggcggccugcuccagcgag

SEQ ID NO: 854244 - RNA, 15 nt, Mycobacterium avium subsp. paratuberculosis
cggcggccugcucgc

SEQ ID NO: 854245 - RNA, 15 nt, Mycobacterium avium subsp. paratuberculosis
cggcggccggcggca

SEQ ID NO: 854246 - RNA, 20 nt, Mycobacterium avium subsp. paratuberculosis
cggcggccgggaugccgccg

SEQ ID NO: 854247 - RNA, 21 nt, Mycobacterium avium subsp. paratuberculosis
cggcggccggggggaggucgc

SEQ ID NO: 854248 - RNA, 14 nt, Mycobacterium avium subsp. paratuberculosis
cggcggccgcgaag

SEQ ID NO: 854249 - RNA, 13 nt, Mycobacterium avium subsp. paratuberculosis
cggcggccgcgac

SEQ ID NO: 854250 - RNA, 12 nt, Mycobacterium avium subsp. paratuberculosis
cggcggccgucg

SEQ ID NO: 854251 - RNA, 13 nt, Mycobacterium avium subsp. paratuberculosis
cggcggccgucgg

SEQ ID NO: 854252 - RNA, 15 nt, Mycobacterium avium subsp. paratuberculosis
cggcggccgcgucgc

SEQ ID NO: 854253 - RNA, 17 nt, Mycobacterium avium subsp. paratuberculosis
cggcggccgcgucgccg

SEQ ID NO: 854254 - RNA, 19 nt, Mycobacterium avium subsp. paratuberculosis
cggcggccgcgucggcggu

SEQ ID NO: 854255 - RNA, 15 nt, Mycobacterium avium subsp. paratuberculosis
cggcggccgcgacgg

SEQ ID NO: 854256 - RNA, 16 nt, Mycobacterium avium subsp. paratuberculosis
cggcggccgcgacgga

SEQ ID NO: 854257 - RNA, 13 nt, Mycobacterium avium subsp. paratuberculosis
cggcggccgcgga

SEQ ID NO: 854258 - RNA, 15 nt, Mycobacterium avium subsp. paratuberculosis
cggcggccgcggacc

SEQ ID NO: 854259 - RNA, 12 nt, Mycobacterium avium subsp. paratuberculosis
cggcggccggcc

SEQ ID NO: 854260 - RNA, 16 nt, Mycobacterium avium subsp. paratuberculosis
cggcggccggccagca

SEQ ID NO: 854261 - RNA, 20 nt, Mycobacterium avium subsp. paratuberculosis
cggcggccggccagcgcgcg

SEQ ID NO: 854262 - RNA, 22 nt, Mycobacterium avium subsp. paratuberculosis
cggcggccggccagcgcgcggc

SEQ ID NO: 854263 - RNA, 16 nt, Mycobacterium avium subsp. paratuberculosis
cggcggccggccccgg

SEQ ID NO: 854264 - RNA, 20 nt, Mycobacterium avium subsp. paratuberculosis
cggcggccggccccggccgg

SEQ ID NO: 854265 - RNA, 13 nt, Mycobacterium avium subsp. paratuberculosis
cggcggccggccg

SEQ ID NO: 854266 - RNA, 14 nt, Mycobacterium avium subsp. paratuberculosis
cggcggccggccgc

SEQ ID NO: 854267 - RNA, 16 nt, Mycobacterium avium subsp. paratuberculosis
cggcggccggccgcgc

SEQ ID NO: 854268 - RNA, 17 nt, Mycobacterium avium subsp. paratuberculosis
cggcggccggccgcgcg

SEQ ID NO: 854269 - RNA, 13 nt, Mycobacterium avium subsp. paratuberculosis
cggcggccggcga

SEQ ID NO: 854270 - RNA, 14 nt, Mycobacterium avium subsp. paratuberculosis
cggcggccggcgcc

SEQ ID NO: 854271 - RNA, 15 nt, Mycobacterium avium subsp. paratuberculosis
cggcggccggcgccg

SEQ ID NO: 854272 - RNA, 12 nt, Mycobacterium avium subsp. paratuberculosis
cggcggccgccg

SEQ ID NO: 854273 - RNA, 15 nt, Mycobacterium avium subsp. paratuberculosis
cggcggccgccgccc

SEQ ID NO: 854274 - RNA, 16 nt, Mycobacterium avium subsp. paratuberculosis
cggcggccgccgcccg

SEQ ID NO: 854275 - RNA, 23 nt, Mycobacterium avium subsp. paratuberculosis
cggcggccgccgcccgcgcggcg

SEQ ID NO: 854276 - RNA, 16 nt, Mycobacterium avium subsp. paratuberculosis
cggcggccgccggcac

SEQ ID NO: 854277 - RNA, 18 nt, Mycobacterium avium subsp. paratuberculosis
cggcggccgccggcaccg

SEQ ID NO: 854278 - RNA, 20 nt, Mycobacterium avium subsp. paratuberculosis
cggcggccgccggcaccguc

SEQ ID NO: 854279 - RNA, 22 nt, Mycobacterium avium subsp. paratuberculosis
cggcggccgccggcaccguccg

SEQ ID NO: 854280 - RNA, 11 nt, Mycobacterium avium subsp. paratuberculosis
cggcggccagg

SEQ ID NO: 854281 - RNA, 17 nt, Mycobacterium avium subsp. paratuberculosis
cggcggccaguugacgu

SEQ ID NO: 854282 - RNA, 18 nt, Mycobacterium avium subsp. paratuberculosis
cggcggccgagcgcaccg

SEQ ID NO: 854283 - RNA, 19 nt, Mycobacterium avium subsp. paratuberculosis
cggcggccgagcgcaccgc

SEQ ID NO: 854284 - RNA, 22 nt, Mycobacterium avium subsp. paratuberculosis
cggcggccgagcgcaccgcgga

SEQ ID NO: 854285 - RNA, 21 nt, Mycobacterium avium subsp. paratuberculosis
cggcggccgcagcgugggcac

SEQ ID NO: 854286 - RNA, 12 nt, Mycobacterium avium subsp. paratuberculosis
cggcggccgcca

SEQ ID NO: 854287 - RNA, 14 nt, Mycobacterium avium subsp. paratuberculosis
cggcggccgccagc

SEQ ID NO: 854288 - RNA, 19 nt, Mycobacterium avium subsp. paratuberculosis
cggcggccgccaucauccg

SEQ ID NO: 854289 - RNA, 12 nt, Mycobacterium avium subsp. paratuberculosis
cggcggccaugg

SEQ ID NO: 854290 - RNA, 20 nt, Mycobacterium avium subsp. paratuberculosis
cggcggccauggucgcggcc

SEQ ID NO: 854291 - RNA, 12 nt, Mycobacterium avium subsp. paratuberculosis
cggcggccaugu

SEQ ID NO: 854292 - RNA, 13 nt, Mycobacterium avium subsp. paratuberculosis
cggcggccauguc

SEQ ID NO: 854293 - RNA, 21 nt, Mycobacterium avium subsp. paratuberculosis
cggcggccaugucggagcugc

SEQ ID NO: 854294 - RNA, 22 nt, Mycobacterium avium subsp. paratuberculosis
cggcggccgacccugcguccgg

SEQ ID NO: 854295 - RNA, 16 nt, Mycobacterium avium subsp. paratuberculosis
cggcggccgacgcgcc

SEQ ID NO: 854296 - RNA, 17 nt, Mycobacterium avium subsp. paratuberculosis
cggcggccgacgcgccg

SEQ ID NO: 854297 - RNA, 19 nt, Mycobacterium avium subsp. paratuberculosis
cggcggccgacgcgccguc

SEQ ID NO: 854298 - RNA, 21 nt, Mycobacterium avium subsp. paratuberculosis
cggcggccgacgcgccgucgg

SEQ ID NO: 854299 - RNA, 13 nt, Mycobacterium avium subsp. paratuberculosis
cggcggccagggu

SEQ ID NO: 854300 - RNA, 15 nt, Mycobacterium avium subsp. paratuberculosis
cggcggccagggugg

SEQ ID NO: 854301 - RNA, 14 nt, Mycobacterium avium subsp. paratuberculosis
cggcggccagcgcg

SEQ ID NO: 854302 - RNA, 13 nt, Mycobacterium avium subsp. paratuberculosis
cggcggccagcgc

SEQ ID NO: 854303 - RNA, 16 nt, Mycobacterium avium subsp. paratuberculosis
cggcggccagcucggc

SEQ ID NO: 854304 - RNA, 12 nt, Mycobacterium avium subsp. paratuberculosis
cggcggccagcg

SEQ ID NO: 854305 - RNA, 13 nt, Mycobacterium avium subsp. paratuberculosis
cggcggccagcga

SEQ ID NO: 854306 - RNA, 13 nt, Mycobacterium avium subsp. paratuberculosis
cggcggccagcau

SEQ ID NO: 854307 - RNA, 17 nt, Mycobacterium avium subsp. paratuberculosis
cggcgggaaaccaccug

SEQ ID NO: 854308 - RNA, 22 nt, Mycobacterium avium subsp. paratuberculosis
cggcgggaaaccaccugccgca

SEQ ID NO: 854309 - RNA, 14 nt, Mycobacterium avium subsp. paratuberculosis
cggcggcugggcag

SEQ ID NO: 854310 - RNA, 21 nt, Mycobacterium avium subsp. paratuberculosis
cggcggcugggcagccgcgcg

SEQ ID NO: 854311 - RNA, 15 nt, Mycobacterium avium subsp. paratuberculosis
cggcggcugggccgc

SEQ ID NO: 854312 - RNA, 17 nt, Mycobacterium avium subsp. paratuberculosis
cggcggcugggccgcgg

SEQ ID NO: 854313 - RNA, 18 nt, Mycobacterium avium subsp. paratuberculosis
cggcggcugggccgcggc

SEQ ID NO: 854314 - RNA, 20 nt, Mycobacterium avium subsp. paratuberculosis
cggcggcugggccgcggcgc

SEQ ID NO: 854315 - RNA, 22 nt, Mycobacterium avium subsp. paratuberculosis
cggcggcugggccgcggcgccg

SEQ ID NO: 854316 - RNA, 23 nt, Mycobacterium avium subsp. paratuberculosis
cggcggcugggccgcggcgccgu

SEQ ID NO: 854317 - RNA, 19 nt, Mycobacterium avium subsp. paratuberculosis
cggcggcugaagcgcuggg

SEQ ID NO: 854318 - RNA, 13 nt, Mycobacterium avium subsp. paratuberculosis
cggcggcugccuc

SEQ ID NO: 854319 - RNA, 17 nt, Mycobacterium avium subsp. paratuberculosis
cggcggcugccucgacg

SEQ ID NO: 854320 - RNA, 20 nt, Mycobacterium avium subsp. paratuberculosis
cggcggcguucagccggagc

SEQ ID NO: 854321 - RNA, 23 nt, Mycobacterium avium subsp. paratuberculosis
cggcggcguucagccggagccgg

SEQ ID NO: 854322 - RNA, 13 nt, Mycobacterium avium subsp. paratuberculosis
cggcggcgucgua

SEQ ID NO: 854323 - RNA, 13 nt, Mycobacterium avium subsp. paratuberculosis
cggcggcgugccg

SEQ ID NO: 854324 - RNA, 22 nt, Mycobacterium avium subsp. paratuberculosis
cggcggcgugccgcccggaccg

SEQ ID NO: 854325 - RNA, 14 nt, Mycobacterium avium subsp. paratuberculosis
cggcggcgugcacc

SEQ ID NO: 854326 - RNA, 15 nt, Mycobacterium avium subsp. paratuberculosis
cggcggcgugcaccg

SEQ ID NO: 854327 - RNA, 16 nt, Mycobacterium avium subsp. paratuberculosis
cggcggcgugcaccgc

SEQ ID NO: 854328 - RNA, 22 nt, Mycobacterium avium subsp. paratuberculosis
cggcggcgugcaccgcccgcgc

SEQ ID NO: 854329 - RNA, 13 nt, Mycobacterium avium subsp. paratuberculosis
cggcggcgucggc

SEQ ID NO: 854330 - RNA, 13 nt, Mycobacterium avium subsp. paratuberculosis
cggcggcucgccg

SEQ ID NO: 854331 - RNA, 18 nt, Mycobacterium avium subsp. paratuberculosis
cggcggcucgccggcguc

SEQ ID NO: 854332 - RNA, 17 nt, Mycobacterium avium subsp. paratuberculosis
cggcggcucggcggcgu

SEQ ID NO: 854333 - RNA, 13 nt, Mycobacterium avium subsp. paratuberculosis
cggcggcucgggg

SEQ ID NO: 854334 - RNA, 21 nt, Mycobacterium avium subsp. paratuberculosis
cggcggcucaggggaucucgg

SEQ ID NO: 854335 - RNA, 14 nt, Mycobacterium avium subsp. paratuberculosis
cggcggcucgucca

SEQ ID NO: 854336 - RNA, 19 nt, Mycobacterium avium subsp. paratuberculosis
cggcggcucguccagcccg

SEQ ID NO: 854337 - RNA, 14 nt, Mycobacterium avium subsp. paratuberculosis
cggcggcgggcagg

SEQ ID NO: 854338 - RNA, 21 nt, Mycobacterium avium subsp. paratuberculosis
cggcggcgggccagggcgagg

SEQ ID NO: 854339 - RNA, 16 nt, Mycobacterium avium subsp. paratuberculosis
cggcggcgggcucgga

SEQ ID NO: 854340 - RNA, 18 nt, Mycobacterium avium subsp. paratuberculosis
cggcggcgggcucggagu

SEQ ID NO: 854341 - RNA, 17 nt, Mycobacterium avium subsp. paratuberculosis
cggcggcggccugcacc

SEQ ID NO: 854342 - RNA, 14 nt, Mycobacterium avium subsp. paratuberculosis
cggcggcggcgcgc

SEQ ID NO: 854343 - RNA, 15 nt, Mycobacterium avium subsp. paratuberculosis
cggcggcggcgcgcc

SEQ ID NO: 854344 - RNA, 13 nt, Mycobacterium avium subsp. paratuberculosis
cggcggcggcggu

SEQ ID NO: 854345 - RNA, 16 nt, Mycobacterium avium subsp. paratuberculosis
cggcggcggcgguccg

SEQ ID NO: 854346 - RNA, 13 nt, Mycobacterium avium subsp. paratuberculosis
cggcggcggcccg

SEQ ID NO: 854347 - RNA, 14 nt, Mycobacterium avium subsp. paratuberculosis
cggcggcggcccgu

SEQ ID NO: 854348 - RNA, 12 nt, Mycobacterium avium subsp. paratuberculosis
cggcggcggcca

SEQ ID NO: 854349 - RNA, 15 nt, Mycobacterium avium subsp. paratuberculosis
cggcggcggcccguc

SEQ ID NO: 854350 - RNA, 17 nt, Mycobacterium avium subsp. paratuberculosis
cggcggcggcccguccg

SEQ ID NO: 854351 - RNA, 12 nt, Mycobacterium avium subsp. paratuberculosis
cggcggcggccg

SEQ ID NO: 854352 - RNA, 13 nt, Mycobacterium avium subsp. paratuberculosis
cggcggcggccgc

SEQ ID NO: 854353 - RNA, 14 nt, Mycobacterium avium subsp. paratuberculosis
cggcggcggccgcg

SEQ ID NO: 854354 - RNA, 15 nt, Mycobacterium avium subsp. paratuberculosis
cggcggcggccgcgu

SEQ ID NO: 854355 - RNA, 12 nt, Mycobacterium avium subsp. paratuberculosis
cggcggcggccu

SEQ ID NO: 854356 - RNA, 18 nt, Mycobacterium avium subsp. paratuberculosis
cggcggcguccgcggccg

SEQ ID NO: 854357 - RNA, 21 nt, Mycobacterium avium subsp. paratuberculosis
cggcggcguccgcggccgcgg

SEQ ID NO: 854358 - RNA, 15 nt, Mycobacterium avium subsp. paratuberculosis
cggcggcgucgaccg

SEQ ID NO: 854359 - RNA, 16 nt, Mycobacterium avium subsp. paratuberculosis
cggcggcgucgaccgc

SEQ ID NO: 854360 - RNA, 20 nt, Mycobacterium avium subsp. paratuberculosis
cggcggcgguccgcccggac

SEQ ID NO: 854361 - RNA, 12 nt, Mycobacterium avium subsp. paratuberculosis
cggcggcggucg

SEQ ID NO: 854362 - RNA, 13 nt, Mycobacterium avium subsp. paratuberculosis
cggcggcggucgg

SEQ ID NO: 854363 - RNA, 12 nt, Mycobacterium avium subsp. paratuberculosis
cggcggcggugc

SEQ ID NO: 854364 - RNA, 15 nt, Mycobacterium avium subsp. paratuberculosis
cggcggcggugccgc

SEQ ID NO: 854365 - RNA, 13 nt, Mycobacterium avium subsp. paratuberculosis
cggcggcggugcg

SEQ ID NO: 854366 - RNA, 19 nt, Mycobacterium avium subsp. paratuberculosis
cggcggcgguuuuggucgg

SEQ ID NO: 854367 - RNA, 15 nt, Mycobacterium avium subsp. paratuberculosis
cggcggcgucggcgu

SEQ ID NO: 854368 - RNA, 18 nt, Mycobacterium avium subsp. paratuberculosis
cggcggggaaggugcggg

SEQ ID NO: 854369 - RNA, 22 nt, Mycobacterium avium subsp. paratuberculosis
cggcggggaaggugcgggcggg

SEQ ID NO: 854370 - RNA, 17 nt, Mycobacterium avium subsp. paratuberculosis
cggcggggccuccacca

SEQ ID NO: 854371 - RNA, 21 nt, Mycobacterium avium subsp. paratuberculosis
cggcggggccuccaccagcgg

SEQ ID NO: 854372 - RNA, 14 nt, Mycobacterium avium subsp. paratuberculosis
cggcggggccucga

SEQ ID NO: 854373 - RNA, 20 nt, Mycobacterium avium subsp. paratuberculosis
cggcggggccucgaugcggc

SEQ ID NO: 854374 - RNA, 22 nt, Mycobacterium avium subsp. paratuberculosis
cggcggggccucgaugcggccg

SEQ ID NO: 854375 - RNA, 14 nt, Mycobacterium avium subsp. paratuberculosis
cggcgggcuggugc

SEQ ID NO: 854376 - RNA, 15 nt, Mycobacterium avium subsp. paratuberculosis
cggcgggcuggugcg

SEQ ID NO: 854377 - RNA, 21 nt, Mycobacterium avium subsp. paratuberculosis
cggcgggcuggugcgcagccg

SEQ ID NO: 854378 - RNA, 12 nt, Mycobacterium avium subsp. paratuberculosis
cggcgggcgcgc

SEQ ID NO: 854379 - RNA, 13 nt, Mycobacterium avium subsp. paratuberculosis
cggcgggcgugcg

SEQ ID NO: 854380 - RNA, 14 nt, Mycobacterium avium subsp. paratuberculosis
cggcgggcucgccg

SEQ ID NO: 854381 - RNA, 16 nt, Mycobacterium avium subsp. paratuberculosis
cggcgggcucgcgcug

SEQ ID NO: 854382 - RNA, 18 nt, Mycobacterium avium subsp. paratuberculosis
cggcgggcucgcgcuggc

SEQ ID NO: 854383 - RNA, 18 nt, Mycobacterium avium subsp. paratuberculosis
cggcgggcucccucgucg

SEQ ID NO: 854384 - RNA, 22 nt, Mycobacterium avium subsp. paratuberculosis
cggcgggcucccucgucgcuac

SEQ ID NO: 854385 - RNA, 23 nt, Mycobacterium avium subsp. paratuberculosis
cggcgggcucccucgucgcuacc

SEQ ID NO: 854386 - RNA, 14 nt, Mycobacterium avium subsp. paratuberculosis
cggcgggcggccga

SEQ ID NO: 854387 - RNA, 15 nt, Mycobacterium avium subsp. paratuberculosis
cggcgggcggccgau

SEQ ID NO: 854388 - RNA, 13 nt, Mycobacterium avium subsp. paratuberculosis
cggcgggcggcgg

SEQ ID NO: 854389 - RNA, 14 nt, Mycobacterium avium subsp. paratuberculosis
cggcgggcggcggc

SEQ ID NO: 854390 - RNA, 15 nt, Mycobacterium avium subsp. paratuberculosis
cggcgggcggcggcg

SEQ ID NO: 854391 - RNA, 14 nt, Mycobacterium avium subsp. paratuberculosis
cggcgggcgggcgg

SEQ ID NO: 854392 - RNA, 13 nt, Mycobacterium avium subsp. paratuberculosis
cggcgggcgcguc

SEQ ID NO: 854393 - RNA, 14 nt, Mycobacterium avium subsp. paratuberculosis
cggcgggcgcgucg

SEQ ID NO: 854394 - RNA, 17 nt, Mycobacterium avium subsp. paratuberculosis
cggcgggcgccggucgg

SEQ ID NO: 854395 - RNA, 19 nt, Mycobacterium avium subsp. paratuberculosis
cggcgggcgccggucggcg

SEQ ID NO: 854396 - RNA, 13 nt, Mycobacterium avium subsp. paratuberculosis
cggcgggcgagcc

SEQ ID NO: 854397 - RNA, 14 nt, Mycobacterium avium subsp. paratuberculosis
cggcgggcgagccg

SEQ ID NO: 854398 - RNA, 13 nt, Mycobacterium avium subsp. paratuberculosis
cggcgggccgguc

SEQ ID NO: 854399 - RNA, 13 nt, Mycobacterium avium subsp. paratuberculosis
cggcgggccggcg

SEQ ID NO: 854400 - RNA, 16 nt, Mycobacterium avium subsp. paratuberculosis
cggcgggccggcgccg

SEQ ID NO: 854401 - RNA, 13 nt, Mycobacterium avium subsp. paratuberculosis
cggcgggccgccc

SEQ ID NO: 854402 - RNA, 15 nt, Mycobacterium avium subsp. paratuberculosis
cggcgggccgcccgg

SEQ ID NO: 854403 - RNA, 16 nt, Mycobacterium avium subsp. paratuberculosis
cggcgggccgcccggc

SEQ ID NO: 854404 - RNA, 22 nt, Mycobacterium avium subsp. paratuberculosis
cggcgggccgcccggcgcgccg

SEQ ID NO: 854405 - RNA, 12 nt, Mycobacterium avium subsp. paratuberculosis
cggcgggccgca

SEQ ID NO: 854406 - RNA, 13 nt, Mycobacterium avium subsp. paratuberculosis
cggcgggccgcaa

SEQ ID NO: 854407 - RNA, 18 nt, Mycobacterium avium subsp. paratuberculosis
cggcgggcaccucggcca

SEQ ID NO: 854408 - RNA, 15 nt, Mycobacterium avium subsp. paratuberculosis
cggcgggcccggcga

SEQ ID NO: 854409 - RNA, 19 nt, Mycobacterium avium subsp. paratuberculosis
cggcgggcccggcgaugcg

SEQ ID NO: 854410 - RNA, 17 nt, Mycobacterium avium subsp. paratuberculosis
cggcgggcccgucgccg

SEQ ID NO: 854411 - RNA, 18 nt, Mycobacterium avium subsp. paratuberculosis
cggcgggcccgucgccgg

SEQ ID NO: 854412 - RNA, 14 nt, Mycobacterium avium subsp. paratuberculosis
cggcgggcccgcag

SEQ ID NO: 854413 - RNA, 23 nt, Mycobacterium avium subsp. paratuberculosis
cggcgggcccgcagcucggagua

SEQ ID NO: 854414 - RNA, 14 nt, Mycobacterium avium subsp. paratuberculosis
cggcgggccagcuc

SEQ ID NO: 854415 - RNA, 15 nt, Mycobacterium avium subsp. paratuberculosis
cggcgggccagcucg

SEQ ID NO: 854416 - RNA, 21 nt, Mycobacterium avium subsp. paratuberculosis
cggcgggccagcucgucgagc

SEQ ID NO: 854417 - RNA, 14 nt, Mycobacterium avium subsp. paratuberculosis
cggcgggccagggc

SEQ ID NO: 854418 - RNA, 13 nt, Mycobacterium avium subsp. paratuberculosis
cggcgggcccagc

SEQ ID NO: 854419 - RNA, 14 nt, Mycobacterium avium subsp. paratuberculosis
cggcgggcccagca

SEQ ID NO: 854420 - RNA, 15 nt, Mycobacterium avium subsp. paratuberculosis
cggcgggcaggccga

SEQ ID NO: 854421 - RNA, 15 nt, Mycobacterium avium subsp. paratuberculosis
cggcgggcaggcuca

SEQ ID NO: 854422 - RNA, 15 nt, Mycobacterium avium subsp. paratuberculosis
cggcgggcaucaucg

SEQ ID NO: 854423 - RNA, 16 nt, Mycobacterium avium subsp. paratuberculosis
cggcgggcaucaucgc

SEQ ID NO: 854424 - RNA, 16 nt, Mycobacterium avium subsp. paratuberculosis
cggcgggaucggaccg

SEQ ID NO: 854425 - RNA, 14 nt, Mycobacterium avium subsp. paratuberculosis
cggcgggagccggc

SEQ ID NO: 854426 - RNA, 18 nt, Mycobacterium avium subsp. paratuberculosis
cggcgggagccggcggcg

SEQ ID NO: 854427 - RNA, 21 nt, Mycobacterium avium subsp. paratuberculosis
cggcgggagcuaggcggccgg

SEQ ID NO: 854428 - RNA, 18 nt, Mycobacterium avium subsp. paratuberculosis
cggcgggaacucgaugcg

SEQ ID NO: 854429 - RNA, 22 nt, Mycobacterium avium subsp. paratuberculosis
cggcgggaacucgaugcggcag

SEQ ID NO: 854430 - RNA, 23 nt, Mycobacterium avium subsp. paratuberculosis
cggcgggaacucgaugcggcagc

SEQ ID NO: 854431 - RNA, 22 nt, Mycobacterium avium subsp. paratuberculosis
cggcgggaaguagugcaucggc

SEQ ID NO: 854432 - RNA, 14 nt, Mycobacterium avium subsp. paratuberculosis
cggcgggacccgcg

SEQ ID NO: 854433 - RNA, 15 nt, Mycobacterium avium subsp. paratuberculosis
cggcgggacccgcga

SEQ ID NO: 854434 - RNA, 16 nt, Mycobacterium avium subsp. paratuberculosis
cggcgggacccgcgac

SEQ ID NO: 854435 - RNA, 18 nt, Mycobacterium avium subsp. paratuberculosis
cggcgggacccgcgaccc

SEQ ID NO: 854436 - RNA, 17 nt, Mycobacterium avium subsp. paratuberculosis
cggcgcgaggacgaugg

SEQ ID NO: 854437 - RNA, 13 nt, Mycobacterium avium subsp. paratuberculosis
cggcgcgacggca

SEQ ID NO: 854438 - RNA, 16 nt, Mycobacterium avium subsp. paratuberculosis
cggcgcgcacggcagc

SEQ ID NO: 854439 - RNA, 22 nt, Mycobacterium avium subsp. paratuberculosis
cggcgcgcccgagucacccggc

SEQ ID NO: 854440 - RNA, 13 nt, Mycobacterium avium subsp. paratuberculosis
cggcgcgcccgga

SEQ ID NO: 854441 - RNA, 23 nt, Mycobacterium avium subsp. paratuberculosis
cggcgcgcccggaaagcgcgggc

SEQ ID NO: 854442 - RNA, 17 nt, Mycobacterium avium subsp. paratuberculosis
cggcgcgcaacagcguc

SEQ ID NO: 854443 - RNA, 13 nt, Mycobacterium avium subsp. paratuberculosis
cggcgcgcaccgc

SEQ ID NO: 854444 - RNA, 14 nt, Mycobacterium avium subsp. paratuberculosis
cggcgcgcaccgcg

SEQ ID NO: 854445 - RNA, 13 nt, Mycobacterium avium subsp. paratuberculosis
cggcgcgaucggc

SEQ ID NO: 854446 - RNA, 14 nt, Mycobacterium avium subsp. paratuberculosis
cggcgcgaucggcc

SEQ ID NO: 854447 - RNA, 15 nt, Mycobacterium avium subsp. paratuberculosis
cggcgcgaucggccg

SEQ ID NO: 854448 - RNA, 19 nt, Mycobacterium avium subsp. paratuberculosis
cggcgcgaucggccgcugc

SEQ ID NO: 854449 - RNA, 14 nt, Mycobacterium avium subsp. paratuberculosis
cggcgcgaucgucg

SEQ ID NO: 854450 - RNA, 21 nt, Mycobacterium avium subsp. paratuberculosis
cggcgcgaucgucgaccacca

SEQ ID NO: 854451 - RNA, 21 nt, Mycobacterium avium subsp. paratuberculosis
cggcgccguccuccucgucgg

SEQ ID NO: 854452 - RNA, 17 nt, Mycobacterium avium subsp. paratuberculosis
cggcgccguccagcucg

SEQ ID NO: 854453 - RNA, 14 nt, Mycobacterium avium subsp. paratuberculosis
cggcgccgucgaac

SEQ ID NO: 854454 - RNA, 24 nt, Mycobacterium avium subsp. paratuberculosis
cggcgccgucgaacacguugcgca

SEQ ID NO: 854455 - RNA, 14 nt, Mycobacterium avium subsp. paratuberculosis
cggcgccgucgacc

SEQ ID NO: 854456 - RNA, 14 nt, Mycobacterium avium subsp. paratuberculosis
cggcgccgucgauc

SEQ ID NO: 854457 - RNA, 12 nt, Mycobacterium avium subsp. paratuberculosis
cggcgccgucgc

SEQ ID NO: 854458 - RNA, 13 nt, Mycobacterium avium subsp. paratuberculosis
cggcgccgucgcc

SEQ ID NO: 854459 - RNA, 15 nt, Mycobacterium avium subsp. paratuberculosis
cggcgccgucgccga

SEQ ID NO: 854460 - RNA, 15 nt, Mycobacterium avium subsp. paratuberculosis
cggcgccgucgccgg

SEQ ID NO: 854461 - RNA, 16 nt, Mycobacterium avium subsp. paratuberculosis
cggcgccgucgccgga

SEQ ID NO: 854462 - RNA, 14 nt, Mycobacterium avium subsp. paratuberculosis
cggcgccgugccgc

SEQ ID NO: 854463 - RNA, 22 nt, Mycobacterium avium subsp. paratuberculosis
cggcgccgugccgcgcggcgau

SEQ ID NO: 854464 - RNA, 17 nt, Mycobacterium avium subsp. paratuberculosis
cggcgccguugaccggc

SEQ ID NO: 854465 - RNA, 18 nt, Mycobacterium avium subsp. paratuberculosis
cggcgccguugaccggcc

SEQ ID NO: 854466 - RNA, 20 nt, Mycobacterium avium subsp. paratuberculosis
cggcgccguugaccggccgg

SEQ ID NO: 854467 - RNA, 22 nt, Mycobacterium avium subsp. paratuberculosis
cggcgccguugaccggccgguc

SEQ ID NO: 854468 - RNA, 15 nt, Mycobacterium avium subsp. paratuberculosis
cggcgccggccgccg

SEQ ID NO: 854469 - RNA, 13 nt, Mycobacterium avium subsp. paratuberculosis
cggcgccggccgg

SEQ ID NO: 854470 - RNA, 14 nt, Mycobacterium avium subsp. paratuberculosis
cggcgccggccguc

SEQ ID NO: 854471 - RNA, 18 nt, Mycobacterium avium subsp. paratuberculosis
cggcgccgguggugucga

SEQ ID NO: 854472 - RNA, 17 nt, Mycobacterium avium subsp. paratuberculosis
cggcgccggcauccagc

SEQ ID NO: 854473 - RNA, 22 nt, Mycobacterium avium subsp. paratuberculosis
cggcgccggaucaugucguuga

SEQ ID NO: 854474 - RNA, 19 nt, Mycobacterium avium subsp. paratuberculosis
cggcgccguagguggccau

SEQ ID NO: 854475 - RNA, 12 nt, Mycobacterium avium subsp. paratuberculosis
cggcgccggcac

SEQ ID NO: 854476 - RNA, 15 nt, Mycobacterium avium subsp. paratuberculosis
cggcgccggaugcca

SEQ ID NO: 854477 - RNA, 19 nt, Mycobacterium avium subsp. paratuberculosis
cggcgccggaucggccccc

SEQ ID NO: 854478 - RNA, 20 nt, Mycobacterium avium subsp. paratuberculosis
cggcgccggaucggcccccg

SEQ ID NO: 854479 - RNA, 14 nt, Mycobacterium avium subsp. paratuberculosis
cggcgccggaucgg

SEQ ID NO: 854480 - RNA, 13 nt, Mycobacterium avium subsp. paratuberculosis
cggcgccggccag

SEQ ID NO: 854481 - RNA, 16 nt, Mycobacterium avium subsp. paratuberculosis
cggcgccggccagcgg

SEQ ID NO: 854482 - RNA, 17 nt, Mycobacterium avium subsp. paratuberculosis
cggcgccggccagcggc

SEQ ID NO: 854483 - RNA, 15 nt, Mycobacterium avium subsp. paratuberculosis
cggcgccggcccgcg

SEQ ID NO: 854484 - RNA, 18 nt, Mycobacterium avium subsp. paratuberculosis
cggcgccggcccgcggcg

SEQ ID NO: 854485 - RNA, 15 nt, Mycobacterium avium subsp. paratuberculosis
cggcgccggccgaca

SEQ ID NO: 854486 - RNA, 16 nt, Mycobacterium avium subsp. paratuberculosis
cggcgccggccgacau

SEQ ID NO: 854487 - RNA, 18 nt, Mycobacterium avium subsp. paratuberculosis
cggcgcgguugucguuga

SEQ ID NO: 854488 - RNA, 15 nt, Mycobacterium avium subsp. paratuberculosis
cggcgcgguugaccg

SEQ ID NO: 854489 - RNA, 16 nt, Mycobacterium avium subsp. paratuberculosis
cggcgcgguugaccgc

SEQ ID NO: 854490 - RNA, 20 nt, Mycobacterium avium subsp. paratuberculosis
cggcgcgguugaccgccgac

SEQ ID NO: 854491 - RNA, 21 nt, Mycobacterium avium subsp. paratuberculosis
cggcgcgguugaccgccgaca

SEQ ID NO: 854492 - RNA, 20 nt, Mycobacterium avium subsp. paratuberculosis
cggcgcgguugcccgcaccc

SEQ ID NO: 854493 - RNA, 12 nt, Mycobacterium avium subsp. paratuberculosis
cggcgcgccggc

SEQ ID NO: 854494 - RNA, 19 nt, Mycobacterium avium subsp. paratuberculosis
cggcgcgguuucggcgucg

SEQ ID NO: 854495 - RNA, 16 nt, Mycobacterium avium subsp. paratuberculosis
cggcgcgguggcgugc

SEQ ID NO: 854496 - RNA, 24 nt, Mycobacterium avium subsp. paratuberculosis
cggcgcgguggcgugcagcgcggc

SEQ ID NO: 854497 - RNA, 15 nt, Mycobacterium avium subsp. paratuberculosis
cggcgcggugggcgg

SEQ ID NO: 854498 - RNA, 18 nt, Mycobacterium avium subsp. paratuberculosis
cggcgcggugggcggcgg

SEQ ID NO: 854499 - RNA, 20 nt, Mycobacterium avium subsp. paratuberculosis
cggcgcgguccacggucagc

SEQ ID NO: 854500 - RNA, 18 nt, Mycobacterium avium subsp. paratuberculosis
cggcgcggucgcaggcga

SEQ ID NO: 854501 - RNA, 19 nt, Mycobacterium avium subsp. paratuberculosis
cggcgcggucgcaggcgag

SEQ ID NO: 854502 - RNA, 23 nt, Mycobacterium avium subsp. paratuberculosis
cggcgcggucgcaggcgagccgg

SEQ ID NO: 854503 - RNA, 19 nt, Mycobacterium avium subsp. paratuberculosis
cggcgcggugcgccgacag

SEQ ID NO: 854504 - RNA, 15 nt, Mycobacterium avium subsp. paratuberculosis
cggcgcggugcucgg

SEQ ID NO: 854505 - RNA, 18 nt, Mycobacterium avium subsp. paratuberculosis
cggcgcggugcucggcgc

SEQ ID NO: 854506 - RNA, 20 nt, Mycobacterium avium subsp. paratuberculosis
cggcgcggugcucggcgcgc

SEQ ID NO: 854507 - RNA, 22 nt, Mycobacterium avium subsp. paratuberculosis
cggcgcggugcucggcgcgcgg

SEQ ID NO: 854508 - RNA, 16 nt, Mycobacterium avium subsp. paratuberculosis
cggcgcgggucgcggu

SEQ ID NO: 854509 - RNA, 23 nt, Mycobacterium avium subsp. paratuberculosis
cggcgcgggucgcuggccgcgac

SEQ ID NO: 854510 - RNA, 19 nt, Mycobacterium avium subsp. paratuberculosis
cggcgcgggggcggccuga

SEQ ID NO: 854511 - RNA, 13 nt, Mycobacterium avium subsp. paratuberculosis
cggcgcggccggu

SEQ ID NO: 854512 - RNA, 16 nt, Mycobacterium avium subsp. paratuberculosis
cggcgcggccggugcg

SEQ ID NO: 854513 - RNA, 15 nt, Mycobacterium avium subsp. paratuberculosis
cggcgcggccagcug

SEQ ID NO: 854514 - RNA, 12 nt, Mycobacterium avium subsp. paratuberculosis
cggcgcggccca

SEQ ID NO: 854515 - RNA, 15 nt, Mycobacterium avium subsp. paratuberculosis
cggcgcggcgcagcg

SEQ ID NO: 854516 - RNA, 20 nt, Mycobacterium avium subsp. paratuberculosis
cggcgcggcgcagcgcgaug

SEQ ID NO: 854517 - RNA, 21 nt, Mycobacterium avium subsp. paratuberculosis
cggcgcggcgaaucgguccgg

SEQ ID NO: 854518 - RNA, 12 nt, Mycobacterium avium subsp. paratuberculosis
cggcgcggcgac

SEQ ID NO: 854519 - RNA, 13 nt, Mycobacterium avium subsp. paratuberculosis
cggcgcggcgacg

SEQ ID NO: 854520 - RNA, 16 nt, Mycobacterium avium subsp. paratuberculosis
cggcgcggcgacguga

SEQ ID NO: 854521 - RNA, 17 nt, Mycobacterium avium subsp. paratuberculosis
cggcgcggcgacgugau

SEQ ID NO: 854522 - RNA, 19 nt, Mycobacterium avium subsp. paratuberculosis
cggcgcggcgacgugaugg

SEQ ID NO: 854523 - RNA, 14 nt, Mycobacterium avium subsp. paratuberculosis
cggcgcggccgccc

SEQ ID NO: 854524 - RNA, 13 nt, Mycobacterium avium subsp. paratuberculosis
cggcgcggccgau

SEQ ID NO: 854525 - RNA, 23 nt, Mycobacterium avium subsp. paratuberculosis
cggcgcggccgauucggcgccgc

SEQ ID NO: 854526 - RNA, 14 nt, Mycobacterium avium subsp. paratuberculosis
cggcgcggccagcu

SEQ ID NO: 854527 - RNA, 13 nt, Mycobacterium avium subsp. paratuberculosis
cggcgcgcgagcg

SEQ ID NO: 854528 - RNA, 14 nt, Mycobacterium avium subsp. paratuberculosis
cggcgcgcgagcgu

SEQ ID NO: 854529 - RNA, 18 nt, Mycobacterium avium subsp. paratuberculosis
cggcgcgcgagcgucacg

SEQ ID NO: 854530 - RNA, 20 nt, Mycobacterium avium subsp. paratuberculosis
cggcgcggcaucggcgacgg

SEQ ID NO: 854531 - RNA, 22 nt, Mycobacterium avium subsp. paratuberculosis
cggcgcgccugcgcggcggcgu

SEQ ID NO: 854532 - RNA, 14 nt, Mycobacterium avium subsp. paratuberculosis
cggcgcgccggccg

SEQ ID NO: 854533 - RNA, 13 nt, Mycobacterium avium subsp. paratuberculosis
cggcgcgccggcc

SEQ ID NO: 854534 - RNA, 16 nt, Mycobacterium avium subsp. paratuberculosis
cggcgcgccggccgga

SEQ ID NO: 854535 - RNA, 18 nt, Mycobacterium avium subsp. paratuberculosis
cggcgcgccggccggagc

SEQ ID NO: 854536 - RNA, 21 nt, Mycobacterium avium subsp. paratuberculosis
cggcgcgccggccggagcgga

SEQ ID NO: 854537 - RNA, 14 nt, Mycobacterium avium subsp. paratuberculosis
cggcgcgccgggca

SEQ ID NO: 854538 - RNA, 15 nt, Mycobacterium avium subsp. paratuberculosis
cggcgcgccgggcag

SEQ ID NO: 854539 - RNA, 16 nt, Mycobacterium avium subsp. paratuberculosis
cggcgcgccgggcagc

SEQ ID NO: 854540 - RNA, 22 nt, Mycobacterium avium subsp. paratuberculosis
cggcgcgccgggcagcccgccg

SEQ ID NO: 854541 - RNA, 23 nt, Mycobacterium avium subsp. paratuberculosis
cggcgcgccgggcagcccgccgc

SEQ ID NO: 854542 - RNA, 13 nt, Mycobacterium avium subsp. paratuberculosis
cggcgcgccgcgu

SEQ ID NO: 854543 - RNA, 18 nt, Mycobacterium avium subsp. paratuberculosis
cggcgcgccgcgauuucc

SEQ ID NO: 854544 - RNA, 15 nt, Mycobacterium avium subsp. paratuberculosis
cggcgcugucggcgg

SEQ ID NO: 854545 - RNA, 17 nt, Mycobacterium avium subsp. paratuberculosis
cggcgcuucugcgccgg

SEQ ID NO: 854546 - RNA, 18 nt, Mycobacterium avium subsp. paratuberculosis
cggcgcuucugcgccggu

SEQ ID NO: 854547 - RNA, 21 nt, Mycobacterium avium subsp. paratuberculosis
cggcgcuucugcgccgguucg

SEQ ID NO: 854548 - RNA, 15 nt, Mycobacterium avium subsp. paratuberculosis
cggcgcuugaccucg

SEQ ID NO: 854549 - RNA, 18 nt, Mycobacterium avium subsp. paratuberculosis
cggcgcuugaccucgccg

SEQ ID NO: 854550 - RNA, 19 nt, Mycobacterium avium subsp. paratuberculosis
cggcgcuugaccucgccga

SEQ ID NO: 854551 - RNA, 23 nt, Mycobacterium avium subsp. paratuberculosis
cggcgcuugaccucgccgagcag

SEQ ID NO: 854552 - RNA, 13 nt, Mycobacterium avium subsp. paratuberculosis
cggcgcuugacga

SEQ ID NO: 854553 - RNA, 18 nt, Mycobacterium avium subsp. paratuberculosis
cggcgcuugacgaacgcc

SEQ ID NO: 854554 - RNA, 22 nt, Mycobacterium avium subsp. paratuberculosis
cggcgcuugacgaacgccacca

SEQ ID NO: 854555 - RNA, 23 nt, Mycobacterium avium subsp. paratuberculosis
cggcgcuugacgaacgccaccac

SEQ ID NO: 854556 - RNA, 16 nt, Mycobacterium avium subsp. paratuberculosis
cggcgcuuuccaccuc

SEQ ID NO: 854557 - RNA, 20 nt, Mycobacterium avium subsp. paratuberculosis
cggcgcuuuccaccucgagc

SEQ ID NO: 854558 - RNA, 15 nt, Mycobacterium avium subsp. paratuberculosis
cggcgcugcgcccgg

SEQ ID NO: 854559 - RNA, 19 nt, Mycobacterium avium subsp. paratuberculosis
cggcgcugcgcccggucag

SEQ ID NO: 854560 - RNA, 13 nt, Mycobacterium avium subsp. paratuberculosis
cggcgcugcgccg

SEQ ID NO: 854561 - RNA, 12 nt, Mycobacterium avium subsp. paratuberculosis
cggcgcugguag

SEQ ID NO: 854562 - RNA, 16 nt, Mycobacterium avium subsp. paratuberculosis
cggcgcuggucggcgg

SEQ ID NO: 854563 - RNA, 17 nt, Mycobacterium avium subsp. paratuberculosis
cggcgcuggucggcggg

SEQ ID NO: 854564 - RNA, 20 nt, Mycobacterium avium subsp. paratuberculosis
cggcgcuggucggcgggcag

SEQ ID NO: 854565 - RNA, 23 nt, Mycobacterium avium subsp. paratuberculosis
cggcgcuggucggcgggcagcga

SEQ ID NO: 854566 - RNA, 14 nt, Mycobacterium avium subsp. paratuberculosis
cggcgcugaugccg

SEQ ID NO: 854567 - RNA, 16 nt, Mycobacterium avium subsp. paratuberculosis
cggcgcugaugccguc

SEQ ID NO: 854568 - RNA, 18 nt, Mycobacterium avium subsp. paratuberculosis
cggcgcugaugccguccu

SEQ ID NO: 854569 - RNA, 16 nt, Mycobacterium avium subsp. paratuberculosis
cggcgcugcccgucga

SEQ ID NO: 854570 - RNA, 18 nt, Mycobacterium avium subsp. paratuberculosis
cggcgcugcccgucgacc

SEQ ID NO: 854571 - RNA, 19 nt, Mycobacterium avium subsp. paratuberculosis
cggcgcugcccgucgaccu

SEQ ID NO: 854572 - RNA, 14 nt, Mycobacterium avium subsp. paratuberculosis
cggcgcugccgccg

SEQ ID NO: 854573 - RNA, 15 nt, Mycobacterium avium subsp. paratuberculosis
cggcgcugccgccgg

SEQ ID NO: 854574 - RNA, 16 nt, Mycobacterium avium subsp. paratuberculosis
cggcgcugccgccggc

SEQ ID NO: 854575 - RNA, 19 nt, Mycobacterium avium subsp. paratuberculosis
cggcgcugccgccggccuc

SEQ ID NO: 854576 - RNA, 16 nt, Mycobacterium avium subsp. paratuberculosis
cggcgcugccggcgca

SEQ ID NO: 854577 - RNA, 17 nt, Mycobacterium avium subsp. paratuberculosis
cggcgcugccggcgcac

SEQ ID NO: 854578 - RNA, 18 nt, Mycobacterium avium subsp. paratuberculosis
cggcgcugccggcgcacc

SEQ ID NO: 854579 - RNA, 14 nt, Mycobacterium avium subsp. paratuberculosis
cggcgcugcagcag

SEQ ID NO: 854580 - RNA, 15 nt, Mycobacterium avium subsp. paratuberculosis
cggcgcugcagcagc

SEQ ID NO: 854581 - RNA, 16 nt, Mycobacterium avium subsp. paratuberculosis
cggcgcugcagcagcc

SEQ ID NO: 854582 - RNA, 19 nt, Mycobacterium avium subsp. paratuberculosis
cggcgcugcagcagcccga

SEQ ID NO: 854583 - RNA, 21 nt, Mycobacterium avium subsp. paratuberculosis
cggcgcugcagcagcccgauc

SEQ ID NO: 854584 - RNA, 18 nt, Mycobacterium avium subsp. paratuberculosis
cggcgcugccccagccac

SEQ ID NO: 854585 - RNA, 20 nt, Mycobacterium avium subsp. paratuberculosis
cggcgcugccccagccacag

SEQ ID NO: 854586 - RNA, 19 nt, Mycobacterium avium subsp. paratuberculosis
cggcgcugcccgccgcggu

SEQ ID NO: 854587 - RNA, 21 nt, Mycobacterium avium subsp. paratuberculosis
cggcgcugcccgccgcggugc

SEQ ID NO: 854588 - RNA, 14 nt, Mycobacterium avium subsp. paratuberculosis
cggcgcugcccgcg

SEQ ID NO: 854589 - RNA, 16 nt, Mycobacterium avium subsp. paratuberculosis
cggcgcugcccgcgau

SEQ ID NO: 854590 - RNA, 17 nt, Mycobacterium avium subsp. paratuberculosis
cggcgcugcccgcgauc

SEQ ID NO: 854591 - RNA, 21 nt, Mycobacterium avium subsp. paratuberculosis
cggcgcguuccaucagcgccc

SEQ ID NO: 854592 - RNA, 22 nt, Mycobacterium avium subsp. paratuberculosis
cggcgcguuccaucagcgcccg

SEQ ID NO: 854593 - RNA, 23 nt, Mycobacterium avium subsp. paratuberculosis
cggcgcguuccaucagcgcccgc

SEQ ID NO: 854594 - RNA, 20 nt, Mycobacterium avium subsp. paratuberculosis
cggcgcgugcuguugcaggu

SEQ ID NO: 854595 - RNA, 21 nt, Mycobacterium avium subsp. paratuberculosis
cggcgcgugcuguugcaggug

SEQ ID NO: 854596 - RNA, 17 nt, Mycobacterium avium subsp. paratuberculosis
cggcgcgugcgccgcgg

SEQ ID NO: 854597 - RNA, 18 nt, Mycobacterium avium subsp. paratuberculosis
cggcgcgugcgccgcggc

SEQ ID NO: 854598 - RNA, 16 nt, Mycobacterium avium subsp. paratuberculosis
cggcgcgugcgcgacg

SEQ ID NO: 854599 - RNA, 16 nt, Mycobacterium avium subsp. paratuberculosis
cggcgcgugccaacca

SEQ ID NO: 854600 - RNA, 19 nt, Mycobacterium avium subsp. paratuberculosis
cggcgcgugauccggaaug

SEQ ID NO: 854601 - RNA, 23 nt, Mycobacterium avium subsp. paratuberculosis
cggcgcgugauccggaaugcggu

SEQ ID NO: 854602 - RNA, 17 nt, Mycobacterium avium subsp. paratuberculosis
cggcgcgucgcugggca

SEQ ID NO: 854603 - RNA, 18 nt, Mycobacterium avium subsp. paratuberculosis
cggcgcgucgcugggcag

SEQ ID NO: 854604 - RNA, 12 nt, Mycobacterium avium subsp. paratuberculosis
cggcgcgucggc

SEQ ID NO: 854605 - RNA, 14 nt, Mycobacterium avium subsp. paratuberculosis
cggcgcgucggcgu

SEQ ID NO: 854606 - RNA, 15 nt, Mycobacterium avium subsp. paratuberculosis
cggcgcgucguacac

SEQ ID NO: 854607 - RNA, 20 nt, Mycobacterium avium subsp. paratuberculosis
cggcgcgucguacaccucgg

SEQ ID NO: 854608 - RNA, 21 nt, Mycobacterium avium subsp. paratuberculosis
cggcgcgucguacaccucggu

SEQ ID NO: 854609 - RNA, 19 nt, Mycobacterium avium subsp. paratuberculosis
cggcgcgucguagucgcuc

SEQ ID NO: 854610 - RNA, 19 nt, Mycobacterium avium subsp. paratuberculosis
cggcgcgucguccgacacc

SEQ ID NO: 854611 - RNA, 14 nt, Mycobacterium avium subsp. paratuberculosis
cggcgcguccaugg

SEQ ID NO: 854612 - RNA, 18 nt, Mycobacterium avium subsp. paratuberculosis
cggcgcguccauggucga

SEQ ID NO: 854613 - RNA, 13 nt, Mycobacterium avium subsp. paratuberculosis
cggcggcacgguu

SEQ ID NO: 854614 - RNA, 20 nt, Mycobacterium avium subsp. paratuberculosis
cggcggcacgguuggccggc

SEQ ID NO: 854615 - RNA, 12 nt, Mycobacterium avium subsp. paratuberculosis
cggcggcaccca

SEQ ID NO: 854616 - RNA, 23 nt, Mycobacterium avium subsp. paratuberculosis
cggcggcacccaggucaccgagg

SEQ ID NO: 854617 - RNA, 17 nt, Mycobacterium avium subsp. paratuberculosis
cggcggcaccgcccggg

SEQ ID NO: 854618 - RNA, 14 nt, Mycobacterium avium subsp. paratuberculosis
cggcggcaccgccg

SEQ ID NO: 854619 - RNA, 18 nt, Mycobacterium avium subsp. paratuberculosis
cggcggcaccgccgcggu

SEQ ID NO: 854620 - RNA, 19 nt, Mycobacterium avium subsp. paratuberculosis
cggcggcaguccggcgagu

SEQ ID NO: 854621 - RNA, 21 nt, Mycobacterium avium subsp. paratuberculosis
cggcggcaguccggcgaguac

SEQ ID NO: 854622 - RNA, 16 nt, Mycobacterium avium subsp. paratuberculosis
cggcggcagcgcggcg

SEQ ID NO: 854623 - RNA, 17 nt, Mycobacterium avium subsp. paratuberculosis
cggcggcagcgcggcgu

SEQ ID NO: 854624 - RNA, 16 nt, Mycobacterium avium subsp. paratuberculosis
cggcggcagcacccgc

SEQ ID NO: 854625 - RNA, 17 nt, Mycobacterium avium subsp. paratuberculosis
cggcggcagcacccgca

SEQ ID NO: 854626 - RNA, 13 nt, Mycobacterium avium subsp. paratuberculosis
cggcggcagcgag

SEQ ID NO: 854627 - RNA, 14 nt, Mycobacterium avium subsp. paratuberculosis
cggcggcagcgagg

SEQ ID NO: 854628 - RNA, 16 nt, Mycobacterium avium subsp. paratuberculosis
cggcggcagcgaggcg

SEQ ID NO: 854629 - RNA, 20 nt, Mycobacterium avium subsp. paratuberculosis
cggcggcagcgaggcgcgca

SEQ ID NO: 854630 - RNA, 21 nt, Mycobacterium avium subsp. paratuberculosis
cggcggcagauagaucagcag

SEQ ID NO: 854631 - RNA, 20 nt, Mycobacterium avium subsp. paratuberculosis
cggcggacagccccgagccg

SEQ ID NO: 854632 - RNA, 21 nt, Mycobacterium avium subsp. paratuberculosis
cggcggacagccccgagccgc

SEQ ID NO: 854633 - RNA, 17 nt, Mycobacterium avium subsp. paratuberculosis
cggcggacaucgccucg

SEQ ID NO: 854634 - RNA, 16 nt, Mycobacterium avium subsp. paratuberculosis
cggcggacccagcucc

SEQ ID NO: 854635 - RNA, 19 nt, Mycobacterium avium subsp. paratuberculosis
cggcggacccagcuccucg

SEQ ID NO: 854636 - RNA, 20 nt, Mycobacterium avium subsp. paratuberculosis
cggcggacccagcuccucgg

SEQ ID NO: 854637 - RNA, 23 nt, Mycobacterium avium subsp. paratuberculosis
cggcggacccagcuccucggcca

SEQ ID NO: 854638 - RNA, 14 nt, Mycobacterium avium subsp. paratuberculosis
cggcggacccggag

SEQ ID NO: 854639 - RNA, 17 nt, Mycobacterium avium subsp. paratuberculosis
cggcggacccggaggcg

SEQ ID NO: 854640 - RNA, 18 nt, Mycobacterium avium subsp. paratuberculosis
cggcggacccggaggcgg

SEQ ID NO: 854641 - RNA, 22 nt, Mycobacterium avium subsp. paratuberculosis
cggcggacccggaggcggcggg

SEQ ID NO: 854642 - RNA, 23 nt, Mycobacterium avium subsp. paratuberculosis
cggcggaacccggguggcccgca

SEQ ID NO: 854643 - RNA, 16 nt, Mycobacterium avium subsp. paratuberculosis
cggcggaaccgggccg

SEQ ID NO: 854644 - RNA, 17 nt, Mycobacterium avium subsp. paratuberculosis
cggcggaaccgggccgc

SEQ ID NO: 854645 - RNA, 19 nt, Mycobacterium avium subsp. paratuberculosis
cggcggaaccgggccgcug

SEQ ID NO: 854646 - RNA, 20 nt, Mycobacterium avium subsp. paratuberculosis
cggcggaacggucggggcgg

SEQ ID NO: 854647 - RNA, 14 nt, Mycobacterium avium subsp. paratuberculosis
cggcggcaccaccc

SEQ ID NO: 854648 - RNA, 21 nt, Mycobacterium avium subsp. paratuberculosis
cggcggcaccacccgcggccg

SEQ ID NO: 854649 - RNA, 22 nt, Mycobacterium avium subsp. paratuberculosis
cggcggcaccacccgcggccgg

SEQ ID NO: 854650 - RNA, 23 nt, Mycobacterium avium subsp. paratuberculosis
cggcggcaccacccgcggccggc

SEQ ID NO: 854651 - RNA, 15 nt, Mycobacterium avium subsp. paratuberculosis
cggcggcaaguccgg

SEQ ID NO: 854652 - RNA, 19 nt, Mycobacterium avium subsp. paratuberculosis
cggcggcaaguccgggucc

SEQ ID NO: 854653 - RNA, 15 nt, Mycobacterium avium subsp. paratuberculosis
cggcggaccggcggc

SEQ ID NO: 854654 - RNA, 17 nt, Mycobacterium avium subsp. paratuberculosis
cggcggaccggcggccg

SEQ ID NO: 854655 - RNA, 18 nt, Mycobacterium avium subsp. paratuberculosis
cggcggaccggcggccgc

SEQ ID NO: 854656 - RNA, 20 nt, Mycobacterium avium subsp. paratuberculosis
cggcggaccggcggccgcca

SEQ ID NO: 854657 - RNA, 22 nt, Mycobacterium avium subsp. paratuberculosis
cggcggaccggcggccgccauc

SEQ ID NO: 854658 - RNA, 20 nt, Mycobacterium avium subsp. paratuberculosis
cggcggcaaagcguugccgc

SEQ ID NO: 854659 - RNA, 18 nt, Mycobacterium avium subsp. paratuberculosis
cggcggcaaccagcuccg

SEQ ID NO: 854660 - RNA, 19 nt, Mycobacterium avium subsp. paratuberculosis
cggcgauguaggacgccgc

SEQ ID NO: 854661 - RNA, 19 nt, Mycobacterium avium subsp. paratuberculosis
cggcgaugguggcgcugcc

SEQ ID NO: 854662 - RNA, 14 nt, Mycobacterium avium subsp. paratuberculosis
cggcgauggugggc

SEQ ID NO: 854663 - RNA, 17 nt, Mycobacterium avium subsp. paratuberculosis
cggcgauggugggcagc

SEQ ID NO: 854664 - RNA, 19 nt, Mycobacterium avium subsp. paratuberculosis
cggcgauggugggcagccg

SEQ ID NO: 854665 - RNA, 20 nt, Mycobacterium avium subsp. paratuberculosis
cggcgauggugggcagccgg

SEQ ID NO: 854666 - RNA, 23 nt, Mycobacterium avium subsp. paratuberculosis
cggcgauggugggcagccggcaa

SEQ ID NO: 854667 - RNA, 20 nt, Mycobacterium avium subsp. paratuberculosis
cggcgauggugaugcggaug

SEQ ID NO: 854668 - RNA, 22 nt, Mycobacterium avium subsp. paratuberculosis
cggcgauggugaugugcggcgc

SEQ ID NO: 854669 - RNA, 22 nt, Mycobacterium avium subsp. paratuberculosis
cggcgauguggcguucgaugcc

SEQ ID NO: 854670 - RNA, 15 nt, Mycobacterium avium subsp. paratuberculosis
cggcgaugucgggca

SEQ ID NO: 854671 - RNA, 13 nt, Mycobacterium avium subsp. paratuberculosis
cggcgaugucguc

SEQ ID NO: 854672 - RNA, 15 nt, Mycobacterium avium subsp. paratuberculosis
cggcgaugucgucga

SEQ ID NO: 854673 - RNA, 18 nt, Mycobacterium avium subsp. paratuberculosis
cggcgaugucgucgacgc

SEQ ID NO: 854674 - RNA, 21 nt, Mycobacterium avium subsp. paratuberculosis
cggcgaugucgucgacgcugc

SEQ ID NO: 854675 - RNA, 15 nt, Mycobacterium avium subsp. paratuberculosis
cggcgcaccccgaac

SEQ ID NO: 854676 - RNA, 15 nt, Mycobacterium avium subsp. paratuberculosis
cggcgcaccgagucg

SEQ ID NO: 854677 - RNA, 16 nt, Mycobacterium avium subsp. paratuberculosis
cggcgcaccgagucgg

SEQ ID NO: 854678 - RNA, 14 nt, Mycobacterium avium subsp. paratuberculosis
cggcgcaccgcccg

SEQ ID NO: 854679 - RNA, 17 nt, Mycobacterium avium subsp. paratuberculosis
cggcgcaccgcccgcgg

SEQ ID NO: 854680 - RNA, 18 nt, Mycobacterium avium subsp. paratuberculosis
cggcgcaccgcccgcggu

SEQ ID NO: 854681 - RNA, 12 nt, Mycobacterium avium subsp. paratuberculosis
cggcgcaccgcg

SEQ ID NO: 854682 - RNA, 14 nt, Mycobacterium avium subsp. paratuberculosis
cggcgcaccgcguc

SEQ ID NO: 854683 - RNA, 15 nt, Mycobacterium avium subsp. paratuberculosis
cggcgcaccgcgucg

SEQ ID NO: 854684 - RNA, 16 nt, Mycobacterium avium subsp. paratuberculosis
cggcgcaccgcgucga

SEQ ID NO: 854685 - RNA, 23 nt, Mycobacterium avium subsp. paratuberculosis
cggcgcaccgcgucgaccaccgc

SEQ ID NO: 854686 - RNA, 14 nt, Mycobacterium avium subsp. paratuberculosis
cggcgcacccgggc

SEQ ID NO: 854687 - RNA, 16 nt, Mycobacterium avium subsp. paratuberculosis
cggcgcacccgggcag

SEQ ID NO: 854688 - RNA, 21 nt, Mycobacterium avium subsp. paratuberculosis
cggcgcacagcuaggucgugg

SEQ ID NO: 854689 - RNA, 19 nt, Mycobacterium avium subsp. paratuberculosis
cggcgcacaggaacgcguc

SEQ ID NO: 854690 - RNA, 21 nt, Mycobacterium avium subsp. paratuberculosis
cggcgcacaggaacgcgucga

SEQ ID NO: 854691 - RNA, 19 nt, Mycobacterium avium subsp. paratuberculosis
cggcgcacaucguggcgac

SEQ ID NO: 854692 - RNA, 23 nt, Mycobacterium avium subsp. paratuberculosis
cggcgcacaucguggcgacgacg

SEQ ID NO: 854693 - RNA, 12 nt, Mycobacterium avium subsp. paratuberculosis
cggcgcaccagg

SEQ ID NO: 854694 - RNA, 13 nt, Mycobacterium avium subsp. paratuberculosis
cggcgcaccaggc

SEQ ID NO: 854695 - RNA, 14 nt, Mycobacterium avium subsp. paratuberculosis
cggcgcaccaggcg

SEQ ID NO: 854696 - RNA, 19 nt, Mycobacterium avium subsp. paratuberculosis
cggcgcaccaggcgccaca

SEQ ID NO: 854697 - RNA, 22 nt, Mycobacterium avium subsp. paratuberculosis
cggcgcaccaggcgccacagca

SEQ ID NO: 854698 - RNA, 23 nt, Mycobacterium avium subsp. paratuberculosis
cggcgcaccagggugucgucgcg

SEQ ID NO: 854699 - RNA, 15 nt, Mycobacterium avium subsp. paratuberculosis
cggcgauggcgcggc

SEQ ID NO: 854700 - RNA, 18 nt, Mycobacterium avium subsp. paratuberculosis
cggcgauggcgcggccgg

SEQ ID NO: 854701 - RNA, 21 nt, Mycobacterium avium subsp. paratuberculosis
cggcgauggcgcggccggccg

SEQ ID NO: 854702 - RNA, 22 nt, Mycobacterium avium subsp. paratuberculosis
cggcgauggcgcggccggccga

SEQ ID NO: 854703 - RNA, 17 nt, Mycobacterium avium subsp. paratuberculosis
cggcgauggcggcgugc

SEQ ID NO: 854704 - RNA, 14 nt, Mycobacterium avium subsp. paratuberculosis
cggcgaugccguug

SEQ ID NO: 854705 - RNA, 18 nt, Mycobacterium avium subsp. paratuberculosis
cggcgaugccuuccucgg

SEQ ID NO: 854706 - RNA, 15 nt, Mycobacterium avium subsp. paratuberculosis
cggcgaugcgcacca

SEQ ID NO: 854707 - RNA, 17 nt, Mycobacterium avium subsp. paratuberculosis
cggcgaugcgcaccauc

SEQ ID NO: 854708 - RNA, 18 nt, Mycobacterium avium subsp. paratuberculosis
cggcgaugcccgugaucg

SEQ ID NO: 854709 - RNA, 20 nt, Mycobacterium avium subsp. paratuberculosis
cggcgaugcccgugaucgcc

SEQ ID NO: 854710 - RNA, 14 nt, Mycobacterium avium subsp. paratuberculosis
cggcgaugccgagc

SEQ ID NO: 854711 - RNA, 13 nt, Mycobacterium avium subsp. paratuberculosis
cggcgaugaucac

SEQ ID NO: 854712 - RNA, 14 nt, Mycobacterium avium subsp. paratuberculosis
cggcgaugaccggg

SEQ ID NO: 854713 - RNA, 15 nt, Mycobacterium avium subsp. paratuberculosis
cggcgaugaccggga

SEQ ID NO: 854714 - RNA, 16 nt, Mycobacterium avium subsp. paratuberculosis
cggcgaugaccgggac

SEQ ID NO: 854715 - RNA, 17 nt, Mycobacterium avium subsp. paratuberculosis
cggcgaugaccgggacg

SEQ ID NO: 854716 - RNA, 21 nt, Mycobacterium avium subsp. paratuberculosis
cggcgaugaccgggacgaagg

SEQ ID NO: 854717 - RNA, 19 nt, Mycobacterium avium subsp. paratuberculosis
cggcgaugaucaggccgga

SEQ ID NO: 854718 - RNA, 20 nt, Mycobacterium avium subsp. paratuberculosis
cggcgaugaucaggccggac

SEQ ID NO: 854719 - RNA, 13 nt, Mycobacterium avium subsp. paratuberculosis
cggcgaugauccg

SEQ ID NO: 854720 - RNA, 19 nt, Mycobacterium avium subsp. paratuberculosis
cggcgaugauccgcggcgc

SEQ ID NO: 854721 - RNA, 20 nt, Mycobacterium avium subsp. paratuberculosis
cggcgaugauccgcggcgcc

SEQ ID NO: 854722 - RNA, 21 nt, Mycobacterium avium subsp. paratuberculosis
cggcgaugauccgcggcgccg

SEQ ID NO: 854723 - RNA, 13 nt, Mycobacterium avium subsp. paratuberculosis
cggcgaugccagc

SEQ ID NO: 854724 - RNA, 19 nt, Mycobacterium avium subsp. paratuberculosis
cggcgaugccagcgcaccg

SEQ ID NO: 854725 - RNA, 23 nt, Mycobacterium avium subsp. paratuberculosis
cggcgaugccagcgcaccgggcc

SEQ ID NO: 854726 - RNA, 14 nt, Mycobacterium avium subsp. paratuberculosis
cggcgaugcccaca

SEQ ID NO: 854727 - RNA, 22 nt, Mycobacterium avium subsp. paratuberculosis
cggcgaugcccacagccaggug

SEQ ID NO: 854728 - RNA, 18 nt, Mycobacterium avium subsp. paratuberculosis
cggcgaucgccggggauc

SEQ ID NO: 854729 - RNA, 14 nt, Mycobacterium avium subsp. paratuberculosis
cggcgaucgccgug

SEQ ID NO: 854730 - RNA, 20 nt, Mycobacterium avium subsp. paratuberculosis
cggcgaucgccguggucaac

SEQ ID NO: 854731 - RNA, 16 nt, Mycobacterium avium subsp. paratuberculosis
cggcgaucgcgagcag

SEQ ID NO: 854732 - RNA, 14 nt, Mycobacterium avium subsp. paratuberculosis
cggcgaucggccgc

SEQ ID NO: 854733 - RNA, 15 nt, Mycobacterium avium subsp. paratuberculosis
cggcgaucggccgcu

SEQ ID NO: 854734 - RNA, 17 nt, Mycobacterium avium subsp. paratuberculosis
cggcgaucggccgcugc

SEQ ID NO: 854735 - RNA, 22 nt, Mycobacterium avium subsp. paratuberculosis
cggcgaucggccgcugcgggcg

SEQ ID NO: 854736 - RNA, 23 nt, Mycobacterium avium subsp. paratuberculosis
cggcgaucggccgcugcgggcgg

SEQ ID NO: 854737 - RNA, 12 nt, Mycobacterium avium subsp. paratuberculosis
cggcgaucggcg

SEQ ID NO: 854738 - RNA, 16 nt, Mycobacterium avium subsp. paratuberculosis
cggcgaucggcgcggc

SEQ ID NO: 854739 - RNA, 14 nt, Mycobacterium avium subsp. paratuberculosis
cggcgaucggcggu

SEQ ID NO: 854740 - RNA, 20 nt, Mycobacterium avium subsp. paratuberculosis
cggcgaucggcgguccgccg

SEQ ID NO: 854741 - RNA, 17 nt, Mycobacterium avium subsp. paratuberculosis
cggcgaucggcgugccg

SEQ ID NO: 854742 - RNA, 14 nt, Mycobacterium avium subsp. paratuberculosis
cggcgaucgucgcc

SEQ ID NO: 854743 - RNA, 15 nt, Mycobacterium avium subsp. paratuberculosis
cggcgaucgucgccg

SEQ ID NO: 854744 - RNA, 17 nt, Mycobacterium avium subsp. paratuberculosis
cggcgaucgucgccguc

SEQ ID NO: 854745 - RNA, 19 nt, Mycobacterium avium subsp. paratuberculosis
cggcgaucgucgccgucac

SEQ ID NO: 854746 - RNA, 14 nt, Mycobacterium avium subsp. paratuberculosis
cggcgaucuccacc

SEQ ID NO: 854747 - RNA, 17 nt, Mycobacterium avium subsp. paratuberculosis
cggcgaucuccaccgug

SEQ ID NO: 854748 - RNA, 21 nt, Mycobacterium avium subsp. paratuberculosis
cggcgaucgggucaccggccg

SEQ ID NO: 854749 - RNA, 23 nt, Mycobacterium avium subsp. paratuberculosis
cggcgaucgggucaccggccgag

SEQ ID NO: 854750 - RNA, 17 nt, Mycobacterium avium subsp. paratuberculosis
cggcgaucucgagcauc

SEQ ID NO: 854751 - RNA, 16 nt, Mycobacterium avium subsp. paratuberculosis
cggcgaucucgaucgu

SEQ ID NO: 854752 - RNA, 16 nt, Mycobacterium avium subsp. paratuberculosis
cggcgaugaccgccug

SEQ ID NO: 854753 - RNA, 22 nt, Mycobacterium avium subsp. paratuberculosis
cggcgaugaccgccugcggcag

SEQ ID NO: 854754 - RNA, 14 nt, Mycobacterium avium subsp. paratuberculosis
cggcgaucuuugcg

SEQ ID NO: 854755 - RNA, 23 nt, Mycobacterium avium subsp. paratuberculosis
cggcgaucuuugcggccguggcg

SEQ ID NO: 854756 - RNA, 18 nt, Mycobacterium avium subsp. paratuberculosis
cggcgaugaacacgccga

SEQ ID NO: 854757 - RNA, 18 nt, Mycobacterium avium subsp. paratuberculosis
cggcgaucugcuccucgg

SEQ ID NO: 854758 - RNA, 18 nt, Mycobacterium avium subsp. paratuberculosis
cggcgaucuggcgguugg

SEQ ID NO: 854759 - RNA, 23 nt, Mycobacterium avium subsp. paratuberculosis
cggcgaucuggcgguuggacagg

SEQ ID NO: 854760 - RNA, 16 nt, Mycobacterium avium subsp. paratuberculosis
cggcgaucucggcggc

SEQ ID NO: 854761 - RNA, 20 nt, Mycobacterium avium subsp. paratuberculosis
cggcgaucucggcggccgcg

SEQ ID NO: 854762 - RNA, 20 nt, Mycobacterium avium subsp. paratuberculosis
cggcgaucucggucaccgag

SEQ ID NO: 854763 - RNA, 21 nt, Mycobacterium avium subsp. paratuberculosis
cggcgaucucggucaccgagc

SEQ ID NO: 854764 - RNA, 20 nt, Mycobacterium avium subsp. paratuberculosis
cggcgaucucgucccacggc

SEQ ID NO: 854765 - RNA, 16 nt, Mycobacterium avium subsp. paratuberculosis
cggcgaucucgucgcg

SEQ ID NO: 854766 - RNA, 20 nt, Mycobacterium avium subsp. paratuberculosis
cggcgaucucgucgcgcagc

SEQ ID NO: 854767 - RNA, 17 nt, Mycobacterium avium subsp. paratuberculosis
cggcgaucucgucgcgg

SEQ ID NO: 854768 - RNA, 16 nt, Mycobacterium avium subsp. paratuberculosis
cggcgaaaacgccugc

SEQ ID NO: 854769 - RNA, 23 nt, Mycobacterium avium subsp. paratuberculosis
cggcgaaaacgccugcgccgccg

SEQ ID NO: 854770 - RNA, 21 nt, Mycobacterium avium subsp. paratuberculosis
cggcgaaacaccaagcaccag

SEQ ID NO: 854771 - RNA, 21 nt, Mycobacterium avium subsp. paratuberculosis
cggcgauccggccggcggcgg

SEQ ID NO: 854772 - RNA, 22 nt, Mycobacterium avium subsp. paratuberculosis
cggcgauccggccggcggcggu

SEQ ID NO: 854773 - RNA, 15 nt, Mycobacterium avium subsp. paratuberculosis
cggcgauccgggcac

SEQ ID NO: 854774 - RNA, 15 nt, Mycobacterium avium subsp. paratuberculosis
cggcgaucgccgcga

SEQ ID NO: 854775 - RNA, 17 nt, Mycobacterium avium subsp. paratuberculosis
cggcgaucgccgcgaac

SEQ ID NO: 854776 - RNA, 16 nt, Mycobacterium avium subsp. paratuberculosis
cggccuuuuccggcga

SEQ ID NO: 854777 - RNA, 17 nt, Mycobacterium avium subsp. paratuberculosis
cggccuuuuccggcgac

SEQ ID NO: 854778 - RNA, 16 nt, Mycobacterium avium subsp. paratuberculosis
cggccuuggccaccgc

SEQ ID NO: 854779 - RNA, 17 nt, Mycobacterium avium subsp. paratuberculosis
cggccuuggccaccgcc

SEQ ID NO: 854780 - RNA, 19 nt, Mycobacterium avium subsp. paratuberculosis
cggccuuggccaccgccug

SEQ ID NO: 854781 - RNA, 14 nt, Mycobacterium avium subsp. paratuberculosis
cggcgcagcgcgau

SEQ ID NO: 854782 - RNA, 12 nt, Mycobacterium avium subsp. paratuberculosis
cggcgcaggcgc

SEQ ID NO: 854783 - RNA, 13 nt, Mycobacterium avium subsp. paratuberculosis
cggcgcaggcgcg

SEQ ID NO: 854784 - RNA, 17 nt, Mycobacterium avium subsp. paratuberculosis
cggcgcaggcgcgcacc

SEQ ID NO: 854785 - RNA, 17 nt, Mycobacterium avium subsp. paratuberculosis
cggcgccaggccggcga

SEQ ID NO: 854786 - RNA, 23 nt, Mycobacterium avium subsp. paratuberculosis
cggcgccaggccggcgacgccgg

SEQ ID NO: 854787 - RNA, 14 nt, Mycobacterium avium subsp. paratuberculosis
cggcgcagggcggc

SEQ ID NO: 854788 - RNA, 17 nt, Mycobacterium avium subsp. paratuberculosis
cggcgcagggcggccgg

SEQ ID NO: 854789 - RNA, 18 nt, Mycobacterium avium subsp. paratuberculosis
cggcgcagggcggccggc

SEQ ID NO: 854790 - RNA, 14 nt, Mycobacterium avium subsp. paratuberculosis
cggcgccaggccgg

SEQ ID NO: 854791 - RNA, 13 nt, Mycobacterium avium subsp. paratuberculosis
cggcgcagcggcc

SEQ ID NO: 854792 - RNA, 16 nt, Mycobacterium avium subsp. paratuberculosis
cggcgcagcggcccga

SEQ ID NO: 854793 - RNA, 12 nt, Mycobacterium avium subsp. paratuberculosis
cggcgcagcucg

SEQ ID NO: 854794 - RNA, 17 nt, Mycobacterium avium subsp. paratuberculosis
cggcgcagcucgcgcag

SEQ ID NO: 854795 - RNA, 18 nt, Mycobacterium avium subsp. paratuberculosis
cggcgcagcucgcgcagc

SEQ ID NO: 854796 - RNA, 12 nt, Mycobacterium avium subsp. paratuberculosis
cggcgcagcgcg

SEQ ID NO: 854797 - RNA, 13 nt, Mycobacterium avium subsp. paratuberculosis
cggcgcagcgcga

SEQ ID NO: 854798 - RNA, 18 nt, Mycobacterium avium subsp. paratuberculosis
cggcgcagcgcacgucgc

SEQ ID NO: 854799 - RNA, 18 nt, Mycobacterium avium subsp. paratuberculosis
cggcgcagcgccgcgccg

SEQ ID NO: 854800 - RNA, 22 nt, Mycobacterium avium subsp. paratuberculosis
cggcgcagcgccgcgccgaccu

SEQ ID NO: 854801 - RNA, 15 nt, Mycobacterium avium subsp. paratuberculosis
cggcgcagccggcca

SEQ ID NO: 854802 - RNA, 16 nt, Mycobacterium avium subsp. paratuberculosis
cggcgcagccggccac

SEQ ID NO: 854803 - RNA, 19 nt, Mycobacterium avium subsp. paratuberculosis
cggcgcagccggccaccgc

SEQ ID NO: 854804 - RNA, 23 nt, Mycobacterium avium subsp. paratuberculosis
cggcgcaccgugucgucgcugac

SEQ ID NO: 854805 - RNA, 15 nt, Mycobacterium avium subsp. paratuberculosis
cggcgcaccuggcgc

SEQ ID NO: 854806 - RNA, 17 nt, Mycobacterium avium subsp. paratuberculosis
cggcgcaccuggcgcag

SEQ ID NO: 854807 - RNA, 18 nt, Mycobacterium avium subsp. paratuberculosis
cggcgcaccuggcgcagc

SEQ ID NO: 854808 - RNA, 21 nt, Mycobacterium avium subsp. paratuberculosis
cggcgcaccuggcgcagcacc

SEQ ID NO: 854809 - RNA, 22 nt, Mycobacterium avium subsp. paratuberculosis
cggcgcaccuggcgcagcaccg

SEQ ID NO: 854810 - RNA, 16 nt, Mycobacterium avium subsp. paratuberculosis
cggcgcccagcggcga

SEQ ID NO: 854811 - RNA, 20 nt, Mycobacterium avium subsp. paratuberculosis
cggcgcccagcggcgaugcc

SEQ ID NO: 854812 - RNA, 22 nt, Mycobacterium avium subsp. paratuberculosis
cggcgcccacggccaccacggc

SEQ ID NO: 854813 - RNA, 12 nt, Mycobacterium avium subsp. paratuberculosis
cggcgcccaccg

SEQ ID NO: 854814 - RNA, 15 nt, Mycobacterium avium subsp. paratuberculosis
cggcgcccaccgcgg

SEQ ID NO: 854815 - RNA, 16 nt, Mycobacterium avium subsp. paratuberculosis
cggcgcccaccgcggc

SEQ ID NO: 854816 - RNA, 17 nt, Mycobacterium avium subsp. paratuberculosis
cggcgcccaccgcggcg

SEQ ID NO: 854817 - RNA, 18 nt, Mycobacterium avium subsp. paratuberculosis
cggcgcccaccgcggcgc

SEQ ID NO: 854818 - RNA, 20 nt, Mycobacterium avium subsp. paratuberculosis
cggcgcccaccgcggcgcgc

SEQ ID NO: 854819 - RNA, 16 nt, Mycobacterium avium subsp. paratuberculosis
cggcgccaugcgccgc

SEQ ID NO: 854820 - RNA, 12 nt, Mycobacterium avium subsp. paratuberculosis
cggcgccaucgu

SEQ ID NO: 854821 - RNA, 14 nt, Mycobacterium avium subsp. paratuberculosis
cggcgccaucgugg

SEQ ID NO: 854822 - RNA, 18 nt, Mycobacterium avium subsp. paratuberculosis
cggcgccaucguggccgc

SEQ ID NO: 854823 - RNA, 19 nt, Mycobacterium avium subsp. paratuberculosis
cggcgccaugaacggcggg

SEQ ID NO: 854824 - RNA, 21 nt, Mycobacterium avium subsp. paratuberculosis
cggcgccaugaacggcggggc

SEQ ID NO: 854825 - RNA, 22 nt, Mycobacterium avium subsp. paratuberculosis
cggcgcaggcauuuccaggucc

SEQ ID NO: 854826 - RNA, 21 nt, Mycobacterium avium subsp. paratuberculosis
cggcgccggaggccagcucga

SEQ ID NO: 854827 - RNA, 15 nt, Mycobacterium avium subsp. paratuberculosis
cggcgccggaggggc

SEQ ID NO: 854828 - RNA, 16 nt, Mycobacterium avium subsp. paratuberculosis
cggcgccgcggcccug

SEQ ID NO: 854829 - RNA, 16 nt, Mycobacterium avium subsp. paratuberculosis
cggcgccgcggccguu

SEQ ID NO: 854830 - RNA, 21 nt, Mycobacterium avium subsp. paratuberculosis
cggcgccgcgggugcggcacg

SEQ ID NO: 854831 - RNA, 17 nt, Mycobacterium avium subsp. paratuberculosis
cggcgccgcguaccagc

SEQ ID NO: 854832 - RNA, 20 nt, Mycobacterium avium subsp. paratuberculosis
cggcgccgcguaccagcgcc

SEQ ID NO: 854833 - RNA, 21 nt, Mycobacterium avium subsp. paratuberculosis
cggcgccgcguaccagcgcca

SEQ ID NO: 854834 - RNA, 16 nt, Mycobacterium avium subsp. paratuberculosis
cggcgccgcgucggac

SEQ ID NO: 854835 - RNA, 16 nt, Mycobacterium avium subsp. paratuberculosis
cggcgccgcggcggca

SEQ ID NO: 854836 - RNA, 22 nt, Mycobacterium avium subsp. paratuberculosis
cggcgccgcggcggcacccagg

SEQ ID NO: 854837 - RNA, 18 nt, Mycobacterium avium subsp. paratuberculosis
cggcgccgcgggcgccgu

SEQ ID NO: 854838 - RNA, 15 nt, Mycobacterium avium subsp. paratuberculosis
cggcgccgcggggcg

SEQ ID NO: 854839 - RNA, 13 nt, Mycobacterium avium subsp. paratuberculosis
cggcgccgcgggu

SEQ ID NO: 854840 - RNA, 15 nt, Mycobacterium avium subsp. paratuberculosis
cggcgccgcgggugc

SEQ ID NO: 854841 - RNA, 10 nt, Mycobacterium avium subsp. paratuberculosis
cggcgccgcg

SEQ ID NO: 854842 - RNA, 13 nt, Mycobacterium avium subsp. paratuberculosis
cggcgccgcgacc

SEQ ID NO: 854843 - RNA, 13 nt, Mycobacterium avium subsp. paratuberculosis
cggcgccgcgccg

SEQ ID NO: 854844 - RNA, 14 nt, Mycobacterium avium subsp. paratuberculosis
cggcgccgcgccgg

SEQ ID NO: 854845 - RNA, 18 nt, Mycobacterium avium subsp. paratuberculosis
cggcgccgcgccggcacu

SEQ ID NO: 854846 - RNA, 13 nt, Mycobacterium avium subsp. paratuberculosis
cggcgccgcgcgc

SEQ ID NO: 854847 - RNA, 14 nt, Mycobacterium avium subsp. paratuberculosis
cggcgccgcgcgcc

SEQ ID NO: 854848 - RNA, 17 nt, Mycobacterium avium subsp. paratuberculosis
cggcgccgcgcgccagc

SEQ ID NO: 854849 - RNA, 15 nt, Mycobacterium avium subsp. paratuberculosis
cggcgccgccguucg

SEQ ID NO: 854850 - RNA, 14 nt, Mycobacterium avium subsp. paratuberculosis
cggcgccgccgguc

SEQ ID NO: 854851 - RNA, 16 nt, Mycobacterium avium subsp. paratuberculosis
cggcgccgccggucgc

SEQ ID NO: 854852 - RNA, 17 nt, Mycobacterium avium subsp. paratuberculosis
cggcgccgccggucgcc

SEQ ID NO: 854853 - RNA, 14 nt, Mycobacterium avium subsp. paratuberculosis
cggcgccgccgagc

SEQ ID NO: 854854 - RNA, 15 nt, Mycobacterium avium subsp. paratuberculosis
cggcgccgccgagcc

SEQ ID NO: 854855 - RNA, 12 nt, Mycobacterium avium subsp. paratuberculosis
cggcgccgccgg

SEQ ID NO: 854856 - RNA, 13 nt, Mycobacterium avium subsp. paratuberculosis
cggcgcccgcggc

SEQ ID NO: 854857 - RNA, 13 nt, Mycobacterium avium subsp. paratuberculosis
cggcgccgcccgg

SEQ ID NO: 854858 - RNA, 15 nt, Mycobacterium avium subsp. paratuberculosis
cggcgccgcccggcg

SEQ ID NO: 854859 - RNA, 14 nt, Mycobacterium avium subsp. paratuberculosis
cggcgccgcccggg

SEQ ID NO: 854860 - RNA, 14 nt, Mycobacterium avium subsp. paratuberculosis
cggcgcccggcgcg

SEQ ID NO: 854861 - RNA, 16 nt, Mycobacterium avium subsp. paratuberculosis
cggcgcccggcgcgcc

SEQ ID NO: 854862 - RNA, 17 nt, Mycobacterium avium subsp. paratuberculosis
cggcgcccggcgcgcca

SEQ ID NO: 854863 - RNA, 18 nt, Mycobacterium avium subsp. paratuberculosis
cggcgcccggcgcgccac

SEQ ID NO: 854864 - RNA, 12 nt, Mycobacterium avium subsp. paratuberculosis
cggcgcccggcu

SEQ ID NO: 854865 - RNA, 21 nt, Mycobacterium avium subsp. paratuberculosis
cggcgcccgucacgcuggcgu

SEQ ID NO: 854866 - RNA, 23 nt, Mycobacterium avium subsp. paratuberculosis
cggcgcccgucacgcuggcguga

SEQ ID NO: 854867 - RNA, 16 nt, Mycobacterium avium subsp. paratuberculosis
cggcgcccucgaugcg

SEQ ID NO: 854868 - RNA, 23 nt, Mycobacterium avium subsp. paratuberculosis
cggcgcccucgaugcgcaccgug

SEQ ID NO: 854869 - RNA, 12 nt, Mycobacterium avium subsp. paratuberculosis
cggcgcccucgc

SEQ ID NO: 854870 - RNA, 22 nt, Mycobacterium avium subsp. paratuberculosis
cggcgcccgcggccuccagccg

SEQ ID NO: 854871 - RNA, 12 nt, Mycobacterium avium subsp. paratuberculosis
cggcgcccgccc

SEQ ID NO: 854872 - RNA, 15 nt, Mycobacterium avium subsp. paratuberculosis
cggcgcccgccccga

SEQ ID NO: 854873 - RNA, 15 nt, Mycobacterium avium subsp. paratuberculosis
cggcgcccggcaccg

SEQ ID NO: 854874 - RNA, 13 nt, Mycobacterium avium subsp. paratuberculosis
cggcgcccggccc

SEQ ID NO: 854875 - RNA, 16 nt, Mycobacterium avium subsp. paratuberculosis
cggcgcccggcccagc

SEQ ID NO: 854876 - RNA, 17 nt, Mycobacterium avium subsp. paratuberculosis
cggcgcccggcccagcc

SEQ ID NO: 854877 - RNA, 20 nt, Mycobacterium avium subsp. paratuberculosis
cggcgcccggcccagccgcu

SEQ ID NO: 854878 - RNA, 22 nt, Mycobacterium avium subsp. paratuberculosis
cggcgcccggcccagccgcugc

SEQ ID NO: 854879 - RNA, 14 nt, Mycobacterium avium subsp. paratuberculosis
cggcgcccggccgg

SEQ ID NO: 854880 - RNA, 15 nt, Mycobacterium avium subsp. paratuberculosis
cggcgcccggccggu

SEQ ID NO: 854881 - RNA, 17 nt, Mycobacterium avium subsp. paratuberculosis
cggcgcccggccggugc

SEQ ID NO: 854882 - RNA, 13 nt, Mycobacterium avium subsp. paratuberculosis
cggcgcccggcgc

SEQ ID NO: 854883 - RNA, 18 nt, Mycobacterium avium subsp. paratuberculosis
cggcgcccgaucggcacc

SEQ ID NO: 854884 - RNA, 21 nt, Mycobacterium avium subsp. paratuberculosis
cggcgcccgaucggcacccgc

SEQ ID NO: 854885 - RNA, 14 nt, Mycobacterium avium subsp. paratuberculosis
cggcgcccgcaggc

SEQ ID NO: 854886 - RNA, 19 nt, Mycobacterium avium subsp. paratuberculosis
cggcgcccgcaggccgcga

SEQ ID NO: 854887 - RNA, 15 nt, Mycobacterium avium subsp. paratuberculosis
cggcgccccggcgcu

SEQ ID NO: 854888 - RNA, 17 nt, Mycobacterium avium subsp. paratuberculosis
cggcgccccggcgcuga

SEQ ID NO: 854889 - RNA, 13 nt, Mycobacterium avium subsp. paratuberculosis
cggcgccccgggc

SEQ ID NO: 854890 - RNA, 18 nt, Mycobacterium avium subsp. paratuberculosis
cggcgccccgggcagcga

SEQ ID NO: 854891 - RNA, 19 nt, Mycobacterium avium subsp. paratuberculosis
cggcgccccgggcagcgaa

SEQ ID NO: 854892 - RNA, 15 nt, Mycobacterium avium subsp. paratuberculosis
cggcgcccccgcgac

SEQ ID NO: 854893 - RNA, 16 nt, Mycobacterium avium subsp. paratuberculosis
cggcgcccccgcgacg

SEQ ID NO: 854894 - RNA, 17 nt, Mycobacterium avium subsp. paratuberculosis
cggcgccccgcccgcga

SEQ ID NO: 854895 - RNA, 18 nt, Mycobacterium avium subsp. paratuberculosis
cggcgccccgcccgcgac

SEQ ID NO: 854896 - RNA, 12 nt, Mycobacterium avium subsp. paratuberculosis
cggcgccccggc

SEQ ID NO: 854897 - RNA, 13 nt, Mycobacterium avium subsp. paratuberculosis
cggcgccccacgc

SEQ ID NO: 854898 - RNA, 16 nt, Mycobacterium avium subsp. paratuberculosis
cggcgccccacgccug

SEQ ID NO: 854899 - RNA, 18 nt, Mycobacterium avium subsp. paratuberculosis
cggcgccccacgccuggc

SEQ ID NO: 854900 - RNA, 14 nt, Mycobacterium avium subsp. paratuberculosis
cggcgcccaggucc

SEQ ID NO: 854901 - RNA, 18 nt, Mycobacterium avium subsp. paratuberculosis
cggcgcccagguccacca

SEQ ID NO: 854902 - RNA, 22 nt, Mycobacterium avium subsp. paratuberculosis
cggcgcccagguccaccaggug

SEQ ID NO: 854903 - RNA, 15 nt, Mycobacterium avium subsp. paratuberculosis
cggaugugacgcggg

SEQ ID NO: 854904 - RNA, 18 nt, Mycobacterium avium subsp. paratuberculosis
cggaugugacgcgggacc

SEQ ID NO: 854905 - RNA, 15 nt, Mycobacterium avium subsp. paratuberculosis
cggaugucgggcgag

SEQ ID NO: 854906 - RNA, 15 nt, Mycobacterium avium subsp. paratuberculosis
cggauguggaggcga

SEQ ID NO: 854907 - RNA, 17 nt, Mycobacterium avium subsp. paratuberculosis
cggauguggaggcgagc

SEQ ID NO: 854908 - RNA, 18 nt, Mycobacterium avium subsp. paratuberculosis
cggauguggaggcgagca

SEQ ID NO: 854909 - RNA, 14 nt, Mycobacterium avium subsp. paratuberculosis
cggauguggucggc

SEQ ID NO: 854910 - RNA, 17 nt, Mycobacterium avium subsp. paratuberculosis
cggauguguugcgcacc

SEQ ID NO: 854911 - RNA, 21 nt, Mycobacterium avium subsp. paratuberculosis
cggaugucgugcggucgcacc

SEQ ID NO: 854912 - RNA, 22 nt, Mycobacterium avium subsp. paratuberculosis
cggauuaccgugacggcaucgg

SEQ ID NO: 854913 - RNA, 16 nt, Mycobacterium avium subsp. paratuberculosis
cggauuacucgccggc

SEQ ID NO: 854914 - RNA, 14 nt, Mycobacterium avium subsp. paratuberculosis
cggaugggugcggu

SEQ ID NO: 854915 - RNA, 22 nt, Mycobacterium avium subsp. paratuberculosis
cggauggcuguggaugacgcag

SEQ ID NO: 854916 - RNA, 15 nt, Mycobacterium avium subsp. paratuberculosis
cggauggucugcagc

SEQ ID NO: 854917 - RNA, 14 nt, Mycobacterium avium subsp. paratuberculosis
cggauggugcccac

SEQ ID NO: 854918 - RNA, 17 nt, Mycobacterium avium subsp. paratuberculosis
cggauggguggcgauca

SEQ ID NO: 854919 - RNA, 20 nt, Mycobacterium avium subsp. paratuberculosis
cggauggguggcgaucaccg

SEQ ID NO: 854920 - RNA, 19 nt, Mycobacterium avium subsp. paratuberculosis
cggauguccuacggcgggu

SEQ ID NO: 854921 - RNA, 13 nt, Mycobacterium avium subsp. paratuberculosis
cggaugcggcgcc

SEQ ID NO: 854922 - RNA, 16 nt, Mycobacterium avium subsp. paratuberculosis
cggaugcggcgcccac

SEQ ID NO: 854923 - RNA, 20 nt, Mycobacterium avium subsp. paratuberculosis
cggaugcggcucccaccgug

SEQ ID NO: 854924 - RNA, 13 nt, Mycobacterium avium subsp. paratuberculosis
cggaugcgggcgc

SEQ ID NO: 854925 - RNA, 14 nt, Mycobacterium avium subsp. paratuberculosis
cggaugcgggcgcu

SEQ ID NO: 854926 - RNA, 13 nt, Mycobacterium avium subsp. paratuberculosis
cggaugcggucga

SEQ ID NO: 854927 - RNA, 16 nt, Mycobacterium avium subsp. paratuberculosis
cggaugcggucgauga

SEQ ID NO: 854928 - RNA, 23 nt, Mycobacterium avium subsp. paratuberculosis
cggaugcucaccggucagcuggu

SEQ ID NO: 854929 - RNA, 21 nt, Mycobacterium avium subsp. paratuberculosis
cggaugcugaccaaggccgac

SEQ ID NO: 854930 - RNA, 16 nt, Mycobacterium avium subsp. paratuberculosis
cggaugcugcggguca

SEQ ID NO: 854931 - RNA, 16 nt, Mycobacterium avium subsp. paratuberculosis
cggauggagcgcgacg

SEQ ID NO: 854932 - RNA, 16 nt, Mycobacterium avium subsp. paratuberculosis
cggauggccccggcga

SEQ ID NO: 854933 - RNA, 20 nt, Mycobacterium avium subsp. paratuberculosis
cggauggccgggcaggccgg

SEQ ID NO: 854934 - RNA, 12 nt, Mycobacterium avium subsp. paratuberculosis
cggauggccucg

SEQ ID NO: 854935 - RNA, 13 nt, Mycobacterium avium subsp. paratuberculosis
cggauggcgcccg

SEQ ID NO: 854936 - RNA, 14 nt, Mycobacterium avium subsp. paratuberculosis
cggauggcgcccgg

SEQ ID NO: 854937 - RNA, 19 nt, Mycobacterium avium subsp. paratuberculosis
cggauggcgcccggcagcc

SEQ ID NO: 854938 - RNA, 20 nt, Mycobacterium avium subsp. paratuberculosis
cggauggcgcccggcagccg

SEQ ID NO: 854939 - RNA, 20 nt, Mycobacterium avium subsp. paratuberculosis
cggauggccucggcgaugcc

SEQ ID NO: 854940 - RNA, 21 nt, Mycobacterium avium subsp. paratuberculosis
cggauggccucggcgaugccg

SEQ ID NO: 854941 - RNA, 22 nt, Mycobacterium avium subsp. paratuberculosis
cggauggccucggcgaugccga

SEQ ID NO: 854942 - RNA, 15 nt, Mycobacterium avium subsp. paratuberculosis
cggauggccucggcg

SEQ ID NO: 854943 - RNA, 17 nt, Mycobacterium avium subsp. paratuberculosis
cggauggccucggcgau

SEQ ID NO: 854944 - RNA, 13 nt, Mycobacterium avium subsp. paratuberculosis
cggauggcgacgg

SEQ ID NO: 854945 - RNA, 17 nt, Mycobacterium avium subsp. paratuberculosis
cggauggcgacggcgac

SEQ ID NO: 854946 - RNA, 21 nt, Mycobacterium avium subsp. paratuberculosis
cggcaaagcguugccgcgcgc

SEQ ID NO: 854947 - RNA, 22 nt, Mycobacterium avium subsp. paratuberculosis
cggcaaagcguugccgcgcgcc

SEQ ID NO: 854948 - RNA, 23 nt, Mycobacterium avium subsp. paratuberculosis
cggcaaagcguugccgcgcgccc

SEQ ID NO: 854949 - RNA, 15 nt, Mycobacterium avium subsp. paratuberculosis
cggcaaaacgcuggg

SEQ ID NO: 854950 - RNA, 19 nt, Mycobacterium avium subsp. paratuberculosis
cggcaaaacgcugggcgcc

SEQ ID NO: 854951 - RNA, 20 nt, Mycobacterium avium subsp. paratuberculosis
cggcaaaacgcugggcgccg

SEQ ID NO: 854952 - RNA, 17 nt, Mycobacterium avium subsp. paratuberculosis
cggauuggugccgauca

SEQ ID NO: 854953 - RNA, 18 nt, Mycobacterium avium subsp. paratuberculosis
cggauuggugccgaucac

SEQ ID NO: 854954 - RNA, 17 nt, Mycobacterium avium subsp. paratuberculosis
cggauuucucagcggcg

SEQ ID NO: 854955 - RNA, 16 nt, Mycobacterium avium subsp. paratuberculosis
cggauucagcgucgcc

SEQ ID NO: 854956 - RNA, 17 nt, Mycobacterium avium subsp. paratuberculosis
cggauucagcgucgcca

SEQ ID NO: 854957 - RNA, 20 nt, Mycobacterium avium subsp. paratuberculosis
cggauucagcgucgccaugc

SEQ ID NO: 854958 - RNA, 21 nt, Mycobacterium avium subsp. paratuberculosis
cggauuccagcgcgaccgccc

SEQ ID NO: 854959 - RNA, 23 nt, Mycobacterium avium subsp. paratuberculosis
cggauuccagcgcguagucggcg

SEQ ID NO: 854960 - RNA, 14 nt, Mycobacterium avium subsp. paratuberculosis
cggauuccggcauc

SEQ ID NO: 854961 - RNA, 18 nt, Mycobacterium avium subsp. paratuberculosis
cggauucgcggcggcgcc

SEQ ID NO: 854962 - RNA, 19 nt, Mycobacterium avium subsp. paratuberculosis
cggauucgcggcggcgccg

SEQ ID NO: 854963 - RNA, 15 nt, Mycobacterium avium subsp. paratuberculosis
cggauucggguggcg

SEQ ID NO: 854964 - RNA, 23 nt, Mycobacterium avium subsp. paratuberculosis
cggauucgucaaugauggucagc

SEQ ID NO: 854965 - RNA, 16 nt, Mycobacterium avium subsp. paratuberculosis
cggauugaccagcacg

SEQ ID NO: 854966 - RNA, 21 nt, Mycobacterium avium subsp. paratuberculosis
cggauugaccagcacguugug

SEQ ID NO: 854967 - RNA, 16 nt, Mycobacterium avium subsp. paratuberculosis
cggauuggucagagcc

SEQ ID NO: 854968 - RNA, 20 nt, Mycobacterium avium subsp. paratuberculosis
cggauuggucagagcccgaa

SEQ ID NO: 854969 - RNA, 13 nt, Mycobacterium avium subsp. paratuberculosis
cggauugccgggc

SEQ ID NO: 854970 - RNA, 20 nt, Mycobacterium avium subsp. paratuberculosis
cggauugccgggcagcggcc

SEQ ID NO: 854971 - RNA, 14 nt, Mycobacterium avium subsp. paratuberculosis
cggauugcgagccg

SEQ ID NO: 854972 - RNA, 15 nt, Mycobacterium avium subsp. paratuberculosis
cggauugcgagccgg

SEQ ID NO: 854973 - RNA, 15 nt, Mycobacterium avium subsp. paratuberculosis
cggaucggcugcggg

SEQ ID NO: 854974 - RNA, 18 nt, Mycobacterium avium subsp. paratuberculosis
cggaucggcugcgggcca

SEQ ID NO: 854975 - RNA, 22 nt, Mycobacterium avium subsp. paratuberculosis
cggaucgggaccgggaagccga

SEQ ID NO: 854976 - RNA, 16 nt, Mycobacterium avium subsp. paratuberculosis
cggaucgggcggucca

SEQ ID NO: 854977 - RNA, 22 nt, Mycobacterium avium subsp. paratuberculosis
cggaucgggcgguccaccgacg

SEQ ID NO: 854978 - RNA, 15 nt, Mycobacterium avium subsp. paratuberculosis
cggaucgggcguggc

SEQ ID NO: 854979 - RNA, 22 nt, Mycobacterium avium subsp. paratuberculosis
cggaucggggcgaccuggacgc

SEQ ID NO: 854980 - RNA, 15 nt, Mycobacterium avium subsp. paratuberculosis
cggaucggugcaggc

SEQ ID NO: 854981 - RNA, 23 nt, Mycobacterium avium subsp. paratuberculosis
cggaucggugcaggccgcgacgg

SEQ ID NO: 854982 - RNA, 14 nt, Mycobacterium avium subsp. paratuberculosis
cggaucgguggacg

SEQ ID NO: 854983 - RNA, 21 nt, Mycobacterium avium subsp. paratuberculosis
cggaucgguguagcccggugc

SEQ ID NO: 854984 - RNA, 24 nt, Mycobacterium avium subsp. paratuberculosis
cggaucgguguagcccggugccac

SEQ ID NO: 854985 - RNA, 14 nt, Mycobacterium avium subsp. paratuberculosis
cggaucgucaccga

SEQ ID NO: 854986 - RNA, 15 nt, Mycobacterium avium subsp. paratuberculosis
cggaucgugucccgg

SEQ ID NO: 854987 - RNA, 17 nt, Mycobacterium avium subsp. paratuberculosis
cggaucgugucccggcg

SEQ ID NO: 854988 - RNA, 20 nt, Mycobacterium avium subsp. paratuberculosis
cggaucgugucccggcgccc

SEQ ID NO: 854989 - RNA, 18 nt, Mycobacterium avium subsp. paratuberculosis
cggaugaccaggucgccg

SEQ ID NO: 854990 - RNA, 19 nt, Mycobacterium avium subsp. paratuberculosis
cggaugaccaggucgccgg

SEQ ID NO: 854991 - RNA, 20 nt, Mycobacterium avium subsp. paratuberculosis
cggaugaccaggucgccggc

SEQ ID NO: 854992 - RNA, 23 nt, Mycobacterium avium subsp. paratuberculosis
cggaugaccaggucgccggcggc

SEQ ID NO: 854993 - RNA, 22 nt, Mycobacterium avium subsp. paratuberculosis
cggaugaaggacuggcccacgc

SEQ ID NO: 854994 - RNA, 16 nt, Mycobacterium avium subsp. paratuberculosis
cggaucuugccgucgg

SEQ ID NO: 854995 - RNA, 19 nt, Mycobacterium avium subsp. paratuberculosis
cggaucuugccgucggccg

SEQ ID NO: 854996 - RNA, 22 nt, Mycobacterium avium subsp. paratuberculosis
cggaucuugccgucggccgccg

SEQ ID NO: 854997 - RNA, 23 nt, Mycobacterium avium subsp. paratuberculosis
cggaucuugccgucggccgccga

SEQ ID NO: 854998 - RNA, 18 nt, Mycobacterium avium subsp. paratuberculosis
cggaucucggugccggug

SEQ ID NO: 854999 - RNA, 16 nt, Mycobacterium avium subsp. paratuberculosis
cggaucucgaccucgu

SEQ ID NO: 855000 - RNA, 22 nt, Mycobacterium avium subsp. paratuberculosis
cggaucucgaccucgucggcgg

SEQ ID NO: 855001 - RNA, 15 nt, Mycobacterium avium subsp. paratuberculosis
cggaucucgcgcagg

SEQ ID NO: 855002 - RNA, 18 nt, Mycobacterium avium subsp. paratuberculosis
cggaucucgcgcaggucc

SEQ ID NO: 855003 - RNA, 13 nt, Mycobacterium avium subsp. paratuberculosis
cggaucucgucgg

SEQ ID NO: 855004 - RNA, 17 nt, Mycobacterium avium subsp. paratuberculosis
cggaucucgucgggcac

SEQ ID NO: 855005 - RNA, 19 nt, Mycobacterium avium subsp. paratuberculosis
cggaucucgucgggcaccg

SEQ ID NO: 855006 - RNA, 22 nt, Mycobacterium avium subsp. paratuberculosis
cggaucugcgucugugguggcg

SEQ ID NO: 855007 - RNA, 21 nt, Mycobacterium avium subsp. paratuberculosis
cggaugcacgugcaccgcggc

SEQ ID NO: 855008 - RNA, 23 nt, Mycobacterium avium subsp. paratuberculosis
cggaugcacgugcaccgcggcca

SEQ ID NO: 855009 - RNA, 17 nt, Mycobacterium avium subsp. paratuberculosis
cggaugccgcgcggcgc

SEQ ID NO: 855010 - RNA, 14 nt, Mycobacterium avium subsp. paratuberculosis
cggaugccggcgcc

SEQ ID NO: 855011 - RNA, 18 nt, Mycobacterium avium subsp. paratuberculosis
cggaugccggcgcccagc

SEQ ID NO: 855012 - RNA, 22 nt, Mycobacterium avium subsp. paratuberculosis
cggaugccggcgcccagcggcg

SEQ ID NO: 855013 - RNA, 17 nt, Mycobacterium avium subsp. paratuberculosis
cggaugccggggcagca

SEQ ID NO: 855014 - RNA, 19 nt, Mycobacterium avium subsp. paratuberculosis
cggaugccggggcagcacc

SEQ ID NO: 855015 - RNA, 17 nt, Mycobacterium avium subsp. paratuberculosis
cggaugcaccggcagcc

SEQ ID NO: 855016 - RNA, 13 nt, Mycobacterium avium subsp. paratuberculosis
cggaugcccgccg

SEQ ID NO: 855017 - RNA, 16 nt, Mycobacterium avium subsp. paratuberculosis
cggaugcccgccggcg

SEQ ID NO: 855018 - RNA, 19 nt, Mycobacterium avium subsp. paratuberculosis
cggaugcccgccggcgucu

SEQ ID NO: 855019 - RNA, 21 nt, Mycobacterium avium subsp. paratuberculosis
cggaugauguucuccggcccg

SEQ ID NO: 855020 - RNA, 15 nt, Mycobacterium avium subsp. paratuberculosis
cggaugcccaggccg

SEQ ID NO: 855021 - RNA, 19 nt, Mycobacterium avium subsp. paratuberculosis
cggaugcccaggccggcga

SEQ ID NO: 855022 - RNA, 16 nt, Mycobacterium avium subsp. paratuberculosis
cggaugccccuugacg

SEQ ID NO: 855023 - RNA, 18 nt, Mycobacterium avium subsp. paratuberculosis
cggaugccccuugacggu

SEQ ID NO: 855024 - RNA, 14 nt, Mycobacterium avium subsp. paratuberculosis
cggauccagcaccg

SEQ ID NO: 855025 - RNA, 16 nt, Mycobacterium avium subsp. paratuberculosis
cggauccagcaccgcc

SEQ ID NO: 855026 - RNA, 19 nt, Mycobacterium avium subsp. paratuberculosis
cggaucaugcgcgucaugg

SEQ ID NO: 855027 - RNA, 23 nt, Mycobacterium avium subsp. paratuberculosis
cggauccagguggggcacgggcg

SEQ ID NO: 855028 - RNA, 18 nt, Mycobacterium avium subsp. paratuberculosis
cggauccccgcgcugggc

SEQ ID NO: 855029 - RNA, 20 nt, Mycobacterium avium subsp. paratuberculosis
cggauccccgcgcugggcug

SEQ ID NO: 855030 - RNA, 18 nt, Mycobacterium avium subsp. paratuberculosis
cggaucccggggcgcgcu

SEQ ID NO: 855031 - RNA, 14 nt, Mycobacterium avium subsp. paratuberculosis
cggauccgggccgc

SEQ ID NO: 855032 - RNA, 19 nt, Mycobacterium avium subsp. paratuberculosis
cggauccgggccgccuucu

SEQ ID NO: 855033 - RNA, 20 nt, Mycobacterium avium subsp. paratuberculosis
cggauccgggccggcgucgc

SEQ ID NO: 855034 - RNA, 23 nt, Mycobacterium avium subsp. paratuberculosis
cggauccgggccggcgucgcggu

SEQ ID NO: 855035 - RNA, 16 nt, Mycobacterium avium subsp. paratuberculosis
cggauccgggcgccgg

SEQ ID NO: 855036 - RNA, 20 nt, Mycobacterium avium subsp. paratuberculosis
cggauccaccaauucgcgcu

SEQ ID NO: 855037 - RNA, 22 nt, Mycobacterium avium subsp. paratuberculosis
cggaucgagguagcgugcgccc

SEQ ID NO: 855038 - RNA, 17 nt, Mycobacterium avium subsp. paratuberculosis
cggaucgagucccgcgc

SEQ ID NO: 855039 - RNA, 18 nt, Mycobacterium avium subsp. paratuberculosis
cggaucgagucccgcgcg

SEQ ID NO: 855040 - RNA, 21 nt, Mycobacterium avium subsp. paratuberculosis
cggaucgagucccgcgcggcg

SEQ ID NO: 855041 - RNA, 22 nt, Mycobacterium avium subsp. paratuberculosis
cggaucgaguucagcgucgaug

SEQ ID NO: 855042 - RNA, 22 nt, Mycobacterium avium subsp. paratuberculosis
cggaucgaacuugaucaccgcg

SEQ ID NO: 855043 - RNA, 22 nt, Mycobacterium avium subsp. paratuberculosis
cggaucgaauccggcggcgcuc

SEQ ID NO: 855044 - RNA, 23 nt, Mycobacterium avium subsp. paratuberculosis
cggaucgaauccggcggcgcuca

SEQ ID NO: 855045 - RNA, 14 nt, Mycobacterium avium subsp. paratuberculosis
cggaucgaacaggg

SEQ ID NO: 855046 - RNA, 16 nt, Mycobacterium avium subsp. paratuberculosis
cggaucgaacagggcg

SEQ ID NO: 855047 - RNA, 18 nt, Mycobacterium avium subsp. paratuberculosis
cggaucgaacagggcggc

SEQ ID NO: 855048 - RNA, 20 nt, Mycobacterium avium subsp. paratuberculosis
cggaucgaacagggcggcgg

SEQ ID NO: 855049 - RNA, 13 nt, Mycobacterium avium subsp. paratuberculosis
cggauccgucgcc

SEQ ID NO: 855050 - RNA, 15 nt, Mycobacterium avium subsp. paratuberculosis
cggauccgucgcccc

SEQ ID NO: 855051 - RNA, 20 nt, Mycobacterium avium subsp. paratuberculosis
cggauccgucgccccgcacc

SEQ ID NO: 855052 - RNA, 12 nt, Mycobacterium avium subsp. paratuberculosis
cggauccgcagc

SEQ ID NO: 855053 - RNA, 20 nt, Mycobacterium avium subsp. paratuberculosis
cggaucgaaaaggucgaaca

SEQ ID NO: 855054 - RNA, 18 nt, Mycobacterium avium subsp. paratuberculosis
cggaucgcaucgggcgac

SEQ ID NO: 855055 - RNA, 23 nt, Mycobacterium avium subsp. paratuberculosis
cggaucgcgggcgacccgcugga

SEQ ID NO: 855056 - RNA, 14 nt, Mycobacterium avium subsp. paratuberculosis
cggaucgcccaccc

SEQ ID NO: 855057 - RNA, 18 nt, Mycobacterium avium subsp. paratuberculosis
cggaucgcccacccgcac

SEQ ID NO: 855058 - RNA, 19 nt, Mycobacterium avium subsp. paratuberculosis
cggaucgcccacccgcacg

SEQ ID NO: 855059 - RNA, 12 nt, Mycobacterium avium subsp. paratuberculosis
cggaucgagcgc

SEQ ID NO: 855060 - RNA, 15 nt, Mycobacterium avium subsp. paratuberculosis
cggaucgagcgcacc

SEQ ID NO: 855061 - RNA, 16 nt, Mycobacterium avium subsp. paratuberculosis
cggaucgagcgcaccg

SEQ ID NO: 855062 - RNA, 19 nt, Mycobacterium avium subsp. paratuberculosis
cggaucgagcgcaccgccc

SEQ ID NO: 855063 - RNA, 18 nt, Mycobacterium avium subsp. paratuberculosis
cggaucgagcacccggcg

SEQ ID NO: 855064 - RNA, 19 nt, Mycobacterium avium subsp. paratuberculosis
cggaucgagcacccggcgg

SEQ ID NO: 855065 - RNA, 16 nt, Mycobacterium avium subsp. paratuberculosis
cggaucggcggcgacg

SEQ ID NO: 855066 - RNA, 18 nt, Mycobacterium avium subsp. paratuberculosis
cggaucggcggcgacggc

SEQ ID NO: 855067 - RNA, 17 nt, Mycobacterium avium subsp. paratuberculosis
cggaucgccgagguagc

SEQ ID NO: 855068 - RNA, 16 nt, Mycobacterium avium subsp. paratuberculosis
cggaucggccagcagg

SEQ ID NO: 855069 - RNA, 22 nt, Mycobacterium avium subsp. paratuberculosis
cggaucggccagcaggucgaag

SEQ ID NO: 855070 - RNA, 22 nt, Mycobacterium avium subsp. paratuberculosis
cggaucggccauggugccgccg

SEQ ID NO: 855071 - RNA, 14 nt, Mycobacterium avium subsp. paratuberculosis
cggaucggcccccg

SEQ ID NO: 855072 - RNA, 20 nt, Mycobacterium avium subsp. paratuberculosis
cggaucggcccgaucucgcg

SEQ ID NO: 855073 - RNA, 12 nt, Mycobacterium avium subsp. paratuberculosis
cggaucggccgc

SEQ ID NO: 855074 - RNA, 13 nt, Mycobacterium avium subsp. paratuberculosis
cggaucggccgcg

SEQ ID NO: 855075 - RNA, 17 nt, Mycobacterium avium subsp. paratuberculosis
cggaucggccgcgucgg

SEQ ID NO: 855076 - RNA, 19 nt, Mycobacterium avium subsp. paratuberculosis
cggaucgcguaguccagca

SEQ ID NO: 855077 - RNA, 21 nt, Mycobacterium avium subsp. paratuberculosis
cggaucgcguaguccagcacg

SEQ ID NO: 855078 - RNA, 22 nt, Mycobacterium avium subsp. paratuberculosis
cggaucgcguaguccagcacgg

SEQ ID NO: 855079 - RNA, 12 nt, Mycobacterium avium subsp. paratuberculosis
cggaucgcgugc

SEQ ID NO: 855080 - RNA, 14 nt, Mycobacterium avium subsp. paratuberculosis
cggaucgcuugacc

SEQ ID NO: 855081 - RNA, 18 nt, Mycobacterium avium subsp. paratuberculosis
cggaucgcuugaccagca

SEQ ID NO: 855082 - RNA, 19 nt, Mycobacterium avium subsp. paratuberculosis
cggaucgcuugaccagcaa

SEQ ID NO: 855083 - RNA, 16 nt, Mycobacterium avium subsp. paratuberculosis
cggcaacucccgaucg

SEQ ID NO: 855084 - RNA, 17 nt, Mycobacterium avium subsp. paratuberculosis
cggcaacucccgaucgc

SEQ ID NO: 855085 - RNA, 20 nt, Mycobacterium avium subsp. paratuberculosis
cggcaacggcggcggcggca

SEQ ID NO: 855086 - RNA, 16 nt, Mycobacterium avium subsp. paratuberculosis
cggcaacgccgggucc

SEQ ID NO: 855087 - RNA, 16 nt, Mycobacterium avium subsp. paratuberculosis
cggcaacgccagccag

SEQ ID NO: 855088 - RNA, 14 nt, Mycobacterium avium subsp. paratuberculosis
cggcaaccugggcg

SEQ ID NO: 855089 - RNA, 23 nt, Mycobacterium avium subsp. paratuberculosis
cggcaacgaggccagggcccgca

SEQ ID NO: 855090 - RNA, 20 nt, Mycobacterium avium subsp. paratuberculosis
cggcaaccagcuccggcaac

SEQ ID NO: 855091 - RNA, 23 nt, Mycobacterium avium subsp. paratuberculosis
cggcaacccgaccucgucgacgg

SEQ ID NO: 855092 - RNA, 15 nt, Mycobacterium avium subsp. paratuberculosis
cggcaacccgaucgc

SEQ ID NO: 855093 - RNA, 18 nt, Mycobacterium avium subsp. paratuberculosis
cggcaacccgaucgccga

SEQ ID NO: 855094 - RNA, 12 nt, Mycobacterium avium subsp. paratuberculosis
cggcaaccgcca

SEQ ID NO: 855095 - RNA, 13 nt, Mycobacterium avium subsp. paratuberculosis
cggcaaccgccac

SEQ ID NO: 855096 - RNA, 20 nt, Mycobacterium avium subsp. paratuberculosis
cggcaaccgccacgacgcgg

SEQ ID NO: 855097 - RNA, 18 nt, Mycobacterium avium subsp. paratuberculosis
cggcaacaacgccagcgu

SEQ ID NO: 855098 - RNA, 20 nt, Mycobacterium avium subsp. paratuberculosis
cggcaacaacgccagcguga

SEQ ID NO: 855099 - RNA, 14 nt, Mycobacterium avium subsp. paratuberculosis
cggcaacacgccgg

SEQ ID NO: 855100 - RNA, 15 nt, Mycobacterium avium subsp. paratuberculosis
cggcaacacgccggc

SEQ ID NO: 855101 - RNA, 17 nt, Mycobacterium avium subsp. paratuberculosis
cggcaacacgccggcgg

SEQ ID NO: 855102 - RNA, 23 nt, Mycobacterium avium subsp. paratuberculosis
cggcaacacguagucgccgaugg

SEQ ID NO: 855103 - RNA, 16 nt, Mycobacterium avium subsp. paratuberculosis
cggcaacagcaccagc

SEQ ID NO: 855104 - RNA, 17 nt, Mycobacterium avium subsp. paratuberculosis
cggcaacagcaccagca

SEQ ID NO: 855105 - RNA, 18 nt, Mycobacterium avium subsp. paratuberculosis
cggcaacagcaccagcac

SEQ ID NO: 855106 - RNA, 22 nt, Mycobacterium avium subsp. paratuberculosis
cggcaaucgggacgccacggcg

SEQ ID NO: 855107 - RNA, 15 nt, Mycobacterium avium subsp. paratuberculosis
cggcaauccggcccc

SEQ ID NO: 855108 - RNA, 16 nt, Mycobacterium avium subsp. paratuberculosis
cggcaaugaccggcac

SEQ ID NO: 855109 - RNA, 17 nt, Mycobacterium avium subsp. paratuberculosis
cggcaaugaccggcacc

SEQ ID NO: 855110 - RNA, 18 nt, Mycobacterium avium subsp. paratuberculosis
cggcaaugaccggcacca

SEQ ID NO: 855111 - RNA, 19 nt, Mycobacterium avium subsp. paratuberculosis
cggcaauugaauucgacca

SEQ ID NO: 855112 - RNA, 21 nt, Mycobacterium avium subsp. paratuberculosis
cggcaauugaauucgaccacg

SEQ ID NO: 855113 - RNA, 22 nt, Mycobacterium avium subsp. paratuberculosis
cggcacaggcgaaucggcgcac

SEQ ID NO: 855114 - RNA, 13 nt, Mycobacterium avium subsp. paratuberculosis
cggcacaccagcg

SEQ ID NO: 855115 - RNA, 22 nt, Mycobacterium avium subsp. paratuberculosis
cggcacaccagcguucgucgcc

SEQ ID NO: 855116 - RNA, 24 nt, Mycobacterium avium subsp. paratuberculosis
cggcacaccagcguucgucgccgg

SEQ ID NO: 855117 - RNA, 22 nt, Mycobacterium avium subsp. paratuberculosis
cggcacaccagguaggcggugg

SEQ ID NO: 855118 - RNA, 13 nt, Mycobacterium avium subsp. paratuberculosis
cggcacaccgagc

SEQ ID NO: 855119 - RNA, 13 nt, Mycobacterium avium subsp. paratuberculosis
cggcaccaacccg

SEQ ID NO: 855120 - RNA, 15 nt, Mycobacterium avium subsp. paratuberculosis
cggcaccaacccgau

SEQ ID NO: 855121 - RNA, 22 nt, Mycobacterium avium subsp. paratuberculosis
cggcaccaacccgaucggcccg

SEQ ID NO: 855122 - RNA, 12 nt, Mycobacterium avium subsp. paratuberculosis
cggcaccaccac

SEQ ID NO: 855123 - RNA, 13 nt, Mycobacterium avium subsp. paratuberculosis
cggcaccaccagc

SEQ ID NO: 855124 - RNA, 20 nt, Mycobacterium avium subsp. paratuberculosis
cggcaccaccagcguguggc

SEQ ID NO: 855125 - RNA, 19 nt, Mycobacterium avium subsp. paratuberculosis
cggcaccacccgcggccgg

SEQ ID NO: 855126 - RNA, 15 nt, Mycobacterium avium subsp. paratuberculosis
cggcaccacgaucac

SEQ ID NO: 855127 - RNA, 23 nt, Mycobacterium avium subsp. paratuberculosis
cggcaccacgaucaccagaccgg

SEQ ID NO: 855128 - RNA, 13 nt, Mycobacterium avium subsp. paratuberculosis
cggcaccagcagc

SEQ ID NO: 855129 - RNA, 14 nt, Mycobacterium avium subsp. paratuberculosis
cggcaccagcagcc

SEQ ID NO: 855130 - RNA, 20 nt, Mycobacterium avium subsp. paratuberculosis
cggcaccagcagccagccca

SEQ ID NO: 855131 - RNA, 24 nt, Mycobacterium avium subsp. paratuberculosis
cggcaccagcagccagcccagccg

SEQ ID NO: 855132 - RNA, 19 nt, Mycobacterium avium subsp. paratuberculosis
cggcaccagcagccgcagc

SEQ ID NO: 855133 - RNA, 20 nt, Mycobacterium avium subsp. paratuberculosis
cggcaccagcagccgcagcg

SEQ ID NO: 855134 - RNA, 19 nt, Mycobacterium avium subsp. paratuberculosis
cggcaccagcaggccccgu

SEQ ID NO: 855135 - RNA, 23 nt, Mycobacterium avium subsp. paratuberculosis
cggcaccagcaggccccguucgg

SEQ ID NO: 855136 - RNA, 13 nt, Mycobacterium avium subsp. paratuberculosis
cggcaccacgcug

SEQ ID NO: 855137 - RNA, 19 nt, Mycobacterium avium subsp. paratuberculosis
cggcaccacgcugugcucg

SEQ ID NO: 855138 - RNA, 23 nt, Mycobacterium avium subsp. paratuberculosis
cggcaccacgcugugcucgacga

SEQ ID NO: 855139 - RNA, 16 nt, Mycobacterium avium subsp. paratuberculosis
cggcaccagagcgccg

SEQ ID NO: 855140 - RNA, 13 nt, Mycobacterium avium subsp. paratuberculosis
cggcaccagcccg

SEQ ID NO: 855141 - RNA, 14 nt, Mycobacterium avium subsp. paratuberculosis
cggcaccagcccgc

SEQ ID NO: 855142 - RNA, 16 nt, Mycobacterium avium subsp. paratuberculosis
cggcaccagcccgccg

SEQ ID NO: 855143 - RNA, 21 nt, Mycobacterium avium subsp. paratuberculosis
cggcaccagcccgccgucggc

SEQ ID NO: 855144 - RNA, 13 nt, Mycobacterium avium subsp. paratuberculosis
cggcaccagcgga

SEQ ID NO: 855145 - RNA, 14 nt, Mycobacterium avium subsp. paratuberculosis
cggcaccagcggau

SEQ ID NO: 855146 - RNA, 21 nt, Mycobacterium avium subsp. paratuberculosis
cggcaccagcggaucggcggu

SEQ ID NO: 855147 - RNA, 16 nt, Mycobacterium avium subsp. paratuberculosis
cggcaccgugccgcgc

SEQ ID NO: 855148 - RNA, 18 nt, Mycobacterium avium subsp. paratuberculosis
cggcaccgugccgcgcgg

SEQ ID NO: 855149 - RNA, 20 nt, Mycobacterium avium subsp. paratuberculosis
cggcaccgugccgcgcggcg

SEQ ID NO: 855150 - RNA, 21 nt, Mycobacterium avium subsp. paratuberculosis
cggcaccgugccgcgcggcgg

SEQ ID NO: 855151 - RNA, 22 nt, Mycobacterium avium subsp. paratuberculosis
cggcaccgugccgcgcggcggu

SEQ ID NO: 855152 - RNA, 24 nt, Mycobacterium avium subsp. paratuberculosis
cggcaccgugccgcgcggcgguga

SEQ ID NO: 855153 - RNA, 16 nt, Mycobacterium avium subsp. paratuberculosis
cggcaccuccugcacc

SEQ ID NO: 855154 - RNA, 22 nt, Mycobacterium avium subsp. paratuberculosis
cggcaccuccugcacccguccg

SEQ ID NO: 855155 - RNA, 23 nt, Mycobacterium avium subsp. paratuberculosis
cggcaccuccugcacccguccga

SEQ ID NO: 855156 - RNA, 11 nt, Mycobacterium avium subsp. paratuberculosis
cggcaccucga

SEQ ID NO: 855157 - RNA, 19 nt, Mycobacterium avium subsp. paratuberculosis
cggcaccucgaagggcgcc

SEQ ID NO: 855158 - RNA, 20 nt, Mycobacterium avium subsp. paratuberculosis
cggcaccucgaagggcgcca

SEQ ID NO: 855159 - RNA, 16 nt, Mycobacterium avium subsp. paratuberculosis
cggcaccucgaucacc

SEQ ID NO: 855160 - RNA, 17 nt, Mycobacterium avium subsp. paratuberculosis
cggcaccucgaucaccg

SEQ ID NO: 855161 - RNA, 18 nt, Mycobacterium avium subsp. paratuberculosis
cggcaccucgaucaccgg

SEQ ID NO: 855162 - RNA, 20 nt, Mycobacterium avium subsp. paratuberculosis
cggcaccucgaucaccgggc

SEQ ID NO: 855163 - RNA, 21 nt, Mycobacterium avium subsp. paratuberculosis
cggcaccucgaucaccgggcg

SEQ ID NO: 855164 - RNA, 23 nt, Mycobacterium avium subsp. paratuberculosis
aacagguaggcggcgccgucgac

SEQ ID NO: 855165 - RNA, 17 nt, Mycobacterium avium subsp. paratuberculosis
cggcaccgcggcgauga

SEQ ID NO: 855166 - RNA, 16 nt, Mycobacterium avium subsp. paratuberculosis
cggcaccgcggcggug

SEQ ID NO: 855167 - RNA, 18 nt, Mycobacterium avium subsp. paratuberculosis
cggcaccgcggcgguguc

SEQ ID NO: 855168 - RNA, 20 nt, Mycobacterium avium subsp. paratuberculosis
cggcaccgcggcggugucgg

SEQ ID NO: 855169 - RNA, 16 nt, Mycobacterium avium subsp. paratuberculosis
cggcaccgcggcucgg

SEQ ID NO: 855170 - RNA, 17 nt, Mycobacterium avium subsp. paratuberculosis
cggcaccgcggcucggu

SEQ ID NO: 855171 - RNA, 21 nt, Mycobacterium avium subsp. paratuberculosis
cggcaccgcggucugcgccag

SEQ ID NO: 855172 - RNA, 13 nt, Mycobacterium avium subsp. paratuberculosis
cggcaccgcgagc

SEQ ID NO: 855173 - RNA, 15 nt, Mycobacterium avium subsp. paratuberculosis
cggcaccgcgagcac

SEQ ID NO: 855174 - RNA, 15 nt, Mycobacterium avium subsp. paratuberculosis
cggcaccgcugccgg

SEQ ID NO: 855175 - RNA, 18 nt, Mycobacterium avium subsp. paratuberculosis
cggcaccgcugccggccg

SEQ ID NO: 855176 - RNA, 19 nt, Mycobacterium avium subsp. paratuberculosis
cggcaccgcugccggccga

SEQ ID NO: 855177 - RNA, 18 nt, Mycobacterium avium subsp. paratuberculosis
cggcaccggugcggcggu

SEQ ID NO: 855178 - RNA, 20 nt, Mycobacterium avium subsp. paratuberculosis
cggcaccggugcggcgguga

SEQ ID NO: 855179 - RNA, 22 nt, Mycobacterium avium subsp. paratuberculosis
cggcaccggugcggcggugacg

SEQ ID NO: 855180 - RNA, 23 nt, Mycobacterium avium subsp. paratuberculosis
cggcaccggugcggcggugacga

SEQ ID NO: 855181 - RNA, 19 nt, Mycobacterium avium subsp. paratuberculosis
cggcaccgucaccgacggc

SEQ ID NO: 855182 - RNA, 15 nt, Mycobacterium avium subsp. paratuberculosis
cggcaccguccggcg

SEQ ID NO: 855183 - RNA, 20 nt, Mycobacterium avium subsp. paratuberculosis
cggcacccaggucaccgagg

SEQ ID NO: 855184 - RNA, 20 nt, Mycobacterium avium subsp. paratuberculosis
cggcacccccaauugccggg

SEQ ID NO: 855185 - RNA, 22 nt, Mycobacterium avium subsp. paratuberculosis
cggcacccccaauugccgggcc

SEQ ID NO: 855186 - RNA, 21 nt, Mycobacterium avium subsp. paratuberculosis
cggcaccagucgcgcagcguc

SEQ ID NO: 855187 - RNA, 23 nt, Mycobacterium avium subsp. paratuberculosis
cggcaccagcggcaucgccgcca

SEQ ID NO: 855188 - RNA, 12 nt, Mycobacterium avium subsp. paratuberculosis
cggcaccaggua

SEQ ID NO: 855189 - RNA, 19 nt, Mycobacterium avium subsp. paratuberculosis
cggcaccagguaccggcgg

SEQ ID NO: 855190 - RNA, 23 nt, Mycobacterium avium subsp. paratuberculosis
cggcaccagguaccggcgggcga

SEQ ID NO: 855191 - RNA, 17 nt, Mycobacterium avium subsp. paratuberculosis
cggcaccagguucacgu

SEQ ID NO: 855192 - RNA, 17 nt, Mycobacterium avium subsp. paratuberculosis
cggcaccgccggcggcc

SEQ ID NO: 855193 - RNA, 18 nt, Mycobacterium avium subsp. paratuberculosis
cggcaccgccggcggccu

SEQ ID NO: 855194 - RNA, 12 nt, Mycobacterium avium subsp. paratuberculosis
cggcaccgccgc

SEQ ID NO: 855195 - RNA, 13 nt, Mycobacterium avium subsp. paratuberculosis
cggcaccgccgcg

SEQ ID NO: 855196 - RNA, 16 nt, Mycobacterium avium subsp. paratuberculosis
cggcaccgccgcgcgg

SEQ ID NO: 855197 - RNA, 17 nt, Mycobacterium avium subsp. paratuberculosis
cggcaccgccgcggugg

SEQ ID NO: 855198 - RNA, 20 nt, Mycobacterium avium subsp. paratuberculosis
cggcaccgcccccgcggcgg

SEQ ID NO: 855199 - RNA, 23 nt, Mycobacterium avium subsp. paratuberculosis
cggcaccgcccccgcggcggcca

SEQ ID NO: 855200 - RNA, 12 nt, Mycobacterium avium subsp. paratuberculosis
cggcaccgcccg

SEQ ID NO: 855201 - RNA, 15 nt, Mycobacterium avium subsp. paratuberculosis
cgcugacgaugcggc

SEQ ID NO: 855202 - RNA, 15 nt, Mycobacterium avium subsp. paratuberculosis
cgcugacgccgagca

SEQ ID NO: 855203 - RNA, 15 nt, Mycobacterium avium subsp. paratuberculosis
cgcugaccguggugu

SEQ ID NO: 855204 - RNA, 18 nt, Mycobacterium avium subsp. paratuberculosis
cgcugaccguggugucgg

SEQ ID NO: 855205 - RNA, 14 nt, Mycobacterium avium subsp. paratuberculosis
cgcugaccgcagga

SEQ ID NO: 855206 - RNA, 19 nt, Mycobacterium avium subsp. paratuberculosis
cgcugaccgccgcgcucgg

SEQ ID NO: 855207 - RNA, 15 nt, Mycobacterium avium subsp. paratuberculosis
cgcugagcaaccgcc

SEQ ID NO: 855208 - RNA, 16 nt, Mycobacterium avium subsp. paratuberculosis
cgcugagcaaccgccg

SEQ ID NO: 855209 - RNA, 17 nt, Mycobacterium avium subsp. paratuberculosis
cgcugagcaaccgccga

SEQ ID NO: 855210 - RNA, 20 nt, Mycobacterium avium subsp. paratuberculosis
cgcugagcaauucggugacg

SEQ ID NO: 855211 - RNA, 17 nt, Mycobacterium avium subsp. paratuberculosis
cgcugagcacccgcccg

SEQ ID NO: 855212 - RNA, 18 nt, Mycobacterium avium subsp. paratuberculosis
cgcugagcacccgcccgg

SEQ ID NO: 855213 - RNA, 22 nt, Mycobacterium avium subsp. paratuberculosis
cgcugagcacccgcccggacgc

SEQ ID NO: 855214 - RNA, 21 nt, Mycobacterium avium subsp. paratuberculosis
cgcugagcacggugggcgccg

SEQ ID NO: 855215 - RNA, 22 nt, Mycobacterium avium subsp. paratuberculosis
cgcugagcacggugggcgccgg

SEQ ID NO: 855216 - RNA, 22 nt, Mycobacterium avium subsp. paratuberculosis
cgcugacuccaucccgugcgga

SEQ ID NO: 855217 - RNA, 16 nt, Mycobacterium avium subsp. paratuberculosis
cgcugacugcgaucgc

SEQ ID NO: 855218 - RNA, 20 nt, Mycobacterium avium subsp. paratuberculosis
cgcugacugcgaucgccgac

SEQ ID NO: 855219 - RNA, 15 nt, Mycobacterium avium subsp. paratuberculosis
cgcugacggucgccg

SEQ ID NO: 855220 - RNA, 14 nt, Mycobacterium avium subsp. paratuberculosis
cgcugacgucgaug

SEQ ID NO: 855221 - RNA, 23 nt, Mycobacterium avium subsp. paratuberculosis
cgcugacgucgaugccggccagc

SEQ ID NO: 855222 - RNA, 14 nt, Mycobacterium avium subsp. paratuberculosis
cgcugacgcggcgg

SEQ ID NO: 855223 - RNA, 21 nt, Mycobacterium avium subsp. paratuberculosis
cggaccaccgcgugcgagccg

SEQ ID NO: 855224 - RNA, 22 nt, Mycobacterium avium subsp. paratuberculosis
cggaccaccgcgugcgagccga

SEQ ID NO: 855225 - RNA, 15 nt, Mycobacterium avium subsp. paratuberculosis
cggacauaggcgucg

SEQ ID NO: 855226 - RNA, 17 nt, Mycobacterium avium subsp. paratuberculosis
cggacauaggcgucgcg

SEQ ID NO: 855227 - RNA, 24 nt, Mycobacterium avium subsp. paratuberculosis
cggacauaggcgucgcggucggcg

SEQ ID NO: 855228 - RNA, 20 nt, Mycobacterium avium subsp. paratuberculosis
cggacauccauugggccgcg

SEQ ID NO: 855229 - RNA, 22 nt, Mycobacterium avium subsp. paratuberculosis
cggacauccauugggccgcggc

SEQ ID NO: 855230 - RNA, 23 nt, Mycobacterium avium subsp. paratuberculosis
cggacauccauugggccgcggcg

SEQ ID NO: 855231 - RNA, 22 nt, Mycobacterium avium subsp. paratuberculosis
cggacaucucccgcacccguuc

SEQ ID NO: 855232 - RNA, 15 nt, Mycobacterium avium subsp. paratuberculosis
cggacaugccggcgc

SEQ ID NO: 855233 - RNA, 23 nt, Mycobacterium avium subsp. paratuberculosis
cgcugagcggguaaccgcagccg

SEQ ID NO: 855234 - RNA, 20 nt, Mycobacterium avium subsp. paratuberculosis
cgcugagcuucugcccggcc

SEQ ID NO: 855235 - RNA, 18 nt, Mycobacterium avium subsp. paratuberculosis
cgcugagccgcucgucga

SEQ ID NO: 855236 - RNA, 22 nt, Mycobacterium avium subsp. paratuberculosis
cgcugagccgcucgucgagucc

SEQ ID NO: 855237 - RNA, 16 nt, Mycobacterium avium subsp. paratuberculosis
cgcugagcgacauggu

SEQ ID NO: 855238 - RNA, 19 nt, Mycobacterium avium subsp. paratuberculosis
cgcugagcgacauggucgg

SEQ ID NO: 855239 - RNA, 20 nt, Mycobacterium avium subsp. paratuberculosis
cggacagguggccgaucagc

SEQ ID NO: 855240 - RNA, 21 nt, Mycobacterium avium subsp. paratuberculosis
cggacaggugugggcguacgg

SEQ ID NO: 855241 - RNA, 16 nt, Mycobacterium avium subsp. paratuberculosis
cggacagggcggcgac

SEQ ID NO: 855242 - RNA, 18 nt, Mycobacterium avium subsp. paratuberculosis
cggacagggcggcgaccu

SEQ ID NO: 855243 - RNA, 14 nt, Mycobacterium avium subsp. paratuberculosis
cggaccgggcgggc

SEQ ID NO: 855244 - RNA, 16 nt, Mycobacterium avium subsp. paratuberculosis
cggaccgggcgggcug

SEQ ID NO: 855245 - RNA, 16 nt, Mycobacterium avium subsp. paratuberculosis
cggaccgcaccaccac

SEQ ID NO: 855246 - RNA, 16 nt, Mycobacterium avium subsp. paratuberculosis
cggaccgcgcgggcca

SEQ ID NO: 855247 - RNA, 17 nt, Mycobacterium avium subsp. paratuberculosis
cggaccgcgcgggccag

SEQ ID NO: 855248 - RNA, 18 nt, Mycobacterium avium subsp. paratuberculosis
cggaccgcgcgggccagc

SEQ ID NO: 855249 - RNA, 19 nt, Mycobacterium avium subsp. paratuberculosis
cggaccgcgcgggccagcg

SEQ ID NO: 855250 - RNA, 14 nt, Mycobacterium avium subsp. paratuberculosis
cggaccgcggucgg

SEQ ID NO: 855251 - RNA, 18 nt, Mycobacterium avium subsp. paratuberculosis
cggaccgcggucgggucc

SEQ ID NO: 855252 - RNA, 22 nt, Mycobacterium avium subsp. paratuberculosis
cggaccgcggucgggucccggc

SEQ ID NO: 855253 - RNA, 21 nt, Mycobacterium avium subsp. paratuberculosis
cggaccgcuugacgccgccga

SEQ ID NO: 855254 - RNA, 15 nt, Mycobacterium avium subsp. paratuberculosis
cggaccggccagcag

SEQ ID NO: 855255 - RNA, 17 nt, Mycobacterium avium subsp. paratuberculosis
cggaccggccagcagcc

SEQ ID NO: 855256 - RNA, 12 nt, Mycobacterium avium subsp. paratuberculosis
cggaccggccgu

SEQ ID NO: 855257 - RNA, 13 nt, Mycobacterium avium subsp. paratuberculosis
cggaccggccgug

SEQ ID NO: 855258 - RNA, 14 nt, Mycobacterium avium subsp. paratuberculosis
cggaccggccgugc

SEQ ID NO: 855259 - RNA, 20 nt, Mycobacterium avium subsp. paratuberculosis
cggaccggccgugcgcgucg

SEQ ID NO: 855260 - RNA, 21 nt, Mycobacterium avium subsp. paratuberculosis
cggaccggcgauuucggccgu

SEQ ID NO: 855261 - RNA, 13 nt, Mycobacterium avium subsp. paratuberculosis
cggaccggcggcc

SEQ ID NO: 855262 - RNA, 14 nt, Mycobacterium avium subsp. paratuberculosis
cggaccggcggccg

SEQ ID NO: 855263 - RNA, 15 nt, Mycobacterium avium subsp. paratuberculosis
cggaccggcggccgc

SEQ ID NO: 855264 - RNA, 17 nt, Mycobacterium avium subsp. paratuberculosis
cggaccggcggccgcca

SEQ ID NO: 855265 - RNA, 19 nt, Mycobacterium avium subsp. paratuberculosis
cggaccggcggccgccauc

SEQ ID NO: 855266 - RNA, 20 nt, Mycobacterium avium subsp. paratuberculosis
cggaccggcggccgccauca

SEQ ID NO: 855267 - RNA, 11 nt, Mycobacterium avium subsp. paratuberculosis
cggaccggcuc

SEQ ID NO: 855268 - RNA, 13 nt, Mycobacterium avium subsp. paratuberculosis
cggaccggcucgu

SEQ ID NO: 855269 - RNA, 14 nt, Mycobacterium avium subsp. paratuberculosis
cggacccggaggcg

SEQ ID NO: 855270 - RNA, 18 nt, Mycobacterium avium subsp. paratuberculosis
cggacccggaggcggcgg

SEQ ID NO: 855271 - RNA, 17 nt, Mycobacterium avium subsp. paratuberculosis
cggacccggucggccgc

SEQ ID NO: 855272 - RNA, 18 nt, Mycobacterium avium subsp. paratuberculosis
cggacccggucggccgcg

SEQ ID NO: 855273 - RNA, 14 nt, Mycobacterium avium subsp. paratuberculosis
cggacccgcucgcc

SEQ ID NO: 855274 - RNA, 15 nt, Mycobacterium avium subsp. paratuberculosis
cggacccgcucgccg

SEQ ID NO: 855275 - RNA, 16 nt, Mycobacterium avium subsp. paratuberculosis
cggacccgcucgccga

SEQ ID NO: 855276 - RNA, 21 nt, Mycobacterium avium subsp. paratuberculosis
cggacccuucagccagaucga

SEQ ID NO: 855277 - RNA, 16 nt, Mycobacterium avium subsp. paratuberculosis
cggacccguugggcca

SEQ ID NO: 855278 - RNA, 12 nt, Mycobacterium avium subsp. paratuberculosis
cggaccgauccg

SEQ ID NO: 855279 - RNA, 12 nt, Mycobacterium avium subsp. paratuberculosis
cggaccgccgag

SEQ ID NO: 855280 - RNA, 14 nt, Mycobacterium avium subsp. paratuberculosis
cggaccgccgcggc

SEQ ID NO: 855281 - RNA, 16 nt, Mycobacterium avium subsp. paratuberculosis
cggaccgccgcggcgc

SEQ ID NO: 855282 - RNA, 20 nt, Mycobacterium avium subsp. paratuberculosis
cggaccgccgcggcgcccgg

SEQ ID NO: 855283 - RNA, 18 nt, Mycobacterium avium subsp. paratuberculosis
cggaccgccgcggcggcc

SEQ ID NO: 855284 - RNA, 19 nt, Mycobacterium avium subsp. paratuberculosis
cggaccgccgcggcggccu

SEQ ID NO: 855285 - RNA, 17 nt, Mycobacterium avium subsp. paratuberculosis
cggacauucugcacgac

SEQ ID NO: 855286 - RNA, 18 nt, Mycobacterium avium subsp. paratuberculosis
cggaccacguccccgggc

SEQ ID NO: 855287 - RNA, 19 nt, Mycobacterium avium subsp. paratuberculosis
cggaccacguccccgggcg

SEQ ID NO: 855288 - RNA, 18 nt, Mycobacterium avium subsp. paratuberculosis
cggaccaggguggcccca

SEQ ID NO: 855289 - RNA, 22 nt, Mycobacterium avium subsp. paratuberculosis
cggaccagguauucaucgcggc

SEQ ID NO: 855290 - RNA, 15 nt, Mycobacterium avium subsp. paratuberculosis
cggaccaucuacgac

SEQ ID NO: 855291 - RNA, 20 nt, Mycobacterium avium subsp. paratuberculosis
cggaccaucuacgaccucga

SEQ ID NO: 855292 - RNA, 14 nt, Mycobacterium avium subsp. paratuberculosis
cggacccagcccga

SEQ ID NO: 855293 - RNA, 17 nt, Mycobacterium avium subsp. paratuberculosis
cggacccagcccggcga

SEQ ID NO: 855294 - RNA, 20 nt, Mycobacterium avium subsp. paratuberculosis
cggacccagcccggcgacga

SEQ ID NO: 855295 - RNA, 13 nt, Mycobacterium avium subsp. paratuberculosis
cggacccagcucc

SEQ ID NO: 855296 - RNA, 18 nt, Mycobacterium avium subsp. paratuberculosis
cggacccagcuccucggc

SEQ ID NO: 855297 - RNA, 14 nt, Mycobacterium avium subsp. paratuberculosis
cggacccaggcagc

SEQ ID NO: 855298 - RNA, 20 nt, Mycobacterium avium subsp. paratuberculosis
cggacccaggcagcgcgacu

SEQ ID NO: 855299 - RNA, 18 nt, Mycobacterium avium subsp. paratuberculosis
cggacccauucgucggcg

SEQ ID NO: 855300 - RNA, 17 nt, Mycobacterium avium subsp. paratuberculosis
cggaccccacagcgcgc

SEQ ID NO: 855301 - RNA, 19 nt, Mycobacterium avium subsp. paratuberculosis
cggaccccacagcgcgccc

SEQ ID NO: 855302 - RNA, 20 nt, Mycobacterium avium subsp. paratuberculosis
cggacccccucggggcucac

SEQ ID NO: 855303 - RNA, 23 nt, Mycobacterium avium subsp. paratuberculosis
cggacuccuccugcgacggcagc

SEQ ID NO: 855304 - RNA, 16 nt, Mycobacterium avium subsp. paratuberculosis
cggacuccucgguggc

SEQ ID NO: 855305 - RNA, 17 nt, Mycobacterium avium subsp. paratuberculosis
cggacuccucgguggcc

SEQ ID NO: 855306 - RNA, 22 nt, Mycobacterium avium subsp. paratuberculosis
cggacucgaagaucgccugcag

SEQ ID NO: 855307 - RNA, 18 nt, Mycobacterium avium subsp. paratuberculosis
cggacucgaucgccaccg

SEQ ID NO: 855308 - RNA, 22 nt, Mycobacterium avium subsp. paratuberculosis
cggacucguuggggccaccaga

SEQ ID NO: 855309 - RNA, 19 nt, Mycobacterium avium subsp. paratuberculosis
cggacugcccgaccgcgcc

SEQ ID NO: 855310 - RNA, 20 nt, Mycobacterium avium subsp. paratuberculosis
cggacugcccgaccgcgccg

SEQ ID NO: 855311 - RNA, 21 nt, Mycobacterium avium subsp. paratuberculosis
cggacugcccgaccgcgccga

SEQ ID NO: 855312 - RNA, 20 nt, Mycobacterium avium subsp. paratuberculosis
cggacuggccaccgcgaucu

SEQ ID NO: 855313 - RNA, 21 nt, Mycobacterium avium subsp. paratuberculosis
cggacggccaccuugucggcg

SEQ ID NO: 855314 - RNA, 22 nt, Mycobacterium avium subsp. paratuberculosis
cggacggccaccuugucggcgc

SEQ ID NO: 855315 - RNA, 12 nt, Mycobacterium avium subsp. paratuberculosis
cggacggcccac

SEQ ID NO: 855316 - RNA, 14 nt, Mycobacterium avium subsp. paratuberculosis
cggacggcccgcaa

SEQ ID NO: 855317 - RNA, 12 nt, Mycobacterium avium subsp. paratuberculosis
cggacggcgacc

SEQ ID NO: 855318 - RNA, 13 nt, Mycobacterium avium subsp. paratuberculosis
cggacggcgacgg

SEQ ID NO: 855319 - RNA, 17 nt, Mycobacterium avium subsp. paratuberculosis
cggacggcgacggcagc

SEQ ID NO: 855320 - RNA, 18 nt, Mycobacterium avium subsp. paratuberculosis
cggacggcgacggcagcg

SEQ ID NO: 855321 - RNA, 14 nt, Mycobacterium avium subsp. paratuberculosis
cggacggcaccgac

SEQ ID NO: 855322 - RNA, 19 nt, Mycobacterium avium subsp. paratuberculosis
cggacggagccgugcccga

SEQ ID NO: 855323 - RNA, 22 nt, Mycobacterium avium subsp. paratuberculosis
cggacgggccgcauccgcgagc

SEQ ID NO: 855324 - RNA, 19 nt, Mycobacterium avium subsp. paratuberculosis
cggacgugauaucgggagu

SEQ ID NO: 855325 - RNA, 15 nt, Mycobacterium avium subsp. paratuberculosis
cggacgugaucgcgg

SEQ ID NO: 855326 - RNA, 20 nt, Mycobacterium avium subsp. paratuberculosis
cggacgugaucgcgguggcc

SEQ ID NO: 855327 - RNA, 14 nt, Mycobacterium avium subsp. paratuberculosis
cggacggucgccga

SEQ ID NO: 855328 - RNA, 15 nt, Mycobacterium avium subsp. paratuberculosis
cggacggucgccgac

SEQ ID NO: 855329 - RNA, 14 nt, Mycobacterium avium subsp. paratuberculosis
cggacggugacgcc

SEQ ID NO: 855330 - RNA, 16 nt, Mycobacterium avium subsp. paratuberculosis
cggacggugacgccgg

SEQ ID NO: 855331 - RNA, 19 nt, Mycobacterium avium subsp. paratuberculosis
cggacggguugggcgccag

SEQ ID NO: 855332 - RNA, 20 nt, Mycobacterium avium subsp. paratuberculosis
cggacggguugggcgccagc

SEQ ID NO: 855333 - RNA, 23 nt, Mycobacterium avium subsp. paratuberculosis
cggacggguugggcgccagcagc

SEQ ID NO: 855334 - RNA, 14 nt, Mycobacterium avium subsp. paratuberculosis
cggacgggucgacc

SEQ ID NO: 855335 - RNA, 15 nt, Mycobacterium avium subsp. paratuberculosis
cggacgggucgaccg

SEQ ID NO: 855336 - RNA, 22 nt, Mycobacterium avium subsp. paratuberculosis
cggacgggucgaccgccgcguc

SEQ ID NO: 855337 - RNA, 16 nt, Mycobacterium avium subsp. paratuberculosis
cggacgggucguagga

SEQ ID NO: 855338 - RNA, 18 nt, Mycobacterium avium subsp. paratuberculosis
cggacgggaccacccgca

SEQ ID NO: 855339 - RNA, 17 nt, Mycobacterium avium subsp. paratuberculosis
cggacgggagacgcugu

SEQ ID NO: 855340 - RNA, 16 nt, Mycobacterium avium subsp. paratuberculosis
cggacgggaucggcgc

SEQ ID NO: 855341 - RNA, 17 nt, Mycobacterium avium subsp. paratuberculosis
cggacgggaucggcgcg

SEQ ID NO: 855342 - RNA, 19 nt, Mycobacterium avium subsp. paratuberculosis
cggacgggaucggcgcguc

SEQ ID NO: 855343 - RNA, 18 nt, Mycobacterium avium subsp. paratuberculosis
cggaccgggugaccggcg

SEQ ID NO: 855344 - RNA, 19 nt, Mycobacterium avium subsp. paratuberculosis
cggaccgggugaccggcgc

SEQ ID NO: 855345 - RNA, 13 nt, Mycobacterium avium subsp. paratuberculosis
cggaccgucggug

SEQ ID NO: 855346 - RNA, 15 nt, Mycobacterium avium subsp. paratuberculosis
cggaccucgaccagc

SEQ ID NO: 855347 - RNA, 16 nt, Mycobacterium avium subsp. paratuberculosis
cggaccucgaccagcc

SEQ ID NO: 855348 - RNA, 16 nt, Mycobacterium avium subsp. paratuberculosis
cggaccugccggcgau

SEQ ID NO: 855349 - RNA, 17 nt, Mycobacterium avium subsp. paratuberculosis
cggacgacggccagcug

SEQ ID NO: 855350 - RNA, 21 nt, Mycobacterium avium subsp. paratuberculosis
cggacgacucguucgacgccg

SEQ ID NO: 855351 - RNA, 20 nt, Mycobacterium avium subsp. paratuberculosis
cggacgaacaucgagcccac

SEQ ID NO: 855352 - RNA, 22 nt, Mycobacterium avium subsp. paratuberculosis
cggacgaacaucgagcccaccg

SEQ ID NO: 855353 - RNA, 18 nt, Mycobacterium avium subsp. paratuberculosis
cggaccuuggugucggcg

SEQ ID NO: 855354 - RNA, 19 nt, Mycobacterium avium subsp. paratuberculosis
cggaccuuggugucggcga

SEQ ID NO: 855355 - RNA, 18 nt, Mycobacterium avium subsp. paratuberculosis
cggaccugggugcgccac

SEQ ID NO: 855356 - RNA, 19 nt, Mycobacterium avium subsp. paratuberculosis
cggaccugggugcgccacu

SEQ ID NO: 855357 - RNA, 17 nt, Mycobacterium avium subsp. paratuberculosis
cggacgagccgucgcgg

SEQ ID NO: 855358 - RNA, 16 nt, Mycobacterium avium subsp. paratuberculosis
cggacgauguccgccg

SEQ ID NO: 855359 - RNA, 17 nt, Mycobacterium avium subsp. paratuberculosis
cggacgauguccgccgg

SEQ ID NO: 855360 - RNA, 18 nt, Mycobacterium avium subsp. paratuberculosis
cggacgauguccgccggc

SEQ ID NO: 855361 - RNA, 20 nt, Mycobacterium avium subsp. paratuberculosis
cggacgauguccgccggccg

SEQ ID NO: 855362 - RNA, 17 nt, Mycobacterium avium subsp. paratuberculosis
cggacgauucgcgauca

SEQ ID NO: 855363 - RNA, 18 nt, Mycobacterium avium subsp. paratuberculosis
cggacgauucgcgaucaa

SEQ ID NO: 855364 - RNA, 16 nt, Mycobacterium avium subsp. paratuberculosis
cggacgaugacccagc

SEQ ID NO: 855365 - RNA, 12 nt, Mycobacterium avium subsp. paratuberculosis
cggacgaugccg

SEQ ID NO: 855366 - RNA, 16 nt, Mycobacterium avium subsp. paratuberculosis
cggacgaugccgcggc

SEQ ID NO: 855367 - RNA, 20 nt, Mycobacterium avium subsp. paratuberculosis
cggacgaugccgcggcgucc

SEQ ID NO: 855368 - RNA, 19 nt, Mycobacterium avium subsp. paratuberculosis
cggacgaugcgcacccccg

SEQ ID NO: 855369 - RNA, 20 nt, Mycobacterium avium subsp. paratuberculosis
cggacgaugcgcacccccgg

SEQ ID NO: 855370 - RNA, 23 nt, Mycobacterium avium subsp. paratuberculosis
cggacgaugcgcacccccggggc

SEQ ID NO: 855371 - RNA, 14 nt, Mycobacterium avium subsp. paratuberculosis
cggacgcggccagc

SEQ ID NO: 855372 - RNA, 18 nt, Mycobacterium avium subsp. paratuberculosis
cggacgcggccagcgccc

SEQ ID NO: 855373 - RNA, 22 nt, Mycobacterium avium subsp. paratuberculosis
cggacgcggccagcgcccgcgc

SEQ ID NO: 855374 - RNA, 15 nt, Mycobacterium avium subsp. paratuberculosis
cggacgcggccgagc

SEQ ID NO: 855375 - RNA, 15 nt, Mycobacterium avium subsp. paratuberculosis
cggacgcggcggacg

SEQ ID NO: 855376 - RNA, 19 nt, Mycobacterium avium subsp. paratuberculosis
cggacgcgcacacggccuc

SEQ ID NO: 855377 - RNA, 23 nt, Mycobacterium avium subsp. paratuberculosis
cggacgcgcacacggccucgccc

SEQ ID NO: 855378 - RNA, 17 nt, Mycobacterium avium subsp. paratuberculosis
cggacgccaguggcugc

SEQ ID NO: 855379 - RNA, 16 nt, Mycobacterium avium subsp. paratuberculosis
cggacgccucccccac

SEQ ID NO: 855380 - RNA, 13 nt, Mycobacterium avium subsp. paratuberculosis
cggacgcccgucg

SEQ ID NO: 855381 - RNA, 16 nt, Mycobacterium avium subsp. paratuberculosis
cggacgcccgucgcgc

SEQ ID NO: 855382 - RNA, 12 nt, Mycobacterium avium subsp. paratuberculosis
cggacgcagcga

SEQ ID NO: 855383 - RNA, 19 nt, Mycobacterium avium subsp. paratuberculosis
cggacgcauccacggccgg

SEQ ID NO: 855384 - RNA, 20 nt, Mycobacterium avium subsp. paratuberculosis
cggacgcauccacggccggu

SEQ ID NO: 855385 - RNA, 22 nt, Mycobacterium avium subsp. paratuberculosis
cggacgcauccacggccgguuc

SEQ ID NO: 855386 - RNA, 17 nt, Mycobacterium avium subsp. paratuberculosis
cggaguggaacagccgg

SEQ ID NO: 855387 - RNA, 22 nt, Mycobacterium avium subsp. paratuberculosis
cggaguugccgauggcggucca

SEQ ID NO: 855388 - RNA, 16 nt, Mycobacterium avium subsp. paratuberculosis
cggaguugcgcagccg

SEQ ID NO: 855389 - RNA, 21 nt, Mycobacterium avium subsp. paratuberculosis
cggaguugcgcagccgggcgg

SEQ ID NO: 855390 - RNA, 23 nt, Mycobacterium avium subsp. paratuberculosis
cggauaacgcaaaacggugcggc

SEQ ID NO: 855391 - RNA, 22 nt, Mycobacterium avium subsp. paratuberculosis
cggauaacucuacugcugcggg

SEQ ID NO: 855392 - RNA, 18 nt, Mycobacterium avium subsp. paratuberculosis
cggagucgguuucgaccu

SEQ ID NO: 855393 - RNA, 17 nt, Mycobacterium avium subsp. paratuberculosis
cggagucgucggcgcgg

SEQ ID NO: 855394 - RNA, 20 nt, Mycobacterium avium subsp. paratuberculosis
cggagucgucggcgcgguug

SEQ ID NO: 855395 - RNA, 16 nt, Mycobacterium avium subsp. paratuberculosis
cggagugaccgccagc

SEQ ID NO: 855396 - RNA, 22 nt, Mycobacterium avium subsp. paratuberculosis
cggagugaccgccagcaccgcg

SEQ ID NO: 855397 - RNA, 18 nt, Mycobacterium avium subsp. paratuberculosis
cggagugacgucgcgcgg

SEQ ID NO: 855398 - RNA, 14 nt, Mycobacterium avium subsp. paratuberculosis
cggaguccaccggc

SEQ ID NO: 855399 - RNA, 14 nt, Mycobacterium avium subsp. paratuberculosis
cggaguccggcucg

SEQ ID NO: 855400 - RNA, 18 nt, Mycobacterium avium subsp. paratuberculosis
cggaguccggcucggugc

SEQ ID NO: 855401 - RNA, 20 nt, Mycobacterium avium subsp. paratuberculosis
cggaguccggcucggugccg

SEQ ID NO: 855402 - RNA, 14 nt, Mycobacterium avium subsp. paratuberculosis
cggaguaggcgccg

SEQ ID NO: 855403 - RNA, 18 nt, Mycobacterium avium subsp. paratuberculosis
cggaguaguuccggcggu

SEQ ID NO: 855404 - RNA, 19 nt, Mycobacterium avium subsp. paratuberculosis
cggaguaguuccggcgguc

SEQ ID NO: 855405 - RNA, 21 nt, Mycobacterium avium subsp. paratuberculosis
cggaguaguuccggcgguccu

SEQ ID NO: 855406 - RNA, 12 nt, Mycobacterium avium subsp. paratuberculosis
cggaggcggcgu

SEQ ID NO: 855407 - RNA, 22 nt, Mycobacterium avium subsp. paratuberculosis
cggaggcggcguagucgccggu

SEQ ID NO: 855408 - RNA, 17 nt, Mycobacterium avium subsp. paratuberculosis
cggaggcgucgacgcgc

SEQ ID NO: 855409 - RNA, 19 nt, Mycobacterium avium subsp. paratuberculosis
cggaggcgucgacgcgcug

SEQ ID NO: 855410 - RNA, 17 nt, Mycobacterium avium subsp. paratuberculosis
cggagggguacucggcu

SEQ ID NO: 855411 - RNA, 23 nt, Mycobacterium avium subsp. paratuberculosis
cggagggguacucggcuucgucg

SEQ ID NO: 855412 - RNA, 23 nt, Mycobacterium avium subsp. paratuberculosis
cggagguacucgaguggcgaacg

SEQ ID NO: 855413 - RNA, 18 nt, Mycobacterium avium subsp. paratuberculosis
cggaggucagcaggguga

SEQ ID NO: 855414 - RNA, 15 nt, Mycobacterium avium subsp. paratuberculosis
cggaggucagcggcc

SEQ ID NO: 855415 - RNA, 23 nt, Mycobacterium avium subsp. paratuberculosis
cggaggucagcggcccgaucacc

SEQ ID NO: 855416 - RNA, 12 nt, Mycobacterium avium subsp. paratuberculosis
cggaggucaugg

SEQ ID NO: 855417 - RNA, 19 nt, Mycobacterium avium subsp. paratuberculosis
cggaggucauggcgaccgc

SEQ ID NO: 855418 - RNA, 14 nt, Mycobacterium avium subsp. paratuberculosis
cggaggugccgcgc

SEQ ID NO: 855419 - RNA, 17 nt, Mycobacterium avium subsp. paratuberculosis
cggaggugccgcgcggc

SEQ ID NO: 855420 - RNA, 17 nt, Mycobacterium avium subsp. paratuberculosis
cggaggugccggccggu

SEQ ID NO: 855421 - RNA, 22 nt, Mycobacterium avium subsp. paratuberculosis
cggaggugcgggucucgaaccg

SEQ ID NO: 855422 - RNA, 23 nt, Mycobacterium avium subsp. paratuberculosis
cggaguagaccuuguccggcguc

SEQ ID NO: 855423 - RNA, 19 nt, Mycobacterium avium subsp. paratuberculosis
cggauaucccgcgggucgc

SEQ ID NO: 855424 - RNA, 19 nt, Mycobacterium avium subsp. paratuberculosis
cggaucaggucggucaccg

SEQ ID NO: 855425 - RNA, 22 nt, Mycobacterium avium subsp. paratuberculosis
cggaucaguaccggcgaugcca

SEQ ID NO: 855426 - RNA, 21 nt, Mycobacterium avium subsp. paratuberculosis
cggaucagcguuccggcggcc

SEQ ID NO: 855427 - RNA, 22 nt, Mycobacterium avium subsp. paratuberculosis
cggaucagcugaccggcgaucg

SEQ ID NO: 855428 - RNA, 17 nt, Mycobacterium avium subsp. paratuberculosis
cggaucagcaccgacgc

SEQ ID NO: 855429 - RNA, 21 nt, Mycobacterium avium subsp. paratuberculosis
cggaucagcaccgacgcggcg

SEQ ID NO: 855430 - RNA, 22 nt, Mycobacterium avium subsp. paratuberculosis
cggaucagcaccgacgcggcga

SEQ ID NO: 855431 - RNA, 22 nt, Mycobacterium avium subsp. paratuberculosis
cggaucagcaggaccgggaucg

SEQ ID NO: 855432 - RNA, 17 nt, Mycobacterium avium subsp. paratuberculosis
cggauacgcccggccac

SEQ ID NO: 855433 - RNA, 16 nt, Mycobacterium avium subsp. paratuberculosis
cggauagaggcggcgc

SEQ ID NO: 855434 - RNA, 16 nt, Mycobacterium avium subsp. paratuberculosis
cggauagcguccgccc

SEQ ID NO: 855435 - RNA, 16 nt, Mycobacterium avium subsp. paratuberculosis
cggauacccgcggccu

SEQ ID NO: 855436 - RNA, 19 nt, Mycobacterium avium subsp. paratuberculosis
cggauacccgcggccuccg

SEQ ID NO: 855437 - RNA, 15 nt, Mycobacterium avium subsp. paratuberculosis
cggagcccagcguga

SEQ ID NO: 855438 - RNA, 18 nt, Mycobacterium avium subsp. paratuberculosis
cggagcccagcuuggcgc

SEQ ID NO: 855439 - RNA, 17 nt, Mycobacterium avium subsp. paratuberculosis
cggagccgaccucggcg

SEQ ID NO: 855440 - RNA, 14 nt, Mycobacterium avium subsp. paratuberculosis
cggagccgagcacc

SEQ ID NO: 855441 - RNA, 16 nt, Mycobacterium avium subsp. paratuberculosis
cggagccgagcaccag

SEQ ID NO: 855442 - RNA, 18 nt, Mycobacterium avium subsp. paratuberculosis
cggagccgagcaccaggc

SEQ ID NO: 855443 - RNA, 14 nt, Mycobacterium avium subsp. paratuberculosis
cggagccgaucgcc

SEQ ID NO: 855444 - RNA, 17 nt, Mycobacterium avium subsp. paratuberculosis
cggagccgaucgccucc

SEQ ID NO: 855445 - RNA, 23 nt, Mycobacterium avium subsp. paratuberculosis
cggagccgaucgccuccgucagc

SEQ ID NO: 855446 - RNA, 12 nt, Mycobacterium avium subsp. paratuberculosis
cggagccggccg

SEQ ID NO: 855447 - RNA, 14 nt, Mycobacterium avium subsp. paratuberculosis
cggagccggccgcc

SEQ ID NO: 855448 - RNA, 15 nt, Mycobacterium avium subsp. paratuberculosis
cggagccggccgccg

SEQ ID NO: 855449 - RNA, 17 nt, Mycobacterium avium subsp. paratuberculosis
cggagccggccucgccg

SEQ ID NO: 855450 - RNA, 23 nt, Mycobacterium avium subsp. paratuberculosis
cggagcgccccagggccucggcg

SEQ ID NO: 855451 - RNA, 12 nt, Mycobacterium avium subsp. paratuberculosis
cggagcgcccgg

SEQ ID NO: 855452 - RNA, 19 nt, Mycobacterium avium subsp. paratuberculosis
cggagcgcccggccagccg

SEQ ID NO: 855453 - RNA, 16 nt, Mycobacterium avium subsp. paratuberculosis
cggagcgcuccaccac

SEQ ID NO: 855454 - RNA, 17 nt, Mycobacterium avium subsp. paratuberculosis
cggagcgcuccaccacc

SEQ ID NO: 855455 - RNA, 18 nt, Mycobacterium avium subsp. paratuberculosis
cggagcgcuccaccaccg

SEQ ID NO: 855456 - RNA, 17 nt, Mycobacterium avium subsp. paratuberculosis
cggagcggauggcgccg

SEQ ID NO: 855457 - RNA, 20 nt, Mycobacterium avium subsp. paratuberculosis
cggagcggauggcgccgucg

SEQ ID NO: 855458 - RNA, 21 nt, Mycobacterium avium subsp. paratuberculosis
cggagcggauggcgccgucga

SEQ ID NO: 855459 - RNA, 13 nt, Mycobacterium avium subsp. paratuberculosis
cggagcggcggua

SEQ ID NO: 855460 - RNA, 13 nt, Mycobacterium avium subsp. paratuberculosis
cggagcggcgguc

SEQ ID NO: 855461 - RNA, 16 nt, Mycobacterium avium subsp. paratuberculosis
cggagcggcggucacg

SEQ ID NO: 855462 - RNA, 18 nt, Mycobacterium avium subsp. paratuberculosis
cggagccuucuucgccgc

SEQ ID NO: 855463 - RNA, 21 nt, Mycobacterium avium subsp. paratuberculosis
cggagccuucuucgccgcaac

SEQ ID NO: 855464 - RNA, 23 nt, Mycobacterium avium subsp. paratuberculosis
cggagccuucuucgccgcagccu

SEQ ID NO: 855465 - RNA, 17 nt, Mycobacterium avium subsp. paratuberculosis
cggagccuugcuggcgg

SEQ ID NO: 855466 - RNA, 18 nt, Mycobacterium avium subsp. paratuberculosis
cggagccuugcuggcggc

SEQ ID NO: 855467 - RNA, 19 nt, Mycobacterium avium subsp. paratuberculosis
cggagccuugcuggcggcc

SEQ ID NO: 855468 - RNA, 21 nt, Mycobacterium avium subsp. paratuberculosis
cggagccuugcuggcggccuu

SEQ ID NO: 855469 - RNA, 17 nt, Mycobacterium avium subsp. paratuberculosis
cggagccuuggucgcgg

SEQ ID NO: 855470 - RNA, 20 nt, Mycobacterium avium subsp. paratuberculosis
cggagccuuggucgcggccu

SEQ ID NO: 855471 - RNA, 21 nt, Mycobacterium avium subsp. paratuberculosis
cggagccuuggucgcggccuu

SEQ ID NO: 855472 - RNA, 23 nt, Mycobacterium avium subsp. paratuberculosis
cggagccuuggucgcggccuugc

SEQ ID NO: 855473 - RNA, 22 nt, Mycobacterium avium subsp. paratuberculosis
cggagcgaaggugccgcgaugc

SEQ ID NO: 855474 - RNA, 11 nt, Mycobacterium avium subsp. paratuberculosis
cggagccgucg

SEQ ID NO: 855475 - RNA, 14 nt, Mycobacterium avium subsp. paratuberculosis
cggagccgucggcu

SEQ ID NO: 855476 - RNA, 12 nt, Mycobacterium avium subsp. paratuberculosis
cggaggccgcgg

SEQ ID NO: 855477 - RNA, 13 nt, Mycobacterium avium subsp. paratuberculosis
cggaggccgcggg

SEQ ID NO: 855478 - RNA, 17 nt, Mycobacterium avium subsp. paratuberculosis
cggaggccaccgcgccg

SEQ ID NO: 855479 - RNA, 19 nt, Mycobacterium avium subsp. paratuberculosis
cggaggccagcucgaccgc

SEQ ID NO: 855480 - RNA, 17 nt, Mycobacterium avium subsp. paratuberculosis
cggaggaauucgccgac

SEQ ID NO: 855481 - RNA, 18 nt, Mycobacterium avium subsp. paratuberculosis
cggaggacaacgcgucga

SEQ ID NO: 855482 - RNA, 22 nt, Mycobacterium avium subsp. paratuberculosis
cggaggacaacgcgucgaacag

SEQ ID NO: 855483 - RNA, 16 nt, Mycobacterium avium subsp. paratuberculosis
cggaggaugccggcca

SEQ ID NO: 855484 - RNA, 19 nt, Mycobacterium avium subsp. paratuberculosis
cggaggaugccggccagcu

SEQ ID NO: 855485 - RNA, 13 nt, Mycobacterium avium subsp. paratuberculosis
cggaggccugcgc

SEQ ID NO: 855486 - RNA, 18 nt, Mycobacterium avium subsp. paratuberculosis
cggaggccugcgcggccg

SEQ ID NO: 855487 - RNA, 13 nt, Mycobacterium avium subsp. paratuberculosis
cggaggcgaugcg

SEQ ID NO: 855488 - RNA, 13 nt, Mycobacterium avium subsp. paratuberculosis
cggaggcgagcag

SEQ ID NO: 855489 - RNA, 17 nt, Mycobacterium avium subsp. paratuberculosis
cggaggcgagcagccgg

SEQ ID NO: 855490 - RNA, 23 nt, Mycobacterium avium subsp. paratuberculosis
cggagcugcgcgccccggcccgg

SEQ ID NO: 855491 - RNA, 16 nt, Mycobacterium avium subsp. paratuberculosis
cggagcgucgcgauga

SEQ ID NO: 855492 - RNA, 14 nt, Mycobacterium avium subsp. paratuberculosis
cggagccgucggug

SEQ ID NO: 855493 - RNA, 21 nt, Mycobacterium avium subsp. paratuberculosis
cggagccgucgguguccaggu

SEQ ID NO: 855494 - RNA, 16 nt, Mycobacterium avium subsp. paratuberculosis
cggagccgugcccgag

SEQ ID NO: 855495 - RNA, 14 nt, Mycobacterium avium subsp. paratuberculosis
cggagcggugcggc

SEQ ID NO: 855496 - RNA, 23 nt, Mycobacterium avium subsp. paratuberculosis
cggagcggugcggcucgggcggu

SEQ ID NO: 855497 - RNA, 20 nt, Mycobacterium avium subsp. paratuberculosis
cggagaccaggucggccuuc

SEQ ID NO: 855498 - RNA, 16 nt, Mycobacterium avium subsp. paratuberculosis
cggagacccgcccgga

SEQ ID NO: 855499 - RNA, 16 nt, Mycobacterium avium subsp. paratuberculosis
cggagaccgccguggc

SEQ ID NO: 855500 - RNA, 17 nt, Mycobacterium avium subsp. paratuberculosis
cggagaccgccguggcg

SEQ ID NO: 855501 - RNA, 18 nt, Mycobacterium avium subsp. paratuberculosis
cggagaaccgcucgaugg

SEQ ID NO: 855502 - RNA, 16 nt, Mycobacterium avium subsp. paratuberculosis
cggagaacaucagccc

SEQ ID NO: 855503 - RNA, 20 nt, Mycobacterium avium subsp. paratuberculosis
cggacuggugggcgucgugg

SEQ ID NO: 855504 - RNA, 18 nt, Mycobacterium avium subsp. paratuberculosis
cggacuucuucagcuuga

SEQ ID NO: 855505 - RNA, 21 nt, Mycobacterium avium subsp. paratuberculosis
cggacuucuucagcuugaccg

SEQ ID NO: 855506 - RNA, 19 nt, Mycobacterium avium subsp. paratuberculosis
cggagaacuccuugagcuc

SEQ ID NO: 855507 - RNA, 13 nt, Mycobacterium avium subsp. paratuberculosis
cggagacguggcg

SEQ ID NO: 855508 - RNA, 17 nt, Mycobacterium avium subsp. paratuberculosis
cggagacguggcggcgg

SEQ ID NO: 855509 - RNA, 14 nt, Mycobacterium avium subsp. paratuberculosis
cggagacguugccg

SEQ ID NO: 855510 - RNA, 15 nt, Mycobacterium avium subsp. paratuberculosis
cggagauccggccgc

SEQ ID NO: 855511 - RNA, 19 nt, Mycobacterium avium subsp. paratuberculosis
cggagauccggccgcuggu

SEQ ID NO: 855512 - RNA, 20 nt, Mycobacterium avium subsp. paratuberculosis
cggagauccggccgcuggug

SEQ ID NO: 855513 - RNA, 15 nt, Mycobacterium avium subsp. paratuberculosis
cggagaucgccccgg

SEQ ID NO: 855514 - RNA, 15 nt, Mycobacterium avium subsp. paratuberculosis
cggagaugcgggcca

SEQ ID NO: 855515 - RNA, 17 nt, Mycobacterium avium subsp. paratuberculosis
cggagaugcgggccacc

SEQ ID NO: 855516 - RNA, 18 nt, Mycobacterium avium subsp. paratuberculosis
cggagaugcgggccaccg

SEQ ID NO: 855517 - RNA, 19 nt, Mycobacterium avium subsp. paratuberculosis
cggagaugcuggugacgcc

SEQ ID NO: 855518 - RNA, 17 nt, Mycobacterium avium subsp. paratuberculosis
cggagaugguggucacc

SEQ ID NO: 855519 - RNA, 21 nt, Mycobacterium avium subsp. paratuberculosis
cggagaugguggucaccacca

SEQ ID NO: 855520 - RNA, 22 nt, Mycobacterium avium subsp. paratuberculosis
cggagaugguggucaccaccac

SEQ ID NO: 855521 - RNA, 19 nt, Mycobacterium avium subsp. paratuberculosis
cggagaugaauucggcgau

SEQ ID NO: 855522 - RNA, 22 nt, Mycobacterium avium subsp. paratuberculosis
cggagaugaauucggcgaucuc

SEQ ID NO: 855523 - RNA, 17 nt, Mycobacterium avium subsp. paratuberculosis
cggagaugauggccgcg

SEQ ID NO: 855524 - RNA, 22 nt, Mycobacterium avium subsp. paratuberculosis
cggagaugauggccgcgccgcc

SEQ ID NO: 855525 - RNA, 20 nt, Mycobacterium avium subsp. paratuberculosis
cggagcaaauccggcagcgc

SEQ ID NO: 855526 - RNA, 16 nt, Mycobacterium avium subsp. paratuberculosis
cggcaucagcgagacg

SEQ ID NO: 855527 - RNA, 23 nt, Mycobacterium avium subsp. paratuberculosis
cggcaucagcgagacgaccagga

SEQ ID NO: 855528 - RNA, 23 nt, Mycobacterium avium subsp. paratuberculosis
cggcauccacccguuccucgacg

SEQ ID NO: 855529 - RNA, 21 nt, Mycobacterium avium subsp. paratuberculosis
cggcauccagcacggccgcca

SEQ ID NO: 855530 - RNA, 21 nt, Mycobacterium avium subsp. paratuberculosis
cggcaucgacaugcccggcga

SEQ ID NO: 855531 - RNA, 22 nt, Mycobacterium avium subsp. paratuberculosis
cggcaucgacaugcccggcgac

SEQ ID NO: 855532 - RNA, 23 nt, Mycobacterium avium subsp. paratuberculosis
cggcaucgacaugcccggcgacg

SEQ ID NO: 855533 - RNA, 15 nt, Mycobacterium avium subsp. paratuberculosis
cggcaucgaccgccc

SEQ ID NO: 855534 - RNA, 19 nt, Mycobacterium avium subsp. paratuberculosis
cggcaucgaccgcccgcug

SEQ ID NO: 855535 - RNA, 14 nt, Mycobacterium avium subsp. paratuberculosis
cggcaucccacccg

SEQ ID NO: 855536 - RNA, 23 nt, Mycobacterium avium subsp. paratuberculosis
cggcauccccagcugggccgcca

SEQ ID NO: 855537 - RNA, 23 nt, Mycobacterium avium subsp. paratuberculosis
cggcaucccuuccugggacagcc

SEQ ID NO: 855538 - RNA, 17 nt, Mycobacterium avium subsp. paratuberculosis
cggcauccucggcgcgu

SEQ ID NO: 855539 - RNA, 20 nt, Mycobacterium avium subsp. paratuberculosis
cggcauccucggcgcgucgg

SEQ ID NO: 855540 - RNA, 21 nt, Mycobacterium avium subsp. paratuberculosis
cggcauagcgccgcucggccg

SEQ ID NO: 855541 - RNA, 18 nt, Mycobacterium avium subsp. paratuberculosis
cggcauaguccagcucgc

SEQ ID NO: 855542 - RNA, 18 nt, Mycobacterium avium subsp. paratuberculosis
cggcaggucggugcgcgg

SEQ ID NO: 855543 - RNA, 16 nt, Mycobacterium avium subsp. paratuberculosis
cggcaggucgucgucg

SEQ ID NO: 855544 - RNA, 19 nt, Mycobacterium avium subsp. paratuberculosis
cggcaggucgucgucgccg

SEQ ID NO: 855545 - RNA, 20 nt, Mycobacterium avium subsp. paratuberculosis
cggcaggucgucgucgccgc

SEQ ID NO: 855546 - RNA, 22 nt, Mycobacterium avium subsp. paratuberculosis
cggcaggucgaggccggccagc

SEQ ID NO: 855547 - RNA, 16 nt, Mycobacterium avium subsp. paratuberculosis
cggcaggucggccagc

SEQ ID NO: 855548 - RNA, 19 nt, Mycobacterium avium subsp. paratuberculosis
cggcaggucggccagcgcc

SEQ ID NO: 855549 - RNA, 20 nt, Mycobacterium avium subsp. paratuberculosis
cggcaggucggccagcgccg

SEQ ID NO: 855550 - RNA, 13 nt, Mycobacterium avium subsp. paratuberculosis
cggcaggucggcg

SEQ ID NO: 855551 - RNA, 14 nt, Mycobacterium avium subsp. paratuberculosis
cggcaggucggcgg

SEQ ID NO: 855552 - RNA, 20 nt, Mycobacterium avium subsp. paratuberculosis
cggcaggucggcgggagccg

SEQ ID NO: 855553 - RNA, 21 nt, Mycobacterium avium subsp. paratuberculosis
cggcaggucggcgggagccgg

SEQ ID NO: 855554 - RNA, 17 nt, Mycobacterium avium subsp. paratuberculosis
cggcagguaggcgccgc

SEQ ID NO: 855555 - RNA, 16 nt, Mycobacterium avium subsp. paratuberculosis
cggcaggucccaggcc

SEQ ID NO: 855556 - RNA, 13 nt, Mycobacterium avium subsp. paratuberculosis
cggcaggccgccc

SEQ ID NO: 855557 - RNA, 14 nt, Mycobacterium avium subsp. paratuberculosis
cggcaggccgcccg

SEQ ID NO: 855558 - RNA, 20 nt, Mycobacterium avium subsp. paratuberculosis
cggcagggccaggccgugau

SEQ ID NO: 855559 - RNA, 14 nt, Mycobacterium avium subsp. paratuberculosis
cggcaggauccgga

SEQ ID NO: 855560 - RNA, 19 nt, Mycobacterium avium subsp. paratuberculosis
cggcaggauccggacgacc

SEQ ID NO: 855561 - RNA, 17 nt, Mycobacterium avium subsp. paratuberculosis
cggcaggauccggucga

SEQ ID NO: 855562 - RNA, 13 nt, Mycobacterium avium subsp. paratuberculosis
cggcaggccgcgg

SEQ ID NO: 855563 - RNA, 15 nt, Mycobacterium avium subsp. paratuberculosis
cggcaggccgcggcc

SEQ ID NO: 855564 - RNA, 17 nt, Mycobacterium avium subsp. paratuberculosis
cggcaggccgcggccgu

SEQ ID NO: 855565 - RNA, 19 nt, Mycobacterium avium subsp. paratuberculosis
cggcaggccgcggccgucg

SEQ ID NO: 855566 - RNA, 22 nt, Mycobacterium avium subsp. paratuberculosis
cggcaggccgcggccgucgucg

SEQ ID NO: 855567 - RNA, 22 nt, Mycobacterium avium subsp. paratuberculosis
cggcagcugaagugcacucggc

SEQ ID NO: 855568 - RNA, 18 nt, Mycobacterium avium subsp. paratuberculosis
cggcaggacgggggccgg

SEQ ID NO: 855569 - RNA, 23 nt, Mycobacterium avium subsp. paratuberculosis
cggcaggaaccgggucagcacca

SEQ ID NO: 855570 - RNA, 15 nt, Mycobacterium avium subsp. paratuberculosis
cggcacgaucggcag

SEQ ID NO: 855571 - RNA, 14 nt, Mycobacterium avium subsp. paratuberculosis
aacagucggccggc

SEQ ID NO: 855572 - RNA, 16 nt, Mycobacterium avium subsp. paratuberculosis
cggcacgaagccgaac

SEQ ID NO: 855573 - RNA, 21 nt, Mycobacterium avium subsp. paratuberculosis
cggcacgaaguugguguccac

SEQ ID NO: 855574 - RNA, 16 nt, Mycobacterium avium subsp. paratuberculosis
cggcagcugcagcgga

SEQ ID NO: 855575 - RNA, 16 nt, Mycobacterium avium subsp. paratuberculosis
cggcagcugcccgucg

SEQ ID NO: 855576 - RNA, 19 nt, Mycobacterium avium subsp. paratuberculosis
cggcagcugcccgucggag

SEQ ID NO: 855577 - RNA, 11 nt, Mycobacterium avium subsp. paratuberculosis
cggcagcucgg

SEQ ID NO: 855578 - RNA, 18 nt, Mycobacterium avium subsp. paratuberculosis
cggcagcucggcggcccg

SEQ ID NO: 855579 - RNA, 21 nt, Mycobacterium avium subsp. paratuberculosis
cggcagcucggcggcccgccg

SEQ ID NO: 855580 - RNA, 22 nt, Mycobacterium avium subsp. paratuberculosis
cggcagcucggcggcccgccgg

SEQ ID NO: 855581 - RNA, 13 nt, Mycobacterium avium subsp. paratuberculosis
cggcagcucgucg

SEQ ID NO: 855582 - RNA, 14 nt, Mycobacterium avium subsp. paratuberculosis
cggcagcucgucga

SEQ ID NO: 855583 - RNA, 15 nt, Mycobacterium avium subsp. paratuberculosis
cggcagcucgucgac

SEQ ID NO: 855584 - RNA, 17 nt, Mycobacterium avium subsp. paratuberculosis
cggcagcucgucgacgu

SEQ ID NO: 855585 - RNA, 16 nt, Mycobacterium avium subsp. paratuberculosis
cggcacgaucggcagc

SEQ ID NO: 855586 - RNA, 17 nt, Mycobacterium avium subsp. paratuberculosis
cggcacgaucggcagcg

SEQ ID NO: 855587 - RNA, 19 nt, Mycobacterium avium subsp. paratuberculosis
cggcacgaucggcagcgcc

SEQ ID NO: 855588 - RNA, 20 nt, Mycobacterium avium subsp. paratuberculosis
cggcacgaucggcagcgcca

SEQ ID NO: 855589 - RNA, 17 nt, Mycobacterium avium subsp. paratuberculosis
cggccacacuggcguga

SEQ ID NO: 855590 - RNA, 19 nt, Mycobacterium avium subsp. paratuberculosis
cggccacacuggcgugacg

SEQ ID NO: 855591 - RNA, 20 nt, Mycobacterium avium subsp. paratuberculosis
cggccaccaacaggucggcg

SEQ ID NO: 855592 - RNA, 17 nt, Mycobacterium avium subsp. paratuberculosis
cggccaccaacggcagc

SEQ ID NO: 855593 - RNA, 19 nt, Mycobacterium avium subsp. paratuberculosis
cggccaccaacggcagcag

SEQ ID NO: 855594 - RNA, 23 nt, Mycobacterium avium subsp. paratuberculosis
cggccaccccgcagaacaccagc

SEQ ID NO: 855595 - RNA, 15 nt, Mycobacterium avium subsp. paratuberculosis
cggccaccccggagc

SEQ ID NO: 855596 - RNA, 21 nt, Mycobacterium avium subsp. paratuberculosis
cggccaccaugggcgggacga

SEQ ID NO: 855597 - RNA, 19 nt, Mycobacterium avium subsp. paratuberculosis
cggccaccaugucggcguc

SEQ ID NO: 855598 - RNA, 14 nt, Mycobacterium avium subsp. paratuberculosis
cggccaccagggcg

SEQ ID NO: 855599 - RNA, 18 nt, Mycobacterium avium subsp. paratuberculosis
cggccaccagggcgaccg

SEQ ID NO: 855600 - RNA, 19 nt, Mycobacterium avium subsp. paratuberculosis
cggccaccagggcgaccgc

SEQ ID NO: 855601 - RNA, 20 nt, Mycobacterium avium subsp. paratuberculosis
cggccaccagggcgaccgcc

SEQ ID NO: 855602 - RNA, 23 nt, Mycobacterium avium subsp. paratuberculosis
cggccaccagggcgaccgccgcg

SEQ ID NO: 855603 - RNA, 23 nt, Mycobacterium avium subsp. paratuberculosis
cggccaccaggucgcacaccagc

SEQ ID NO: 855604 - RNA, 15 nt, Mycobacterium avium subsp. paratuberculosis
cggccaccagggaca

SEQ ID NO: 855605 - RNA, 20 nt, Mycobacterium avium subsp. paratuberculosis
cggccaccaucuccgcggcg

SEQ ID NO: 855606 - RNA, 23 nt, Mycobacterium avium subsp. paratuberculosis
cggccaccaucuccgcggcgcgg

SEQ ID NO: 855607 - RNA, 14 nt, Mycobacterium avium subsp. paratuberculosis
cggccaccaugccg

SEQ ID NO: 855608 - RNA, 18 nt, Mycobacterium avium subsp. paratuberculosis
cggccaccaugccggcgu

SEQ ID NO: 855609 - RNA, 19 nt, Mycobacterium avium subsp. paratuberculosis
cggccaccaugccggcguc

SEQ ID NO: 855610 - RNA, 16 nt, Mycobacterium avium subsp. paratuberculosis
cggccaccuggccggu

SEQ ID NO: 855611 - RNA, 15 nt, Mycobacterium avium subsp. paratuberculosis
cggccaccucguccc

SEQ ID NO: 855612 - RNA, 18 nt, Mycobacterium avium subsp. paratuberculosis
cggccaccucgucccagc

SEQ ID NO: 855613 - RNA, 20 nt, Mycobacterium avium subsp. paratuberculosis
cggccaccucgucccagcgc

SEQ ID NO: 855614 - RNA, 22 nt, Mycobacterium avium subsp. paratuberculosis
cggccaccucgucccagcgcaa

SEQ ID NO: 855615 - RNA, 19 nt, Mycobacterium avium subsp. paratuberculosis
cggccaccucgucggcggu

SEQ ID NO: 855616 - RNA, 23 nt, Mycobacterium avium subsp. paratuberculosis
cggccaccucgucggcggucaac

SEQ ID NO: 855617 - RNA, 14 nt, Mycobacterium avium subsp. paratuberculosis
cggccaccgcgguc

SEQ ID NO: 855618 - RNA, 17 nt, Mycobacterium avium subsp. paratuberculosis
cggccaccgucagcguc

SEQ ID NO: 855619 - RNA, 18 nt, Mycobacterium avium subsp. paratuberculosis
cggccaccgucagcguca

SEQ ID NO: 855620 - RNA, 14 nt, Mycobacterium avium subsp. paratuberculosis
cggccaccuccagc

SEQ ID NO: 855621 - RNA, 14 nt, Mycobacterium avium subsp. paratuberculosis
cggccaccucgccg

SEQ ID NO: 855622 - RNA, 16 nt, Mycobacterium avium subsp. paratuberculosis
cggccaccucgccgca

SEQ ID NO: 855623 - RNA, 19 nt, Mycobacterium avium subsp. paratuberculosis
cggccaccucgccgcaggc

SEQ ID NO: 855624 - RNA, 19 nt, Mycobacterium avium subsp. paratuberculosis
cggccaccucggcggcacc

SEQ ID NO: 855625 - RNA, 15 nt, Mycobacterium avium subsp. paratuberculosis
cggccaccgggaccg

SEQ ID NO: 855626 - RNA, 17 nt, Mycobacterium avium subsp. paratuberculosis
cggccaccgacugcgac

SEQ ID NO: 855627 - RNA, 14 nt, Mycobacterium avium subsp. paratuberculosis
cggccaccgcgacg

SEQ ID NO: 855628 - RNA, 17 nt, Mycobacterium avium subsp. paratuberculosis
cggccaccgcgacgcug

SEQ ID NO: 855629 - RNA, 20 nt, Mycobacterium avium subsp. paratuberculosis
cggccaccgcgacgcugccg

SEQ ID NO: 855630 - RNA, 21 nt, Mycobacterium avium subsp. paratuberculosis
cggccaccgcgacgcugccgg

SEQ ID NO: 855631 - RNA, 14 nt, Mycobacterium avium subsp. paratuberculosis
cggccaccgcgauc

SEQ ID NO: 855632 - RNA, 16 nt, Mycobacterium avium subsp. paratuberculosis
cggccaccgccccagc

SEQ ID NO: 855633 - RNA, 22 nt, Mycobacterium avium subsp. paratuberculosis
cggccaccgccccagccgacca

SEQ ID NO: 855634 - RNA, 12 nt, Mycobacterium avium subsp. paratuberculosis
cggccaccgccg

SEQ ID NO: 855635 - RNA, 14 nt, Mycobacterium avium subsp. paratuberculosis
cggccaccgccgcc

SEQ ID NO: 855636 - RNA, 15 nt, Mycobacterium avium subsp. paratuberculosis
cggccaccgccgcca

SEQ ID NO: 855637 - RNA, 17 nt, Mycobacterium avium subsp. paratuberculosis
cggccaccgccgccagc

SEQ ID NO: 855638 - RNA, 19 nt, Mycobacterium avium subsp. paratuberculosis
cggccaccgccgccagcag

SEQ ID NO: 855639 - RNA, 19 nt, Mycobacterium avium subsp. paratuberculosis
cggccaccgcgccccggcg

SEQ ID NO: 855640 - RNA, 20 nt, Mycobacterium avium subsp. paratuberculosis
cggccaccgcgccccggcgc

SEQ ID NO: 855641 - RNA, 21 nt, Mycobacterium avium subsp. paratuberculosis
cggccaccgcgccccggcgca

SEQ ID NO: 855642 - RNA, 14 nt, Mycobacterium avium subsp. paratuberculosis
cggccaccgcgccg

SEQ ID NO: 855643 - RNA, 18 nt, Mycobacterium avium subsp. paratuberculosis
cggccaccgcgccguggg

SEQ ID NO: 855644 - RNA, 13 nt, Mycobacterium avium subsp. paratuberculosis
cggccaccgcgcg

SEQ ID NO: 855645 - RNA, 14 nt, Mycobacterium avium subsp. paratuberculosis
cggccaccgcgcgc

SEQ ID NO: 855646 - RNA, 15 nt, Mycobacterium avium subsp. paratuberculosis
cggccaccgcgcgcu

SEQ ID NO: 855647 - RNA, 17 nt, Mycobacterium avium subsp. paratuberculosis
cggccaccgcgcggcgg

SEQ ID NO: 855648 - RNA, 21 nt, Mycobacterium avium subsp. paratuberculosis
cggccaccgcgcggcggucca

SEQ ID NO: 855649 - RNA, 16 nt, Mycobacterium avium subsp. paratuberculosis
cggccaccgcgcggug

SEQ ID NO: 855650 - RNA, 17 nt, Mycobacterium avium subsp. paratuberculosis
cggccaccgcgcggugc

SEQ ID NO: 855651 - RNA, 19 nt, Mycobacterium avium subsp. paratuberculosis
cggccaccgcggccagcug

SEQ ID NO: 855652 - RNA, 22 nt, Mycobacterium avium subsp. paratuberculosis
cggccaccgcggccagcugcga

SEQ ID NO: 855653 - RNA, 15 nt, Mycobacterium avium subsp. paratuberculosis
cggccaccggcgcga

SEQ ID NO: 855654 - RNA, 16 nt, Mycobacterium avium subsp. paratuberculosis
cggccaccggcgcgac

SEQ ID NO: 855655 - RNA, 19 nt, Mycobacterium avium subsp. paratuberculosis
cggccaccggcgcgacggc

SEQ ID NO: 855656 - RNA, 20 nt, Mycobacterium avium subsp. paratuberculosis
cggccaccggcgcgacggcg

SEQ ID NO: 855657 - RNA, 22 nt, Mycobacterium avium subsp. paratuberculosis
cggccaccggcgcgacggcggc

SEQ ID NO: 855658 - RNA, 23 nt, Mycobacterium avium subsp. paratuberculosis
cggccaccggcgcgacggcggcg

SEQ ID NO: 855659 - RNA, 15 nt, Mycobacterium avium subsp. paratuberculosis
cggcauugcagcgga

SEQ ID NO: 855660 - RNA, 18 nt, Mycobacterium avium subsp. paratuberculosis
cggccaauuccucagccc

SEQ ID NO: 855661 - RNA, 23 nt, Mycobacterium avium subsp. paratuberculosis
cggccaauuccucagcccggcag

SEQ ID NO: 855662 - RNA, 17 nt, Mycobacterium avium subsp. paratuberculosis
cggccacaccgaucagc

SEQ ID NO: 855663 - RNA, 18 nt, Mycobacterium avium subsp. paratuberculosis
cggccacaccgaucagca

SEQ ID NO: 855664 - RNA, 21 nt, Mycobacterium avium subsp. paratuberculosis
cggccacaccgaucagcaugc

SEQ ID NO: 855665 - RNA, 14 nt, Mycobacterium avium subsp. paratuberculosis
cggccacaccgggg

SEQ ID NO: 855666 - RNA, 17 nt, Mycobacterium avium subsp. paratuberculosis
cggccacaccggggcca

SEQ ID NO: 855667 - RNA, 24 nt, Mycobacterium avium subsp. paratuberculosis
cggcaucgauggcgggcgcgccgg

SEQ ID NO: 855668 - RNA, 17 nt, Mycobacterium avium subsp. paratuberculosis
cggcaucgaggaccggc

SEQ ID NO: 855669 - RNA, 18 nt, Mycobacterium avium subsp. paratuberculosis
cggcaucgaggaccggcg

SEQ ID NO: 855670 - RNA, 19 nt, Mycobacterium avium subsp. paratuberculosis
cggcaucgaggaccggcgc

SEQ ID NO: 855671 - RNA, 21 nt, Mycobacterium avium subsp. paratuberculosis
cggcaucgaggaccggcgccg

SEQ ID NO: 855672 - RNA, 22 nt, Mycobacterium avium subsp. paratuberculosis
cggcaucgaggaccggcgccgg

SEQ ID NO: 855673 - RNA, 21 nt, Mycobacterium avium subsp. paratuberculosis
cggcauggcgaacacgucggc

SEQ ID NO: 855674 - RNA, 18 nt, Mycobacterium avium subsp. paratuberculosis
cggcaucgccgccaaggg

SEQ ID NO: 855675 - RNA, 22 nt, Mycobacterium avium subsp. paratuberculosis
cggcaugucgguggacagcgcg

SEQ ID NO: 855676 - RNA, 13 nt, Mycobacterium avium subsp. paratuberculosis
cggcauggcgaug

SEQ ID NO: 855677 - RNA, 23 nt, Mycobacterium avium subsp. paratuberculosis
cggcauggcgaugaccagcgcga

SEQ ID NO: 855678 - RNA, 23 nt, Mycobacterium avium subsp. paratuberculosis
cggcauggcuggcggcaacggcc

SEQ ID NO: 855679 - RNA, 17 nt, Mycobacterium avium subsp. paratuberculosis
cggccaguucccgggcg

SEQ ID NO: 855680 - RNA, 17 nt, Mycobacterium avium subsp. paratuberculosis
cggccaguucggguccg

SEQ ID NO: 855681 - RNA, 16 nt, Mycobacterium avium subsp. paratuberculosis
cggccaguucgagcgc

SEQ ID NO: 855682 - RNA, 19 nt, Mycobacterium avium subsp. paratuberculosis
cggccaguucgagcgccgc

SEQ ID NO: 855683 - RNA, 21 nt, Mycobacterium avium subsp. paratuberculosis
cggccaguucgagcgccgcgg

SEQ ID NO: 855684 - RNA, 20 nt, Mycobacterium avium subsp. paratuberculosis
cggccaguucgccggugacc

SEQ ID NO: 855685 - RNA, 12 nt, Mycobacterium avium subsp. paratuberculosis
cggccaguucgg

SEQ ID NO: 855686 - RNA, 21 nt, Mycobacterium avium subsp. paratuberculosis
cggccaguugaaguccggcgg

SEQ ID NO: 855687 - RNA, 20 nt, Mycobacterium avium subsp. paratuberculosis
cggccagguccacaccgugg

SEQ ID NO: 855688 - RNA, 21 nt, Mycobacterium avium subsp. paratuberculosis
cggccagguccacaccgugga

SEQ ID NO: 855689 - RNA, 18 nt, Mycobacterium avium subsp. paratuberculosis
cggccaggucgacggggu

SEQ ID NO: 855690 - RNA, 23 nt, Mycobacterium avium subsp. paratuberculosis
cggccaggguagaggcggcgacc

SEQ ID NO: 855691 - RNA, 18 nt, Mycobacterium avium subsp. paratuberculosis
cggccagggugucccagc

SEQ ID NO: 855692 - RNA, 22 nt, Mycobacterium avium subsp. paratuberculosis
cggccagggugucccagcgcca

SEQ ID NO: 855693 - RNA, 15 nt, Mycobacterium avium subsp. paratuberculosis
cggccagggcggcgc

SEQ ID NO: 855694 - RNA, 16 nt, Mycobacterium avium subsp. paratuberculosis
cggccagggcggcgcc

SEQ ID NO: 855695 - RNA, 18 nt, Mycobacterium avium subsp. paratuberculosis
cggccagggcggcgccgg

SEQ ID NO: 855696 - RNA, 19 nt, Mycobacterium avium subsp. paratuberculosis
cggccagggcucgugcagc

SEQ ID NO: 855697 - RNA, 24 nt, Mycobacterium avium subsp. paratuberculosis
cggccagggcucgugcagccggcg

SEQ ID NO: 855698 - RNA, 16 nt, Mycobacterium avium subsp. paratuberculosis
cggccagggccgccgc

SEQ ID NO: 855699 - RNA, 21 nt, Mycobacterium avium subsp. paratuberculosis
cggccagggccgccgcauacc

SEQ ID NO: 855700 - RNA, 13 nt, Mycobacterium avium subsp. paratuberculosis
cggccaggcgccc

SEQ ID NO: 855701 - RNA, 14 nt, Mycobacterium avium subsp. paratuberculosis
cggccaggcgccca

SEQ ID NO: 855702 - RNA, 15 nt, Mycobacterium avium subsp. paratuberculosis
cggccaggcgcccag

SEQ ID NO: 855703 - RNA, 23 nt, Mycobacterium avium subsp. paratuberculosis
cggccaggcgcccagcacccggu

SEQ ID NO: 855704 - RNA, 23 nt, Mycobacterium avium subsp. paratuberculosis
cggccaggcgacuguccaggccg

SEQ ID NO: 855705 - RNA, 17 nt, Mycobacterium avium subsp. paratuberculosis
cggccaggccggcgacg

SEQ ID NO: 855706 - RNA, 23 nt, Mycobacterium avium subsp. paratuberculosis
cggccaggccggccugccggaug

SEQ ID NO: 855707 - RNA, 12 nt, Mycobacterium avium subsp. paratuberculosis
cggccaggccgg

SEQ ID NO: 855708 - RNA, 17 nt, Mycobacterium avium subsp. paratuberculosis
cggccauauaggggugg

SEQ ID NO: 855709 - RNA, 19 nt, Mycobacterium avium subsp. paratuberculosis
cggccauauaggggugggc

SEQ ID NO: 855710 - RNA, 16 nt, Mycobacterium avium subsp. paratuberculosis
cggccaucacggugcc

SEQ ID NO: 855711 - RNA, 14 nt, Mycobacterium avium subsp. paratuberculosis
cggccaucagcacc

SEQ ID NO: 855712 - RNA, 15 nt, Mycobacterium avium subsp. paratuberculosis
cggccaucucggcgg

SEQ ID NO: 855713 - RNA, 16 nt, Mycobacterium avium subsp. paratuberculosis
cggccaucucggcggc

SEQ ID NO: 855714 - RNA, 22 nt, Mycobacterium avium subsp. paratuberculosis
cggccaugaagccguugccgcc

SEQ ID NO: 855715 - RNA, 23 nt, Mycobacterium avium subsp. paratuberculosis
cggccaugaagccguugccgccg

SEQ ID NO: 855716 - RNA, 20 nt, Mycobacterium avium subsp. paratuberculosis
cggccaugaccaugucgacg

SEQ ID NO: 855717 - RNA, 21 nt, Mycobacterium avium subsp. paratuberculosis
cggccaucuucaguucggccg

SEQ ID NO: 855718 - RNA, 18 nt, Mycobacterium avium subsp. paratuberculosis
cggccaucugcgcgacga

SEQ ID NO: 855719 - RNA, 13 nt, Mycobacterium avium subsp. paratuberculosis
cggcccaccaccg

SEQ ID NO: 855720 - RNA, 15 nt, Mycobacterium avium subsp. paratuberculosis
cggcccaccaccgcc

SEQ ID NO: 855721 - RNA, 18 nt, Mycobacterium avium subsp. paratuberculosis
cggcccaccaccgccucg

SEQ ID NO: 855722 - RNA, 20 nt, Mycobacterium avium subsp. paratuberculosis
cggcccaccaccgccucgac

SEQ ID NO: 855723 - RNA, 18 nt, Mycobacterium avium subsp. paratuberculosis
cggcccacccgcagggcg

SEQ ID NO: 855724 - RNA, 17 nt, Mycobacterium avium subsp. paratuberculosis
cggccaugccgcgcuug

SEQ ID NO: 855725 - RNA, 15 nt, Mycobacterium avium subsp. paratuberculosis
cggccaugcccucga

SEQ ID NO: 855726 - RNA, 20 nt, Mycobacterium avium subsp. paratuberculosis
cggccaugcagaccagcccg

SEQ ID NO: 855727 - RNA, 23 nt, Mycobacterium avium subsp. paratuberculosis
cggccaugcagaccagcccgucg

SEQ ID NO: 855728 - RNA, 14 nt, Mycobacterium avium subsp. paratuberculosis
cggccccaccgccg

SEQ ID NO: 855729 - RNA, 21 nt, Mycobacterium avium subsp. paratuberculosis
cggcccaugggggaacccccu

SEQ ID NO: 855730 - RNA, 23 nt, Mycobacterium avium subsp. paratuberculosis
cggccccaaaagccuugacguag

SEQ ID NO: 855731 - RNA, 13 nt, Mycobacterium avium subsp. paratuberculosis
cggccccaacggc

SEQ ID NO: 855732 - RNA, 16 nt, Mycobacterium avium subsp. paratuberculosis
cggccccaacggcgug

SEQ ID NO: 855733 - RNA, 18 nt, Mycobacterium avium subsp. paratuberculosis
cggccccaacggcgugca

SEQ ID NO: 855734 - RNA, 14 nt, Mycobacterium avium subsp. paratuberculosis
cggcccagcaccac

SEQ ID NO: 855735 - RNA, 13 nt, Mycobacterium avium subsp. paratuberculosis
cggcccagccggc

SEQ ID NO: 855736 - RNA, 17 nt, Mycobacterium avium subsp. paratuberculosis
cggcccaucacgucggg

SEQ ID NO: 855737 - RNA, 18 nt, Mycobacterium avium subsp. paratuberculosis
cggcccagcagcgucacg

SEQ ID NO: 855738 - RNA, 22 nt, Mycobacterium avium subsp. paratuberculosis
cggcccagcagcgucacgucga

SEQ ID NO: 855739 - RNA, 14 nt, Mycobacterium avium subsp. paratuberculosis
cggcccacgucgcg

SEQ ID NO: 855740 - RNA, 17 nt, Mycobacterium avium subsp. paratuberculosis
cggcccacgucgcgccg

SEQ ID NO: 855741 - RNA, 23 nt, Mycobacterium avium subsp. paratuberculosis
cggcccagacgaugucgucgccg

SEQ ID NO: 855742 - RNA, 18 nt, Mycobacterium avium subsp. paratuberculosis
cggcccagaucgcggucc

SEQ ID NO: 855743 - RNA, 12 nt, Mycobacterium avium subsp. paratuberculosis
cggcccagcccg

SEQ ID NO: 855744 - RNA, 16 nt, Mycobacterium avium subsp. paratuberculosis
cggcccagcccggcca

SEQ ID NO: 855745 - RNA, 17 nt, Mycobacterium avium subsp. paratuberculosis
cggcccagcccggccag

SEQ ID NO: 855746 - RNA, 18 nt, Mycobacterium avium subsp. paratuberculosis
cggcccagcccggccagc

SEQ ID NO: 855747 - RNA, 20 nt, Mycobacterium avium subsp. paratuberculosis
cggcccagcccggccagcac

SEQ ID NO: 855748 - RNA, 15 nt, Mycobacterium avium subsp. paratuberculosis
cggcccacggugauu

SEQ ID NO: 855749 - RNA, 23 nt, Mycobacterium avium subsp. paratuberculosis
cggcccacggugauuccggcacc

SEQ ID NO: 855750 - RNA, 13 nt, Mycobacterium avium subsp. paratuberculosis
cggcccaccgcga

SEQ ID NO: 855751 - RNA, 15 nt, Mycobacterium avium subsp. paratuberculosis
cggcccaccgcgacc

SEQ ID NO: 855752 - RNA, 19 nt, Mycobacterium avium subsp. paratuberculosis
cggcccaccgcgacccggc

SEQ ID NO: 855753 - RNA, 22 nt, Mycobacterium avium subsp. paratuberculosis
cggcccaccgcgacccggccga

SEQ ID NO: 855754 - RNA, 13 nt, Mycobacterium avium subsp. paratuberculosis
cggccacgaucgc

SEQ ID NO: 855755 - RNA, 22 nt, Mycobacterium avium subsp. paratuberculosis
cggccacgaucgcgaucgccga

SEQ ID NO: 855756 - RNA, 18 nt, Mycobacterium avium subsp. paratuberculosis
cggccacgaucgcggcca

SEQ ID NO: 855757 - RNA, 20 nt, Mycobacterium avium subsp. paratuberculosis
cggccacgaucgcggccagc

SEQ ID NO: 855758 - RNA, 16 nt, Mycobacterium avium subsp. paratuberculosis
cggccacgcaggcguc

SEQ ID NO: 855759 - RNA, 17 nt, Mycobacterium avium subsp. paratuberculosis
cggccacgcccuggccg

SEQ ID NO: 855760 - RNA, 19 nt, Mycobacterium avium subsp. paratuberculosis
cggccacgcccuggccgcc

SEQ ID NO: 855761 - RNA, 20 nt, Mycobacterium avium subsp. paratuberculosis
cggccacgcccuggccgccg

SEQ ID NO: 855762 - RNA, 21 nt, Mycobacterium avium subsp. paratuberculosis
cggccacgcccuggccgccgg

SEQ ID NO: 855763 - RNA, 20 nt, Mycobacterium avium subsp. paratuberculosis
cggccacgaccucggggucg

SEQ ID NO: 855764 - RNA, 13 nt, Mycobacterium avium subsp. paratuberculosis
cggccacgacgcg

SEQ ID NO: 855765 - RNA, 17 nt, Mycobacterium avium subsp. paratuberculosis
cggccacgacgcggcgc

SEQ ID NO: 855766 - RNA, 18 nt, Mycobacterium avium subsp. paratuberculosis
cggccacgacgcggcgcg

SEQ ID NO: 855767 - RNA, 19 nt, Mycobacterium avium subsp. paratuberculosis
cggccacgacgcggcgcgc

SEQ ID NO: 855768 - RNA, 21 nt, Mycobacterium avium subsp. paratuberculosis
cggccacgacggcgcuggccg

SEQ ID NO: 855769 - RNA, 19 nt, Mycobacterium avium subsp. paratuberculosis
cggccacgcuagcgugacg

SEQ ID NO: 855770 - RNA, 17 nt, Mycobacterium avium subsp. paratuberculosis
cggccacgcucgccaga

SEQ ID NO: 855771 - RNA, 20 nt, Mycobacterium avium subsp. paratuberculosis
cggccacgcucgccagaccg

SEQ ID NO: 855772 - RNA, 22 nt, Mycobacterium avium subsp. paratuberculosis
cggccacgcucgccagaccggu

SEQ ID NO: 855773 - RNA, 13 nt, Mycobacterium avium subsp. paratuberculosis
cggccacgcucgg

SEQ ID NO: 855774 - RNA, 15 nt, Mycobacterium avium subsp. paratuberculosis
cggccacgcucggcg

SEQ ID NO: 855775 - RNA, 18 nt, Mycobacterium avium subsp. paratuberculosis
cggccacgcucggcggcg

SEQ ID NO: 855776 - RNA, 23 nt, Mycobacterium avium subsp. paratuberculosis
cggccacgcucggcggcgcgcag

SEQ ID NO: 855777 - RNA, 21 nt, Mycobacterium avium subsp. paratuberculosis
cggccacgcucgggccggcgc

SEQ ID NO: 855778 - RNA, 13 nt, Mycobacterium avium subsp. paratuberculosis
cggccacgucgau

SEQ ID NO: 855779 - RNA, 14 nt, Mycobacterium avium subsp. paratuberculosis
cggccacgucgaug

SEQ ID NO: 855780 - RNA, 17 nt, Mycobacterium avium subsp. paratuberculosis
cggccacgucgaugccg

SEQ ID NO: 855781 - RNA, 14 nt, Mycobacterium avium subsp. paratuberculosis
cggccacgccgggc

SEQ ID NO: 855782 - RNA, 17 nt, Mycobacterium avium subsp. paratuberculosis
cggccaccuugucggcg

SEQ ID NO: 855783 - RNA, 19 nt, Mycobacterium avium subsp. paratuberculosis
cggccaccuugucggcgcc

SEQ ID NO: 855784 - RNA, 22 nt, Mycobacterium avium subsp. paratuberculosis
cggccaccuugucggcgcccag

SEQ ID NO: 855785 - RNA, 17 nt, Mycobacterium avium subsp. paratuberculosis
cggccagcacggucagc

SEQ ID NO: 855786 - RNA, 22 nt, Mycobacterium avium subsp. paratuberculosis
cggccagcacggucagcggcca

SEQ ID NO: 855787 - RNA, 22 nt, Mycobacterium avium subsp. paratuberculosis
cggccagauagaugagccgcag

SEQ ID NO: 855788 - RNA, 14 nt, Mycobacterium avium subsp. paratuberculosis
cggccagcagcacc

SEQ ID NO: 855789 - RNA, 15 nt, Mycobacterium avium subsp. paratuberculosis
cggccagcagcacca

SEQ ID NO: 855790 - RNA, 16 nt, Mycobacterium avium subsp. paratuberculosis
cggccagcagcaccag

SEQ ID NO: 855791 - RNA, 17 nt, Mycobacterium avium subsp. paratuberculosis
cggccagcagcaccaga

SEQ ID NO: 855792 - RNA, 17 nt, Mycobacterium avium subsp. paratuberculosis
cggccagcagcaccagg

SEQ ID NO: 855793 - RNA, 20 nt, Mycobacterium avium subsp. paratuberculosis
cggccagcagcaccagggcg

SEQ ID NO: 855794 - RNA, 15 nt, Mycobacterium avium subsp. paratuberculosis
cggccagcagcaccg

SEQ ID NO: 855795 - RNA, 17 nt, Mycobacterium avium subsp. paratuberculosis
cggccagcagcaccgcg

SEQ ID NO: 855796 - RNA, 16 nt, Mycobacterium avium subsp. paratuberculosis
cggccacugccccggc

SEQ ID NO: 855797 - RNA, 11 nt, Mycobacterium avium subsp. paratuberculosis
cggccagaccg

SEQ ID NO: 855798 - RNA, 13 nt, Mycobacterium avium subsp. paratuberculosis
cggccagaccgca

SEQ ID NO: 855799 - RNA, 20 nt, Mycobacterium avium subsp. paratuberculosis
cggccagaccgcacaauccg

SEQ ID NO: 855800 - RNA, 14 nt, Mycobacterium avium subsp. paratuberculosis
cggccacucgccgc

SEQ ID NO: 855801 - RNA, 17 nt, Mycobacterium avium subsp. paratuberculosis
cggccacucgccgcgaa

SEQ ID NO: 855802 - RNA, 21 nt, Mycobacterium avium subsp. paratuberculosis
cggccacucgcguccccgcgc

SEQ ID NO: 855803 - RNA, 23 nt, Mycobacterium avium subsp. paratuberculosis
cggccacucgcguccccgcgccg

SEQ ID NO: 855804 - RNA, 12 nt, Mycobacterium avium subsp. paratuberculosis
cggccacguugc

SEQ ID NO: 855805 - RNA, 16 nt, Mycobacterium avium subsp. paratuberculosis
cggccacguugccggg

SEQ ID NO: 855806 - RNA, 17 nt, Mycobacterium avium subsp. paratuberculosis
cggccacguugccgggu

SEQ ID NO: 855807 - RNA, 17 nt, Mycobacterium avium subsp. paratuberculosis
cggccaggcccagccca

SEQ ID NO: 855808 - RNA, 17 nt, Mycobacterium avium subsp. paratuberculosis
cggccagcgguugcacg

SEQ ID NO: 855809 - RNA, 22 nt, Mycobacterium avium subsp. paratuberculosis
cggccagcgguugcacggucug

SEQ ID NO: 855810 - RNA, 23 nt, Mycobacterium avium subsp. paratuberculosis
cggccagcgguugcacggucugg

SEQ ID NO: 855811 - RNA, 14 nt, Mycobacterium avium subsp. paratuberculosis
cggccagcggcgcc

SEQ ID NO: 855812 - RNA, 15 nt, Mycobacterium avium subsp. paratuberculosis
cggccagcggcgccg

SEQ ID NO: 855813 - RNA, 14 nt, Mycobacterium avium subsp. paratuberculosis
cggccagcggcauc

SEQ ID NO: 855814 - RNA, 15 nt, Mycobacterium avium subsp. paratuberculosis
cggccagcggccagc

SEQ ID NO: 855815 - RNA, 18 nt, Mycobacterium avium subsp. paratuberculosis
cggccagcggccagcccg

SEQ ID NO: 855816 - RNA, 20 nt, Mycobacterium avium subsp. paratuberculosis
cggccagcggccagcccgcg

SEQ ID NO: 855817 - RNA, 21 nt, Mycobacterium avium subsp. paratuberculosis
cggccagcggccagcccgcgg

SEQ ID NO: 855818 - RNA, 14 nt, Mycobacterium avium subsp. paratuberculosis
cggccagcgggcgg

SEQ ID NO: 855819 - RNA, 17 nt, Mycobacterium avium subsp. paratuberculosis
cggccagcgggcggccc

SEQ ID NO: 855820 - RNA, 13 nt, Mycobacterium avium subsp. paratuberculosis
cggccagcggguc

SEQ ID NO: 855821 - RNA, 14 nt, Mycobacterium avium subsp. paratuberculosis
cggccagcggguga

SEQ ID NO: 855822 - RNA, 17 nt, Mycobacterium avium subsp. paratuberculosis
cggccagcgggugaugg

SEQ ID NO: 855823 - RNA, 22 nt, Mycobacterium avium subsp. paratuberculosis
cggccagcgggugauggccgcc

SEQ ID NO: 855824 - RNA, 23 nt, Mycobacterium avium subsp. paratuberculosis
cggccagcgggugauggccgccg

SEQ ID NO: 855825 - RNA, 12 nt, Mycobacterium avium subsp. paratuberculosis
cggccagcggca

SEQ ID NO: 855826 - RNA, 15 nt, Mycobacterium avium subsp. paratuberculosis
cggccagcggcagcg

SEQ ID NO: 855827 - RNA, 16 nt, Mycobacterium avium subsp. paratuberculosis
cggccagcggcagcgg

SEQ ID NO: 855828 - RNA, 18 nt, Mycobacterium avium subsp. paratuberculosis
cggccagcggcagcgucg

SEQ ID NO: 855829 - RNA, 17 nt, Mycobacterium avium subsp. paratuberculosis
cggccagcgcgucggcc

SEQ ID NO: 855830 - RNA, 22 nt, Mycobacterium avium subsp. paratuberculosis
cggccagcgcgucggccagcac

SEQ ID NO: 855831 - RNA, 14 nt, Mycobacterium avium subsp. paratuberculosis
cggccagcgcguga

SEQ ID NO: 855832 - RNA, 15 nt, Mycobacterium avium subsp. paratuberculosis
cggccagcgcgucgg

SEQ ID NO: 855833 - RNA, 14 nt, Mycobacterium avium subsp. paratuberculosis
cggccagcgcggug

SEQ ID NO: 855834 - RNA, 12 nt, Mycobacterium avium subsp. paratuberculosis
cggccagcgcgu

SEQ ID NO: 855835 - RNA, 20 nt, Mycobacterium avium subsp. paratuberculosis
cggccagcgcggcggccagc

SEQ ID NO: 855836 - RNA, 18 nt, Mycobacterium avium subsp. paratuberculosis
cggccagcgcggcggucg

SEQ ID NO: 855837 - RNA, 21 nt, Mycobacterium avium subsp. paratuberculosis
cggccagccccgggaaccagc

SEQ ID NO: 855838 - RNA, 16 nt, Mycobacterium avium subsp. paratuberculosis
cggccagcccgcggca

SEQ ID NO: 855839 - RNA, 18 nt, Mycobacterium avium subsp. paratuberculosis
cggccagcccgcggcagc

SEQ ID NO: 855840 - RNA, 15 nt, Mycobacterium avium subsp. paratuberculosis
cggccagccgcgcga

SEQ ID NO: 855841 - RNA, 20 nt, Mycobacterium avium subsp. paratuberculosis
cggccagccgcgcgacgccg

SEQ ID NO: 855842 - RNA, 15 nt, Mycobacterium avium subsp. paratuberculosis
cggccagccgcgcgg

SEQ ID NO: 855843 - RNA, 16 nt, Mycobacterium avium subsp. paratuberculosis
cggccagccgcgcggc

SEQ ID NO: 855844 - RNA, 17 nt, Mycobacterium avium subsp. paratuberculosis
cggccagccgcgcggcg

SEQ ID NO: 855845 - RNA, 14 nt, Mycobacterium avium subsp. paratuberculosis
cggccagccagccg

SEQ ID NO: 855846 - RNA, 14 nt, Mycobacterium avium subsp. paratuberculosis
cggccagccaggcc

SEQ ID NO: 855847 - RNA, 15 nt, Mycobacterium avium subsp. paratuberculosis
cggccagccaggccg

SEQ ID NO: 855848 - RNA, 19 nt, Mycobacterium avium subsp. paratuberculosis
cggccagccaggccgucgg

SEQ ID NO: 855849 - RNA, 21 nt, Mycobacterium avium subsp. paratuberculosis
cggccagccaggccgucggcg

SEQ ID NO: 855850 - RNA, 23 nt, Mycobacterium avium subsp. paratuberculosis
cggccagccaggccgucggcgcg

SEQ ID NO: 855851 - RNA, 14 nt, Mycobacterium avium subsp. paratuberculosis
cggccagccacgcc

SEQ ID NO: 855852 - RNA, 23 nt, Mycobacterium avium subsp. paratuberculosis
cggccagcccaucccgauccgcg

SEQ ID NO: 855853 - RNA, 13 nt, Mycobacterium avium subsp. paratuberculosis
cggccagccccac

SEQ ID NO: 855854 - RNA, 18 nt, Mycobacterium avium subsp. paratuberculosis
cggccagccccaccaccg

SEQ ID NO: 855855 - RNA, 15 nt, Mycobacterium avium subsp. paratuberculosis
cggccagccacgccg

SEQ ID NO: 855856 - RNA, 20 nt, Mycobacterium avium subsp. paratuberculosis
cggccagccacgccgacacc

SEQ ID NO: 855857 - RNA, 21 nt, Mycobacterium avium subsp. paratuberculosis
cggccagccacgccgacaccg

SEQ ID NO: 855858 - RNA, 13 nt, Mycobacterium avium subsp. paratuberculosis
cggccagcaucgg

SEQ ID NO: 855859 - RNA, 14 nt, Mycobacterium avium subsp. paratuberculosis
cggccagcaucgga

SEQ ID NO: 855860 - RNA, 14 nt, Mycobacterium avium subsp. paratuberculosis
cggccagcagcggc

SEQ ID NO: 855861 - RNA, 15 nt, Mycobacterium avium subsp. paratuberculosis
cggccagcaggucga

SEQ ID NO: 855862 - RNA, 17 nt, Mycobacterium avium subsp. paratuberculosis
cggccagcagcgcgucg

SEQ ID NO: 855863 - RNA, 17 nt, Mycobacterium avium subsp. paratuberculosis
cggccagcagggcgccg

SEQ ID NO: 855864 - RNA, 18 nt, Mycobacterium avium subsp. paratuberculosis
cggccagcagggcgccga

SEQ ID NO: 855865 - RNA, 19 nt, Mycobacterium avium subsp. paratuberculosis
cggccagcagggcgccgac

SEQ ID NO: 855866 - RNA, 20 nt, Mycobacterium avium subsp. paratuberculosis
cggccagcagggcgccgacg

SEQ ID NO: 855867 - RNA, 20 nt, Mycobacterium avium subsp. paratuberculosis
cggccagcaggaugaugacc

SEQ ID NO: 855868 - RNA, 13 nt, Mycobacterium avium subsp. paratuberculosis
cggccagcagccg

SEQ ID NO: 855869 - RNA, 18 nt, Mycobacterium avium subsp. paratuberculosis
cggccagcagccgcucgu

SEQ ID NO: 855870 - RNA, 15 nt, Mycobacterium avium subsp. paratuberculosis
cggccagcagccggu

SEQ ID NO: 855871 - RNA, 14 nt, Mycobacterium avium subsp. paratuberculosis
cggccagcagcagc

SEQ ID NO: 855872 - RNA, 21 nt, Mycobacterium avium subsp. paratuberculosis
cggccagcagcagcccgccga

SEQ ID NO: 855873 - RNA, 15 nt, Mycobacterium avium subsp. paratuberculosis
cggccguugcgggug

SEQ ID NO: 855874 - RNA, 19 nt, Mycobacterium avium subsp. paratuberculosis
cggccguugggccagcggc

SEQ ID NO: 855875 - RNA, 18 nt, Mycobacterium avium subsp. paratuberculosis
cggccuaggacgccgccc

SEQ ID NO: 855876 - RNA, 22 nt, Mycobacterium avium subsp. paratuberculosis
cggccucaguccgacgcgacgg

SEQ ID NO: 855877 - RNA, 13 nt, Mycobacterium avium subsp. paratuberculosis
cggccucaccgcg

SEQ ID NO: 855878 - RNA, 16 nt, Mycobacterium avium subsp. paratuberculosis
cggccucaggcgucgg

SEQ ID NO: 855879 - RNA, 19 nt, Mycobacterium avium subsp. paratuberculosis
cggccucaggcgucgguca

SEQ ID NO: 855880 - RNA, 16 nt, Mycobacterium avium subsp. paratuberculosis
cggccuccgcgcgcgg

SEQ ID NO: 855881 - RNA, 19 nt, Mycobacterium avium subsp. paratuberculosis
cggccuccgcgcgcggccc

SEQ ID NO: 855882 - RNA, 21 nt, Mycobacterium avium subsp. paratuberculosis
cggccucccgguaggcggcga

SEQ ID NO: 855883 - RNA, 19 nt, Mycobacterium avium subsp. paratuberculosis
cggccuccgagcggcgcag

SEQ ID NO: 855884 - RNA, 12 nt, Mycobacterium avium subsp. paratuberculosis
cggccuccgcca

SEQ ID NO: 855885 - RNA, 16 nt, Mycobacterium avium subsp. paratuberculosis
cggccuccagccgcuc

SEQ ID NO: 855886 - RNA, 17 nt, Mycobacterium avium subsp. paratuberculosis
cggccuccagccggcgg

SEQ ID NO: 855887 - RNA, 21 nt, Mycobacterium avium subsp. paratuberculosis
cggccucccacucgucgaucg

SEQ ID NO: 855888 - RNA, 23 nt, Mycobacterium avium subsp. paratuberculosis
cggccucccacucgucgaucgac

SEQ ID NO: 855889 - RNA, 18 nt, Mycobacterium avium subsp. paratuberculosis
cggccguucuugcgggug

SEQ ID NO: 855890 - RNA, 19 nt, Mycobacterium avium subsp. paratuberculosis
cggccguucuugcggguga

SEQ ID NO: 855891 - RNA, 18 nt, Mycobacterium avium subsp. paratuberculosis
cggccguucgccggccag

SEQ ID NO: 855892 - RNA, 21 nt, Mycobacterium avium subsp. paratuberculosis
cggccguucgccggccagcac

SEQ ID NO: 855893 - RNA, 22 nt, Mycobacterium avium subsp. paratuberculosis
cggccguucgccggccagcacg

SEQ ID NO: 855894 - RNA, 16 nt, Mycobacterium avium subsp. paratuberculosis
cggccguguacagcag

SEQ ID NO: 855895 - RNA, 22 nt, Mycobacterium avium subsp. paratuberculosis
cggccguguacagcagggucga

SEQ ID NO: 855896 - RNA, 20 nt, Mycobacterium avium subsp. paratuberculosis
cggccguggcgaacucgacg

SEQ ID NO: 855897 - RNA, 14 nt, Mycobacterium avium subsp. paratuberculosis
cggccgugcgcguc

SEQ ID NO: 855898 - RNA, 18 nt, Mycobacterium avium subsp. paratuberculosis
cggccgugcgcgucgaca

SEQ ID NO: 855899 - RNA, 20 nt, Mycobacterium avium subsp. paratuberculosis
cggccgugcgcgucgacacc

SEQ ID NO: 855900 - RNA, 21 nt, Mycobacterium avium subsp. paratuberculosis
cggccgugcgcgucgacaccc

SEQ ID NO: 855901 - RNA, 15 nt, Mycobacterium avium subsp. paratuberculosis
cggccgugccggcuc

SEQ ID NO: 855902 - RNA, 19 nt, Mycobacterium avium subsp. paratuberculosis
cggccgugccggcucggcg

SEQ ID NO: 855903 - RNA, 20 nt, Mycobacterium avium subsp. paratuberculosis
cggccgugccggcucggcgg

SEQ ID NO: 855904 - RNA, 21 nt, Mycobacterium avium subsp. paratuberculosis
cggccgugccggcucggcggc

SEQ ID NO: 855905 - RNA, 15 nt, Mycobacterium avium subsp. paratuberculosis
cggccgugccguggu

SEQ ID NO: 855906 - RNA, 18 nt, Mycobacterium avium subsp. paratuberculosis
cggccgugccguggucgg

SEQ ID NO: 855907 - RNA, 22 nt, Mycobacterium avium subsp. paratuberculosis
cggccgugccguggucggugcc

SEQ ID NO: 855908 - RNA, 19 nt, Mycobacterium avium subsp. paratuberculosis
cggccgucgucgugcacca

SEQ ID NO: 855909 - RNA, 22 nt, Mycobacterium avium subsp. paratuberculosis
cggccgugaguguugaagccgc

SEQ ID NO: 855910 - RNA, 19 nt, Mycobacterium avium subsp. paratuberculosis
cggccgugaucucgugccg

SEQ ID NO: 855911 - RNA, 21 nt, Mycobacterium avium subsp. paratuberculosis
cggccgugaucucgugccgca

SEQ ID NO: 855912 - RNA, 23 nt, Mycobacterium avium subsp. paratuberculosis
cggccgugaucucgugccgcacc

SEQ ID NO: 855913 - RNA, 14 nt, Mycobacterium avium subsp. paratuberculosis
cggccgugaugccg

SEQ ID NO: 855914 - RNA, 17 nt, Mycobacterium avium subsp. paratuberculosis
cggccgugaugccgggc

SEQ ID NO: 855915 - RNA, 19 nt, Mycobacterium avium subsp. paratuberculosis
cggccgugaugccgggcaa

SEQ ID NO: 855916 - RNA, 14 nt, Mycobacterium avium subsp. paratuberculosis
cggccgugaugcgc

SEQ ID NO: 855917 - RNA, 21 nt, Mycobacterium avium subsp. paratuberculosis
cggccgugaugcgccggcggu

SEQ ID NO: 855918 - RNA, 20 nt, Mycobacterium avium subsp. paratuberculosis
cggccgucuugcccggcgag

SEQ ID NO: 855919 - RNA, 21 nt, Mycobacterium avium subsp. paratuberculosis
cggccgucuugcccggcgagc

SEQ ID NO: 855920 - RNA, 22 nt, Mycobacterium avium subsp. paratuberculosis
cggccgucuugcccggcgagcg

SEQ ID NO: 855921 - RNA, 14 nt, Mycobacterium avium subsp. paratuberculosis
cggccgucggcgcc

SEQ ID NO: 855922 - RNA, 16 nt, Mycobacterium avium subsp. paratuberculosis
cggccgucggcgccgc

SEQ ID NO: 855923 - RNA, 21 nt, Mycobacterium avium subsp. paratuberculosis
cggccgucggcgccgccgagc

SEQ ID NO: 855924 - RNA, 15 nt, Mycobacterium avium subsp. paratuberculosis
cggccgucgcgcacc

SEQ ID NO: 855925 - RNA, 13 nt, Mycobacterium avium subsp. paratuberculosis
cggccgucgccgg

SEQ ID NO: 855926 - RNA, 16 nt, Mycobacterium avium subsp. paratuberculosis
cggccgucgccgggcg

SEQ ID NO: 855927 - RNA, 18 nt, Mycobacterium avium subsp. paratuberculosis
cggccgucgcgcaccacc

SEQ ID NO: 855928 - RNA, 14 nt, Mycobacterium avium subsp. paratuberculosis
cggccgucgcggcg

SEQ ID NO: 855929 - RNA, 21 nt, Mycobacterium avium subsp. paratuberculosis
cggccgucgcggcgaucgcga

SEQ ID NO: 855930 - RNA, 16 nt, Mycobacterium avium subsp. paratuberculosis
cggccguaucggccaa

SEQ ID NO: 855931 - RNA, 18 nt, Mycobacterium avium subsp. paratuberculosis
cggccgucaggaacgccg

SEQ ID NO: 855932 - RNA, 15 nt, Mycobacterium avium subsp. paratuberculosis
cggccguccaccacc

SEQ ID NO: 855933 - RNA, 15 nt, Mycobacterium avium subsp. paratuberculosis
cggccguccacggcg

SEQ ID NO: 855934 - RNA, 17 nt, Mycobacterium avium subsp. paratuberculosis
cggccguccacggcggu

SEQ ID NO: 855935 - RNA, 16 nt, Mycobacterium avium subsp. paratuberculosis
cggccguccagcgucu

SEQ ID NO: 855936 - RNA, 19 nt, Mycobacterium avium subsp. paratuberculosis
cggccguccagcgucuggc

SEQ ID NO: 855937 - RNA, 23 nt, Mycobacterium avium subsp. paratuberculosis
cggccguccaggcgccauugucg

SEQ ID NO: 855938 - RNA, 13 nt, Mycobacterium avium subsp. paratuberculosis
cggccgucacgcu

SEQ ID NO: 855939 - RNA, 16 nt, Mycobacterium avium subsp. paratuberculosis
cggccgucacgcuggc

SEQ ID NO: 855940 - RNA, 12 nt, Mycobacterium avium subsp. paratuberculosis
cggccgguuggc

SEQ ID NO: 855941 - RNA, 14 nt, Mycobacterium avium subsp. paratuberculosis
cggccguaccggcg

SEQ ID NO: 855942 - RNA, 17 nt, Mycobacterium avium subsp. paratuberculosis
cggccguaccggcguac

SEQ ID NO: 855943 - RNA, 17 nt, Mycobacterium avium subsp. paratuberculosis
cggccguagccggaccg

SEQ ID NO: 855944 - RNA, 15 nt, Mycobacterium avium subsp. paratuberculosis
cggccguagccguag

SEQ ID NO: 855945 - RNA, 22 nt, Mycobacterium avium subsp. paratuberculosis
cggccguagcguugccggccga

SEQ ID NO: 855946 - RNA, 14 nt, Mycobacterium avium subsp. paratuberculosis
cggccgguuccacg

SEQ ID NO: 855947 - RNA, 23 nt, Mycobacterium avium subsp. paratuberculosis
cggccgguggccggugggcggcg

SEQ ID NO: 855948 - RNA, 14 nt, Mycobacterium avium subsp. paratuberculosis
cggccggucgccga

SEQ ID NO: 855949 - RNA, 15 nt, Mycobacterium avium subsp. paratuberculosis
cggccggugcgcguc

SEQ ID NO: 855950 - RNA, 23 nt, Mycobacterium avium subsp. paratuberculosis
cggccggugcgcgucagccgucg

SEQ ID NO: 855951 - RNA, 16 nt, Mycobacterium avium subsp. paratuberculosis
cggccggugccacggu

SEQ ID NO: 855952 - RNA, 12 nt, Mycobacterium avium subsp. paratuberculosis
cggccggugacu

SEQ ID NO: 855953 - RNA, 22 nt, Mycobacterium avium subsp. paratuberculosis
cggccggugacuccuccucggc

SEQ ID NO: 855954 - RNA, 14 nt, Mycobacterium avium subsp. paratuberculosis
cggccggugaucgg

SEQ ID NO: 855955 - RNA, 14 nt, Mycobacterium avium subsp. paratuberculosis
cggccgguccgccc

SEQ ID NO: 855956 - RNA, 18 nt, Mycobacterium avium subsp. paratuberculosis
cggccgguccgugcacgg

SEQ ID NO: 855957 - RNA, 18 nt, Mycobacterium avium subsp. paratuberculosis
cggccgguccucugcgac

SEQ ID NO: 855958 - RNA, 21 nt, Mycobacterium avium subsp. paratuberculosis
cggccgguccucugcgaccac

SEQ ID NO: 855959 - RNA, 23 nt, Mycobacterium avium subsp. paratuberculosis
cggccgguccucugcgaccaccc

SEQ ID NO: 855960 - RNA, 17 nt, Mycobacterium avium subsp. paratuberculosis
cggccgggucgcaggca

SEQ ID NO: 855961 - RNA, 13 nt, Mycobacterium avium subsp. paratuberculosis
cggccggggcgac

SEQ ID NO: 855962 - RNA, 15 nt, Mycobacterium avium subsp. paratuberculosis
cggccgggucacgug

SEQ ID NO: 855963 - RNA, 17 nt, Mycobacterium avium subsp. paratuberculosis
cggccgggucaggaaca

SEQ ID NO: 855964 - RNA, 20 nt, Mycobacterium avium subsp. paratuberculosis
cggccgggucgaccgcgaug

SEQ ID NO: 855965 - RNA, 21 nt, Mycobacterium avium subsp. paratuberculosis
cggccgggucgagcgcgccga

SEQ ID NO: 855966 - RNA, 18 nt, Mycobacterium avium subsp. paratuberculosis
cggccggggccagcaccc

SEQ ID NO: 855967 - RNA, 19 nt, Mycobacterium avium subsp. paratuberculosis
cggccggggccagcaccca

SEQ ID NO: 855968 - RNA, 14 nt, Mycobacterium avium subsp. paratuberculosis
cggccggggcggcg

SEQ ID NO: 855969 - RNA, 15 nt, Mycobacterium avium subsp. paratuberculosis
cggccggggcggcgg

SEQ ID NO: 855970 - RNA, 20 nt, Mycobacterium avium subsp. paratuberculosis
cggccggggcggcgguaccg

SEQ ID NO: 855971 - RNA, 17 nt, Mycobacterium avium subsp. paratuberculosis
cggccggggcgggcacg

SEQ ID NO: 855972 - RNA, 20 nt, Mycobacterium avium subsp. paratuberculosis
cggccggggcgggcacgucg

SEQ ID NO: 855973 - RNA, 14 nt, Mycobacterium avium subsp. paratuberculosis
cggccgggggcgcg

SEQ ID NO: 855974 - RNA, 16 nt, Mycobacterium avium subsp. paratuberculosis
cggccgggggcgcggg

SEQ ID NO: 855975 - RNA, 18 nt, Mycobacterium avium subsp. paratuberculosis
cggccgggggcgcgggcg

SEQ ID NO: 855976 - RNA, 13 nt, Mycobacterium avium subsp. paratuberculosis
cggccucgccggc

SEQ ID NO: 855977 - RNA, 17 nt, Mycobacterium avium subsp. paratuberculosis
cggccugagacgacgcc

SEQ ID NO: 855978 - RNA, 18 nt, Mycobacterium avium subsp. paratuberculosis
cggccugagacgacgcca

SEQ ID NO: 855979 - RNA, 20 nt, Mycobacterium avium subsp. paratuberculosis
cggccugagacgacgccacc

SEQ ID NO: 855980 - RNA, 14 nt, Mycobacterium avium subsp. paratuberculosis
cggccugcacgucg

SEQ ID NO: 855981 - RNA, 19 nt, Mycobacterium avium subsp. paratuberculosis
cggccugcacgucggcgcg

SEQ ID NO: 855982 - RNA, 21 nt, Mycobacterium avium subsp. paratuberculosis
cggccugcacgucggcgcgca

SEQ ID NO: 855983 - RNA, 22 nt, Mycobacterium avium subsp. paratuberculosis
cggccugcacgucggcgcgcag

SEQ ID NO: 855984 - RNA, 19 nt, Mycobacterium avium subsp. paratuberculosis
cggccugcaccucgggaug

SEQ ID NO: 855985 - RNA, 16 nt, Mycobacterium avium subsp. paratuberculosis
cggccugcacaggggc

SEQ ID NO: 855986 - RNA, 14 nt, Mycobacterium avium subsp. paratuberculosis
cggccugcaccacc

SEQ ID NO: 855987 - RNA, 19 nt, Mycobacterium avium subsp. paratuberculosis
cggccugcaccaccacacc

SEQ ID NO: 855988 - RNA, 18 nt, Mycobacterium avium subsp. paratuberculosis
cggccucgucgacgucgg

SEQ ID NO: 855989 - RNA, 23 nt, Mycobacterium avium subsp. paratuberculosis
cggccucgucgacgucggggaug

SEQ ID NO: 855990 - RNA, 13 nt, Mycobacterium avium subsp. paratuberculosis
cggccucgucgag

SEQ ID NO: 855991 - RNA, 14 nt, Mycobacterium avium subsp. paratuberculosis
cggccucgucgagg

SEQ ID NO: 855992 - RNA, 17 nt, Mycobacterium avium subsp. paratuberculosis
cggccucgucgagguac

SEQ ID NO: 855993 - RNA, 15 nt, Mycobacterium avium subsp. paratuberculosis
cggccucggcggccg

SEQ ID NO: 855994 - RNA, 16 nt, Mycobacterium avium subsp. paratuberculosis
cggccucggcggccgg

SEQ ID NO: 855995 - RNA, 14 nt, Mycobacterium avium subsp. paratuberculosis
cggccucgucggcg

SEQ ID NO: 855996 - RNA, 17 nt, Mycobacterium avium subsp. paratuberculosis
cggccucgucggcgagc

SEQ ID NO: 855997 - RNA, 20 nt, Mycobacterium avium subsp. paratuberculosis
cggccucgugcaaggccugc

SEQ ID NO: 855998 - RNA, 23 nt, Mycobacterium avium subsp. paratuberculosis
cggccucgugcaaggccugcgcc

SEQ ID NO: 855999 - RNA, 21 nt, Mycobacterium avium subsp. paratuberculosis
cggccucguugaccgggucgc

SEQ ID NO: 856000 - RNA, 19 nt, Mycobacterium avium subsp. paratuberculosis
cggccucucagcgcugucg

SEQ ID NO: 856001 - RNA, 22 nt, Mycobacterium avium subsp. paratuberculosis
cggccucggugcucaucagcga

SEQ ID NO: 856002 - RNA, 13 nt, Mycobacterium avium subsp. paratuberculosis
cggccucggcacc

SEQ ID NO: 856003 - RNA, 14 nt, Mycobacterium avium subsp. paratuberculosis
cggccucggcaccg

SEQ ID NO: 856004 - RNA, 17 nt, Mycobacterium avium subsp. paratuberculosis
cggccucggcaccgugc

SEQ ID NO: 856005 - RNA, 14 nt, Mycobacterium avium subsp. paratuberculosis
cggccucggcggug

SEQ ID NO: 856006 - RNA, 15 nt, Mycobacterium avium subsp. paratuberculosis
cggccucggcggugg

SEQ ID NO: 856007 - RNA, 18 nt, Mycobacterium avium subsp. paratuberculosis
cggccucggcgguggccu

SEQ ID NO: 856008 - RNA, 14 nt, Mycobacterium avium subsp. paratuberculosis
cggccucggcgucc

SEQ ID NO: 856009 - RNA, 15 nt, Mycobacterium avium subsp. paratuberculosis
cggccucggcguccg

SEQ ID NO: 856010 - RNA, 20 nt, Mycobacterium avium subsp. paratuberculosis
cggccucggcguccgcggcg

SEQ ID NO: 856011 - RNA, 17 nt, Mycobacterium avium subsp. paratuberculosis
cggccucggcgucgaag

SEQ ID NO: 856012 - RNA, 16 nt, Mycobacterium avium subsp. paratuberculosis
cggccucgccgucgcg

SEQ ID NO: 856013 - RNA, 14 nt, Mycobacterium avium subsp. paratuberculosis
cggccucgccggcg

SEQ ID NO: 856014 - RNA, 16 nt, Mycobacterium avium subsp. paratuberculosis
cggccucgccggcgcc

SEQ ID NO: 856015 - RNA, 13 nt, Mycobacterium avium subsp. paratuberculosis
cggccucgcccag

SEQ ID NO: 856016 - RNA, 14 nt, Mycobacterium avium subsp. paratuberculosis
cggccucgcccagc

SEQ ID NO: 856017 - RNA, 21 nt, Mycobacterium avium subsp. paratuberculosis
cggccucgcccagcgccgcgg

SEQ ID NO: 856018 - RNA, 22 nt, Mycobacterium avium subsp. paratuberculosis
cggccucgcccagcgccgcggc

SEQ ID NO: 856019 - RNA, 22 nt, Mycobacterium avium subsp. paratuberculosis
cggccucgaucaucaccaccgc

SEQ ID NO: 856020 - RNA, 21 nt, Mycobacterium avium subsp. paratuberculosis
cggccucgaugucgucgauga

SEQ ID NO: 856021 - RNA, 21 nt, Mycobacterium avium subsp. paratuberculosis
cggccuccggauggcggucgc

SEQ ID NO: 856022 - RNA, 15 nt, Mycobacterium avium subsp. paratuberculosis
cggccuccuccucgc

SEQ ID NO: 856023 - RNA, 17 nt, Mycobacterium avium subsp. paratuberculosis
cggccuccuccucgcug

SEQ ID NO: 856024 - RNA, 14 nt, Mycobacterium avium subsp. paratuberculosis
cggccucgaagcug

SEQ ID NO: 856025 - RNA, 14 nt, Mycobacterium avium subsp. paratuberculosis
cggccugccggccg

SEQ ID NO: 856026 - RNA, 13 nt, Mycobacterium avium subsp. paratuberculosis
cggccuggggggc

SEQ ID NO: 856027 - RNA, 17 nt, Mycobacterium avium subsp. paratuberculosis
cggccugccggaugccg

SEQ ID NO: 856028 - RNA, 22 nt, Mycobacterium avium subsp. paratuberculosis
cggccugccggaugccgcgcgg

SEQ ID NO: 856029 - RNA, 14 nt, Mycobacterium avium subsp. paratuberculosis
cggccugcccgccg

SEQ ID NO: 856030 - RNA, 19 nt, Mycobacterium avium subsp. paratuberculosis
cggccugcccgccgcggcc

SEQ ID NO: 856031 - RNA, 13 nt, Mycobacterium avium subsp. paratuberculosis
cggccugcccgcg

SEQ ID NO: 856032 - RNA, 14 nt, Mycobacterium avium subsp. paratuberculosis
cggccugcccgcgg

SEQ ID NO: 856033 - RNA, 16 nt, Mycobacterium avium subsp. paratuberculosis
cggccugcccgcgggu

SEQ ID NO: 856034 - RNA, 14 nt, Mycobacterium avium subsp. paratuberculosis
cggccugccaccgc

SEQ ID NO: 856035 - RNA, 15 nt, Mycobacterium avium subsp. paratuberculosis
cggccugccaccgcg

SEQ ID NO: 856036 - RNA, 17 nt, Mycobacterium avium subsp. paratuberculosis
cggccugcagcaccgaa

SEQ ID NO: 856037 - RNA, 14 nt, Mycobacterium avium subsp. paratuberculosis
cggccugcagcgcg

SEQ ID NO: 856038 - RNA, 16 nt, Mycobacterium avium subsp. paratuberculosis
cggccugcagcgcggu

SEQ ID NO: 856039 - RNA, 17 nt, Mycobacterium avium subsp. paratuberculosis
cggccugcagcgcgguc

SEQ ID NO: 856040 - RNA, 18 nt, Mycobacterium avium subsp. paratuberculosis
cggccugcagcgcgguca

SEQ ID NO: 856041 - RNA, 21 nt, Mycobacterium avium subsp. paratuberculosis
cggccugucaacgagacaccc

SEQ ID NO: 856042 - RNA, 17 nt, Mycobacterium avium subsp. paratuberculosis
cggccugggugaccgag

SEQ ID NO: 856043 - RNA, 23 nt, Mycobacterium avium subsp. paratuberculosis
cggccugggugaccgagucgucg

SEQ ID NO: 856044 - RNA, 17 nt, Mycobacterium avium subsp. paratuberculosis
cggccugguacagcacc

SEQ ID NO: 856045 - RNA, 18 nt, Mycobacterium avium subsp. paratuberculosis
cggccugguacagcaccg

SEQ ID NO: 856046 - RNA, 21 nt, Mycobacterium avium subsp. paratuberculosis
cggccugguacagcaccgccg

SEQ ID NO: 856047 - RNA, 22 nt, Mycobacterium avium subsp. paratuberculosis
cggccugguacagcaccgccgc

SEQ ID NO: 856048 - RNA, 18 nt, Mycobacterium avium subsp. paratuberculosis
cggccuucucgcgcaccg

SEQ ID NO: 856049 - RNA, 19 nt, Mycobacterium avium subsp. paratuberculosis
cggccuucucgcgcaccgc

SEQ ID NO: 856050 - RNA, 20 nt, Mycobacterium avium subsp. paratuberculosis
cggccuucucgcgcaccgcg

SEQ ID NO: 856051 - RNA, 19 nt, Mycobacterium avium subsp. paratuberculosis
cggccuucuuggccggagc

SEQ ID NO: 856052 - RNA, 21 nt, Mycobacterium avium subsp. paratuberculosis
cggccuugaacgcguccgacg

SEQ ID NO: 856053 - RNA, 15 nt, Mycobacterium avium subsp. paratuberculosis
cggccuugaccacgg

SEQ ID NO: 856054 - RNA, 17 nt, Mycobacterium avium subsp. paratuberculosis
cggccuugaccaggaug

SEQ ID NO: 856055 - RNA, 15 nt, Mycobacterium avium subsp. paratuberculosis
cggccuucgccucgu

SEQ ID NO: 856056 - RNA, 15 nt, Mycobacterium avium subsp. paratuberculosis
cggccuucggggugg

SEQ ID NO: 856057 - RNA, 23 nt, Mycobacterium avium subsp. paratuberculosis
cggccuuacgcugcgcgaccugc

SEQ ID NO: 856058 - RNA, 19 nt, Mycobacterium avium subsp. paratuberculosis
cggccuucagcguccacga

SEQ ID NO: 856059 - RNA, 22 nt, Mycobacterium avium subsp. paratuberculosis
cggccuucagugaaccccgggc

SEQ ID NO: 856060 - RNA, 21 nt, Mycobacterium avium subsp. paratuberculosis
cggccggggaguucgcgguug

SEQ ID NO: 856061 - RNA, 15 nt, Mycobacterium avium subsp. paratuberculosis
cggccggggcagacc

SEQ ID NO: 856062 - RNA, 14 nt, Mycobacterium avium subsp. paratuberculosis
cggccgggccgcgg

SEQ ID NO: 856063 - RNA, 15 nt, Mycobacterium avium subsp. paratuberculosis
cggccgggccgcggc

SEQ ID NO: 856064 - RNA, 16 nt, Mycobacterium avium subsp. paratuberculosis
cggccgggccgcggcg

SEQ ID NO: 856065 - RNA, 17 nt, Mycobacterium avium subsp. paratuberculosis
cggccgggccgcggcgg

SEQ ID NO: 856066 - RNA, 15 nt, Mycobacterium avium subsp. paratuberculosis
cggccgggccggaac

SEQ ID NO: 856067 - RNA, 14 nt, Mycobacterium avium subsp. paratuberculosis
cggccgggccggcg

SEQ ID NO: 856068 - RNA, 20 nt, Mycobacterium avium subsp. paratuberculosis
cggccgggcggacggcaccg

SEQ ID NO: 856069 - RNA, 18 nt, Mycobacterium avium subsp. paratuberculosis
cggccgggcggccggagc

SEQ ID NO: 856070 - RNA, 21 nt, Mycobacterium avium subsp. paratuberculosis
cggccgggcgggggcugucca

SEQ ID NO: 856071 - RNA, 13 nt, Mycobacterium avium subsp. paratuberculosis
cggccgggcccuc

SEQ ID NO: 856072 - RNA, 14 nt, Mycobacterium avium subsp. paratuberculosis
cggccgggaucugg

SEQ ID NO: 856073 - RNA, 16 nt, Mycobacterium avium subsp. paratuberculosis
cggccgggaugccgcc

SEQ ID NO: 856074 - RNA, 17 nt, Mycobacterium avium subsp. paratuberculosis
cggccgggaugccgccg

SEQ ID NO: 856075 - RNA, 20 nt, Mycobacterium avium subsp. paratuberculosis
cggccgggaugccgccgguc

SEQ ID NO: 856076 - RNA, 21 nt, Mycobacterium avium subsp. paratuberculosis
cggccgggaugccgccgguca

SEQ ID NO: 856077 - RNA, 22 nt, Mycobacterium avium subsp. paratuberculosis
cggccgggaugccgccggucac

SEQ ID NO: 856078 - RNA, 19 nt, Mycobacterium avium subsp. paratuberculosis
cggccgggauuucccgggc

SEQ ID NO: 856079 - RNA, 23 nt, Mycobacterium avium subsp. paratuberculosis
cggccgggauuucccgggcgauc

SEQ ID NO: 856080 - RNA, 17 nt, Mycobacterium avium subsp. paratuberculosis
cggccgggacgcggucc

SEQ ID NO: 856081 - RNA, 21 nt, Mycobacterium avium subsp. paratuberculosis
cggccgggaaacccucgacgc

SEQ ID NO: 856082 - RNA, 23 nt, Mycobacterium avium subsp. paratuberculosis
cggccgggaaacccucgacgccg

SEQ ID NO: 856083 - RNA, 16 nt, Mycobacterium avium subsp. paratuberculosis
cggccggcugcagccg

SEQ ID NO: 856084 - RNA, 17 nt, Mycobacterium avium subsp. paratuberculosis
cggccggcugcagccgg

SEQ ID NO: 856085 - RNA, 23 nt, Mycobacterium avium subsp. paratuberculosis
cggccggcugcagccgggcggcg

SEQ ID NO: 856086 - RNA, 13 nt, Mycobacterium avium subsp. paratuberculosis
cggccggcggugu

SEQ ID NO: 856087 - RNA, 14 nt, Mycobacterium avium subsp. paratuberculosis
cggccggcgguguc

SEQ ID NO: 856088 - RNA, 15 nt, Mycobacterium avium subsp. paratuberculosis
cggccggcggugucg

SEQ ID NO: 856089 - RNA, 16 nt, Mycobacterium avium subsp. paratuberculosis
cggccggcggugucgu

SEQ ID NO: 856090 - RNA, 14 nt, Mycobacterium avium subsp. paratuberculosis
cggccggcgucacu

SEQ ID NO: 856091 - RNA, 15 nt, Mycobacterium avium subsp. paratuberculosis
cggccggcgucacuc

SEQ ID NO: 856092 - RNA, 19 nt, Mycobacterium avium subsp. paratuberculosis
cggccggcgucacucuggc

SEQ ID NO: 856093 - RNA, 12 nt, Mycobacterium avium subsp. paratuberculosis
cggccggcggcg

SEQ ID NO: 856094 - RNA, 12 nt, Mycobacterium avium subsp. paratuberculosis
cggccggcgugg

SEQ ID NO: 856095 - RNA, 15 nt, Mycobacterium avium subsp. paratuberculosis
cggccggcggcgguu

SEQ ID NO: 856096 - RNA, 18 nt, Mycobacterium avium subsp. paratuberculosis
cggccggcggcgucguga

SEQ ID NO: 856097 - RNA, 20 nt, Mycobacterium avium subsp. paratuberculosis
cggccggcggcgucgugacc

SEQ ID NO: 856098 - RNA, 16 nt, Mycobacterium avium subsp. paratuberculosis
cggccggcgcggcggc

SEQ ID NO: 856099 - RNA, 18 nt, Mycobacterium avium subsp. paratuberculosis
cggccggcgcggcggcga

SEQ ID NO: 856100 - RNA, 19 nt, Mycobacterium avium subsp. paratuberculosis
cggccggcggacgcggcca

SEQ ID NO: 856101 - RNA, 22 nt, Mycobacterium avium subsp. paratuberculosis
cggccggcggacgcggccagcg

SEQ ID NO: 856102 - RNA, 11 nt, Mycobacterium avium subsp. paratuberculosis
cggccggcggc

SEQ ID NO: 856103 - RNA, 21 nt, Mycobacterium avium subsp. paratuberculosis
cggccggcggcaguccggcga

SEQ ID NO: 856104 - RNA, 22 nt, Mycobacterium avium subsp. paratuberculosis
cggccggcggcaguccggcgag

SEQ ID NO: 856105 - RNA, 12 nt, Mycobacterium avium subsp. paratuberculosis
cggccggcgcgg

SEQ ID NO: 856106 - RNA, 14 nt, Mycobacterium avium subsp. paratuberculosis
cggccggcgcggcg

SEQ ID NO: 856107 - RNA, 14 nt, Mycobacterium avium subsp. paratuberculosis
cggccggcgccgcc

SEQ ID NO: 856108 - RNA, 15 nt, Mycobacterium avium subsp. paratuberculosis
cggccggcgccggcg

SEQ ID NO: 856109 - RNA, 16 nt, Mycobacterium avium subsp. paratuberculosis
cggccggcgccggcgg

SEQ ID NO: 856110 - RNA, 14 nt, Mycobacterium avium subsp. paratuberculosis
cggccggcgcgacc

SEQ ID NO: 856111 - RNA, 15 nt, Mycobacterium avium subsp. paratuberculosis
cggccggcgcgacca

SEQ ID NO: 856112 - RNA, 16 nt, Mycobacterium avium subsp. paratuberculosis
cggccggcgcgaccag

SEQ ID NO: 856113 - RNA, 17 nt, Mycobacterium avium subsp. paratuberculosis
cggccggcgcgaccagc

SEQ ID NO: 856114 - RNA, 18 nt, Mycobacterium avium subsp. paratuberculosis
cggccggcgcgaccagcg

SEQ ID NO: 856115 - RNA, 16 nt, Mycobacterium avium subsp. paratuberculosis
cggccggcgcgcacgg

SEQ ID NO: 856116 - RNA, 20 nt, Mycobacterium avium subsp. paratuberculosis
cggccggcgcgcacggcagc

SEQ ID NO: 856117 - RNA, 16 nt, Mycobacterium avium subsp. paratuberculosis
cggccggauggccagc

SEQ ID NO: 856118 - RNA, 17 nt, Mycobacterium avium subsp. paratuberculosis
cggccggauggccagca

SEQ ID NO: 856119 - RNA, 20 nt, Mycobacterium avium subsp. paratuberculosis
cggccggauggccagcaggu

SEQ ID NO: 856120 - RNA, 21 nt, Mycobacterium avium subsp. paratuberculosis
cggccggauggccagcaggua

SEQ ID NO: 856121 - RNA, 16 nt, Mycobacterium avium subsp. paratuberculosis
cggccggaucgaaaag

SEQ ID NO: 856122 - RNA, 22 nt, Mycobacterium avium subsp. paratuberculosis
cggccggaucgaauccggcggc

SEQ ID NO: 856123 - RNA, 23 nt, Mycobacterium avium subsp. paratuberculosis
cggccggaucgaauccggcggcg

SEQ ID NO: 856124 - RNA, 19 nt, Mycobacterium avium subsp. paratuberculosis
cggccggauucucgcccgg

SEQ ID NO: 856125 - RNA, 20 nt, Mycobacterium avium subsp. paratuberculosis
cggccggauucucgcccggc

SEQ ID NO: 856126 - RNA, 21 nt, Mycobacterium avium subsp. paratuberculosis
cggccggauucucgcccggcu

SEQ ID NO: 856127 - RNA, 22 nt, Mycobacterium avium subsp. paratuberculosis
cggccggauucucgcccggcuc

SEQ ID NO: 856128 - RNA, 14 nt, Mycobacterium avium subsp. paratuberculosis
cggccggaccaccc

SEQ ID NO: 856129 - RNA, 13 nt, Mycobacterium avium subsp. paratuberculosis
cggccggagccga

SEQ ID NO: 856130 - RNA, 19 nt, Mycobacterium avium subsp. paratuberculosis
cggccggagccgaccucgg

SEQ ID NO: 856131 - RNA, 15 nt, Mycobacterium avium subsp. paratuberculosis
cggccggaacagcug

SEQ ID NO: 856132 - RNA, 17 nt, Mycobacterium avium subsp. paratuberculosis
cggccggaacagcuggu

SEQ ID NO: 856133 - RNA, 22 nt, Mycobacterium avium subsp. paratuberculosis
cggccggaacagcuggucccac

SEQ ID NO: 856134 - RNA, 20 nt, Mycobacterium avium subsp. paratuberculosis
cggccggaagaccguugacg

SEQ ID NO: 856135 - RNA, 14 nt, Mycobacterium avium subsp. paratuberculosis
cggccggaagguca

SEQ ID NO: 856136 - RNA, 20 nt, Mycobacterium avium subsp. paratuberculosis
cggccggaaucucgugguac

SEQ ID NO: 856137 - RNA, 12 nt, Mycobacterium avium subsp. paratuberculosis
cggccgcgucgc

SEQ ID NO: 856138 - RNA, 20 nt, Mycobacterium avium subsp. paratuberculosis
cggccgcggucucgaccgac

SEQ ID NO: 856139 - RNA, 12 nt, Mycobacterium avium subsp. paratuberculosis
cggccgcggugu

SEQ ID NO: 856140 - RNA, 22 nt, Mycobacterium avium subsp. paratuberculosis
cggccgcguacuucgcgcccug

SEQ ID NO: 856141 - RNA, 14 nt, Mycobacterium avium subsp. paratuberculosis
cggccgcgucgccg

SEQ ID NO: 856142 - RNA, 15 nt, Mycobacterium avium subsp. paratuberculosis
cggccgcgucgccga

SEQ ID NO: 856143 - RNA, 15 nt, Mycobacterium avium subsp. paratuberculosis
cggccgcguccucgc

SEQ ID NO: 856144 - RNA, 21 nt, Mycobacterium avium subsp. paratuberculosis
cggccgcguccucgccguacg

SEQ ID NO: 856145 - RNA, 16 nt, Mycobacterium avium subsp. paratuberculosis
cggccgcuucccaccc

SEQ ID NO: 856146 - RNA, 18 nt, Mycobacterium avium subsp. paratuberculosis
cggccgcuucccacccgg

SEQ ID NO: 856147 - RNA, 19 nt, Mycobacterium avium subsp. paratuberculosis
cggccgcuucccacccggu

SEQ ID NO: 856148 - RNA, 16 nt, Mycobacterium avium subsp. paratuberculosis
cggccgcuggcguuga

SEQ ID NO: 856149 - RNA, 14 nt, Mycobacterium avium subsp. paratuberculosis
cggccgcggggccg

SEQ ID NO: 856150 - RNA, 23 nt, Mycobacterium avium subsp. paratuberculosis
cggccgcggggccggcgcuggcg

SEQ ID NO: 856151 - RNA, 21 nt, Mycobacterium avium subsp. paratuberculosis
cggccgccuucacgaccggca

SEQ ID NO: 856152 - RNA, 13 nt, Mycobacterium avium subsp. paratuberculosis
cggccgcggcgcg

SEQ ID NO: 856153 - RNA, 14 nt, Mycobacterium avium subsp. paratuberculosis
cggccgcggcgcgg

SEQ ID NO: 856154 - RNA, 15 nt, Mycobacterium avium subsp. paratuberculosis
cggccgcggcgcggc

SEQ ID NO: 856155 - RNA, 17 nt, Mycobacterium avium subsp. paratuberculosis
cggccgcggcgcggccc

SEQ ID NO: 856156 - RNA, 23 nt, Mycobacterium avium subsp. paratuberculosis
cggccgcggcgcggcccggcccg

SEQ ID NO: 856157 - RNA, 14 nt, Mycobacterium avium subsp. paratuberculosis
cggccgcggcgggc

SEQ ID NO: 856158 - RNA, 17 nt, Mycobacterium avium subsp. paratuberculosis
cggccgcggcgggcgcg

SEQ ID NO: 856159 - RNA, 19 nt, Mycobacterium avium subsp. paratuberculosis
cggccgcggcgggcgcguc

SEQ ID NO: 856160 - RNA, 22 nt, Mycobacterium avium subsp. paratuberculosis
cggccgcggcgggcgcgucgag

SEQ ID NO: 856161 - RNA, 15 nt, Mycobacterium avium subsp. paratuberculosis
cggccgcggcggugc

SEQ ID NO: 856162 - RNA, 16 nt, Mycobacterium avium subsp. paratuberculosis
cggccgcggcggugcc

SEQ ID NO: 856163 - RNA, 12 nt, Mycobacterium avium subsp. paratuberculosis
cggccgcggcgu

SEQ ID NO: 856164 - RNA, 12 nt, Mycobacterium avium subsp. paratuberculosis
cggccgccugga

SEQ ID NO: 856165 - RNA, 20 nt, Mycobacterium avium subsp. paratuberculosis
cggccgccuggacgacgucg

SEQ ID NO: 856166 - RNA, 23 nt, Mycobacterium avium subsp. paratuberculosis
cggccgccuggacgacgucgaug

SEQ ID NO: 856167 - RNA, 14 nt, Mycobacterium avium subsp. paratuberculosis
cggccgccucgucg

SEQ ID NO: 856168 - RNA, 15 nt, Mycobacterium avium subsp. paratuberculosis
cggccgccucgucga

SEQ ID NO: 856169 - RNA, 16 nt, Mycobacterium avium subsp. paratuberculosis
cggccgccucgucgag

SEQ ID NO: 856170 - RNA, 13 nt, Mycobacterium avium subsp. paratuberculosis
cggccgccucccg

SEQ ID NO: 856171 - RNA, 17 nt, Mycobacterium avium subsp. paratuberculosis
cggccgccucccgcagc

SEQ ID NO: 856172 - RNA, 21 nt, Mycobacterium avium subsp. paratuberculosis
cggccgccucccgcagcgcca

SEQ ID NO: 856173 - RNA, 23 nt, Mycobacterium avium subsp. paratuberculosis
cggccgccucccgcagcgccagc

SEQ ID NO: 856174 - RNA, 15 nt, Mycobacterium avium subsp. paratuberculosis
cggccgccggggccc

SEQ ID NO: 856175 - RNA, 13 nt, Mycobacterium avium subsp. paratuberculosis
cggccgccguauc

SEQ ID NO: 856176 - RNA, 19 nt, Mycobacterium avium subsp. paratuberculosis
cggccgccguaucccugcc

SEQ ID NO: 856177 - RNA, 14 nt, Mycobacterium avium subsp. paratuberculosis
cggccgccggcggc

SEQ ID NO: 856178 - RNA, 21 nt, Mycobacterium avium subsp. paratuberculosis
cggccgccggauuacucgccg

SEQ ID NO: 856179 - RNA, 23 nt, Mycobacterium avium subsp. paratuberculosis
cggccgccggauuacucgccggc

SEQ ID NO: 856180 - RNA, 14 nt, Mycobacterium avium subsp. paratuberculosis
cggccgccggcacc

SEQ ID NO: 856181 - RNA, 15 nt, Mycobacterium avium subsp. paratuberculosis
cggccgccggcaccg

SEQ ID NO: 856182 - RNA, 14 nt, Mycobacterium avium subsp. paratuberculosis
cggccgccggccag

SEQ ID NO: 856183 - RNA, 15 nt, Mycobacterium avium subsp. paratuberculosis
cggccgccggccagc

SEQ ID NO: 856184 - RNA, 16 nt, Mycobacterium avium subsp. paratuberculosis
cggccgccggccagcu

SEQ ID NO: 856185 - RNA, 12 nt, Mycobacterium avium subsp. paratuberculosis
cggccgccgcga

SEQ ID NO: 856186 - RNA, 14 nt, Mycobacterium avium subsp. paratuberculosis
cggccgccgcgacg

SEQ ID NO: 856187 - RNA, 19 nt, Mycobacterium avium subsp. paratuberculosis
cggccgccgcgacgccgug

SEQ ID NO: 856188 - RNA, 22 nt, Mycobacterium avium subsp. paratuberculosis
cggccgccgcgacggccgccga

SEQ ID NO: 856189 - RNA, 15 nt, Mycobacterium avium subsp. paratuberculosis
cggccgccgcgauca

SEQ ID NO: 856190 - RNA, 15 nt, Mycobacterium avium subsp. paratuberculosis
cggccgccgcgcauc

SEQ ID NO: 856191 - RNA, 21 nt, Mycobacterium avium subsp. paratuberculosis
cggccgccgcccgcgcggcgg

SEQ ID NO: 856192 - RNA, 14 nt, Mycobacterium avium subsp. paratuberculosis
cggccgccgccgcg

SEQ ID NO: 856193 - RNA, 15 nt, Mycobacterium avium subsp. paratuberculosis
cggccgccgccgcgg

SEQ ID NO: 856194 - RNA, 16 nt, Mycobacterium avium subsp. paratuberculosis
cggccgccgccgcggc

SEQ ID NO: 856195 - RNA, 21 nt, Mycobacterium avium subsp. paratuberculosis
cggccgccgccgcggccgcgg

SEQ ID NO: 856196 - RNA, 13 nt, Mycobacterium avium subsp. paratuberculosis
cggccgccgcccg

SEQ ID NO: 856197 - RNA, 17 nt, Mycobacterium avium subsp. paratuberculosis
cggccgccgaggcgaug

SEQ ID NO: 856198 - RNA, 22 nt, Mycobacterium avium subsp. paratuberculosis
cggccgccgaggcgaugccgug

SEQ ID NO: 856199 - RNA, 20 nt, Mycobacterium avium subsp. paratuberculosis
cggccgccgaucaacaggcc

SEQ ID NO: 856200 - RNA, 19 nt, Mycobacterium avium subsp. paratuberculosis
cggccgccgauuccggccg

SEQ ID NO: 856201 - RNA, 13 nt, Mycobacterium avium subsp. paratuberculosis
cggccgcccgucc

SEQ ID NO: 856202 - RNA, 14 nt, Mycobacterium avium subsp. paratuberculosis
cggccgcccguccg

SEQ ID NO: 856203 - RNA, 18 nt, Mycobacterium avium subsp. paratuberculosis
cggccgcccguccgggcc

SEQ ID NO: 856204 - RNA, 20 nt, Mycobacterium avium subsp. paratuberculosis
cggccgcccguccgggccgg

SEQ ID NO: 856205 - RNA, 15 nt, Mycobacterium avium subsp. paratuberculosis
cggccgcccgucggg

SEQ ID NO: 856206 - RNA, 15 nt, Mycobacterium avium subsp. paratuberculosis
cggccgccgaagccg

SEQ ID NO: 856207 - RNA, 20 nt, Mycobacterium avium subsp. paratuberculosis
cggccgccgaagccggcucg

SEQ ID NO: 856208 - RNA, 14 nt, Mycobacterium avium subsp. paratuberculosis
cggccgccgacacc

SEQ ID NO: 856209 - RNA, 15 nt, Mycobacterium avium subsp. paratuberculosis
cggccgccgacacca

SEQ ID NO: 856210 - RNA, 22 nt, Mycobacterium avium subsp. paratuberculosis
cggccgccgacaccaccacgaa

SEQ ID NO: 856211 - RNA, 12 nt, Mycobacterium avium subsp. paratuberculosis
cggccgcccggc

SEQ ID NO: 856212 - RNA, 15 nt, Mycobacterium avium subsp. paratuberculosis
cggccgcccggcgag

SEQ ID NO: 856213 - RNA, 16 nt, Mycobacterium avium subsp. paratuberculosis
cggccgcccggcgagc

SEQ ID NO: 856214 - RNA, 18 nt, Mycobacterium avium subsp. paratuberculosis
cggccgcccggcgagcag

SEQ ID NO: 856215 - RNA, 13 nt, Mycobacterium avium subsp. paratuberculosis
cggccgcccgggc

SEQ ID NO: 856216 - RNA, 14 nt, Mycobacterium avium subsp. paratuberculosis
cggccgcccgggcg

SEQ ID NO: 856217 - RNA, 20 nt, Mycobacterium avium subsp. paratuberculosis
cggccgcccgggcggcccgc

SEQ ID NO: 856218 - RNA, 23 nt, Mycobacterium avium subsp. paratuberculosis
cggccgcccgggcggcccgcauc

SEQ ID NO: 856219 - RNA, 21 nt, Mycobacterium avium subsp. paratuberculosis
cggccgcccgguccgggucgc

SEQ ID NO: 856220 - RNA, 12 nt, Mycobacterium avium subsp. paratuberculosis
cggccgccaccg

SEQ ID NO: 856221 - RNA, 13 nt, Mycobacterium avium subsp. paratuberculosis
cggccgccaccga

SEQ ID NO: 856222 - RNA, 14 nt, Mycobacterium avium subsp. paratuberculosis
cggccgccaccgag

SEQ ID NO: 856223 - RNA, 15 nt, Mycobacterium avium subsp. paratuberculosis
cggccgccaccgagg

SEQ ID NO: 856224 - RNA, 21 nt, Mycobacterium avium subsp. paratuberculosis
cggccgcccgcaccagcaggu

SEQ ID NO: 856225 - RNA, 19 nt, Mycobacterium avium subsp. paratuberculosis
cggccgccaaaucgaucac

SEQ ID NO: 856226 - RNA, 14 nt, Mycobacterium avium subsp. paratuberculosis
cggccgcaucguug

SEQ ID NO: 856227 - RNA, 23 nt, Mycobacterium avium subsp. paratuberculosis
cggccgcaucguugguccaggcg

SEQ ID NO: 856228 - RNA, 19 nt, Mycobacterium avium subsp. paratuberculosis
cggccgcaugucgaccucg

SEQ ID NO: 856229 - RNA, 21 nt, Mycobacterium avium subsp. paratuberculosis
cggccgcaugucgaccucggc

SEQ ID NO: 856230 - RNA, 19 nt, Mycobacterium avium subsp. paratuberculosis
cggccgcagcggcaggucg

SEQ ID NO: 856231 - RNA, 14 nt, Mycobacterium avium subsp. paratuberculosis
cggccgcagcgacu

SEQ ID NO: 856232 - RNA, 19 nt, Mycobacterium avium subsp. paratuberculosis
cggccgcagcgcaucgccg

SEQ ID NO: 856233 - RNA, 22 nt, Mycobacterium avium subsp. paratuberculosis
cggccgcagcgcaucgccggcg

SEQ ID NO: 856234 - RNA, 14 nt, Mycobacterium avium subsp. paratuberculosis
cggccgcagcgccc

SEQ ID NO: 856235 - RNA, 21 nt, Mycobacterium avium subsp. paratuberculosis
cggccgcagcgcccggcagcg

SEQ ID NO: 856236 - RNA, 13 nt, Mycobacterium avium subsp. paratuberculosis
cggccgcagcgcg

SEQ ID NO: 856237 - RNA, 18 nt, Mycobacterium avium subsp. paratuberculosis
cggccgcagcgcgacgaa

SEQ ID NO: 856238 - RNA, 14 nt, Mycobacterium avium subsp. paratuberculosis
cggccgcagcggga

SEQ ID NO: 856239 - RNA, 20 nt, Mycobacterium avium subsp. paratuberculosis
cggccgcagcgugggcaccg

SEQ ID NO: 856240 - RNA, 21 nt, Mycobacterium avium subsp. paratuberculosis
cggccgcagcgugggcaccgg

SEQ ID NO: 856241 - RNA, 13 nt, Mycobacterium avium subsp. paratuberculosis
cggccgcagcugc

SEQ ID NO: 856242 - RNA, 21 nt, Mycobacterium avium subsp. paratuberculosis
cggccgcagcugcugcggccg

SEQ ID NO: 856243 - RNA, 16 nt, Mycobacterium avium subsp. paratuberculosis
cggccgaucauggucg

SEQ ID NO: 856244 - RNA, 22 nt, Mycobacterium avium subsp. paratuberculosis
cggccgaucauggucggcgacg

SEQ ID NO: 856245 - RNA, 16 nt, Mycobacterium avium subsp. paratuberculosis
cggccgaucccgaugc

SEQ ID NO: 856246 - RNA, 22 nt, Mycobacterium avium subsp. paratuberculosis
cggccgcacguauccgcggucg

SEQ ID NO: 856247 - RNA, 23 nt, Mycobacterium avium subsp. paratuberculosis
cggccgcacguauccgcggucga

SEQ ID NO: 856248 - RNA, 19 nt, Mycobacterium avium subsp. paratuberculosis
cggccgaucaccucgaugg

SEQ ID NO: 856249 - RNA, 14 nt, Mycobacterium avium subsp. paratuberculosis
cggccgagucgacg

SEQ ID NO: 856250 - RNA, 22 nt, Mycobacterium avium subsp. paratuberculosis
cggccgagucgacgugcucggc

SEQ ID NO: 856251 - RNA, 18 nt, Mycobacterium avium subsp. paratuberculosis
cggccgagguccgcgguu

SEQ ID NO: 856252 - RNA, 17 nt, Mycobacterium avium subsp. paratuberculosis
cggccgagcgcaccgcg

SEQ ID NO: 856253 - RNA, 16 nt, Mycobacterium avium subsp. paratuberculosis
cggccgagcgcgccga

SEQ ID NO: 856254 - RNA, 17 nt, Mycobacterium avium subsp. paratuberculosis
cggccgagcgcgccgag

SEQ ID NO: 856255 - RNA, 19 nt, Mycobacterium avium subsp. paratuberculosis
cggccgagcgcgccgagca

SEQ ID NO: 856256 - RNA, 20 nt, Mycobacterium avium subsp. paratuberculosis
cggccgagcgcgccgagcag

SEQ ID NO: 856257 - RNA, 21 nt, Mycobacterium avium subsp. paratuberculosis
cggccgagcgcgccgagcagc

SEQ ID NO: 856258 - RNA, 15 nt, Mycobacterium avium subsp. paratuberculosis
cggccgagccgagcc

SEQ ID NO: 856259 - RNA, 18 nt, Mycobacterium avium subsp. paratuberculosis
cggccgagccgaggccga

SEQ ID NO: 856260 - RNA, 23 nt, Mycobacterium avium subsp. paratuberculosis
cggccgagccgaugcccagcagc

SEQ ID NO: 856261 - RNA, 12 nt, Mycobacterium avium subsp. paratuberculosis
cggccgacgaac

SEQ ID NO: 856262 - RNA, 15 nt, Mycobacterium avium subsp. paratuberculosis
cggccgagcgcaccg

SEQ ID NO: 856263 - RNA, 15 nt, Mycobacterium avium subsp. paratuberculosis
cggccgacucgaugc

SEQ ID NO: 856264 - RNA, 16 nt, Mycobacterium avium subsp. paratuberculosis
cggccgacucgaugcg

SEQ ID NO: 856265 - RNA, 19 nt, Mycobacterium avium subsp. paratuberculosis
cggccgacugauccaccau

SEQ ID NO: 856266 - RNA, 20 nt, Mycobacterium avium subsp. paratuberculosis
cggccgacuuggucagcccg

SEQ ID NO: 856267 - RNA, 15 nt, Mycobacterium avium subsp. paratuberculosis
cggccgacgggcgug

SEQ ID NO: 856268 - RNA, 12 nt, Mycobacterium avium subsp. paratuberculosis
cggccgacgccc

SEQ ID NO: 856269 - RNA, 16 nt, Mycobacterium avium subsp. paratuberculosis
cggccgacgcgccguc

SEQ ID NO: 856270 - RNA, 20 nt, Mycobacterium avium subsp. paratuberculosis
cggccgacgcgccgucggcc

SEQ ID NO: 856271 - RNA, 13 nt, Mycobacterium avium subsp. paratuberculosis
cggccgacgcggc

SEQ ID NO: 856272 - RNA, 21 nt, Mycobacterium avium subsp. paratuberculosis
cggccgaccggucucgaccgc

SEQ ID NO: 856273 - RNA, 18 nt, Mycobacterium avium subsp. paratuberculosis
cggccgacauggacgcgg

SEQ ID NO: 856274 - RNA, 21 nt, Mycobacterium avium subsp. paratuberculosis
cggccgacauggacgcggccu

SEQ ID NO: 856275 - RNA, 17 nt, Mycobacterium avium subsp. paratuberculosis
cggccgacagcgcgucg

SEQ ID NO: 856276 - RNA, 19 nt, Mycobacterium avium subsp. paratuberculosis
cggcccuucucggacgccc

SEQ ID NO: 856277 - RNA, 23 nt, Mycobacterium avium subsp. paratuberculosis
cggcccuucucggacgcccgucg

SEQ ID NO: 856278 - RNA, 16 nt, Mycobacterium avium subsp. paratuberculosis
cggcccuugcggccga

SEQ ID NO: 856279 - RNA, 18 nt, Mycobacterium avium subsp. paratuberculosis
cggcccuugcggccgauc

SEQ ID NO: 856280 - RNA, 19 nt, Mycobacterium avium subsp. paratuberculosis
cggcccuugcggccgauca

SEQ ID NO: 856281 - RNA, 16 nt, Mycobacterium avium subsp. paratuberculosis
cggcccuggaugucac

SEQ ID NO: 856282 - RNA, 14 nt, Mycobacterium avium subsp. paratuberculosis
cggcccugcggcca

SEQ ID NO: 856283 - RNA, 19 nt, Mycobacterium avium subsp. paratuberculosis
cggcccugcggccagugcc

SEQ ID NO: 856284 - RNA, 13 nt, Mycobacterium avium subsp. paratuberculosis
cggcccugguuga

SEQ ID NO: 856285 - RNA, 18 nt, Mycobacterium avium subsp. paratuberculosis
cggcccugguugagcacc

SEQ ID NO: 856286 - RNA, 19 nt, Mycobacterium avium subsp. paratuberculosis
cggcccugguugagcaccg

SEQ ID NO: 856287 - RNA, 20 nt, Mycobacterium avium subsp. paratuberculosis
cggcccugguugagcaccgc

SEQ ID NO: 856288 - RNA, 21 nt, Mycobacterium avium subsp. paratuberculosis
cggcccugguugagcaccgcg

SEQ ID NO: 856289 - RNA, 17 nt, Mycobacterium avium subsp. paratuberculosis
cggcccuguucgccguc

SEQ ID NO: 856290 - RNA, 18 nt, Mycobacterium avium subsp. paratuberculosis
cggcccuguucgccgucg

SEQ ID NO: 856291 - RNA, 20 nt, Mycobacterium avium subsp. paratuberculosis
cggcccuguucgccgucgcg

SEQ ID NO: 856292 - RNA, 18 nt, Mycobacterium avium subsp. paratuberculosis
cggcccgggaagccgcag

SEQ ID NO: 856293 - RNA, 23 nt, Mycobacterium avium subsp. paratuberculosis
cggcccgggcgauucgucgucgu

SEQ ID NO: 856294 - RNA, 20 nt, Mycobacterium avium subsp. paratuberculosis
cggcccggcguuacccgaac

SEQ ID NO: 856295 - RNA, 12 nt, Mycobacterium avium subsp. paratuberculosis
cggcccggcuca

SEQ ID NO: 856296 - RNA, 17 nt, Mycobacterium avium subsp. paratuberculosis
cggcccggcucaaugcc

SEQ ID NO: 856297 - RNA, 13 nt, Mycobacterium avium subsp. paratuberculosis
cggcccggcgucg

SEQ ID NO: 856298 - RNA, 14 nt, Mycobacterium avium subsp. paratuberculosis
cggcccggcggccg

SEQ ID NO: 856299 - RNA, 19 nt, Mycobacterium avium subsp. paratuberculosis
cggcccggcgggucagcac

SEQ ID NO: 856300 - RNA, 21 nt, Mycobacterium avium subsp. paratuberculosis
cggcccggcgggucagcaccg

SEQ ID NO: 856301 - RNA, 13 nt, Mycobacterium avium subsp. paratuberculosis
cggcccggcguca

SEQ ID NO: 856302 - RNA, 14 nt, Mycobacterium avium subsp. paratuberculosis
cggcccggcguccg

SEQ ID NO: 856303 - RNA, 19 nt, Mycobacterium avium subsp. paratuberculosis
cggcccggcguccgcgaac

SEQ ID NO: 856304 - RNA, 16 nt, Mycobacterium avium subsp. paratuberculosis
cggcccggcgcggccg

SEQ ID NO: 856305 - RNA, 17 nt, Mycobacterium avium subsp. paratuberculosis
cggcccggcgcggccgg

SEQ ID NO: 856306 - RNA, 17 nt, Mycobacterium avium subsp. paratuberculosis
cggcccggccggcgcga

SEQ ID NO: 856307 - RNA, 21 nt, Mycobacterium avium subsp. paratuberculosis
cggcccggcgaaucagcagcu

SEQ ID NO: 856308 - RNA, 13 nt, Mycobacterium avium subsp. paratuberculosis
cggcccggcgaug

SEQ ID NO: 856309 - RNA, 14 nt, Mycobacterium avium subsp. paratuberculosis
cggcccggcgaugc

SEQ ID NO: 856310 - RNA, 15 nt, Mycobacterium avium subsp. paratuberculosis
cggcccggcgaugcc

SEQ ID NO: 856311 - RNA, 17 nt, Mycobacterium avium subsp. paratuberculosis
cggcccggcacuggcga

SEQ ID NO: 856312 - RNA, 18 nt, Mycobacterium avium subsp. paratuberculosis
cggcccggcacuggcgaa

SEQ ID NO: 856313 - RNA, 17 nt, Mycobacterium avium subsp. paratuberculosis
cggccccagccgccgcg

SEQ ID NO: 856314 - RNA, 17 nt, Mycobacterium avium subsp. paratuberculosis
cggcccggcccgacgga

SEQ ID NO: 856315 - RNA, 17 nt, Mycobacterium avium subsp. paratuberculosis
cggcccggcccgcuggc

SEQ ID NO: 856316 - RNA, 18 nt, Mycobacterium avium subsp. paratuberculosis
cggcccggccaccaggga

SEQ ID NO: 856317 - RNA, 15 nt, Mycobacterium avium subsp. paratuberculosis
cggcccggccacucg

SEQ ID NO: 856318 - RNA, 18 nt, Mycobacterium avium subsp. paratuberculosis
cggcccggccacucgccg

SEQ ID NO: 856319 - RNA, 15 nt, Mycobacterium avium subsp. paratuberculosis
cgcgauccgcgcguc

SEQ ID NO: 856320 - RNA, 16 nt, Mycobacterium avium subsp. paratuberculosis
cgcgauccgcgcgucg

SEQ ID NO: 856321 - RNA, 17 nt, Mycobacterium avium subsp. paratuberculosis
cgcgauccgcgcgucgg

SEQ ID NO: 856322 - RNA, 18 nt, Mycobacterium avium subsp. paratuberculosis
cgcgauccgcgcgucggg

SEQ ID NO: 856323 - RNA, 16 nt, Mycobacterium avium subsp. paratuberculosis
cgcgaucgccggaucg

SEQ ID NO: 856324 - RNA, 18 nt, Mycobacterium avium subsp. paratuberculosis
cgcgaucgccggugcggc

SEQ ID NO: 856325 - RNA, 23 nt, Mycobacterium avium subsp. paratuberculosis
cgcgaucgccggugcggccgcga

SEQ ID NO: 856326 - RNA, 13 nt, Mycobacterium avium subsp. paratuberculosis
cgcgaucgccgac

SEQ ID NO: 856327 - RNA, 12 nt, Mycobacterium avium subsp. paratuberculosis
cgcgaucgagga

SEQ ID NO: 856328 - RNA, 19 nt, Mycobacterium avium subsp. paratuberculosis
cgcgaucgaguaguccggg

SEQ ID NO: 856329 - RNA, 19 nt, Mycobacterium avium subsp. paratuberculosis
cgcgaugaggcucaggccg

SEQ ID NO: 856330 - RNA, 20 nt, Mycobacterium avium subsp. paratuberculosis
cgcgaugcccaagccggcca

SEQ ID NO: 856331 - RNA, 13 nt, Mycobacterium avium subsp. paratuberculosis
cgcgaugaucgcc

SEQ ID NO: 856332 - RNA, 21 nt, Mycobacterium avium subsp. paratuberculosis
cgcgaugaucgccggcgccgg

SEQ ID NO: 856333 - RNA, 22 nt, Mycobacterium avium subsp. paratuberculosis
cgcgaugaugagcaagucggcg

SEQ ID NO: 856334 - RNA, 16 nt, Mycobacterium avium subsp. paratuberculosis
cgcgaugauggcgucg

SEQ ID NO: 856335 - RNA, 20 nt, Mycobacterium avium subsp. paratuberculosis
cgcgaugauggcgucgacgu

SEQ ID NO: 856336 - RNA, 22 nt, Mycobacterium avium subsp. paratuberculosis
cgcgaugauggcgucgacgugc

SEQ ID NO: 856337 - RNA, 21 nt, Mycobacterium avium subsp. paratuberculosis
cgcgaugcaacaccgaacgcc

SEQ ID NO: 856338 - RNA, 13 nt, Mycobacterium avium subsp. paratuberculosis
cgcgauggccucc

SEQ ID NO: 856339 - RNA, 20 nt, Mycobacterium avium subsp. paratuberculosis
cgcgauggccuccgacccgu

SEQ ID NO: 856340 - RNA, 16 nt, Mycobacterium avium subsp. paratuberculosis
cgcgauggcgugccgg

SEQ ID NO: 856341 - RNA, 21 nt, Mycobacterium avium subsp. paratuberculosis
cgcgauggcgugccggcgcug

SEQ ID NO: 856342 - RNA, 16 nt, Mycobacterium avium subsp. paratuberculosis
cgcgaugcgacaccgc

SEQ ID NO: 856343 - RNA, 18 nt, Mycobacterium avium subsp. paratuberculosis
cgcgaugcgacaccgcgu

SEQ ID NO: 856344 - RNA, 17 nt, Mycobacterium avium subsp. paratuberculosis
cgcgauggcgcuggccg

SEQ ID NO: 856345 - RNA, 19 nt, Mycobacterium avium subsp. paratuberculosis
cgcgauggcgcuggccgcg

SEQ ID NO: 856346 - RNA, 13 nt, Mycobacterium avium subsp. paratuberculosis
cgcgauggcggcg

SEQ ID NO: 856347 - RNA, 13 nt, Mycobacterium avium subsp. paratuberculosis
cgcgauggcgggu

SEQ ID NO: 856348 - RNA, 13 nt, Mycobacterium avium subsp. paratuberculosis
cgcgaugcggcuc

SEQ ID NO: 856349 - RNA, 14 nt, Mycobacterium avium subsp. paratuberculosis
cgcgaugcggcuca

SEQ ID NO: 856350 - RNA, 15 nt, Mycobacterium avium subsp. paratuberculosis
cgcgaugcgggcgcc

SEQ ID NO: 856351 - RNA, 16 nt, Mycobacterium avium subsp. paratuberculosis
cgcgaugcgggcgccg

SEQ ID NO: 856352 - RNA, 17 nt, Mycobacterium avium subsp. paratuberculosis
cgcgaugcgggcgccga

SEQ ID NO: 856353 - RNA, 18 nt, Mycobacterium avium subsp. paratuberculosis
cgcgaugcgggcgccgaa

SEQ ID NO: 856354 - RNA, 19 nt, Mycobacterium avium subsp. paratuberculosis
cgcgaugcgggcgccgaac

SEQ ID NO: 856355 - RNA, 17 nt, Mycobacterium avium subsp. paratuberculosis
cgcgaugccggccaggc

SEQ ID NO: 856356 - RNA, 22 nt, Mycobacterium avium subsp. paratuberculosis
cgcgaugccggccaggcacagc

SEQ ID NO: 856357 - RNA, 13 nt, Mycobacterium avium subsp. paratuberculosis
cgcgaugcccgcc

SEQ ID NO: 856358 - RNA, 14 nt, Mycobacterium avium subsp. paratuberculosis
cgcgaugcccgccg

SEQ ID NO: 856359 - RNA, 18 nt, Mycobacterium avium subsp. paratuberculosis
cgcgcaauccugcccggu

SEQ ID NO: 856360 - RNA, 16 nt, Mycobacterium avium subsp. paratuberculosis
cgcgcaaugccaucgu

SEQ ID NO: 856361 - RNA, 16 nt, Mycobacterium avium subsp. paratuberculosis
cgcgcaaugccgccgc

SEQ ID NO: 856362 - RNA, 18 nt, Mycobacterium avium subsp. paratuberculosis
cgcgcaaugccgccgcga

SEQ ID NO: 856363 - RNA, 19 nt, Mycobacterium avium subsp. paratuberculosis
cgcgcaauaacggagcggc

SEQ ID NO: 856364 - RNA, 21 nt, Mycobacterium avium subsp. paratuberculosis
cgcgcaauaacggagcggccu

SEQ ID NO: 856365 - RNA, 20 nt, Mycobacterium avium subsp. paratuberculosis
cgcgcaauacccgaccagca

SEQ ID NO: 856366 - RNA, 18 nt, Mycobacterium avium subsp. paratuberculosis
cgcgcaacucguccacca

SEQ ID NO: 856367 - RNA, 20 nt, Mycobacterium avium subsp. paratuberculosis
cgcgcaacucguccaccagc

SEQ ID NO: 856368 - RNA, 21 nt, Mycobacterium avium subsp. paratuberculosis
cgcgcaacucguccaccagcu

SEQ ID NO: 856369 - RNA, 21 nt, Mycobacterium avium subsp. paratuberculosis
cgcgcaacuggguggucacac

SEQ ID NO: 856370 - RNA, 24 nt, Mycobacterium avium subsp. paratuberculosis
cgcgcaacuggguggucacaccgc

SEQ ID NO: 856371 - RNA, 21 nt, Mycobacterium avium subsp. paratuberculosis
cgcgcacaucacgguggccgc

SEQ ID NO: 856372 - RNA, 23 nt, Mycobacterium avium subsp. paratuberculosis
cgcgcacaucacgguggccgcca

SEQ ID NO: 856373 - RNA, 13 nt, Mycobacterium avium subsp. paratuberculosis
cgcgcaccaccuc

SEQ ID NO: 856374 - RNA, 15 nt, Mycobacterium avium subsp. paratuberculosis
cgcgcaccaccucga

SEQ ID NO: 856375 - RNA, 15 nt, Mycobacterium avium subsp. paratuberculosis
cgcgcaccaccucgg

SEQ ID NO: 856376 - RNA, 20 nt, Mycobacterium avium subsp. paratuberculosis
cgcgcaccaccucggcgauc

SEQ ID NO: 856377 - RNA, 21 nt, Mycobacterium avium subsp. paratuberculosis
cgcgcaccaccucggcgaucu

SEQ ID NO: 856378 - RNA, 13 nt, Mycobacterium avium subsp. paratuberculosis
cgcgcacagcgcc

SEQ ID NO: 856379 - RNA, 14 nt, Mycobacterium avium subsp. paratuberculosis
cgcgcacagcgcca

SEQ ID NO: 856380 - RNA, 15 nt, Mycobacterium avium subsp. paratuberculosis
cgcgcacagcgccac

SEQ ID NO: 856381 - RNA, 17 nt, Mycobacterium avium subsp. paratuberculosis
cgcgcacagcgccacac

SEQ ID NO: 856382 - RNA, 18 nt, Mycobacterium avium subsp. paratuberculosis
cgcgcacagcgccacacc

SEQ ID NO: 856383 - RNA, 14 nt, Mycobacterium avium subsp. paratuberculosis
cgcgaucgccgauc

SEQ ID NO: 856384 - RNA, 20 nt, Mycobacterium avium subsp. paratuberculosis
cgcgcaaucaaaaaccccgc

SEQ ID NO: 856385 - RNA, 11 nt, Mycobacterium avium subsp. paratuberculosis
cgcgcacaaca

SEQ ID NO: 856386 - RNA, 14 nt, Mycobacterium avium subsp. paratuberculosis
cgcgcacaacagcc

SEQ ID NO: 856387 - RNA, 19 nt, Mycobacterium avium subsp. paratuberculosis
cgcgcacaauucggucagc

SEQ ID NO: 856388 - RNA, 14 nt, Mycobacterium avium subsp. paratuberculosis
cgcgcacacggccu

SEQ ID NO: 856389 - RNA, 20 nt, Mycobacterium avium subsp. paratuberculosis
cgcgcaccacgguggcgccg

SEQ ID NO: 856390 - RNA, 21 nt, Mycobacterium avium subsp. paratuberculosis
cgcgcaccaggccgacgcugg

SEQ ID NO: 856391 - RNA, 14 nt, Mycobacterium avium subsp. paratuberculosis
cgcgcaccagcucg

SEQ ID NO: 856392 - RNA, 15 nt, Mycobacterium avium subsp. paratuberculosis
cgcgcaccagcucga

SEQ ID NO: 856393 - RNA, 17 nt, Mycobacterium avium subsp. paratuberculosis
cgcgcaccagcucggcg

SEQ ID NO: 856394 - RNA, 21 nt, Mycobacterium avium subsp. paratuberculosis
cgcgcacccccuucuccacgc

SEQ ID NO: 856395 - RNA, 22 nt, Mycobacterium avium subsp. paratuberculosis
cgcgcacccccuucuccacgcu

SEQ ID NO: 856396 - RNA, 13 nt, Mycobacterium avium subsp. paratuberculosis
cgcgcaccccggc

SEQ ID NO: 856397 - RNA, 15 nt, Mycobacterium avium subsp. paratuberculosis
cgcgcacccagacgu

SEQ ID NO: 856398 - RNA, 18 nt, Mycobacterium avium subsp. paratuberculosis
cgcgcaccagggccgcga

SEQ ID NO: 856399 - RNA, 17 nt, Mycobacterium avium subsp. paratuberculosis
cgcgcaccagggccugc

SEQ ID NO: 856400 - RNA, 23 nt, Mycobacterium avium subsp. paratuberculosis
cgcgcaccagggccugcagcacc

SEQ ID NO: 856401 - RNA, 13 nt, Mycobacterium avium subsp. paratuberculosis
cgcgcaccauccg

SEQ ID NO: 856402 - RNA, 18 nt, Mycobacterium avium subsp. paratuberculosis
cgcgcacgucaccgcgcu

SEQ ID NO: 856403 - RNA, 20 nt, Mycobacterium avium subsp. paratuberculosis
cgcgcacguuggcggccagc

SEQ ID NO: 856404 - RNA, 23 nt, Mycobacterium avium subsp. paratuberculosis
cgcgcacguuggcggccagcgcg

SEQ ID NO: 856405 - RNA, 22 nt, Mycobacterium avium subsp. paratuberculosis
cgcgcacucgaacggcccggac

SEQ ID NO: 856406 - RNA, 14 nt, Mycobacterium avium subsp. paratuberculosis
cgcgcacggcgcgc

SEQ ID NO: 856407 - RNA, 19 nt, Mycobacterium avium subsp. paratuberculosis
cgcgcacggcgcgcaccgc

SEQ ID NO: 856408 - RNA, 14 nt, Mycobacterium avium subsp. paratuberculosis
cgcgcacgcucgcg

SEQ ID NO: 856409 - RNA, 17 nt, Mycobacterium avium subsp. paratuberculosis
cgcgcacgcucgcggug

SEQ ID NO: 856410 - RNA, 15 nt, Mycobacterium avium subsp. paratuberculosis
cgcgcacgcuggccg

SEQ ID NO: 856411 - RNA, 16 nt, Mycobacterium avium subsp. paratuberculosis
cgcgcacgcuggccgg

SEQ ID NO: 856412 - RNA, 17 nt, Mycobacterium avium subsp. paratuberculosis
cgcgcacgcuggccggc

SEQ ID NO: 856413 - RNA, 15 nt, Mycobacterium avium subsp. paratuberculosis
cgcgcacgccaucgc

SEQ ID NO: 856414 - RNA, 16 nt, Mycobacterium avium subsp. paratuberculosis
cgcgcacgccaucgcc

SEQ ID NO: 856415 - RNA, 18 nt, Mycobacterium avium subsp. paratuberculosis
cgcgcacgccaucgccuc

SEQ ID NO: 856416 - RNA, 23 nt, Mycobacterium avium subsp. paratuberculosis
cgcgauccgggcauggucaccgg

SEQ ID NO: 856417 - RNA, 14 nt, Mycobacterium avium subsp. paratuberculosis
cgcgauccgggcgc

SEQ ID NO: 856418 - RNA, 17 nt, Mycobacterium avium subsp. paratuberculosis
cgcgauccgggcgccgg

SEQ ID NO: 856419 - RNA, 16 nt, Mycobacterium avium subsp. paratuberculosis
cgcgauccggggggcg

SEQ ID NO: 856420 - RNA, 21 nt, Mycobacterium avium subsp. paratuberculosis
cgcgauccggggggcgggguc

SEQ ID NO: 856421 - RNA, 22 nt, Mycobacterium avium subsp. paratuberculosis
cgcgauccggggggcggggucg

SEQ ID NO: 856422 - RNA, 17 nt, Mycobacterium avium subsp. paratuberculosis
cgcgaucaacaccgguc

SEQ ID NO: 856423 - RNA, 19 nt, Mycobacterium avium subsp. paratuberculosis
cgcgauagggccggccgga

SEQ ID NO: 856424 - RNA, 20 nt, Mycobacterium avium subsp. paratuberculosis
cgcgauagggccggccggac

SEQ ID NO: 856425 - RNA, 23 nt, Mycobacterium avium subsp. paratuberculosis
cgcgauagaccucacggucggcg

SEQ ID NO: 856426 - RNA, 13 nt, Mycobacterium avium subsp. paratuberculosis
cgcgacugggcgc

SEQ ID NO: 856427 - RNA, 17 nt, Mycobacterium avium subsp. paratuberculosis
cgcgacugggcgcccac

SEQ ID NO: 856428 - RNA, 18 nt, Mycobacterium avium subsp. paratuberculosis
cgcgacugggcgcccacc

SEQ ID NO: 856429 - RNA, 19 nt, Mycobacterium avium subsp. paratuberculosis
cgcgacugggcgcccaccc

SEQ ID NO: 856430 - RNA, 15 nt, Mycobacterium avium subsp. paratuberculosis
cgcgacugggugcuc

SEQ ID NO: 856431 - RNA, 21 nt, Mycobacterium avium subsp. paratuberculosis
cgcgacugggugcucccgcca

SEQ ID NO: 856432 - RNA, 12 nt, Mycobacterium avium subsp. paratuberculosis
cgcgagacccgg

SEQ ID NO: 856433 - RNA, 17 nt, Mycobacterium avium subsp. paratuberculosis
cgcgagacgagccgccg

SEQ ID NO: 856434 - RNA, 20 nt, Mycobacterium avium subsp. paratuberculosis
cgcgagagugcaacuagcga

SEQ ID NO: 856435 - RNA, 13 nt, Mycobacterium avium subsp. paratuberculosis
cgcgagauggcga

SEQ ID NO: 856436 - RNA, 18 nt, Mycobacterium avium subsp. paratuberculosis
cgcgagauggcgaucaga

SEQ ID NO: 856437 - RNA, 20 nt, Mycobacterium avium subsp. paratuberculosis
cgcgagcaccgcgaucgccg

SEQ ID NO: 856438 - RNA, 12 nt, Mycobacterium avium subsp. paratuberculosis
cgcgagcacgac

SEQ ID NO: 856439 - RNA, 13 nt, Mycobacterium avium subsp. paratuberculosis
cgcgagcacgacg

SEQ ID NO: 856440 - RNA, 19 nt, Mycobacterium avium subsp. paratuberculosis
cgcgagcacgacgucgacg

SEQ ID NO: 856441 - RNA, 20 nt, Mycobacterium avium subsp. paratuberculosis
cgcgagcacgacgucgacgu

SEQ ID NO: 856442 - RNA, 19 nt, Mycobacterium avium subsp. paratuberculosis
cgcgagcagacacaaaagc

SEQ ID NO: 856443 - RNA, 12 nt, Mycobacterium avium subsp. paratuberculosis
cgcgagcaccgc

SEQ ID NO: 856444 - RNA, 15 nt, Mycobacterium avium subsp. paratuberculosis
cgccugcugccagga

SEQ ID NO: 856445 - RNA, 23 nt, Mycobacterium avium subsp. paratuberculosis
cgccugcuggacguugggguggu

SEQ ID NO: 856446 - RNA, 21 nt, Mycobacterium avium subsp. paratuberculosis
cgcgacgcugauggcgaggaa

SEQ ID NO: 856447 - RNA, 14 nt, Mycobacterium avium subsp. paratuberculosis
cgcgacgcugccgg

SEQ ID NO: 856448 - RNA, 17 nt, Mycobacterium avium subsp. paratuberculosis
cgcgacgcugccggggc

SEQ ID NO: 856449 - RNA, 18 nt, Mycobacterium avium subsp. paratuberculosis
cgcgacgcugccggggcg

SEQ ID NO: 856450 - RNA, 17 nt, Mycobacterium avium subsp. paratuberculosis
cgcgacgcugccggugg

SEQ ID NO: 856451 - RNA, 18 nt, Mycobacterium avium subsp. paratuberculosis
cgcgacgcugccgguggu

SEQ ID NO: 856452 - RNA, 21 nt, Mycobacterium avium subsp. paratuberculosis
cgccugcgggaaguugcccaa

SEQ ID NO: 856453 - RNA, 22 nt, Mycobacterium avium subsp. paratuberculosis
cgccugcggugagcugaucgcg

SEQ ID NO: 856454 - RNA, 14 nt, Mycobacterium avium subsp. paratuberculosis
cgccugcgcggcgg

SEQ ID NO: 856455 - RNA, 16 nt, Mycobacterium avium subsp. paratuberculosis
cgccugcgcgggcgcg

SEQ ID NO: 856456 - RNA, 17 nt, Mycobacterium avium subsp. paratuberculosis
cgccugcgcgggcgcgg

SEQ ID NO: 856457 - RNA, 13 nt, Mycobacterium avium subsp. paratuberculosis
cgccugcgcggcg

SEQ ID NO: 856458 - RNA, 14 nt, Mycobacterium avium subsp. paratuberculosis
cgccugcgcgccgu

SEQ ID NO: 856459 - RNA, 20 nt, Mycobacterium avium subsp. paratuberculosis
cgccugcgcgccgucggcga

SEQ ID NO: 856460 - RNA, 15 nt, Mycobacterium avium subsp. paratuberculosis
cgcgacgugccggcg

SEQ ID NO: 856461 - RNA, 13 nt, Mycobacterium avium subsp. paratuberculosis
cgcgacguggcgc

SEQ ID NO: 856462 - RNA, 13 nt, Mycobacterium avium subsp. paratuberculosis
cgcgacucggugu

SEQ ID NO: 856463 - RNA, 14 nt, Mycobacterium avium subsp. paratuberculosis
cgcgacucgguguc

SEQ ID NO: 856464 - RNA, 14 nt, Mycobacterium avium subsp. paratuberculosis
cgcgacugcacccg

SEQ ID NO: 856465 - RNA, 13 nt, Mycobacterium avium subsp. paratuberculosis
cgcgacugucggc

SEQ ID NO: 856466 - RNA, 16 nt, Mycobacterium avium subsp. paratuberculosis
cgcgacugucggcgcc

SEQ ID NO: 856467 - RNA, 16 nt, Mycobacterium avium subsp. paratuberculosis
cgcgacugucggcucg

SEQ ID NO: 856468 - RNA, 18 nt, Mycobacterium avium subsp. paratuberculosis
cgcgacugucggcucgcc

SEQ ID NO: 856469 - RNA, 17 nt, Mycobacterium avium subsp. paratuberculosis
cgcgacggccucgccgu

SEQ ID NO: 856470 - RNA, 20 nt, Mycobacterium avium subsp. paratuberculosis
cgcgacggccucgccgucgc

SEQ ID NO: 856471 - RNA, 14 nt, Mycobacterium avium subsp. paratuberculosis
cgcgacggcgagcc

SEQ ID NO: 856472 - RNA, 16 nt, Mycobacterium avium subsp. paratuberculosis
cgcgacggcgagccgg

SEQ ID NO: 856473 - RNA, 19 nt, Mycobacterium avium subsp. paratuberculosis
cgcgacggcgagccgggcc

SEQ ID NO: 856474 - RNA, 20 nt, Mycobacterium avium subsp. paratuberculosis
cgcgacggcgagccgggccg

SEQ ID NO: 856475 - RNA, 23 nt, Mycobacterium avium subsp. paratuberculosis
cgcgacggcgagccgggccgggu

SEQ ID NO: 856476 - RNA, 11 nt, Mycobacterium avium subsp. paratuberculosis
cgcgacggcgc

SEQ ID NO: 856477 - RNA, 15 nt, Mycobacterium avium subsp. paratuberculosis
cgcgacggaccagug

SEQ ID NO: 856478 - RNA, 11 nt, Mycobacterium avium subsp. paratuberculosis
cgcgacggccg

SEQ ID NO: 856479 - RNA, 13 nt, Mycobacterium avium subsp. paratuberculosis
cgcgacggccgcc

SEQ ID NO: 856480 - RNA, 13 nt, Mycobacterium avium subsp. paratuberculosis
cgcgacggccggg

SEQ ID NO: 856481 - RNA, 17 nt, Mycobacterium avium subsp. paratuberculosis
cgcgacggccggggcca

SEQ ID NO: 856482 - RNA, 13 nt, Mycobacterium avium subsp. paratuberculosis
cgcgacggcggcg

SEQ ID NO: 856483 - RNA, 14 nt, Mycobacterium avium subsp. paratuberculosis
cgcgacggcggcga

SEQ ID NO: 856484 - RNA, 13 nt, Mycobacterium avium subsp. paratuberculosis
cgcgacgggcacc

SEQ ID NO: 856485 - RNA, 14 nt, Mycobacterium avium subsp. paratuberculosis
cgcgacgggcaccc

SEQ ID NO: 856486 - RNA, 19 nt, Mycobacterium avium subsp. paratuberculosis
cgcgacgggcacccgcgcg

SEQ ID NO: 856487 - RNA, 20 nt, Mycobacterium avium subsp. paratuberculosis
cgcgacgggcacccgcgcgu

SEQ ID NO: 856488 - RNA, 22 nt, Mycobacterium avium subsp. paratuberculosis
cgcgacgggcacccgcgcgucg

SEQ ID NO: 856489 - RNA, 14 nt, Mycobacterium avium subsp. paratuberculosis
cgcgacggcgcccg

SEQ ID NO: 856490 - RNA, 14 nt, Mycobacterium avium subsp. paratuberculosis
cgcgacgucgaccg

SEQ ID NO: 856491 - RNA, 15 nt, Mycobacterium avium subsp. paratuberculosis
cgcgacgucgaccgc

SEQ ID NO: 856492 - RNA, 22 nt, Mycobacterium avium subsp. paratuberculosis
cgcgacgucgaccgcgacgacc

SEQ ID NO: 856493 - RNA, 14 nt, Mycobacterium avium subsp. paratuberculosis
cgcgccacagcguc

SEQ ID NO: 856494 - RNA, 16 nt, Mycobacterium avium subsp. paratuberculosis
cgcgccacagcgucuc

SEQ ID NO: 856495 - RNA, 20 nt, Mycobacterium avium subsp. paratuberculosis
cgcgccacagcgucucgacc

SEQ ID NO: 856496 - RNA, 20 nt, Mycobacterium avium subsp. paratuberculosis
cgcgccaccccgagcucggg

SEQ ID NO: 856497 - RNA, 13 nt, Mycobacterium avium subsp. paratuberculosis
cgcgccaccgagg

SEQ ID NO: 856498 - RNA, 18 nt, Mycobacterium avium subsp. paratuberculosis
cgcgccagcgguccagcg

SEQ ID NO: 856499 - RNA, 13 nt, Mycobacterium avium subsp. paratuberculosis
cgcgccaccgcgg

SEQ ID NO: 856500 - RNA, 21 nt, Mycobacterium avium subsp. paratuberculosis
cgcgccaccgcggggcugggc

SEQ ID NO: 856501 - RNA, 19 nt, Mycobacterium avium subsp. paratuberculosis
cgcgccacgacauccccgc

SEQ ID NO: 856502 - RNA, 21 nt, Mycobacterium avium subsp. paratuberculosis
cgcgccaggucgaagaggugc

SEQ ID NO: 856503 - RNA, 13 nt, Mycobacterium avium subsp. paratuberculosis
cgcgccagcucgg

SEQ ID NO: 856504 - RNA, 15 nt, Mycobacterium avium subsp. paratuberculosis
cgcgcaucugcucgg

SEQ ID NO: 856505 - RNA, 19 nt, Mycobacterium avium subsp. paratuberculosis
cgcgcaucugcucggcguc

SEQ ID NO: 856506 - RNA, 20 nt, Mycobacterium avium subsp. paratuberculosis
cgcgcaucugcucggcgucc

SEQ ID NO: 856507 - RNA, 14 nt, Mycobacterium avium subsp. paratuberculosis
cgcgcaucgcgggc

SEQ ID NO: 856508 - RNA, 15 nt, Mycobacterium avium subsp. paratuberculosis
cgcgcaucgcgggcc

SEQ ID NO: 856509 - RNA, 16 nt, Mycobacterium avium subsp. paratuberculosis
cgcgcaucgcgggcca

SEQ ID NO: 856510 - RNA, 17 nt, Mycobacterium avium subsp. paratuberculosis
cgcgcagucgcaggccc

SEQ ID NO: 856511 - RNA, 15 nt, Mycobacterium avium subsp. paratuberculosis
cgcgcagucggcguc

SEQ ID NO: 856512 - RNA, 23 nt, Mycobacterium avium subsp. paratuberculosis
cgcgcaguagcgcauaggccgcg

SEQ ID NO: 856513 - RNA, 14 nt, Mycobacterium avium subsp. paratuberculosis
cgcgcagggucagc

SEQ ID NO: 856514 - RNA, 17 nt, Mycobacterium avium subsp. paratuberculosis
cgcgcagguagccgccg

SEQ ID NO: 856515 - RNA, 22 nt, Mycobacterium avium subsp. paratuberculosis
cgcgcaggucacccuccucgcg

SEQ ID NO: 856516 - RNA, 19 nt, Mycobacterium avium subsp. paratuberculosis
cgcgcaggucgggccggcc

SEQ ID NO: 856517 - RNA, 20 nt, Mycobacterium avium subsp. paratuberculosis
cgcgcaggucgggccggccg

SEQ ID NO: 856518 - RNA, 21 nt, Mycobacterium avium subsp. paratuberculosis
cgcgcaggucguccgacagga

SEQ ID NO: 856519 - RNA, 14 nt, Mycobacterium avium subsp. paratuberculosis
cgcgcaggugaugc

SEQ ID NO: 856520 - RNA, 21 nt, Mycobacterium avium subsp. paratuberculosis
cgcgcaggugaugcggcccga

SEQ ID NO: 856521 - RNA, 15 nt, Mycobacterium avium subsp. paratuberculosis
cgcgcagcgucaucg

SEQ ID NO: 856522 - RNA, 17 nt, Mycobacterium avium subsp. paratuberculosis
cgcgcaggcggcgacgg

SEQ ID NO: 856523 - RNA, 23 nt, Mycobacterium avium subsp. paratuberculosis
cgcgcaggcggcgacggccgucc

SEQ ID NO: 856524 - RNA, 16 nt, Mycobacterium avium subsp. paratuberculosis
cgcgcagggccagcgc

SEQ ID NO: 856525 - RNA, 22 nt, Mycobacterium avium subsp. paratuberculosis
cgcgcagggccagcgccucggc

SEQ ID NO: 856526 - RNA, 23 nt, Mycobacterium avium subsp. paratuberculosis
cgcgcagggccagcgccucggcg

SEQ ID NO: 856527 - RNA, 16 nt, Mycobacterium avium subsp. paratuberculosis
cgcgcagggacgggcg

SEQ ID NO: 856528 - RNA, 13 nt, Mycobacterium avium subsp. paratuberculosis
cgcgcagcgcguc

SEQ ID NO: 856529 - RNA, 15 nt, Mycobacterium avium subsp. paratuberculosis
cgcgcagcgcgucgg

SEQ ID NO: 856530 - RNA, 12 nt, Mycobacterium avium subsp. paratuberculosis
cgcgcagccgcg

SEQ ID NO: 856531 - RNA, 22 nt, Mycobacterium avium subsp. paratuberculosis
cgcgcagcgaagcgaggcgcca

SEQ ID NO: 856532 - RNA, 14 nt, Mycobacterium avium subsp. paratuberculosis
cgcgcagccgcggu

SEQ ID NO: 856533 - RNA, 15 nt, Mycobacterium avium subsp. paratuberculosis
cgcgcagccgcggug

SEQ ID NO: 856534 - RNA, 16 nt, Mycobacterium avium subsp. paratuberculosis
cgcgcagccggccgac

SEQ ID NO: 856535 - RNA, 17 nt, Mycobacterium avium subsp. paratuberculosis
cgcgcagccggccgacc

SEQ ID NO: 856536 - RNA, 16 nt, Mycobacterium avium subsp. paratuberculosis
cgcgcagccggccguc

SEQ ID NO: 856537 - RNA, 18 nt, Mycobacterium avium subsp. paratuberculosis
cgcgcagccggccgucca

SEQ ID NO: 856538 - RNA, 14 nt, Mycobacterium avium subsp. paratuberculosis
cgcgcagccgggcg

SEQ ID NO: 856539 - RNA, 15 nt, Mycobacterium avium subsp. paratuberculosis
cgcgcagccgggcgg

SEQ ID NO: 856540 - RNA, 16 nt, Mycobacterium avium subsp. paratuberculosis
cgcgcagccgggcggc

SEQ ID NO: 856541 - RNA, 18 nt, Mycobacterium avium subsp. paratuberculosis
cgcgcagccgggcggcgc

SEQ ID NO: 856542 - RNA, 19 nt, Mycobacterium avium subsp. paratuberculosis
cgcgcagaacaccaccgcc

SEQ ID NO: 856543 - RNA, 20 nt, Mycobacterium avium subsp. paratuberculosis
cgcgcagaacaccaccgcca

SEQ ID NO: 856544 - RNA, 13 nt, Mycobacterium avium subsp. paratuberculosis
cgcgcagcccagc

SEQ ID NO: 856545 - RNA, 20 nt, Mycobacterium avium subsp. paratuberculosis
cgcgcagaaaccccacgauc

SEQ ID NO: 856546 - RNA, 18 nt, Mycobacterium avium subsp. paratuberculosis
cgcgcacuggagugcugc

SEQ ID NO: 856547 - RNA, 15 nt, Mycobacterium avium subsp. paratuberculosis
cgcgcacgucgaggu

SEQ ID NO: 856548 - RNA, 19 nt, Mycobacterium avium subsp. paratuberculosis
cgcgcacuucgcgggcggc

SEQ ID NO: 856549 - RNA, 21 nt, Mycobacterium avium subsp. paratuberculosis
cgcgccgccgccagccagccg

SEQ ID NO: 856550 - RNA, 22 nt, Mycobacterium avium subsp. paratuberculosis
cgcgccgccgccgcccacgccg

SEQ ID NO: 856551 - RNA, 13 nt, Mycobacterium avium subsp. paratuberculosis
cgcgccgccgcgu

SEQ ID NO: 856552 - RNA, 19 nt, Mycobacterium avium subsp. paratuberculosis
cgcgccgccgcguaggcca

SEQ ID NO: 856553 - RNA, 21 nt, Mycobacterium avium subsp. paratuberculosis
cgcgccgccgcgucgugccga

SEQ ID NO: 856554 - RNA, 13 nt, Mycobacterium avium subsp. paratuberculosis
cgcgccgccgcca

SEQ ID NO: 856555 - RNA, 13 nt, Mycobacterium avium subsp. paratuberculosis
cgcgccgccgaug

SEQ ID NO: 856556 - RNA, 18 nt, Mycobacterium avium subsp. paratuberculosis
cgcgccgcccggcgaucu

SEQ ID NO: 856557 - RNA, 15 nt, Mycobacterium avium subsp. paratuberculosis
cgcgccgcgucgucg

SEQ ID NO: 856558 - RNA, 14 nt, Mycobacterium avium subsp. paratuberculosis
cgcgccgcucggcc

SEQ ID NO: 856559 - RNA, 16 nt, Mycobacterium avium subsp. paratuberculosis
cgcgccgcucggccag

SEQ ID NO: 856560 - RNA, 20 nt, Mycobacterium avium subsp. paratuberculosis
cgcgccgcucggccagcagc

SEQ ID NO: 856561 - RNA, 23 nt, Mycobacterium avium subsp. paratuberculosis
cgcgccgcucggccagcagcacc

SEQ ID NO: 856562 - RNA, 13 nt, Mycobacterium avium subsp. paratuberculosis
cgcgccgccacgc

SEQ ID NO: 856563 - RNA, 19 nt, Mycobacterium avium subsp. paratuberculosis
cgcgccgccacgcggcgcg

SEQ ID NO: 856564 - RNA, 22 nt, Mycobacterium avium subsp. paratuberculosis
cgcgccgccagcaaccccgcgg

SEQ ID NO: 856565 - RNA, 19 nt, Mycobacterium avium subsp. paratuberculosis
cgcgccgcccucgccgaac

SEQ ID NO: 856566 - RNA, 22 nt, Mycobacterium avium subsp. paratuberculosis
cgcgccgcccucgccgaaccgg

SEQ ID NO: 856567 - RNA, 13 nt, Mycobacterium avium subsp. paratuberculosis
cgcgccgccgacc

SEQ ID NO: 856568 - RNA, 20 nt, Mycobacterium avium subsp. paratuberculosis
cgcgccgccgaccacgccgc

SEQ ID NO: 856569 - RNA, 24 nt, Mycobacterium avium subsp. paratuberculosis
cgcgccgccgaccacgccgcgcuu

SEQ ID NO: 856570 - RNA, 13 nt, Mycobacterium avium subsp. paratuberculosis
cgcgccgcccagc

SEQ ID NO: 856571 - RNA, 14 nt, Mycobacterium avium subsp. paratuberculosis
cgcgccgcccagcg

SEQ ID NO: 856572 - RNA, 16 nt, Mycobacterium avium subsp. paratuberculosis
cgcgccgcccagcggc

SEQ ID NO: 856573 - RNA, 18 nt, Mycobacterium avium subsp. paratuberculosis
cgcgccgcccagcggccc

SEQ ID NO: 856574 - RNA, 12 nt, Mycobacterium avium subsp. paratuberculosis
cgcgccgaucac

SEQ ID NO: 856575 - RNA, 13 nt, Mycobacterium avium subsp. paratuberculosis
cgcgccgaggcgc

SEQ ID NO: 856576 - RNA, 17 nt, Mycobacterium avium subsp. paratuberculosis
cgcgccggagccggaga

SEQ ID NO: 856577 - RNA, 19 nt, Mycobacterium avium subsp. paratuberculosis
cgcgccgcguucggcggcg

SEQ ID NO: 856578 - RNA, 12 nt, Mycobacterium avium subsp. paratuberculosis
cgcgccggccag

SEQ ID NO: 856579 - RNA, 15 nt, Mycobacterium avium subsp. paratuberculosis
cgcgccggccagcac

SEQ ID NO: 856580 - RNA, 16 nt, Mycobacterium avium subsp. paratuberculosis
cgcgccggccagcagc

SEQ ID NO: 856581 - RNA, 15 nt, Mycobacterium avium subsp. paratuberculosis
cgcgccggccagccg

SEQ ID NO: 856582 - RNA, 17 nt, Mycobacterium avium subsp. paratuberculosis
cgcgccggccagccggc

SEQ ID NO: 856583 - RNA, 22 nt, Mycobacterium avium subsp. paratuberculosis
cgcgccggucccgcggcggcgc

SEQ ID NO: 856584 - RNA, 23 nt, Mycobacterium avium subsp. paratuberculosis
cgcgccggucccgcggcggcgcc

SEQ ID NO: 856585 - RNA, 24 nt, Mycobacterium avium subsp. paratuberculosis
cgcgccggucccgcggcggcgcca

SEQ ID NO: 856586 - RNA, 14 nt, Mycobacterium avium subsp. paratuberculosis
cgcgccggcccgau

SEQ ID NO: 856587 - RNA, 19 nt, Mycobacterium avium subsp. paratuberculosis
cgcgccgggguccucucgg

SEQ ID NO: 856588 - RNA, 17 nt, Mycobacterium avium subsp. paratuberculosis
cgcgccggggugggcca

SEQ ID NO: 856589 - RNA, 23 nt, Mycobacterium avium subsp. paratuberculosis
cgcgccggggugggccaucggca

SEQ ID NO: 856590 - RNA, 16 nt, Mycobacterium avium subsp. paratuberculosis
cgcgccggggugucca

SEQ ID NO: 856591 - RNA, 20 nt, Mycobacterium avium subsp. paratuberculosis
cgcgccggcccagacgguuc

SEQ ID NO: 856592 - RNA, 13 nt, Mycobacterium avium subsp. paratuberculosis
cgcgcccaggccc

SEQ ID NO: 856593 - RNA, 18 nt, Mycobacterium avium subsp. paratuberculosis
cgcgcccaccuggaggcc

SEQ ID NO: 856594 - RNA, 21 nt, Mycobacterium avium subsp. paratuberculosis
cgcgcccaggaacgcgccggc

SEQ ID NO: 856595 - RNA, 23 nt, Mycobacterium avium subsp. paratuberculosis
cgcgcccaggaacgcgccggcgc

SEQ ID NO: 856596 - RNA, 12 nt, Mycobacterium avium subsp. paratuberculosis
cgcgcccagccc

SEQ ID NO: 856597 - RNA, 14 nt, Mycobacterium avium subsp. paratuberculosis
cgcgcccagcccca

SEQ ID NO: 856598 - RNA, 20 nt, Mycobacterium avium subsp. paratuberculosis
cgcgcccagccccagcacga

SEQ ID NO: 856599 - RNA, 19 nt, Mycobacterium avium subsp. paratuberculosis
cgcgcccggaaagcgcggg

SEQ ID NO: 856600 - RNA, 20 nt, Mycobacterium avium subsp. paratuberculosis
cgcgcccggaaagcgcgggc

SEQ ID NO: 856601 - RNA, 22 nt, Mycobacterium avium subsp. paratuberculosis
cgcgcccggaaagcgcgggcag

SEQ ID NO: 856602 - RNA, 14 nt, Mycobacterium avium subsp. paratuberculosis
cgcgcccgcggcca

SEQ ID NO: 856603 - RNA, 15 nt, Mycobacterium avium subsp. paratuberculosis
cgcgcccgcggccau

SEQ ID NO: 856604 - RNA, 19 nt, Mycobacterium avium subsp. paratuberculosis
cgcgcccgcggccaucgcc

SEQ ID NO: 856605 - RNA, 13 nt, Mycobacterium avium subsp. paratuberculosis
cgcgcccgcgaac

SEQ ID NO: 856606 - RNA, 16 nt, Mycobacterium avium subsp. paratuberculosis
cgcgcccgcgaacacg

SEQ ID NO: 856607 - RNA, 19 nt, Mycobacterium avium subsp. paratuberculosis
cgcgcccgcgaacacgcga

SEQ ID NO: 856608 - RNA, 18 nt, Mycobacterium avium subsp. paratuberculosis
cgcgccccagugcaggca

SEQ ID NO: 856609 - RNA, 21 nt, Mycobacterium avium subsp. paratuberculosis
cgcgcccaucgcggccgcccg

SEQ ID NO: 856610 - RNA, 23 nt, Mycobacterium avium subsp. paratuberculosis
cgcgccccgagcagcgggucguc

SEQ ID NO: 856611 - RNA, 22 nt, Mycobacterium avium subsp. paratuberculosis
cgcgcccaggggagcggcggag

SEQ ID NO: 856612 - RNA, 23 nt, Mycobacterium avium subsp. paratuberculosis
cgcgccccagccccucgccgggc

SEQ ID NO: 856613 - RNA, 16 nt, Mycobacterium avium subsp. paratuberculosis
cgcgcccaugaacgcg

SEQ ID NO: 856614 - RNA, 19 nt, Mycobacterium avium subsp. paratuberculosis
cgcgcccaugaacgcgucg

SEQ ID NO: 856615 - RNA, 20 nt, Mycobacterium avium subsp. paratuberculosis
cgcgcccaugaacgcgucgc

SEQ ID NO: 856616 - RNA, 22 nt, Mycobacterium avium subsp. paratuberculosis
cgcgcccaugaacgcgucgccg

SEQ ID NO: 856617 - RNA, 13 nt, Mycobacterium avium subsp. paratuberculosis
cgcgcccggcggg

SEQ ID NO: 856618 - RNA, 14 nt, Mycobacterium avium subsp. paratuberculosis
cgcgcccggcgucg

SEQ ID NO: 856619 - RNA, 13 nt, Mycobacterium avium subsp. paratuberculosis
cgcgcccggcgcc

SEQ ID NO: 856620 - RNA, 15 nt, Mycobacterium avium subsp. paratuberculosis
cgcgcccggcuucgc

SEQ ID NO: 856621 - RNA, 19 nt, Mycobacterium avium subsp. paratuberculosis
cgcgcccggcuucgccgcg

SEQ ID NO: 856622 - RNA, 14 nt, Mycobacterium avium subsp. paratuberculosis
cgcgcccggcgacg

SEQ ID NO: 856623 - RNA, 14 nt, Mycobacterium avium subsp. paratuberculosis
cgcgcccggcgccg

SEQ ID NO: 856624 - RNA, 15 nt, Mycobacterium avium subsp. paratuberculosis
cgcgcccggcgccgg

SEQ ID NO: 856625 - RNA, 16 nt, Mycobacterium avium subsp. paratuberculosis
cgcgcccggcgccggc

SEQ ID NO: 856626 - RNA, 20 nt, Mycobacterium avium subsp. paratuberculosis
cgcgcccggcgccggcccgc

SEQ ID NO: 856627 - RNA, 13 nt, Mycobacterium avium subsp. paratuberculosis
cgcgcccggccag

SEQ ID NO: 856628 - RNA, 14 nt, Mycobacterium avium subsp. paratuberculosis
cgcgccgagguggc

SEQ ID NO: 856629 - RNA, 18 nt, Mycobacterium avium subsp. paratuberculosis
cgcgccgagguggcccgc

SEQ ID NO: 856630 - RNA, 17 nt, Mycobacterium avium subsp. paratuberculosis
cgcgccgagguggccgc

SEQ ID NO: 856631 - RNA, 19 nt, Mycobacterium avium subsp. paratuberculosis
cgcgccgagguggccgcca

SEQ ID NO: 856632 - RNA, 21 nt, Mycobacterium avium subsp. paratuberculosis
cgcgccgagguggccgccagc

SEQ ID NO: 856633 - RNA, 16 nt, Mycobacterium avium subsp. paratuberculosis
cgcgccgacggccgcg

SEQ ID NO: 856634 - RNA, 18 nt, Mycobacterium avium subsp. paratuberculosis
cgcgccgacggccgcgcc

SEQ ID NO: 856635 - RNA, 16 nt, Mycobacterium avium subsp. paratuberculosis
cgcgccgagcgcuggu

SEQ ID NO: 856636 - RNA, 17 nt, Mycobacterium avium subsp. paratuberculosis
cgcgccgagcgcugguu

SEQ ID NO: 856637 - RNA, 20 nt, Mycobacterium avium subsp. paratuberculosis
cgcgccgacccgcccgccgg

SEQ ID NO: 856638 - RNA, 21 nt, Mycobacterium avium subsp. paratuberculosis
cgcgccgacccgcccgccggg

SEQ ID NO: 856639 - RNA, 22 nt, Mycobacterium avium subsp. paratuberculosis
cgcgccgacccgcccgccgggc

SEQ ID NO: 856640 - RNA, 17 nt, Mycobacterium avium subsp. paratuberculosis
cgcgccgaccucgucgg

SEQ ID NO: 856641 - RNA, 19 nt, Mycobacterium avium subsp. paratuberculosis
cgcgccgaccucgucggcg

SEQ ID NO: 856642 - RNA, 23 nt, Mycobacterium avium subsp. paratuberculosis
cgcgccgaccucgucggcggugc

SEQ ID NO: 856643 - RNA, 20 nt, Mycobacterium avium subsp. paratuberculosis
cgcgccgaccuggucgccga

SEQ ID NO: 856644 - RNA, 14 nt, Mycobacterium avium subsp. paratuberculosis
cgcgccgacgccca

SEQ ID NO: 856645 - RNA, 16 nt, Mycobacterium avium subsp. paratuberculosis
cgcgccgacgcccaca

SEQ ID NO: 856646 - RNA, 17 nt, Mycobacterium avium subsp. paratuberculosis
cgcgccgagagcgcguc

SEQ ID NO: 856647 - RNA, 19 nt, Mycobacterium avium subsp. paratuberculosis
cgcgccgagagcgcgucga

SEQ ID NO: 856648 - RNA, 20 nt, Mycobacterium avium subsp. paratuberculosis
cgcgccgagauuggacgaca

SEQ ID NO: 856649 - RNA, 21 nt, Mycobacterium avium subsp. paratuberculosis
cgcgccgagauuggacgacac

SEQ ID NO: 856650 - RNA, 18 nt, Mycobacterium avium subsp. paratuberculosis
cgcgccgagcaaccggga

SEQ ID NO: 856651 - RNA, 19 nt, Mycobacterium avium subsp. paratuberculosis
cgcgcgcuggugcgggcca

SEQ ID NO: 856652 - RNA, 22 nt, Mycobacterium avium subsp. paratuberculosis
cgcgcgcuguccucgucgggga

SEQ ID NO: 856653 - RNA, 14 nt, Mycobacterium avium subsp. paratuberculosis
cgcgcgcugacccc

SEQ ID NO: 856654 - RNA, 13 nt, Mycobacterium avium subsp. paratuberculosis
cgcgcgcugccgc

SEQ ID NO: 856655 - RNA, 21 nt, Mycobacterium avium subsp. paratuberculosis
cgcgcgcugccgcgccccgag

SEQ ID NO: 856656 - RNA, 14 nt, Mycobacterium avium subsp. paratuberculosis
cgcgcgcggcguca

SEQ ID NO: 856657 - RNA, 15 nt, Mycobacterium avium subsp. paratuberculosis
cgcgcgcggcgucag

SEQ ID NO: 856658 - RNA, 13 nt, Mycobacterium avium subsp. paratuberculosis
cgcgcgcggcgug

SEQ ID NO: 856659 - RNA, 13 nt, Mycobacterium avium subsp. paratuberculosis
cgcgcgcgggcca

SEQ ID NO: 856660 - RNA, 14 nt, Mycobacterium avium subsp. paratuberculosis
cgcgcgcgggccag

SEQ ID NO: 856661 - RNA, 22 nt, Mycobacterium avium subsp. paratuberculosis
cgcgcgccgcccccgcggcguc

SEQ ID NO: 856662 - RNA, 12 nt, Mycobacterium avium subsp. paratuberculosis
cgcgcgcucggc

SEQ ID NO: 856663 - RNA, 14 nt, Mycobacterium avium subsp. paratuberculosis
cgcgcgcucggcgu

SEQ ID NO: 856664 - RNA, 12 nt, Mycobacterium avium subsp. paratuberculosis
cgcgcgcucggg

SEQ ID NO: 856665 - RNA, 12 nt, Mycobacterium avium subsp. paratuberculosis
cgcgcgcucggu

SEQ ID NO: 856666 - RNA, 19 nt, Mycobacterium avium subsp. paratuberculosis
cgcgcgcucggucagcacc

SEQ ID NO: 856667 - RNA, 14 nt, Mycobacterium avium subsp. paratuberculosis
cgcgcggacgcggc

SEQ ID NO: 856668 - RNA, 21 nt, Mycobacterium avium subsp. paratuberculosis
cgcgcgcuugcgcucggucgc

SEQ ID NO: 856669 - RNA, 20 nt, Mycobacterium avium subsp. paratuberculosis
cgcgcggaugcccaggccgg

SEQ ID NO: 856670 - RNA, 22 nt, Mycobacterium avium subsp. paratuberculosis
cgcgcggaugcccaggccggcg

SEQ ID NO: 856671 - RNA, 21 nt, Mycobacterium avium subsp. paratuberculosis
cgcgcggauuucucagcggcg

SEQ ID NO: 856672 - RNA, 15 nt, Mycobacterium avium subsp. paratuberculosis
cgcgcggcaccacca

SEQ ID NO: 856673 - RNA, 20 nt, Mycobacterium avium subsp. paratuberculosis
cgcgcggcaccaccagcgug

SEQ ID NO: 856674 - RNA, 12 nt, Mycobacterium avium subsp. paratuberculosis
cgcgcggcgggc

SEQ ID NO: 856675 - RNA, 22 nt, Mycobacterium avium subsp. paratuberculosis
cgcgcggcgggcccgcagcucg

SEQ ID NO: 856676 - RNA, 12 nt, Mycobacterium avium subsp. paratuberculosis
cgcgcggcgguc

SEQ ID NO: 856677 - RNA, 15 nt, Mycobacterium avium subsp. paratuberculosis
cgcgcggcgguccag

SEQ ID NO: 856678 - RNA, 19 nt, Mycobacterium avium subsp. paratuberculosis
cgcgcggcgguccagcgag

SEQ ID NO: 856679 - RNA, 14 nt, Mycobacterium avium subsp. paratuberculosis
cgcgcggcgguguc

SEQ ID NO: 856680 - RNA, 19 nt, Mycobacterium avium subsp. paratuberculosis
cgcgcggcggugucggugc

SEQ ID NO: 856681 - RNA, 15 nt, Mycobacterium avium subsp. paratuberculosis
cgcgcggcgccgcgu

SEQ ID NO: 856682 - RNA, 13 nt, Mycobacterium avium subsp. paratuberculosis
cgcgcggcgccca

SEQ ID NO: 856683 - RNA, 12 nt, Mycobacterium avium subsp. paratuberculosis
cgcgcggcgcag

SEQ ID NO: 856684 - RNA, 21 nt, Mycobacterium avium subsp. paratuberculosis
cgcgcggcgcagguccggcag

SEQ ID NO: 856685 - RNA, 23 nt, Mycobacterium avium subsp. paratuberculosis
cgcgcggcgcaguucgaccggca

SEQ ID NO: 856686 - RNA, 14 nt, Mycobacterium avium subsp. paratuberculosis
cgcgcggcgccagc

SEQ ID NO: 856687 - RNA, 17 nt, Mycobacterium avium subsp. paratuberculosis
cgcgcggcgccagcggc

SEQ ID NO: 856688 - RNA, 12 nt, Mycobacterium avium subsp. paratuberculosis
cgcgcggcgccc

SEQ ID NO: 856689 - RNA, 13 nt, Mycobacterium avium subsp. paratuberculosis
cgcgcggcgacga

SEQ ID NO: 856690 - RNA, 15 nt, Mycobacterium avium subsp. paratuberculosis
cgcgcggcgacggug

SEQ ID NO: 856691 - RNA, 16 nt, Mycobacterium avium subsp. paratuberculosis
cgcgcggcgacggugg

SEQ ID NO: 856692 - RNA, 17 nt, Mycobacterium avium subsp. paratuberculosis
cgcgcggccuccagccg

SEQ ID NO: 856693 - RNA, 18 nt, Mycobacterium avium subsp. paratuberculosis
cgcgcggccuccagccgc

SEQ ID NO: 856694 - RNA, 13 nt, Mycobacterium avium subsp. paratuberculosis
cgcgcggccgcca

SEQ ID NO: 856695 - RNA, 14 nt, Mycobacterium avium subsp. paratuberculosis
cgcgcggccgccag

SEQ ID NO: 856696 - RNA, 17 nt, Mycobacterium avium subsp. paratuberculosis
cgcgcgcugcagcaucc

SEQ ID NO: 856697 - RNA, 14 nt, Mycobacterium avium subsp. paratuberculosis
cgcgcggcccgcga

SEQ ID NO: 856698 - RNA, 12 nt, Mycobacterium avium subsp. paratuberculosis
cgcgcggcaggu

SEQ ID NO: 856699 - RNA, 15 nt, Mycobacterium avium subsp. paratuberculosis
cgcgcggcaucguca

SEQ ID NO: 856700 - RNA, 14 nt, Mycobacterium avium subsp. paratuberculosis
cgcgcggccaccag

SEQ ID NO: 856701 - RNA, 15 nt, Mycobacterium avium subsp. paratuberculosis
cgcgcggccaccagc

SEQ ID NO: 856702 - RNA, 19 nt, Mycobacterium avium subsp. paratuberculosis
cgcgcggccaccagcgcgg

SEQ ID NO: 856703 - RNA, 22 nt, Mycobacterium avium subsp. paratuberculosis
cgcgcggccaccagcgcggcca

SEQ ID NO: 856704 - RNA, 24 nt, Mycobacterium avium subsp. paratuberculosis
cgcgcggccaccagcgcggccacc

SEQ ID NO: 856705 - RNA, 16 nt, Mycobacterium avium subsp. paratuberculosis
cgcgcggccaccgcgc

SEQ ID NO: 856706 - RNA, 21 nt, Mycobacterium avium subsp. paratuberculosis
cgcgcggccaccgcgcgcugc

SEQ ID NO: 856707 - RNA, 12 nt, Mycobacterium avium subsp. paratuberculosis
cgcgcggccagc

SEQ ID NO: 856708 - RNA, 15 nt, Mycobacterium avium subsp. paratuberculosis
cgcgcgccaggucga

SEQ ID NO: 856709 - RNA, 13 nt, Mycobacterium avium subsp. paratuberculosis
cgcgcgcaggcgc

SEQ ID NO: 856710 - RNA, 14 nt, Mycobacterium avium subsp. paratuberculosis
cgcgcgcaucaccg

SEQ ID NO: 856711 - RNA, 12 nt, Mycobacterium avium subsp. paratuberculosis
cgcgcgcaggaa

SEQ ID NO: 856712 - RNA, 16 nt, Mycobacterium avium subsp. paratuberculosis
cgcgcgcaggccccgg

SEQ ID NO: 856713 - RNA, 14 nt, Mycobacterium avium subsp. paratuberculosis
cgcgcgccgcagcg

SEQ ID NO: 856714 - RNA, 13 nt, Mycobacterium avium subsp. paratuberculosis
cgcgcgccgagag

SEQ ID NO: 856715 - RNA, 22 nt, Mycobacterium avium subsp. paratuberculosis
cgcgcgccccagccccucgccg

SEQ ID NO: 856716 - RNA, 15 nt, Mycobacterium avium subsp. paratuberculosis
cgcgcgccgacagac

SEQ ID NO: 856717 - RNA, 13 nt, Mycobacterium avium subsp. paratuberculosis
cgcgcgcccgcgg

SEQ ID NO: 856718 - RNA, 14 nt, Mycobacterium avium subsp. paratuberculosis
cgcgcgcccgcggc

SEQ ID NO: 856719 - RNA, 16 nt, Mycobacterium avium subsp. paratuberculosis
cgcgcgcccgcggcca

SEQ ID NO: 856720 - RNA, 21 nt, Mycobacterium avium subsp. paratuberculosis
cgcgcgccccggucccgccgg

SEQ ID NO: 856721 - RNA, 12 nt, Mycobacterium avium subsp. paratuberculosis
cgcgcgcgucga

SEQ ID NO: 856722 - RNA, 13 nt, Mycobacterium avium subsp. paratuberculosis
cgcgcgcgucgac

SEQ ID NO: 856723 - RNA, 15 nt, Mycobacterium avium subsp. paratuberculosis
cgcgcgcggcgccgc

SEQ ID NO: 856724 - RNA, 13 nt, Mycobacterium avium subsp. paratuberculosis
cgcgcgcggcgcg

SEQ ID NO: 856725 - RNA, 14 nt, Mycobacterium avium subsp. paratuberculosis
cgcgcgcggcgcgg

SEQ ID NO: 856726 - RNA, 15 nt, Mycobacterium avium subsp. paratuberculosis
cgcgcgcggcgcgga

SEQ ID NO: 856727 - RNA, 13 nt, Mycobacterium avium subsp. paratuberculosis
cgcgcgcggcggc

SEQ ID NO: 856728 - RNA, 15 nt, Mycobacterium avium subsp. paratuberculosis
cgcgcgcggccaccg

SEQ ID NO: 856729 - RNA, 15 nt, Mycobacterium avium subsp. paratuberculosis
cgcgcgcgcggccuc

SEQ ID NO: 856730 - RNA, 13 nt, Mycobacterium avium subsp. paratuberculosis
cgcgcgcgaucgg

SEQ ID NO: 856731 - RNA, 13 nt, Mycobacterium avium subsp. paratuberculosis
cgcgcgcgacggc

SEQ ID NO: 856732 - RNA, 15 nt, Mycobacterium avium subsp. paratuberculosis
cgcgcgcgacggcgc

SEQ ID NO: 856733 - RNA, 14 nt, Mycobacterium avium subsp. paratuberculosis
cgcgcgcgagccga

SEQ ID NO: 856734 - RNA, 11 nt, Mycobacterium avium subsp. paratuberculosis
cgcgcgccggg

SEQ ID NO: 856735 - RNA, 13 nt, Mycobacterium avium subsp. paratuberculosis
cgcgcgccgggau

SEQ ID NO: 856736 - RNA, 14 nt, Mycobacterium avium subsp. paratuberculosis
cgcgcgccgggauc

SEQ ID NO: 856737 - RNA, 14 nt, Mycobacterium avium subsp. paratuberculosis
cgcgcgccggcgca

SEQ ID NO: 856738 - RNA, 15 nt, Mycobacterium avium subsp. paratuberculosis
cgcgcgccggcgcag

SEQ ID NO: 856739 - RNA, 14 nt, Mycobacterium avium subsp. paratuberculosis
cgcgcgccggccag

SEQ ID NO: 856740 - RNA, 19 nt, Mycobacterium avium subsp. paratuberculosis
cgcgcgccggccagcacgg

SEQ ID NO: 856741 - RNA, 20 nt, Mycobacterium avium subsp. paratuberculosis
cgcgcgccggccagcacggc

SEQ ID NO: 856742 - RNA, 20 nt, Mycobacterium avium subsp. paratuberculosis
cgcgcgaaaaaacggcggcg

SEQ ID NO: 856743 - RNA, 15 nt, Mycobacterium avium subsp. paratuberculosis
cgcgcgaaacccccg

SEQ ID NO: 856744 - RNA, 15 nt, Mycobacterium avium subsp. paratuberculosis
cgcgcgacggcgcgu

SEQ ID NO: 856745 - RNA, 16 nt, Mycobacterium avium subsp. paratuberculosis
cgcgcgacggcgcgug

SEQ ID NO: 856746 - RNA, 13 nt, Mycobacterium avium subsp. paratuberculosis
cgcgcgacgccgu

SEQ ID NO: 856747 - RNA, 13 nt, Mycobacterium avium subsp. paratuberculosis
cgcgcgaccagua

SEQ ID NO: 856748 - RNA, 15 nt, Mycobacterium avium subsp. paratuberculosis
cgcgcgaccaguacc

SEQ ID NO: 856749 - RNA, 22 nt, Mycobacterium avium subsp. paratuberculosis
cgcgcgaccaucagcccgguga

SEQ ID NO: 856750 - RNA, 16 nt, Mycobacterium avium subsp. paratuberculosis
cgcgcgaccgcgaugc

SEQ ID NO: 856751 - RNA, 21 nt, Mycobacterium avium subsp. paratuberculosis
cgcgcgaacagccgaccgauc

SEQ ID NO: 856752 - RNA, 16 nt, Mycobacterium avium subsp. paratuberculosis
cgcgccuugggccauc

SEQ ID NO: 856753 - RNA, 16 nt, Mycobacterium avium subsp. paratuberculosis
cgcgccuucgacccgg

SEQ ID NO: 856754 - RNA, 15 nt, Mycobacterium avium subsp. paratuberculosis
cgcgcgaaggcucgc

SEQ ID NO: 856755 - RNA, 19 nt, Mycobacterium avium subsp. paratuberculosis
cgcgcgaaggcucgccacg

SEQ ID NO: 856756 - RNA, 11 nt, Mycobacterium avium subsp. paratuberculosis
cgcgcgagcag

SEQ ID NO: 856757 - RNA, 12 nt, Mycobacterium avium subsp. paratuberculosis
cgcgcgcacuuc

SEQ ID NO: 856758 - RNA, 23 nt, Mycobacterium avium subsp. paratuberculosis
cgcgcgcacuuccuccucuucgc

SEQ ID NO: 856759 - RNA, 12 nt, Mycobacterium avium subsp. paratuberculosis
cgcgcgcaccac

SEQ ID NO: 856760 - RNA, 14 nt, Mycobacterium avium subsp. paratuberculosis
cgcgcgcaccacgu

SEQ ID NO: 856761 - RNA, 20 nt, Mycobacterium avium subsp. paratuberculosis
cgcgcgcaccacgugcgcga

SEQ ID NO: 856762 - RNA, 15 nt, Mycobacterium avium subsp. paratuberculosis
cgcgcgcaacgaggc

SEQ ID NO: 856763 - RNA, 16 nt, Mycobacterium avium subsp. paratuberculosis
cgcgcgauggacagca

SEQ ID NO: 856764 - RNA, 19 nt, Mycobacterium avium subsp. paratuberculosis
cgcgcgauggacagcagcc

SEQ ID NO: 856765 - RNA, 23 nt, Mycobacterium avium subsp. paratuberculosis
cgcgcgaugaugagcaagucggc

SEQ ID NO: 856766 - RNA, 18 nt, Mycobacterium avium subsp. paratuberculosis
cgcgcgaucagcgccguc

SEQ ID NO: 856767 - RNA, 12 nt, Mycobacterium avium subsp. paratuberculosis
cgcgcgaucagg

SEQ ID NO: 856768 - RNA, 15 nt, Mycobacterium avium subsp. paratuberculosis
cgcgcgaucaggccg

SEQ ID NO: 856769 - RNA, 16 nt, Mycobacterium avium subsp. paratuberculosis
cgcgcgaucaggccgg

SEQ ID NO: 856770 - RNA, 19 nt, Mycobacterium avium subsp. paratuberculosis
cgcgcgaucaggccggcca

SEQ ID NO: 856771 - RNA, 19 nt, Mycobacterium avium subsp. paratuberculosis
cgcgcgaucgccggugcgg

SEQ ID NO: 856772 - RNA, 13 nt, Mycobacterium avium subsp. paratuberculosis
cgcgcgaucggcg

SEQ ID NO: 856773 - RNA, 21 nt, Mycobacterium avium subsp. paratuberculosis
cgcgcgaucgguguccagccg

SEQ ID NO: 856774 - RNA, 22 nt, Mycobacterium avium subsp. paratuberculosis
cgcgcgaucgguguccagccgc

SEQ ID NO: 856775 - RNA, 19 nt, Mycobacterium avium subsp. paratuberculosis
cgcgcgaucuccgucaccg

SEQ ID NO: 856776 - RNA, 23 nt, Mycobacterium avium subsp. paratuberculosis
cgcgcgaucuccgucaccguggu

SEQ ID NO: 856777 - RNA, 20 nt, Mycobacterium avium subsp. paratuberculosis
cgcgcgagcgucacgcuggc

SEQ ID NO: 856778 - RNA, 21 nt, Mycobacterium avium subsp. paratuberculosis
cgcgcgagcgcagcgccaggc

SEQ ID NO: 856779 - RNA, 15 nt, Mycobacterium avium subsp. paratuberculosis
cgcgcgagccgaaac

SEQ ID NO: 856780 - RNA, 22 nt, Mycobacterium avium subsp. paratuberculosis
cgcgcgagaguaucgccacgcc

SEQ ID NO: 856781 - RNA, 19 nt, Mycobacterium avium subsp. paratuberculosis
cgcgcgagacaccucgucg

SEQ ID NO: 856782 - RNA, 22 nt, Mycobacterium avium subsp. paratuberculosis
cgcgcgagacaccucgucgauc

SEQ ID NO: 856783 - RNA, 23 nt, Mycobacterium avium subsp. paratuberculosis
cgcgcgagacaccucgucgaucu

SEQ ID NO: 856784 - RNA, 21 nt, Mycobacterium avium subsp. paratuberculosis
cgcgccguugaccgcggcgau

SEQ ID NO: 856785 - RNA, 23 nt, Mycobacterium avium subsp. paratuberculosis
cgcgccguugaccgcggcgaugg

SEQ ID NO: 856786 - RNA, 14 nt, Mycobacterium avium subsp. paratuberculosis
cgcgccuccgacga

SEQ ID NO: 856787 - RNA, 12 nt, Mycobacterium avium subsp. paratuberculosis
cgcgccucgcgu

SEQ ID NO: 856788 - RNA, 14 nt, Mycobacterium avium subsp. paratuberculosis
cgcgccuggcgcag

SEQ ID NO: 856789 - RNA, 14 nt, Mycobacterium avium subsp. paratuberculosis
cgcgccugcaccgg

SEQ ID NO: 856790 - RNA, 16 nt, Mycobacterium avium subsp. paratuberculosis
cgcgccugcaccggcg

SEQ ID NO: 856791 - RNA, 19 nt, Mycobacterium avium subsp. paratuberculosis
cgcgccugcaccggcgacg

SEQ ID NO: 856792 - RNA, 20 nt, Mycobacterium avium subsp. paratuberculosis
cgcgccugcaccggcgacgg

SEQ ID NO: 856793 - RNA, 20 nt, Mycobacterium avium subsp. paratuberculosis
cgcgccguguuccagguaca

SEQ ID NO: 856794 - RNA, 14 nt, Mycobacterium avium subsp. paratuberculosis
cgcgccgucggcgu

SEQ ID NO: 856795 - RNA, 18 nt, Mycobacterium avium subsp. paratuberculosis
cgcgccgugggcgucacg

SEQ ID NO: 856796 - RNA, 16 nt, Mycobacterium avium subsp. paratuberculosis
cgcgccgugcgccagc

SEQ ID NO: 856797 - RNA, 18 nt, Mycobacterium avium subsp. paratuberculosis
cgcgccgugcgccagcga

SEQ ID NO: 856798 - RNA, 19 nt, Mycobacterium avium subsp. paratuberculosis
cgcgccgugcgccagcgac

SEQ ID NO: 856799 - RNA, 20 nt, Mycobacterium avium subsp. paratuberculosis
cgcgccgugcgccagcgacc

SEQ ID NO: 856800 - RNA, 19 nt, Mycobacterium avium subsp. paratuberculosis
cgcgccgucuuccgggcca

SEQ ID NO: 856801 - RNA, 15 nt, Mycobacterium avium subsp. paratuberculosis
cgcgccgugacgccg

SEQ ID NO: 856802 - RNA, 16 nt, Mycobacterium avium subsp. paratuberculosis
cgcgccgugacgccga

SEQ ID NO: 856803 - RNA, 21 nt, Mycobacterium avium subsp. paratuberculosis
cgcgccgucccagccggacag

SEQ ID NO: 856804 - RNA, 13 nt, Mycobacterium avium subsp. paratuberculosis
cgcgccgucggcg

SEQ ID NO: 856805 - RNA, 19 nt, Mycobacterium avium subsp. paratuberculosis
cgcgccgucgucgagcacc

SEQ ID NO: 856806 - RNA, 21 nt, Mycobacterium avium subsp. paratuberculosis
cgcgccgucgucgagcaccac

SEQ ID NO: 856807 - RNA, 22 nt, Mycobacterium avium subsp. paratuberculosis
cgcgccgucgucggacaccagc

SEQ ID NO: 856808 - RNA, 15 nt, Mycobacterium avium subsp. paratuberculosis
cgcgccgucgucguc

SEQ ID NO: 856809 - RNA, 21 nt, Mycobacterium avium subsp. paratuberculosis
cgcgccgucgucgucgcucca

SEQ ID NO: 856810 - RNA, 18 nt, Mycobacterium avium subsp. paratuberculosis
cgcgccgucuccggcgua

SEQ ID NO: 856811 - RNA, 15 nt, Mycobacterium avium subsp. paratuberculosis
cgcgccguagcggcc

SEQ ID NO: 856812 - RNA, 17 nt, Mycobacterium avium subsp. paratuberculosis
cgcgccguagcggccca

SEQ ID NO: 856813 - RNA, 14 nt, Mycobacterium avium subsp. paratuberculosis
cgcgccguagcggu

SEQ ID NO: 856814 - RNA, 21 nt, Mycobacterium avium subsp. paratuberculosis
cgcgccguaccgcuuggccca

SEQ ID NO: 856815 - RNA, 19 nt, Mycobacterium avium subsp. paratuberculosis
cgcgccgguguucggcgcc

SEQ ID NO: 856816 - RNA, 23 nt, Mycobacterium avium subsp. paratuberculosis
cgcgccgguaaugggcgaucgau

SEQ ID NO: 856817 - RNA, 19 nt, Mycobacterium avium subsp. paratuberculosis
cgcgccgguaggcggccag

SEQ ID NO: 856818 - RNA, 14 nt, Mycobacterium avium subsp. paratuberculosis
cgcgcucccggcgc

SEQ ID NO: 856819 - RNA, 16 nt, Mycobacterium avium subsp. paratuberculosis
cgcgcucccggcgccg

SEQ ID NO: 856820 - RNA, 17 nt, Mycobacterium avium subsp. paratuberculosis
cgcgcucccggcgccgc

SEQ ID NO: 856821 - RNA, 20 nt, Mycobacterium avium subsp. paratuberculosis
cgcgcucccggcgccgccgu

SEQ ID NO: 856822 - RNA, 14 nt, Mycobacterium avium subsp. paratuberculosis
cgcgcucgaacuca

SEQ ID NO: 856823 - RNA, 13 nt, Mycobacterium avium subsp. paratuberculosis
cgcgcucgcacca

SEQ ID NO: 856824 - RNA, 15 nt, Mycobacterium avium subsp. paratuberculosis
cgcgcucgcaccagc

SEQ ID NO: 856825 - RNA, 18 nt, Mycobacterium avium subsp. paratuberculosis
cgcgcucgcaccagcgcu

SEQ ID NO: 856826 - RNA, 17 nt, Mycobacterium avium subsp. paratuberculosis
cgcgcuccugccagcgg

SEQ ID NO: 856827 - RNA, 13 nt, Mycobacterium avium subsp. paratuberculosis
cgcgcucggcgac

SEQ ID NO: 856828 - RNA, 15 nt, Mycobacterium avium subsp. paratuberculosis
cgcgcucggcgaccg

SEQ ID NO: 856829 - RNA, 17 nt, Mycobacterium avium subsp. paratuberculosis
cgcgcucggcgaccgcc

SEQ ID NO: 856830 - RNA, 20 nt, Mycobacterium avium subsp. paratuberculosis
cgcgcucggcgaccgccggu

SEQ ID NO: 856831 - RNA, 15 nt, Mycobacterium avium subsp. paratuberculosis
cgcgcucggcgacga

SEQ ID NO: 856832 - RNA, 13 nt, Mycobacterium avium subsp. paratuberculosis
cgcgcugcccagc

SEQ ID NO: 856833 - RNA, 14 nt, Mycobacterium avium subsp. paratuberculosis
cgcgcugccagggc

SEQ ID NO: 856834 - RNA, 13 nt, Mycobacterium avium subsp. paratuberculosis
cgcgcugccgacg

SEQ ID NO: 856835 - RNA, 14 nt, Mycobacterium avium subsp. paratuberculosis
cgcgcugccgacga

SEQ ID NO: 856836 - RNA, 17 nt, Mycobacterium avium subsp. paratuberculosis
cgcgcugccgacgaugu

SEQ ID NO: 856837 - RNA, 13 nt, Mycobacterium avium subsp. paratuberculosis
cgcgcugcaggcc

SEQ ID NO: 856838 - RNA, 15 nt, Mycobacterium avium subsp. paratuberculosis
cgcgcugcaggcccg

SEQ ID NO: 856839 - RNA, 13 nt, Mycobacterium avium subsp. paratuberculosis
cgcgcugaucgcc

SEQ ID NO: 856840 - RNA, 16 nt, Mycobacterium avium subsp. paratuberculosis
cgcgcugaucgccgcu

SEQ ID NO: 856841 - RNA, 19 nt, Mycobacterium avium subsp. paratuberculosis
cgcgcugaucgccgcuugc

SEQ ID NO: 856842 - RNA, 14 nt, Mycobacterium avium subsp. paratuberculosis
cgcgcucgggggug

SEQ ID NO: 856843 - RNA, 21 nt, Mycobacterium avium subsp. paratuberculosis
cgcgcucggucagcaccgggg

SEQ ID NO: 856844 - RNA, 15 nt, Mycobacterium avium subsp. paratuberculosis
cgcgcucggcguugg

SEQ ID NO: 856845 - RNA, 12 nt, Mycobacterium avium subsp. paratuberculosis
cgcgcucggcga

SEQ ID NO: 856846 - RNA, 14 nt, Mycobacterium avium subsp. paratuberculosis
cgcgcucgugcugc

SEQ ID NO: 856847 - RNA, 22 nt, Mycobacterium avium subsp. paratuberculosis
cgcgcucuaacuccgcucgggc

SEQ ID NO: 856848 - RNA, 21 nt, Mycobacterium avium subsp. paratuberculosis
cgcgcucuugggcggccggcu

SEQ ID NO: 856849 - RNA, 13 nt, Mycobacterium avium subsp. paratuberculosis
cgcgcugaacgcg

SEQ ID NO: 856850 - RNA, 17 nt, Mycobacterium avium subsp. paratuberculosis
cgcgcugaacgcggugg

SEQ ID NO: 856851 - RNA, 22 nt, Mycobacterium avium subsp. paratuberculosis
cgcgcugaacgcggugggcacc

SEQ ID NO: 856852 - RNA, 13 nt, Mycobacterium avium subsp. paratuberculosis
cgcgcugaccagc

SEQ ID NO: 856853 - RNA, 17 nt, Mycobacterium avium subsp. paratuberculosis
cgcgcugaccagcguga

SEQ ID NO: 856854 - RNA, 23 nt, Mycobacterium avium subsp. paratuberculosis
cgcgcugaccagcgugaccucga

SEQ ID NO: 856855 - RNA, 16 nt, Mycobacterium avium subsp. paratuberculosis
cgcgcugaccaggccg

SEQ ID NO: 856856 - RNA, 18 nt, Mycobacterium avium subsp. paratuberculosis
cgcgcugaccaggccguc

SEQ ID NO: 856857 - RNA, 22 nt, Mycobacterium avium subsp. paratuberculosis
cgcgcugaccaggccguccacc

SEQ ID NO: 856858 - RNA, 23 nt, Mycobacterium avium subsp. paratuberculosis
cgcgcugaccaggccguccacca

SEQ ID NO: 856859 - RNA, 18 nt, Mycobacterium avium subsp. paratuberculosis
cgcgcuuuggaccagggc

SEQ ID NO: 856860 - RNA, 21 nt, Mycobacterium avium subsp. paratuberculosis
cgcgcuuuggaccagggcggu

SEQ ID NO: 856861 - RNA, 14 nt, Mycobacterium avium subsp. paratuberculosis
cgcgcuggggugcu

SEQ ID NO: 856862 - RNA, 21 nt, Mycobacterium avium subsp. paratuberculosis
cgcggaaacuccuggccccga

SEQ ID NO: 856863 - RNA, 22 nt, Mycobacterium avium subsp. paratuberculosis
cgcggaaacuccuggccccgau

SEQ ID NO: 856864 - RNA, 17 nt, Mycobacterium avium subsp. paratuberculosis
cgcggaacagccggcuc

SEQ ID NO: 856865 - RNA, 19 nt, Mycobacterium avium subsp. paratuberculosis
cgcggaacagcgucgccga

SEQ ID NO: 856866 - RNA, 20 nt, Mycobacterium avium subsp. paratuberculosis
cgcggaacagcgucgccgac

SEQ ID NO: 856867 - RNA, 16 nt, Mycobacterium avium subsp. paratuberculosis
cgcggaaccggccggg

SEQ ID NO: 856868 - RNA, 21 nt, Mycobacterium avium subsp. paratuberculosis
cgcggaaccguagaccaccuc

SEQ ID NO: 856869 - RNA, 22 nt, Mycobacterium avium subsp. paratuberculosis
cgcggaaccguagaccaccucg

SEQ ID NO: 856870 - RNA, 16 nt, Mycobacterium avium subsp. paratuberculosis
cgcggaaccguugcag

SEQ ID NO: 856871 - RNA, 22 nt, Mycobacterium avium subsp. paratuberculosis
cgcggaaccguugcagcacagc

SEQ ID NO: 856872 - RNA, 15 nt, Mycobacterium avium subsp. paratuberculosis
cgcggaacgcgccgg

SEQ ID NO: 856873 - RNA, 23 nt, Mycobacterium avium subsp. paratuberculosis
cgcggaacgcgccgggcaacagc

SEQ ID NO: 856874 - RNA, 14 nt, Mycobacterium avium subsp. paratuberculosis
cgcggaacgggucg

SEQ ID NO: 856875 - RNA, 20 nt, Mycobacterium avium subsp. paratuberculosis
cgcggaacugcucccaggcg

SEQ ID NO: 856876 - RNA, 19 nt, Mycobacterium avium subsp. paratuberculosis
cgcggacagcucgccggcc

SEQ ID NO: 856877 - RNA, 15 nt, Mycobacterium avium subsp. paratuberculosis
cgcggacagcugcgc

SEQ ID NO: 856878 - RNA, 14 nt, Mycobacterium avium subsp. paratuberculosis
cgcggacagggcgg

SEQ ID NO: 856879 - RNA, 18 nt, Mycobacterium avium subsp. paratuberculosis
cgcggacagggcggcgac

SEQ ID NO: 856880 - RNA, 19 nt, Mycobacterium avium subsp. paratuberculosis
cgcggacagggcggcgacc

SEQ ID NO: 856881 - RNA, 21 nt, Mycobacterium avium subsp. paratuberculosis
cgcggaagaacaguuccucgg

SEQ ID NO: 856882 - RNA, 23 nt, Mycobacterium avium subsp. paratuberculosis
cgcggaagaacaguuccucggcg

SEQ ID NO: 856883 - RNA, 15 nt, Mycobacterium avium subsp. paratuberculosis
cgcgcugggcuaacg

SEQ ID NO: 856884 - RNA, 23 nt, Mycobacterium avium subsp. paratuberculosis
cgcgcugggcuaacgcuggucga

SEQ ID NO: 856885 - RNA, 14 nt, Mycobacterium avium subsp. paratuberculosis
cgcgcuggcggcca

SEQ ID NO: 856886 - RNA, 17 nt, Mycobacterium avium subsp. paratuberculosis
cgcgcuggcggccaucg

SEQ ID NO: 856887 - RNA, 20 nt, Mycobacterium avium subsp. paratuberculosis
cgcgcuggcggccaucgccg

SEQ ID NO: 856888 - RNA, 16 nt, Mycobacterium avium subsp. paratuberculosis
cgcgcuggccgcgugc

SEQ ID NO: 856889 - RNA, 14 nt, Mycobacterium avium subsp. paratuberculosis
cgcgcuggccgggu

SEQ ID NO: 856890 - RNA, 14 nt, Mycobacterium avium subsp. paratuberculosis
cgcgcuggccgauc

SEQ ID NO: 856891 - RNA, 14 nt, Mycobacterium avium subsp. paratuberculosis
cgcgcuggccagcg

SEQ ID NO: 856892 - RNA, 17 nt, Mycobacterium avium subsp. paratuberculosis
cgcgcuggccagcguca

SEQ ID NO: 856893 - RNA, 23 nt, Mycobacterium avium subsp. paratuberculosis
cgcgcuggccagcgucagggcga

SEQ ID NO: 856894 - RNA, 14 nt, Mycobacterium avium subsp. paratuberculosis
cgcgcugcuugacc

SEQ ID NO: 856895 - RNA, 16 nt, Mycobacterium avium subsp. paratuberculosis
cgcgcugcuugacccg

SEQ ID NO: 856896 - RNA, 14 nt, Mycobacterium avium subsp. paratuberculosis
cgcgcugcggcguc

SEQ ID NO: 856897 - RNA, 16 nt, Mycobacterium avium subsp. paratuberculosis
cgcgcugccggcccga

SEQ ID NO: 856898 - RNA, 19 nt, Mycobacterium avium subsp. paratuberculosis
cgcgcugccgcgcgccgac

SEQ ID NO: 856899 - RNA, 12 nt, Mycobacterium avium subsp. paratuberculosis
cgcgcugcgccg

SEQ ID NO: 856900 - RNA, 13 nt, Mycobacterium avium subsp. paratuberculosis
cgcgcugcgccgg

SEQ ID NO: 856901 - RNA, 14 nt, Mycobacterium avium subsp. paratuberculosis
cgcgcugcgccggg

SEQ ID NO: 856902 - RNA, 15 nt, Mycobacterium avium subsp. paratuberculosis
cgcgcugcgccgggu

SEQ ID NO: 856903 - RNA, 17 nt, Mycobacterium avium subsp. paratuberculosis
cgcgcguuccagcacgc

SEQ ID NO: 856904 - RNA, 13 nt, Mycobacterium avium subsp. paratuberculosis
cgcgcgugggcca

SEQ ID NO: 856905 - RNA, 19 nt, Mycobacterium avium subsp. paratuberculosis
cgcgcgugggccaacgcga

SEQ ID NO: 856906 - RNA, 21 nt, Mycobacterium avium subsp. paratuberculosis
cgcgcguggucccacaccacc

SEQ ID NO: 856907 - RNA, 16 nt, Mycobacterium avium subsp. paratuberculosis
cgcgcguuguccagca

SEQ ID NO: 856908 - RNA, 21 nt, Mycobacterium avium subsp. paratuberculosis
cgcgcguuguccagcagcgcc

SEQ ID NO: 856909 - RNA, 22 nt, Mycobacterium avium subsp. paratuberculosis
cgcgcguuguccagcagcgccg

SEQ ID NO: 856910 - RNA, 15 nt, Mycobacterium avium subsp. paratuberculosis
cgcgcgugcagccgg

SEQ ID NO: 856911 - RNA, 18 nt, Mycobacterium avium subsp. paratuberculosis
cgcgcgugcagccgggcg

SEQ ID NO: 856912 - RNA, 20 nt, Mycobacterium avium subsp. paratuberculosis
cgcgcgugcagccgggcggc

SEQ ID NO: 856913 - RNA, 21 nt, Mycobacterium avium subsp. paratuberculosis
cgcgcgugcagccgggcggcg

SEQ ID NO: 856914 - RNA, 16 nt, Mycobacterium avium subsp. paratuberculosis
cgcgcgucucccccga

SEQ ID NO: 856915 - RNA, 22 nt, Mycobacterium avium subsp. paratuberculosis
cgcgcgucucccccgaucagcg

SEQ ID NO: 856916 - RNA, 18 nt, Mycobacterium avium subsp. paratuberculosis
cgcgcgugacggcggggc

SEQ ID NO: 856917 - RNA, 15 nt, Mycobacterium avium subsp. paratuberculosis
cgcgcgucgggggug

SEQ ID NO: 856918 - RNA, 19 nt, Mycobacterium avium subsp. paratuberculosis
cgcgcgucgggggugccgc

SEQ ID NO: 856919 - RNA, 22 nt, Mycobacterium avium subsp. paratuberculosis
cgcgcgucgacguucgccgcca

SEQ ID NO: 856920 - RNA, 18 nt, Mycobacterium avium subsp. paratuberculosis
cgcgcucagugcacgcuc

SEQ ID NO: 856921 - RNA, 21 nt, Mycobacterium avium subsp. paratuberculosis
cgcgcucagugcacgcucggc

SEQ ID NO: 856922 - RNA, 17 nt, Mycobacterium avium subsp. paratuberculosis
cgcgcucauaucccguc

SEQ ID NO: 856923 - RNA, 15 nt, Mycobacterium avium subsp. paratuberculosis
cgcgcucagcgcggc

SEQ ID NO: 856924 - RNA, 18 nt, Mycobacterium avium subsp. paratuberculosis
cgcgcucagcgcggccac

SEQ ID NO: 856925 - RNA, 16 nt, Mycobacterium avium subsp. paratuberculosis
cgcgcucagccccagc

SEQ ID NO: 856926 - RNA, 19 nt, Mycobacterium avium subsp. paratuberculosis
cgcgcucagccccagcgga

SEQ ID NO: 856927 - RNA, 14 nt, Mycobacterium avium subsp. paratuberculosis
cgcgcucaccgucg

SEQ ID NO: 856928 - RNA, 18 nt, Mycobacterium avium subsp. paratuberculosis
cgcgcucaaccgcccagc

SEQ ID NO: 856929 - RNA, 19 nt, Mycobacterium avium subsp. paratuberculosis
cgcgcucaaccgcccagcg

SEQ ID NO: 856930 - RNA, 20 nt, Mycobacterium avium subsp. paratuberculosis
cgcgcucaaccgcccagcgg

SEQ ID NO: 856931 - RNA, 21 nt, Mycobacterium avium subsp. paratuberculosis
cgcgcucaaccgcccagcggc

SEQ ID NO: 856932 - RNA, 17 nt, Mycobacterium avium subsp. paratuberculosis
cgcgcuaacggcgcggc

SEQ ID NO: 856933 - RNA, 21 nt, Mycobacterium avium subsp. paratuberculosis
cgcgcgggucgagcagcagcc

SEQ ID NO: 856934 - RNA, 21 nt, Mycobacterium avium subsp. paratuberculosis
cgcgcgggugaguagccgaua

SEQ ID NO: 856935 - RNA, 14 nt, Mycobacterium avium subsp. paratuberculosis
cgcgcgggugcggg

SEQ ID NO: 856936 - RNA, 18 nt, Mycobacterium avium subsp. paratuberculosis
cgcgcgggugcgggcguc

SEQ ID NO: 856937 - RNA, 19 nt, Mycobacterium avium subsp. paratuberculosis
cgcgcgggugcgggcgucc

SEQ ID NO: 856938 - RNA, 18 nt, Mycobacterium avium subsp. paratuberculosis
cgcgcggugcaccaggac

SEQ ID NO: 856939 - RNA, 20 nt, Mycobacterium avium subsp. paratuberculosis
cgcgcggugcaccaggacgc

SEQ ID NO: 856940 - RNA, 14 nt, Mycobacterium avium subsp. paratuberculosis
cgcgcggugcacgg

SEQ ID NO: 856941 - RNA, 15 nt, Mycobacterium avium subsp. paratuberculosis
cgcgcggugcacggu

SEQ ID NO: 856942 - RNA, 16 nt, Mycobacterium avium subsp. paratuberculosis
cgcgcggugcacgguc

SEQ ID NO: 856943 - RNA, 19 nt, Mycobacterium avium subsp. paratuberculosis
cgcgcggugcacggucagc

SEQ ID NO: 856944 - RNA, 18 nt, Mycobacterium avium subsp. paratuberculosis
cgcgcggugaugaccucc

SEQ ID NO: 856945 - RNA, 16 nt, Mycobacterium avium subsp. paratuberculosis
cgcgcguagcgcagcu

SEQ ID NO: 856946 - RNA, 20 nt, Mycobacterium avium subsp. paratuberculosis
cgcgcgucacgcuggcguga

SEQ ID NO: 856947 - RNA, 18 nt, Mycobacterium avium subsp. paratuberculosis
cgcgcguauuccagcgcc

SEQ ID NO: 856948 - RNA, 19 nt, Mycobacterium avium subsp. paratuberculosis
cgcgcguauuccagcgcca

SEQ ID NO: 856949 - RNA, 21 nt, Mycobacterium avium subsp. paratuberculosis
cgcgcguauuccagcgccagc

SEQ ID NO: 856950 - RNA, 23 nt, Mycobacterium avium subsp. paratuberculosis
cgcgcguauuccagcgccagcga

SEQ ID NO: 856951 - RNA, 16 nt, Mycobacterium avium subsp. paratuberculosis
cgcgcgggcgaccugc

SEQ ID NO: 856952 - RNA, 17 nt, Mycobacterium avium subsp. paratuberculosis
cgcgcggugcgccagcg

SEQ ID NO: 856953 - RNA, 19 nt, Mycobacterium avium subsp. paratuberculosis
cgcgcggggucgggccgga

SEQ ID NO: 856954 - RNA, 14 nt, Mycobacterium avium subsp. paratuberculosis
cgcgcggggcggcc

SEQ ID NO: 856955 - RNA, 16 nt, Mycobacterium avium subsp. paratuberculosis
cgcgcggggcggccgc

SEQ ID NO: 856956 - RNA, 22 nt, Mycobacterium avium subsp. paratuberculosis
cgcgcggggcggccgccgggcc

SEQ ID NO: 856957 - RNA, 20 nt, Mycobacterium avium subsp. paratuberculosis
cgcgcgggggccgccgcgau

SEQ ID NO: 856958 - RNA, 18 nt, Mycobacterium avium subsp. paratuberculosis
cgcgcggggugacgcccg

SEQ ID NO: 856959 - RNA, 20 nt, Mycobacterium avium subsp. paratuberculosis
cgcgcggggugacgcccguc

SEQ ID NO: 856960 - RNA, 17 nt, Mycobacterium avium subsp. paratuberculosis
cgcgcggggugucgcgg

SEQ ID NO: 856961 - RNA, 16 nt, Mycobacterium avium subsp. paratuberculosis
cgcgcggguacggcgg

SEQ ID NO: 856962 - RNA, 17 nt, Mycobacterium avium subsp. paratuberculosis
cgcgcggguagacguuc

SEQ ID NO: 856963 - RNA, 14 nt, Mycobacterium avium subsp. paratuberculosis
cgcgcggggccggc

SEQ ID NO: 856964 - RNA, 18 nt, Mycobacterium avium subsp. paratuberculosis
cgcgcggggccggcgcgg

SEQ ID NO: 856965 - RNA, 19 nt, Mycobacterium avium subsp. paratuberculosis
cgcgcggggccggcgcggu

SEQ ID NO: 856966 - RNA, 15 nt, Mycobacterium avium subsp. paratuberculosis
cgcgcgggcggcguc

SEQ ID NO: 856967 - RNA, 15 nt, Mycobacterium avium subsp. paratuberculosis
cgcgcgggcguccuc

SEQ ID NO: 856968 - RNA, 17 nt, Mycobacterium avium subsp. paratuberculosis
cgcgcgggcguccucgu

SEQ ID NO: 856969 - RNA, 18 nt, Mycobacterium avium subsp. paratuberculosis
cgcgcgggcgcgcgccgc

SEQ ID NO: 856970 - RNA, 19 nt, Mycobacterium avium subsp. paratuberculosis
cgcgcgggcgcgcgccgcc

SEQ ID NO: 856971 - RNA, 13 nt, Mycobacterium avium subsp. paratuberculosis
cgcgcgggcgcgc

SEQ ID NO: 856972 - RNA, 21 nt, Mycobacterium avium subsp. paratuberculosis
cgcgcgggccuaggaccccgg

SEQ ID NO: 856973 - RNA, 14 nt, Mycobacterium avium subsp. paratuberculosis
cgcgcgggagcgcu

SEQ ID NO: 856974 - RNA, 15 nt, Mycobacterium avium subsp. paratuberculosis
cgcgcgggagcgcug

SEQ ID NO: 856975 - RNA, 13 nt, Mycobacterium avium subsp. paratuberculosis
cgcgcgggccagc

SEQ ID NO: 856976 - RNA, 13 nt, Mycobacterium avium subsp. paratuberculosis
cgcgcggcucgcg

SEQ ID NO: 856977 - RNA, 18 nt, Mycobacterium avium subsp. paratuberculosis
cgcgcggcgcggagccgg

SEQ ID NO: 856978 - RNA, 13 nt, Mycobacterium avium subsp. paratuberculosis
cgcgcggcugcuc

SEQ ID NO: 856979 - RNA, 15 nt, Mycobacterium avium subsp. paratuberculosis
cgcgcggcugcucga

SEQ ID NO: 856980 - RNA, 15 nt, Mycobacterium avium subsp. paratuberculosis
cgcgcggcuacagca

SEQ ID NO: 856981 - RNA, 14 nt, Mycobacterium avium subsp. paratuberculosis
cgcgcggcgucggc

SEQ ID NO: 856982 - RNA, 17 nt, Mycobacterium avium subsp. paratuberculosis
cgcgcggcgucggccgg

SEQ ID NO: 856983 - RNA, 13 nt, Mycobacterium avium subsp. paratuberculosis
cgcgcggcggcca

SEQ ID NO: 856984 - RNA, 21 nt, Mycobacterium avium subsp. paratuberculosis
cgcgcggcggccaacgcgacg

SEQ ID NO: 856985 - RNA, 17 nt, Mycobacterium avium subsp. paratuberculosis
cgcgcggcggccaccgc

SEQ ID NO: 856986 - RNA, 18 nt, Mycobacterium avium subsp. paratuberculosis
aacagcgggccggcgucg

SEQ ID NO: 856987 - RNA, 22 nt, Mycobacterium avium subsp. paratuberculosis
aacagcgucucgacggcgccga

SEQ ID NO: 856988 - RNA, 15 nt, Mycobacterium avium subsp. paratuberculosis
cgcgggucgagcagc

SEQ ID NO: 856989 - RNA, 18 nt, Mycobacterium avium subsp. paratuberculosis
cgcgggucgagcagcagc

SEQ ID NO: 856990 - RNA, 23 nt, Mycobacterium avium subsp. paratuberculosis
cgcgggucgagcagcagccgccg

SEQ ID NO: 856991 - RNA, 18 nt, Mycobacterium avium subsp. paratuberculosis
cgcgggucgccgggcagg

SEQ ID NO: 856992 - RNA, 13 nt, Mycobacterium avium subsp. paratuberculosis
cgcgggucgcggc

SEQ ID NO: 856993 - RNA, 14 nt, Mycobacterium avium subsp. paratuberculosis
cgcgggucgcggcc

SEQ ID NO: 856994 - RNA, 17 nt, Mycobacterium avium subsp. paratuberculosis
cgcgggucgcggcccac

SEQ ID NO: 856995 - RNA, 14 nt, Mycobacterium avium subsp. paratuberculosis
cgcgggucgcgguu

SEQ ID NO: 856996 - RNA, 17 nt, Mycobacterium avium subsp. paratuberculosis
cgcgggucgcuggccgc

SEQ ID NO: 856997 - RNA, 17 nt, Mycobacterium avium subsp. paratuberculosis
cgcgggucggcgacggc

SEQ ID NO: 856998 - RNA, 15 nt, Mycobacterium avium subsp. paratuberculosis
cgcgggucggcgccg

SEQ ID NO: 856999 - RNA, 16 nt, Mycobacterium avium subsp. paratuberculosis
cgcgggucggcgccgg

SEQ ID NO: 857000 - RNA, 17 nt, Mycobacterium avium subsp. paratuberculosis
cgcgggucggcgccggc

SEQ ID NO: 857001 - RNA, 19 nt, Mycobacterium avium subsp. paratuberculosis
cgcgggucggcgccggcca

SEQ ID NO: 857002 - RNA, 24 nt, Mycobacterium avium subsp. paratuberculosis
cgcgggucggcgccggccagcggc

SEQ ID NO: 857003 - RNA, 13 nt, Mycobacterium avium subsp. paratuberculosis
aacagcgcgccgg

SEQ ID NO: 857004 - RNA, 13 nt, Mycobacterium avium subsp. paratuberculosis
aacagcgcccggc

SEQ ID NO: 857005 - RNA, 18 nt, Mycobacterium avium subsp. paratuberculosis
aacagcgcgccggccggc

SEQ ID NO: 857006 - RNA, 13 nt, Mycobacterium avium subsp. paratuberculosis
aacagcgcggcca

SEQ ID NO: 857007 - RNA, 16 nt, Mycobacterium avium subsp. paratuberculosis
aacagcgcggccacca

SEQ ID NO: 857008 - RNA, 15 nt, Mycobacterium avium subsp. paratuberculosis
aacagcgcggccgga

SEQ ID NO: 857009 - RNA, 19 nt, Mycobacterium avium subsp. paratuberculosis
aacagcggggugcccacca

SEQ ID NO: 857010 - RNA, 23 nt, Mycobacterium avium subsp. paratuberculosis
cgcggguggccuucaucaccgcc

SEQ ID NO: 857011 - RNA, 15 nt, Mycobacterium avium subsp. paratuberculosis
cgcgggugucgagcc

SEQ ID NO: 857012 - RNA, 21 nt, Mycobacterium avium subsp. paratuberculosis
cgcgggugucgagccaccacu

SEQ ID NO: 857013 - RNA, 14 nt, Mycobacterium avium subsp. paratuberculosis
cgcgggugucgccc

SEQ ID NO: 857014 - RNA, 19 nt, Mycobacterium avium subsp. paratuberculosis
cgcggguguuucggucggc

SEQ ID NO: 857015 - RNA, 20 nt, Mycobacterium avium subsp. paratuberculosis
cgcggguguuucggucggcg

SEQ ID NO: 857016 - RNA, 19 nt, Mycobacterium avium subsp. paratuberculosis
cgcgggugaucugcgccgu

SEQ ID NO: 857017 - RNA, 20 nt, Mycobacterium avium subsp. paratuberculosis
cgcgggugaucugcgccgug

SEQ ID NO: 857018 - RNA, 17 nt, Mycobacterium avium subsp. paratuberculosis
cgcgggugcgcucgacg

SEQ ID NO: 857019 - RNA, 21 nt, Mycobacterium avium subsp. paratuberculosis
cgcgggugcgcugcagcgaga

SEQ ID NO: 857020 - RNA, 19 nt, Mycobacterium avium subsp. paratuberculosis
cgcgggugcggcacggcau

SEQ ID NO: 857021 - RNA, 20 nt, Mycobacterium avium subsp. paratuberculosis
cgcgggugcggcacggcaug

SEQ ID NO: 857022 - RNA, 16 nt, Mycobacterium avium subsp. paratuberculosis
cgcgggugcggcgcug

SEQ ID NO: 857023 - RNA, 15 nt, Mycobacterium avium subsp. paratuberculosis
cgcgggugcugggcg

SEQ ID NO: 857024 - RNA, 19 nt, Mycobacterium avium subsp. paratuberculosis
cgcgggugacgaucaccgc

SEQ ID NO: 857025 - RNA, 19 nt, Mycobacterium avium subsp. paratuberculosis
cgcgggugacgaucuggcg

SEQ ID NO: 857026 - RNA, 22 nt, Mycobacterium avium subsp. paratuberculosis
cgcgggugaggggcgcgcgccg

SEQ ID NO: 857027 - RNA, 23 nt, Mycobacterium avium subsp. paratuberculosis
cgcgggugaggggcgcgcgccgg

SEQ ID NO: 857028 - RNA, 17 nt, Mycobacterium avium subsp. paratuberculosis
cgcgggugauccggugc

SEQ ID NO: 857029 - RNA, 18 nt, Mycobacterium avium subsp. paratuberculosis
cgcggguccugcaaccgc

SEQ ID NO: 857030 - RNA, 15 nt, Mycobacterium avium subsp. paratuberculosis
cgcgggucuggcucg

SEQ ID NO: 857031 - RNA, 17 nt, Mycobacterium avium subsp. paratuberculosis
cgcgggucuggcucggc

SEQ ID NO: 857032 - RNA, 23 nt, Mycobacterium avium subsp. paratuberculosis
cgcgggucuggcucggcaccaga

SEQ ID NO: 857033 - RNA, 16 nt, Mycobacterium avium subsp. paratuberculosis
cgcgggucgucgacgu

SEQ ID NO: 857034 - RNA, 13 nt, Mycobacterium avium subsp. paratuberculosis
cgcgggggccgcg

SEQ ID NO: 857035 - RNA, 14 nt, Mycobacterium avium subsp. paratuberculosis
cgcgggggccgcga

SEQ ID NO: 857036 - RNA, 15 nt, Mycobacterium avium subsp. paratuberculosis
cgcgggggcggccgg

SEQ ID NO: 857037 - RNA, 21 nt, Mycobacterium avium subsp. paratuberculosis
cgcggggcggccgccgggccg

SEQ ID NO: 857038 - RNA, 16 nt, Mycobacterium avium subsp. paratuberculosis
cgcgggggcggccggg

SEQ ID NO: 857039 - RNA, 22 nt, Mycobacterium avium subsp. paratuberculosis
cgcggggucggccagucguacu

SEQ ID NO: 857040 - RNA, 16 nt, Mycobacterium avium subsp. paratuberculosis
cgcggggucgggccgg

SEQ ID NO: 857041 - RNA, 20 nt, Mycobacterium avium subsp. paratuberculosis
aacagccgguccgaccgcca

SEQ ID NO: 857042 - RNA, 17 nt, Mycobacterium avium subsp. paratuberculosis
cgcggguacggcggccg

SEQ ID NO: 857043 - RNA, 16 nt, Mycobacterium avium subsp. paratuberculosis
cgcggguacggucggc

SEQ ID NO: 857044 - RNA, 22 nt, Mycobacterium avium subsp. paratuberculosis
cgcggguagacguucuccccgc

SEQ ID NO: 857045 - RNA, 20 nt, Mycobacterium avium subsp. paratuberculosis
cgcggguagcccgucgacgg

SEQ ID NO: 857046 - RNA, 23 nt, Mycobacterium avium subsp. paratuberculosis
cgcggguagcccgucgacgggcc

SEQ ID NO: 857047 - RNA, 20 nt, Mycobacterium avium subsp. paratuberculosis
cgcggggggagggucggugg

SEQ ID NO: 857048 - RNA, 21 nt, Mycobacterium avium subsp. paratuberculosis
cgcggggggagggucgguggc

SEQ ID NO: 857049 - RNA, 16 nt, Mycobacterium avium subsp. paratuberculosis
cgcggggugucgcggc

SEQ ID NO: 857050 - RNA, 13 nt, Mycobacterium avium subsp. paratuberculosis
cgcggggcggcgg

SEQ ID NO: 857051 - RNA, 19 nt, Mycobacterium avium subsp. paratuberculosis
cgcggggcguacgcgcugc

SEQ ID NO: 857052 - RNA, 22 nt, Mycobacterium avium subsp. paratuberculosis
cgcggggcguacgcgcugccga

SEQ ID NO: 857053 - RNA, 21 nt, Mycobacterium avium subsp. paratuberculosis
cgcggggcugggcgccauggc

SEQ ID NO: 857054 - RNA, 13 nt, Mycobacterium avium subsp. paratuberculosis
cgcggggccggcg

SEQ ID NO: 857055 - RNA, 14 nt, Mycobacterium avium subsp. paratuberculosis
cgcggggccggcgc

SEQ ID NO: 857056 - RNA, 18 nt, Mycobacterium avium subsp. paratuberculosis
cgcggggccggcgcggug

SEQ ID NO: 857057 - RNA, 17 nt, Mycobacterium avium subsp. paratuberculosis
cgcgggcugcggcgagu

SEQ ID NO: 857058 - RNA, 20 nt, Mycobacterium avium subsp. paratuberculosis
cgcgggcguggcggucggug

SEQ ID NO: 857059 - RNA, 15 nt, Mycobacterium avium subsp. paratuberculosis
cgcgggcggucgcgc

SEQ ID NO: 857060 - RNA, 13 nt, Mycobacterium avium subsp. paratuberculosis
cgcgggcguccac

SEQ ID NO: 857061 - RNA, 15 nt, Mycobacterium avium subsp. paratuberculosis
cgcgggcguccacga

SEQ ID NO: 857062 - RNA, 19 nt, Mycobacterium avium subsp. paratuberculosis
cgcgggcguccucgucggc

SEQ ID NO: 857063 - RNA, 21 nt, Mycobacterium avium subsp. paratuberculosis
cgcgggcguccucgucggcga

SEQ ID NO: 857064 - RNA, 12 nt, Mycobacterium avium subsp. paratuberculosis
cgcgggcgucgg

SEQ ID NO: 857065 - RNA, 13 nt, Mycobacterium avium subsp. paratuberculosis
cgcgggcguucau

SEQ ID NO: 857066 - RNA, 23 nt, Mycobacterium avium subsp. paratuberculosis
cgcgggcguucaucaccuggucg

SEQ ID NO: 857067 - RNA, 17 nt, Mycobacterium avium subsp. paratuberculosis
cgcgggcucccgcucgc

SEQ ID NO: 857068 - RNA, 15 nt, Mycobacterium avium subsp. paratuberculosis
cgcgggcucgaacaa

SEQ ID NO: 857069 - RNA, 20 nt, Mycobacterium avium subsp. paratuberculosis
cgcgggcucgaacaacccgg

SEQ ID NO: 857070 - RNA, 20 nt, Mycobacterium avium subsp. paratuberculosis
cgcgggcugcagggccgggu

SEQ ID NO: 857071 - RNA, 14 nt, Mycobacterium avium subsp. paratuberculosis
cgcgggcgggccga

SEQ ID NO: 857072 - RNA, 17 nt, Mycobacterium avium subsp. paratuberculosis
cgcgggcggggcgccga

SEQ ID NO: 857073 - RNA, 17 nt, Mycobacterium avium subsp. paratuberculosis
cgcgggcggcgcagucg

SEQ ID NO: 857074 - RNA, 17 nt, Mycobacterium avium subsp. paratuberculosis
cgcgggcggcgucggcg

SEQ ID NO: 857075 - RNA, 18 nt, Mycobacterium avium subsp. paratuberculosis
cgcgggcggcgucggcga

SEQ ID NO: 857076 - RNA, 20 nt, Mycobacterium avium subsp. paratuberculosis
cgcgggcggcgucggcgacg

SEQ ID NO: 857077 - RNA, 15 nt, Mycobacterium avium subsp. paratuberculosis
cgcgggccugcucgu

SEQ ID NO: 857078 - RNA, 23 nt, Mycobacterium avium subsp. paratuberculosis
cgcgggccugcucgucggggcag

SEQ ID NO: 857079 - RNA, 16 nt, Mycobacterium avium subsp. paratuberculosis
cgcgggccgcagcgcg

SEQ ID NO: 857080 - RNA, 18 nt, Mycobacterium avium subsp. paratuberculosis
cgcgggccgcagcgcgcg

SEQ ID NO: 857081 - RNA, 15 nt, Mycobacterium avium subsp. paratuberculosis
cgcgggccgcgucgg

SEQ ID NO: 857082 - RNA, 16 nt, Mycobacterium avium subsp. paratuberculosis
cgcgggccgcgucggc

SEQ ID NO: 857083 - RNA, 22 nt, Mycobacterium avium subsp. paratuberculosis
cgcgggccggcacuucgaucau

SEQ ID NO: 857084 - RNA, 19 nt, Mycobacterium avium subsp. paratuberculosis
cgcgguagcgcucggucag

SEQ ID NO: 857085 - RNA, 16 nt, Mycobacterium avium subsp. paratuberculosis
cgcgguagcgcucguc

SEQ ID NO: 857086 - RNA, 13 nt, Mycobacterium avium subsp. paratuberculosis
cgcgguagcggac

SEQ ID NO: 857087 - RNA, 13 nt, Mycobacterium avium subsp. paratuberculosis
cgcggucaacacc

SEQ ID NO: 857088 - RNA, 17 nt, Mycobacterium avium subsp. paratuberculosis
cgcggucaacaccggga

SEQ ID NO: 857089 - RNA, 12 nt, Mycobacterium avium subsp. paratuberculosis
cgcggguggcca

SEQ ID NO: 857090 - RNA, 20 nt, Mycobacterium avium subsp. paratuberculosis
cgcggucaaacccauugucg

SEQ ID NO: 857091 - RNA, 15 nt, Mycobacterium avium subsp. paratuberculosis
cgcggucgccccggc

SEQ ID NO: 857092 - RNA, 18 nt, Mycobacterium avium subsp. paratuberculosis
cgcggucgccccggccgc

SEQ ID NO: 857093 - RNA, 18 nt, Mycobacterium avium subsp. paratuberculosis
cgcggucgccgcccacgc

SEQ ID NO: 857094 - RNA, 22 nt, Mycobacterium avium subsp. paratuberculosis
cgcggucgccgcccacgccgug

SEQ ID NO: 857095 - RNA, 17 nt, Mycobacterium avium subsp. paratuberculosis
cgcggucgcggcgccgg

SEQ ID NO: 857096 - RNA, 15 nt, Mycobacterium avium subsp. paratuberculosis
cgcggucgcaggccg

SEQ ID NO: 857097 - RNA, 16 nt, Mycobacterium avium subsp. paratuberculosis
cgcggucgcaggccgc

SEQ ID NO: 857098 - RNA, 19 nt, Mycobacterium avium subsp. paratuberculosis
cgcggucgcaggccgcccg

SEQ ID NO: 857099 - RNA, 21 nt, Mycobacterium avium subsp. paratuberculosis
cgcggucgcaggccgcccggc

SEQ ID NO: 857100 - RNA, 15 nt, Mycobacterium avium subsp. paratuberculosis
cgcggucgcaggcga

SEQ ID NO: 857101 - RNA, 15 nt, Mycobacterium avium subsp. paratuberculosis
cgcggucgccaccac

SEQ ID NO: 857102 - RNA, 19 nt, Mycobacterium avium subsp. paratuberculosis
cgcggucgccaccaccagc

SEQ ID NO: 857103 - RNA, 22 nt, Mycobacterium avium subsp. paratuberculosis
cgcggucgccaccaccagcggg

SEQ ID NO: 857104 - RNA, 13 nt, Mycobacterium avium subsp. paratuberculosis
cgcggucagcgcg

SEQ ID NO: 857105 - RNA, 14 nt, Mycobacterium avium subsp. paratuberculosis
cgcggucagcgcgu

SEQ ID NO: 857106 - RNA, 15 nt, Mycobacterium avium subsp. paratuberculosis
cgcggucagcgcguc

SEQ ID NO: 857107 - RNA, 23 nt, Mycobacterium avium subsp. paratuberculosis
cgcggucagcgcguccaggugcg

SEQ ID NO: 857108 - RNA, 14 nt, Mycobacterium avium subsp. paratuberculosis
cgcggucaccggcu

SEQ ID NO: 857109 - RNA, 14 nt, Mycobacterium avium subsp. paratuberculosis
cgcggucagcccgc

SEQ ID NO: 857110 - RNA, 13 nt, Mycobacterium avium subsp. paratuberculosis
cgcggucagccgg

SEQ ID NO: 857111 - RNA, 15 nt, Mycobacterium avium subsp. paratuberculosis
cgcggucagccggcu

SEQ ID NO: 857112 - RNA, 14 nt, Mycobacterium avium subsp. paratuberculosis
cgcggugcgccgac

SEQ ID NO: 857113 - RNA, 20 nt, Mycobacterium avium subsp. paratuberculosis
cgcggugcgcgcgcgcucgg

SEQ ID NO: 857114 - RNA, 13 nt, Mycobacterium avium subsp. paratuberculosis
cgcggugcgccac

SEQ ID NO: 857115 - RNA, 13 nt, Mycobacterium avium subsp. paratuberculosis
cgcggugccggug

SEQ ID NO: 857116 - RNA, 13 nt, Mycobacterium avium subsp. paratuberculosis
cgcggucggggaa

SEQ ID NO: 857117 - RNA, 21 nt, Mycobacterium avium subsp. paratuberculosis
cgcggucggggaauuccggcg

SEQ ID NO: 857118 - RNA, 23 nt, Mycobacterium avium subsp. paratuberculosis
cgcggucggggaauuccggcgcg

SEQ ID NO: 857119 - RNA, 17 nt, Mycobacterium avium subsp. paratuberculosis
cgcggucggcaacccga

SEQ ID NO: 857120 - RNA, 11 nt, Mycobacterium avium subsp. paratuberculosis
cgcggucggcg

SEQ ID NO: 857121 - RNA, 15 nt, Mycobacterium avium subsp. paratuberculosis
cgcggucggcgcccg

SEQ ID NO: 857122 - RNA, 17 nt, Mycobacterium avium subsp. paratuberculosis
cgcggucggcgcccggc

SEQ ID NO: 857123 - RNA, 22 nt, Mycobacterium avium subsp. paratuberculosis
cgcggucggcgcccggcccagc

SEQ ID NO: 857124 - RNA, 23 nt, Mycobacterium avium subsp. paratuberculosis
cgcggucggcgcccggcccagcc

SEQ ID NO: 857125 - RNA, 12 nt, Mycobacterium avium subsp. paratuberculosis
cgcggucggcgg

SEQ ID NO: 857126 - RNA, 19 nt, Mycobacterium avium subsp. paratuberculosis
cgcgguggccgggaugcca

SEQ ID NO: 857127 - RNA, 16 nt, Mycobacterium avium subsp. paratuberculosis
cgcgguggccguaacc

SEQ ID NO: 857128 - RNA, 14 nt, Mycobacterium avium subsp. paratuberculosis
cgcgguggcgaacu

SEQ ID NO: 857129 - RNA, 23 nt, Mycobacterium avium subsp. paratuberculosis
cgcgguggcgaacugcaccagca

SEQ ID NO: 857130 - RNA, 14 nt, Mycobacterium avium subsp. paratuberculosis
cgcgguggccagca

SEQ ID NO: 857131 - RNA, 18 nt, Mycobacterium avium subsp. paratuberculosis
cgcgguggcgcccgcggu

SEQ ID NO: 857132 - RNA, 16 nt, Mycobacterium avium subsp. paratuberculosis
cgcggugugcccggcg

SEQ ID NO: 857133 - RNA, 21 nt, Mycobacterium avium subsp. paratuberculosis
cgcgguggagcacagcacggc

SEQ ID NO: 857134 - RNA, 20 nt, Mycobacterium avium subsp. paratuberculosis
cgcgguggaacccagcaccc

SEQ ID NO: 857135 - RNA, 13 nt, Mycobacterium avium subsp. paratuberculosis
cgcggugcggccc

SEQ ID NO: 857136 - RNA, 15 nt, Mycobacterium avium subsp. paratuberculosis
cgcggugcggggccg

SEQ ID NO: 857137 - RNA, 22 nt, Mycobacterium avium subsp. paratuberculosis
cgcggugcggggccgcggccgg

SEQ ID NO: 857138 - RNA, 16 nt, Mycobacterium avium subsp. paratuberculosis
cgcgguguuggcggcg

SEQ ID NO: 857139 - RNA, 18 nt, Mycobacterium avium subsp. paratuberculosis
cgcgguguuggcggcguc

SEQ ID NO: 857140 - RNA, 21 nt, Mycobacterium avium subsp. paratuberculosis
cgcgguguuuggccgcgcagc

SEQ ID NO: 857141 - RNA, 13 nt, Mycobacterium avium subsp. paratuberculosis
cgcgguuccggcg

SEQ ID NO: 857142 - RNA, 15 nt, Mycobacterium avium subsp. paratuberculosis
cgcgguuccggcgug

SEQ ID NO: 857143 - RNA, 18 nt, Mycobacterium avium subsp. paratuberculosis
cgcgguuccggcgugcag

SEQ ID NO: 857144 - RNA, 19 nt, Mycobacterium avium subsp. paratuberculosis
cgcggugugcggcagcucg

SEQ ID NO: 857145 - RNA, 20 nt, Mycobacterium avium subsp. paratuberculosis
cgcggugugcggcagcucgg

SEQ ID NO: 857146 - RNA, 21 nt, Mycobacterium avium subsp. paratuberculosis
cgcggugugcggcagcucggc

SEQ ID NO: 857147 - RNA, 22 nt, Mycobacterium avium subsp. paratuberculosis
cgcggugugcggcagcucggcg

SEQ ID NO: 857148 - RNA, 14 nt, Mycobacterium avium subsp. paratuberculosis
cgcggugugcggcg

SEQ ID NO: 857149 - RNA, 19 nt, Mycobacterium avium subsp. paratuberculosis
cgcggugugcuggccagca

SEQ ID NO: 857150 - RNA, 21 nt, Mycobacterium avium subsp. paratuberculosis
cgcggugugcuggccagcacc

SEQ ID NO: 857151 - RNA, 22 nt, Mycobacterium avium subsp. paratuberculosis
cgcggugugcuggccagcacca

SEQ ID NO: 857152 - RNA, 16 nt, Mycobacterium avium subsp. paratuberculosis
cgcggugugggcgaug

SEQ ID NO: 857153 - RNA, 17 nt, Mycobacterium avium subsp. paratuberculosis
cgcggugugggcgaugg

SEQ ID NO: 857154 - RNA, 19 nt, Mycobacterium avium subsp. paratuberculosis
cgcggugugggcgauggcg

SEQ ID NO: 857155 - RNA, 20 nt, Mycobacterium avium subsp. paratuberculosis
cgcggugugggcgauggcgg

SEQ ID NO: 857156 - RNA, 21 nt, Mycobacterium avium subsp. paratuberculosis
cgcggugugggcggacugccc

SEQ ID NO: 857157 - RNA, 17 nt, Mycobacterium avium subsp. paratuberculosis
cgcgguguugagcgcgu

SEQ ID NO: 857158 - RNA, 15 nt, Mycobacterium avium subsp. paratuberculosis
cgcgguucgaggugc

SEQ ID NO: 857159 - RNA, 20 nt, Mycobacterium avium subsp. paratuberculosis
cgcgguucgaucuccucggc

SEQ ID NO: 857160 - RNA, 16 nt, Mycobacterium avium subsp. paratuberculosis
cgcgguugaucacacc

SEQ ID NO: 857161 - RNA, 14 nt, Mycobacterium avium subsp. paratuberculosis
cgcgguugaugauc

SEQ ID NO: 857162 - RNA, 18 nt, Mycobacterium avium subsp. paratuberculosis
cgcgguugaugaucuugg

SEQ ID NO: 857163 - RNA, 23 nt, Mycobacterium avium subsp. paratuberculosis
cgcgguucuuggcguaguggugc

SEQ ID NO: 857164 - RNA, 13 nt, Mycobacterium avium subsp. paratuberculosis
cgcgguugaacag

SEQ ID NO: 857165 - RNA, 14 nt, Mycobacterium avium subsp. paratuberculosis
cgcgguugaccgcc

SEQ ID NO: 857166 - RNA, 19 nt, Mycobacterium avium subsp. paratuberculosis
cgcgguugaccgccgacac

SEQ ID NO: 857167 - RNA, 20 nt, Mycobacterium avium subsp. paratuberculosis
cgcgguuggucaccaggucg

SEQ ID NO: 857168 - RNA, 17 nt, Mycobacterium avium subsp. paratuberculosis
cgcgguugggccgccgg

SEQ ID NO: 857169 - RNA, 17 nt, Mycobacterium avium subsp. paratuberculosis
cgcgguugggccggcgc

SEQ ID NO: 857170 - RNA, 20 nt, Mycobacterium avium subsp. paratuberculosis
cgcgguugggccggcgcccg

SEQ ID NO: 857171 - RNA, 14 nt, Mycobacterium avium subsp. paratuberculosis
cgcgguucggcguc

SEQ ID NO: 857172 - RNA, 15 nt, Mycobacterium avium subsp. paratuberculosis
cgcgguucggcgucg

SEQ ID NO: 857173 - RNA, 20 nt, Mycobacterium avium subsp. paratuberculosis
cgcgguucggcgucggucca

SEQ ID NO: 857174 - RNA, 12 nt, Mycobacterium avium subsp. paratuberculosis
cgcgguugacgu

SEQ ID NO: 857175 - RNA, 22 nt, Mycobacterium avium subsp. paratuberculosis
cgcgguugcgguugucggucag

SEQ ID NO: 857176 - RNA, 15 nt, Mycobacterium avium subsp. paratuberculosis
cgcguaaccggcggc

SEQ ID NO: 857177 - RNA, 17 nt, Mycobacterium avium subsp. paratuberculosis
cgcguaaccggcggcgg

SEQ ID NO: 857178 - RNA, 19 nt, Mycobacterium avium subsp. paratuberculosis
cgcguaaccggcggcggug

SEQ ID NO: 857179 - RNA, 21 nt, Mycobacterium avium subsp. paratuberculosis
cgcguaaccggcggcggugag

SEQ ID NO: 857180 - RNA, 17 nt, Mycobacterium avium subsp. paratuberculosis
cgcgguuuugaugccgc

SEQ ID NO: 857181 - RNA, 19 nt, Mycobacterium avium subsp. paratuberculosis
cgcgguuuugaugccgccg

SEQ ID NO: 857182 - RNA, 20 nt, Mycobacterium avium subsp. paratuberculosis
cgcgguuuugaugccgccgg

SEQ ID NO: 857183 - RNA, 23 nt, Mycobacterium avium subsp. paratuberculosis
cgcgguuuggucagcgcccccga

SEQ ID NO: 857184 - RNA, 20 nt, Mycobacterium avium subsp. paratuberculosis
cgcgguuucggcgucgccuu

SEQ ID NO: 857185 - RNA, 22 nt, Mycobacterium avium subsp. paratuberculosis
cgcgguuucaccgugcgcgcgc

SEQ ID NO: 857186 - RNA, 16 nt, Mycobacterium avium subsp. paratuberculosis
cgcgguuuccggcgau

SEQ ID NO: 857187 - RNA, 20 nt, Mycobacterium avium subsp. paratuberculosis
cgcgguuuccggcgauucga

SEQ ID NO: 857188 - RNA, 18 nt, Mycobacterium avium subsp. paratuberculosis
cgcguacaccggcugacc

SEQ ID NO: 857189 - RNA, 20 nt, Mycobacterium avium subsp. paratuberculosis
cgcguacaccggcugaccgg

SEQ ID NO: 857190 - RNA, 21 nt, Mycobacterium avium subsp. paratuberculosis
cgcguacaccggcugaccggc

SEQ ID NO: 857191 - RNA, 15 nt, Mycobacterium avium subsp. paratuberculosis
cgcguacacgaugcc

SEQ ID NO: 857192 - RNA, 17 nt, Mycobacterium avium subsp. paratuberculosis
cgcguacacggcccgcg

SEQ ID NO: 857193 - RNA, 19 nt, Mycobacterium avium subsp. paratuberculosis
cgcguacagccagcccgug

SEQ ID NO: 857194 - RNA, 17 nt, Mycobacterium avium subsp. paratuberculosis
cgcguacagggcgucgg

SEQ ID NO: 857195 - RNA, 20 nt, Mycobacterium avium subsp. paratuberculosis
cgcguacagggcgucggaca

SEQ ID NO: 857196 - RNA, 21 nt, Mycobacterium avium subsp. paratuberculosis
cgcguacaggucgcacaggau

SEQ ID NO: 857197 - RNA, 13 nt, Mycobacterium avium subsp. paratuberculosis
cgcguacagcgcc

SEQ ID NO: 857198 - RNA, 13 nt, Mycobacterium avium subsp. paratuberculosis
cgcguacagcggg

SEQ ID NO: 857199 - RNA, 17 nt, Mycobacterium avium subsp. paratuberculosis
cgcguacagcgggucgu

SEQ ID NO: 857200 - RNA, 17 nt, Mycobacterium avium subsp. paratuberculosis
aacagcagcgaacccgc

SEQ ID NO: 857201 - RNA, 19 nt, Mycobacterium avium subsp. paratuberculosis
aacagcagcgaacccgcca

SEQ ID NO: 857202 - RNA, 20 nt, Mycobacterium avium subsp. paratuberculosis
aacagcacgccggccggcgu

SEQ ID NO: 857203 - RNA, 13 nt, Mycobacterium avium subsp. paratuberculosis
cgcggcgccguug

SEQ ID NO: 857204 - RNA, 19 nt, Mycobacterium avium subsp. paratuberculosis
cgcggcgccguugaccggc

SEQ ID NO: 857205 - RNA, 22 nt, Mycobacterium avium subsp. paratuberculosis
cgcggcgccguugaccggccgg

SEQ ID NO: 857206 - RNA, 19 nt, Mycobacterium avium subsp. paratuberculosis
cgcggcgccguuucggacg

SEQ ID NO: 857207 - RNA, 16 nt, Mycobacterium avium subsp. paratuberculosis
aacagcagcagcagcg

SEQ ID NO: 857208 - RNA, 14 nt, Mycobacterium avium subsp. paratuberculosis
aacagcagccacga

SEQ ID NO: 857209 - RNA, 14 nt, Mycobacterium avium subsp. paratuberculosis
cgcggcgcgcgaaa

SEQ ID NO: 857210 - RNA, 15 nt, Mycobacterium avium subsp. paratuberculosis
cgcggcgcgacaccg

SEQ ID NO: 857211 - RNA, 16 nt, Mycobacterium avium subsp. paratuberculosis
cgcggcgcgacaccgc

SEQ ID NO: 857212 - RNA, 15 nt, Mycobacterium avium subsp. paratuberculosis
cgcggcgcgaugauc

SEQ ID NO: 857213 - RNA, 20 nt, Mycobacterium avium subsp. paratuberculosis
cgcggcgcgaugaucgccgg

SEQ ID NO: 857214 - RNA, 21 nt, Mycobacterium avium subsp. paratuberculosis
cgcggcgcgaugaucgccggc

SEQ ID NO: 857215 - RNA, 22 nt, Mycobacterium avium subsp. paratuberculosis
cgcggcgcgaugaucgccggcg

SEQ ID NO: 857216 - RNA, 23 nt, Mycobacterium avium subsp. paratuberculosis
cgcggcgcgaugaucgccggcgc

SEQ ID NO: 857217 - RNA, 12 nt, Mycobacterium avium subsp. paratuberculosis
cgcggcgcgcag

SEQ ID NO: 857218 - RNA, 14 nt, Mycobacterium avium subsp. paratuberculosis
cgcggcgcgcaggu

SEQ ID NO: 857219 - RNA, 17 nt, Mycobacterium avium subsp. paratuberculosis
cgcggcgcgcaucccga

SEQ ID NO: 857220 - RNA, 17 nt, Mycobacterium avium subsp. paratuberculosis
cgcggcgcgcaucgccg

SEQ ID NO: 857221 - RNA, 21 nt, Mycobacterium avium subsp. paratuberculosis
cgcggcgcgcaucgccgucca

SEQ ID NO: 857222 - RNA, 17 nt, Mycobacterium avium subsp. paratuberculosis
cgcggcgcgcaucgucg

SEQ ID NO: 857223 - RNA, 18 nt, Mycobacterium avium subsp. paratuberculosis
cgcggcgcgcaucgucgc

SEQ ID NO: 857224 - RNA, 22 nt, Mycobacterium avium subsp. paratuberculosis
cgcggcgcgcaucgucgcggcg

SEQ ID NO: 857225 - RNA, 22 nt, Mycobacterium avium subsp. paratuberculosis
cgcggcgcuaaagccaccagcg

SEQ ID NO: 857226 - RNA, 23 nt, Mycobacterium avium subsp. paratuberculosis
cgcggcgcuaaagccaccagcgu

SEQ ID NO: 857227 - RNA, 16 nt, Mycobacterium avium subsp. paratuberculosis
cgcggcgcggcccggc

SEQ ID NO: 857228 - RNA, 14 nt, Mycobacterium avium subsp. paratuberculosis
cgcggcgcgcgaug

SEQ ID NO: 857229 - RNA, 15 nt, Mycobacterium avium subsp. paratuberculosis
cgcggcgcgcgaugg

SEQ ID NO: 857230 - RNA, 21 nt, Mycobacterium avium subsp. paratuberculosis
cgcggcgcggagccggccgcc

SEQ ID NO: 857231 - RNA, 13 nt, Mycobacterium avium subsp. paratuberculosis
cgcggcgcugccg

SEQ ID NO: 857232 - RNA, 19 nt, Mycobacterium avium subsp. paratuberculosis
cgcggcgcugccgccggcc

SEQ ID NO: 857233 - RNA, 14 nt, Mycobacterium avium subsp. paratuberculosis
cgcggcgcugccgg

SEQ ID NO: 857234 - RNA, 16 nt, Mycobacterium avium subsp. paratuberculosis
cgcggcgcugccggug

SEQ ID NO: 857235 - RNA, 12 nt, Mycobacterium avium subsp. paratuberculosis
cgcggcgcgcgg

SEQ ID NO: 857236 - RNA, 16 nt, Mycobacterium avium subsp. paratuberculosis
cgcggcgcgcggccgc

SEQ ID NO: 857237 - RNA, 15 nt, Mycobacterium avium subsp. paratuberculosis
cgcggcggcgugccg

SEQ ID NO: 857238 - RNA, 14 nt, Mycobacterium avium subsp. paratuberculosis
cgcggcgggcccgc

SEQ ID NO: 857239 - RNA, 15 nt, Mycobacterium avium subsp. paratuberculosis
cgcggcgggcccgca

SEQ ID NO: 857240 - RNA, 20 nt, Mycobacterium avium subsp. paratuberculosis
cgcggcgggcccgcagcucg

SEQ ID NO: 857241 - RNA, 20 nt, Mycobacterium avium subsp. paratuberculosis
cgcggcgggcgcgucgaggu

SEQ ID NO: 857242 - RNA, 16 nt, Mycobacterium avium subsp. paratuberculosis
cgcggcgggcgugcga

SEQ ID NO: 857243 - RNA, 22 nt, Mycobacterium avium subsp. paratuberculosis
cgcggcggggcauggugucagg

SEQ ID NO: 857244 - RNA, 19 nt, Mycobacterium avium subsp. paratuberculosis
cgcggcgggggucggagca

SEQ ID NO: 857245 - RNA, 19 nt, Mycobacterium avium subsp. paratuberculosis
cgcggcgggguccacgcag

SEQ ID NO: 857246 - RNA, 21 nt, Mycobacterium avium subsp. paratuberculosis
cgcggcgggguccacgcagug

SEQ ID NO: 857247 - RNA, 18 nt, Mycobacterium avium subsp. paratuberculosis
cgcggcgggucagcaccc

SEQ ID NO: 857248 - RNA, 16 nt, Mycobacterium avium subsp. paratuberculosis
cgcggcgggcauaccg

SEQ ID NO: 857249 - RNA, 18 nt, Mycobacterium avium subsp. paratuberculosis
cgcggcgggcauaccguc

SEQ ID NO: 857250 - RNA, 13 nt, Mycobacterium avium subsp. paratuberculosis
cgcggcgggccag

SEQ ID NO: 857251 - RNA, 23 nt, Mycobacterium avium subsp. paratuberculosis
cgcggcgggccagucgccgcgca

SEQ ID NO: 857252 - RNA, 13 nt, Mycobacterium avium subsp. paratuberculosis
cgcggcgggcccg

SEQ ID NO: 857253 - RNA, 15 nt, Mycobacterium avium subsp. paratuberculosis
cgcggcggcaaccag

SEQ ID NO: 857254 - RNA, 16 nt, Mycobacterium avium subsp. paratuberculosis
cgcggcggcaaccagc

SEQ ID NO: 857255 - RNA, 18 nt, Mycobacterium avium subsp. paratuberculosis
cgcggcggcaaguccggg

SEQ ID NO: 857256 - RNA, 12 nt, Mycobacterium avium subsp. paratuberculosis
cgcggcggcucg

SEQ ID NO: 857257 - RNA, 13 nt, Mycobacterium avium subsp. paratuberculosis
cgcggcggcucgg

SEQ ID NO: 857258 - RNA, 14 nt, Mycobacterium avium subsp. paratuberculosis
cgcggcggcucggc

SEQ ID NO: 857259 - RNA, 15 nt, Mycobacterium avium subsp. paratuberculosis
cgcggcggcucggcg

SEQ ID NO: 857260 - RNA, 16 nt, Mycobacterium avium subsp. paratuberculosis
cgcggcggcucggcgg

SEQ ID NO: 857261 - RNA, 18 nt, Mycobacterium avium subsp. paratuberculosis
cgcggcggcucggcggcg

SEQ ID NO: 857262 - RNA, 15 nt, Mycobacterium avium subsp. paratuberculosis
cgcggcggcacccag

SEQ ID NO: 857263 - RNA, 23 nt, Mycobacterium avium subsp. paratuberculosis
cgcggcggcacccaggucaccga

SEQ ID NO: 857264 - RNA, 15 nt, Mycobacterium avium subsp. paratuberculosis
cgcggcggcagcacc

SEQ ID NO: 857265 - RNA, 19 nt, Mycobacterium avium subsp. paratuberculosis
cgcggcggcagcacccgca

SEQ ID NO: 857266 - RNA, 16 nt, Mycobacterium avium subsp. paratuberculosis
cgcggcggcagcagcc

SEQ ID NO: 857267 - RNA, 13 nt, Mycobacterium avium subsp. paratuberculosis
cgcggcggcgugc

SEQ ID NO: 857268 - RNA, 16 nt, Mycobacterium avium subsp. paratuberculosis
cgcggcggacagcacg

SEQ ID NO: 857269 - RNA, 15 nt, Mycobacterium avium subsp. paratuberculosis
cgcggcggacgaugu

SEQ ID NO: 857270 - RNA, 21 nt, Mycobacterium avium subsp. paratuberculosis
cgcggcggauccagcaccgcc

SEQ ID NO: 857271 - RNA, 21 nt, Mycobacterium avium subsp. paratuberculosis
cgcggcgcuugaccucgccga

SEQ ID NO: 857272 - RNA, 18 nt, Mycobacterium avium subsp. paratuberculosis
cgcggcggaggccugcgc

SEQ ID NO: 857273 - RNA, 23 nt, Mycobacterium avium subsp. paratuberculosis
cgcggcggaggccugcgcggccg

SEQ ID NO: 857274 - RNA, 12 nt, Mycobacterium avium subsp. paratuberculosis
cgcggcggaggg

SEQ ID NO: 857275 - RNA, 22 nt, Mycobacterium avium subsp. paratuberculosis
cgcggcggagggguacucggcu

SEQ ID NO: 857276 - RNA, 19 nt, Mycobacterium avium subsp. paratuberculosis
cgcggcggaggucagcggc

SEQ ID NO: 857277 - RNA, 20 nt, Mycobacterium avium subsp. paratuberculosis
cgcggcggaggucagcggcc

SEQ ID NO: 857278 - RNA, 18 nt, Mycobacterium avium subsp. paratuberculosis
cgcgggagcgcuggucgg

SEQ ID NO: 857279 - RNA, 23 nt, Mycobacterium avium subsp. paratuberculosis
cgcgggagcgcuggucggcgaac

SEQ ID NO: 857280 - RNA, 15 nt, Mycobacterium avium subsp. paratuberculosis
cgcgggaggacagcg

SEQ ID NO: 857281 - RNA, 17 nt, Mycobacterium avium subsp. paratuberculosis
cgcgggaggacagcgcg

SEQ ID NO: 857282 - RNA, 19 nt, Mycobacterium avium subsp. paratuberculosis
cgcgggaauggccgcgccg

SEQ ID NO: 857283 - RNA, 22 nt, Mycobacterium avium subsp. paratuberculosis
cgcgggaauuggcaccggaccg

SEQ ID NO: 857284 - RNA, 17 nt, Mycobacterium avium subsp. paratuberculosis
cgcgggacacggcggcg

SEQ ID NO: 857285 - RNA, 12 nt, Mycobacterium avium subsp. paratuberculosis
cgcgggacggcg

SEQ ID NO: 857286 - RNA, 18 nt, Mycobacterium avium subsp. paratuberculosis
cgcggcuuuuggcgucgu

SEQ ID NO: 857287 - RNA, 19 nt, Mycobacterium avium subsp. paratuberculosis
cgcggcuuuuggcgucguu

SEQ ID NO: 857288 - RNA, 17 nt, Mycobacterium avium subsp. paratuberculosis
cgcgggaacgaucggcu

SEQ ID NO: 857289 - RNA, 22 nt, Mycobacterium avium subsp. paratuberculosis
cgcgggaacgaucggcuccagc

SEQ ID NO: 857290 - RNA, 19 nt, Mycobacterium avium subsp. paratuberculosis
cgcgggaaucccacccgca

SEQ ID NO: 857291 - RNA, 20 nt, Mycobacterium avium subsp. paratuberculosis
cgcgggaaucccacccgcaa

SEQ ID NO: 857292 - RNA, 17 nt, Mycobacterium avium subsp. paratuberculosis
cgcgggcccgcguaacc

SEQ ID NO: 857293 - RNA, 16 nt, Mycobacterium avium subsp. paratuberculosis
cgcgggcccaccgcca

SEQ ID NO: 857294 - RNA, 13 nt, Mycobacterium avium subsp. paratuberculosis
cgcgggcccgccg

SEQ ID NO: 857295 - RNA, 15 nt, Mycobacterium avium subsp. paratuberculosis
cgcgggcccgcgccg

SEQ ID NO: 857296 - RNA, 16 nt, Mycobacterium avium subsp. paratuberculosis
cgcgggcccgcgccgc

SEQ ID NO: 857297 - RNA, 18 nt, Mycobacterium avium subsp. paratuberculosis
cgcgggcccgcgccgcgu

SEQ ID NO: 857298 - RNA, 14 nt, Mycobacterium avium subsp. paratuberculosis
cgcgggccaccggc

SEQ ID NO: 857299 - RNA, 18 nt, Mycobacterium avium subsp. paratuberculosis
cgcgggccaccggcgcca

SEQ ID NO: 857300 - RNA, 23 nt, Mycobacterium avium subsp. paratuberculosis
cgcgggccagcguuuccagcgcc

SEQ ID NO: 857301 - RNA, 12 nt, Mycobacterium avium subsp. paratuberculosis
cgcgggccaggc

SEQ ID NO: 857302 - RNA, 22 nt, Mycobacterium avium subsp. paratuberculosis
cgcgggccagacugcgcaccgc

SEQ ID NO: 857303 - RNA, 17 nt, Mycobacterium avium subsp. paratuberculosis
cgcgggccagcagcagc

SEQ ID NO: 857304 - RNA, 19 nt, Mycobacterium avium subsp. paratuberculosis
cgcgggccagcagccgggu

SEQ ID NO: 857305 - RNA, 21 nt, Mycobacterium avium subsp. paratuberculosis
cgcgggccagcagccggguca

SEQ ID NO: 857306 - RNA, 15 nt, Mycobacterium avium subsp. paratuberculosis
cgcgggaguccacgc

SEQ ID NO: 857307 - RNA, 21 nt, Mycobacterium avium subsp. paratuberculosis
cgcggcuaauucagcugcgga

SEQ ID NO: 857308 - RNA, 20 nt, Mycobacterium avium subsp. paratuberculosis
cgcggcguucuccagcaccc

SEQ ID NO: 857309 - RNA, 22 nt, Mycobacterium avium subsp. paratuberculosis
cgcggcguucuccagcacccgc

SEQ ID NO: 857310 - RNA, 23 nt, Mycobacterium avium subsp. paratuberculosis
cgcggcguugcccgcugcggcaa

SEQ ID NO: 857311 - RNA, 17 nt, Mycobacterium avium subsp. paratuberculosis
cgcggcguugcccgggu

SEQ ID NO: 857312 - RNA, 13 nt, Mycobacterium avium subsp. paratuberculosis
cgcggcguugccg

SEQ ID NO: 857313 - RNA, 16 nt, Mycobacterium avium subsp. paratuberculosis
cgcggcguugccgccg

SEQ ID NO: 857314 - RNA, 17 nt, Mycobacterium avium subsp. paratuberculosis
cgcggcguugccgccgg

SEQ ID NO: 857315 - RNA, 19 nt, Mycobacterium avium subsp. paratuberculosis
cgcggcguugccgccggcg

SEQ ID NO: 857316 - RNA, 20 nt, Mycobacterium avium subsp. paratuberculosis
cgcggcguugccgccggcgc

SEQ ID NO: 857317 - RNA, 21 nt, Mycobacterium avium subsp. paratuberculosis
cgcggcguugccgccggcgcg

SEQ ID NO: 857318 - RNA, 20 nt, Mycobacterium avium subsp. paratuberculosis
cgcggcggucacgcccgggu

SEQ ID NO: 857319 - RNA, 17 nt, Mycobacterium avium subsp. paratuberculosis
cgcggcggucagguucg

SEQ ID NO: 857320 - RNA, 18 nt, Mycobacterium avium subsp. paratuberculosis
cgcggcguucagcagcgc

SEQ ID NO: 857321 - RNA, 14 nt, Mycobacterium avium subsp. paratuberculosis
cgcggcgugguagc

SEQ ID NO: 857322 - RNA, 17 nt, Mycobacterium avium subsp. paratuberculosis
cgcggcgugguagccgc

SEQ ID NO: 857323 - RNA, 14 nt, Mycobacterium avium subsp. paratuberculosis
cgcggcggugacga

SEQ ID NO: 857324 - RNA, 16 nt, Mycobacterium avium subsp. paratuberculosis
cgcggcggugagccgc

SEQ ID NO: 857325 - RNA, 17 nt, Mycobacterium avium subsp. paratuberculosis
cgcggcggugagccgcc

SEQ ID NO: 857326 - RNA, 14 nt, Mycobacterium avium subsp. paratuberculosis
cgcggcggucgcca

SEQ ID NO: 857327 - RNA, 14 nt, Mycobacterium avium subsp. paratuberculosis
cgcggcggucgcgc

SEQ ID NO: 857328 - RNA, 15 nt, Mycobacterium avium subsp. paratuberculosis
cgcggcggucgcgcg

SEQ ID NO: 857329 - RNA, 18 nt, Mycobacterium avium subsp. paratuberculosis
cgcggcggucgcgcgccg

SEQ ID NO: 857330 - RNA, 20 nt, Mycobacterium avium subsp. paratuberculosis
cgcggcggucgcgcgccggc

SEQ ID NO: 857331 - RNA, 21 nt, Mycobacterium avium subsp. paratuberculosis
cgcggcggucgcgcgccggcg

SEQ ID NO: 857332 - RNA, 24 nt, Mycobacterium avium subsp. paratuberculosis
cgcggcggucgcgcgccggcgcag

SEQ ID NO: 857333 - RNA, 13 nt, Mycobacterium avium subsp. paratuberculosis
cgcggcgagcgcg

SEQ ID NO: 857334 - RNA, 14 nt, Mycobacterium avium subsp. paratuberculosis
cgcggcgagcgcgu

SEQ ID NO: 857335 - RNA, 12 nt, Mycobacterium avium subsp. paratuberculosis
cgcggcgagccg

SEQ ID NO: 857336 - RNA, 12 nt, Mycobacterium avium subsp. paratuberculosis
cgcggcgagcgc

SEQ ID NO: 857337 - RNA, 12 nt, Mycobacterium avium subsp. paratuberculosis
cgcggccucacc

SEQ ID NO: 857338 - RNA, 16 nt, Mycobacterium avium subsp. paratuberculosis
cgcggccucaccgcgg

SEQ ID NO: 857339 - RNA, 21 nt, Mycobacterium avium subsp. paratuberculosis
cgcggccucaccgcgggccag

SEQ ID NO: 857340 - RNA, 21 nt, Mycobacterium avium subsp. paratuberculosis
cgcggccuccagccgcgcggc

SEQ ID NO: 857341 - RNA, 20 nt, Mycobacterium avium subsp. paratuberculosis
cgcggccuccagccgcuccg

SEQ ID NO: 857342 - RNA, 23 nt, Mycobacterium avium subsp. paratuberculosis
cgcggccuccagccgcuccgcgg

SEQ ID NO: 857343 - RNA, 17 nt, Mycobacterium avium subsp. paratuberculosis
cgcggccuccgagcggc

SEQ ID NO: 857344 - RNA, 21 nt, Mycobacterium avium subsp. paratuberculosis
cgcggccuccgagcggcgcag

SEQ ID NO: 857345 - RNA, 13 nt, Mycobacterium avium subsp. paratuberculosis
cgcggccggcgug

SEQ ID NO: 857346 - RNA, 14 nt, Mycobacterium avium subsp. paratuberculosis
cgcggccuccgguu

SEQ ID NO: 857347 - RNA, 17 nt, Mycobacterium avium subsp. paratuberculosis
cgcggccucgaagcugg

SEQ ID NO: 857348 - RNA, 19 nt, Mycobacterium avium subsp. paratuberculosis
cgcggcgagcagcgcgaug

SEQ ID NO: 857349 - RNA, 21 nt, Mycobacterium avium subsp. paratuberculosis
cgcggcgagcagcgcgaugcc

SEQ ID NO: 857350 - RNA, 19 nt, Mycobacterium avium subsp. paratuberculosis
cgcggccguugcucucggc

SEQ ID NO: 857351 - RNA, 21 nt, Mycobacterium avium subsp. paratuberculosis
cgcggccguugcucucggccu

SEQ ID NO: 857352 - RNA, 22 nt, Mycobacterium avium subsp. paratuberculosis
cgcggccgucgucgugcaccac

SEQ ID NO: 857353 - RNA, 21 nt, Mycobacterium avium subsp. paratuberculosis
cgcggccggugccacggucag

SEQ ID NO: 857354 - RNA, 14 nt, Mycobacterium avium subsp. paratuberculosis
cgcggccggugcgc

SEQ ID NO: 857355 - RNA, 14 nt, Mycobacterium avium subsp. paratuberculosis
cgcggccguagccg

SEQ ID NO: 857356 - RNA, 13 nt, Mycobacterium avium subsp. paratuberculosis
cgcggccgggcgc

SEQ ID NO: 857357 - RNA, 16 nt, Mycobacterium avium subsp. paratuberculosis
cgcggccgggcgcccc

SEQ ID NO: 857358 - RNA, 15 nt, Mycobacterium avium subsp. paratuberculosis
cgcggcgcccggcgc

SEQ ID NO: 857359 - RNA, 22 nt, Mycobacterium avium subsp. paratuberculosis
cgcggcgcccccgcgacgucca

SEQ ID NO: 857360 - RNA, 18 nt, Mycobacterium avium subsp. paratuberculosis
cgcggcgcccucgccggc

SEQ ID NO: 857361 - RNA, 13 nt, Mycobacterium avium subsp. paratuberculosis
cgcggcgcccgga

SEQ ID NO: 857362 - RNA, 13 nt, Mycobacterium avium subsp. paratuberculosis
cgcggcgcccggc

SEQ ID NO: 857363 - RNA, 14 nt, Mycobacterium avium subsp. paratuberculosis
cgcggcgcccggcg

SEQ ID NO: 857364 - RNA, 13 nt, Mycobacterium avium subsp. paratuberculosis
aacagcaccagca

SEQ ID NO: 857365 - RNA, 12 nt, Mycobacterium avium subsp. paratuberculosis
aacagcaccgcc

SEQ ID NO: 857366 - RNA, 16 nt, Mycobacterium avium subsp. paratuberculosis
aacagcaccucgucgc

SEQ ID NO: 857367 - RNA, 19 nt, Mycobacterium avium subsp. paratuberculosis
cgcggcgaugcgcuccagc

SEQ ID NO: 857368 - RNA, 17 nt, Mycobacterium avium subsp. paratuberculosis
cgcggcgccagcggccg

SEQ ID NO: 857369 - RNA, 18 nt, Mycobacterium avium subsp. paratuberculosis
cgcggcgccagcggccga

SEQ ID NO: 857370 - RNA, 23 nt, Mycobacterium avium subsp. paratuberculosis
cgcggcgaucuugucccgcaugg

SEQ ID NO: 857371 - RNA, 23 nt, Mycobacterium avium subsp. paratuberculosis
cgcggcgaucuuugcggccgugg

SEQ ID NO: 857372 - RNA, 16 nt, Mycobacterium avium subsp. paratuberculosis
cgcggcgaugaccgga

SEQ ID NO: 857373 - RNA, 17 nt, Mycobacterium avium subsp. paratuberculosis
cgcggcgaugaucacga

SEQ ID NO: 857374 - RNA, 16 nt, Mycobacterium avium subsp. paratuberculosis
cgcggcgaugauccgc

SEQ ID NO: 857375 - RNA, 17 nt, Mycobacterium avium subsp. paratuberculosis
cgcggcgaugauccgcg

SEQ ID NO: 857376 - RNA, 23 nt, Mycobacterium avium subsp. paratuberculosis
cgcggcgaugauccgcggcgccg

SEQ ID NO: 857377 - RNA, 12 nt, Mycobacterium avium subsp. paratuberculosis
cgcggcgaugcg

SEQ ID NO: 857378 - RNA, 13 nt, Mycobacterium avium subsp. paratuberculosis
cgcggcgaugcgc

SEQ ID NO: 857379 - RNA, 12 nt, Mycobacterium avium subsp. paratuberculosis
cgcggcgaucag

SEQ ID NO: 857380 - RNA, 16 nt, Mycobacterium avium subsp. paratuberculosis
cgcggcgaucagcagc

SEQ ID NO: 857381 - RNA, 20 nt, Mycobacterium avium subsp. paratuberculosis
cgcggcgaucagcagcaccc

SEQ ID NO: 857382 - RNA, 21 nt, Mycobacterium avium subsp. paratuberculosis
cgcggcgaucagcagcacccg

SEQ ID NO: 857383 - RNA, 16 nt, Mycobacterium avium subsp. paratuberculosis
cgcggcgaucagcccg

SEQ ID NO: 857384 - RNA, 20 nt, Mycobacterium avium subsp. paratuberculosis
cgcggcgaucagcccggccc

SEQ ID NO: 857385 - RNA, 22 nt, Mycobacterium avium subsp. paratuberculosis
cgcggcgaucagcccggcccgc

SEQ ID NO: 857386 - RNA, 23 nt, Mycobacterium avium subsp. paratuberculosis
cgcggcgaucagcccggcccgca

SEQ ID NO: 857387 - RNA, 14 nt, Mycobacterium avium subsp. paratuberculosis
cgcggcgaucgccg

SEQ ID NO: 857388 - RNA, 19 nt, Mycobacterium avium subsp. paratuberculosis
cgcggcgaucgcgagcagg

SEQ ID NO: 857389 - RNA, 13 nt, Mycobacterium avium subsp. paratuberculosis
cgcggcgaucggc

SEQ ID NO: 857390 - RNA, 17 nt, Mycobacterium avium subsp. paratuberculosis
cgcggcgaucggcgguc

SEQ ID NO: 857391 - RNA, 22 nt, Mycobacterium avium subsp. paratuberculosis
cgcggcgaucggcgguccgccg

SEQ ID NO: 857392 - RNA, 20 nt, Mycobacterium avium subsp. paratuberculosis
cgcggcgaucgggucaccgg

SEQ ID NO: 857393 - RNA, 20 nt, Mycobacterium avium subsp. paratuberculosis
cgcggcgaucucgaucgugg

SEQ ID NO: 857394 - RNA, 14 nt, Mycobacterium avium subsp. paratuberculosis
cgcggcgaucucgg

SEQ ID NO: 857395 - RNA, 20 nt, Mycobacterium avium subsp. paratuberculosis
cgcggccggcgagucgcgga

SEQ ID NO: 857396 - RNA, 21 nt, Mycobacterium avium subsp. paratuberculosis
cgcggccggccggccuggugc

SEQ ID NO: 857397 - RNA, 18 nt, Mycobacterium avium subsp. paratuberculosis
cgcggccggccacgcucg

SEQ ID NO: 857398 - RNA, 21 nt, Mycobacterium avium subsp. paratuberculosis
cgcggccggccacgcucggcg

SEQ ID NO: 857399 - RNA, 15 nt, Mycobacterium avium subsp. paratuberculosis
cgcggccggcccagc

SEQ ID NO: 857400 - RNA, 18 nt, Mycobacterium avium subsp. paratuberculosis
cgcggccggcccagcgcg

SEQ ID NO: 857401 - RNA, 23 nt, Mycobacterium avium subsp. paratuberculosis
cgcggccggcccagcgcgcggcg

SEQ ID NO: 857402 - RNA, 13 nt, Mycobacterium avium subsp. paratuberculosis
cgcggccggccga

SEQ ID NO: 857403 - RNA, 14 nt, Mycobacterium avium subsp. paratuberculosis
cgcggccggccgac

SEQ ID NO: 857404 - RNA, 17 nt, Mycobacterium avium subsp. paratuberculosis
cgcggccggccgacacc

SEQ ID NO: 857405 - RNA, 14 nt, Mycobacterium avium subsp. paratuberculosis
cgcggccggaucga

SEQ ID NO: 857406 - RNA, 22 nt, Mycobacterium avium subsp. paratuberculosis
cgcggccggaucgaauccggcg

SEQ ID NO: 857407 - RNA, 22 nt, Mycobacterium avium subsp. paratuberculosis
cgcggccggaagaccguugacg

SEQ ID NO: 857408 - RNA, 16 nt, Mycobacterium avium subsp. paratuberculosis
cgcggccgcgucggcg

SEQ ID NO: 857409 - RNA, 15 nt, Mycobacterium avium subsp. paratuberculosis
cgcggccgcguuguc

SEQ ID NO: 857410 - RNA, 20 nt, Mycobacterium avium subsp. paratuberculosis
cgcggccgcguugucgacca

SEQ ID NO: 857411 - RNA, 12 nt, Mycobacterium avium subsp. paratuberculosis
cgcggccgcugc

SEQ ID NO: 857412 - RNA, 19 nt, Mycobacterium avium subsp. paratuberculosis
cgcggccgcugcgcccagc

SEQ ID NO: 857413 - RNA, 15 nt, Mycobacterium avium subsp. paratuberculosis
cgcggccgcuggcgu

SEQ ID NO: 857414 - RNA, 13 nt, Mycobacterium avium subsp. paratuberculosis
cgcggccgcgccg

SEQ ID NO: 857415 - RNA, 14 nt, Mycobacterium avium subsp. paratuberculosis
cgcggccgcgccgg

SEQ ID NO: 857416 - RNA, 15 nt, Mycobacterium avium subsp. paratuberculosis
cgcggccgcgccggc

SEQ ID NO: 857417 - RNA, 15 nt, Mycobacterium avium subsp. paratuberculosis
cgcggccgcgcgccc

SEQ ID NO: 857418 - RNA, 12 nt, Mycobacterium avium subsp. paratuberculosis
cgcggccgcggc

SEQ ID NO: 857419 - RNA, 15 nt, Mycobacterium avium subsp. paratuberculosis
cgcggccgcggcgcg

SEQ ID NO: 857420 - RNA, 17 nt, Mycobacterium avium subsp. paratuberculosis
cgcggccgcggcgcgca

SEQ ID NO: 857421 - RNA, 14 nt, Mycobacterium avium subsp. paratuberculosis
cgcggccgcggcgg

SEQ ID NO: 857422 - RNA, 19 nt, Mycobacterium avium subsp. paratuberculosis
cgcggcccguugagcaccg

SEQ ID NO: 857423 - RNA, 18 nt, Mycobacterium avium subsp. paratuberculosis
cgcggcccguacucgggu

SEQ ID NO: 857424 - RNA, 14 nt, Mycobacterium avium subsp. paratuberculosis
cgcggcccggccac

SEQ ID NO: 857425 - RNA, 15 nt, Mycobacterium avium subsp. paratuberculosis
cgcggcccggccacc

SEQ ID NO: 857426 - RNA, 18 nt, Mycobacterium avium subsp. paratuberculosis
cgcggcccggcccgcugg

SEQ ID NO: 857427 - RNA, 22 nt, Mycobacterium avium subsp. paratuberculosis
cgcggcccggcccgcuggccgc

SEQ ID NO: 857428 - RNA, 11 nt, Mycobacterium avium subsp. paratuberculosis
cgcggcccgcg

SEQ ID NO: 857429 - RNA, 16 nt, Mycobacterium avium subsp. paratuberculosis
cgcggcccgcgacguc

SEQ ID NO: 857430 - RNA, 18 nt, Mycobacterium avium subsp. paratuberculosis
cgcggcccgcgacgucgg

SEQ ID NO: 857431 - RNA, 12 nt, Mycobacterium avium subsp. paratuberculosis
cgcggcccgcgg

SEQ ID NO: 857432 - RNA, 14 nt, Mycobacterium avium subsp. paratuberculosis
cgcggcccgcgggg

SEQ ID NO: 857433 - RNA, 15 nt, Mycobacterium avium subsp. paratuberculosis
cgcggcccgccgaac

SEQ ID NO: 857434 - RNA, 22 nt, Mycobacterium avium subsp. paratuberculosis
cgcggcccgccgaacgccuccg

SEQ ID NO: 857435 - RNA, 18 nt, Mycobacterium avium subsp. paratuberculosis
cgcggcccgccgcucacc

SEQ ID NO: 857436 - RNA, 20 nt, Mycobacterium avium subsp. paratuberculosis
cgcggcccgccgcucaccgc

SEQ ID NO: 857437 - RNA, 22 nt, Mycobacterium avium subsp. paratuberculosis
cgcggacccuggccagcaccgc

SEQ ID NO: 857438 - RNA, 15 nt, Mycobacterium avium subsp. paratuberculosis
cgcggaccccagcgu

SEQ ID NO: 857439 - RNA, 20 nt, Mycobacterium avium subsp. paratuberculosis
cgcggaccccagcgugacgu

SEQ ID NO: 857440 - RNA, 17 nt, Mycobacterium avium subsp. paratuberculosis
cgcggaccccagugcag

SEQ ID NO: 857441 - RNA, 21 nt, Mycobacterium avium subsp. paratuberculosis
cgcggaccccagugcaggcug

SEQ ID NO: 857442 - RNA, 20 nt, Mycobacterium avium subsp. paratuberculosis
cgcggacauucggacggccc

SEQ ID NO: 857443 - RNA, 18 nt, Mycobacterium avium subsp. paratuberculosis
cgcggacauucugcacga

SEQ ID NO: 857444 - RNA, 21 nt, Mycobacterium avium subsp. paratuberculosis
cgcggacauucugcacgacga

SEQ ID NO: 857445 - RNA, 22 nt, Mycobacterium avium subsp. paratuberculosis
cgcggacauucugcacgacgaa

SEQ ID NO: 857446 - RNA, 13 nt, Mycobacterium avium subsp. paratuberculosis
cgcggaccaccgc

SEQ ID NO: 857447 - RNA, 14 nt, Mycobacterium avium subsp. paratuberculosis
cgcggaccaccgcg

SEQ ID NO: 857448 - RNA, 19 nt, Mycobacterium avium subsp. paratuberculosis
cgcucuaacuccgcucggg

SEQ ID NO: 857449 - RNA, 16 nt, Mycobacterium avium subsp. paratuberculosis
cgcucguccagggugg

SEQ ID NO: 857450 - RNA, 13 nt, Mycobacterium avium subsp. paratuberculosis
cgcucgucgucgc

SEQ ID NO: 857451 - RNA, 22 nt, Mycobacterium avium subsp. paratuberculosis
cgcucgucuuuauucggcuucg

SEQ ID NO: 857452 - RNA, 17 nt, Mycobacterium avium subsp. paratuberculosis
cgcucgugaccggcggu

SEQ ID NO: 857453 - RNA, 18 nt, Mycobacterium avium subsp. paratuberculosis
cgcucgugaccggcggug

SEQ ID NO: 857454 - RNA, 13 nt, Mycobacterium avium subsp. paratuberculosis
cgcucgucggcca

SEQ ID NO: 857455 - RNA, 17 nt, Mycobacterium avium subsp. paratuberculosis
cgcucgucggccagcga

SEQ ID NO: 857456 - RNA, 12 nt, Mycobacterium avium subsp. paratuberculosis
cgcucgucggcg

SEQ ID NO: 857457 - RNA, 13 nt, Mycobacterium avium subsp. paratuberculosis
cgcucgucggcgc

SEQ ID NO: 857458 - RNA, 14 nt, Mycobacterium avium subsp. paratuberculosis
cgcucgucggcgcg

SEQ ID NO: 857459 - RNA, 15 nt, Mycobacterium avium subsp. paratuberculosis
cgcucgucggcgcgg

SEQ ID NO: 857460 - RNA, 14 nt, Mycobacterium avium subsp. paratuberculosis
cgcucgucgggcac

SEQ ID NO: 857461 - RNA, 15 nt, Mycobacterium avium subsp. paratuberculosis
cgcucgucgggcaca

SEQ ID NO: 857462 - RNA, 18 nt, Mycobacterium avium subsp. paratuberculosis
cgcucgucgggcucgucg

SEQ ID NO: 857463 - RNA, 21 nt, Mycobacterium avium subsp. paratuberculosis
cgcucgucguagucgaggccg

SEQ ID NO: 857464 - RNA, 22 nt, Mycobacterium avium subsp. paratuberculosis
cgcucguaacgccacggcggcc

SEQ ID NO: 857465 - RNA, 18 nt, Mycobacterium avium subsp. paratuberculosis
cgcucguaguuggggccg

SEQ ID NO: 857466 - RNA, 23 nt, Mycobacterium avium subsp. paratuberculosis
cgcucguaguuggggccggccgc

SEQ ID NO: 857467 - RNA, 15 nt, Mycobacterium avium subsp. paratuberculosis
cgcucggucagcacc

SEQ ID NO: 857468 - RNA, 16 nt, Mycobacterium avium subsp. paratuberculosis
cgcucggucagcaccg

SEQ ID NO: 857469 - RNA, 20 nt, Mycobacterium avium subsp. paratuberculosis
cgcucggucagcaccggggc

SEQ ID NO: 857470 - RNA, 14 nt, Mycobacterium avium subsp. paratuberculosis
cgcucgggugucgc

SEQ ID NO: 857471 - RNA, 19 nt, Mycobacterium avium subsp. paratuberculosis
cgcucgggugucgccgagc

SEQ ID NO: 857472 - RNA, 23 nt, Mycobacterium avium subsp. paratuberculosis
cgcucgggugucgccgagccgca

SEQ ID NO: 857473 - RNA, 22 nt, Mycobacterium avium subsp. paratuberculosis
cgcucgggcgugcgcguggggc

SEQ ID NO: 857474 - RNA, 18 nt, Mycobacterium avium subsp. paratuberculosis
cgcucgggcuucggcguc

SEQ ID NO: 857475 - RNA, 22 nt, Mycobacterium avium subsp. paratuberculosis
cgcucggucuugaucaggucgc

SEQ ID NO: 857476 - RNA, 19 nt, Mycobacterium avium subsp. paratuberculosis
cgcucggucgccacggccg

SEQ ID NO: 857477 - RNA, 16 nt, Mycobacterium avium subsp. paratuberculosis
cgcucggucgcggcga

SEQ ID NO: 857478 - RNA, 18 nt, Mycobacterium avium subsp. paratuberculosis
cgcucggucgcggcgauc

SEQ ID NO: 857479 - RNA, 14 nt, Mycobacterium avium subsp. paratuberculosis
cgcucggcggccga

SEQ ID NO: 857480 - RNA, 16 nt, Mycobacterium avium subsp. paratuberculosis
cgcucggcggccgagg

SEQ ID NO: 857481 - RNA, 20 nt, Mycobacterium avium subsp. paratuberculosis
cgcucggcgcgcggggccgg

SEQ ID NO: 857482 - RNA, 13 nt, Mycobacterium avium subsp. paratuberculosis
cgcucggcgcguc

SEQ ID NO: 857483 - RNA, 14 nt, Mycobacterium avium subsp. paratuberculosis
cgcucggcgcgucg

SEQ ID NO: 857484 - RNA, 15 nt, Mycobacterium avium subsp. paratuberculosis
cgcucggcgcgucgu

SEQ ID NO: 857485 - RNA, 22 nt, Mycobacterium avium subsp. paratuberculosis
cgcucggcgcuccagcgggcgg

SEQ ID NO: 857486 - RNA, 16 nt, Mycobacterium avium subsp. paratuberculosis
cgcucggcgccggccg

SEQ ID NO: 857487 - RNA, 20 nt, Mycobacterium avium subsp. paratuberculosis
cgcucggcgccggccgucac

SEQ ID NO: 857488 - RNA, 21 nt, Mycobacterium avium subsp. paratuberculosis
cgcucggcgccggccgucacg

SEQ ID NO: 857489 - RNA, 12 nt, Mycobacterium avium subsp. paratuberculosis
cgcucggcggcg

SEQ ID NO: 857490 - RNA, 13 nt, Mycobacterium avium subsp. paratuberculosis
cgcucggcggcga

SEQ ID NO: 857491 - RNA, 18 nt, Mycobacterium avium subsp. paratuberculosis
cgcucggcggcgacggug

SEQ ID NO: 857492 - RNA, 17 nt, Mycobacterium avium subsp. paratuberculosis
cgcucggcggcgccguc

SEQ ID NO: 857493 - RNA, 18 nt, Mycobacterium avium subsp. paratuberculosis
cgcucggcggcgccgucg

SEQ ID NO: 857494 - RNA, 20 nt, Mycobacterium avium subsp. paratuberculosis
cgcucggauucccgcucggg

SEQ ID NO: 857495 - RNA, 22 nt, Mycobacterium avium subsp. paratuberculosis
cgcucggcggggggagaggcgc

SEQ ID NO: 857496 - RNA, 14 nt, Mycobacterium avium subsp. paratuberculosis
cgcucggcgggucg

SEQ ID NO: 857497 - RNA, 20 nt, Mycobacterium avium subsp. paratuberculosis
cgcucggcguggcgcucagc

SEQ ID NO: 857498 - RNA, 19 nt, Mycobacterium avium subsp. paratuberculosis
cgcucgggcccgcgcaccg

SEQ ID NO: 857499 - RNA, 20 nt, Mycobacterium avium subsp. paratuberculosis
cgcucgggcccgcgcaccgu

SEQ ID NO: 857500 - RNA, 14 nt, Mycobacterium avium subsp. paratuberculosis
cgcucgggccggcg

SEQ ID NO: 857501 - RNA, 17 nt, Mycobacterium avium subsp. paratuberculosis
cgcucgggccggcgccg

SEQ ID NO: 857502 - RNA, 23 nt, Mycobacterium avium subsp. paratuberculosis
cgcugaauucuguugucggcucg

SEQ ID NO: 857503 - RNA, 14 nt, Mycobacterium avium subsp. paratuberculosis
cgcugaccaccgag

SEQ ID NO: 857504 - RNA, 23 nt, Mycobacterium avium subsp. paratuberculosis
cgcugaccagcgugaccucgacg

SEQ ID NO: 857505 - RNA, 15 nt, Mycobacterium avium subsp. paratuberculosis
cgcugaccaggccga

SEQ ID NO: 857506 - RNA, 21 nt, Mycobacterium avium subsp. paratuberculosis
cgcugaccaggccguccacca

SEQ ID NO: 857507 - RNA, 22 nt, Mycobacterium avium subsp. paratuberculosis
cgcugacccccguuuccucgcg

SEQ ID NO: 857508 - RNA, 16 nt, Mycobacterium avium subsp. paratuberculosis
cgcugaccccgcucgg

SEQ ID NO: 857509 - RNA, 19 nt, Mycobacterium avium subsp. paratuberculosis
cgcugaccccgcucggcgu

SEQ ID NO: 857510 - RNA, 15 nt, Mycobacterium avium subsp. paratuberculosis
cgcugacccgccgca

SEQ ID NO: 857511 - RNA, 15 nt, Mycobacterium avium subsp. paratuberculosis
cgcugaagcgcgacc

SEQ ID NO: 857512 - RNA, 16 nt, Mycobacterium avium subsp. paratuberculosis
cgcugaagcgcgaccc

SEQ ID NO: 857513 - RNA, 17 nt, Mycobacterium avium subsp. paratuberculosis
cgcugaagccgcuggaa

SEQ ID NO: 857514 - RNA, 17 nt, Mycobacterium avium subsp. paratuberculosis
cgcugaagugcagcgca

SEQ ID NO: 857515 - RNA, 17 nt, Mycobacterium avium subsp. paratuberculosis
cgcugaacugcucgacc

SEQ ID NO: 857516 - RNA, 20 nt, Mycobacterium avium subsp. paratuberculosis
cgcugaacugcucgaccagc

SEQ ID NO: 857517 - RNA, 23 nt, Mycobacterium avium subsp. paratuberculosis
cgcugaacugcucgaccagcgcc

SEQ ID NO: 857518 - RNA, 21 nt, Mycobacterium avium subsp. paratuberculosis
cgcugaagaagaugggcgccg

SEQ ID NO: 857519 - RNA, 14 nt, Mycobacterium avium subsp. paratuberculosis
cgcugaagcccacc

SEQ ID NO: 857520 - RNA, 16 nt, Mycobacterium avium subsp. paratuberculosis
cgcugaagcccaccgc

SEQ ID NO: 857521 - RNA, 20 nt, Mycobacterium avium subsp. paratuberculosis
cgcugaagccgaacgcgcug

SEQ ID NO: 857522 - RNA, 15 nt, Mycobacterium avium subsp. paratuberculosis
cgcugaacagcagca

SEQ ID NO: 857523 - RNA, 22 nt, Mycobacterium avium subsp. paratuberculosis
cgcugaacagcagcagcagcgg

SEQ ID NO: 857524 - RNA, 23 nt, Mycobacterium avium subsp. paratuberculosis
cgcugaacagcagcagcagcggc

SEQ ID NO: 857525 - RNA, 14 nt, Mycobacterium avium subsp. paratuberculosis
cgcugaacagcccg

SEQ ID NO: 857526 - RNA, 15 nt, Mycobacterium avium subsp. paratuberculosis
cgcugaacgcggugg

SEQ ID NO: 857527 - RNA, 23 nt, Mycobacterium avium subsp. paratuberculosis
cgcugaacgcggugggcaccagc

SEQ ID NO: 857528 - RNA, 14 nt, Mycobacterium avium subsp. paratuberculosis
cgcugaacgcgucg

SEQ ID NO: 857529 - RNA, 15 nt, Mycobacterium avium subsp. paratuberculosis
cgcugaacgcgucgu

SEQ ID NO: 857530 - RNA, 17 nt, Mycobacterium avium subsp. paratuberculosis
cgcugaacgggcagcca

SEQ ID NO: 857531 - RNA, 20 nt, Mycobacterium avium subsp. paratuberculosis
cgcugaacgggcagccacgc

SEQ ID NO: 857532 - RNA, 13 nt, Mycobacterium avium subsp. paratuberculosis
cgcucuucgacga

SEQ ID NO: 857533 - RNA, 14 nt, Mycobacterium avium subsp. paratuberculosis
cgcucuugcgggag

SEQ ID NO: 857534 - RNA, 22 nt, Mycobacterium avium subsp. paratuberculosis
cgcugaaagcucgcgucgacgu

SEQ ID NO: 857535 - RNA, 14 nt, Mycobacterium avium subsp. paratuberculosis
cgcucugccgggcc

SEQ ID NO: 857536 - RNA, 17 nt, Mycobacterium avium subsp. paratuberculosis
cgcucucgccggucagc

SEQ ID NO: 857537 - RNA, 19 nt, Mycobacterium avium subsp. paratuberculosis
cgcucucgccggucagcac

SEQ ID NO: 857538 - RNA, 17 nt, Mycobacterium avium subsp. paratuberculosis
cgcucgcgguugggccg

SEQ ID NO: 857539 - RNA, 23 nt, Mycobacterium avium subsp. paratuberculosis
cgcucgcgguugggccgccggcc

SEQ ID NO: 857540 - RNA, 22 nt, Mycobacterium avium subsp. paratuberculosis
cgcucgcgguugggccggcgcc

SEQ ID NO: 857541 - RNA, 13 nt, Mycobacterium avium subsp. paratuberculosis
cgcucgcgggugc

SEQ ID NO: 857542 - RNA, 21 nt, Mycobacterium avium subsp. paratuberculosis
cgcucgcguggccugggcgac

SEQ ID NO: 857543 - RNA, 16 nt, Mycobacterium avium subsp. paratuberculosis
cgcucgcgggugcgcu

SEQ ID NO: 857544 - RNA, 14 nt, Mycobacterium avium subsp. paratuberculosis
cgcucgcgggccac

SEQ ID NO: 857545 - RNA, 23 nt, Mycobacterium avium subsp. paratuberculosis
cgcucgcgggccacagcggcgac

SEQ ID NO: 857546 - RNA, 17 nt, Mycobacterium avium subsp. paratuberculosis
cgcucgcgggcccgcgc

SEQ ID NO: 857547 - RNA, 18 nt, Mycobacterium avium subsp. paratuberculosis
cgcucgcgggcccgcgcc

SEQ ID NO: 857548 - RNA, 22 nt, Mycobacterium avium subsp. paratuberculosis
cgcucgcggauguccgaccggu

SEQ ID NO: 857549 - RNA, 16 nt, Mycobacterium avium subsp. paratuberculosis
cgcucgcgcaccggga

SEQ ID NO: 857550 - RNA, 22 nt, Mycobacterium avium subsp. paratuberculosis
cgcucgccggggacgacggcgg

SEQ ID NO: 857551 - RNA, 16 nt, Mycobacterium avium subsp. paratuberculosis
cgcucgccgucggcca

SEQ ID NO: 857552 - RNA, 17 nt, Mycobacterium avium subsp. paratuberculosis
cgcucgccgaucuggcg

SEQ ID NO: 857553 - RNA, 12 nt, Mycobacterium avium subsp. paratuberculosis
cgcucgccgaug

SEQ ID NO: 857554 - RNA, 15 nt, Mycobacterium avium subsp. paratuberculosis
cgcucgccgaugacg

SEQ ID NO: 857555 - RNA, 18 nt, Mycobacterium avium subsp. paratuberculosis
cgcucgccgcgcggcccg

SEQ ID NO: 857556 - RNA, 14 nt, Mycobacterium avium subsp. paratuberculosis
cgcucgccgcgggu

SEQ ID NO: 857557 - RNA, 15 nt, Mycobacterium avium subsp. paratuberculosis
cgcucgccggcggcc

SEQ ID NO: 857558 - RNA, 16 nt, Mycobacterium avium subsp. paratuberculosis
cgcucgccggcggccg

SEQ ID NO: 857559 - RNA, 23 nt, Mycobacterium avium subsp. paratuberculosis
cgcucgccggcggccgccacgcu

SEQ ID NO: 857560 - RNA, 21 nt, Mycobacterium avium subsp. paratuberculosis
cgcucgccgaaaugccgugcc

SEQ ID NO: 857561 - RNA, 23 nt, Mycobacterium avium subsp. paratuberculosis
cgcucggacucaggagugguagg

SEQ ID NO: 857562 - RNA, 17 nt, Mycobacterium avium subsp. paratuberculosis
cgcucggccagcgcgcc

SEQ ID NO: 857563 - RNA, 14 nt, Mycobacterium avium subsp. paratuberculosis
cgcucggccagcgc

SEQ ID NO: 857564 - RNA, 20 nt, Mycobacterium avium subsp. paratuberculosis
cgcucggccagcgcagcgac

SEQ ID NO: 857565 - RNA, 14 nt, Mycobacterium avium subsp. paratuberculosis
cgcucggcgcgacg

SEQ ID NO: 857566 - RNA, 15 nt, Mycobacterium avium subsp. paratuberculosis
cgcucggcgcgacgu

SEQ ID NO: 857567 - RNA, 17 nt, Mycobacterium avium subsp. paratuberculosis
cgcucggcgcgacguug

SEQ ID NO: 857568 - RNA, 23 nt, Mycobacterium avium subsp. paratuberculosis
cgcucggcgagcugcgggugcuc

SEQ ID NO: 857569 - RNA, 12 nt, Mycobacterium avium subsp. paratuberculosis
cgcucggcgaug

SEQ ID NO: 857570 - RNA, 11 nt, Mycobacterium avium subsp. paratuberculosis
cgcucggcgag

SEQ ID NO: 857571 - RNA, 16 nt, Mycobacterium avium subsp. paratuberculosis
cgcucggcgaccgccg

SEQ ID NO: 857572 - RNA, 18 nt, Mycobacterium avium subsp. paratuberculosis
cgcucggcgaccgccggu

SEQ ID NO: 857573 - RNA, 18 nt, Mycobacterium avium subsp. paratuberculosis
cgcucggcgaccugcggc

SEQ ID NO: 857574 - RNA, 21 nt, Mycobacterium avium subsp. paratuberculosis
cgcucggcgaccugcggcucg

SEQ ID NO: 857575 - RNA, 17 nt, Mycobacterium avium subsp. paratuberculosis
cgcucggccguggccgu

SEQ ID NO: 857576 - RNA, 18 nt, Mycobacterium avium subsp. paratuberculosis
cgcucggccguggccguc

SEQ ID NO: 857577 - RNA, 19 nt, Mycobacterium avium subsp. paratuberculosis
cgcucggccguggccguca

SEQ ID NO: 857578 - RNA, 20 nt, Mycobacterium avium subsp. paratuberculosis
cgcucggccucaggcgucgg

SEQ ID NO: 857579 - RNA, 21 nt, Mycobacterium avium subsp. paratuberculosis
cgcucggccagcagcaccagg

SEQ ID NO: 857580 - RNA, 16 nt, Mycobacterium avium subsp. paratuberculosis
cgcucggccagcagug

SEQ ID NO: 857581 - RNA, 18 nt, Mycobacterium avium subsp. paratuberculosis
cgcucgaggggcuuggcg

SEQ ID NO: 857582 - RNA, 21 nt, Mycobacterium avium subsp. paratuberculosis
cgcucgaggggcuuggcgacg

SEQ ID NO: 857583 - RNA, 21 nt, Mycobacterium avium subsp. paratuberculosis
cgcucgauggaauucgucggc

SEQ ID NO: 857584 - RNA, 23 nt, Mycobacterium avium subsp. paratuberculosis
cgcucgauggaauucgucggcgg

SEQ ID NO: 857585 - RNA, 23 nt, Mycobacterium avium subsp. paratuberculosis
cgcucgaucuggcggacccgcuc

SEQ ID NO: 857586 - RNA, 19 nt, Mycobacterium avium subsp. paratuberculosis
cgcucgcacaacccgcccg

SEQ ID NO: 857587 - RNA, 15 nt, Mycobacterium avium subsp. paratuberculosis
cgcucgcaccagcgc

SEQ ID NO: 857588 - RNA, 17 nt, Mycobacterium avium subsp. paratuberculosis
cgcucgauggguguggc

SEQ ID NO: 857589 - RNA, 21 nt, Mycobacterium avium subsp. paratuberculosis
cgcucgauggguguggcgucg

SEQ ID NO: 857590 - RNA, 23 nt, Mycobacterium avium subsp. paratuberculosis
cgcucgauggguguggcgucgau

SEQ ID NO: 857591 - RNA, 22 nt, Mycobacterium avium subsp. paratuberculosis
cgcucgauggcgccgaucgcgc

SEQ ID NO: 857592 - RNA, 19 nt, Mycobacterium avium subsp. paratuberculosis
cgcucgccaccccgcgcca

SEQ ID NO: 857593 - RNA, 13 nt, Mycobacterium avium subsp. paratuberculosis
cgcucgccagacc

SEQ ID NO: 857594 - RNA, 14 nt, Mycobacterium avium subsp. paratuberculosis
cgcucgccagaccg

SEQ ID NO: 857595 - RNA, 15 nt, Mycobacterium avium subsp. paratuberculosis
cgcucgccagaccgg

SEQ ID NO: 857596 - RNA, 19 nt, Mycobacterium avium subsp. paratuberculosis
cgcucgccaugcgaccacg

SEQ ID NO: 857597 - RNA, 16 nt, Mycobacterium avium subsp. paratuberculosis
cgcucgcccagcgcgg

SEQ ID NO: 857598 - RNA, 17 nt, Mycobacterium avium subsp. paratuberculosis
cgcucgcccagcgcggc

SEQ ID NO: 857599 - RNA, 18 nt, Mycobacterium avium subsp. paratuberculosis
cgcucgcccagcgcggcg

SEQ ID NO: 857600 - RNA, 22 nt, Mycobacterium avium subsp. paratuberculosis
cgcucgcccagcgcggcggcca

SEQ ID NO: 857601 - RNA, 15 nt, Mycobacterium avium subsp. paratuberculosis
cgcucgacgaguucc

SEQ ID NO: 857602 - RNA, 16 nt, Mycobacterium avium subsp. paratuberculosis
cgcucgaccucggcgg

SEQ ID NO: 857603 - RNA, 17 nt, Mycobacterium avium subsp. paratuberculosis
cgcucgaccucggcggc

SEQ ID NO: 857604 - RNA, 18 nt, Mycobacterium avium subsp. paratuberculosis
cgcucgaccucggcggcc

SEQ ID NO: 857605 - RNA, 23 nt, Mycobacterium avium subsp. paratuberculosis
cgcucgacgcgcacccgggaccg

SEQ ID NO: 857606 - RNA, 13 nt, Mycobacterium avium subsp. paratuberculosis
cgcucgacgcguc

SEQ ID NO: 857607 - RNA, 15 nt, Mycobacterium avium subsp. paratuberculosis
cgcucgacgcgucga

SEQ ID NO: 857608 - RNA, 11 nt, Mycobacterium avium subsp. paratuberculosis
cgcucgacggc

SEQ ID NO: 857609 - RNA, 13 nt, Mycobacterium avium subsp. paratuberculosis
cgcucgacggccg

SEQ ID NO: 857610 - RNA, 17 nt, Mycobacterium avium subsp. paratuberculosis
cgcucgacggccggcgu

SEQ ID NO: 857611 - RNA, 18 nt, Mycobacterium avium subsp. paratuberculosis
cgcucgacggccggcguc

SEQ ID NO: 857612 - RNA, 16 nt, Mycobacterium avium subsp. paratuberculosis
cgcucgacggccugca

SEQ ID NO: 857613 - RNA, 19 nt, Mycobacterium avium subsp. paratuberculosis
cgcuccagcggccacaccg

SEQ ID NO: 857614 - RNA, 15 nt, Mycobacterium avium subsp. paratuberculosis
cgcuccagcgggcgg

SEQ ID NO: 857615 - RNA, 16 nt, Mycobacterium avium subsp. paratuberculosis
cgcuccagcgggcggc

SEQ ID NO: 857616 - RNA, 20 nt, Mycobacterium avium subsp. paratuberculosis
cgcuccagcgggcggcggug

SEQ ID NO: 857617 - RNA, 16 nt, Mycobacterium avium subsp. paratuberculosis
cgcuccagaugcggug

SEQ ID NO: 857618 - RNA, 19 nt, Mycobacterium avium subsp. paratuberculosis
cgcuccagaugcgguggug

SEQ ID NO: 857619 - RNA, 19 nt, Mycobacterium avium subsp. paratuberculosis
cgcucaugcccgccacggc

SEQ ID NO: 857620 - RNA, 13 nt, Mycobacterium avium subsp. paratuberculosis
cgcuccaccaccg

SEQ ID NO: 857621 - RNA, 15 nt, Mycobacterium avium subsp. paratuberculosis
cgcuccaccagcgcg

SEQ ID NO: 857622 - RNA, 17 nt, Mycobacterium avium subsp. paratuberculosis
cgcuccaccagcgcggu

SEQ ID NO: 857623 - RNA, 19 nt, Mycobacterium avium subsp. paratuberculosis
cgcuccaccagcgcgguga

SEQ ID NO: 857624 - RNA, 16 nt, Mycobacterium avium subsp. paratuberculosis
cgcgucuugcgccgaa

SEQ ID NO: 857625 - RNA, 17 nt, Mycobacterium avium subsp. paratuberculosis
cgcgucuuggacgcccg

SEQ ID NO: 857626 - RNA, 12 nt, Mycobacterium avium subsp. paratuberculosis
cgcgucuuguug

SEQ ID NO: 857627 - RNA, 22 nt, Mycobacterium avium subsp. paratuberculosis
cgcgugcuggggguggcgucga

SEQ ID NO: 857628 - RNA, 23 nt, Mycobacterium avium subsp. paratuberculosis
cgcgugcuggggguggcgucgac

SEQ ID NO: 857629 - RNA, 13 nt, Mycobacterium avium subsp. paratuberculosis
cgcgugcuguugc

SEQ ID NO: 857630 - RNA, 22 nt, Mycobacterium avium subsp. paratuberculosis
cgcgugcuugccgaugucggcg

SEQ ID NO: 857631 - RNA, 13 nt, Mycobacterium avium subsp. paratuberculosis
cgcgucugcucgc

SEQ ID NO: 857632 - RNA, 15 nt, Mycobacterium avium subsp. paratuberculosis
cgcgucugcucgccg

SEQ ID NO: 857633 - RNA, 17 nt, Mycobacterium avium subsp. paratuberculosis
cgcgucugcucgccggc

SEQ ID NO: 857634 - RNA, 18 nt, Mycobacterium avium subsp. paratuberculosis
cgcgucugcucgccggcu

SEQ ID NO: 857635 - RNA, 20 nt, Mycobacterium avium subsp. paratuberculosis
cgcgucugcucgccggcuac

SEQ ID NO: 857636 - RNA, 18 nt, Mycobacterium avium subsp. paratuberculosis
cgcgucugcucgcgguuc

SEQ ID NO: 857637 - RNA, 19 nt, Mycobacterium avium subsp. paratuberculosis
cgcgucguugucgucgccg

SEQ ID NO: 857638 - RNA, 20 nt, Mycobacterium avium subsp. paratuberculosis
cgcgucguugucgucgccgg

SEQ ID NO: 857639 - RNA, 18 nt, Mycobacterium avium subsp. paratuberculosis
cgcgucucccccgaucag

SEQ ID NO: 857640 - RNA, 19 nt, Mycobacterium avium subsp. paratuberculosis
cgcgucucccccgaucagc

SEQ ID NO: 857641 - RNA, 23 nt, Mycobacterium avium subsp. paratuberculosis
cgcgucucccccgaucagcguca

SEQ ID NO: 857642 - RNA, 14 nt, Mycobacterium avium subsp. paratuberculosis
cgcgugucggcaca

SEQ ID NO: 857643 - RNA, 19 nt, Mycobacterium avium subsp. paratuberculosis
cgcgugguucaggcguccg

SEQ ID NO: 857644 - RNA, 14 nt, Mycobacterium avium subsp. paratuberculosis
cgcgugggagagcg

SEQ ID NO: 857645 - RNA, 15 nt, Mycobacterium avium subsp. paratuberculosis
cgcgugggagagcgg

SEQ ID NO: 857646 - RNA, 19 nt, Mycobacterium avium subsp. paratuberculosis
cgcgugggagagcgggacc

SEQ ID NO: 857647 - RNA, 16 nt, Mycobacterium avium subsp. paratuberculosis
cgcgugggcaccccga

SEQ ID NO: 857648 - RNA, 16 nt, Mycobacterium avium subsp. paratuberculosis
cgcguggggcgucgcc

SEQ ID NO: 857649 - RNA, 18 nt, Mycobacterium avium subsp. paratuberculosis
cgcguggggcgucgccgc

SEQ ID NO: 857650 - RNA, 23 nt, Mycobacterium avium subsp. paratuberculosis
cgcguggguguccuugcgcacca

SEQ ID NO: 857651 - RNA, 14 nt, Mycobacterium avium subsp. paratuberculosis
cgcguggccucccg

SEQ ID NO: 857652 - RNA, 12 nt, Mycobacterium avium subsp. paratuberculosis
cgcguggccugg

SEQ ID NO: 857653 - RNA, 13 nt, Mycobacterium avium subsp. paratuberculosis
cgcguggcgcaca

SEQ ID NO: 857654 - RNA, 16 nt, Mycobacterium avium subsp. paratuberculosis
cgcguggcgcacagcg

SEQ ID NO: 857655 - RNA, 13 nt, Mycobacterium avium subsp. paratuberculosis
cgcgucacauccg

SEQ ID NO: 857656 - RNA, 23 nt, Mycobacterium avium subsp. paratuberculosis
cgcgucacauccgucacgcccgu

SEQ ID NO: 857657 - RNA, 21 nt, Mycobacterium avium subsp. paratuberculosis
cgcgucaaccaccggcaucgg

SEQ ID NO: 857658 - RNA, 12 nt, Mycobacterium avium subsp. paratuberculosis
cgcgucgccgcc

SEQ ID NO: 857659 - RNA, 16 nt, Mycobacterium avium subsp. paratuberculosis
cgcgucgccgccgggc

SEQ ID NO: 857660 - RNA, 20 nt, Mycobacterium avium subsp. paratuberculosis
cgcgucgccgccgggcgcca

SEQ ID NO: 857661 - RNA, 14 nt, Mycobacterium avium subsp. paratuberculosis
cgcgucgcagugcc

SEQ ID NO: 857662 - RNA, 19 nt, Mycobacterium avium subsp. paratuberculosis
cgcgucgccgaucgcccgg

SEQ ID NO: 857663 - RNA, 15 nt, Mycobacterium avium subsp. paratuberculosis
cgcguagucggcguc

SEQ ID NO: 857664 - RNA, 21 nt, Mycobacterium avium subsp. paratuberculosis
cgcguagucggcgucggccac

SEQ ID NO: 857665 - RNA, 19 nt, Mycobacterium avium subsp. paratuberculosis
cgcguagucguugucggcg

SEQ ID NO: 857666 - RNA, 13 nt, Mycobacterium avium subsp. paratuberculosis
cgcguaguggugc

SEQ ID NO: 857667 - RNA, 16 nt, Mycobacterium avium subsp. paratuberculosis
cgcguauuccagcgcc

SEQ ID NO: 857668 - RNA, 18 nt, Mycobacterium avium subsp. paratuberculosis
cgcguauuccagcgccag

SEQ ID NO: 857669 - RNA, 19 nt, Mycobacterium avium subsp. paratuberculosis
cgcguauuccagcgccagc

SEQ ID NO: 857670 - RNA, 19 nt, Mycobacterium avium subsp. paratuberculosis
cgcguauugcacggcggcg

SEQ ID NO: 857671 - RNA, 20 nt, Mycobacterium avium subsp. paratuberculosis
cgcguauugcacggcggcga

SEQ ID NO: 857672 - RNA, 16 nt, Mycobacterium avium subsp. paratuberculosis
cgcguaguccagcacg

SEQ ID NO: 857673 - RNA, 18 nt, Mycobacterium avium subsp. paratuberculosis
cgcguaguccagcacggc

SEQ ID NO: 857674 - RNA, 22 nt, Mycobacterium avium subsp. paratuberculosis
cgcguaguccagcacggcgaag

SEQ ID NO: 857675 - RNA, 14 nt, Mycobacterium avium subsp. paratuberculosis
cgcguaccagcgcc

SEQ ID NO: 857676 - RNA, 17 nt, Mycobacterium avium subsp. paratuberculosis
cgcguaccagcgccacg

SEQ ID NO: 857677 - RNA, 18 nt, Mycobacterium avium subsp. paratuberculosis
cgcguacccgcgcggcgu

SEQ ID NO: 857678 - RNA, 19 nt, Mycobacterium avium subsp. paratuberculosis
cgcgucgugccgagcguga

SEQ ID NO: 857679 - RNA, 14 nt, Mycobacterium avium subsp. paratuberculosis
cgcgucgugcggcc

SEQ ID NO: 857680 - RNA, 15 nt, Mycobacterium avium subsp. paratuberculosis
cgcgucgugcggccg

SEQ ID NO: 857681 - RNA, 17 nt, Mycobacterium avium subsp. paratuberculosis
cgcgucgugcggccggc

SEQ ID NO: 857682 - RNA, 18 nt, Mycobacterium avium subsp. paratuberculosis
cgcgucgugcggccggcg

SEQ ID NO: 857683 - RNA, 19 nt, Mycobacterium avium subsp. paratuberculosis
cgcgucgugcggccggcgc

SEQ ID NO: 857684 - RNA, 20 nt, Mycobacterium avium subsp. paratuberculosis
cgcgucgugcggccggcgcc

SEQ ID NO: 857685 - RNA, 16 nt, Mycobacterium avium subsp. paratuberculosis
cgcgucguggcccugc

SEQ ID NO: 857686 - RNA, 23 nt, Mycobacterium avium subsp. paratuberculosis
cgcgucguggcccugcucgucgu

SEQ ID NO: 857687 - RNA, 18 nt, Mycobacterium avium subsp. paratuberculosis
cgcgucguguccgggccc

SEQ ID NO: 857688 - RNA, 12 nt, Mycobacterium avium subsp. paratuberculosis
cgcgucgucgcc

SEQ ID NO: 857689 - RNA, 14 nt, Mycobacterium avium subsp. paratuberculosis
cgcgucgucgccga

SEQ ID NO: 857690 - RNA, 16 nt, Mycobacterium avium subsp. paratuberculosis
cgcgucgucggcgggc

SEQ ID NO: 857691 - RNA, 22 nt, Mycobacterium avium subsp. paratuberculosis
cgcgucgucggucaggccggcg

SEQ ID NO: 857692 - RNA, 12 nt, Mycobacterium avium subsp. paratuberculosis
cgcgucgguguc

SEQ ID NO: 857693 - RNA, 17 nt, Mycobacterium avium subsp. paratuberculosis
cgcgucguacaccucgg

SEQ ID NO: 857694 - RNA, 20 nt, Mycobacterium avium subsp. paratuberculosis
cgcgucguagucgcucggcg

SEQ ID NO: 857695 - RNA, 13 nt, Mycobacterium avium subsp. paratuberculosis
cgcgucgucaucg

SEQ ID NO: 857696 - RNA, 15 nt, Mycobacterium avium subsp. paratuberculosis
cgcgucguccgacac

SEQ ID NO: 857697 - RNA, 18 nt, Mycobacterium avium subsp. paratuberculosis
cgcgucggagaucaccgg

SEQ ID NO: 857698 - RNA, 17 nt, Mycobacterium avium subsp. paratuberculosis
cgcgucgggcucggccg

SEQ ID NO: 857699 - RNA, 20 nt, Mycobacterium avium subsp. paratuberculosis
cgcgucgguaaucggcggug

SEQ ID NO: 857700 - RNA, 17 nt, Mycobacterium avium subsp. paratuberculosis
cgcgucggucagcgcca

SEQ ID NO: 857701 - RNA, 18 nt, Mycobacterium avium subsp. paratuberculosis
cgcgucggucagcgccac

SEQ ID NO: 857702 - RNA, 20 nt, Mycobacterium avium subsp. paratuberculosis
cgcgucggucagcggcguca

SEQ ID NO: 857703 - RNA, 20 nt, Mycobacterium avium subsp. paratuberculosis
cgcgucgcugggcagccguc

SEQ ID NO: 857704 - RNA, 14 nt, Mycobacterium avium subsp. paratuberculosis
cgcgucgcugccgu

SEQ ID NO: 857705 - RNA, 24 nt, Mycobacterium avium subsp. paratuberculosis
cgcgucgcgcgguuccggcgugca

SEQ ID NO: 857706 - RNA, 17 nt, Mycobacterium avium subsp. paratuberculosis
cgcgucgcggcgcggac

SEQ ID NO: 857707 - RNA, 15 nt, Mycobacterium avium subsp. paratuberculosis
cgcgucgcggcgggg

SEQ ID NO: 857708 - RNA, 16 nt, Mycobacterium avium subsp. paratuberculosis
cgcgucgcgggcccgg

SEQ ID NO: 857709 - RNA, 12 nt, Mycobacterium avium subsp. paratuberculosis
cgcgucgccgug

SEQ ID NO: 857710 - RNA, 13 nt, Mycobacterium avium subsp. paratuberculosis
cgcgucgccgugc

SEQ ID NO: 857711 - RNA, 15 nt, Mycobacterium avium subsp. paratuberculosis
cgcgucgccgugccg

SEQ ID NO: 857712 - RNA, 23 nt, Mycobacterium avium subsp. paratuberculosis
cgcgucgccgugccggaccgcgc

SEQ ID NO: 857713 - RNA, 11 nt, Mycobacterium avium subsp. paratuberculosis
cgcgucgcgcc

SEQ ID NO: 857714 - RNA, 17 nt, Mycobacterium avium subsp. paratuberculosis
cgcgucgcgccagcggu

SEQ ID NO: 857715 - RNA, 19 nt, Mycobacterium avium subsp. paratuberculosis
cgcgucgcgcccggcgucg

SEQ ID NO: 857716 - RNA, 20 nt, Mycobacterium avium subsp. paratuberculosis
cgcgucgcgcccggcgucgg

SEQ ID NO: 857717 - RNA, 13 nt, Mycobacterium avium subsp. paratuberculosis
cgcgucgcgccgc

SEQ ID NO: 857718 - RNA, 23 nt, Mycobacterium avium subsp. paratuberculosis
cgcgucgcgccgccgcgucgugc

SEQ ID NO: 857719 - RNA, 17 nt, Mycobacterium avium subsp. paratuberculosis
cgcuaguuggugcuggg

SEQ ID NO: 857720 - RNA, 19 nt, Mycobacterium avium subsp. paratuberculosis
cgcuagucgcccagcagcc

SEQ ID NO: 857721 - RNA, 21 nt, Mycobacterium avium subsp. paratuberculosis
cgcuagguuuggccagcaccg

SEQ ID NO: 857722 - RNA, 22 nt, Mycobacterium avium subsp. paratuberculosis
cgcuagguuuggccagcaccgc

SEQ ID NO: 857723 - RNA, 17 nt, Mycobacterium avium subsp. paratuberculosis
cgcuauaucgcaccggc

SEQ ID NO: 857724 - RNA, 19 nt, Mycobacterium avium subsp. paratuberculosis
cgcuagaccgauggcggcg

SEQ ID NO: 857725 - RNA, 14 nt, Mycobacterium avium subsp. paratuberculosis
cgcuacugccgcug

SEQ ID NO: 857726 - RNA, 13 nt, Mycobacterium avium subsp. paratuberculosis
cgcuagcgugacg

SEQ ID NO: 857727 - RNA, 16 nt, Mycobacterium avium subsp. paratuberculosis
cgcuagcugcgccggc

SEQ ID NO: 857728 - RNA, 17 nt, Mycobacterium avium subsp. paratuberculosis
cgcuaggacgcgggccu

SEQ ID NO: 857729 - RNA, 15 nt, Mycobacterium avium subsp. paratuberculosis
cgcguucacccgcgc

SEQ ID NO: 857730 - RNA, 19 nt, Mycobacterium avium subsp. paratuberculosis
cgcguucagggugcaggcc

SEQ ID NO: 857731 - RNA, 20 nt, Mycobacterium avium subsp. paratuberculosis
cgcguucagggugcaggccc

SEQ ID NO: 857732 - RNA, 18 nt, Mycobacterium avium subsp. paratuberculosis
cgcguucugcaccagcuc

SEQ ID NO: 857733 - RNA, 16 nt, Mycobacterium avium subsp. paratuberculosis
cgcguucaagccgccg

SEQ ID NO: 857734 - RNA, 16 nt, Mycobacterium avium subsp. paratuberculosis
cgcguugaaagccgcg

SEQ ID NO: 857735 - RNA, 17 nt, Mycobacterium avium subsp. paratuberculosis
cgcguugaaagccgcga

SEQ ID NO: 857736 - RNA, 22 nt, Mycobacterium avium subsp. paratuberculosis
cgcguugaacgacaucaccacc

SEQ ID NO: 857737 - RNA, 15 nt, Mycobacterium avium subsp. paratuberculosis
cgcguugagcgucgc

SEQ ID NO: 857738 - RNA, 17 nt, Mycobacterium avium subsp. paratuberculosis
cgcguugagcgucgcca

SEQ ID NO: 857739 - RNA, 20 nt, Mycobacterium avium subsp. paratuberculosis
cgcguugagcgucgccacca

SEQ ID NO: 857740 - RNA, 19 nt, Mycobacterium avium subsp. paratuberculosis
cgcguugcgcggaccggcg

SEQ ID NO: 857741 - RNA, 17 nt, Mycobacterium avium subsp. paratuberculosis
cgcguugcggaucucga

SEQ ID NO: 857742 - RNA, 23 nt, Mycobacterium avium subsp. paratuberculosis
cgcguugcggaucucgaccucgu

SEQ ID NO: 857743 - RNA, 17 nt, Mycobacterium avium subsp. paratuberculosis
cgcguugcggccgucca

SEQ ID NO: 857744 - RNA, 14 nt, Mycobacterium avium subsp. paratuberculosis
cgcguugaugacgg

SEQ ID NO: 857745 - RNA, 17 nt, Mycobacterium avium subsp. paratuberculosis
cgcguugaugccgugcg

SEQ ID NO: 857746 - RNA, 14 nt, Mycobacterium avium subsp. paratuberculosis
cgcguugaccagac

SEQ ID NO: 857747 - RNA, 19 nt, Mycobacterium avium subsp. paratuberculosis
cgcguugaccagaccgaag

SEQ ID NO: 857748 - RNA, 16 nt, Mycobacterium avium subsp. paratuberculosis
cgcguugaucagcgcc

SEQ ID NO: 857749 - RNA, 22 nt, Mycobacterium avium subsp. paratuberculosis
cgcguugaucagcgccaggugg

SEQ ID NO: 857750 - RNA, 17 nt, Mycobacterium avium subsp. paratuberculosis
cgcucaacccgggccgg

SEQ ID NO: 857751 - RNA, 15 nt, Mycobacterium avium subsp. paratuberculosis
cgcucaacccgucgc

SEQ ID NO: 857752 - RNA, 20 nt, Mycobacterium avium subsp. paratuberculosis
cgcucaacccgucgcggguc

SEQ ID NO: 857753 - RNA, 18 nt, Mycobacterium avium subsp. paratuberculosis
cgcucaaccgcccagcgg

SEQ ID NO: 857754 - RNA, 23 nt, Mycobacterium avium subsp. paratuberculosis
cgcuauuggccgagccgggcggc

SEQ ID NO: 857755 - RNA, 22 nt, Mycobacterium avium subsp. paratuberculosis
cgcucaacgugauacgccgacg

SEQ ID NO: 857756 - RNA, 20 nt, Mycobacterium avium subsp. paratuberculosis
cgcucaucccgaugucggcg

SEQ ID NO: 857757 - RNA, 15 nt, Mycobacterium avium subsp. paratuberculosis
cgcucaucaggcggc

SEQ ID NO: 857758 - RNA, 19 nt, Mycobacterium avium subsp. paratuberculosis
cgcucaucaggcggccggc

SEQ ID NO: 857759 - RNA, 16 nt, Mycobacterium avium subsp. paratuberculosis
cgcucaguccagcucc

SEQ ID NO: 857760 - RNA, 19 nt, Mycobacterium avium subsp. paratuberculosis
cgcucagugcacgcucggc

SEQ ID NO: 857761 - RNA, 20 nt, Mycobacterium avium subsp. paratuberculosis
cgcucagugcacgcucggcg

SEQ ID NO: 857762 - RNA, 16 nt, Mycobacterium avium subsp. paratuberculosis
cgcucacacagccgcu

SEQ ID NO: 857763 - RNA, 21 nt, Mycobacterium avium subsp. paratuberculosis
cgcucacacagccgcuuggcg

SEQ ID NO: 857764 - RNA, 15 nt, Mycobacterium avium subsp. paratuberculosis
aacagacucagcccg

SEQ ID NO: 857765 - RNA, 17 nt, Mycobacterium avium subsp. paratuberculosis
aacagacucagcccggc

SEQ ID NO: 857766 - RNA, 14 nt, Mycobacterium avium subsp. paratuberculosis
aacagacugaugaa

SEQ ID NO: 857767 - RNA, 18 nt, Mycobacterium avium subsp. paratuberculosis
aacacgucggccagcgcg

SEQ ID NO: 857768 - RNA, 16 nt, Mycobacterium avium subsp. paratuberculosis
aacacguacagcggcg

SEQ ID NO: 857769 - RNA, 16 nt, Mycobacterium avium subsp. paratuberculosis
aacacgccggcggcca

SEQ ID NO: 857770 - RNA, 21 nt, Mycobacterium avium subsp. paratuberculosis
cgccguugcggugcucgucga

SEQ ID NO: 857771 - RNA, 23 nt, Mycobacterium avium subsp. paratuberculosis
cgccuacacagcccccacgcucg

SEQ ID NO: 857772 - RNA, 16 nt, Mycobacterium avium subsp. paratuberculosis
cgccguuuugccgccg

SEQ ID NO: 857773 - RNA, 17 nt, Mycobacterium avium subsp. paratuberculosis
cgccguuuugccgccga

SEQ ID NO: 857774 - RNA, 15 nt, Mycobacterium avium subsp. paratuberculosis
cgccguuucagcagc

SEQ ID NO: 857775 - RNA, 17 nt, Mycobacterium avium subsp. paratuberculosis
cgccguuucagcagcgc

SEQ ID NO: 857776 - RNA, 19 nt, Mycobacterium avium subsp. paratuberculosis
cgccguuucagcagcgcgu

SEQ ID NO: 857777 - RNA, 23 nt, Mycobacterium avium subsp. paratuberculosis
cgccguuguugagcguggcagcg

SEQ ID NO: 857778 - RNA, 21 nt, Mycobacterium avium subsp. paratuberculosis
cgccguuguugaggaugacga

SEQ ID NO: 857779 - RNA, 18 nt, Mycobacterium avium subsp. paratuberculosis
cgccguuucggacgagcc

SEQ ID NO: 857780 - RNA, 19 nt, Mycobacterium avium subsp. paratuberculosis
cgccguuucggacgagccg

SEQ ID NO: 857781 - RNA, 22 nt, Mycobacterium avium subsp. paratuberculosis
cgccguuucggacgagccgucg

SEQ ID NO: 857782 - RNA, 15 nt, Mycobacterium avium subsp. paratuberculosis
cgccguugcgggucg

SEQ ID NO: 857783 - RNA, 19 nt, Mycobacterium avium subsp. paratuberculosis
cgccguugcgggucggcgu

SEQ ID NO: 857784 - RNA, 21 nt, Mycobacterium avium subsp. paratuberculosis
cgccguugcggcccacgguga

SEQ ID NO: 857785 - RNA, 21 nt, Mycobacterium avium subsp. paratuberculosis
cgccguugcgagucaucgcca

SEQ ID NO: 857786 - RNA, 14 nt, Mycobacterium avium subsp. paratuberculosis
cgccguuggcgugg

SEQ ID NO: 857787 - RNA, 17 nt, Mycobacterium avium subsp. paratuberculosis
cgccguuggcguggaug

SEQ ID NO: 857788 - RNA, 20 nt, Mycobacterium avium subsp. paratuberculosis
cgccguuggcguggauggcc

SEQ ID NO: 857789 - RNA, 23 nt, Mycobacterium avium subsp. paratuberculosis
cgccguuggcguggauggccggc

SEQ ID NO: 857790 - RNA, 15 nt, Mycobacterium avium subsp. paratuberculosis
cgccguuggccuggu

SEQ ID NO: 857791 - RNA, 23 nt, Mycobacterium avium subsp. paratuberculosis
cgccguuggucugcgcgagcaga

SEQ ID NO: 857792 - RNA, 14 nt, Mycobacterium avium subsp. paratuberculosis
cgccguuggugguc

SEQ ID NO: 857793 - RNA, 22 nt, Mycobacterium avium subsp. paratuberculosis
cgccguuguaggccgcgcggug

SEQ ID NO: 857794 - RNA, 23 nt, Mycobacterium avium subsp. paratuberculosis
cgccguuguaguagaccuugacc

SEQ ID NO: 857795 - RNA, 17 nt, Mycobacterium avium subsp. paratuberculosis
cgccguugacaccgggu

SEQ ID NO: 857796 - RNA, 19 nt, Mycobacterium avium subsp. paratuberculosis
cgccguugaccccgacggc

SEQ ID NO: 857797 - RNA, 20 nt, Mycobacterium avium subsp. paratuberculosis
cgccguugaccccgacggcg

SEQ ID NO: 857798 - RNA, 21 nt, Mycobacterium avium subsp. paratuberculosis
cgccguugaccccgacggcgc

SEQ ID NO: 857799 - RNA, 23 nt, Mycobacterium avium subsp. paratuberculosis
cgccguugaccccgacggcgccg

SEQ ID NO: 857800 - RNA, 14 nt, Mycobacterium avium subsp. paratuberculosis
cgccguugaccgcg

SEQ ID NO: 857801 - RNA, 16 nt, Mycobacterium avium subsp. paratuberculosis
cgccguugaccgcggc

SEQ ID NO: 857802 - RNA, 18 nt, Mycobacterium avium subsp. paratuberculosis
cgccguugaccgcggcga

SEQ ID NO: 857803 - RNA, 19 nt, Mycobacterium avium subsp. paratuberculosis
cgccguugaccgcggcgau

SEQ ID NO: 857804 - RNA, 15 nt, Mycobacterium avium subsp. paratuberculosis
cgccguugaccggcc

SEQ ID NO: 857805 - RNA, 16 nt, Mycobacterium avium subsp. paratuberculosis
cgccguugaccggccg

SEQ ID NO: 857806 - RNA, 18 nt, Mycobacterium avium subsp. paratuberculosis
cgccguugaccggccggu

SEQ ID NO: 857807 - RNA, 19 nt, Mycobacterium avium subsp. paratuberculosis
cgccguugaccggccgguc

SEQ ID NO: 857808 - RNA, 14 nt, Mycobacterium avium subsp. paratuberculosis
cgccguugaccggu

SEQ ID NO: 857809 - RNA, 19 nt, Mycobacterium avium subsp. paratuberculosis
cgccguugaccggugcgcc

SEQ ID NO: 857810 - RNA, 15 nt, Mycobacterium avium subsp. paratuberculosis
cgccguucuugucga

SEQ ID NO: 857811 - RNA, 18 nt, Mycobacterium avium subsp. paratuberculosis
cgccguucuugucgaagu

SEQ ID NO: 857812 - RNA, 20 nt, Mycobacterium avium subsp. paratuberculosis
cgccguucucgcgcagguca

SEQ ID NO: 857813 - RNA, 21 nt, Mycobacterium avium subsp. paratuberculosis
cgccguucucgcgcaggucac

SEQ ID NO: 857814 - RNA, 19 nt, Mycobacterium avium subsp. paratuberculosis
cgccguugauugcgcccgc

SEQ ID NO: 857815 - RNA, 20 nt, Mycobacterium avium subsp. paratuberculosis
cgccguugauugcgcccgcc

SEQ ID NO: 857816 - RNA, 21 nt, Mycobacterium avium subsp. paratuberculosis
cgccguugauugcgcccgccg

SEQ ID NO: 857817 - RNA, 15 nt, Mycobacterium avium subsp. paratuberculosis
cgccguugccggccc

SEQ ID NO: 857818 - RNA, 17 nt, Mycobacterium avium subsp. paratuberculosis
cgccguugccggcccgc

SEQ ID NO: 857819 - RNA, 18 nt, Mycobacterium avium subsp. paratuberculosis
cgccguugccggcccgca

SEQ ID NO: 857820 - RNA, 14 nt, Mycobacterium avium subsp. paratuberculosis
cgccguucucgcgc

SEQ ID NO: 857821 - RNA, 17 nt, Mycobacterium avium subsp. paratuberculosis
cgccguucucgcgcagg

SEQ ID NO: 857822 - RNA, 17 nt, Mycobacterium avium subsp. paratuberculosis
cgccguuccgaugaaga

SEQ ID NO: 857823 - RNA, 14 nt, Mycobacterium avium subsp. paratuberculosis
cgccguucgccggc

SEQ ID NO: 857824 - RNA, 16 nt, Mycobacterium avium subsp. paratuberculosis
cgccguucgccggcga

SEQ ID NO: 857825 - RNA, 17 nt, Mycobacterium avium subsp. paratuberculosis
cgccguucgccggcgac

SEQ ID NO: 857826 - RNA, 18 nt, Mycobacterium avium subsp. paratuberculosis
cgccguucgccggcgacg

SEQ ID NO: 857827 - RNA, 20 nt, Mycobacterium avium subsp. paratuberculosis
cgccguucgccggcgacggc

SEQ ID NO: 857828 - RNA, 21 nt, Mycobacterium avium subsp. paratuberculosis
cgccguucgccggcgacggcc

SEQ ID NO: 857829 - RNA, 14 nt, Mycobacterium avium subsp. paratuberculosis
cgccgugcgccucg

SEQ ID NO: 857830 - RNA, 15 nt, Mycobacterium avium subsp. paratuberculosis
cgccugcagccgccg

SEQ ID NO: 857831 - RNA, 18 nt, Mycobacterium avium subsp. paratuberculosis
cgccugagcaaccgguuc

SEQ ID NO: 857832 - RNA, 19 nt, Mycobacterium avium subsp. paratuberculosis
cgccugagcaaccgguucg

SEQ ID NO: 857833 - RNA, 23 nt, Mycobacterium avium subsp. paratuberculosis
cgccugcacggugccgccgucca

SEQ ID NO: 857834 - RNA, 21 nt, Mycobacterium avium subsp. paratuberculosis
cgccugcagggauucggccau

SEQ ID NO: 857835 - RNA, 22 nt, Mycobacterium avium subsp. paratuberculosis
cgccugcagggauucggccaug

SEQ ID NO: 857836 - RNA, 23 nt, Mycobacterium avium subsp. paratuberculosis
cgccugcagggauucggccaugc

SEQ ID NO: 857837 - RNA, 15 nt, Mycobacterium avium subsp. paratuberculosis
cgccucggcggccgc

SEQ ID NO: 857838 - RNA, 22 nt, Mycobacterium avium subsp. paratuberculosis
cgccucgugcaugugcucggcg

SEQ ID NO: 857839 - RNA, 23 nt, Mycobacterium avium subsp. paratuberculosis
cgccucgugcaugugcucggcga

SEQ ID NO: 857840 - RNA, 13 nt, Mycobacterium avium subsp. paratuberculosis
cgccucggcggcc

SEQ ID NO: 857841 - RNA, 20 nt, Mycobacterium avium subsp. paratuberculosis
cgccucguuggccagcucgg

SEQ ID NO: 857842 - RNA, 15 nt, Mycobacterium avium subsp. paratuberculosis
cgccucggcggaguc

SEQ ID NO: 857843 - RNA, 12 nt, Mycobacterium avium subsp. paratuberculosis
cgccucggcggc

SEQ ID NO: 857844 - RNA, 13 nt, Mycobacterium avium subsp. paratuberculosis
cgccucggccgcg

SEQ ID NO: 857845 - RNA, 18 nt, Mycobacterium avium subsp. paratuberculosis
cgccucggccucgucgac

SEQ ID NO: 857846 - RNA, 16 nt, Mycobacterium avium subsp. paratuberculosis
cgccucggccugcgcc

SEQ ID NO: 857847 - RNA, 22 nt, Mycobacterium avium subsp. paratuberculosis
cgccucggcgaggucgucgagg

SEQ ID NO: 857848 - RNA, 13 nt, Mycobacterium avium subsp. paratuberculosis
cgccucggcgauc

SEQ ID NO: 857849 - RNA, 14 nt, Mycobacterium avium subsp. paratuberculosis
cgccucggcgaucg

SEQ ID NO: 857850 - RNA, 20 nt, Mycobacterium avium subsp. paratuberculosis
cgccucggcgccucggcguc

SEQ ID NO: 857851 - RNA, 16 nt, Mycobacterium avium subsp. paratuberculosis
cgccucggccaccuug

SEQ ID NO: 857852 - RNA, 18 nt, Mycobacterium avium subsp. paratuberculosis
cgccucggaggccaccgc

SEQ ID NO: 857853 - RNA, 22 nt, Mycobacterium avium subsp. paratuberculosis
cgccucggaggccaccgcgccg

SEQ ID NO: 857854 - RNA, 21 nt, Mycobacterium avium subsp. paratuberculosis
cgccucggaucccggggcgcg

SEQ ID NO: 857855 - RNA, 21 nt, Mycobacterium avium subsp. paratuberculosis
cgccucacacggggcagaccg

SEQ ID NO: 857856 - RNA, 17 nt, Mycobacterium avium subsp. paratuberculosis
cgccucaccccagcgcg

SEQ ID NO: 857857 - RNA, 21 nt, Mycobacterium avium subsp. paratuberculosis
cgccucaccccagcgcgacca

SEQ ID NO: 857858 - RNA, 23 nt, Mycobacterium avium subsp. paratuberculosis
cgccucaccccagcgcgaccagu

SEQ ID NO: 857859 - RNA, 18 nt, Mycobacterium avium subsp. paratuberculosis
cgccucaggcgagcaccc

SEQ ID NO: 857860 - RNA, 16 nt, Mycobacterium avium subsp. paratuberculosis
cgccucacgcagggcc

SEQ ID NO: 857861 - RNA, 16 nt, Mycobacterium avium subsp. paratuberculosis
cgccuaccggguggcc

SEQ ID NO: 857862 - RNA, 21 nt, Mycobacterium avium subsp. paratuberculosis
cgccucgcuaaucgccgcgcg

SEQ ID NO: 857863 - RNA, 22 nt, Mycobacterium avium subsp. paratuberculosis
cgccucgcuaaucgccgcgcgu

SEQ ID NO: 857864 - RNA, 20 nt, Mycobacterium avium subsp. paratuberculosis
cgccucgccagccccaccgg

SEQ ID NO: 857865 - RNA, 14 nt, Mycobacterium avium subsp. paratuberculosis
cgccucgccgggcc

SEQ ID NO: 857866 - RNA, 16 nt, Mycobacterium avium subsp. paratuberculosis
cgccucgccgggcccg

SEQ ID NO: 857867 - RNA, 12 nt, Mycobacterium avium subsp. paratuberculosis
cgccucgccgac

SEQ ID NO: 857868 - RNA, 13 nt, Mycobacterium avium subsp. paratuberculosis
cgccucgccgacc

SEQ ID NO: 857869 - RNA, 14 nt, Mycobacterium avium subsp. paratuberculosis
cgccucgccgaccu

SEQ ID NO: 857870 - RNA, 16 nt, Mycobacterium avium subsp. paratuberculosis
cgccucgcgcagcgcg

SEQ ID NO: 857871 - RNA, 17 nt, Mycobacterium avium subsp. paratuberculosis
cgccucgcgcagcgcgu

SEQ ID NO: 857872 - RNA, 20 nt, Mycobacterium avium subsp. paratuberculosis
cgccucgauggcccgcucgg

SEQ ID NO: 857873 - RNA, 21 nt, Mycobacterium avium subsp. paratuberculosis
cgccucgauggcccgcucggu

SEQ ID NO: 857874 - RNA, 17 nt, Mycobacterium avium subsp. paratuberculosis
cgccucgaucaacgccg

SEQ ID NO: 857875 - RNA, 22 nt, Mycobacterium avium subsp. paratuberculosis
cgccucgaucaacgccgggucg

SEQ ID NO: 857876 - RNA, 17 nt, Mycobacterium avium subsp. paratuberculosis
cgccucgaucagcgcga

SEQ ID NO: 857877 - RNA, 16 nt, Mycobacterium avium subsp. paratuberculosis
cgccucgagcaacggc

SEQ ID NO: 857878 - RNA, 17 nt, Mycobacterium avium subsp. paratuberculosis
cgccucgagcaacggcc

SEQ ID NO: 857879 - RNA, 21 nt, Mycobacterium avium subsp. paratuberculosis
cgccucgagcaacggccgcag

SEQ ID NO: 857880 - RNA, 22 nt, Mycobacterium avium subsp. paratuberculosis
cgccucgagcaacggccgcagc

SEQ ID NO: 857881 - RNA, 14 nt, Mycobacterium avium subsp. paratuberculosis
cgccucgagcacca

SEQ ID NO: 857882 - RNA, 23 nt, Mycobacterium avium subsp. paratuberculosis
cgccucaugccagacgcgcaccg

SEQ ID NO: 857883 - RNA, 19 nt, Mycobacterium avium subsp. paratuberculosis
cgccuccacauacgcggcg

SEQ ID NO: 857884 - RNA, 20 nt, Mycobacterium avium subsp. paratuberculosis
cgccuccacauacgcggcgg

SEQ ID NO: 857885 - RNA, 15 nt, Mycobacterium avium subsp. paratuberculosis
cgccgguggcggcga

SEQ ID NO: 857886 - RNA, 16 nt, Mycobacterium avium subsp. paratuberculosis
cgccgguggcggcgag

SEQ ID NO: 857887 - RNA, 13 nt, Mycobacterium avium subsp. paratuberculosis
cgccgguggcguc

SEQ ID NO: 857888 - RNA, 20 nt, Mycobacterium avium subsp. paratuberculosis
cgccgguggcgucggugaug

SEQ ID NO: 857889 - RNA, 19 nt, Mycobacterium avium subsp. paratuberculosis
cgccgguggggugaugagg

SEQ ID NO: 857890 - RNA, 18 nt, Mycobacterium avium subsp. paratuberculosis
cgccgguggugcaccggu

SEQ ID NO: 857891 - RNA, 15 nt, Mycobacterium avium subsp. paratuberculosis
cgccgguggccgccg

SEQ ID NO: 857892 - RNA, 16 nt, Mycobacterium avium subsp. paratuberculosis
cgccgguggccgccgg

SEQ ID NO: 857893 - RNA, 14 nt, Mycobacterium avium subsp. paratuberculosis
cgccgguggccgcg

SEQ ID NO: 857894 - RNA, 15 nt, Mycobacterium avium subsp. paratuberculosis
cgccgguggccgcgc

SEQ ID NO: 857895 - RNA, 16 nt, Mycobacterium avium subsp. paratuberculosis
cgccgguggccgcgcu

SEQ ID NO: 857896 - RNA, 19 nt, Mycobacterium avium subsp. paratuberculosis
cgccgguugaucacccggg

SEQ ID NO: 857897 - RNA, 22 nt, Mycobacterium avium subsp. paratuberculosis
cgccgguugaucacccgggucg

SEQ ID NO: 857898 - RNA, 19 nt, Mycobacterium avium subsp. paratuberculosis
cgccgguucgcuggcggcc

SEQ ID NO: 857899 - RNA, 21 nt, Mycobacterium avium subsp. paratuberculosis
cgccgguucgcuggcggccag

SEQ ID NO: 857900 - RNA, 20 nt, Mycobacterium avium subsp. paratuberculosis
cgccgguguucggcgccagc

SEQ ID NO: 857901 - RNA, 18 nt, Mycobacterium avium subsp. paratuberculosis
cgccgguggugucgacgg

SEQ ID NO: 857902 - RNA, 16 nt, Mycobacterium avium subsp. paratuberculosis
cgccgguguagaucgg

SEQ ID NO: 857903 - RNA, 20 nt, Mycobacterium avium subsp. paratuberculosis
cgccgguguagaucggcuca

SEQ ID NO: 857904 - RNA, 15 nt, Mycobacterium avium subsp. paratuberculosis
cgccggugucggcga

SEQ ID NO: 857905 - RNA, 16 nt, Mycobacterium avium subsp. paratuberculosis
cgccggugucggcgac

SEQ ID NO: 857906 - RNA, 17 nt, Mycobacterium avium subsp. paratuberculosis
cgccggugucggcgacc

SEQ ID NO: 857907 - RNA, 16 nt, Mycobacterium avium subsp. paratuberculosis
cgccggugugaucgag

SEQ ID NO: 857908 - RNA, 19 nt, Mycobacterium avium subsp. paratuberculosis
cgccggugugaucgagcac

SEQ ID NO: 857909 - RNA, 14 nt, Mycobacterium avium subsp. paratuberculosis
cgccggugugcagc

SEQ ID NO: 857910 - RNA, 19 nt, Mycobacterium avium subsp. paratuberculosis
cgccggugugcagccaccc

SEQ ID NO: 857911 - RNA, 20 nt, Mycobacterium avium subsp. paratuberculosis
cgccggugugcagccacccg

SEQ ID NO: 857912 - RNA, 23 nt, Mycobacterium avium subsp. paratuberculosis
cgccggugugcagccacccgucg

SEQ ID NO: 857913 - RNA, 14 nt, Mycobacterium avium subsp. paratuberculosis
cgccguccccgcgc

SEQ ID NO: 857914 - RNA, 17 nt, Mycobacterium avium subsp. paratuberculosis
cgccguccccgcgcggc

SEQ ID NO: 857915 - RNA, 13 nt, Mycobacterium avium subsp. paratuberculosis
cgccgucccggac

SEQ ID NO: 857916 - RNA, 14 nt, Mycobacterium avium subsp. paratuberculosis
cgccgucccggacg

SEQ ID NO: 857917 - RNA, 18 nt, Mycobacterium avium subsp. paratuberculosis
cgccgucccggacgcugc

SEQ ID NO: 857918 - RNA, 15 nt, Mycobacterium avium subsp. paratuberculosis
cgccgucccgucacg

SEQ ID NO: 857919 - RNA, 18 nt, Mycobacterium avium subsp. paratuberculosis
cgccgucccgucacggcu

SEQ ID NO: 857920 - RNA, 14 nt, Mycobacterium avium subsp. paratuberculosis
cgccgucccguccg

SEQ ID NO: 857921 - RNA, 15 nt, Mycobacterium avium subsp. paratuberculosis
cgccgucccguccga

SEQ ID NO: 857922 - RNA, 15 nt, Mycobacterium avium subsp. paratuberculosis
cgccguccgacgugc

SEQ ID NO: 857923 - RNA, 15 nt, Mycobacterium avium subsp. paratuberculosis
cgccgucaccucgag

SEQ ID NO: 857924 - RNA, 19 nt, Mycobacterium avium subsp. paratuberculosis
cgccgucaccucgaggaac

SEQ ID NO: 857925 - RNA, 15 nt, Mycobacterium avium subsp. paratuberculosis
cgccgucacggaucg

SEQ ID NO: 857926 - RNA, 21 nt, Mycobacterium avium subsp. paratuberculosis
cgccgucacggaucgcccacc

SEQ ID NO: 857927 - RNA, 22 nt, Mycobacterium avium subsp. paratuberculosis
cgccgucacggaucgcccaccc

SEQ ID NO: 857928 - RNA, 20 nt, Mycobacterium avium subsp. paratuberculosis
cgccgucacaccgcggccag

SEQ ID NO: 857929 - RNA, 21 nt, Mycobacterium avium subsp. paratuberculosis
cgccgucacaccgcggccagc

SEQ ID NO: 857930 - RNA, 22 nt, Mycobacterium avium subsp. paratuberculosis
cgccgucacaccgcggccagcg

SEQ ID NO: 857931 - RNA, 23 nt, Mycobacterium avium subsp. paratuberculosis
cgccgucacaccgcggccagcgc

SEQ ID NO: 857932 - RNA, 21 nt, Mycobacterium avium subsp. paratuberculosis
cgccguauuggcaggcgaugu

SEQ ID NO: 857933 - RNA, 15 nt, Mycobacterium avium subsp. paratuberculosis
cgccgucaccgccag

SEQ ID NO: 857934 - RNA, 16 nt, Mycobacterium avium subsp. paratuberculosis
cgccgucaccgccagg

SEQ ID NO: 857935 - RNA, 19 nt, Mycobacterium avium subsp. paratuberculosis
cgccgucaccgccaggacc

SEQ ID NO: 857936 - RNA, 12 nt, Mycobacterium avium subsp. paratuberculosis
cgccgucaccgg

SEQ ID NO: 857937 - RNA, 16 nt, Mycobacterium avium subsp. paratuberculosis
cgccgucaccggcugc

SEQ ID NO: 857938 - RNA, 22 nt, Mycobacterium avium subsp. paratuberculosis
cgccgucaccggcugcccgacc

SEQ ID NO: 857939 - RNA, 16 nt, Mycobacterium avium subsp. paratuberculosis
cgccgucacguagcgc

SEQ ID NO: 857940 - RNA, 19 nt, Mycobacterium avium subsp. paratuberculosis
cgccgucacguagcgcggc

SEQ ID NO: 857941 - RNA, 21 nt, Mycobacterium avium subsp. paratuberculosis
cgccgucacguagcgcggccg

SEQ ID NO: 857942 - RNA, 22 nt, Mycobacterium avium subsp. paratuberculosis
cgccgucacguagcgcggccgc

SEQ ID NO: 857943 - RNA, 23 nt, Mycobacterium avium subsp. paratuberculosis
cgccgucacgucauuucggucgg

SEQ ID NO: 857944 - RNA, 23 nt, Mycobacterium avium subsp. paratuberculosis
cgccgucacugcacgcacggcga

SEQ ID NO: 857945 - RNA, 13 nt, Mycobacterium avium subsp. paratuberculosis
cgccggugacccc

SEQ ID NO: 857946 - RNA, 20 nt, Mycobacterium avium subsp. paratuberculosis
cgccggugaccccgucgaac

SEQ ID NO: 857947 - RNA, 20 nt, Mycobacterium avium subsp. paratuberculosis
cgccggugcuggucaugccg

SEQ ID NO: 857948 - RNA, 14 nt, Mycobacterium avium subsp. paratuberculosis
cgccggugcggccg

SEQ ID NO: 857949 - RNA, 15 nt, Mycobacterium avium subsp. paratuberculosis
cgccggugcggccgc

SEQ ID NO: 857950 - RNA, 16 nt, Mycobacterium avium subsp. paratuberculosis
cgccggugcggccgcg

SEQ ID NO: 857951 - RNA, 17 nt, Mycobacterium avium subsp. paratuberculosis
cgccggugcggccgcga

SEQ ID NO: 857952 - RNA, 18 nt, Mycobacterium avium subsp. paratuberculosis
cgccggugcggccgcgau

SEQ ID NO: 857953 - RNA, 14 nt, Mycobacterium avium subsp. paratuberculosis
cgccggugcgggcu

SEQ ID NO: 857954 - RNA, 16 nt, Mycobacterium avium subsp. paratuberculosis
cgccggugcgggcugg

SEQ ID NO: 857955 - RNA, 20 nt, Mycobacterium avium subsp. paratuberculosis
cgccggugccguugaucagg

SEQ ID NO: 857956 - RNA, 16 nt, Mycobacterium avium subsp. paratuberculosis
cgccggugaccgcgcc

SEQ ID NO: 857957 - RNA, 17 nt, Mycobacterium avium subsp. paratuberculosis
cgccggugaccgcgccg

SEQ ID NO: 857958 - RNA, 13 nt, Mycobacterium avium subsp. paratuberculosis
cgccggugaccug

SEQ ID NO: 857959 - RNA, 14 nt, Mycobacterium avium subsp. paratuberculosis
cgccggugaccugc

SEQ ID NO: 857960 - RNA, 17 nt, Mycobacterium avium subsp. paratuberculosis
cgccggugaacacgaac

SEQ ID NO: 857961 - RNA, 18 nt, Mycobacterium avium subsp. paratuberculosis
cgccggugaagaucagcg

SEQ ID NO: 857962 - RNA, 20 nt, Mycobacterium avium subsp. paratuberculosis
cgccggugaagaucagcgcg

SEQ ID NO: 857963 - RNA, 21 nt, Mycobacterium avium subsp. paratuberculosis
cgccggugaagaucagcgcgu

SEQ ID NO: 857964 - RNA, 24 nt, Mycobacterium avium subsp. paratuberculosis
cgccggugaagaucagcgcgucgg

SEQ ID NO: 857965 - RNA, 16 nt, Mycobacterium avium subsp. paratuberculosis
cgccggugaagaucgc

SEQ ID NO: 857966 - RNA, 20 nt, Mycobacterium avium subsp. paratuberculosis
cgccggugaagaucgcccgc

SEQ ID NO: 857967 - RNA, 23 nt, Mycobacterium avium subsp. paratuberculosis
cgccggugaagaucgcccgccgc

SEQ ID NO: 857968 - RNA, 18 nt, Mycobacterium avium subsp. paratuberculosis
cgccggugaagcgggaca

SEQ ID NO: 857969 - RNA, 19 nt, Mycobacterium avium subsp. paratuberculosis
cgccggugaccacgcugag

SEQ ID NO: 857970 - RNA, 14 nt, Mycobacterium avium subsp. paratuberculosis
cgccggugaccaga

SEQ ID NO: 857971 - RNA, 12 nt, Mycobacterium avium subsp. paratuberculosis
cgccggucggcg

SEQ ID NO: 857972 - RNA, 13 nt, Mycobacterium avium subsp. paratuberculosis
cgccggucggcgg

SEQ ID NO: 857973 - RNA, 14 nt, Mycobacterium avium subsp. paratuberculosis
cgccggucgcugcg

SEQ ID NO: 857974 - RNA, 19 nt, Mycobacterium avium subsp. paratuberculosis
cgccggucgcugcgaugau

SEQ ID NO: 857975 - RNA, 14 nt, Mycobacterium avium subsp. paratuberculosis
cgccggucggugcg

SEQ ID NO: 857976 - RNA, 18 nt, Mycobacterium avium subsp. paratuberculosis
cgccggucguagcgucgg

SEQ ID NO: 857977 - RNA, 21 nt, Mycobacterium avium subsp. paratuberculosis
cgccggucguuacgacucggc

SEQ ID NO: 857978 - RNA, 21 nt, Mycobacterium avium subsp. paratuberculosis
cgccggucucgaacacgccgu

SEQ ID NO: 857979 - RNA, 23 nt, Mycobacterium avium subsp. paratuberculosis
cgccggucucgaacacgccgucg

SEQ ID NO: 857980 - RNA, 20 nt, Mycobacterium avium subsp. paratuberculosis
cgccgggauaacccagcacc

SEQ ID NO: 857981 - RNA, 24 nt, Mycobacterium avium subsp. paratuberculosis
cgccgggauaacccagcaccacca

SEQ ID NO: 857982 - RNA, 22 nt, Mycobacterium avium subsp. paratuberculosis
cgccgggacgggcauccggcuc

SEQ ID NO: 857983 - RNA, 17 nt, Mycobacterium avium subsp. paratuberculosis
cgccggcuuucgaagag

SEQ ID NO: 857984 - RNA, 17 nt, Mycobacterium avium subsp. paratuberculosis
cgccgggauauucgccc

SEQ ID NO: 857985 - RNA, 18 nt, Mycobacterium avium subsp. paratuberculosis
cgccgggauauucgccca

SEQ ID NO: 857986 - RNA, 22 nt, Mycobacterium avium subsp. paratuberculosis
cgccgggauauucgcccagcgg

SEQ ID NO: 857987 - RNA, 16 nt, Mycobacterium avium subsp. paratuberculosis
cgccgggaucggcggg

SEQ ID NO: 857988 - RNA, 13 nt, Mycobacterium avium subsp. paratuberculosis
cgccgggaugcgc

SEQ ID NO: 857989 - RNA, 17 nt, Mycobacterium avium subsp. paratuberculosis
cgccgggaugcgccacc

SEQ ID NO: 857990 - RNA, 18 nt, Mycobacterium avium subsp. paratuberculosis
cgccgggaugcgccaccg

SEQ ID NO: 857991 - RNA, 21 nt, Mycobacterium avium subsp. paratuberculosis
cgccgggaugcgccaccgaca

SEQ ID NO: 857992 - RNA, 17 nt, Mycobacterium avium subsp. paratuberculosis
cgccgggcaacagcgcg

SEQ ID NO: 857993 - RNA, 23 nt, Mycobacterium avium subsp. paratuberculosis
cgccgggcaacagcgcgccggcc

SEQ ID NO: 857994 - RNA, 18 nt, Mycobacterium avium subsp. paratuberculosis
cgccgggcagcccgccgc

SEQ ID NO: 857995 - RNA, 14 nt, Mycobacterium avium subsp. paratuberculosis
cgccgggcaucucg

SEQ ID NO: 857996 - RNA, 18 nt, Mycobacterium avium subsp. paratuberculosis
cgccgggcccggucccgc

SEQ ID NO: 857997 - RNA, 12 nt, Mycobacterium avium subsp. paratuberculosis
cgccgggcccgc

SEQ ID NO: 857998 - RNA, 14 nt, Mycobacterium avium subsp. paratuberculosis
cgccgggcccgcuc

SEQ ID NO: 857999 - RNA, 17 nt, Mycobacterium avium subsp. paratuberculosis
cgccgggcagcccgggu

SEQ ID NO: 858000 - RNA, 20 nt, Mycobacterium avium subsp. paratuberculosis
cgccgggcagcgcgcgagac

SEQ ID NO: 858001 - RNA, 17 nt, Mycobacterium avium subsp. paratuberculosis
cgccgggcagguggucg

SEQ ID NO: 858002 - RNA, 20 nt, Mycobacterium avium subsp. paratuberculosis
cgccgggcagguggucggcg

SEQ ID NO: 858003 - RNA, 17 nt, Mycobacterium avium subsp. paratuberculosis
cgccgggcauccgggcc

SEQ ID NO: 858004 - RNA, 18 nt, Mycobacterium avium subsp. paratuberculosis
cgccgggcauccgggccg

SEQ ID NO: 858005 - RNA, 14 nt, Mycobacterium avium subsp. paratuberculosis
cgccgggcaccacc

SEQ ID NO: 858006 - RNA, 15 nt, Mycobacterium avium subsp. paratuberculosis
cgccgggcaccacca

SEQ ID NO: 858007 - RNA, 16 nt, Mycobacterium avium subsp. paratuberculosis
cgccgggcaccaccac

SEQ ID NO: 858008 - RNA, 19 nt, Mycobacterium avium subsp. paratuberculosis
cgccgggcaccaccaccga

SEQ ID NO: 858009 - RNA, 20 nt, Mycobacterium avium subsp. paratuberculosis
cgccgggcaccaccaccgac

SEQ ID NO: 858010 - RNA, 17 nt, Mycobacterium avium subsp. paratuberculosis
cgccgggcacccgggug

SEQ ID NO: 858011 - RNA, 19 nt, Mycobacterium avium subsp. paratuberculosis
cgccgggcaccucggcguc

SEQ ID NO: 858012 - RNA, 20 nt, Mycobacterium avium subsp. paratuberculosis
cgccgggcaccucggcgucg

SEQ ID NO: 858013 - RNA, 21 nt, Mycobacterium avium subsp. paratuberculosis
cgccgggcaccucggcgucgg

SEQ ID NO: 858014 - RNA, 22 nt, Mycobacterium avium subsp. paratuberculosis
cgccgggcaccucggcgucggc

SEQ ID NO: 858015 - RNA, 15 nt, Mycobacterium avium subsp. paratuberculosis
cgccgugcgcggcga

SEQ ID NO: 858016 - RNA, 16 nt, Mycobacterium avium subsp. paratuberculosis
cgccgugcgcggcgac

SEQ ID NO: 858017 - RNA, 19 nt, Mycobacterium avium subsp. paratuberculosis
cgccgugcgcggcgaccac

SEQ ID NO: 858018 - RNA, 15 nt, Mycobacterium avium subsp. paratuberculosis
cgccgugcgccagcg

SEQ ID NO: 858019 - RNA, 16 nt, Mycobacterium avium subsp. paratuberculosis
cgccgugcgccagcga

SEQ ID NO: 858020 - RNA, 18 nt, Mycobacterium avium subsp. paratuberculosis
cgccgugcgccagcgacc

SEQ ID NO: 858021 - RNA, 22 nt, Mycobacterium avium subsp. paratuberculosis
cgccgugcgccagcgaccgcag

SEQ ID NO: 858022 - RNA, 13 nt, Mycobacterium avium subsp. paratuberculosis
cgccgugcgucca

SEQ ID NO: 858023 - RNA, 14 nt, Mycobacterium avium subsp. paratuberculosis
cgccgugcguccag

SEQ ID NO: 858024 - RNA, 17 nt, Mycobacterium avium subsp. paratuberculosis
cgccgugcguccagucg

SEQ ID NO: 858025 - RNA, 14 nt, Mycobacterium avium subsp. paratuberculosis
cgccgugcccggcg

SEQ ID NO: 858026 - RNA, 14 nt, Mycobacterium avium subsp. paratuberculosis
cgccgugccggacc

SEQ ID NO: 858027 - RNA, 15 nt, Mycobacterium avium subsp. paratuberculosis
cgccgugccggaccg

SEQ ID NO: 858028 - RNA, 13 nt, Mycobacterium avium subsp. paratuberculosis
cgccgugccgcgc

SEQ ID NO: 858029 - RNA, 15 nt, Mycobacterium avium subsp. paratuberculosis
cgccgugccgcgcgg

SEQ ID NO: 858030 - RNA, 18 nt, Mycobacterium avium subsp. paratuberculosis
cgccgugccgcgcggcga

SEQ ID NO: 858031 - RNA, 23 nt, Mycobacterium avium subsp. paratuberculosis
cgccgugccgcgcggcgauggcc

SEQ ID NO: 858032 - RNA, 18 nt, Mycobacterium avium subsp. paratuberculosis
cgccgugcagaacagcac

SEQ ID NO: 858033 - RNA, 20 nt, Mycobacterium avium subsp. paratuberculosis
cgccgugcagaacagcacga

SEQ ID NO: 858034 - RNA, 20 nt, Mycobacterium avium subsp. paratuberculosis
cgccgugcauccagccgucc

SEQ ID NO: 858035 - RNA, 17 nt, Mycobacterium avium subsp. paratuberculosis
cgccgugcccaacacgc

SEQ ID NO: 858036 - RNA, 14 nt, Mycobacterium avium subsp. paratuberculosis
cgccgugcagcacc

SEQ ID NO: 858037 - RNA, 15 nt, Mycobacterium avium subsp. paratuberculosis
cgccgugcagcaccu

SEQ ID NO: 858038 - RNA, 15 nt, Mycobacterium avium subsp. paratuberculosis
cgccgugcagcacgc

SEQ ID NO: 858039 - RNA, 16 nt, Mycobacterium avium subsp. paratuberculosis
cgccgugcagcacgcc

SEQ ID NO: 858040 - RNA, 17 nt, Mycobacterium avium subsp. paratuberculosis
cgccgugcagcacgccg

SEQ ID NO: 858041 - RNA, 22 nt, Mycobacterium avium subsp. paratuberculosis
cgccgugcagcacgccgcggaa

SEQ ID NO: 858042 - RNA, 21 nt, Mycobacterium avium subsp. paratuberculosis
cgccgugcaggaugaccgcgu

SEQ ID NO: 858043 - RNA, 22 nt, Mycobacterium avium subsp. paratuberculosis
cgccgugcaggaugaccgcguc

SEQ ID NO: 858044 - RNA, 23 nt, Mycobacterium avium subsp. paratuberculosis
cgccgugcaggaugaccgcgucg

SEQ ID NO: 858045 - RNA, 18 nt, Mycobacterium avium subsp. paratuberculosis
cgccgugaucuggugggc

SEQ ID NO: 858046 - RNA, 16 nt, Mycobacterium avium subsp. paratuberculosis
cgccgugagauccagc

SEQ ID NO: 858047 - RNA, 19 nt, Mycobacterium avium subsp. paratuberculosis
cgccgugagauccagcagc

SEQ ID NO: 858048 - RNA, 20 nt, Mycobacterium avium subsp. paratuberculosis
cgccgugagauccagcagcc

SEQ ID NO: 858049 - RNA, 13 nt, Mycobacterium avium subsp. paratuberculosis
cgccgugaccggc

SEQ ID NO: 858050 - RNA, 14 nt, Mycobacterium avium subsp. paratuberculosis
cgccgugaccggcg

SEQ ID NO: 858051 - RNA, 17 nt, Mycobacterium avium subsp. paratuberculosis
cgccgugaccggcgauc

SEQ ID NO: 858052 - RNA, 17 nt, Mycobacterium avium subsp. paratuberculosis
cgccguguaggccgcgc

SEQ ID NO: 858053 - RNA, 20 nt, Mycobacterium avium subsp. paratuberculosis
cgccguguaggccgcgcugg

SEQ ID NO: 858054 - RNA, 20 nt, Mycobacterium avium subsp. paratuberculosis
cgccgugguccagccggucg

SEQ ID NO: 858055 - RNA, 23 nt, Mycobacterium avium subsp. paratuberculosis
cgccgugguccagccggucgcag

SEQ ID NO: 858056 - RNA, 20 nt, Mycobacterium avium subsp. paratuberculosis
cgccguggcguuacacccgc

SEQ ID NO: 858057 - RNA, 21 nt, Mycobacterium avium subsp. paratuberculosis
cgccguggcguuacacccgcg

SEQ ID NO: 858058 - RNA, 15 nt, Mycobacterium avium subsp. paratuberculosis
cgccguggcggcccg

SEQ ID NO: 858059 - RNA, 21 nt, Mycobacterium avium subsp. paratuberculosis
cgccguggcggcccgaccagc

SEQ ID NO: 858060 - RNA, 23 nt, Mycobacterium avium subsp. paratuberculosis
cgccguggcggcccgaccagcgg

SEQ ID NO: 858061 - RNA, 14 nt, Mycobacterium avium subsp. paratuberculosis
cgccguggcggcgg

SEQ ID NO: 858062 - RNA, 15 nt, Mycobacterium avium subsp. paratuberculosis
cgccguggcagggcc

SEQ ID NO: 858063 - RNA, 16 nt, Mycobacterium avium subsp. paratuberculosis
cgccguggcagggcca

SEQ ID NO: 858064 - RNA, 21 nt, Mycobacterium avium subsp. paratuberculosis
cgccguggcagggccagcagc

SEQ ID NO: 858065 - RNA, 13 nt, Mycobacterium avium subsp. paratuberculosis
cgccguggccugc

SEQ ID NO: 858066 - RNA, 16 nt, Mycobacterium avium subsp. paratuberculosis
cgccguggccugcgac

SEQ ID NO: 858067 - RNA, 13 nt, Mycobacterium avium subsp. paratuberculosis
cgccguggcccau

SEQ ID NO: 858068 - RNA, 13 nt, Mycobacterium avium subsp. paratuberculosis
cgccguggcccgc

SEQ ID NO: 858069 - RNA, 14 nt, Mycobacterium avium subsp. paratuberculosis
cgccguggcccggu

SEQ ID NO: 858070 - RNA, 15 nt, Mycobacterium avium subsp. paratuberculosis
cgccguggcccgguc

SEQ ID NO: 858071 - RNA, 17 nt, Mycobacterium avium subsp. paratuberculosis
cgccguggcccggucgg

SEQ ID NO: 858072 - RNA, 14 nt, Mycobacterium avium subsp. paratuberculosis
cgccguggccgaac

SEQ ID NO: 858073 - RNA, 16 nt, Mycobacterium avium subsp. paratuberculosis
cgccguggccgaacgg

SEQ ID NO: 858074 - RNA, 14 nt, Mycobacterium avium subsp. paratuberculosis
cgccgugcggcguu

SEQ ID NO: 858075 - RNA, 22 nt, Mycobacterium avium subsp. paratuberculosis
cgccgugcugccggaacgagcc

SEQ ID NO: 858076 - RNA, 21 nt, Mycobacterium avium subsp. paratuberculosis
cgccgugaacugugcggugcg

SEQ ID NO: 858077 - RNA, 22 nt, Mycobacterium avium subsp. paratuberculosis
cgccgugaacugugcggugcgg

SEQ ID NO: 858078 - RNA, 17 nt, Mycobacterium avium subsp. paratuberculosis
cgccgugaagggcccgc

SEQ ID NO: 858079 - RNA, 19 nt, Mycobacterium avium subsp. paratuberculosis
cgccgugaagggcccgccg

SEQ ID NO: 858080 - RNA, 20 nt, Mycobacterium avium subsp. paratuberculosis
cgccgugaagggcccgccgg

SEQ ID NO: 858081 - RNA, 21 nt, Mycobacterium avium subsp. paratuberculosis
cgccgucuucccagugccgca

SEQ ID NO: 858082 - RNA, 15 nt, Mycobacterium avium subsp. paratuberculosis
cgccgucgucgagca

SEQ ID NO: 858083 - RNA, 17 nt, Mycobacterium avium subsp. paratuberculosis
cgccgucgucgagcacc

SEQ ID NO: 858084 - RNA, 21 nt, Mycobacterium avium subsp. paratuberculosis
cgccgucgugcucggcgagca

SEQ ID NO: 858085 - RNA, 23 nt, Mycobacterium avium subsp. paratuberculosis
cgccgucgugcucggcgagcacc

SEQ ID NO: 858086 - RNA, 21 nt, Mycobacterium avium subsp. paratuberculosis
cgccgucgugguggccgcgaa

SEQ ID NO: 858087 - RNA, 14 nt, Mycobacterium avium subsp. paratuberculosis
cgccgucuccggcg

SEQ ID NO: 858088 - RNA, 17 nt, Mycobacterium avium subsp. paratuberculosis
cgccgucuccucgacca

SEQ ID NO: 858089 - RNA, 21 nt, Mycobacterium avium subsp. paratuberculosis
cgccgucuccucgaccagcgc

SEQ ID NO: 858090 - RNA, 22 nt, Mycobacterium avium subsp. paratuberculosis
cgccgucuccucgaccagcgcg

SEQ ID NO: 858091 - RNA, 14 nt, Mycobacterium avium subsp. paratuberculosis
cgccgucucgacca

SEQ ID NO: 858092 - RNA, 18 nt, Mycobacterium avium subsp. paratuberculosis
cgccgucucgacccgggc

SEQ ID NO: 858093 - RNA, 18 nt, Mycobacterium avium subsp. paratuberculosis
cgccgucugguccaccgg

SEQ ID NO: 858094 - RNA, 22 nt, Mycobacterium avium subsp. paratuberculosis
cgccgucguugaucaggugcag

SEQ ID NO: 858095 - RNA, 14 nt, Mycobacterium avium subsp. paratuberculosis
cgccgucguagccg

SEQ ID NO: 858096 - RNA, 20 nt, Mycobacterium avium subsp. paratuberculosis
cgccgucguauucgacggcg

SEQ ID NO: 858097 - RNA, 23 nt, Mycobacterium avium subsp. paratuberculosis
cgccgucguauucgacggcgacc

SEQ ID NO: 858098 - RNA, 16 nt, Mycobacterium avium subsp. paratuberculosis
cgccgucgucagccgg

SEQ ID NO: 858099 - RNA, 20 nt, Mycobacterium avium subsp. paratuberculosis
cgccgucgucagccgggcca

SEQ ID NO: 858100 - RNA, 14 nt, Mycobacterium avium subsp. paratuberculosis
cgccgucgucgucg

SEQ ID NO: 858101 - RNA, 17 nt, Mycobacterium avium subsp. paratuberculosis
cgccgucgucgucgcuc

SEQ ID NO: 858102 - RNA, 17 nt, Mycobacterium avium subsp. paratuberculosis
cgccgucgucgucggcc

SEQ ID NO: 858103 - RNA, 14 nt, Mycobacterium avium subsp. paratuberculosis
cgccgucggugaug

SEQ ID NO: 858104 - RNA, 13 nt, Mycobacterium avium subsp. paratuberculosis
cgccgucgacgau

SEQ ID NO: 858105 - RNA, 13 nt, Mycobacterium avium subsp. paratuberculosis
cgccgucgguggg

SEQ ID NO: 858106 - RNA, 14 nt, Mycobacterium avium subsp. paratuberculosis
cgccgucgggguag

SEQ ID NO: 858107 - RNA, 14 nt, Mycobacterium avium subsp. paratuberculosis
cgccgucggggucg

SEQ ID NO: 858108 - RNA, 19 nt, Mycobacterium avium subsp. paratuberculosis
cgccgucggggucgcgccg

SEQ ID NO: 858109 - RNA, 21 nt, Mycobacterium avium subsp. paratuberculosis
cgccgucggggucgcgccggu

SEQ ID NO: 858110 - RNA, 13 nt, Mycobacterium avium subsp. paratuberculosis
cgccgucggggug

SEQ ID NO: 858111 - RNA, 19 nt, Mycobacterium avium subsp. paratuberculosis
cgccgucggggugcggucg

SEQ ID NO: 858112 - RNA, 20 nt, Mycobacterium avium subsp. paratuberculosis
cgccgucggggugcggucgg

SEQ ID NO: 858113 - RNA, 22 nt, Mycobacterium avium subsp. paratuberculosis
cgccgucggggugcggucggcg

SEQ ID NO: 858114 - RNA, 21 nt, Mycobacterium avium subsp. paratuberculosis
cgccgucggcguucagcggca

SEQ ID NO: 858115 - RNA, 23 nt, Mycobacterium avium subsp. paratuberculosis
cgccgucggcguucagcggcacc

SEQ ID NO: 858116 - RNA, 15 nt, Mycobacterium avium subsp. paratuberculosis
cgccgucggggcguc

SEQ ID NO: 858117 - RNA, 16 nt, Mycobacterium avium subsp. paratuberculosis
cgccgucggggcgucg

SEQ ID NO: 858118 - RNA, 17 nt, Mycobacterium avium subsp. paratuberculosis
cgccgucggggcgucgg

SEQ ID NO: 858119 - RNA, 19 nt, Mycobacterium avium subsp. paratuberculosis
cgccgucggggcgucggcg

SEQ ID NO: 858120 - RNA, 22 nt, Mycobacterium avium subsp. paratuberculosis
cgccgucggggcgucggcggcc

SEQ ID NO: 858121 - RNA, 21 nt, Mycobacterium avium subsp. paratuberculosis
cgccgucggggcugaguucgg

SEQ ID NO: 858122 - RNA, 14 nt, Mycobacterium avium subsp. paratuberculosis
cgccgucggcaucc

SEQ ID NO: 858123 - RNA, 22 nt, Mycobacterium avium subsp. paratuberculosis
cgccgucggcauccacccguuc

SEQ ID NO: 858124 - RNA, 11 nt, Mycobacterium avium subsp. paratuberculosis
cgccgucggcc

SEQ ID NO: 858125 - RNA, 13 nt, Mycobacterium avium subsp. paratuberculosis
cgccgucggccag

SEQ ID NO: 858126 - RNA, 14 nt, Mycobacterium avium subsp. paratuberculosis
cgccgucggccagc

SEQ ID NO: 858127 - RNA, 15 nt, Mycobacterium avium subsp. paratuberculosis
cgccgucggccagca

SEQ ID NO: 858128 - RNA, 17 nt, Mycobacterium avium subsp. paratuberculosis
cgccgucggccagcagc

SEQ ID NO: 858129 - RNA, 18 nt, Mycobacterium avium subsp. paratuberculosis
cgccgucggccagcagcg

SEQ ID NO: 858130 - RNA, 22 nt, Mycobacterium avium subsp. paratuberculosis
cgccgucggccagcagcgcguc

SEQ ID NO: 858131 - RNA, 20 nt, Mycobacterium avium subsp. paratuberculosis
cgccgucggcccacggugag

SEQ ID NO: 858132 - RNA, 13 nt, Mycobacterium avium subsp. paratuberculosis
cgccgucgacgcg

SEQ ID NO: 858133 - RNA, 19 nt, Mycobacterium avium subsp. paratuberculosis
cgccgucgacgcgugcguc

SEQ ID NO: 858134 - RNA, 20 nt, Mycobacterium avium subsp. paratuberculosis
cgccgucgacgcgugcguca

SEQ ID NO: 858135 - RNA, 12 nt, Mycobacterium avium subsp. paratuberculosis
cgccgucgacgg

SEQ ID NO: 858136 - RNA, 21 nt, Mycobacterium avium subsp. paratuberculosis
cgccgucgacccguuccccgg

SEQ ID NO: 858137 - RNA, 15 nt, Mycobacterium avium subsp. paratuberculosis
cgccgucgaccacga

SEQ ID NO: 858138 - RNA, 22 nt, Mycobacterium avium subsp. paratuberculosis
cgccguccgggaacacguagcg

SEQ ID NO: 858139 - RNA, 20 nt, Mycobacterium avium subsp. paratuberculosis
cgccguccggggccggugcg

SEQ ID NO: 858140 - RNA, 13 nt, Mycobacterium avium subsp. paratuberculosis
cgccguccgcacc

SEQ ID NO: 858141 - RNA, 14 nt, Mycobacterium avium subsp. paratuberculosis
cgccguccgcaccg

SEQ ID NO: 858142 - RNA, 19 nt, Mycobacterium avium subsp. paratuberculosis
cgccguccgcaccgcgacg

SEQ ID NO: 858143 - RNA, 13 nt, Mycobacterium avium subsp. paratuberculosis
cgccguccgcggc

SEQ ID NO: 858144 - RNA, 14 nt, Mycobacterium avium subsp. paratuberculosis
cgccguccgcggcg

SEQ ID NO: 858145 - RNA, 15 nt, Mycobacterium avium subsp. paratuberculosis
cgccguccgcggcgg

SEQ ID NO: 858146 - RNA, 15 nt, Mycobacterium avium subsp. paratuberculosis
cgccguccggccacg

SEQ ID NO: 858147 - RNA, 18 nt, Mycobacterium avium subsp. paratuberculosis
cgccgcguucggcggcgc

SEQ ID NO: 858148 - RNA, 14 nt, Mycobacterium avium subsp. paratuberculosis
cgccgcguugucgg

SEQ ID NO: 858149 - RNA, 17 nt, Mycobacterium avium subsp. paratuberculosis
cgccgcguugucggcgu

SEQ ID NO: 858150 - RNA, 19 nt, Mycobacterium avium subsp. paratuberculosis
cgccgcguugucggcgucc

SEQ ID NO: 858151 - RNA, 20 nt, Mycobacterium avium subsp. paratuberculosis
cgccgcguugucggcguccu

SEQ ID NO: 858152 - RNA, 23 nt, Mycobacterium avium subsp. paratuberculosis
cgccgcgugggagagcgggaccg

SEQ ID NO: 858153 - RNA, 18 nt, Mycobacterium avium subsp. paratuberculosis
cgccgcguucacccgcgc

SEQ ID NO: 858154 - RNA, 21 nt, Mycobacterium avium subsp. paratuberculosis
cgccgcguucacccgcgcccg

SEQ ID NO: 858155 - RNA, 23 nt, Mycobacterium avium subsp. paratuberculosis
cgccgcguucacccgcgcccgca

SEQ ID NO: 858156 - RNA, 17 nt, Mycobacterium avium subsp. paratuberculosis
cgccgcgucgucgucga

SEQ ID NO: 858157 - RNA, 12 nt, Mycobacterium avium subsp. paratuberculosis
cgccgcugguga

SEQ ID NO: 858158 - RNA, 22 nt, Mycobacterium avium subsp. paratuberculosis
cgccgcuggugaacucgccgau

SEQ ID NO: 858159 - RNA, 14 nt, Mycobacterium avium subsp. paratuberculosis
cgccgcugggcgug

SEQ ID NO: 858160 - RNA, 17 nt, Mycobacterium avium subsp. paratuberculosis
cgccgcugggcguggug

SEQ ID NO: 858161 - RNA, 17 nt, Mycobacterium avium subsp. paratuberculosis
cgccgcuguccucgucg

SEQ ID NO: 858162 - RNA, 22 nt, Mycobacterium avium subsp. paratuberculosis
cgccgcuugcagcuuggcggug

SEQ ID NO: 858163 - RNA, 14 nt, Mycobacterium avium subsp. paratuberculosis
cgccgcuucgucgc

SEQ ID NO: 858164 - RNA, 20 nt, Mycobacterium avium subsp. paratuberculosis
cgccgcuucgucgccggccg

SEQ ID NO: 858165 - RNA, 14 nt, Mycobacterium avium subsp. paratuberculosis
cgccggacggcccg

SEQ ID NO: 858166 - RNA, 15 nt, Mycobacterium avium subsp. paratuberculosis
cgccggacggcccgc

SEQ ID NO: 858167 - RNA, 15 nt, Mycobacterium avium subsp. paratuberculosis
cgccggaccgauccg

SEQ ID NO: 858168 - RNA, 23 nt, Mycobacterium avium subsp. paratuberculosis
cgccggaccgauccggcgcccga

SEQ ID NO: 858169 - RNA, 18 nt, Mycobacterium avium subsp. paratuberculosis
cgccggaccccacagcgc

SEQ ID NO: 858170 - RNA, 20 nt, Mycobacterium avium subsp. paratuberculosis
cgccggaccccacagcgcgc

SEQ ID NO: 858171 - RNA, 22 nt, Mycobacterium avium subsp. paratuberculosis
cgccggaccccacagcgcgccc

SEQ ID NO: 858172 - RNA, 14 nt, Mycobacterium avium subsp. paratuberculosis
cgccggagaccagc

SEQ ID NO: 858173 - RNA, 21 nt, Mycobacterium avium subsp. paratuberculosis
cgccggagagcccgucgucgg

SEQ ID NO: 858174 - RNA, 19 nt, Mycobacterium avium subsp. paratuberculosis
cgccggacucgaucgccac

SEQ ID NO: 858175 - RNA, 20 nt, Mycobacterium avium subsp. paratuberculosis
cgccggacucgaucgccacc

SEQ ID NO: 858176 - RNA, 21 nt, Mycobacterium avium subsp. paratuberculosis
cgccggacucgaucgccaccg

SEQ ID NO: 858177 - RNA, 22 nt, Mycobacterium avium subsp. paratuberculosis
cgccggacucgaucgccaccga

SEQ ID NO: 858178 - RNA, 22 nt, Mycobacterium avium subsp. paratuberculosis
cgccggagaugaucaugucguc

SEQ ID NO: 858179 - RNA, 14 nt, Mycobacterium avium subsp. paratuberculosis
cgccggagccgauc

SEQ ID NO: 858180 - RNA, 15 nt, Mycobacterium avium subsp. paratuberculosis
cgccggagccgaucg

SEQ ID NO: 858181 - RNA, 19 nt, Mycobacterium avium subsp. paratuberculosis
cgccggaggccagcucgac

SEQ ID NO: 858182 - RNA, 12 nt, Mycobacterium avium subsp. paratuberculosis
cgccggaggcga

SEQ ID NO: 858183 - RNA, 15 nt, Mycobacterium avium subsp. paratuberculosis
cgccggaggcgauca

SEQ ID NO: 858184 - RNA, 17 nt, Mycobacterium avium subsp. paratuberculosis
cgccggaggcgaucagg

SEQ ID NO: 858185 - RNA, 15 nt, Mycobacterium avium subsp. paratuberculosis
cgccggaugguccgc

SEQ ID NO: 858186 - RNA, 21 nt, Mycobacterium avium subsp. paratuberculosis
cgccggaugguccgcaugucg

SEQ ID NO: 858187 - RNA, 20 nt, Mycobacterium avium subsp. paratuberculosis
cgccggauuacucgccggcg

SEQ ID NO: 858188 - RNA, 12 nt, Mycobacterium avium subsp. paratuberculosis
cgccggccacca

SEQ ID NO: 858189 - RNA, 20 nt, Mycobacterium avium subsp. paratuberculosis
cgccggccaggccggccugc

SEQ ID NO: 858190 - RNA, 13 nt, Mycobacterium avium subsp. paratuberculosis
cgccggccaggcg

SEQ ID NO: 858191 - RNA, 14 nt, Mycobacterium avium subsp. paratuberculosis
cgccggccaggcga

SEQ ID NO: 858192 - RNA, 15 nt, Mycobacterium avium subsp. paratuberculosis
cgccggccaggcgac

SEQ ID NO: 858193 - RNA, 16 nt, Mycobacterium avium subsp. paratuberculosis
cgccggccaggcgacu

SEQ ID NO: 858194 - RNA, 16 nt, Mycobacterium avium subsp. paratuberculosis
cgccggccagcuccgc

SEQ ID NO: 858195 - RNA, 18 nt, Mycobacterium avium subsp. paratuberculosis
cgccggccagcuccgcca

SEQ ID NO: 858196 - RNA, 20 nt, Mycobacterium avium subsp. paratuberculosis
cgccggccagcuccgccacc

SEQ ID NO: 858197 - RNA, 16 nt, Mycobacterium avium subsp. paratuberculosis
cgccggccagcggcuu

SEQ ID NO: 858198 - RNA, 22 nt, Mycobacterium avium subsp. paratuberculosis
cgccggccagcggcuuggccgu

SEQ ID NO: 858199 - RNA, 13 nt, Mycobacterium avium subsp. paratuberculosis
cgccggccagcgg

SEQ ID NO: 858200 - RNA, 12 nt, Mycobacterium avium subsp. paratuberculosis
cgccggccagcg

SEQ ID NO: 858201 - RNA, 23 nt, Mycobacterium avium subsp. paratuberculosis
cgccggccaccaacaggucggcg

SEQ ID NO: 858202 - RNA, 14 nt, Mycobacterium avium subsp. paratuberculosis
cgccggccagcacg

SEQ ID NO: 858203 - RNA, 15 nt, Mycobacterium avium subsp. paratuberculosis
cgccggccagcacgc

SEQ ID NO: 858204 - RNA, 20 nt, Mycobacterium avium subsp. paratuberculosis
cgccggccagcacgccgucc

SEQ ID NO: 858205 - RNA, 16 nt, Mycobacterium avium subsp. paratuberculosis
cgccggccagcacggc

SEQ ID NO: 858206 - RNA, 17 nt, Mycobacterium avium subsp. paratuberculosis
cgccggccagcacggcg

SEQ ID NO: 858207 - RNA, 20 nt, Mycobacterium avium subsp. paratuberculosis
cgccggccagcacggcggcg

SEQ ID NO: 858208 - RNA, 21 nt, Mycobacterium avium subsp. paratuberculosis
cgccggccagcacggcggcgu

SEQ ID NO: 858209 - RNA, 22 nt, Mycobacterium avium subsp. paratuberculosis
cgccggccagcacggcggcgug

SEQ ID NO: 858210 - RNA, 13 nt, Mycobacterium avium subsp. paratuberculosis
cgccggccagcag

SEQ ID NO: 858211 - RNA, 14 nt, Mycobacterium avium subsp. paratuberculosis
cgccggccagcagc

SEQ ID NO: 858212 - RNA, 16 nt, Mycobacterium avium subsp. paratuberculosis
cgccggccagcagcag

SEQ ID NO: 858213 - RNA, 15 nt, Mycobacterium avium subsp. paratuberculosis
cgccggccaccaggg

SEQ ID NO: 858214 - RNA, 22 nt, Mycobacterium avium subsp. paratuberculosis
cgccggccaccagggucucgcg

SEQ ID NO: 858215 - RNA, 16 nt, Mycobacterium avium subsp. paratuberculosis
cgccggcaucagcgag

SEQ ID NO: 858216 - RNA, 19 nt, Mycobacterium avium subsp. paratuberculosis
cgccggcaucagcgagacg

SEQ ID NO: 858217 - RNA, 15 nt, Mycobacterium avium subsp. paratuberculosis
cgccggcauccagca

SEQ ID NO: 858218 - RNA, 17 nt, Mycobacterium avium subsp. paratuberculosis
cgccggcauccagcacg

SEQ ID NO: 858219 - RNA, 18 nt, Mycobacterium avium subsp. paratuberculosis
cgccggcauccagcacgg

SEQ ID NO: 858220 - RNA, 19 nt, Mycobacterium avium subsp. paratuberculosis
cgccggcauccagcacggc

SEQ ID NO: 858221 - RNA, 21 nt, Mycobacterium avium subsp. paratuberculosis
cgccggcauccagcacggccg

SEQ ID NO: 858222 - RNA, 18 nt, Mycobacterium avium subsp. paratuberculosis
cgccggcaucgaccgccc

SEQ ID NO: 858223 - RNA, 20 nt, Mycobacterium avium subsp. paratuberculosis
cgccggcaucgaccgcccgc

SEQ ID NO: 858224 - RNA, 18 nt, Mycobacterium avium subsp. paratuberculosis
cgccggcacaccgagcga

SEQ ID NO: 858225 - RNA, 20 nt, Mycobacterium avium subsp. paratuberculosis
cgccggcacaccgagcgagc

SEQ ID NO: 858226 - RNA, 13 nt, Mycobacterium avium subsp. paratuberculosis
cgccggcaccagc

SEQ ID NO: 858227 - RNA, 14 nt, Mycobacterium avium subsp. paratuberculosis
cgccggcaccagca

SEQ ID NO: 858228 - RNA, 15 nt, Mycobacterium avium subsp. paratuberculosis
cgccggcaccagcag

SEQ ID NO: 858229 - RNA, 16 nt, Mycobacterium avium subsp. paratuberculosis
cgccggcaccagcagc

SEQ ID NO: 858230 - RNA, 17 nt, Mycobacterium avium subsp. paratuberculosis
cgccggcaccagcagcc

SEQ ID NO: 858231 - RNA, 15 nt, Mycobacterium avium subsp. paratuberculosis
cgccggagcgcccca

SEQ ID NO: 858232 - RNA, 23 nt, Mycobacterium avium subsp. paratuberculosis
cgccggagcgccccagggccucg

SEQ ID NO: 858233 - RNA, 18 nt, Mycobacterium avium subsp. paratuberculosis
cgccggauucggcgcggc

SEQ ID NO: 858234 - RNA, 19 nt, Mycobacterium avium subsp. paratuberculosis
cgccggauucggcgcggcu

SEQ ID NO: 858235 - RNA, 17 nt, Mycobacterium avium subsp. paratuberculosis
cgccggauuggcgucgg

SEQ ID NO: 858236 - RNA, 18 nt, Mycobacterium avium subsp. paratuberculosis
cgccggauuggcgucggu

SEQ ID NO: 858237 - RNA, 20 nt, Mycobacterium avium subsp. paratuberculosis
cgccggauuggcgucggugg

SEQ ID NO: 858238 - RNA, 16 nt, Mycobacterium avium subsp. paratuberculosis
cgccggcuugccccgg

SEQ ID NO: 858239 - RNA, 17 nt, Mycobacterium avium subsp. paratuberculosis
cgccggcuuaccgaccu

SEQ ID NO: 858240 - RNA, 20 nt, Mycobacterium avium subsp. paratuberculosis
cgccggcuuaccgaccucga

SEQ ID NO: 858241 - RNA, 12 nt, Mycobacterium avium subsp. paratuberculosis
cgccggcucggu

SEQ ID NO: 858242 - RNA, 21 nt, Mycobacterium avium subsp. paratuberculosis
cgccggcuggcgggcgaucgc

SEQ ID NO: 858243 - RNA, 17 nt, Mycobacterium avium subsp. paratuberculosis
cgccggcugacugccgg

SEQ ID NO: 858244 - RNA, 19 nt, Mycobacterium avium subsp. paratuberculosis
cgccggcugacugccggcg

SEQ ID NO: 858245 - RNA, 18 nt, Mycobacterium avium subsp. paratuberculosis
cgccggcuagacgcgcag

SEQ ID NO: 858246 - RNA, 16 nt, Mycobacterium avium subsp. paratuberculosis
cgccggcuaccggcgc

SEQ ID NO: 858247 - RNA, 18 nt, Mycobacterium avium subsp. paratuberculosis
cgccggcuaccggcgcug

SEQ ID NO: 858248 - RNA, 14 nt, Mycobacterium avium subsp. paratuberculosis
cgccggcuccaccg

SEQ ID NO: 858249 - RNA, 15 nt, Mycobacterium avium subsp. paratuberculosis
cgccggcuccaccgc

SEQ ID NO: 858250 - RNA, 19 nt, Mycobacterium avium subsp. paratuberculosis
cgccggcuccaccgcgccg

SEQ ID NO: 858251 - RNA, 20 nt, Mycobacterium avium subsp. paratuberculosis
cgccggcuccaccgcgccgg

SEQ ID NO: 858252 - RNA, 21 nt, Mycobacterium avium subsp. paratuberculosis
cgccggcuccaccgcgccggc

SEQ ID NO: 858253 - RNA, 22 nt, Mycobacterium avium subsp. paratuberculosis
cgccggcuccaccgcgccggcg

SEQ ID NO: 858254 - RNA, 16 nt, Mycobacterium avium subsp. paratuberculosis
cgccggcuccgcaugc

SEQ ID NO: 858255 - RNA, 14 nt, Mycobacterium avium subsp. paratuberculosis
cgccggcguccagc

SEQ ID NO: 858256 - RNA, 21 nt, Mycobacterium avium subsp. paratuberculosis
cgccggcguccagcgccgcca

SEQ ID NO: 858257 - RNA, 18 nt, Mycobacterium avium subsp. paratuberculosis
cgccggcgucgacgucgg

SEQ ID NO: 858258 - RNA, 15 nt, Mycobacterium avium subsp. paratuberculosis
cgccggcgucgccgc

SEQ ID NO: 858259 - RNA, 17 nt, Mycobacterium avium subsp. paratuberculosis
cgccggcgucgccgcuc

SEQ ID NO: 858260 - RNA, 13 nt, Mycobacterium avium subsp. paratuberculosis
cgccggcgucggu

SEQ ID NO: 858261 - RNA, 14 nt, Mycobacterium avium subsp. paratuberculosis
cgccggcgucggug

SEQ ID NO: 858262 - RNA, 20 nt, Mycobacterium avium subsp. paratuberculosis
cgccggcgucggugucccgc

SEQ ID NO: 858263 - RNA, 23 nt, Mycobacterium avium subsp. paratuberculosis
cgccggcgucugcauccggaacc

SEQ ID NO: 858264 - RNA, 17 nt, Mycobacterium avium subsp. paratuberculosis
cgccggcgugucggcgc

SEQ ID NO: 858265 - RNA, 21 nt, Mycobacterium avium subsp. paratuberculosis
cgccggcgugucggcgccacc

SEQ ID NO: 858266 - RNA, 12 nt, Mycobacterium avium subsp. paratuberculosis
cgccggcgucau

SEQ ID NO: 858267 - RNA, 17 nt, Mycobacterium avium subsp. paratuberculosis
cgccggcggugcggcgg

SEQ ID NO: 858268 - RNA, 15 nt, Mycobacterium avium subsp. paratuberculosis
cgccggcggugucga

SEQ ID NO: 858269 - RNA, 21 nt, Mycobacterium avium subsp. paratuberculosis
cgccggcguagaccagcgacg

SEQ ID NO: 858270 - RNA, 15 nt, Mycobacterium avium subsp. paratuberculosis
cgccggcggucgaca

SEQ ID NO: 858271 - RNA, 18 nt, Mycobacterium avium subsp. paratuberculosis
cgccggcggucgacacga

SEQ ID NO: 858272 - RNA, 19 nt, Mycobacterium avium subsp. paratuberculosis
cgccggcggguuggccguc

SEQ ID NO: 858273 - RNA, 21 nt, Mycobacterium avium subsp. paratuberculosis
cgccggcggguuggccgucga

SEQ ID NO: 858274 - RNA, 23 nt, Mycobacterium avium subsp. paratuberculosis
cgccggcggguuggccgucgaac

SEQ ID NO: 858275 - RNA, 13 nt, Mycobacterium avium subsp. paratuberculosis
cgccggcgguaug

SEQ ID NO: 858276 - RNA, 21 nt, Mycobacterium avium subsp. paratuberculosis
cgccggcgguaugcccgggcc

SEQ ID NO: 858277 - RNA, 22 nt, Mycobacterium avium subsp. paratuberculosis
cgccggcgguaugcccgggccg

SEQ ID NO: 858278 - RNA, 11 nt, Mycobacterium avium subsp. paratuberculosis
cgccggcgguc

SEQ ID NO: 858279 - RNA, 13 nt, Mycobacterium avium subsp. paratuberculosis
cgccggcggggcg

SEQ ID NO: 858280 - RNA, 21 nt, Mycobacterium avium subsp. paratuberculosis
cgccggcggggcgucgcccgc

SEQ ID NO: 858281 - RNA, 19 nt, Mycobacterium avium subsp. paratuberculosis
cgccggcggggguucgacg

SEQ ID NO: 858282 - RNA, 22 nt, Mycobacterium avium subsp. paratuberculosis
cgccggcggggguucgacguca

SEQ ID NO: 858283 - RNA, 19 nt, Mycobacterium avium subsp. paratuberculosis
cgccggcgggugagccggu

SEQ ID NO: 858284 - RNA, 22 nt, Mycobacterium avium subsp. paratuberculosis
cgccggcgggugagccggucga

SEQ ID NO: 858285 - RNA, 12 nt, Mycobacterium avium subsp. paratuberculosis
cgccggcggcgg

SEQ ID NO: 858286 - RNA, 13 nt, Mycobacterium avium subsp. paratuberculosis
cgccggcggcggc

SEQ ID NO: 858287 - RNA, 14 nt, Mycobacterium avium subsp. paratuberculosis
cgccggcggcggcg

SEQ ID NO: 858288 - RNA, 15 nt, Mycobacterium avium subsp. paratuberculosis
cgccggcggcgcccg

SEQ ID NO: 858289 - RNA, 15 nt, Mycobacterium avium subsp. paratuberculosis
cgccggcggcgauga

SEQ ID NO: 858290 - RNA, 19 nt, Mycobacterium avium subsp. paratuberculosis
cgccggcggcgaugaucgg

SEQ ID NO: 858291 - RNA, 20 nt, Mycobacterium avium subsp. paratuberculosis
cgccggcggcgaugaucggg

SEQ ID NO: 858292 - RNA, 13 nt, Mycobacterium avium subsp. paratuberculosis
cgccggcggcgau

SEQ ID NO: 858293 - RNA, 14 nt, Mycobacterium avium subsp. paratuberculosis
cgccggcggcgaug

SEQ ID NO: 858294 - RNA, 12 nt, Mycobacterium avium subsp. paratuberculosis
cgccggcggcga

SEQ ID NO: 858295 - RNA, 14 nt, Mycobacterium avium subsp. paratuberculosis
cgccggcggccacg

SEQ ID NO: 858296 - RNA, 16 nt, Mycobacterium avium subsp. paratuberculosis
cgccggcggccacgau

SEQ ID NO: 858297 - RNA, 19 nt, Mycobacterium avium subsp. paratuberculosis
cgccggcggccacgaucgc

SEQ ID NO: 858298 - RNA, 15 nt, Mycobacterium avium subsp. paratuberculosis
cgccggcggccacgc

SEQ ID NO: 858299 - RNA, 13 nt, Mycobacterium avium subsp. paratuberculosis
cgccggcggccaa

SEQ ID NO: 858300 - RNA, 21 nt, Mycobacterium avium subsp. paratuberculosis
cgccggcggccaaucccacca

SEQ ID NO: 858301 - RNA, 22 nt, Mycobacterium avium subsp. paratuberculosis
cgccggcggccaaucccaccau

SEQ ID NO: 858302 - RNA, 12 nt, Mycobacterium avium subsp. paratuberculosis
cgccggcggccg

SEQ ID NO: 858303 - RNA, 13 nt, Mycobacterium avium subsp. paratuberculosis
cgccggcggccga

SEQ ID NO: 858304 - RNA, 14 nt, Mycobacterium avium subsp. paratuberculosis
cgccggcggccgac

SEQ ID NO: 858305 - RNA, 14 nt, Mycobacterium avium subsp. paratuberculosis
cgccggcggccgcc

SEQ ID NO: 858306 - RNA, 15 nt, Mycobacterium avium subsp. paratuberculosis
cgccggcggccgcca

SEQ ID NO: 858307 - RNA, 18 nt, Mycobacterium avium subsp. paratuberculosis
cgccggcggccgccgccc

SEQ ID NO: 858308 - RNA, 15 nt, Mycobacterium avium subsp. paratuberculosis
cgccggcggccgcga

SEQ ID NO: 858309 - RNA, 14 nt, Mycobacterium avium subsp. paratuberculosis
cgccggcgccgggc

SEQ ID NO: 858310 - RNA, 12 nt, Mycobacterium avium subsp. paratuberculosis
cgccggcgccgg

SEQ ID NO: 858311 - RNA, 14 nt, Mycobacterium avium subsp. paratuberculosis
cgccggcgcccugc

SEQ ID NO: 858312 - RNA, 14 nt, Mycobacterium avium subsp. paratuberculosis
cgccggccggcgcg

SEQ ID NO: 858313 - RNA, 20 nt, Mycobacterium avium subsp. paratuberculosis
cgccggcgcaacucguccag

SEQ ID NO: 858314 - RNA, 17 nt, Mycobacterium avium subsp. paratuberculosis
cgccggcgcacaucgug

SEQ ID NO: 858315 - RNA, 21 nt, Mycobacterium avium subsp. paratuberculosis
cgccggcgcacaucguggcga

SEQ ID NO: 858316 - RNA, 15 nt, Mycobacterium avium subsp. paratuberculosis
cgccggcgcagcggc

SEQ ID NO: 858317 - RNA, 23 nt, Mycobacterium avium subsp. paratuberculosis
cgccggcgcaguccaggguggug

SEQ ID NO: 858318 - RNA, 18 nt, Mycobacterium avium subsp. paratuberculosis
cgccggcgcaucaucucg

SEQ ID NO: 858319 - RNA, 21 nt, Mycobacterium avium subsp. paratuberculosis
cgccggcgcaucaucucggcg

SEQ ID NO: 858320 - RNA, 23 nt, Mycobacterium avium subsp. paratuberculosis
cgccggccgcggugugcccggcg

SEQ ID NO: 858321 - RNA, 14 nt, Mycobacterium avium subsp. paratuberculosis
cgccggccgcucgc

SEQ ID NO: 858322 - RNA, 11 nt, Mycobacterium avium subsp. paratuberculosis
cgccggccgcg

SEQ ID NO: 858323 - RNA, 15 nt, Mycobacterium avium subsp. paratuberculosis
cgccggccgcgcaga

SEQ ID NO: 858324 - RNA, 22 nt, Mycobacterium avium subsp. paratuberculosis
cgccggccggcgcgugcgcgac

SEQ ID NO: 858325 - RNA, 15 nt, Mycobacterium avium subsp. paratuberculosis
cgccggccggcgguc

SEQ ID NO: 858326 - RNA, 16 nt, Mycobacterium avium subsp. paratuberculosis
cgccggccggcgguca

SEQ ID NO: 858327 - RNA, 14 nt, Mycobacterium avium subsp. paratuberculosis
cgccggccggcgug

SEQ ID NO: 858328 - RNA, 15 nt, Mycobacterium avium subsp. paratuberculosis
cgccggccgcgcgug

SEQ ID NO: 858329 - RNA, 13 nt, Mycobacterium avium subsp. paratuberculosis
cgccggccgcggc

SEQ ID NO: 858330 - RNA, 14 nt, Mycobacterium avium subsp. paratuberculosis
cgccggccgcggcg

SEQ ID NO: 858331 - RNA, 15 nt, Mycobacterium avium subsp. paratuberculosis
cgccggccgcggcgu

SEQ ID NO: 858332 - RNA, 16 nt, Mycobacterium avium subsp. paratuberculosis
cgccggccgcggcgug

SEQ ID NO: 858333 - RNA, 18 nt, Mycobacterium avium subsp. paratuberculosis
cgccggccgcggcgugca

SEQ ID NO: 858334 - RNA, 16 nt, Mycobacterium avium subsp. paratuberculosis
cgccggccgcgggcga

SEQ ID NO: 858335 - RNA, 17 nt, Mycobacterium avium subsp. paratuberculosis
cgccggccgccagcgcc

SEQ ID NO: 858336 - RNA, 19 nt, Mycobacterium avium subsp. paratuberculosis
cgccggccgccagcgcccg

SEQ ID NO: 858337 - RNA, 20 nt, Mycobacterium avium subsp. paratuberculosis
cgccggccgccagcgcccgc

SEQ ID NO: 858338 - RNA, 15 nt, Mycobacterium avium subsp. paratuberculosis
cgccggccgccgcga

SEQ ID NO: 858339 - RNA, 13 nt, Mycobacterium avium subsp. paratuberculosis
cgccggccgccgg

SEQ ID NO: 858340 - RNA, 16 nt, Mycobacterium avium subsp. paratuberculosis
cgccggccgccggauc

SEQ ID NO: 858341 - RNA, 17 nt, Mycobacterium avium subsp. paratuberculosis
cgccggccgccggaucg

SEQ ID NO: 858342 - RNA, 13 nt, Mycobacterium avium subsp. paratuberculosis
cgccggccgccgu

SEQ ID NO: 858343 - RNA, 14 nt, Mycobacterium avium subsp. paratuberculosis
cgccggccgccgug

SEQ ID NO: 858344 - RNA, 16 nt, Mycobacterium avium subsp. paratuberculosis
cgccggccgccguggc

SEQ ID NO: 858345 - RNA, 15 nt, Mycobacterium avium subsp. paratuberculosis
cgccggccgccagcg

SEQ ID NO: 858346 - RNA, 15 nt, Mycobacterium avium subsp. paratuberculosis
cgccggcccggucga

SEQ ID NO: 858347 - RNA, 16 nt, Mycobacterium avium subsp. paratuberculosis
cgccggcccggucgac

SEQ ID NO: 858348 - RNA, 17 nt, Mycobacterium avium subsp. paratuberculosis
cgccggcccggucgacu

SEQ ID NO: 858349 - RNA, 13 nt, Mycobacterium avium subsp. paratuberculosis
cgccgauggugcc

SEQ ID NO: 858350 - RNA, 17 nt, Mycobacterium avium subsp. paratuberculosis
cgccgauguacuccugg

SEQ ID NO: 858351 - RNA, 19 nt, Mycobacterium avium subsp. paratuberculosis
cgccgauguacugggccgu

SEQ ID NO: 858352 - RNA, 21 nt, Mycobacterium avium subsp. paratuberculosis
cgccgauguacugggccgucg

SEQ ID NO: 858353 - RNA, 21 nt, Mycobacterium avium subsp. paratuberculosis
cgccgauggcguucaucgucc

SEQ ID NO: 858354 - RNA, 16 nt, Mycobacterium avium subsp. paratuberculosis
cgccgaugccgcgcug

SEQ ID NO: 858355 - RNA, 19 nt, Mycobacterium avium subsp. paratuberculosis
cgccgaugccgcgcugcgc

SEQ ID NO: 858356 - RNA, 14 nt, Mycobacterium avium subsp. paratuberculosis
cgccgaugcgcccg

SEQ ID NO: 858357 - RNA, 14 nt, Mycobacterium avium subsp. paratuberculosis
cgccgauggacacg

SEQ ID NO: 858358 - RNA, 13 nt, Mycobacterium avium subsp. paratuberculosis
cgccgauggccug

SEQ ID NO: 858359 - RNA, 12 nt, Mycobacterium avium subsp. paratuberculosis
cgccgauggcga

SEQ ID NO: 858360 - RNA, 13 nt, Mycobacterium avium subsp. paratuberculosis
cgccgauggcgac

SEQ ID NO: 858361 - RNA, 14 nt, Mycobacterium avium subsp. paratuberculosis
cgccgauggcgacg

SEQ ID NO: 858362 - RNA, 16 nt, Mycobacterium avium subsp. paratuberculosis
cgccgauggcgacggu

SEQ ID NO: 858363 - RNA, 18 nt, Mycobacterium avium subsp. paratuberculosis
cgccgauggcgacggucu

SEQ ID NO: 858364 - RNA, 14 nt, Mycobacterium avium subsp. paratuberculosis
cgccgccgccgagc

SEQ ID NO: 858365 - RNA, 14 nt, Mycobacterium avium subsp. paratuberculosis
cgccgccgccgauc

SEQ ID NO: 858366 - RNA, 16 nt, Mycobacterium avium subsp. paratuberculosis
cgccgccgcgaacuca

SEQ ID NO: 858367 - RNA, 16 nt, Mycobacterium avium subsp. paratuberculosis
cgccgccgcgaccaca

SEQ ID NO: 858368 - RNA, 15 nt, Mycobacterium avium subsp. paratuberculosis
cgccgccgcccuggc

SEQ ID NO: 858369 - RNA, 12 nt, Mycobacterium avium subsp. paratuberculosis
cgccgccgccga

SEQ ID NO: 858370 - RNA, 15 nt, Mycobacterium avium subsp. paratuberculosis
cgccgaugcgccgca

SEQ ID NO: 858371 - RNA, 14 nt, Mycobacterium avium subsp. paratuberculosis
cgccgccgcccugg

SEQ ID NO: 858372 - RNA, 18 nt, Mycobacterium avium subsp. paratuberculosis
cgccgauguccccgcggg

SEQ ID NO: 858373 - RNA, 19 nt, Mycobacterium avium subsp. paratuberculosis
cgccgauguccccgcgggu

SEQ ID NO: 858374 - RNA, 20 nt, Mycobacterium avium subsp. paratuberculosis
cgccgauguccccgcgggug

SEQ ID NO: 858375 - RNA, 20 nt, Mycobacterium avium subsp. paratuberculosis
cgccgauggugacggugccg

SEQ ID NO: 858376 - RNA, 22 nt, Mycobacterium avium subsp. paratuberculosis
cgccgauggugacggugccgcc

SEQ ID NO: 858377 - RNA, 19 nt, Mycobacterium avium subsp. paratuberculosis
cgccgaugugaucggcggc

SEQ ID NO: 858378 - RNA, 21 nt, Mycobacterium avium subsp. paratuberculosis
cgccgaugugaucggcggcca

SEQ ID NO: 858379 - RNA, 15 nt, Mycobacterium avium subsp. paratuberculosis
cgccgauguggccgg

SEQ ID NO: 858380 - RNA, 16 nt, Mycobacterium avium subsp. paratuberculosis
cgccgauguggccggc

SEQ ID NO: 858381 - RNA, 20 nt, Mycobacterium avium subsp. paratuberculosis
cgccgauguggccggcgaug

SEQ ID NO: 858382 - RNA, 23 nt, Mycobacterium avium subsp. paratuberculosis
cgccgauguggccggcgauggcg

SEQ ID NO: 858383 - RNA, 19 nt, Mycobacterium avium subsp. paratuberculosis
cgccgauguggcgggcguc

SEQ ID NO: 858384 - RNA, 20 nt, Mycobacterium avium subsp. paratuberculosis
cgccgauguggcgggcgucc

SEQ ID NO: 858385 - RNA, 12 nt, Mycobacterium avium subsp. paratuberculosis
cgccgccggucg

SEQ ID NO: 858386 - RNA, 12 nt, Mycobacterium avium subsp. paratuberculosis
cgccgccgguga

SEQ ID NO: 858387 - RNA, 12 nt, Mycobacterium avium subsp. paratuberculosis
cgccgccggugc

SEQ ID NO: 858388 - RNA, 15 nt, Mycobacterium avium subsp. paratuberculosis
cgccgccgccgccca

SEQ ID NO: 858389 - RNA, 15 nt, Mycobacterium avium subsp. paratuberculosis
cgccgccggggcguc

SEQ ID NO: 858390 - RNA, 13 nt, Mycobacterium avium subsp. paratuberculosis
cgccgccggggcg

SEQ ID NO: 858391 - RNA, 15 nt, Mycobacterium avium subsp. paratuberculosis
cgccgccggggcgca

SEQ ID NO: 858392 - RNA, 17 nt, Mycobacterium avium subsp. paratuberculosis
cgccgccggggcgcaga

SEQ ID NO: 858393 - RNA, 23 nt, Mycobacterium avium subsp. paratuberculosis
cgccgccggggcgggcagcacca

SEQ ID NO: 858394 - RNA, 17 nt, Mycobacterium avium subsp. paratuberculosis
cgccgccgggcgccacc

SEQ ID NO: 858395 - RNA, 14 nt, Mycobacterium avium subsp. paratuberculosis
cgccgccgcugucg

SEQ ID NO: 858396 - RNA, 22 nt, Mycobacterium avium subsp. paratuberculosis
cgccgccgggauaacccagcac

SEQ ID NO: 858397 - RNA, 12 nt, Mycobacterium avium subsp. paratuberculosis
cgccgccgcggc

SEQ ID NO: 858398 - RNA, 13 nt, Mycobacterium avium subsp. paratuberculosis
cgccgccgcggcc

SEQ ID NO: 858399 - RNA, 14 nt, Mycobacterium avium subsp. paratuberculosis
cgccgccgcggccg

SEQ ID NO: 858400 - RNA, 19 nt, Mycobacterium avium subsp. paratuberculosis
cgccgccgcggccgcggcg

SEQ ID NO: 858401 - RNA, 15 nt, Mycobacterium avium subsp. paratuberculosis
cgccgccgcgcaccg

SEQ ID NO: 858402 - RNA, 14 nt, Mycobacterium avium subsp. paratuberculosis
cgccgccgcgcacc

SEQ ID NO: 858403 - RNA, 12 nt, Mycobacterium avium subsp. paratuberculosis
cgccgcgcaccc

SEQ ID NO: 858404 - RNA, 14 nt, Mycobacterium avium subsp. paratuberculosis
cgccgcgcaccccg

SEQ ID NO: 858405 - RNA, 15 nt, Mycobacterium avium subsp. paratuberculosis
cgccgcgcaccccga

SEQ ID NO: 858406 - RNA, 13 nt, Mycobacterium avium subsp. paratuberculosis
cgccgcgcacccg

SEQ ID NO: 858407 - RNA, 19 nt, Mycobacterium avium subsp. paratuberculosis
cgccgcgcacccggccacg

SEQ ID NO: 858408 - RNA, 23 nt, Mycobacterium avium subsp. paratuberculosis
cgccgcgcacccggccacgccgg

SEQ ID NO: 858409 - RNA, 15 nt, Mycobacterium avium subsp. paratuberculosis
cgccgcgcacgacgu

SEQ ID NO: 858410 - RNA, 15 nt, Mycobacterium avium subsp. paratuberculosis
cgccgcgcagcaccg

SEQ ID NO: 858411 - RNA, 23 nt, Mycobacterium avium subsp. paratuberculosis
cgccgcgcagccagaccucgccg

SEQ ID NO: 858412 - RNA, 13 nt, Mycobacterium avium subsp. paratuberculosis
cgccgcgcccggc

SEQ ID NO: 858413 - RNA, 14 nt, Mycobacterium avium subsp. paratuberculosis
cgccgcgcccgccg

SEQ ID NO: 858414 - RNA, 15 nt, Mycobacterium avium subsp. paratuberculosis
cgccgcgcccgccgg

SEQ ID NO: 858415 - RNA, 16 nt, Mycobacterium avium subsp. paratuberculosis
cgccgcgcccgccggc

SEQ ID NO: 858416 - RNA, 17 nt, Mycobacterium avium subsp. paratuberculosis
cgccgcgcccgccggcc

SEQ ID NO: 858417 - RNA, 14 nt, Mycobacterium avium subsp. paratuberculosis
cgccgcgcccagca

SEQ ID NO: 858418 - RNA, 16 nt, Mycobacterium avium subsp. paratuberculosis
cgccgcgcccagcacg

SEQ ID NO: 858419 - RNA, 13 nt, Mycobacterium avium subsp. paratuberculosis
cgccgcgccaccg

SEQ ID NO: 858420 - RNA, 14 nt, Mycobacterium avium subsp. paratuberculosis
cgccgcgccagccg

SEQ ID NO: 858421 - RNA, 22 nt, Mycobacterium avium subsp. paratuberculosis
cgccgcgccagccgccgccgac

SEQ ID NO: 858422 - RNA, 23 nt, Mycobacterium avium subsp. paratuberculosis
cgccgcgccagccgccgccgacc

SEQ ID NO: 858423 - RNA, 19 nt, Mycobacterium avium subsp. paratuberculosis
cgccgcgcagcggggcgcg

SEQ ID NO: 858424 - RNA, 23 nt, Mycobacterium avium subsp. paratuberculosis
cgccgcgcaggccgccgacgacg

SEQ ID NO: 858425 - RNA, 15 nt, Mycobacterium avium subsp. paratuberculosis
cgccgcgccaccgag

SEQ ID NO: 858426 - RNA, 15 nt, Mycobacterium avium subsp. paratuberculosis
cgccgcgccagcacc

SEQ ID NO: 858427 - RNA, 16 nt, Mycobacterium avium subsp. paratuberculosis
cgccgcgccagcaccu

SEQ ID NO: 858428 - RNA, 19 nt, Mycobacterium avium subsp. paratuberculosis
cgccgcgccagcaccucgg

SEQ ID NO: 858429 - RNA, 21 nt, Mycobacterium avium subsp. paratuberculosis
cgccgcgccagcaccucggcg

SEQ ID NO: 858430 - RNA, 23 nt, Mycobacterium avium subsp. paratuberculosis
cgccgcgccagcaccucggcgac

SEQ ID NO: 858431 - RNA, 23 nt, Mycobacterium avium subsp. paratuberculosis
cgccgcgaugaucacacccacga

SEQ ID NO: 858432 - RNA, 14 nt, Mycobacterium avium subsp. paratuberculosis
cgccgccuccgggc

SEQ ID NO: 858433 - RNA, 18 nt, Mycobacterium avium subsp. paratuberculosis
cgccgccuccgggcugcc

SEQ ID NO: 858434 - RNA, 16 nt, Mycobacterium avium subsp. paratuberculosis
cgccgccuccgacagc

SEQ ID NO: 858435 - RNA, 23 nt, Mycobacterium avium subsp. paratuberculosis
cgccgccuccgacagccgcaccg

SEQ ID NO: 858436 - RNA, 15 nt, Mycobacterium avium subsp. paratuberculosis
cgccgccucaccgaa

SEQ ID NO: 858437 - RNA, 22 nt, Mycobacterium avium subsp. paratuberculosis
cgccgccguguaggccgcgcug

SEQ ID NO: 858438 - RNA, 18 nt, Mycobacterium avium subsp. paratuberculosis
cgccgccguucgccggcg

SEQ ID NO: 858439 - RNA, 15 nt, Mycobacterium avium subsp. paratuberculosis
cgccgccguccagcg

SEQ ID NO: 858440 - RNA, 12 nt, Mycobacterium avium subsp. paratuberculosis
cgccgccguccc

SEQ ID NO: 858441 - RNA, 21 nt, Mycobacterium avium subsp. paratuberculosis
cgccgccgucccaccggcgau

SEQ ID NO: 858442 - RNA, 13 nt, Mycobacterium avium subsp. paratuberculosis
cgccgccgucggu

SEQ ID NO: 858443 - RNA, 16 nt, Mycobacterium avium subsp. paratuberculosis
cgccgccgucggugua

SEQ ID NO: 858444 - RNA, 13 nt, Mycobacterium avium subsp. paratuberculosis
cgccgcgcggccc

SEQ ID NO: 858445 - RNA, 21 nt, Mycobacterium avium subsp. paratuberculosis
cgccgcgcggcccgcgacguc

SEQ ID NO: 858446 - RNA, 15 nt, Mycobacterium avium subsp. paratuberculosis
cgccgcgcgcgucga

SEQ ID NO: 858447 - RNA, 16 nt, Mycobacterium avium subsp. paratuberculosis
cgccgcgcgcgucgac

SEQ ID NO: 858448 - RNA, 20 nt, Mycobacterium avium subsp. paratuberculosis
cgccgcgcggguacggcggc

SEQ ID NO: 858449 - RNA, 21 nt, Mycobacterium avium subsp. paratuberculosis
cgccgcgcggguacggcggcc

SEQ ID NO: 858450 - RNA, 16 nt, Mycobacterium avium subsp. paratuberculosis
cgccgcgccgaccucg

SEQ ID NO: 858451 - RNA, 13 nt, Mycobacterium avium subsp. paratuberculosis
cgccgcgccgagg

SEQ ID NO: 858452 - RNA, 16 nt, Mycobacterium avium subsp. paratuberculosis
cgccgcgcccggcuuc

SEQ ID NO: 858453 - RNA, 17 nt, Mycobacterium avium subsp. paratuberculosis
cgccgcgcccggcuucg

SEQ ID NO: 858454 - RNA, 12 nt, Mycobacterium avium subsp. paratuberculosis
cgccgcgcccgu

SEQ ID NO: 858455 - RNA, 14 nt, Mycobacterium avium subsp. paratuberculosis
cgccgcgcccgucg

SEQ ID NO: 858456 - RNA, 16 nt, Mycobacterium avium subsp. paratuberculosis
cgccgcgcccgucgag

SEQ ID NO: 858457 - RNA, 22 nt, Mycobacterium avium subsp. paratuberculosis
cgccgcgcccgucgagcgucac

SEQ ID NO: 858458 - RNA, 22 nt, Mycobacterium avium subsp. paratuberculosis
cgccgcgcccgucgagcgucau

SEQ ID NO: 858459 - RNA, 19 nt, Mycobacterium avium subsp. paratuberculosis
cgccgcgcucggccauccg

SEQ ID NO: 858460 - RNA, 20 nt, Mycobacterium avium subsp. paratuberculosis
cgccgcgcucggccauccgg

SEQ ID NO: 858461 - RNA, 20 nt, Mycobacterium avium subsp. paratuberculosis
cgccgcgcucgugcugcugc

SEQ ID NO: 858462 - RNA, 12 nt, Mycobacterium avium subsp. paratuberculosis
cgccgcgcucgc

SEQ ID NO: 858463 - RNA, 16 nt, Mycobacterium avium subsp. paratuberculosis
cgccgcgcucgcacca

SEQ ID NO: 858464 - RNA, 19 nt, Mycobacterium avium subsp. paratuberculosis
cgccgcgcucgcaccagcg

SEQ ID NO: 858465 - RNA, 14 nt, Mycobacterium avium subsp. paratuberculosis
cgccgcggccaccg

SEQ ID NO: 858466 - RNA, 15 nt, Mycobacterium avium subsp. paratuberculosis
cgccgcggccaccgg

SEQ ID NO: 858467 - RNA, 19 nt, Mycobacterium avium subsp. paratuberculosis
cgccgcggccaccgggucg

SEQ ID NO: 858468 - RNA, 20 nt, Mycobacterium avium subsp. paratuberculosis
cgccgcggccaccgggucgu

SEQ ID NO: 858469 - RNA, 19 nt, Mycobacterium avium subsp. paratuberculosis
cgccgcggccacgcucggg

SEQ ID NO: 858470 - RNA, 19 nt, Mycobacterium avium subsp. paratuberculosis
cgccgcgcucaacccgggc

SEQ ID NO: 858471 - RNA, 22 nt, Mycobacterium avium subsp. paratuberculosis
cgccgcgcucaacccgggccgg

SEQ ID NO: 858472 - RNA, 12 nt, Mycobacterium avium subsp. paratuberculosis
cgccgcgccgcc

SEQ ID NO: 858473 - RNA, 17 nt, Mycobacterium avium subsp. paratuberculosis
cgccgcgcguuccagca

SEQ ID NO: 858474 - RNA, 19 nt, Mycobacterium avium subsp. paratuberculosis
cgccgcgcguuccagcacg

SEQ ID NO: 858475 - RNA, 14 nt, Mycobacterium avium subsp. paratuberculosis
cgccgcggcgacca

SEQ ID NO: 858476 - RNA, 15 nt, Mycobacterium avium subsp. paratuberculosis
cgccgcggcgaccac

SEQ ID NO: 858477 - RNA, 15 nt, Mycobacterium avium subsp. paratuberculosis
cgccgcggcggcacc

SEQ ID NO: 858478 - RNA, 16 nt, Mycobacterium avium subsp. paratuberculosis
cgccgcggcggcaccc

SEQ ID NO: 858479 - RNA, 17 nt, Mycobacterium avium subsp. paratuberculosis
cgccgcggcggcaccca

SEQ ID NO: 858480 - RNA, 23 nt, Mycobacterium avium subsp. paratuberculosis
cgccgcggcgcuugaccucgccg

SEQ ID NO: 858481 - RNA, 12 nt, Mycobacterium avium subsp. paratuberculosis
cgccgcggcggc

SEQ ID NO: 858482 - RNA, 16 nt, Mycobacterium avium subsp. paratuberculosis
cgccgcggcgcccggc

SEQ ID NO: 858483 - RNA, 16 nt, Mycobacterium avium subsp. paratuberculosis
cgccgcggcgcccucg

SEQ ID NO: 858484 - RNA, 19 nt, Mycobacterium avium subsp. paratuberculosis
cgccgcggcgcccucgccg

SEQ ID NO: 858485 - RNA, 15 nt, Mycobacterium avium subsp. paratuberculosis
cgccgcggcgccgcc

SEQ ID NO: 858486 - RNA, 16 nt, Mycobacterium avium subsp. paratuberculosis
cgccgcggcgccgcca

SEQ ID NO: 858487 - RNA, 13 nt, Mycobacterium avium subsp. paratuberculosis
cgccgcggcgccc

SEQ ID NO: 858488 - RNA, 14 nt, Mycobacterium avium subsp. paratuberculosis
cgccgcggcgagcc

SEQ ID NO: 858489 - RNA, 15 nt, Mycobacterium avium subsp. paratuberculosis
cgccgcggcgagccg

SEQ ID NO: 858490 - RNA, 19 nt, Mycobacterium avium subsp. paratuberculosis
cgccgcggcgagccggccg

SEQ ID NO: 858491 - RNA, 20 nt, Mycobacterium avium subsp. paratuberculosis
cgccgcggcgagccggccgu

SEQ ID NO: 858492 - RNA, 13 nt, Mycobacterium avium subsp. paratuberculosis
cgccgcggcgacc

SEQ ID NO: 858493 - RNA, 14 nt, Mycobacterium avium subsp. paratuberculosis
cgccgcggcgaccg

SEQ ID NO: 858494 - RNA, 19 nt, Mycobacterium avium subsp. paratuberculosis
cgccgcggcgaccggggcg

SEQ ID NO: 858495 - RNA, 12 nt, Mycobacterium avium subsp. paratuberculosis
cgccgcggcgag

SEQ ID NO: 858496 - RNA, 15 nt, Mycobacterium avium subsp. paratuberculosis
cgccgcggccguugc

SEQ ID NO: 858497 - RNA, 13 nt, Mycobacterium avium subsp. paratuberculosis
cgccgcggccgcg

SEQ ID NO: 858498 - RNA, 14 nt, Mycobacterium avium subsp. paratuberculosis
cgccgcggccgcga

SEQ ID NO: 858499 - RNA, 15 nt, Mycobacterium avium subsp. paratuberculosis
cgccgcggccgcggc

SEQ ID NO: 858500 - RNA, 16 nt, Mycobacterium avium subsp. paratuberculosis
cgccgcggccgcuggc

SEQ ID NO: 858501 - RNA, 17 nt, Mycobacterium avium subsp. paratuberculosis
cgccgcggccgcuggcg

SEQ ID NO: 858502 - RNA, 16 nt, Mycobacterium avium subsp. paratuberculosis
cgccgcggccaggucg

SEQ ID NO: 858503 - RNA, 17 nt, Mycobacterium avium subsp. paratuberculosis
cgccgcggccaggucga

SEQ ID NO: 858504 - RNA, 20 nt, Mycobacterium avium subsp. paratuberculosis
cgccgcggcccugcagcgcc

SEQ ID NO: 858505 - RNA, 14 nt, Mycobacterium avium subsp. paratuberculosis
cgccgcggccgaac

SEQ ID NO: 858506 - RNA, 21 nt, Mycobacterium avium subsp. paratuberculosis
cgccgcggccgaaccgcugca

SEQ ID NO: 858507 - RNA, 15 nt, Mycobacterium avium subsp. paratuberculosis
cgccgcggccagccg

SEQ ID NO: 858508 - RNA, 16 nt, Mycobacterium avium subsp. paratuberculosis
cgccgcggccagccgg

SEQ ID NO: 858509 - RNA, 17 nt, Mycobacterium avium subsp. paratuberculosis
cgccgcggccagccggu

SEQ ID NO: 858510 - RNA, 19 nt, Mycobacterium avium subsp. paratuberculosis
cgccgcggccagccggucg

SEQ ID NO: 858511 - RNA, 22 nt, Mycobacterium avium subsp. paratuberculosis
cgccgcggccagccggucgucg
